United States Patent 11,640,849 (METHODS FOR HISTOLOGICAL DIAGNOSIS AND TREATMENT OF DISEASES) - sequence listing, part 71

SEQ ID NO: 2707131 - protein, 26 aa, Entamoeba histolytica
YEIFEPYHAFFIPPNYPHGYIEGECV

SEQ ID NO: 2707132 - protein, 18 aa, Entamoeba histolytica
YEKALYNAFLKTDQEVLK

SEQ ID NO: 2707133 - protein, 26 aa, Entamoeba histolytica
YGCTVSLFTHWLPRFGIEVDLIDTSD

SEQ ID NO: 2707134 - protein, 17 aa, Entamoeba histolytica
YHQQLPSAFTPVTDFSL

SEQ ID NO: 2707135 - protein, 23 aa, Entamoeba histolytica
YKAIFSAGFYLDKQMPLCNSYDS

SEQ ID NO: 2707136 - protein, 24 aa, Entamoeba histolytica
YKNEEFILHLWDTAGQEEYDRLRP

SEQ ID NO: 2707137 - protein, 24 aa, Entamoeba histolytica
YKPSLIMSKFFPALQGSMGKMSAS

SEQ ID NO: 2707138 - protein, 22 aa, Entamoeba histolytica
YLAIDIGCYCVFATHFHEITGL

SEQ ID NO: 2707139 - protein, 20 aa, Entamoeba histolytica
YMAPELYRRLPYGNKIDCWS

SEQ ID NO: 2707140 - protein, 26 aa, Entamoeba histolytica
YNGQKPRKLAMWPKYNFYKADQRYME

SEQ ID NO: 2707141 - protein, 36 aa, Entamoeba histolytica
YNINIYYEFCESFDYLPLGVIIKRKIGKFFCCHGGI

SEQ ID NO: 2707142 - protein, 17 aa, Entamoeba histolytica
YPYFAQLCESYNQCLHP

SEQ ID NO: 2707143 - protein, 21 aa, Entamoeba histolytica
YQAIRMWTCNIFPTLVSSEVK

SEQ ID NO: 2707144 - protein, 22 aa, Entamoeba histolytica
YQAIRMWTCNIFPTLVSSEVKE

SEQ ID NO: 2707145 - protein, 17 aa, Entamoeba histolytica
YQITEWMLRLFKESRGI

SEQ ID NO: 2707146 - protein, 20 aa, Entamoeba histolytica
YQNLCASTLYYWIRAEERES

SEQ ID NO: 2707147 - protein, 20 aa, Entamoeba histolytica
YRMGNLFIVGPTKTGKTEFA

SEQ ID NO: 2707148 - protein, 26 aa, Entamoeba histolytica
YSYEHNSVFWTIKFYHTDTKTSRKTL

SEQ ID NO: 2707149 - protein, 27 aa, Entamoeba histolytica
YTKKTKLNTVIWPSPKLSSGVVEPYNA

SEQ ID NO: 2707150 - protein, 23 aa, Entamoeba histolytica
YTTSLFDLLFNNTNYKSFCNCFK

SEQ ID NO: 2707151 - protein, 23 aa, Entamoeba histolytica
YVRLDLKSFTFINKKSLMQFLRK

SEQ ID NO: 2707152 - protein, 18 aa, Entamoeba histolytica
YVSRAFCIKTKGSFVLPG

SEQ ID NO: 2707153 - protein, 21 aa, Entamoeba histolytica
YYAAYYFVTLIQTIGGNQWNL

SEQ ID NO: 2707154 - protein, 25 aa, Entamoeba histolytica
YYYSNGYMIFTSREYVRTVGVYVLN

SEQ ID NO: 2707155 - protein, 26 aa, Entamoeba histolytica
AAADILSFILIFLNYITKFSNKNKMN

SEQ ID NO: 2707156 - protein, 24 aa, Entamoeba histolytica
AAEKGLPLYKYLAELTGHKEMTMP

SEQ ID NO: 2707157 - protein, 18 aa, Entamoeba histolytica
AAELFVGIPIFPGNSEYN

SEQ ID NO: 2707158 - protein, 29 aa, Entamoeba histolytica
AAEQLPIPLRHARLFTYQLCRGLSYIHSK

SEQ ID NO: 2707159 - protein, 19 aa, Entamoeba histolytica
AAFQFNFFCEEKSICILYD

SEQ ID NO: 2707160 - protein, 20 aa, Entamoeba histolytica
AAFWGCCSIRRVLFPSSVTS

SEQ ID NO: 2707161 - protein, 28 aa, Entamoeba histolytica
AAGQIGYNLLFLIAHGLMFGPNQTVYLH

SEQ ID NO: 2707162 - protein, 29 aa, Entamoeba histolytica
AAGQIGYNLLFLIAHGLMFGPNQTVYLHL

SEQ ID NO: 2707163 - protein, 20 aa, Entamoeba histolytica
AAGYDLYDYLCSHYTYCKTG

SEQ ID NO: 2707164 - protein, 17 aa, Entamoeba histolytica
AAHLIRSLITPENYVIV

SEQ ID NO: 2707165 - protein, 26 aa, Entamoeba histolytica
AAIDTLIHDTIFFYGEREYSKSRCRL

SEQ ID NO: 2707166 - protein, 35 aa, Entamoeba histolytica
AAIGNEIRFILRILKGVFRIGFTDRSLPPAIAQAV

SEQ ID NO: 2707167 - protein, 26 aa, Entamoeba histolytica
AAINFTLYHNLSSFFKELFGFAKQIN

SEQ ID NO: 2707168 - protein, 19 aa, Entamoeba histolytica
AAIQLLNGLNERALLQKDE

SEQ ID NO: 2707169 - protein, 17 aa, Entamoeba histolytica
AAIRGLLRLGNSKQIHT

SEQ ID NO: 2707170 - protein, 26 aa, Entamoeba histolytica
AAISEFYVFFIDYIIVHAEQIIKFWR

SEQ ID NO: 2707171 - protein, 33 aa, Entamoeba histolytica
AAKGTVLILGKEKHFLLKKLTFNLIKDISEHNI

SEQ ID NO: 2707172 - protein, 29 aa, Entamoeba histolytica
AAKKALTGRYYAKKILTPNFCRVTEFKEA

SEQ ID NO: 2707173 - protein, 23 aa, Entamoeba histolytica
AAKKLMEHLKVCTLAVSLGCVDT

SEQ ID NO: 2707174 - protein, 23 aa, Entamoeba histolytica
AAKSLIYYLRSEEDIKIFITQFV

SEQ ID NO: 2707175 - protein, 25 aa, Entamoeba histolytica
AALAKEWHMLFYEVSAKTNQNITEM

SEQ ID NO: 2707176 - protein, 43 aa, Entamoeba histolytica
AALCFMICHYFTTFDPPLFPSDFRYYLVPPCELRILGTKLSAQ

SEQ ID NO: 2707177 - protein, 21 aa, Entamoeba histolytica
AALCIFAEMTFVPGEMLQAED

SEQ ID NO: 2707178 - protein, 18 aa, Entamoeba histolytica
AALDFRNVSIIAHYIKER

SEQ ID NO: 2707179 - protein, 32 aa, Entamoeba histolytica
AALIIRYSIQFNLLLSYLKPFVDDRAVVNISL

SEQ ID NO: 2707180 - protein, 18 aa, Entamoeba histolytica
AALQRTIFPFYNKTTKPK

SEQ ID NO: 2707181 - protein, 22 aa, Entamoeba histolytica
AAMCALLFSGVDMKGIVVGMCV

SEQ ID NO: 2707182 - protein, 17 aa, Entamoeba histolytica
AAMIWIIGEYNQLITNS

SEQ ID NO: 2707183 - protein, 26 aa, Entamoeba histolytica
AANALMSLLQFPFTKYNVLKVIQLRV

SEQ ID NO: 2707184 - protein, 19 aa, Entamoeba histolytica
AAPGMMPMQQPMGGMGMMN

SEQ ID NO: 2707185 - protein, 23 aa, Entamoeba histolytica
AAPICTLALRSLRYLSSLELSAP

SEQ ID NO: 2707186 - protein, 17 aa, Entamoeba histolytica
AAPSLPGRPLGAPPRKP

SEQ ID NO: 2707187 - protein, 25 aa, Entamoeba histolytica
AAPTPKKFLILAGIEDVFTQTTGHT

SEQ ID NO: 2707188 - protein, 25 aa, Entamoeba histolytica
AAQAWNHAFYWKCMCGCGVKPSEQL

SEQ ID NO: 2707189 - protein, 17 aa, Entamoeba histolytica
AAQSMKCSCPLPHTPNF

SEQ ID NO: 2707190 - protein, 26 aa, Entamoeba histolytica
AARNIIEKYYPLLTLDFHTNKHVVDE

SEQ ID NO: 2707191 - protein, 25 aa, Entamoeba histolytica
AARTAMGIVLRMVQSRQISGRAILL

SEQ ID NO: 2707192 - protein, 20 aa, Entamoeba histolytica
AASKRIKGYAYYTALEYSNT

SEQ ID NO: 2707193 - protein, 23 aa, Entamoeba histolytica
AASKRIKGYAYYTALEYSNTISK

SEQ ID NO: 2707194 - protein, 18 aa, Entamoeba histolytica
AASQKLAFAPQPPAIICR

SEQ ID NO: 2707195 - protein, 33 aa, Entamoeba histolytica
AAVIKDYLRLLPNPLIPYNLYEEFIELRNNHRG

SEQ ID NO: 2707196 - protein, 17 aa, Entamoeba histolytica
AAYFNKKHATEEKKEKK

SEQ ID NO: 2707197 - protein, 21 aa, Entamoeba histolytica
AAYLKMLFREALHKGFYELTL

SEQ ID NO: 2707198 - protein, 17 aa, Entamoeba histolytica
ACDTILKLFVNFAPRTT

SEQ ID NO: 2707199 - protein, 21 aa, Entamoeba histolytica
ACGVFSCAYLKLSEKQEICGK

SEQ ID NO: 2707200 - protein, 19 aa, Entamoeba histolytica
ACHFPNYVKKYKLLDAAKP

SEQ ID NO: 2707201 - protein, 37 aa, Entamoeba histolytica
ACHHQSYYLERIFSLYLPMLFGYQIYIPSKSVYQQTL

SEQ ID NO: 2707202 - protein, 19 aa, Entamoeba histolytica
ACKWLNSFKELLTQFFNIP

SEQ ID NO: 2707203 - protein, 23 aa, Entamoeba histolytica
ACLHWLKIFKNYTSPKGILAYQF

SEQ ID NO: 2707204 - protein, 17 aa, Entamoeba histolytica
ACLWTDSIYFLQAKKEI

SEQ ID NO: 2707205 - protein, 28 aa, Entamoeba histolytica
ACQQAVFIGLLNMFGYEIGIERVYKISK

SEQ ID NO: 2707206 - protein, 17 aa, Entamoeba histolytica
ACRCIVNLTYYNEPARN

SEQ ID NO: 2707207 - protein, 20 aa, Entamoeba histolytica
ACSLYPSAMKRLLIPTGYPK

SEQ ID NO: 2707208 - protein, 21 aa, Entamoeba histolytica
ACSTFGFPPISNTLEEVICNL

SEQ ID NO: 2707209 - protein, 28 aa, Entamoeba histolytica
ACTTRTFDLGWIPELDRFKRSQPRNVAT

SEQ ID NO: 2707210 - protein, 21 aa, Entamoeba histolytica
ACVQPPPPPPIDNSKVPSVSS

SEQ ID NO: 2707211 - protein, 21 aa, Entamoeba histolytica
ADALCVIPKVLAQNAAKDASE

SEQ ID NO: 2707212 - protein, 24 aa, Entamoeba histolytica
ADAYLDQYLWYEGDKRHLFPNWIK

SEQ ID NO: 2707213 - protein, 24 aa, Entamoeba histolytica
ADCGVEFIHIIAAQAKDVAANTNR

SEQ ID NO: 2707214 - protein, 21 aa, Entamoeba histolytica
ADDFLTTTFLAATCPKLIAPA

SEQ ID NO: 2707215 - protein, 22 aa, Entamoeba histolytica
ADDFLTTTFLAATCPKLIAPAM

SEQ ID NO: 2707216 - protein, 17 aa, Entamoeba histolytica
ADDIFTRISRRAELTLS

SEQ ID NO: 2707217 - protein, 23 aa, Entamoeba histolytica
ADDPEMIKLYLTTILKIFIAGDE

SEQ ID NO: 2707218 - protein, 21 aa, Entamoeba histolytica
ADDVKLTVIILNKIDIQHNNN

SEQ ID NO: 2707219 - protein, 34 aa, Entamoeba histolytica
ADDVNPQKFIYYEFYEQTDHIGAEYKAQVVVVNE

SEQ ID NO: 2707220 - protein, 19 aa, Entamoeba histolytica
ADEFAKVLFGPRAHRLDPK

SEQ ID NO: 2707221 - protein, 18 aa, Entamoeba histolytica
ADEIKHTLGKYLILIATL

SEQ ID NO: 2707222 - protein, 22 aa, Entamoeba histolytica
ADEIKKFFGYDPKCVQLKKKYE

SEQ ID NO: 2707223 - protein, 23 aa, Entamoeba histolytica
ADELLTLKLFLYTGDPCYPIQDF

SEQ ID NO: 2707224 - protein, 21 aa, Entamoeba histolytica
ADEPMTRFLTCASCGFFWKMS

SEQ ID NO: 2707225 - protein, 25 aa, Entamoeba histolytica
ADETVVNYLIDMKKIMIAGKMCYIS

SEQ ID NO: 2707226 - protein, 17 aa, Entamoeba histolytica
ADFAALLCSCQEGFSYV

SEQ ID NO: 2707227 - protein, 26 aa, Entamoeba histolytica
ADFQGFVIQFKFNNGLYLPACEYALK

SEQ ID NO: 2707228 - protein, 23 aa, Entamoeba histolytica
ADGLGKRFLVYAPTIKFALNKYC

SEQ ID NO: 2707229 - protein, 30 aa, Entamoeba histolytica
ADGTPPYMDFPPMKALFQITTKGIPPLEGI

SEQ ID NO: 2707230 - protein, 17 aa, Entamoeba histolytica
ADHSFIVWMRSKEQIFV

SEQ ID NO: 2707231 - protein, 19 aa, Entamoeba histolytica
ADIIKIYLRNLPEPLLPYD

SEQ ID NO: 2707232 - protein, 22 aa, Entamoeba histolytica
ADIKAICTEAGLLALRERRMKV

SEQ ID NO: 2707233 - protein, 39 aa, Entamoeba histolytica
ADIKLIQQHPFFKGFNWDTIFEQTPPYLPKLKSPFDTSN

SEQ ID NO: 2707234 - protein, 31 aa, Entamoeba histolytica
ADILLLELTIAFYKINFYSSALANILLELRI

SEQ ID NO: 2707235 - protein, 27 aa, Entamoeba histolytica
ADITLQTPLVFWKWANEHILAIVTSTS

SEQ ID NO: 2707236 - protein, 26 aa, Entamoeba histolytica
ADKGHKIFFKLPLIKKVELKGELIQR

SEQ ID NO: 2707237 - protein, 27 aa, Entamoeba histolytica
ADKHPDLAIPLWYSYGTVVILLEEIVS

SEQ ID NO: 2707238 - protein, 20 aa, Entamoeba histolytica
ADKLKLSYLIDLLKGIVDEE

SEQ ID NO: 2707239 - protein, 23 aa, Entamoeba histolytica
ADKLLTLQNYQALAGFYVGLEAY

SEQ ID NO: 2707240 - protein, 23 aa, Entamoeba histolytica
ADKLTRLIMLKNPDLLNSYNGTL

SEQ ID NO: 2707241 - protein, 18 aa, Entamoeba histolytica
ADKRDHRLIGRQQDLFFF

SEQ ID NO: 2707242 - protein, 23 aa, Entamoeba histolytica
ADKRPFQYCALFLAPRVNNHFYF

SEQ ID NO: 2707243 - protein, 25 aa, Entamoeba histolytica
ADLAHQFIPILINDASVFPNNRQSI

SEQ ID NO: 2707244 - protein, 23 aa, Entamoeba histolytica
ADLDLVLKYLVEGEPSYILFRTE

SEQ ID NO: 2707245 - protein, 21 aa, Entamoeba histolytica
ADLLRKIHSLFTFSITSYDDL

SEQ ID NO: 2707246 - protein, 20 aa, Entamoeba histolytica
ADMGLEFLTRLFLINNEIIK

SEQ ID NO: 2707247 - protein, 25 aa, Entamoeba histolytica
ADMKQIGIIEPFRVKKHILTAATEA

SEQ ID NO: 2707248 - protein, 20 aa, Entamoeba histolytica
ADMLYKLQPLFPNKSSQQIL

SEQ ID NO: 2707249 - protein, 17 aa, Entamoeba histolytica
ADNKFCFDCGKGGATFV

SEQ ID NO: 2707250 - protein, 23 aa, Entamoeba histolytica
ADNKLLEIIITLSPNSTIANVYR

SEQ ID NO: 2707251 - protein, 29 aa, Entamoeba histolytica
ADNKYIHHDILMPNIPLTTSYLDMGSCPI

SEQ ID NO: 2707252 - protein, 24 aa, Entamoeba histolytica
ADQQKKLERIRKVAAAEIEEKEKE

SEQ ID NO: 2707253 - protein, 29 aa, Entamoeba histolytica
ADRLLKQICHFICYYIIEEMLKRNKINGM

SEQ ID NO: 2707254 - protein, 23 aa, Entamoeba histolytica
ADSINFIQKSFYKGCLMGGVHGG

SEQ ID NO: 2707255 - protein, 23 aa, Entamoeba histolytica
ADSLKFIQFANCSIGIIADGCGW

SEQ ID NO: 2707256 - protein, 24 aa, Entamoeba histolytica
ADSTFPFVFTSVDIGYLVNPLLLV

SEQ ID NO: 2707257 - protein, 21 aa, Entamoeba histolytica
ADTAIFERYIVNKYVKVVNGQ

SEQ ID NO: 2707258 - protein, 36 aa, Entamoeba histolytica; identical to SEQ ID NO: 2518779

SEQ ID NO: 2707259 - protein, 24 aa, Entamoeba histolytica
ADTYEAGYRRGADAAGPMASKGTW

SEQ ID NO: 2707260 - protein, 35 aa, Entamoeba histolytica
ADVWAAGCLLYKLEFFVTPFDGSPMKIIRGSYDLP

SEQ ID NO: 2707261 - protein, 25 aa, Entamoeba histolytica
ADVWALGCILYKICYFDTPFEESPM

SEQ ID NO: 2707262 - protein, 23 aa, Entamoeba histolytica
ADYQLATLHLLLHSLGGVVANVG

SEQ ID NO: 2707263 - protein, 20 aa, Entamoeba histolytica
AEAFQMVPRVLAENAGLDAT

SEQ ID NO: 2707264 - protein, 29 aa, Entamoeba histolytica
AEANAAYVRFLMKLFRILGRSEVMGVFEY

SEQ ID NO: 2707265 - protein, 24 aa, Entamoeba histolytica
AEAPTEMMMYFPQLKALCTAEEIN

SEQ ID NO: 2707266 - protein, 31 aa, Entamoeba histolytica; identical to SEQ ID NO: 2518789

SEQ ID NO: 2707267 - protein, 29 aa, Entamoeba histolytica
AEAYNRRAIIFLQNYNKFRDANEKIQQAI

SEQ ID NO: 2707268 - protein, 19 aa, Entamoeba histolytica
AECCICFTGNFLSPDEHIY

SEQ ID NO: 2707269 - protein, 32 aa, Entamoeba histolytica
AECKMKYSLTLYYQFCSLFDSLPLVCVVHRDI

SEQ ID NO: 2707270 - protein, 19 aa, Entamoeba histolytica
AEDTFLTTSYFRKVIYGKR

SEQ ID NO: 2707271 - protein, 20 aa, Entamoeba histolytica
AEECISITKLYLNNDIRYPN

SEQ ID NO: 2707272 - protein, 19 aa, Entamoeba histolytica
AEEEVLSSRILLLEKELGE

SEQ ID NO: 2707273 - protein, 26 aa, Entamoeba histolytica
AEEFSLPITFTCWPAEAQNGLTLSMS

SEQ ID NO: 2707274 - protein, 22 aa, Entamoeba histolytica
AEELACLWGISFIETSAKKKSN

SEQ ID NO: 2707275 - protein, 35 aa, Entamoeba histolytica
AEERNYYIPCWIKIRYYQSFTFDAFKLCRSHNCHN

SEQ ID NO: 2707276 - protein, 19 aa, Entamoeba histolytica
AEEYKFIDTLRDIKVIQQE

SEQ ID NO: 2707277 - protein, 19 aa, Entamoeba histolytica
AEFFVNELGFNDFKIIYDS

SEQ ID NO: 2707278 - protein, 17 aa, Entamoeba histolytica
AEFVPWNKEAIKVVHTR

SEQ ID NO: 2707279 - protein, 24 aa, Entamoeba histolytica
AEGDTAYDPLIGLYANRKKEQRIR

SEQ ID NO: 2707280 - protein, 17 aa, Entamoeba histolytica
AEGILKRKNAFERLRKY

SEQ ID NO: 2707281 - protein, 23 aa, Entamoeba histolytica
AEGITPLMYAIELGFDDISLDIL

SEQ ID NO: 2707282 - protein, 17 aa, Entamoeba histolytica
AEHFIYIEQQYFLSNCG

SEQ ID NO: 2707283 - protein, 24 aa, Entamoeba histolytica
AEHNGKWMRSLITTGTYNDKIKAL

SEQ ID NO: 2707284 - protein, 17 aa, Entamoeba histolytica
AEICIKALFAANKSFEN

SEQ ID NO: 2707285 - protein, 23 aa, Entamoeba histolytica
AEIDEWLKIHQISFVFDNDLFIP

SEQ ID NO: 2707286 - protein, 26 aa, Entamoeba histolytica
AEIFKLKAEIEKLKYENSRLKDDLEQ

SEQ ID NO: 2707287 - protein, 27 aa, Entamoeba histolytica
AEIGMPLYNFVQLIKPIIKSADSQPIF

SEQ ID NO: 2707288 - protein, 19 aa, Entamoeba histolytica
AEIIINEILALKCIDVKTR

SEQ ID NO: 2707289 - protein, 20 aa, Entamoeba histolytica
AEILAPEMFVLQASVVSVQA

SEQ ID NO: 2707290 - protein, 25 aa, Entamoeba histolytica
AEILQERFAPFLPTVLQIVLSRAQM

SEQ ID NO: 2707291 - protein, 23 aa, Entamoeba histolytica
AEINPFFIGSWIDMSQQGGMDGG

SEQ ID NO: 2707292 - protein, 24 aa, Entamoeba histolytica
AEKLVSLLSGYFYLCGETSPDVEK

SEQ ID NO: 2707293 - protein, 33 aa, Entamoeba histolytica
AEKYGNKLILGLLYTLYRIYRMNPVDLVGSENG

SEQ ID NO: 2707294 - protein, 29 aa, Entamoeba histolytica
AELGTKRRIFVIPYLMYSTMERAVHPGEV

SEQ ID NO: 2707295 - protein, 20 aa, Entamoeba histolytica
AELIMFLPQLIQALKFELHH

SEQ ID NO: 2707296 - protein, 18 aa, Entamoeba histolytica
AELLTGQILFRGMTTSDQ

SEQ ID NO: 2707297 - protein, 20 aa, Entamoeba histolytica
AEMPADSGYPAYLAARLASF

SEQ ID NO: 2707298 - protein, 28 aa, Entamoeba histolytica
AEQECALICLLIYEGFNMQFSVPRKSSE

SEQ ID NO: 2707299 - protein, 26 aa, Entamoeba histolytica
AEQEDYKWVLLEDSNAQKDYVITLLQ

SEQ ID NO: 2707300 - protein, 22 aa, Entamoeba histolytica
AEQIDFFDLFLGDELNPQGMIS

SEQ ID NO: 2707301 - protein, 18 aa, Entamoeba histolytica
AEQLFAFVRKILSKYCNY

SEQ ID NO: 2707302 - protein, 27 aa, Entamoeba histolytica
AEQLPPLYSYLLFKSKYPNVYSDSMLI

SEQ ID NO: 2707303 - protein, 23 aa, Entamoeba histolytica
AEREMAFWDPRNLATPLCRHTVD

SEQ ID NO: 2707304 - protein, 39 aa, Entamoeba histolytica
AERMFNFTPVHIRKGKYRFPGTDLWYNTIEEYKKLQKEY

SEQ ID NO: 2707305 - protein, 17 aa, Entamoeba histolytica
AERMKRAIAERREQLRI

SEQ ID NO: 2707306 - protein, 18 aa, Entamoeba histolytica
AESLVPPIDFFIPQEAVS

SEQ ID NO: 2707307 - protein, 26 aa, Entamoeba histolytica
AESTESKWKLLVFDKFCSELIESHLV

SEQ ID NO: 2707308 - protein, 27 aa, Entamoeba histolytica
AETIQFINSIHLFLEKLNRGILTEFSR

SEQ ID NO: 2707309 - protein, 26 aa, Entamoeba histolytica
AEYEKMKFGIWLKKLQIVLTEDSKEI

SEQ ID NO: 2707310 - protein, 19 aa, Entamoeba histolytica
AEYLHLEAELPFISFEDLL

SEQ ID NO: 2707311 - protein, 19 aa, Entamoeba histolytica
AFAQKFPSPRLGLIEVIKG

SEQ ID NO: 2707312 - protein, 18 aa, Entamoeba histolytica
AFAVIPYTRVGKQCGICL

SEQ ID NO: 2707313 - protein, 20 aa, Entamoeba histolytica
AFDCAIRLRQPNFINIDYVN

SEQ ID NO: 2707314 - protein, 23 aa, Entamoeba histolytica
AFDFPISTLFLQELTYKASNLFS

SEQ ID NO: 2707315 - protein, 19 aa, Entamoeba histolytica
AFDIKLIDKILPTNIFFIG

SEQ ID NO: 2707316 - protein, 23 aa, Entamoeba histolytica
AFDNPHEFLLRIKRQLLTQRTFK

SEQ ID NO: 2707317 - protein, 25 aa, Entamoeba histolytica
AFDVLHNCTPFISKLYSLINTPEYH

SEQ ID NO: 2707318 - protein, 24 aa, Entamoeba histolytica
AFEDLGMEAVWKIKVEDLLAFVLV

SEQ ID NO: 2707319 - protein, 17 aa, Entamoeba histolytica
AFEIAYDKLYQFICPNY

SEQ ID NO: 2707320 - protein, 18 aa, Entamoeba histolytica
AFEKCGIISLILPSLLNS

SEQ ID NO: 2707321 - protein, 28 aa, Entamoeba histolytica
AFEKLASQILANKLLMDSLPETTEANLN

SEQ ID NO: 2707322 - protein, 17 aa, Entamoeba histolytica
AFERRRLPSSIAHSSRR

SEQ ID NO: 2707323 - protein, 35 aa, Entamoeba histolytica
AFEYNGDLLIFLLDSLYNCQFANYLEYPNTCSCNI

SEQ ID NO: 2707324 - protein, 26 aa, Entamoeba histolytica
AFFEHLRSFQKLPGPFLVVTPLSTLE

SEQ ID NO: 2707325 - protein, 17 aa, Entamoeba histolytica
AFFPFLRVAVDERVHLL

SEQ ID NO: 2707326 - protein, 21 aa, Entamoeba histolytica
AFFQTVYLPALLDNKQYQIMK

SEQ ID NO: 2707327 - protein, 18 aa, Entamoeba histolytica
AFGNQRPMINPMANFFIG

SEQ ID NO: 2707328 - protein, 25 aa, Entamoeba histolytica
AFIKLKTIIEFFYQSVDFSSSEALL

SEQ ID NO: 2707329 - protein, 17 aa, Entamoeba histolytica
AFILKNALGNKTVPFNC

SEQ ID NO: 2707330 - protein, 18 aa, Entamoeba histolytica
AFKDACLAAFQLGRQRIK

SEQ ID NO: 2707331 - protein, 22 aa, Entamoeba histolytica
AFKPEWATIVDDTLYLGSQGLD

SEQ ID NO: 2707332 - protein, 17 aa, Entamoeba histolytica
AFKQLQMNKPLLLTFDD

SEQ ID NO: 2707333 - protein, 26 aa, Entamoeba histolytica
AFKSKHLPFITVFQDPTFGGTTASYA

SEQ ID NO: 2707334 - protein, 17 aa, Entamoeba histolytica
AFLALARVMAKYGRQDP

SEQ ID NO: 2707335 - protein, 19 aa, Entamoeba histolytica
AFLDFLKRALQWDPEVRMR

SEQ ID NO: 2707336 - protein, 17 aa, Entamoeba histolytica
AFLVVITSRTSSLENCS

SEQ ID NO: 2707337 - protein, 26 aa, Entamoeba histolytica
AFMKTPVHNLCFYKNKLYGVIPSPTK

SEQ ID NO: 2707338 - protein, 26 aa, Entamoeba histolytica
AFNHCPYLTSIVLPSSLKRLGYMAFG

SEQ ID NO: 2707339 - protein, 22 aa, Entamoeba histolytica
AFNITLFGFDIIRENGTGKPYI

SEQ ID NO: 2707340 - protein, 18 aa, Entamoeba histolytica
AFNQPLCEYLTCAVITGS

SEQ ID NO: 2707341 - protein, 23 aa, Entamoeba histolytica
AFPAKFQLLTLKPILRTIVTSQI

SEQ ID NO: 2707342 - protein, 30 aa, Entamoeba histolytica
AFQILKYLPPFYHCILLLPHLIHYIPKSSV

SEQ ID NO: 2707343 - protein, 23 aa, Entamoeba histolytica
AFQPLVHLPFDILIEQIKMELRD

SEQ ID NO: 2707344 - protein, 19 aa, Entamoeba histolytica
AFQQSVLMGILVKEGYTFN

SEQ ID NO: 2707345 - protein, 18 aa, Entamoeba histolytica
AFRIPPKYLQQLLVDARP

SEQ ID NO: 2707346 - protein, 25 aa, Entamoeba histolytica
AFRLNAPNLKLDFPRAFLVMELCDG

SEQ ID NO: 2707347 - protein, 17 aa, Entamoeba histolytica
AFRSPLSMFIPSNPRIF

SEQ ID NO: 2707348 - protein, 25 aa, Entamoeba histolytica
AFSGQVLWDLYNFSSTKKEVVGENS

SEQ ID NO: 2707349 - protein, 18 aa, Entamoeba histolytica
AFSHWSWCISNHQLIIVD

SEQ ID NO: 2707350 - protein, 20 aa, Entamoeba histolytica
AFSNTFADFKIPSQGDFNGV

SEQ ID NO: 2707351 - protein, 23 aa, Entamoeba histolytica
AFSQLLRSIINLKPIFVDPGEEE

SEQ ID NO: 2707352 - protein, 30 aa, Entamoeba histolytica
AFTGNLYTKFINIISFLLAIRNTETFITAF

SEQ ID NO: 2707353 - protein, 19 aa, Entamoeba histolytica
AFTVKRFMRITNETAKSHF

SEQ ID NO: 2707354 - protein, 21 aa, Entamoeba histolytica
AFVGKTCFFKRFSSGEFNPNT

SEQ ID NO: 2707355 - protein, 29 aa, Entamoeba histolytica
AFVIDMNLLLRYIFGLIGYVPTVSFGNYS

SEQ ID NO: 2707356 - protein, 20 aa, Entamoeba histolytica
AFVILLKQMIELRIHHLKIL

SEQ ID NO: 2707357 - protein, 22 aa, Entamoeba histolytica
AFVLHVFHYKELPKTLVQLLEN

SEQ ID NO: 2707358 - protein, 17 aa, Entamoeba histolytica
AFYDTIVSLPFICQSQE

SEQ ID NO: 2707359 - protein, 30 aa, Entamoeba histolytica; identical to SEQ ID NO: 2518873

SEQ ID NO: 2707360 - protein, 25 aa, Entamoeba histolytica
AGDIVFVIKTIPHPLFTRDGDDLHC

SEQ ID NO: 2707361 - protein, 28 aa, Entamoeba histolytica
AGDRKGILSFMYQILNKYRLGNCPVKMA

SEQ ID NO: 2707362 - protein, 35 aa, Entamoeba histolytica; identical to SEQ ID NO: 2518875

SEQ ID NO: 2707363 - protein, 31 aa, Entamoeba histolytica
AGEFTKYIYTPMPYFVFSFIGVYSVGIIEGE

SEQ ID NO: 2707364 - protein, 31 aa, Entamoeba histolytica
AGEKALLVPILVANAINWGSIFFIASNSDDE

SEQ ID NO: 2707365 - protein, 32 aa, Entamoeba histolytica
AGEKALLVPILVANAINWGSIFFIASNSDDEM

SEQ ID NO: 2707366 - protein, 24 aa, Entamoeba histolytica
AGGVMTALIPRNSTIPAKKSEIFS

SEQ ID NO: 2707367 - protein, 27 aa, Entamoeba histolytica
AGHRGYYLKGWGFKLNQALINYGTNFL

SEQ ID NO: 2707368 - protein, 25 aa, Entamoeba histolytica
AGIDHYFCFGISSLIKLLQSVHDYY

SEQ ID NO: 2707369 - protein, 25 aa, Entamoeba histolytica
AGITDIDLYFYPCVKCGNAASQVNS

SEQ ID NO: 2707370 - protein, 27 aa, Entamoeba histolytica
AGIVVWPCIAEILPQYVFNDRNPIICG

SEQ ID NO: 2707371 - protein, 17 aa, Entamoeba histolytica
AGIYCFQPYCVTGQLEP

SEQ ID NO: 2707372 - protein, 21 aa, Entamoeba histolytica
AGKGMGGAIIGLQGGVWAASA

SEQ ID NO: 2707373 - protein, 21 aa, Entamoeba histolytica
AGKIPFIIRRRLPNGSYEDWK

SEQ ID NO: 2707374 - protein, 21 aa, Entamoeba histolytica
AGLCEIHMICFIASFLEGGEA

SEQ ID NO: 2707375 - protein, 26 aa, Entamoeba histolytica
AGLNEIRIIIKYPFKTNISLKKQLED

SEQ ID NO: 2707376 - protein, 17 aa, Entamoeba histolytica
AGLYDMGPLGCALKQNI

SEQ ID NO: 2707377 - protein, 27 aa, Entamoeba histolytica
AGMISKIVKRRLLLMKNYVSNHSIDMW

SEQ ID NO: 2707378 - protein, 24 aa, Entamoeba histolytica
AGMYVLYCYYSTYPLSCSASIQLK

SEQ ID NO: 2707379 - protein, 26 aa, Entamoeba histolytica
AGNVLRPHVFAAFRALYESNKKKGLK

SEQ ID NO: 2707380 - protein, 28 aa, Entamoeba histolytica
AGQERFRTIVASYYRGVLGIAMIYDVTS

SEQ ID NO: 2707381 - protein, 36 aa, Entamoeba histolytica; identical to SEQ ID NO: 2518889

SEQ ID NO: 2707382 - protein, 28 aa, Entamoeba histolytica
AGQERYRAITNAYYRGALGALVVYDITK

SEQ ID NO: 2707383 - protein, 26 aa, Entamoeba histolytica
AGQERYRSLIPNYIRGASVVVIVYDI

SEQ ID NO: 2707384 - protein, 27 aa, Entamoeba histolytica
AGQIGYNLCFLIGRGFLFDCDVILHLY

SEQ ID NO: 2707385 - protein, 24 aa, Entamoeba histolytica
AGQKYLFENIINLFGKDVKKNFIA

SEQ ID NO: 2707386 - protein, 18 aa, Entamoeba histolytica
AGTTLAIVMIYDNTIYTA

SEQ ID NO: 2707387 - protein, 22 aa, Entamoeba histolytica
AGTYMRTLCVHLGYLMGCGAHM

SEQ ID NO: 2707388 - protein, 24 aa, Entamoeba histolytica
AGVKFMYDCVMGLKQGFKGNGCIL

SEQ ID NO: 2707389 - protein, 21 aa, Entamoeba histolytica
AGYVPKYLSDILNKLESMGIK

SEQ ID NO: 2707390 - protein, 19 aa, Entamoeba histolytica
AHAIKNYDLLYSLTGSLGD

SEQ ID NO: 2707391 - protein, 24 aa, Entamoeba histolytica
AHAYHAIELFRKAKMTWFGVEVCL

SEQ ID NO: 2707392 - protein, 30 aa, Entamoeba histolytica
AHCDDIVDVAFWRGLLVSASQDNLCCIIDY

SEQ ID NO: 2707393 - protein, 30 aa, Entamoeba histolytica
AHFEQYIIPFPYSLFIPKSYKEIAAFCSKY

SEQ ID NO: 2707394 - protein, 19 aa, Entamoeba histolytica
AHFLFSFRNKINTGHIKFN

SEQ ID NO: 2707395 - protein, 23 aa, Entamoeba histolytica
AHGKVLELLLWMFEKELTENPPE

SEQ ID NO: 2707396 - protein, 28 aa, Entamoeba histolytica
AHGSLQPFGGLIAWLRMYATDEFLNVKK

SEQ ID NO: 2707397 - protein, 25 aa, Entamoeba histolytica
AHIIGQQYQFLQQELKYYKELLNEP

SEQ ID NO: 2707398 - protein, 27 aa, Entamoeba histolytica
AHKEASVILLRYFNPIGAHKSGLLGEN

SEQ ID NO: 2707399 - protein, 30 aa, Entamoeba histolytica; identical to SEQ ID NO: 2518910

SEQ ID NO: 2707400 - protein, 25 aa, Entamoeba histolytica
AHMLYKKRFQPYYMSPIIAGIDDNG

SEQ ID NO: 2707401 - protein, 20 aa, Entamoeba histolytica
AHNILLCGCGLLFKHYGNEI

SEQ ID NO: 2707402 - protein, 22 aa, Entamoeba histolytica
AHPLALPIVFNTPISLREIQSH

SEQ ID NO: 2707403 - protein, 20 aa, Entamoeba histolytica
AHPTYPLLLVGCIDGRILII

SEQ ID NO: 2707404 - protein, 29 aa, Entamoeba histolytica
AHTVDFRVFCFYFEFLMNAFKNKSSVIQI

SEQ ID NO: 2707405 - protein, 23 aa, Entamoeba histolytica
AHYFEQFWEIKGSIEWNRIGVAY

SEQ ID NO: 2707406 - protein, 19 aa, Entamoeba histolytica
AIAADFLISGVDLDNIPDQ

SEQ ID NO: 2707407 - protein, 18 aa, Entamoeba histolytica
AIAAFWWDDFCDGDLEDL

SEQ ID NO: 2707408 - protein, 18 aa, Entamoeba histolytica
AIASLKMSQLLKAKSKNE

SEQ ID NO: 2707409 - protein, 19 aa, Entamoeba histolytica
AICGYDDIKEAVLCLMLGG

SEQ ID NO: 2707410 - protein, 19 aa, Entamoeba histolytica
AICRFFINVTPLTGIPKET

SEQ ID NO: 2707411 - protein, 22 aa, Entamoeba histolytica
AICTYCLPLIRKEKINNLIVDY

SEQ ID NO: 2707412 - protein, 24 aa, Entamoeba histolytica
AIDGYALLHRIATRNPRQIVLNND

SEQ ID NO: 2707413 - protein, 29 aa, Entamoeba histolytica
AIDIDDCIYLFKTAGYLVTKKFLKEYFEK

SEQ ID NO: 2707414 - protein, 26 aa, Entamoeba histolytica
AIDPTGNHLLLYTLNGELYYTSKDLI

SEQ ID NO: 2707415 - protein, 17 aa, Entamoeba histolytica
AIDTLRKICNHPHLINK

SEQ ID NO: 2707416 - protein, 31 aa, Entamoeba histolytica
AIDVHTLNYAFRWFNCFLLREFSPEQGIRLF

SEQ ID NO: 2707417 - protein, 22 aa, Entamoeba histolytica
AIEILTGCFILIQGKTVSVIGS

SEQ ID NO: 2707418 - protein, 24 aa, Entamoeba histolytica
AIEKIVLLFISLKSIIQSNIIITL

SEQ ID NO: 2707419 - protein, 17 aa, Entamoeba histolytica
AIELCKYLPNAIGEFRK

SEQ ID NO: 2707420 - protein, 26 aa, Entamoeba histolytica
AIELDPNYAKAYARLAIALTKKHKYT

SEQ ID NO: 2707421 - protein, 18 aa, Entamoeba histolytica
AIESFSFFELCFNTIVFS

SEQ ID NO: 2707422 - protein, 26 aa, Entamoeba histolytica
AIEYKTKILFIFETKSGVVGFYQEDM

SEQ ID NO: 2707423 - protein, 29 aa, Entamoeba histolytica
AIFEYSNLIPREWLMKFDIVFQCGIPEET

SEQ ID NO: 2707424 - protein, 20 aa, Entamoeba histolytica
AIFIAHTPLNWGEAIQIICD

SEQ ID NO: 2707425 - protein, 25 aa, Entamoeba histolytica
AIFLKVVEFLFSPLPTIFAFCSRQS

SEQ ID NO: 2707426 - protein, 36 aa, Entamoeba histolytica; identical to SEQ ID NO: 2518936

SEQ ID NO: 2707427 - protein, 26 aa, Entamoeba histolytica
AIGDGIKRAFRLFGNNLGNNLERKRN

SEQ ID NO: 2707428 - protein, 25 aa, Entamoeba histolytica
AIGPTPSLLIKWSYASTDNESLPIS

SEQ ID NO: 2707429 - protein, 18 aa, Entamoeba histolytica
AIHLFSSYCLVYQNNQEF

SEQ ID NO: 2707430 - protein, 18 aa, Entamoeba histolytica
AIHLKYCLRIIEEASEIL

SEQ ID NO: 2707431 - protein, 17 aa, Entamoeba histolytica
AIILSVFYNWSESGQLP

SEQ ID NO: 2707432 - protein, 27 aa, Entamoeba histolytica
AIKDSLRPLLFIFREIDPLCTLQLESY

SEQ ID NO: 2707433 - protein, 29 aa, Entamoeba histolytica
AIKDVATIFWIAYLPIKVKSKFIELINTL

SEQ ID NO: 2707434 - protein, 18 aa, Entamoeba histolytica
AIKMNGNLRWNLWDEVHK

SEQ ID NO: 2707435 - protein, 27 aa, Entamoeba histolytica
AIKRLRFTNPQLSFRFIEWCILNYSEI

SEQ ID NO: 2707436 - protein, 26 aa, Entamoeba histolytica
AIKSAFNLFLFPIYSQVNKYIILQEN

SEQ ID NO: 2707437 - protein, 18 aa, Entamoeba histolytica
AIKSYLNFVYPNGGYEKE

SEQ ID NO: 2707438 - protein, 19 aa, Entamoeba histolytica
AIKVIPAPELLYCVPERVV

SEQ ID NO: 2707439 - protein, 23 aa, Entamoeba histolytica
AIKYNCVLLLPPASLVKDLVITP

SEQ ID NO: 2707440 - protein, 24 aa, Entamoeba histolytica
AILIGVLNLYYNITVQFGSIRTPK

SEQ ID NO: 2707441 - protein, 41 aa, Entamoeba histolytica
AILKDYLRQLPEPLIPYEYYKQFIELPLKTTDPKLFMESLP

SEQ ID NO: 2707442 - protein, 18 aa, Entamoeba histolytica
AINFPDLEKIYLRDIAVP

SEQ ID NO: 2707443 - protein, 29 aa, Entamoeba histolytica
AINHLLSPIFHFLLPFLTSTTKEPEMKFN

SEQ ID NO: 2707444 - protein, 18 aa, Entamoeba histolytica
AINIGKYYSILPTDMSVI

SEQ ID NO: 2707445 - protein, 22 aa, Entamoeba histolytica
AINKYPYGLRYLCKVINENSME

SEQ ID NO: 2707446 - protein, 26 aa, Entamoeba histolytica
AINSFHTLFYPIKIVCKPTASDSSSW

SEQ ID NO: 2707447 - protein, 26 aa, Entamoeba histolytica
AIPDSHRPFLLPIVKSKPVRTASGIV

SEQ ID NO: 2707448 - protein, 17 aa, Entamoeba histolytica
AIPIDFKKIALIGRGNI

SEQ ID NO: 2707449 - protein, 17 aa, Entamoeba histolytica
AIPIVETMLKHQMIANI

SEQ ID NO: 2707450 - protein, 20 aa, Entamoeba histolytica
AIPLFLDIIQIFLKSGDDKA

SEQ ID NO: 2707451 - protein, 26 aa, Entamoeba histolytica
AIPPMIVELALTIKSLYREEWKGDWQ

SEQ ID NO: 2707452 - protein, 21 aa, Entamoeba histolytica
AIPRMINMEKIIAATRPKNLD

SEQ ID NO: 2707453 - protein, 29 aa, Entamoeba histolytica
AIPRPLNIPIIPLYWNILRNITYSTSHSF

SEQ ID NO: 2707454 - protein, 24 aa, Entamoeba histolytica
AIPTLSLLKLKTSLSSQYYPLILH

SEQ ID NO: 2707455 - protein, 26 aa, Entamoeba histolytica
AIPVFEQIILFTFKSHLLKSVRIITT

SEQ ID NO: 2707456 - protein, 24 aa, Entamoeba histolytica
AIQFISNLLVLEPSLRLTAEEALQ

SEQ ID NO: 2707457 - protein, 26 aa, Entamoeba histolytica
AIQLMYAPHNIGLLAITCIKRYLIDW

SEQ ID NO: 2707458 - protein, 17 aa, Entamoeba histolytica
AIQLRQKKPNYVPLVVE

SEQ ID NO: 2707459 - protein, 25 aa, Entamoeba histolytica
AIRPSNVIITKLFLNKDREALLAKK

SEQ ID NO: 2707460 - protein, 26 aa, Entamoeba histolytica
AIRSIAIIIFHRLITPALVSPANYNS

SEQ ID NO: 2707461 - protein, 20 aa, Entamoeba histolytica
AISFSWLIQLAEQNGISFGK

SEQ ID NO: 2707462 - protein, 20 aa, Entamoeba histolytica
AISILMIYYEIAPPMIKAST

SEQ ID NO: 2707463 - protein, 28 aa, Entamoeba histolytica
AISNKENLIRFVFPISRITLLPCNSKKD

SEQ ID NO: 2707464 - protein, 24 aa, Entamoeba histolytica
AISSETFINLIKPLTELLTITNSN

SEQ ID NO: 2707465 - protein, 17 aa, Entamoeba histolytica
AISSLCGLLLLEGLPKP

SEQ ID NO: 2707466 - protein, 25 aa, Entamoeba histolytica
AISYESLSPIYFSGGRMKVYGIPNS

SEQ ID NO: 2707467 - protein, 17 aa, Entamoeba histolytica
AITFPFKNKKMIAADVM

SEQ ID NO: 2707468 - protein, 20 aa, Entamoeba histolytica
AITMWTPNMANAVVGLGFHK

SEQ ID NO: 2707469 - protein, 27 aa, Entamoeba histolytica
AITSTLKGLFRRLPIPLIPSNINSKIE

SEQ ID NO: 2707470 - protein, 22 aa, Entamoeba histolytica
AITVGYPNPFLRKLTRDIWSNN

SEQ ID NO: 2707471 - protein, 17 aa, Entamoeba histolytica
AIVKLPPFSLNNLRINH

SEQ ID NO: 2707472 - protein, 30 aa, Entamoeba histolytica
AIVLESGDEIILCSDGIWDVITPEKAFEMM

SEQ ID NO: 2707473 - protein, 21 aa, Entamoeba histolytica
AIVLRKTYWWKNFKVCFFFFS

SEQ ID NO: 2707474 - protein, 19 aa, Entamoeba histolytica
AIVLWELSTNKTPFSEFKF

SEQ ID NO: 2707475 - protein, 29 aa, Entamoeba histolytica
AIVNCDWENTSARDLFALLSVCVPNGGKL

SEQ ID NO: 2707476 - protein, 19 aa, Entamoeba histolytica
AIVSFRRTKKTKNTIKMMV

SEQ ID NO: 2707477 - protein, 18 aa, Entamoeba histolytica
AIYCPTTSVLDPYEFTIA

SEQ ID NO: 2707478 - protein, 27 aa, Entamoeba histolytica
AIYLGRSSLKPVMYEGFMAGGVAAGGQ

SEQ ID NO: 2707479 - protein, 19 aa, Entamoeba histolytica
AIYLLRCQIINSCISYMEE

SEQ ID NO: 2707480 - protein, 24 aa, Entamoeba histolytica
AIYMHPDLLLLDEPSNHLDFHALI

SEQ ID NO: 2707481 - protein, 36 aa, Entamoeba histolytica
AIYRNRLKIIPPTEARIIVFSLWMKDMISLQEINVH

SEQ ID NO: 2707482 - protein, 17 aa, Entamoeba histolytica
AKAQQFKTKMNKFKKQA

SEQ ID NO: 2707483 - protein, 27 aa, Entamoeba histolytica
AKCISYFELFVFLFDKSKTMKQLMYPR

SEQ ID NO: 2707484 - protein, 21 aa, Entamoeba histolytica
AKDDYAWWKGRLSQMAQYFSA

SEQ ID NO: 2707485 - protein, 19 aa, Entamoeba histolytica
AKDKIEGLTLDNEDLKKKQ

SEQ ID NO: 2707486 - protein, 35 aa, Entamoeba histolytica
AKDLTRFINNLLKHPSYLFNEVTINFLTKPDFEII

SEQ ID NO: 2707487 - protein, 33 aa, Entamoeba histolytica
AKDMIYNQYLVDIYEVLVKMINTLVQHAATLPR

SEQ ID NO: 2707488 - protein, 19 aa, Entamoeba histolytica
AKDMWRVMFGYGVDVGRVK

SEQ ID NO: 2707489 - protein, 25 aa, Entamoeba histolytica
AKEDLHSFIPIFDSKKVQLIPTPNG

SEQ ID NO: 2707490 - protein, 23 aa, Entamoeba histolytica
AKEFQYYELPWKQINEFISCIYN

SEQ ID NO: 2707491 - protein, 22 aa, Entamoeba histolytica
AKEFTRFFSYSKKKPNFNVIYS

SEQ ID NO: 2707492 - protein, 31 aa, Entamoeba histolytica; identical to SEQ ID NO: 2518997

SEQ ID NO: 2707493 - protein, 22 aa, Entamoeba histolytica
AKEIPKIFGICKDYVLLADEDG

SEQ ID NO: 2707494 - protein, 17 aa, Entamoeba histolytica
AKEIYQMLLCCVKAKDL

SEQ ID NO: 2707495 - protein, 24 aa, Entamoeba histolytica
AKEKKLLLAQKMWNVLLDYSQLTM

SEQ ID NO: 2707496 - protein, 25 aa, Entamoeba histolytica
AKEKSRIHFVFSSSPDPMTHSLTPT

SEQ ID NO: 2707497 - protein, 26 aa, Entamoeba histolytica
AKENQRESWWLAYIMDQIEEEKSKGI

SEQ ID NO: 2707498 - protein, 24 aa, Entamoeba histolytica
AKETLTCLTLEWIDELTDRKGEFM

SEQ ID NO: 2707499 - protein, 24 aa, Entamoeba histolytica
AKEYIKYFYPLEIKGHLYDLNLEH

SEQ ID NO: 2707500 - protein, 28 aa, Entamoeba histolytica
AKEYSPMAFAIVRRFFGLTPESMIESIC

SEQ ID NO: 2707501 - protein, 24 aa, Entamoeba histolytica
AKFINQQIYFIYGTELFKITEELK

SEQ ID NO: 2707502 - protein, 20 aa, Entamoeba histolytica
AKFPPFYTIQLVDKTKNQQL

SEQ ID NO: 2707503 - protein, 21 aa, Entamoeba histolytica
AKGIVLREKLIKHPTIEMCND

SEQ ID NO: 2707504 - protein, 34 aa, Entamoeba histolytica
AKHHKINPPLIKSPLLFVTLRKWIINVPTEYVDS

SEQ ID NO: 2707505 - protein, 17 aa, Entamoeba histolytica
AKIFLGMSSNIVSSGLR

SEQ ID NO: 2707506 - protein, 17 aa, Entamoeba histolytica
AKIIDMLGPIPDYLLRK

SEQ ID NO: 2707507 - protein, 21 aa, Entamoeba histolytica
AKIIIVIGPLLAREGEIAWKT

SEQ ID NO: 2707508 - protein, 21 aa, Entamoeba histolytica
AKIILKRRTVKATVTKPFLCI

SEQ ID NO: 2707509 - protein, 20 aa, Entamoeba histolytica
AKIKEVFDAMNGKNVWEVIE

SEQ ID NO: 2707510 - protein, 26 aa, Entamoeba histolytica
AKIKTIMYQIFSALKYLHENNIIHRD

SEQ ID NO: 2707511 - protein, 22 aa, Entamoeba histolytica
AKILYTSLNNYIKLASCLLKLK

SEQ ID NO: 2707512 - protein, 22 aa, Entamoeba histolytica
AKITRLIFKQFSDLVNPKPDAN

SEQ ID NO: 2707513 - protein, 32 aa, Entamoeba histolytica
AKKDPNRPKRPPTPYFLYLNEHRASIKEEHPD

SEQ ID NO: 2707514 - protein, 24 aa, Entamoeba histolytica
AKKEYEVIYFELVQKLISHRRIVR

SEQ ID NO: 2707515 - protein, 20 aa, Entamoeba histolytica
AKKYGAVCVIGIGYPLPLSK

SEQ ID NO: 2707516 - protein, 20 aa, Entamoeba histolytica
AKLGEVWRAMSKEEKQPFFD

SEQ ID NO: 2707517 - protein, 22 aa, Entamoeba histolytica
AKLIIQFLKENHISIAFVGHRF

SEQ ID NO: 2707518 - protein, 20 aa, Entamoeba histolytica
AKLKLLVKHPELVEFHDSNS

SEQ ID NO: 2707519 - protein, 18 aa, Entamoeba histolytica
AKLYFSLIPNVQMLGEFF

SEQ ID NO: 2707520 - protein, 31 aa, Entamoeba histolytica
AKMIFATEFAYNWYVRKFFFEEGLKDAELST

SEQ ID NO: 2707521 - protein, 28 aa, Entamoeba histolytica
AKMISQFYITYWMMLNWVCFGGDSLTQQ

SEQ ID NO: 2707522 - protein, 19 aa, Entamoeba histolytica
AKMVFSSDVLKQKLGERAL

SEQ ID NO: 2707523 - protein, 30 aa, Entamoeba histolytica
AKNETSRFNFFILYHPLISFMSRNYQRSKE

SEQ ID NO: 2707524 - protein, 24 aa, Entamoeba histolytica
AKNIQQAILLRKKYLKFSDGSEVY

SEQ ID NO: 2707525 - protein, 17 aa, Entamoeba histolytica
AKNLLLGKKFVLVRCED

SEQ ID NO: 2707526 - protein, 22 aa, Entamoeba histolytica
AKPFSIPVDLNPPFTLKMANGI

SEQ ID NO: 2707527 - protein, 19 aa, Entamoeba histolytica
AKPLISIASDFIPGGEIIK

SEQ ID NO: 2707528 - protein, 27 aa, Entamoeba histolytica
AKPNKLPFMPMILNISPDIITIPQETQ

SEQ ID NO: 2707529 - protein, 26 aa, Entamoeba histolytica
AKQIKLIIPLKIEALELPQLPEYYVN

SEQ ID NO: 2707530 - protein, 24 aa, Entamoeba histolytica
AKQLNLPQYWRQLSQKAISTGHFK

SEQ ID NO: 2707531 - protein, 26 aa, Entamoeba histolytica
AKQQSLLILKLLKKHPEIPIERMPMV

SEQ ID NO: 2707532 - protein, 25 aa, Entamoeba histolytica
AKRGIKIYVLLYKSPYVSHLTKNQT

SEQ ID NO: 2707533 - protein, 19 aa, Entamoeba histolytica
AKRHNLEVLFHEKPFLDVN

SEQ ID NO: 2707534 - protein, 25 aa, Entamoeba histolytica
AKRKIDLNMIFSIPFEIKEIDDTKI

SEQ ID NO: 2707535 - protein, 31 aa, Entamoeba histolytica
AKRSKYILNIPFSSSPILLRVNYKGCIVIGY

SEQ ID NO: 2707536 - protein, 17 aa, Entamoeba histolytica
AKSILKFTSLSFTYDSS

SEQ ID NO: 2707537 - protein, 24 aa, Entamoeba histolytica
AKSIRNMMLIRLRRIYDEACNSSE

SEQ ID NO: 2707538 - protein, 30 aa, Entamoeba histolytica; identical to SEQ ID NO: 2519036

SEQ ID NO: 2707539 - protein, 29 aa, Entamoeba histolytica
AKSSKLLAQWIVLCPSSVIPIFSEAATQA

SEQ ID NO: 2707540 - protein, 23 aa, Entamoeba histolytica
AKTIVYGCIYGIGPFSLADQLHV

SEQ ID NO: 2707541 - protein, 18 aa, Entamoeba histolytica
AKTKCVCRYFMGASIVCY

SEQ ID NO: 2707542 - protein, 23 aa, Entamoeba histolytica
AKTWLKQSWAHNISSSFLAMNEN

SEQ ID NO: 2707543 - protein, 20 aa, Entamoeba histolytica
AKVCILSCPFEPPKTKTTTN

SEQ ID NO: 2707544 - protein, 23 aa, Entamoeba histolytica
AKVRLILCQIITSITNAFPDVLK

SEQ ID NO: 2707545 - protein, 17 aa, Entamoeba histolytica
AKWIGVEAIWKTKTKEF

SEQ ID NO: 2707546 - protein, 25 aa, Entamoeba histolytica
AKYSACLRFLLEKKLYQKELDNTSM

SEQ ID NO: 2707547 - protein, 25 aa, Entamoeba histolytica
AKYSRGYHLYKHLLWLIDHSHINHI

SEQ ID NO: 2707548 - protein, 17 aa, Entamoeba histolytica
AKYVPSILSVTVPLLLS

SEQ ID NO: 2707549 - protein, 19 aa, Entamoeba histolytica
ALCCVLNYALMLRDRHGDN

SEQ ID NO: 2707550 - protein, 26 aa, Entamoeba histolytica
ALCDFNFNVWPPINPQTFIPEPLIVP

SEQ ID NO: 2707551 - protein, 24 aa, Entamoeba histolytica
ALCHRLFYQPFKAKDIQFIIYQIL

SEQ ID NO: 2707552 - protein, 26 aa, Entamoeba histolytica
ALCKHKSYLCIHEINESKKRINEMVN

SEQ ID NO: 2707553 - protein, 24 aa, Entamoeba histolytica
ALCKNEFIVPLIDSAIYSEPEKKV

SEQ ID NO: 2707554 - protein, 17 aa, Entamoeba histolytica
ALCLKTMHSVEKKNVLI

SEQ ID NO: 2707555 - protein, 19 aa, Entamoeba histolytica
ALCPFNRLPPKESYGFVDC

SEQ ID NO: 2707556 - protein, 19 aa, Entamoeba histolytica
ALCRKYLKNPFEVFIDDGE

SEQ ID NO: 2707557 - protein, 26 aa, Entamoeba histolytica
ALDDSYLYFINLLTNDLEIARIFGES

SEQ ID NO: 2707558 - protein, 24 aa, Entamoeba histolytica
ALDETHFFYHTKLDWVEAGLQVIR

SEQ ID NO: 2707559 - protein, 19 aa, Entamoeba histolytica
ALDFCAILTWIFKRYRDTF

SEQ ID NO: 2707560 - protein, 23 aa, Entamoeba histolytica
ALDHPFITQAPFTKNWQPKPRKV

SEQ ID NO: 2707561 - protein, 18 aa, Entamoeba histolytica
ALEFARRHSLIYTETSAK

SEQ ID NO: 2707562 - protein, 18 aa, Entamoeba histolytica
ALELPQLPEYYVNCKEEL

SEQ ID NO: 2707563 - protein, 24 aa, Entamoeba histolytica
ALETIHRYVVILDKYFGSVSEIDI

SEQ ID NO: 2707564 - protein, 23 aa, Entamoeba histolytica
ALFKDLERVIKLGKYTIIAGSGE

SEQ ID NO: 2707565 - protein, 21 aa, Entamoeba histolytica
ALFLKTLLDKKYSLPYAALDA

SEQ ID NO: 2707566 - protein, 18 aa, Entamoeba histolytica
ALFQVPEPRFKTMKTHRI

SEQ ID NO: 2707567 - protein, 23 aa, Entamoeba histolytica
ALHCMIHLWDTIAADIVYLLPET

SEQ ID NO: 2707568 - protein, 19 aa, Entamoeba histolytica
ALICYIASGNVNKLIDIWI

SEQ ID NO: 2707569 - protein, 25 aa, Entamoeba histolytica
ALIDCNYDKNACAELLFMAQENGST

SEQ ID NO: 2707570 - protein, 20 aa, Entamoeba histolytica
ALIEGKWVVSKNWIINGMKK

SEQ ID NO: 2707571 - protein, 17 aa, Entamoeba histolytica
ALIELINTRFEDLVFLS

SEQ ID NO: 2707572 - protein, 21 aa, Entamoeba histolytica
ALIIVLQGVIRLYLNDRLHIS

SEQ ID NO: 2707573 - protein, 21 aa, Entamoeba histolytica
ALIKFCESFLFFVYSQNILTP

SEQ ID NO: 2707574 - protein, 17 aa, Entamoeba histolytica
ALIKYLNDIKLVSDIVV

SEQ ID NO: 2707575 - protein, 23 aa, Entamoeba histolytica
ALIQKMVDFFWNVGAPEVEIDRL

SEQ ID NO: 2707576 - protein, 20 aa, Entamoeba histolytica
ALIQLIPLIQNNNLSSLCAC

SEQ ID NO: 2707577 - protein, 28 aa, Entamoeba histolytica
ALIRKECFLFIFYSIQQHYIPLLDHLIQ

SEQ ID NO: 2707578 - protein, 18 aa, Entamoeba histolytica
ALKELYLHKVSDKVLNSA

SEQ ID NO: 2707579 - protein, 20 aa, Entamoeba histolytica
ALKGLVLYLNYKREFYETFI

SEQ ID NO: 2707580 - protein, 17 aa, Entamoeba histolytica
ALKNRGDMGQLFYWLLV

SEQ ID NO: 2707581 - protein, 39 aa, Entamoeba histolytica
ALKQYQTFFNFHYFNPPQTQFFFICFNTNNNVIVGAPTG

SEQ ID NO: 2707582 - protein, 27 aa, Entamoeba histolytica
ALKRKQSCIFFLYCSDPLQQKRNIETR

SEQ ID NO: 2707583 - protein, 22 aa, Entamoeba histolytica
ALKRRIYNGWTPLLYASSFGRK

SEQ ID NO: 2707584 - protein, 24 aa, Entamoeba histolytica
ALKRYGLENIPVDTFLTLGSLAEG

SEQ ID NO: 2707585 - protein, 23 aa, Entamoeba histolytica
ALKRYGVENIPVDTFLTLGSLAE

SEQ ID NO: 2707586 - protein, 31 aa, Entamoeba histolytica
ALKVLRNRPAYFRQGMLEIAVLQLLNEKFDI

SEQ ID NO: 2707587 - protein, 17 aa, Entamoeba histolytica
ALLCKRTGKSCNIISVP

SEQ ID NO: 2707588 - protein, 21 aa, Entamoeba histolytica
ALLKHLIRINPKLPLKENIGD

SEQ ID NO: 2707589 - protein, 25 aa, Entamoeba histolytica
ALLNRLDVLDKEKLAWWLCERQTVT

SEQ ID NO: 2707590 - protein, 21 aa, Entamoeba histolytica
ALLPYPECSLKFWDCSCDIEL

SEQ ID NO: 2707591 - protein, 17 aa, Entamoeba histolytica
ALLRCIISLQPQLCCFG

SEQ ID NO: 2707592 - protein, 20 aa, Entamoeba histolytica
ALLRSGRFDRKIEFPTPNEE

SEQ ID NO: 2707593 - protein, 37 aa, Entamoeba histolytica
ALLSFICVSPPLDYITILFYKSGPTYFQYHNALLDIV

SEQ ID NO: 2707594 - protein, 17 aa, Entamoeba histolytica
ALLVYDISRKESFEKIP

SEQ ID NO: 2707595 - protein, 28 aa, Entamoeba histolytica
ALMEKVMYEMYVIFFIRKGRTSTHFSYN

SEQ ID NO: 2707596 - protein, 20 aa, Entamoeba histolytica
ALMQALYKQVKLGVSISNGM

SEQ ID NO: 2707597 - protein, 19 aa, Entamoeba histolytica
ALMRPGRLDRKIEISLPND

SEQ ID NO: 2707598 - protein, 29 aa, Entamoeba histolytica
ALNKRSTIGRIFFWLIKSELHIPETQRRF

SEQ ID NO: 2707599 - protein, 18 aa, Entamoeba histolytica
ALNKVAIWAIGEYGDLLA

SEQ ID NO: 2707600 - protein, 24 aa, Entamoeba histolytica
ALNLITELIIIKQDLHIYAMSKES

SEQ ID NO: 2707601 - protein, 18 aa, Entamoeba histolytica
ALNVNSIIFFQCTFAKKT

SEQ ID NO: 2707602 - protein, 21 aa, Entamoeba histolytica
ALPIHDMFQALLTLINEVIPA

SEQ ID NO: 2707603 - protein, 17 aa, Entamoeba histolytica
ALQKKIETAGLVAKNAA

SEQ ID NO: 2707604 - protein, 24 aa, Entamoeba histolytica
ALRDPSLWRCIDAPHYRTGTQFKC

SEQ ID NO: 2707605 - protein, 21 aa, Entamoeba histolytica
ALRFMRIFDTSRTGHLNIYEF

SEQ ID NO: 2707606 - protein, 30 aa, Entamoeba histolytica; identical to SEQ ID NO: 2519110

SEQ ID NO: 2707607 - protein, 22 aa, Entamoeba histolytica
ALRRFGRFDREIDLGIPDTEGR

SEQ ID NO: 2707608 - protein, 19 aa, Entamoeba histolytica
ALRYFTVESVILMKSSIGL

SEQ ID NO: 2707609 - protein, 22 aa, Entamoeba histolytica
ALSDLIPYIMKIATKKLCLEEK

SEQ ID NO: 2707610 - protein, 23 aa, Entamoeba histolytica
ALSELHIDCNFNGKLIGVGEDPD

SEQ ID NO: 2707611 - protein, 22 aa, Entamoeba histolytica
ALSKPAFLSSPMFAGKQSSPYN

SEQ ID NO: 2707612 - protein, 28 aa, Entamoeba histolytica
ALSRLINHLLQLPKVVPFDFIVGGEFLR

SEQ ID NO: 2707613 - protein, 18 aa, Entamoeba histolytica
ALTFLLDGNNRFVEGKTI

SEQ ID NO: 2707614 - protein, 18 aa, Entamoeba histolytica
ALTFNWLVGYAEQNGYTV

SEQ ID NO: 2707615 - protein, 28 aa, Entamoeba histolytica
ALTFNYLIKLLESLGYFVSTRPTKSSKK

SEQ ID NO: 2707616 - protein, 24 aa, Entamoeba histolytica
ALTGWLAELCYLVNGALVLKGEFI

SEQ ID NO: 2707617 - protein, 27 aa, Entamoeba histolytica
ALTIPSTVLYLDNSVLFWGSKGGDSHL

SEQ ID NO: 2707618 - protein, 32 aa, Entamoeba histolytica
ALTLDPIDLLPYFLPLLNSLITSNPIFVKTVH

SEQ ID NO: 2707619 - protein, 18 aa, Entamoeba histolytica
ALTMQKFYSFLYTSKEPI

SEQ ID NO: 2707620 - protein, 27 aa, Entamoeba histolytica
ALTNSFLDILITDFHFEMKYSRTKGAT

SEQ ID NO: 2707621 - protein, 33 aa, Entamoeba histolytica
ALVDKKLEWPTYKRHFYLPYRLDVDLCYQAKSA

SEQ ID NO: 2707622 - protein, 18 aa, Entamoeba histolytica
ALVDLFSVYGSELAPLIP

SEQ ID NO: 2707623 - protein, 19 aa, Entamoeba histolytica
ALVNMKIINFKLSGNKFDN

SEQ ID NO: 2707624 - protein, 24 aa, Entamoeba histolytica
ALVNTFIHPLLLGLSNGSIYVFLF

SEQ ID NO: 2707625 - protein, 18 aa, Entamoeba histolytica
ALVNYKGILPGKKVVIQG

SEQ ID NO: 2707626 - protein, 18 aa, Entamoeba histolytica
ALYLINQLPFVNTMTKRL

SEQ ID NO: 2707627 - protein, 25 aa, Entamoeba histolytica
AMCHDLHMAIFLLDNIKVIDVRIGK

SEQ ID NO: 2707628 - protein, 23 aa, Entamoeba histolytica
AMDDIKLVFVHKSMRTEKVLDAI

SEQ ID NO: 2707629 - protein, 17 aa, Entamoeba histolytica
AMDLVRINELKIVGGGL

SEQ ID NO: 2707630 - protein, 19 aa, Entamoeba histolytica
AMFFNSNFDTKFKDLDFAK

SEQ ID NO: 2707631 - protein, 25 aa, Entamoeba histolytica
AMGALYLFPKITFPNKYIDECKRKD

SEQ ID NO: 2707632 - protein, 28 aa, Entamoeba histolytica
AMHRRALVILLCWTLDIPYSKASEINPK

SEQ ID NO: 2707633 - protein, 19 aa, Entamoeba histolytica
AMILPVKFIVNLAKHKQRV

SEQ ID NO: 2707634 - protein, 20 aa, Entamoeba histolytica
AMKLVYECKTLLPVIPSTCL

SEQ ID NO: 2707635 - protein, 17 aa, Entamoeba histolytica
AMKRRGEFMYGSRIRNS

SEQ ID NO: 2707636 - protein, 31 aa, Entamoeba histolytica
AMKSGEYRWCYESWIVLGFEALGLNKNSDAV

SEQ ID NO: 2707637 - protein, 29 aa, Entamoeba histolytica
AMKSHRTWFTLLLLSQSFRYFLSINSVNV

SEQ ID NO: 2707638 - protein, 22 aa, Entamoeba histolytica
AMKTINFLLKNYGGKVICLNGS

SEQ ID NO: 2707639 - protein, 17 aa, Entamoeba histolytica
AMKVICGVNKYVKWEEN

SEQ ID NO: 2707640 - protein, 31 aa, Entamoeba histolytica
AMLDKFRNEYIIQFYGAVFIPNKICMVTEYA

SEQ ID NO: 2707641 - protein, 26 aa, Entamoeba histolytica
AMLQGLSYFLMALPDSLIPSSRFYDV

SEQ ID NO: 2707642 - protein, 20 aa, Entamoeba histolytica
AMLTGRYVCYVNPTLPTYRF

SEQ ID NO: 2707643 - protein, 29 aa, Entamoeba histolytica
AMNRNVFIKKQLELLIPIIEARISDGCVI

SEQ ID NO: 2707644 - protein, 23 aa, Entamoeba histolytica
AMQHPFLLNKPLHPNYQPPHLPE

SEQ ID NO: 2707645 - protein, 27 aa, Entamoeba histolytica
AMQKYIMKIYLKIPHDKAWIIRREFVR

SEQ ID NO: 2707646 - protein, 17 aa, Entamoeba histolytica
AMRFALLAYMTQGHDIN

SEQ ID NO: 2707647 - protein, 37 aa, Entamoeba histolytica
AMRILQTWGPLYPNELYDYQLMYDKYISKGVYFPVLD

SEQ ID NO: 2707648 - protein, 20 aa, Entamoeba histolytica
AMRRLFYRFQMVGESQIVGR

SEQ ID NO: 2707649 - protein, 22 aa, Entamoeba histolytica
AMSMPGMMDTILNLGLNDKTVV

SEQ ID NO: 2707650 - protein, 20 aa, Entamoeba histolytica
AMSPYVEQLLTQLFNDLQSN

SEQ ID NO: 2707651 - protein, 25 aa, Entamoeba histolytica
AMSTCQYFFPEMSADFFPKVWALRD

SEQ ID NO: 2707652 - protein, 17 aa, Entamoeba histolytica
AMTIIAQIWLALNSLRN

SEQ ID NO: 2707653 - protein, 17 aa, Entamoeba histolytica
AMVFLKESPSQSLCYCH

SEQ ID NO: 2707654 - protein, 26 aa, Entamoeba histolytica
AMVLRTLYNILVKRIGNRKIGKVVIT

SEQ ID NO: 2707655 - protein, 22 aa, Entamoeba histolytica
AMVYIKYIEYVSNLFKTFVGIV

SEQ ID NO: 2707656 - protein, 26 aa, Entamoeba histolytica
ANAEELWNYVELFGSLELENGKEGSD

SEQ ID NO: 2707657 - protein, 25 aa, Entamoeba histolytica
ANAFKVLQSLTFSLLPPGDSVTADI

SEQ ID NO: 2707658 - protein, 26 aa, Entamoeba histolytica
ANALNKTITILNAQPPLKTESKTKEE

SEQ ID NO: 2707659 - protein, 18 aa, Entamoeba histolytica
ANCLLYEKGDVIIVNEMT

SEQ ID NO: 2707660 - protein, 26 aa, Entamoeba histolytica
ANDERIVMHLLWLMANIASDGVIPSE

SEQ ID NO: 2707661 - protein, 25 aa, Entamoeba histolytica
ANDSARNILPYISVFLVDDHKNVRN

SEQ ID NO: 2707662 - protein, 18 aa, Entamoeba histolytica
ANEKLPLKRTISITPSED

SEQ ID NO: 2707663 - protein, 24 aa, Entamoeba histolytica
ANELWKKYFFEQQTQKIKEMESVF

SEQ ID NO: 2707664 - protein, 24 aa, Entamoeba histolytica
ANETGVFLILINGPEIMSKMAGES

SEQ ID NO: 2707665 - protein, 19 aa, Entamoeba histolytica
ANEYFISGVKYLKFVDQST

SEQ ID NO: 2707666 - protein, 31 aa, Entamoeba histolytica
ANFPQPIFYTFNRTIILYLCLSSETQSIKIS

SEQ ID NO: 2707667 - protein, 27 aa, Entamoeba histolytica
ANGEIQQFLSLIFFIGQKSGTKIQKRR

SEQ ID NO: 2707668 - protein, 23 aa, Entamoeba histolytica
ANGKTFLYYACEKSYRGLVEMLI

SEQ ID NO: 2707669 - protein, 24 aa, Entamoeba histolytica
ANGLNPDPYYWYTQQRKYGSCPHG

SEQ ID NO: 2707670 - protein, 18 aa, Entamoeba histolytica
ANHFGVGIAFIRKSRSFE

SEQ ID NO: 2707671 - protein, 22 aa, Entamoeba histolytica
ANIFICLGPALRGCPFCFNYAT

SEQ ID NO: 2707672 - protein, 18 aa, Entamoeba histolytica
ANIFIHNMNVKIGDFGLA

SEQ ID NO: 2707673 - protein, 18 aa, Entamoeba histolytica
ANIPLTEYILIDSISVTI

SEQ ID NO: 2707674 - protein, 23 aa, Entamoeba histolytica
ANITNVIKIANIILSKGVTISES

SEQ ID NO: 2707675 - protein, 19 aa, Entamoeba histolytica
ANIVDLKKPLKVKFIGEEG

SEQ ID NO: 2707676 - protein, 19 aa, Entamoeba histolytica
ANKAALNKALCLSKGAHPE

SEQ ID NO: 2707677 - protein, 30 aa, Entamoeba histolytica
ANKESPYYRPLLPESAFDPIFQKAIQYAVG

SEQ ID NO: 2707678 - protein, 23 aa, Entamoeba histolytica
ANKFTFQIAFYERMKDLEKYGAR

SEQ ID NO: 2707679 - protein, 25 aa, Entamoeba histolytica
ANKTQIFKFPAFKNLQIAVDKLKEL

SEQ ID NO: 2707680 - protein, 27 aa, Entamoeba histolytica
ANLEEKLIIDWFGRFGIEVGDFKTSFN

SEQ ID NO: 2707681 - protein, 17 aa, Entamoeba histolytica
ANLGLFQTLIGFFSQFS

SEQ ID NO: 2707682 - protein, 20 aa, Entamoeba histolytica
ANLPTLIQRSNLLDIQDVEL

SEQ ID NO: 2707683 - protein, 29 aa, Entamoeba histolytica
ANNGKLEPRFIFEGEIFLAAGEKALLVPI

SEQ ID NO: 2707684 - protein, 23 aa, Entamoeba histolytica
ANNKVIIYTLMDFDMISRYKGIT

SEQ ID NO: 2707685 - protein, 28 aa, Entamoeba histolytica
ANNQLLGCFVPHHLCIDNAIHTFAGPQL

SEQ ID NO: 2707686 - protein, 17 aa, Entamoeba histolytica
ANPPYYNKLLAEAKEQH

SEQ ID NO: 2707687 - protein, 25 aa, Entamoeba histolytica
ANQDTLWFILHFLKKVVHNSEKNKM

SEQ ID NO: 2707688 - protein, 24 aa, Entamoeba histolytica
ANQGKMVLLVGLEGFLACIEYSNE

SEQ ID NO: 2707689 - protein, 27 aa, Entamoeba histolytica
ANQLLLEHFPLLKDNLITCSLCFCCFS

SEQ ID NO: 2707690 - protein, 31 aa, Entamoeba histolytica; identical to SEQ ID NO: 2519183

SEQ ID NO: 2707691 - protein, 28 aa, Entamoeba histolytica
ANRDWVNMRSWWFNEDKSLYIIMNHSVE

SEQ ID NO: 2707692 - protein, 29 aa, Entamoeba histolytica
ANSKFAIVLALIQKLYPRVYPQIVLDSKS

SEQ ID NO: 2707693 - protein, 19 aa, Entamoeba histolytica
ANSKYRFDYVIEKEQQTAQ

SEQ ID NO: 2707694 - protein, 29 aa, Entamoeba histolytica
ANSYRWCMEVFDYLNIAALIDGKIFCVHG

SEQ ID NO: 2707695 - protein, 24 aa, Entamoeba histolytica
ANTNELIYNLKEDIKTKDNIIIGL

SEQ ID NO: 2707696 - protein, 26 aa, Entamoeba histolytica
ANTNKRICLLFFTDKGFIFGVCHKRI

SEQ ID NO: 2707697 - protein, 26 aa, Entamoeba histolytica
ANTQFRVTYLLNCVVIPWLHETNVDI

SEQ ID NO: 2707698 - protein, 25 aa, Entamoeba histolytica
ANVKVEGFWPIVMAKALANADIEDL

SEQ ID NO: 2707699 - protein, 22 aa, Entamoeba histolytica
ANVLKKFLRNLPVHIIDNEITQ

SEQ ID NO: 2707700 - protein, 21 aa, Entamoeba histolytica
ANVVIPLNLQFDKNGICNISI

SEQ ID NO: 2707701 - protein, 24 aa, Entamoeba histolytica
ANVYGYFTMFKVDNGFCYLSCPDC

SEQ ID NO: 2707702 - protein, 26 aa, Entamoeba histolytica
ANYNIPIMIMFPYDYPMKPPFFFTDP

SEQ ID NO: 2707703 - protein, 18 aa, Entamoeba histolytica
APAFSIFDIKWDDQSYLN

SEQ ID NO: 2707704 - protein, 30 aa, Entamoeba histolytica; identical to SEQ ID NO: 2519199

SEQ ID NO: 2707705 - protein, 17 aa, Entamoeba histolytica
APCYILIDSLHSEFMED

SEQ ID NO: 2707706 - protein, 20 aa, Entamoeba histolytica
APCYTSLLKEYYLNCYVPSI

SEQ ID NO: 2707707 - protein, 22 aa, Entamoeba histolytica
APDGFILIHLPHHSISGTHLHI

SEQ ID NO: 2707708 - protein, 22 aa, Entamoeba histolytica
APEEFFKPLASFIESWKNARKD

SEQ ID NO: 2707709 - protein, 27 aa, Entamoeba histolytica
APEGYCGALYAAIQILGEDKKEACISK

SEQ ID NO: 2707710 - protein, 28 aa, Entamoeba histolytica
APEVVGKEQVLIQPLTTTQQPLSEIIDK

SEQ ID NO: 2707711 - protein, 28 aa, Entamoeba histolytica
APFNILIINNKCIFTMYLYTHPGTGAWG

SEQ ID NO: 2707712 - protein, 18 aa, Entamoeba histolytica
APFPQFHFMEEVRSFILS

SEQ ID NO: 2707713 - protein, 30 aa, Entamoeba histolytica
APGLALIVRCYPGFQATIIYRVAHILYECG

SEQ ID NO: 2707714 - protein, 30 aa, Entamoeba histolytica
APIEKIKLIGNQVWILQKTGDIKIYDSEKL

SEQ ID NO: 2707715 - protein, 18 aa, Entamoeba histolytica
APIFFKYGNKRLQEIKEI

SEQ ID NO: 2707716 - protein, 27 aa, Entamoeba histolytica
APIKYNVLIFNLFYKQIPPYISTEHDQ

SEQ ID NO: 2707717 - protein, 21 aa, Entamoeba histolytica
APISQPLLPQVPAPVVQPVMP

SEQ ID NO: 2707718 - protein, 31 aa, Entamoeba histolytica; identical to SEQ ID NO: 2519208

SEQ ID NO: 2707719 - protein, 25 aa, Entamoeba histolytica
APKSYDLIVEVLETLPLIEDNSSRS

SEQ ID NO: 2707720 - protein, 36 aa, Entamoeba histolytica
APLGPEFYYNLYLFPYLVFIGFTRCHLPISGVSAQT

SEQ ID NO: 2707721 - protein, 18 aa, Entamoeba histolytica
APLLLMPGHDELTFLIPE

SEQ ID NO: 2707722 - protein, 20 aa, Entamoeba histolytica
APLSSIVFGPDYLGVIISQQ

SEQ ID NO: 2707723 - protein, 27 aa, Entamoeba histolytica
APMDAFLCIRGVKTLPMRMKVHMENGL

SEQ ID NO: 2707724 - protein, 23 aa, Entamoeba histolytica
APMMDNIPPPPPVAPAIGNPPPP

SEQ ID NO: 2707725 - protein, 35 aa, Entamoeba histolytica
APPTPSKCAPPLPTKNAPPVPQKKVAPPPGHPTIS

SEQ ID NO: 2707726 - protein, 17 aa, Entamoeba histolytica
APQLPKAYGFHVCVTKW

SEQ ID NO: 2707727 - protein, 21 aa, Entamoeba histolytica
APRALRIQLVNKFKSYFNKII

SEQ ID NO: 2707728 - protein, 17 aa, Entamoeba histolytica
APRGMPRGGPRGAPRGA

SEQ ID NO: 2707729 - protein, 29 aa, Entamoeba histolytica
APSLIVTNLLPMPFSLKTPTSVFPVRSLS

SEQ ID NO: 2707730 - protein, 26 aa, Entamoeba histolytica
APSLPPPVPPPRGGAPALPPPRRGTK

SEQ ID NO: 2707731 - protein, 28 aa, Entamoeba histolytica
APTGHTLRFLSLPTLLRDMLEKVIKLQD

SEQ ID NO: 2707732 - protein, 39 aa, Entamoeba histolytica
APTQQMFDMSLFPQSFIQFLAWQRLMQIYSKLDANNIEM

SEQ ID NO: 2707733 - protein, 18 aa, Entamoeba histolytica
APVLLTCYTQLLSDNKAL

SEQ ID NO: 2707734 - protein, 17 aa, Entamoeba histolytica
APYCLPLIPKTVEWLNT

SEQ ID NO: 2707735 - protein, 17 aa, Entamoeba histolytica
APYSQIYKWIPEHYSID

SEQ ID NO: 2707736 - protein, 18 aa, Entamoeba histolytica
AQAKGIRIMAIKALTDIS

SEQ ID NO: 2707737 - protein, 22 aa, Entamoeba histolytica
AQDILKLRMSFQDTPLGMINTA

SEQ ID NO: 2707738 - protein, 26 aa, Entamoeba histolytica
AQELERLLMIQKNALARLQKKKIFIR

SEQ ID NO: 2707739 - protein, 18 aa, Entamoeba histolytica
AQFAYLPKEFMKPYVMVF

SEQ ID NO: 2707740 - protein, 21 aa, Entamoeba histolytica
AQFHDIEKPLRFICNDSYKQG

SEQ ID NO: 2707741 - protein, 24 aa, Entamoeba histolytica
AQFIQGLILFMKRLQQLKDIHFLV

SEQ ID NO: 2707742 - protein, 24 aa, Entamoeba histolytica
AQGRLDSFFNVKKVPLSKSEAASG

SEQ ID NO: 2707743 - protein, 22 aa, Entamoeba histolytica
AQGYHLLLPLTLQCLQMIVPFK

SEQ ID NO: 2707744 - protein, 19 aa, Entamoeba histolytica
AQIFDHKVLVLPASQRDPF

SEQ ID NO: 2707745 - protein, 20 aa, Entamoeba histolytica
AQIIIVIGKLTIPIGKWPAL

SEQ ID NO: 2707746 - protein, 34 aa, Entamoeba histolytica
AQIPLGLEKALKYLFLNGLNKEGLFRLSSTPDKL

SEQ ID NO: 2707747 - protein, 28 aa, Entamoeba histolytica
AQIQSQLKDILIIPHFSQDNLVLVDVIS

SEQ ID NO: 2707748 - protein, 24 aa, Entamoeba histolytica
AQISSLCRLILSKGYRTTKGFCDL

SEQ ID NO: 2707749 - protein, 17 aa, Entamoeba histolytica
AQKALERTSLHEPVFGI

SEQ ID NO: 2707750 - protein, 20 aa, Entamoeba histolytica
AQKFFKKKGMTLKMAGERTN

SEQ ID NO: 2707751 - protein, 20 aa, Entamoeba histolytica
AQKIPLFIAAGCDSTFKIVA

SEQ ID NO: 2707752 - protein, 19 aa, Entamoeba histolytica
AQKRVPLMTIKQVEDKEKE

SEQ ID NO: 2707753 - protein, 37 aa, Entamoeba histolytica
AQKVIEQIFLHLQFPQIKLLNPFYTMKKNIHKIKGNI

SEQ ID NO: 2707754 - protein, 23 aa, Entamoeba histolytica
AQKYLDIPLGLVYQPLHGHISTN

SEQ ID NO: 2707755 - protein, 18 aa, Entamoeba histolytica
AQLFTPQYGDIYIEFLKL

SEQ ID NO: 2707756 - protein, 17 aa, Entamoeba histolytica
AQLIGQYEQLEAKKQEE

SEQ ID NO: 2707757 - protein, 28 aa, Entamoeba histolytica
AQLKASIKNVLFSLPLNTIVVTGHGSNT

SEQ ID NO: 2707758 - protein, 34 aa, Entamoeba histolytica
AQLSKRKYDKLIAYIYLLLSFFPSDNETTINTNQ

SEQ ID NO: 2707759 - protein, 25 aa, Entamoeba histolytica
AQMKEKLLRLNKLCGASVVGEGGEF

SEQ ID NO: 2707760 - protein, 25 aa, Entamoeba histolytica
AQPKGVLLYGPPGTGKTLLARAVAH

SEQ ID NO: 2707761 - protein, 26 aa, Entamoeba histolytica
AQQDTPFGMLALPAAPGMMPMQQPMG

SEQ ID NO: 2707762 - protein, 27 aa, Entamoeba histolytica
AQSKNNIYLPYLINTSLIAFDRFIISG

SEQ ID NO: 2707763 - protein, 34 aa, Entamoeba histolytica
AQSPNEMLNTLNYLSQFLLTCVTTLIGESVTFLK

SEQ ID NO: 2707764 - protein, 30 aa, Entamoeba histolytica
AQTLRVYLNYILRCPYFVDHFPVFSQSKEL

SEQ ID NO: 2707765 - protein, 24 aa, Entamoeba histolytica
AQVCGHIFSKQAIYNLIGRNKTIK

SEQ ID NO: 2707766 - protein, 20 aa, Entamoeba histolytica
AQVIYIIVNSLFQILEKDDT

SEQ ID NO: 2707767 - protein, 24 aa, Entamoeba histolytica
AQVKFPFELSPPIQKLTFGHQYAV

SEQ ID NO: 2707768 - protein, 26 aa, Entamoeba histolytica
AQYKKVLNQWLSKGGYFIITSCNWTE

SEQ ID NO: 2707769 - protein, 23 aa, Entamoeba histolytica
ARAKMIKWNLGKLPNQLTDNDFK

SEQ ID NO: 2707770 - protein, 18 aa, Entamoeba histolytica
ARATFFEPMYKKMRLFSQ

SEQ ID NO: 2707771 - protein, 20 aa, Entamoeba histolytica
ARAVLIIGAPYLQSEILTIK

SEQ ID NO: 2707772 - protein, 26 aa, Entamoeba histolytica
ARDAYRRFIQNYNTLKLGNIFQLSKL

SEQ ID NO: 2707773 - protein, 17 aa, Entamoeba histolytica
ARDIYLEFCSIKGISYV

SEQ ID NO: 2707774 - protein, 27 aa, Entamoeba histolytica
AREDRNYHIFYQLLAGATAQQKSEMHL

SEQ ID NO: 2707775 - protein, 23 aa, Entamoeba histolytica
AREYANATLLRNLAKGAVEYSKE

SEQ ID NO: 2707776 - protein, 26 aa, Entamoeba histolytica
ARFFSRQRELVISKPNALFVDAKQKI

SEQ ID NO: 2707777 - protein, 28 aa, Entamoeba histolytica
ARFGGPERYYAFPGFLTCLYKTITIGTT

SEQ ID NO: 2707778 - protein, 24 aa, Entamoeba histolytica
ARGNFSRILLLDERFLSILIHFYT

SEQ ID NO: 2707779 - protein, 26 aa, Entamoeba histolytica
ARGNIQQFLSLVFFIAKKSNTRIEKK

SEQ ID NO: 2707780 - protein, 20 aa, Entamoeba histolytica
ARIHGVLLEKMVGFKYECII

SEQ ID NO: 2707781 - protein, 21 aa, Entamoeba histolytica
ARKIWCFGPDNCGPNLFVDVT

SEQ ID NO: 2707782 - protein, 25 aa, Entamoeba histolytica
ARQMTLIIHTAFSKIKLYEFFKWTN

SEQ ID NO: 2707783 - protein, 23 aa, Entamoeba histolytica
ARRFHKYISLYLNQFKTRNDETL

SEQ ID NO: 2707784 - protein, 25 aa, Entamoeba histolytica
ARSLKWLCQCIYYNELIIPDEEGKS

SEQ ID NO: 2707785 - protein, 17 aa, Entamoeba histolytica
ARTLLFNIYEKKWDDEL

SEQ ID NO: 2707786 - protein, 26 aa, Entamoeba histolytica
ARTLSLFIKFLLFQNSLNEPYHGGLG

SEQ ID NO: 2707787 - protein, 27 aa, Entamoeba histolytica
ARVTSIPTVLVLNPGSWNALQRTAKEF

SEQ ID NO: 2707788 - protein, 26 aa, Entamoeba histolytica
ARYFNDQIIPILKKNASEYPRMVSNF

SEQ ID NO: 2707789 - protein, 23 aa, Entamoeba histolytica
ASADLIWDLFREANTITPSKVSP

SEQ ID NO: 2707790 - protein, 20 aa, Entamoeba histolytica
ASADRTIKIWKVKQNYSLVQ

SEQ ID NO: 2707791 - protein, 25 aa, Entamoeba histolytica
ASDDGTLYMWMPLQSQKPVHRLVGH

SEQ ID NO: 2707792 - protein, 26 aa, Entamoeba histolytica
ASDDGTLYMWVPLQSQKPVHRLVGHS

SEQ ID NO: 2707793 - protein, 19 aa, Entamoeba histolytica
ASDFILLVKVIARYCEFIE

SEQ ID NO: 2707794 - protein, 35 aa, Entamoeba histolytica
ASDIWSCGVMLYNMLFLFPFKKPKNMYELQITDDT

SEQ ID NO: 2707795 - protein, 22 aa, Entamoeba histolytica
ASDLHENALKWGHSNPQLVIQT

SEQ ID NO: 2707796 - protein, 25 aa, Entamoeba histolytica
ASDLKSIFYPFAQPCLEVVLKLVQD

SEQ ID NO: 2707797 - protein, 25 aa, Entamoeba histolytica
ASDVIMIMFKLFGQSMSDYFVQIFQ

SEQ ID NO: 2707798 - protein, 19 aa, Entamoeba histolytica
ASEFISIFENVLSVQVLSM

SEQ ID NO: 2707799 - protein, 26 aa, Entamoeba histolytica
ASEGLQMILIINKIDRLVFEKNFSIE

SEQ ID NO: 2707800 - protein, 23 aa, Entamoeba histolytica
ASERLRGIVPKKITVEPITNKEL

SEQ ID NO: 2707801 - protein, 26 aa, Entamoeba histolytica
ASEWNELLINMFTLGNDLDIEILKNT

SEQ ID NO: 2707802 - protein, 24 aa, Entamoeba histolytica
ASFAPYCLPLIPKTVEWLNTELPP

SEQ ID NO: 2707803 - protein, 17 aa, Entamoeba histolytica
ASFLCKVHYSYFSGSKD

SEQ ID NO: 2707804 - protein, 24 aa, Entamoeba histolytica
ASGAMSWIMKYPGGYIKVIDLVTQ

SEQ ID NO: 2707805 - protein, 23 aa, Entamoeba histolytica
ASGIRFWEHLFPGSKTMKREARR

SEQ ID NO: 2707806 - protein, 30 aa, Entamoeba histolytica
ASGKYTPYCQYMFYDCLEILPDNYLELPKE

SEQ ID NO: 2707807 - protein, 30 aa, Entamoeba histolytica
ASGRADVYLRLPRNLSYQEKIWDHAAGYLI

SEQ ID NO: 2707808 - protein, 26 aa, Entamoeba histolytica
ASIAPVKVGLFPLLTKLEFNNKIAEI

SEQ ID NO: 2707809 - protein, 21 aa, Entamoeba histolytica
ASIELTYVLPKEFPINQITEP

SEQ ID NO: 2707810 - protein, 17 aa, Entamoeba histolytica
ASIIVLGNKLDLAYEYG

SEQ ID NO: 2707811 - protein, 19 aa, Entamoeba histolytica
ASILFIDKYFRINPNQKTI

SEQ ID NO: 2707812 - protein, 31 aa, Entamoeba histolytica
ASIPNSHYNLFIYLLSFIKEILRQNSSLHPE

SEQ ID NO: 2707813 - protein, 29 aa, Entamoeba histolytica
ASIRQISPFIFTKTKFPVLKKLDLQHNCI

SEQ ID NO: 2707814 - protein, 18 aa, Entamoeba histolytica
ASKGTWAATTDSGITAPC

SEQ ID NO: 2707815 - protein, 24 aa, Entamoeba histolytica
ASKKLFIPQFVPTIKVLPELLNPP

SEQ ID NO: 2707816 - protein, 38 aa, Entamoeba histolytica
ASKTPQKTFKPAKQQGKIAILTKQLAGGFDTKQSSFEI

SEQ ID NO: 2707817 - protein, 20 aa, Entamoeba histolytica
ASLILQYYYAHGKVLELLLW

SEQ ID NO: 2707818 - protein, 21 aa, Entamoeba histolytica
ASLIPPFMIDLLRKSRSTAAL

SEQ ID NO: 2707819 - protein, 17 aa, Entamoeba histolytica
ASLKAWLKKSLDETARK

SEQ ID NO: 2707820 - protein, 23 aa, Entamoeba histolytica
ASMKIYLEYFGFNVIYEESNSEY

SEQ ID NO: 2707821 - protein, 23 aa, Entamoeba histolytica
ASNILRALSYFNGTFGFYLIGEI

SEQ ID NO: 2707822 - protein, 23 aa, Entamoeba histolytica
ASNRQMKLISRQFDINSIEDVQD

SEQ ID NO: 2707823 - protein, 23 aa, Entamoeba histolytica
ASNVLFIIIELKDNIFKLKGNEL

SEQ ID NO: 2707824 - protein, 28 aa, Entamoeba histolytica
ASQMLELELGLLILKIGLNGTKTLILIG

SEQ ID NO: 2707825 - protein, 27 aa, Entamoeba histolytica
ASRNDGYISYWRLFRNGRWKPVKEVKC

SEQ ID NO: 2707826 - protein, 26 aa, Entamoeba histolytica
ASSEKIWIYPYIKDADFVYSTFLTTE

SEQ ID NO: 2707827 - protein, 23 aa, Entamoeba histolytica
ASSGKIVAAPPPLKKKRVTKPKT

SEQ ID NO: 2707828 - protein, 23 aa, Entamoeba histolytica
ASTEFIQIFAFTGNLLCQSTYIV

SEQ ID NO: 2707829 - protein, 28 aa, Entamoeba histolytica
ASTIYISVLPAVRKLLTKYPKYKVLCTG

SEQ ID NO: 2707830 - protein, 26 aa, Entamoeba histolytica
ASTLMPSLLIIFRITQDRVGAKKCSS

SEQ ID NO: 2707831 - protein, 29 aa, Entamoeba histolytica
ASTMIQNLQIIIPELIKEIRDELIKIIDC

SEQ ID NO: 2707832 - protein, 24 aa, Entamoeba histolytica
ASTMLFQLIILPKTTFQFKKQITK

SEQ ID NO: 2707833 - protein, 32 aa, Entamoeba histolytica
ASVLSSFILYCSQFFIFDSKYQTLMLRPKAPV

SEQ ID NO: 2707834 - protein, 17 aa, Entamoeba histolytica
ASVSKPFFPIETIQFND

SEQ ID NO: 2707835 - protein, 25 aa, Entamoeba histolytica
ASVYWLERMILSGEKLSYITRRMLR

SEQ ID NO: 2707836 - protein, 26 aa, Entamoeba histolytica
ASYGNYLPQLLHLAASLLFVSNDESM

SEQ ID NO: 2707837 - protein, 41 aa, Entamoeba histolytica
ASYTPQILIYKKLPLFNVPRLPYPLSYIPLMKEVIINQGDI

SEQ ID NO: 2707838 - protein, 20 aa, Entamoeba histolytica
ATAFMFPEIPKEVLDSCLGS

SEQ ID NO: 2707839 - protein, 28 aa, Entamoeba histolytica
ATASLDCKVILWDIITGKQIGVLDHSLP

SEQ ID NO: 2707840 - protein, 28 aa, Entamoeba histolytica
ATDHPTLISLFIKPTIEILFHYATMISD

SEQ ID NO: 2707841 - protein, 38 aa, Entamoeba histolytica
ATDKIKSMMFNDLNVPFLKIVNPALMALYAEGKETGVV

SEQ ID NO: 2707842 - protein, 22 aa, Entamoeba histolytica
ATDLKIHMLYHSDEKPFQCPFP

SEQ ID NO: 2707843 - protein, 29 aa, Entamoeba histolytica
ATDRLRFERRPRLRATFLEDSAHKRINDM

SEQ ID NO: 2707844 - protein, 25 aa, Entamoeba histolytica
ATEDVLLLDVAPLTLGIETAGGVMT

SEQ ID NO: 2707845 - protein, 24 aa, Entamoeba histolytica
ATERLMNVLAFCGLEQTIKSEFNK

SEQ ID NO: 2707846 - protein, 31 aa, Entamoeba histolytica
ATFNLGMNLLKFTRLWNGKGYIYMYVTVEGS

SEQ ID NO: 2707847 - protein, 25 aa, Entamoeba histolytica
ATGDDWMDKSLLPKILQTKDWGKKG

SEQ ID NO: 2707848 - protein, 26 aa, Entamoeba histolytica
ATGVPPPPPPPGMPGAPPPPPPMGKG

SEQ ID NO: 2707849 - protein, 27 aa, Entamoeba histolytica
ATIGGLRIIGRLAVGNRKGLLLPNTCN

SEQ ID NO: 2707850 - protein, 30 aa, Entamoeba histolytica
ATIIKRLCRILIIPYYMVKSFFVRGDFTKE

SEQ ID NO: 2707851 - protein, 25 aa, Entamoeba histolytica
ATIQYFTDFFILNPSTSQPKDVLSE

SEQ ID NO: 2707852 - protein, 24 aa, Entamoeba histolytica
ATKFPQILYNFLKTQNIKTAFFQA

SEQ ID NO: 2707853 - protein, 27 aa, Entamoeba histolytica
ATKNILITLQKWLMEDPFQFTRVEGTL

SEQ ID NO: 2707854 - protein, 23 aa, Entamoeba histolytica
ATKVHLHYLYFTSLVMSDNFESR

SEQ ID NO: 2707855 - protein, 24 aa, Entamoeba histolytica
ATLGIEVLWVHKASRRKKVASHLL

SEQ ID NO: 2707856 - protein, 24 aa, Entamoeba histolytica
ATLKKFMRDLPEPIFPSSAYKEII

SEQ ID NO: 2707857 - protein, 26 aa, Entamoeba histolytica
ATLKWIPEILNLPLLNTIKLNNCECI

SEQ ID NO: 2707858 - protein, 21 aa, Entamoeba histolytica
ATLQMFIQNLVSAKLEFAKTQ

SEQ ID NO: 2707859 - protein, 32 aa, Entamoeba histolytica
ATLQPPILVFDILQLKFKGLLISTRKYSFEMN

SEQ ID NO: 2707860 - protein, 20 aa, Entamoeba histolytica
ATLTNLIVRCYLATSQYSVC

SEQ ID NO: 2707861 - protein, 25 aa, Entamoeba histolytica
ATNNSLICMLEQLGWKIVLKNTKNS

SEQ ID NO: 2707862 - protein, 36 aa, Entamoeba histolytica
ATNPFLVDLICSFIKKYKHFGNIFDFISSVTAIVSP

SEQ ID NO: 2707863 - protein, 19 aa, Entamoeba histolytica
ATNRQFLEDLLSAARAAGI

SEQ ID NO: 2707864 - protein, 32 aa, Entamoeba histolytica
ATNRSCLSCLISVRDIHLLTCGDLGINCDDYV

SEQ ID NO: 2707865 - protein, 32 aa, Entamoeba histolytica
ATPDEYRRLFFYLISFLKKLIEMGEDKIILVT

SEQ ID NO: 2707866 - protein, 24 aa, Entamoeba histolytica
ATPPFYDLLGHLNPFMHNNRLIQC

SEQ ID NO: 2707867 - protein, 26 aa, Entamoeba histolytica
ATQENFTLNHLLFLIPNSISEFSSAL

SEQ ID NO: 2707868 - protein, 18 aa, Entamoeba histolytica
ATQMKYALVWGTSVKHSP

SEQ ID NO: 2707869 - protein, 27 aa, Entamoeba histolytica
ATQTIEPMLLIPILRFNPKCIVCVGDP

SEQ ID NO: 2707870 - protein, 26 aa, Entamoeba histolytica
ATQTLRPLPAKPLLPAKPIRSDNVNT

SEQ ID NO: 2707871 - protein, 20 aa, Entamoeba histolytica
ATSFAQCSLIPGAPSIFLYS

SEQ ID NO: 2707872 - protein, 24 aa, Entamoeba histolytica
ATSKIFNLLINKRGVHQKPVDVKL

SEQ ID NO: 2707873 - protein, 24 aa, Entamoeba histolytica
ATSLATHLVYSKGLGWHVSIIDIL

SEQ ID NO: 2707874 - protein, 19 aa, Entamoeba histolytica
ATSLGYSYLTFKKKNFYGT

SEQ ID NO: 2707875 - protein, 17 aa, Entamoeba histolytica
ATSLLTMAGLKVPIITV

SEQ ID NO: 2707876 - protein, 35 aa, Entamoeba histolytica; identical to SEQ ID NO: 2519383

SEQ ID NO: 2707877 - protein, 17 aa, Entamoeba histolytica
ATSYIKQGQEIKLALWD

SEQ ID NO: 2707878 - protein, 23 aa, Entamoeba histolytica
ATTERYIFLYHQDLNYQSIVSYN

SEQ ID NO: 2707879 - protein, 25 aa, Entamoeba histolytica
ATTISFMIPYDIRKFLPKIQKESIG

SEQ ID NO: 2707880 - protein, 28 aa, Entamoeba histolytica
ATTPKWSSVNLGIFICIRCAGIHRSMGT

SEQ ID NO: 2707881 - protein, 29 aa, Entamoeba histolytica
ATTRSLILSKYPLYPVHSYIPHSTIYGRP

SEQ ID NO: 2707882 - protein, 24 aa, Entamoeba histolytica
ATVASAIPGVNAIAAPVAAAAKTI

SEQ ID NO: 2707883 - protein, 19 aa, Entamoeba histolytica
ATVLYLGCEIVKIAYVGDC

SEQ ID NO: 2707884 - protein, 25 aa, Entamoeba histolytica
ATVQLDFQLPLRFKLDYMSEDPNQP

SEQ ID NO: 2707885 - protein, 22 aa, Entamoeba histolytica
ATVTTQFFRVGTLKFSNNQVID

SEQ ID NO: 2707886 - protein, 24 aa, Entamoeba histolytica
AVAFDMPIPGYKTLNTLNLRLWSS

SEQ ID NO: 2707887 - protein, 25 aa, Entamoeba histolytica
AVAFSLNIDLWHVHSFMGRPKKEWL

SEQ ID NO: 2707888 - protein, 23 aa, Entamoeba histolytica
AVAILMTICEMYKNKEVPVVIVF

SEQ ID NO: 2707889 - protein, 25 aa, Entamoeba histolytica
AVAKGAAYLAYLKKENAASTTIVYD

SEQ ID NO: 2707890 - protein, 24 aa, Entamoeba histolytica
AVAKGAAYLAYLKQDSIDSNKIVY

SEQ ID NO: 2707891 - protein, 25 aa, Entamoeba histolytica
AVASVILMFLRELPEPLITFESYDL

SEQ ID NO: 2707892 - protein, 26 aa, Entamoeba histolytica
AVAVLLALLYLGIKNIRIGPSAPAFL

SEQ ID NO: 2707893 - protein, 17 aa, Entamoeba histolytica
AVAWAIAQGKLYHKQTG

SEQ ID NO: 2707894 - protein, 21 aa, Entamoeba histolytica
AVCDIPPKGLNLSGTFIGNST

SEQ ID NO: 2707895 - protein, 24 aa, Entamoeba histolytica
AVDLLQKMFIYTPEKRISAADALK

SEQ ID NO: 2707896 - protein, 30 aa, Entamoeba histolytica; identical to SEQ ID NO: 2519400

SEQ ID NO: 2707897 - protein, 29 aa, Entamoeba histolytica
AVEAFARALRQLPMIIADNAGYDSADLVA

SEQ ID NO: 2707898 - protein, 18 aa, Entamoeba histolytica
AVEILISMIHHPLHSKAP

SEQ ID NO: 2707899 - protein, 27 aa, Entamoeba histolytica
AVEKNELGKWFKIKIMTFKDGGNVTLD

SEQ ID NO: 2707900 - protein, 26 aa, Entamoeba histolytica
AVEQIQQIMIWLIKNGFKHVSELHNG

SEQ ID NO: 2707901 - protein, 30 aa, Entamoeba histolytica
AVEYKKIITQDIVGLLGSLDLDTIRNDLQE

SEQ ID NO: 2707902 - protein, 27 aa, Entamoeba histolytica
AVGATLPYLGMFLTDLLFTEDMTSSAV

SEQ ID NO: 2707903 - protein, 25 aa, Entamoeba histolytica
AVGKSCLLLQFQDKRFQPIHDLTIG

SEQ ID NO: 2707904 - protein, 24 aa, Entamoeba histolytica
AVGTTYGFIVFSIKNGEFTKRFHR

SEQ ID NO: 2707905 - protein, 20 aa, Entamoeba histolytica
AVHSKQFKAFTSGLAKGTKS

SEQ ID NO: 2707906 - protein, 17 aa, Entamoeba histolytica
AVIEPLMKHLRVCQDDT

SEQ ID NO: 2707907 - protein, 19 aa, Entamoeba histolytica
AVIIKYVKAFVTIQFEEHT

SEQ ID NO: 2707908 - protein, 26 aa, Entamoeba histolytica
AVIKDYLRLLPNPLIPYNLYEEFIEL

SEQ ID NO: 2707909 - protein, 21 aa, Entamoeba histolytica
AVIPTQKYFAGSRPTFARCVN

SEQ ID NO: 2707910 - protein, 24 aa, Entamoeba histolytica
AVISSWDLTLKHLVDWKVFDKIKS

SEQ ID NO: 2707911 - protein, 27 aa, Entamoeba histolytica
AVIYQMPAWWMGEPWIVKKYIDEVFGL

SEQ ID NO: 2707912 - protein, 18 aa, Entamoeba histolytica
AVKLKYINRLCSLFIHTD

SEQ ID NO: 2707913 - protein, 36 aa, Entamoeba histolytica
AVKLPLDYRVAKLVFFGLYFGVFTETARIAALFGIN

SEQ ID NO: 2707914 - protein, 23 aa, Entamoeba histolytica
AVKPSLLHVLYYDGVYMGDDRSL

SEQ ID NO: 2707915 - protein, 25 aa, Entamoeba histolytica
AVKQYPLFDYVLFLEDDQAFYKNAF

SEQ ID NO: 2707916 - protein, 18 aa, Entamoeba histolytica
AVLFIKTNPLILPTKENR

SEQ ID NO: 2707917 - protein, 19 aa, Entamoeba histolytica
AVLPSNYFYARLTFGKTKE

SEQ ID NO: 2707918 - protein, 19 aa, Entamoeba histolytica
AVLTPTKLVDFIVTKMKTL

SEQ ID NO: 2707919 - protein, 19 aa, Entamoeba histolytica
AVMHITKMMALQYAPNIRI

SEQ ID NO: 2707920 - protein, 34 aa, Entamoeba histolytica
AVMLDSVLFCHQEDSFWPFEEPKKLKEKFDDVFG

SEQ ID NO: 2707921 - protein, 22 aa, Entamoeba histolytica
AVNDLFSKLSFPKKFQPSKDVQ

SEQ ID NO: 2707922 - protein, 24 aa, Entamoeba histolytica
AVNLGYRGYAAKVIIWIADAPPHG

SEQ ID NO: 2707923 - protein, 25 aa, Entamoeba histolytica
AVNMNPYPRLHFFSSSIAPVSNALS

SEQ ID NO: 2707924 - protein, 25 aa, Entamoeba histolytica
AVNNPLLWKSYGSYETFNCGKIYGT

SEQ ID NO: 2707925 - protein, 19 aa, Entamoeba histolytica
AVPLLIDFSGYKMIFKLGD

SEQ ID NO: 2707926 - protein, 25 aa, Entamoeba histolytica
AVQDKHMFAFTLSNPFNVPTQKYNW

SEQ ID NO: 2707927 - protein, 19 aa, Entamoeba histolytica
AVQIPHFCYGRVAPGSSLA

SEQ ID NO: 2707928 - protein, 17 aa, Entamoeba histolytica
AVQIPHFCYGRVAPRSS

SEQ ID NO: 2707929 - protein, 30 aa, Entamoeba histolytica
AVQNNQIEILKWIRGIAPEIIKKANSIGET

SEQ ID NO: 2707930 - protein, 24 aa, Entamoeba histolytica
AVREPRGYIIDGVFPFLIDKEEEE

SEQ ID NO: 2707931 - protein, 25 aa, Entamoeba histolytica
AVRKNRYIILPADFEKAYKKVVRKQ

SEQ ID NO: 2707932 - protein, 17 aa, Entamoeba histolytica
AVRQLFMRARNSAPCVI

SEQ ID NO: 2707933 - protein, 19 aa, Entamoeba histolytica
AVSKIFPTHSFISATTSLE

SEQ ID NO: 2707934 - protein, 25 aa, Entamoeba histolytica
AVSRAYYPGARWVLQEDLLHLHYKR

SEQ ID NO: 2707935 - protein, 24 aa, Entamoeba histolytica
AVSTIKHLFNVDIIINLGSAGGMK

SEQ ID NO: 2707936 - protein, 26 aa, Entamoeba histolytica
AVTNKYTITYILKLNTECNNSGLLYF

SEQ ID NO: 2707937 - protein, 18 aa, Entamoeba histolytica
AVVDKTHFIFSIKNVAHP

SEQ ID NO: 2707938 - protein, 25 aa, Entamoeba histolytica
AVVQFRYHNNEILPYIIDLNSKEGV

SEQ ID NO: 2707939 - protein, 24 aa, Entamoeba histolytica
AVYGITAPYLPKKSFYPLHNEEIT

SEQ ID NO: 2707940 - protein, 18 aa, Entamoeba histolytica
AVYHLLVPAMKSLKERYL

SEQ ID NO: 2707941 - protein, 17 aa, Entamoeba histolytica
AVYIWRILSGGEKLVKG

SEQ ID NO: 2707942 - protein, 25 aa, Entamoeba histolytica
AVYLKSLQTLQLPNSLYSLKLNNSS

SEQ ID NO: 2707943 - protein, 26 aa, Entamoeba histolytica
AWARRDMIIFNGLFVLYGETGRIPLT

SEQ ID NO: 2707944 - protein, 17 aa, Entamoeba histolytica
AWDLTIETTAFDGSRIV

SEQ ID NO: 2707945 - protein, 18 aa, Entamoeba histolytica
AWNVLPAELFMKLFRQDI

SEQ ID NO: 2707946 - protein, 31 aa, Entamoeba histolytica
AWTERSTVYVLLKYFYWKYTEPSVMSLHEMY

SEQ ID NO: 2707947 - protein, 28 aa, Entamoeba histolytica
AWTSKIVTSAWWVYSDQVSKTAPSGEYL

SEQ ID NO: 2707948 - protein, 17 aa, Entamoeba histolytica
AYAFVKYDNTLSPSEAI

SEQ ID NO: 2707949 - protein, 25 aa, Entamoeba histolytica
AYANPRVRPTFIPGMHWDPAPGDYT

SEQ ID NO: 2707950 - protein, 17 aa, Entamoeba histolytica
AYARQNCHPKWSGTVGS

SEQ ID NO: 2707951 - protein, 22 aa, Entamoeba histolytica
AYDDWMIPLNDYTPPKQRFIPS

SEQ ID NO: 2707952 - protein, 28 aa, Entamoeba histolytica
AYDEEQNYRFILFDDINYDKNLIRLIKA

SEQ ID NO: 2707953 - protein, 17 aa, Entamoeba histolytica
AYDNSFIGAIRSLDAAG

SEQ ID NO: 2707954 - protein, 25 aa, Entamoeba histolytica
AYDSYRRFVSLFGKIALNVDDEVYD

SEQ ID NO: 2707955 - protein, 24 aa, Entamoeba histolytica
AYEDFIPQQMSLSRLKGIFGEKIE

SEQ ID NO: 2707956 - protein, 18 aa, Entamoeba histolytica
AYEKLWYIITRIGKAAET

SEQ ID NO: 2707957 - protein, 33 aa, Entamoeba histolytica
AYENQWFNITPQKNIIIFPYRLNYNDSTKRLLL

SEQ ID NO: 2707958 - protein, 23 aa, Entamoeba histolytica
AYFCETFYTLPHLQLVSPFYDIE

SEQ ID NO: 2707959 - protein, 26 aa, Entamoeba histolytica
AYFGPWFIPNFFLEYPELLPSSSCFL

SEQ ID NO: 2707960 - protein, 20 aa, Entamoeba histolytica
AYFSDLDTHKIKFAYDGAGS

SEQ ID NO: 2707961 - protein, 17 aa, Entamoeba histolytica
AYGARPMRRYIEKTVVT

SEQ ID NO: 2707962 - protein, 18 aa, Entamoeba histolytica
AYGARPMRRYIEKTVVTE

SEQ ID NO: 2707963 - protein, 31 aa, Entamoeba histolytica
AYGLSIDVRHLLLLSDLMTFKGVILGITRYG

SEQ ID NO: 2707964 - protein, 20 aa, Entamoeba histolytica
AYGSTFFVFSDYCRPTIRLA

SEQ ID NO: 2707965 - protein, 33 aa, Entamoeba histolytica
AYGSTFFVFSDYCRPTIRLAALSHYPSIFVFTH

SEQ ID NO: 2707966 - protein, 17 aa, Entamoeba histolytica
AYHIRKARKTLIFVELR

SEQ ID NO: 2707967 - protein, 28 aa, Entamoeba histolytica
AYHSMNLWLEYLLLCRNSNDFKLSQKIK

SEQ ID NO: 2707968 - protein, 18 aa, Entamoeba histolytica
AYIHSDFLVHFGHSPLIP

SEQ ID NO: 2707969 - protein, 26 aa, Entamoeba histolytica
AYISTLHFPYYYVTPTLKKLNDSRNK

SEQ ID NO: 2707970 - protein, 21 aa, Entamoeba histolytica
AYIVTAPMSPSPKGTVLIAAP

SEQ ID NO: 2707971 - protein, 20 aa, Entamoeba histolytica
AYKILFPEQPINKVIDTEKT

SEQ ID NO: 2707972 - protein, 22 aa, Entamoeba histolytica
AYLEQIAPKRILASILTAIKQN

SEQ ID NO: 2707973 - protein, 17 aa, Entamoeba histolytica
AYNFVRCQSSWRNPTTG

SEQ ID NO: 2707974 - protein, 21 aa, Entamoeba histolytica
AYNLLELHQWIPSIFEQCFVR

SEQ ID NO: 2707975 - protein, 21 aa, Entamoeba histolytica
AYNLPFPTAVFDINYFKSNPK

SEQ ID NO: 2707976 - protein, 26 aa, Entamoeba histolytica
AYNRLEAFIFMIYRMIDLYSNQKNYS

SEQ ID NO: 2707977 - protein, 22 aa, Entamoeba histolytica
AYPFCLPVPLSLPKKNYNKLFE

SEQ ID NO: 2707978 - protein, 18 aa, Entamoeba histolytica
AYPLFGIKNFRSTCFANS

SEQ ID NO: 2707979 - protein, 22 aa, Entamoeba histolytica
AYQAIFNLTKYLRKGGLFVGTT

SEQ ID NO: 2707980 - protein, 23 aa, Entamoeba histolytica
AYSDVFDWAMKRISAFTHNIVYH

SEQ ID NO: 2707981 - protein, 22 aa, Entamoeba histolytica
AYSIGFAAMLTGRYVCYVNPTL

SEQ ID NO: 2707982 - protein, 25 aa, Entamoeba histolytica
AYSLPIILNGFLKKLNQWTSESSLY

SEQ ID NO: 2707983 - protein, 20 aa, Entamoeba histolytica
AYTYGVLTKVVMLLNRICDN

SEQ ID NO: 2707984 - protein, 19 aa, Entamoeba histolytica
AYVIGIFPNEESINQMSQE

SEQ ID NO: 2707985 - protein, 36 aa, Entamoeba histolytica
AYVLAHYIYQQKNIVFLLICDKYCFGFFNSQCLQSY

SEQ ID NO: 2707986 - protein, 20 aa, Entamoeba histolytica
AYYDLVELPELFKSNFIEIC

SEQ ID NO: 2707987 - protein, 17 aa, Entamoeba histolytica
CAAFDYQCVLVLGIVNN

SEQ ID NO: 2707988 - protein, 17 aa, Entamoeba histolytica
CAAVYKYTKKKMEFLWT

SEQ ID NO: 2707989 - protein, 17 aa, Entamoeba histolytica
CAFIALGRFLIKGYDHL

SEQ ID NO: 2707990 - protein, 17 aa, Entamoeba histolytica
CAFVSFKTPLEAQKCFS

SEQ ID NO: 2707991 - protein, 28 aa, Entamoeba histolytica
CALIHILRVILWALREPISSNFFTCGLT

SEQ ID NO: 2707992 - protein, 24 aa, Entamoeba histolytica
CALRWGVPVLNFQWLFDCLKEGRV

SEQ ID NO: 2707993 - protein, 18 aa, Entamoeba histolytica
CALTFMERDMLVKNPGCS

SEQ ID NO: 2707994 - protein, 17 aa, Entamoeba histolytica
CANKLHEFNFNLNIQRL

SEQ ID NO: 2707995 - protein, 23 aa, Entamoeba histolytica
CARCKDFLTTRDYLRDNIYCTKC

SEQ ID NO: 2707996 - protein, 27 aa, Entamoeba histolytica
CARDGNLLCLILLLQTFPSIQESSVVD

SEQ ID NO: 2707997 - protein, 17 aa, Entamoeba histolytica
CARWIAKSLVHAGLCHR

SEQ ID NO: 2707998 - protein, 18 aa, Entamoeba histolytica
CARWIAKSLVHAGLCHRV

SEQ ID NO: 2707999 - protein, 23 aa, Entamoeba histolytica
CATTSMPPLYQARVLFDFESKNG

SEQ ID NO: 2708000 - protein, 26 aa, Entamoeba histolytica
CAVVARTLSIIWNIPLIGVNHCVAHI

SEQ ID NO: 2708001 - protein, 34 aa, Entamoeba histolytica
CCCDINGLLNYLHDKICIGYLCIWCSGETSSFHS

SEQ ID NO: 2708002 - protein, 18 aa, Entamoeba histolytica
CCCPRIKAFKKFINTFEK

SEQ ID NO: 2708003 - protein, 18 aa, Entamoeba histolytica
CCECSCYKPELYGELKTK

SEQ ID NO: 2708004 - protein, 17 aa, Entamoeba histolytica
CCEYYFKAKYSDSCFPP

SEQ ID NO: 2708005 - protein, 17 aa, Entamoeba histolytica
CCICGDGSSFPLYCVVN

SEQ ID NO: 2708006 - protein, 17 aa, Entamoeba histolytica
CCLVSTLHSRYFCVHGG

SEQ ID NO: 2708007 - protein, 24 aa, Entamoeba histolytica
CCMEYKLKLPRMTKILFTSSDWSC

SEQ ID NO: 2708008 - protein, 25 aa, Entamoeba histolytica
CCPSALLRYLELKPINHPSLTKDKE

SEQ ID NO: 2708009 - protein, 20 aa, Entamoeba histolytica
CCWFEVIINGVVRIPKLCCD

SEQ ID NO: 2708010 - protein, 17 aa, Entamoeba histolytica
CDAFAGVGPFAIPAALK

SEQ ID NO: 2708011 - protein, 24 aa, Entamoeba histolytica
CDAQDSLLKTKMKSEMEAKKKVEI

SEQ ID NO: 2708012 - protein, 17 aa, Entamoeba histolytica
CDCFSPDPDWAIINMGI

SEQ ID NO: 2708013 - protein, 24 aa, Entamoeba histolytica
CDDKKHFMFTLKNPYNVPPTRFKQ

SEQ ID NO: 2708014 - protein, 28 aa, Entamoeba histolytica
CDEKYITAYFLLFIDIEFVKPYIRNAYD

SEQ ID NO: 2708015 - protein, 19 aa, Entamoeba histolytica
CDFIRAEGFVFGHVADEGY

SEQ ID NO: 2708016 - protein, 18 aa, Entamoeba histolytica
CDGEFNVICATIAFGMGI

SEQ ID NO: 2708017 - protein, 22 aa, Entamoeba histolytica
CDGHIRFESYNEKKPKQFKKHQ

SEQ ID NO: 2708018 - protein, 30 aa, Entamoeba histolytica
CDGIKEVLIQTFNIMRIILLDASETLCDNC

SEQ ID NO: 2708019 - protein, 25 aa, Entamoeba histolytica
CDGLYLTKVPWKISINHFVPSVKIK

SEQ ID NO: 2708020 - protein, 17 aa, Entamoeba histolytica
CDILDGSKRQILEELVV

SEQ ID NO: 2708021 - protein, 30 aa, Entamoeba histolytica
CDINGIEKKYFVKLLLAFHDVKRKRRGKDE

SEQ ID NO: 2708022 - protein, 34 aa, Entamoeba histolytica
CDIWSLGVITYVLLSGYLPFFGETQDELFQKIMS

SEQ ID NO: 2708023 - protein, 20 aa, Entamoeba histolytica
CDKHFISQAVYLKHCTQGPH

SEQ ID NO: 2708024 - protein, 18 aa, Entamoeba histolytica
CDKIIREFDLAPGSLNEL

SEQ ID NO: 2708025 - protein, 23 aa, Entamoeba histolytica
CDKIYPEELTLLPQGWSCGYFRN

SEQ ID NO: 2708026 - protein, 24 aa, Entamoeba histolytica
CDKKIKLPLPVLSLDDGCKKFAAS

SEQ ID NO: 2708027 - protein, 34 aa, Entamoeba histolytica; identical to SEQ ID NO: 2519520

SEQ ID NO: 2708028 - protein, 29 aa, Entamoeba histolytica
CDLDIQYHGIKLLLYLLKHQSYSSEVELM

SEQ ID NO: 2708029 - protein, 23 aa, Entamoeba histolytica
CDQALAVGIFPYILKLLSSTTSV

SEQ ID NO: 2708030 - protein, 22 aa, Entamoeba histolytica
CDQFWRRNYVDIIYGEPLFGSD

SEQ ID NO: 2708031 - protein, 24 aa, Entamoeba histolytica
CDQYIRQPIMFPVKDFFTGKLGDL

SEQ ID NO: 2708032 - protein, 20 aa, Entamoeba histolytica
CDRYLLGHDYPMIKIATIST

SEQ ID NO: 2708033 - protein, 21 aa, Entamoeba histolytica
CDSEYFKQWISTSLPNSIISI

SEQ ID NO: 2708034 - protein, 24 aa, Entamoeba histolytica
CDVFKIKDIWKRVCIVWTKCFNHF

SEQ ID NO: 2708035 - protein, 34 aa, Entamoeba histolytica
CDVNRPLILRFDVKYVLGLFFGYGLSHGMFVSPL

SEQ ID NO: 2708036 - protein, 17 aa, Entamoeba histolytica
CDWIHNYAPTFAPTALQ

SEQ ID NO: 2708037 - protein, 22 aa, Entamoeba histolytica
CDYYAFVQYNLHLQLKEASDYA

SEQ ID NO: 2708038 - protein, 27 aa, Entamoeba histolytica
CEADKLLVYLIFYIQSLLLKFNGHTKV

SEQ ID NO: 2708039 - protein, 27 aa, Entamoeba histolytica
CEADKLLVYLIFYIQSLLLKFNGRTKV

SEQ ID NO: 2708040 - protein, 23 aa, Entamoeba histolytica
CEEFISHILATYKKAKIIIVIGP

SEQ ID NO: 2708041 - protein, 19 aa, Entamoeba histolytica
CEESMFSYLTPLCSHEITK

SEQ ID NO: 2708042 - protein, 18 aa, Entamoeba histolytica
CEFVCQLYLSAAFSNPRK

SEQ ID NO: 2708043 - protein, 18 aa, Entamoeba histolytica
CEGEGNIFLIFEYMPHDL

SEQ ID NO: 2708044 - protein, 19 aa, Entamoeba histolytica
CEGIPYDYKSDMWSLGCIL

SEQ ID NO: 2708045 - protein, 19 aa, Entamoeba histolytica
CEHQYKLSQFCDHTRLCEV

SEQ ID NO: 2708046 - protein, 17 aa, Entamoeba histolytica
CEIINGRPFIYKSEFER

SEQ ID NO: 2708047 - protein, 17 aa, Entamoeba histolytica
CEILFNKFTGRINFSVK

SEQ ID NO: 2708048 - protein, 25 aa, Entamoeba histolytica
CEIMLDPFFRTIDGFIILIEKDWKS

SEQ ID NO: 2708049 - protein, 23 aa, Entamoeba histolytica
CELDLIYYFHKVYQVIDEVFLAG

SEQ ID NO: 2708050 - protein, 26 aa, Entamoeba histolytica
CELERLKRSLELLQSPIKDKKPKKKE

SEQ ID NO: 2708051 - protein, 19 aa, Entamoeba histolytica
CELGDFNIGFIMYSCVVQI

SEQ ID NO: 2708052 - protein, 29 aa, Entamoeba histolytica
CENIGFKRFILKIKPTLYSFILIKNFETR

SEQ ID NO: 2708053 - protein, 38 aa, Entamoeba histolytica
CENKPFVCVAIAGWILSAKIPEIIAIALRIDSLAQQYT

SEQ ID NO: 2708054 - protein, 31 aa, Entamoeba histolytica
CENKPFVCVAIAGWILSAKIPETIAIALRID

SEQ ID NO: 2708055 - protein, 17 aa, Entamoeba histolytica
CENLYWVGALDNDLRVF

SEQ ID NO: 2708056 - protein, 21 aa, Entamoeba histolytica
CEPFYHEYFPGTHAVPFSIII

SEQ ID NO: 2708057 - protein, 17 aa, Entamoeba histolytica
CEPPCIPFLGSTLGDLV

SEQ ID NO: 2708058 - protein, 24 aa, Entamoeba histolytica
CEQYNFYQFEYLSSLTISCCELYF

SEQ ID NO: 2708059 - protein, 23 aa, Entamoeba histolytica
CETFCYLIVSYSFGFNIYKSNQT

SEQ ID NO: 2708060 - protein, 21 aa, Entamoeba histolytica
CETRYEWMAFLLAATRQGIVI

SEQ ID NO: 2708061 - protein, 19 aa, Entamoeba histolytica
CEWIKKNSVYFPDKKKRSS

SEQ ID NO: 2708062 - protein, 24 aa, Entamoeba histolytica
CEYYCLRDVLVLREGFLKYRQMVQ

SEQ ID NO: 2708063 - protein, 18 aa, Entamoeba histolytica
CFAKPLIPISSINPNIKP

SEQ ID NO: 2708064 - protein, 41 aa, Entamoeba histolytica; identical to SEQ ID NO: 2519573

SEQ ID NO: 2708065 - protein, 23 aa, Entamoeba histolytica
CFDRESIICCLPLEKNDDESDNT

SEQ ID NO: 2708066 - protein, 18 aa, Entamoeba histolytica
CFEYCTSLRIINIPTNVS

SEQ ID NO: 2708067 - protein, 17 aa, Entamoeba histolytica
CFIKMRNALFIRDTLTP

SEQ ID NO: 2708068 - protein, 28 aa, Entamoeba histolytica
CFISKLIIRRCKFIEGILLPFQCQAIHI

SEQ ID NO: 2708069 - protein, 18 aa, Entamoeba histolytica
CFLGDFRAKSITVPKSVT

SEQ ID NO: 2708070 - protein, 19 aa, Entamoeba histolytica
CFNHKHLLLPYCESFIKNV

SEQ ID NO: 2708071 - protein, 19 aa, Entamoeba histolytica
CFNNIDFTNAGLIPRSINA

SEQ ID NO: 2708072 - protein, 25 aa, Entamoeba histolytica
CFNRKQIPKAPKKGYKYIKNDKDFF

SEQ ID NO: 2708073 - protein, 17 aa, Entamoeba histolytica
CFNRPICGPPENHIIIG

SEQ ID NO: 2708074 - protein, 17 aa, Entamoeba histolytica
CFPQGMLPVVDFNGKIL

SEQ ID NO: 2708075 - protein, 24 aa, Entamoeba histolytica
CFQIEYRLLCEVFTDSIIGNSNIV

SEQ ID NO: 2708076 - protein, 26 aa, Entamoeba histolytica
CFSAICHIYRLYPDLVPNASKLICTA

SEQ ID NO: 2708077 - protein, 26 aa, Entamoeba histolytica
CFSECTSLVYIKFPTSITSIGNECFK

SEQ ID NO: 2708078 - protein, 20 aa, Entamoeba histolytica
CFSFKNPLRVIFRIEEYTRA

SEQ ID NO: 2708079 - protein, 27 aa, Entamoeba histolytica
CFSGCKYLHTIYFPTGLQKIGDDCFNG

SEQ ID NO: 2708080 - protein, 27 aa, Entamoeba histolytica
CFSPHGPFYQIVKKYCKYALHDDRFDP

SEQ ID NO: 2708081 - protein, 28 aa, Entamoeba histolytica
CFSSSCSLILFYYLPNNYPFEEIPRFEA

SEQ ID NO: 2708082 - protein, 35 aa, Entamoeba histolytica
CFSTSDNRWLLVQHPIYGLGYVPLSYVQCEKSIYH

SEQ ID NO: 2708083 - protein, 17 aa, Entamoeba histolytica
CFVCGKTGHKSRDCPKA

SEQ ID NO: 2708084 - protein, 26 aa, Entamoeba histolytica
CFYDCPLLQHVLLPTTLTLIGDNCFQ

SEQ ID NO: 2708085 - protein, 18 aa, Entamoeba histolytica
CFYDDKLLFLGDKNGRVY

SEQ ID NO: 2708086 - protein, 23 aa, Entamoeba histolytica
CFYDSIELLHYLYSLTTTHWTQR

SEQ ID NO: 2708087 - protein, 17 aa, Entamoeba histolytica
CFYQCNFISKIFPNYCF

SEQ ID NO: 2708088 - protein, 25 aa, Entamoeba histolytica
CGCKHFSMIWDVAGGGAFAVIPYTK

SEQ ID NO: 2708089 - protein, 31 aa, Entamoeba histolytica
CGEFINFLHLHYKGVILGYIKELFNDQQALE

SEQ ID NO: 2708090 - protein, 24 aa, Entamoeba histolytica
CGEPLEKYFMKDKKLMCKTCACPK

SEQ ID NO: 2708091 - protein, 17 aa, Entamoeba histolytica
CGFVIHKGCKDTFYLKC

SEQ ID NO: 2708092 - protein, 25 aa, Entamoeba histolytica
CGGHSLFNWSFSPPSTFISNVSSHP

SEQ ID NO: 2708093 - protein, 23 aa, Entamoeba histolytica
CGGNGYVMITTRQGMYMMQSQQV

SEQ ID NO: 2708094 - protein, 32 aa, Entamoeba histolytica
CGGQSGKLFVWEWDNWEYPKNALKGHPESIES

SEQ ID NO: 2708095 - protein, 21 aa, Entamoeba histolytica
CGIMFYEMILRRSPFDGTLNE

SEQ ID NO: 2708096 - protein, 20 aa, Entamoeba histolytica
CGIVYYKMGIISCMNFERIE

SEQ ID NO: 2708097 - protein, 17 aa, Entamoeba histolytica
CGIYFCYNEWFERARCI

SEQ ID NO: 2708098 - protein, 26 aa, Entamoeba histolytica
CGKINLWVNLYCAQYIPLTSKFGERD

SEQ ID NO: 2708099 - protein, 30 aa, Entamoeba histolytica
CGKNKVVCLLFPWVIRPQQNIMFINSTMIK

SEQ ID NO: 2708100 - protein, 23 aa, Entamoeba histolytica
CGKPIIGPSLSALGKKYHPECFV

SEQ ID NO: 2708101 - protein, 24 aa, Entamoeba histolytica
CGKSLLGSQLYLFEGCLLVFSNQK

SEQ ID NO: 2708102 - protein, 29 aa, Entamoeba histolytica
CGKSNVIDGLLFVFGRRAKQIRQQKVADL

SEQ ID NO: 2708103 - protein, 20 aa, Entamoeba histolytica
CGKTLLAKAIAGEVGVAFIE

SEQ ID NO: 2708104 - protein, 18 aa, Entamoeba histolytica
CGLGILSLFAARAGAKHV

SEQ ID NO: 2708105 - protein, 24 aa, Entamoeba histolytica
CGLHLTLKNFFFDQGTQAVYCKNH

SEQ ID NO: 2708106 - protein, 25 aa, Entamoeba histolytica
CGLPKPDIVFFLELSLEDAEKRRKT

SEQ ID NO: 2708107 - protein, 27 aa, Entamoeba histolytica
CGNELLYEFEILPSIISLIKDIPEFGA

SEQ ID NO: 2708108 - protein, 23 aa, Entamoeba histolytica
CGNGYTLSLLGKEGYQHLYGMDY

SEQ ID NO: 2708109 - protein, 18 aa, Entamoeba histolytica
CGNTNLLKLPYTTTLTNI

SEQ ID NO: 2708110 - protein, 24 aa, Entamoeba histolytica
CGPCKMISPIFIELAQDYPLIKCI

SEQ ID NO: 2708111 - protein, 18 aa, Entamoeba histolytica
CGPYDCVSKYKYHIKLTP

SEQ ID NO: 2708112 - protein, 24 aa, Entamoeba histolytica
CGQTNIMVIIITTDCYIFGSYNSL

SEQ ID NO: 2708113 - protein, 22 aa, Entamoeba histolytica
CGRILLKVIGDQTYLSCPTCSL

SEQ ID NO: 2708114 - protein, 17 aa, Entamoeba histolytica
CGRKWHADHFRCAECHN

SEQ ID NO: 2708115 - protein, 17 aa, Entamoeba histolytica
CGRYFAVSVLSIIDGGD

SEQ ID NO: 2708116 - protein, 19 aa, Entamoeba histolytica
CGSETNWDLFKMWTGKACC

SEQ ID NO: 2708117 - protein, 27 aa, Entamoeba histolytica
CGSFTSLGFTFSPYAEPYRPSRSVNAS

SEQ ID NO: 2708118 - protein, 23 aa, Entamoeba histolytica
CGTEFFQHYAGMYDQFKIDGVSV

SEQ ID NO: 2708119 - protein, 19 aa, Entamoeba histolytica
CGTFRQLIRSCNGILRACI

SEQ ID NO: 2708120 - protein, 28 aa, Entamoeba histolytica
CGTMQEYLYELLKIYPEFLKSNNKATLQ

SEQ ID NO: 2708121 - protein, 25 aa, Entamoeba histolytica
CGVKWDIDVLPFLTTYYGTFKKVNQ

SEQ ID NO: 2708122 - protein, 19 aa, Entamoeba histolytica
CGWYVRKTEWKGMSGKKLF

SEQ ID NO: 2708123 - protein, 25 aa, Entamoeba histolytica
CGYVMNILHINPFHFKPLKVIGRTT

SEQ ID NO: 2708124 - protein, 30 aa, Entamoeba histolytica
CHCPETFFDSFIKFLPHNMKHRLLQFSSTS

SEQ ID NO: 2708125 - protein, 17 aa, Entamoeba histolytica
CHFEILRMELIDEIERR

SEQ ID NO: 2708126 - protein, 37 aa, Entamoeba histolytica; identical to SEQ ID NO: 2519640

SEQ ID NO: 2708127 - protein, 26 aa, Entamoeba histolytica
CHMKRTIIVRRDYFHYVSKYQRYEKR

SEQ ID NO: 2708128 - protein, 22 aa, Entamoeba histolytica
CHNLKLIQIPLLTSIPEYCFSQ

SEQ ID NO: 2708129 - protein, 26 aa, Entamoeba histolytica
CHSCQHRIPLILNKFPQQKISEQISQ

SEQ ID NO: 2708130 - protein, 29 aa, Entamoeba histolytica
CHTIASLFKLFLRELPTPIIPPIYYDKFV

SEQ ID NO: 2708131 - protein, 32 aa, Entamoeba histolytica
CHVVYTDYRPTPLCHYLFPAGGNGIYLVVDKE

SEQ ID NO: 2708132 - protein, 25 aa, Entamoeba histolytica
CHYAPLLCHFVDYFQPVEFTTIAED

SEQ ID NO: 2708133 - protein, 21 aa, Entamoeba histolytica
CIAAELILGIPIFPGSSEYNQ

SEQ ID NO: 2708134 - protein, 22 aa, Entamoeba histolytica
CIALYASEHFFPKLPKKIKINK

SEQ ID NO: 2708135 - protein, 24 aa, Entamoeba histolytica
CIANTLFKIAYYYKSNAVHNKSTT

SEQ ID NO: 2708136 - protein, 22 aa, Entamoeba histolytica
CIAPQWLMKRLNLVDGDYIDLQ

SEQ ID NO: 2708137 - protein, 24 aa, Entamoeba histolytica
CIDIAYQRLNIPKLIKAEFVEKNT

SEQ ID NO: 2708138 - protein, 42 aa, Entamoeba histolytica
CIDIKTLRHLMFSLYILNPVLFFIQLETMKLLVWGEDSMFWL

SEQ ID NO: 2708139 - protein, 27 aa, Entamoeba histolytica
CIDPAMLRPGRLDRLISVDLPNSDARV

SEQ ID NO: 2708140 - protein, 23 aa, Entamoeba histolytica
CIDRKEKYFIIKCQGTILCDQNL

SEQ ID NO: 2708141 - protein, 21 aa, Entamoeba histolytica
CIDYQILYDAFFKNQKKGSMT

SEQ ID NO: 2708142 - protein, 30 aa, Entamoeba histolytica; identical to SEQ ID NO: 2519651

SEQ ID NO: 2708143 - protein, 17 aa, Entamoeba histolytica
CIERDYFIKLDAPTIYS

SEQ ID NO: 2708144 - protein, 41 aa, Entamoeba histolytica
CIESHYLPFIDFDYPPLLAPFLPPPLPTHLSVLVYSLSLKP

SEQ ID NO: 2708145 - protein, 31 aa, Entamoeba histolytica
CIFSTIIPEITPPWYLKFNNSAIYDDNTEDE

SEQ ID NO: 2708146 - protein, 25 aa, Entamoeba histolytica
CIGAPGYGLVIYKPPFAKSYCYNTS

SEQ ID NO: 2708147 - protein, 17 aa, Entamoeba histolytica
CIGLLPPSIHKIPTISE

SEQ ID NO: 2708148 - protein, 17 aa, Entamoeba histolytica
CIIGDSGVGKTCISSRL

SEQ ID NO: 2708149 - protein, 19 aa, Entamoeba histolytica
CIISKYIIEPLLINERKFE

SEQ ID NO: 2708150 - protein, 19 aa, Entamoeba histolytica
CIIVVVRHPTEKKCLFVRK

SEQ ID NO: 2708151 - protein, 28 aa, Entamoeba histolytica
CIIYNNPTYRLQTQKLLLDVICGVLLGK

SEQ ID NO: 2708152 - protein, 24 aa, Entamoeba histolytica
CIKRKCYIEYIFAYSVVDMNVMAK

SEQ ID NO: 2708153 - protein, 30 aa, Entamoeba histolytica; identical to SEQ ID NO: 2519674

SEQ ID NO: 2708154 - protein, 19 aa, Entamoeba histolytica
CIPISKKGFLYVSLHCKKG

SEQ ID NO: 2708155 - protein, 18 aa, Entamoeba histolytica
CIPNFTAPDFFLFAAIDG

SEQ ID NO: 2708156 - protein, 19 aa, Entamoeba histolytica
CIQEFLAPLNLFDTSNKKY

SEQ ID NO: 2708157 - protein, 25 aa, Entamoeba histolytica
CIQLPTYVPCKVTAKYDYIATYGKD

SEQ ID NO: 2708158 - protein, 23 aa, Entamoeba histolytica
CIRSIIHTIPNLHKLNLPLTKLI

SEQ ID NO: 2708159 - protein, 18 aa, Entamoeba histolytica
CISCMIVLPLLLEMITTQ

SEQ ID NO: 2708160 - protein, 25 aa, Entamoeba histolytica
CISTKLLYELIVARPNIFLSKLESW

SEQ ID NO: 2708161 - protein, 21 aa, Entamoeba histolytica
CITMDIVRYLVDDYTYYRYCE

SEQ ID NO: 2708162 - protein, 25 aa, Entamoeba histolytica
CITPTLLLAPEFIKRLLYSLKDVIK

SEQ ID NO: 2708163 - protein, 20 aa, Entamoeba histolytica
CIVPYFSQFQLLSNSVVQVA

SEQ ID NO: 2708164 - protein, 30 aa, Entamoeba histolytica; identical to SEQ ID NO: 2519689

SEQ ID NO: 2708165 - protein, 23 aa, Entamoeba histolytica
CKDKFIENLPQQIKDMNIIKQKP

SEQ ID NO: 2708166 - protein, 26 aa, Entamoeba histolytica
CKDYKKLYGLIRFKKFERIIIEVDET

SEQ ID NO: 2708167 - protein, 17 aa, Entamoeba histolytica
CKEIIQNIIFIISGKKT

SEQ ID NO: 2708168 - protein, 19 aa, Entamoeba histolytica
CKFLYTPNDVDTLLKFIII

SEQ ID NO: 2708169 - protein, 25 aa, Entamoeba histolytica
CKFTKDVLLFFKKQATMKAQSMDYL

SEQ ID NO: 2708170 - protein, 17 aa, Entamoeba histolytica
CKGVQWLHNGMNLIHRD

SEQ ID NO: 2708171 - protein, 25 aa, Entamoeba histolytica
CKGYNSIRYFWDIGTLRIDAEEWVF

SEQ ID NO: 2708172 - protein, 21 aa, Entamoeba histolytica
CKHQVFVDWNLPNSIRCCADV

SEQ ID NO: 2708173 - protein, 25 aa, Entamoeba histolytica
CKICQRVFGVIRDSFWRNARSKLNA

SEQ ID NO: 2708174 - protein, 30 aa, Entamoeba histolytica
CKIELMSFYLITPIQRIPRYELLIRDMLKD

SEQ ID NO: 2708175 - protein, 24 aa, Entamoeba histolytica
CKIGQLFQIFQIFGTPTEESWPGV

SEQ ID NO: 2708176 - protein, 23 aa, Entamoeba histolytica
CKKHGGFYLGAIGGAAALLAEKN

SEQ ID NO: 2708177 - protein, 30 aa, Entamoeba histolytica
CKLELVKSFYRLLINWRPTVKKYPATYFKE

SEQ ID NO: 2708178 - protein, 19 aa, Entamoeba histolytica
CKLFLNGEAVTSIIRTFLD

SEQ ID NO: 2708179 - protein, 20 aa, Entamoeba histolytica
CKNCGSINHWTYQCTVEIEE

SEQ ID NO: 2708180 - protein, 18 aa, Entamoeba histolytica
CKNECCVKWRKGICPWNK

SEQ ID NO: 2708181 - protein, 18 aa, Entamoeba histolytica
CKNFTLADGTFWPIPITM

SEQ ID NO: 2708182 - protein, 24 aa, Entamoeba histolytica
CKNGKYYIPYYPIPRIVDENTFVR

SEQ ID NO: 2708183 - protein, 26 aa, Entamoeba histolytica
CKNIKLIIFLMFELYLRKYNELYLAI

SEQ ID NO: 2708184 - protein, 17 aa, Entamoeba histolytica
CKNIVSIDFFSCLCNDK

SEQ ID NO: 2708185 - protein, 24 aa, Entamoeba histolytica
CKNKAFGVKYLLKTNKKHPTKVMI

SEQ ID NO: 2708186 - protein, 23 aa, Entamoeba histolytica
CKNNTYYQTILLMSLKSLQHIKE

SEQ ID NO: 2708187 - protein, 25 aa, Entamoeba histolytica
CKNQCKLMLIFHHSPQSPLSLQSLS

SEQ ID NO: 2708188 - protein, 25 aa, Entamoeba histolytica
CKNYLNIRYPLPECKRLPKGWGIGM

SEQ ID NO: 2708189 - protein, 24 aa, Entamoeba histolytica
CKPFPTDPIIPYSGAIVAKEIDAA

SEQ ID NO: 2708190 - protein, 29 aa, Entamoeba histolytica
CKQLNQKLIILFILYTVYMTQPKDKSPIP

SEQ ID NO: 2708191 - protein, 23 aa, Entamoeba histolytica
CKRGFLPIAEYILIHSNGLASTA

SEQ ID NO: 2708192 - protein, 19 aa, Entamoeba histolytica
CKRMLVSHVNLIGFLSMYD

SEQ ID NO: 2708193 - protein, 18 aa, Entamoeba histolytica
CKSCLTIVLTSSDKTPFC

SEQ ID NO: 2708194 - protein, 23 aa, Entamoeba histolytica
CKSEILPFPPFLETSVFHHDIHF

SEQ ID NO: 2708195 - protein, 30 aa, Entamoeba histolytica; identical to SEQ ID NO: 2519720

SEQ ID NO: 2708196 - protein, 17 aa, Entamoeba histolytica
CKSSVSPFPPFMTTTHY

SEQ ID NO: 2708197 - protein, 28 aa, Entamoeba histolytica
CKTDKEFNLLFWKYLMKTKPLPSREVVP

SEQ ID NO: 2708198 - protein, 25 aa, Entamoeba histolytica
CKTEYLTYRTFLQQQLIKMKEAYLK

SEQ ID NO: 2708199 - protein, 23 aa, Entamoeba histolytica
CKTIKQVILSLKKNYNKPLPNNL

SEQ ID NO: 2708200 - protein, 23 aa, Entamoeba histolytica
CKVCVNLAEFILRQARNGKSKKK

SEQ ID NO: 2708201 - protein, 29 aa, Entamoeba histolytica
CKYKKRLAIFICYGEYLFGVYYHSQLIPS

SEQ ID NO: 2708202 - protein, 18 aa, Entamoeba histolytica
CKYLPNAIGEFRKLIPNL

SEQ ID NO: 2708203 - protein, 28 aa, Entamoeba histolytica
CLAKTMMSLFIRSIPETQLRSLLFTFFL

SEQ ID NO: 2708204 - protein, 26 aa, Entamoeba histolytica
CLCQQLVPFLGYFELPYSLSSLNDNS

SEQ ID NO: 2708205 - protein, 25 aa, Entamoeba histolytica
CLCVGHSLLRFVRYSPRPSPSIQYN

SEQ ID NO: 2708206 - protein, 29 aa, Entamoeba histolytica
CLDDKELNQMLSLKRLAPYDERKITQAEK

SEQ ID NO: 2708207 - protein, 34 aa, Entamoeba histolytica
CLENHIIWKYLLKSKYWITIFIDIAVSLVSSKEY

SEQ ID NO: 2708208 - protein, 18 aa, Entamoeba histolytica
CLEPILTALLQLVTKKPS

SEQ ID NO: 2708209 - protein, 24 aa, Entamoeba histolytica
CLEPPFQMICYLSNSIFQGKKNKM

SEQ ID NO: 2708210 - protein, 17 aa, Entamoeba histolytica
CLEYLFYNKSRNDPYHI

SEQ ID NO: 2708211 - protein, 19 aa, Entamoeba histolytica
CLFHCLEYLFYNKSRNDPY

SEQ ID NO: 2708212 - protein, 24 aa, Entamoeba histolytica
CLGCGLMDFLPIKCSYCHNPFCNK

SEQ ID NO: 2708213 - protein, 18 aa, Entamoeba histolytica
CLGIIPPQRVQTEILRFG

SEQ ID NO: 2708214 - protein, 17 aa, Entamoeba histolytica
CLGILNKAPQRPSNESS

SEQ ID NO: 2708215 - protein, 18 aa, Entamoeba histolytica
CLGPKSMLKMLIDPQAGV

SEQ ID NO: 2708216 - protein, 17 aa, Entamoeba histolytica
CLHLLMDILSEFGYFFN

SEQ ID NO: 2708217 - protein, 26 aa, Entamoeba histolytica
CLHYINPQYPIFNPYQRVIDAIGRAL

SEQ ID NO: 2708218 - protein, 24 aa, Entamoeba histolytica
CLIHTTPLVQFFQKDDWKKDINLN

SEQ ID NO: 2708219 - protein, 17 aa, Entamoeba histolytica
CLKDILQIIRKGSFRVS

SEQ ID NO: 2708220 - protein, 24 aa, Entamoeba histolytica
CLKLVQQPIPTWVNRMAWYGSQFE

SEQ ID NO: 2708221 - protein, 22 aa, Entamoeba histolytica
CLKTIYVPLIKYLKAYYDQNTS

SEQ ID NO: 2708222 - protein, 20 aa, Entamoeba histolytica
CLLLKKRFVPKMKDILETED

SEQ ID NO: 2708223 - protein, 28 aa, Entamoeba histolytica
CLLYTHMPFTRILPLFQLRVEQPPTTVR

SEQ ID NO: 2708224 - protein, 25 aa, Entamoeba histolytica
CLMSDIFQFIIKYHSLLPELTIDDF

SEQ ID NO: 2708225 - protein, 18 aa, Entamoeba histolytica
CLNLLVSSWKNTESMIIN

SEQ ID NO: 2708226 - protein, 23 aa, Entamoeba histolytica
CLNTKPFIEIKLITKLFEAMKKT

SEQ ID NO: 2708227 - protein, 18 aa, Entamoeba histolytica
CLPFYWNGSRNEADFIEF

SEQ ID NO: 2708228 - protein, 19 aa, Entamoeba histolytica
CLPLCCLVSTLHSRYFCVH

SEQ ID NO: 2708229 - protein, 19 aa, Entamoeba histolytica
CLPLINSRKLFMNSSNEQL

SEQ ID NO: 2708230 - protein, 30 aa, Entamoeba histolytica
CLPPINKAMTIFIINFLQLISSYEEKTKMG

SEQ ID NO: 2708231 - protein, 23 aa, Entamoeba histolytica
CLQFLVHPRPVSSLMFHPTEHLL

SEQ ID NO: 2708232 - protein, 28 aa, Entamoeba histolytica
CLQLAKSQLNIPILLSAQAIGANQLDDN

SEQ ID NO: 2708233 - protein, 18 aa, Entamoeba histolytica
CLQRLKTSYTCLTCYGRY

SEQ ID NO: 2708234 - protein, 25 aa, Entamoeba histolytica
CLRITKQIYSWLFNKGQKSEQIKKN

SEQ ID NO: 2708235 - protein, 18 aa, Entamoeba histolytica
CLSAFAGMISKIVKRRLL

SEQ ID NO: 2708236 - protein, 24 aa, Entamoeba histolytica
CLSIELIHDIDLLNWLVSDIDAEI

SEQ ID NO: 2708237 - protein, 29 aa, Entamoeba histolytica
CLSKRFKKGFLIYYYREMIYSKRNRLLKQ

SEQ ID NO: 2708238 - protein, 17 aa, Entamoeba histolytica
CLSNFFKPEFFKGDNRL

SEQ ID NO: 2708239 - protein, 25 aa, Entamoeba histolytica
CLTTPLRVAVLYYIQNSLLMKWDAT

SEQ ID NO: 2708240 - protein, 18 aa, Entamoeba histolytica
CLVLQQFLQQLMTFNLKN

SEQ ID NO: 2708241 - protein, 19 aa, Entamoeba histolytica
CLVYCVQQFLKVSSQEVRL

SEQ ID NO: 2708242 - protein, 19 aa, Entamoeba histolytica
CLYIPAVFCSIFGLSLDAK

SEQ ID NO: 2708243 - protein, 32 aa, Entamoeba histolytica
CLYPRQQLHLYPFLEKIVPAKLLVPTKILMES

SEQ ID NO: 2708244 - protein, 23 aa, Entamoeba histolytica
CMKEGIYSKIYFCDLNKKEIEST

SEQ ID NO: 2708245 - protein, 20 aa, Entamoeba histolytica
CMLGSLPCHCCCYRCLSCFR

SEQ ID NO: 2708246 - protein, 22 aa, Entamoeba histolytica
CMQRGYWLMMENVNFCNPTVLD

SEQ ID NO: 2708247 - protein, 17 aa, Entamoeba histolytica
CMRCGTPFTLFFRKHHC

SEQ ID NO: 2708248 - protein, 23 aa, Entamoeba histolytica
CMSDPRHFIFTVKLNQPDTIKQY

SEQ ID NO: 2708249 - protein, 26 aa, Entamoeba histolytica
CMSNYLLTKVILPTSLTRIGNYSFYS

SEQ ID NO: 2708250 - protein, 23 aa, Entamoeba histolytica
CNANAFFKYDCFEDKIMVSSALS

SEQ ID NO: 2708251 - protein, 26 aa, Entamoeba histolytica
CNDLQADFILFSSYLHLHMKKEGIEV

SEQ ID NO: 2708252 - protein, 26 aa, Entamoeba histolytica
CNDMYQWLLQALFGIKIAYRCVVIGL

SEQ ID NO: 2708253 - protein, 17 aa, Entamoeba histolytica
CNDRYIIISQPYGNLLI

SEQ ID NO: 2708254 - protein, 25 aa, Entamoeba histolytica
CNDVIVFWDACIMDATKSVKLFTLD

SEQ ID NO: 2708255 - protein, 28 aa, Entamoeba histolytica
CNEDMVLWGLFSLANAIHFLNITAKLGH

SEQ ID NO: 2708256 - protein, 17 aa, Entamoeba histolytica
CNELMKNIIFISNLLLN

SEQ ID NO: 2708257 - protein, 23 aa, Entamoeba histolytica
CNEVITLWYRPPELLYGAVEYSE

SEQ ID NO: 2708258 - protein, 19 aa, Entamoeba histolytica
CNGINGKFILFTPSKEEAL

SEQ ID NO: 2708259 - protein, 23 aa, Entamoeba histolytica
CNGKPFVMCLINLDPSSNKIHIK

SEQ ID NO: 2708260 - protein, 25 aa, Entamoeba histolytica
CNGRIDVVWLWVNGSDPQWLYQYKQ

SEQ ID NO: 2708261 - protein, 18 aa, Entamoeba histolytica
CNGYRYGKGLYFANCASK

SEQ ID NO: 2708262 - protein, 26 aa, Entamoeba histolytica
CNHETHKLILWKMKREAETLELFKEN

SEQ ID NO: 2708263 - protein, 30 aa, Entamoeba histolytica
CNHMTCKCGYQFCWLCGVKYSSDHWTNNTT

SEQ ID NO: 2708264 - protein, 27 aa, Entamoeba histolytica
CNKDDIIFISFSKYLDYLVIIYNQFHM

SEQ ID NO: 2708265 - protein, 23 aa, Entamoeba histolytica
CNKDLVIGVYKYGFSSSEYLQQD

SEQ ID NO: 2708266 - protein, 29 aa, Entamoeba histolytica
CNKKYKEQAIWFLNAYWLENGEAEAENVW

SEQ ID NO: 2708267 - protein, 19 aa, Entamoeba histolytica
CNKVFITNSSGIEGIISQC

SEQ ID NO: 2708268 - protein, 26 aa, Entamoeba histolytica
CNKWKKYVNNILNYLISFIERSQPLF

SEQ ID NO: 2708269 - protein, 25 aa, Entamoeba histolytica
CNLLGKFELTGIPPAPRGVPQIEVT

SEQ ID NO: 2708270 - protein, 21 aa, Entamoeba histolytica
CNLLGRFELTGIAPAPRGVPK

SEQ ID NO: 2708271 - protein, 17 aa, Entamoeba histolytica
CNLLLDSPLILKYSMEN

SEQ ID NO: 2708272 - protein, 21 aa, Entamoeba histolytica
CNLPLLEHMTFIDSPGVLSGE

SEQ ID NO: 2708273 - protein, 27 aa, Entamoeba histolytica
CNMNLELPFVPFLSKADLLGGYGFNVK

SEQ ID NO: 2708274 - protein, 25 aa, Entamoeba histolytica
CNNQRIIKCYGIASSWYSISSQLQH

SEQ ID NO: 2708275 - protein, 25 aa, Entamoeba histolytica
CNNRVKLMRIIYNRIILEGPNVRAT

SEQ ID NO: 2708276 - protein, 26 aa, Entamoeba histolytica
CNQNPDLLCTWYLDNTCCVWNVETRR

SEQ ID NO: 2708277 - protein, 19 aa, Entamoeba histolytica
CNRLRIAVPGISIATDIIC

SEQ ID NO: 2708278 - protein, 24 aa, Entamoeba histolytica
CNRNWCHCIILSNPIQLYGQYYYP

SEQ ID NO: 2708279 - protein, 22 aa, Entamoeba histolytica
CNRYPLLPLGLYDNPGMEPVRL

SEQ ID NO: 2708280 - protein, 18 aa, Entamoeba histolytica
CNSFVSDCIYYFTTSSIS

SEQ ID NO: 2708281 - protein, 25 aa, Entamoeba histolytica
CNSISWIILSFISPNNIYGVKNHYL

SEQ ID NO: 2708282 - protein, 27 aa, Entamoeba histolytica
CNTDDFIYKMIRLSIKNNIGLIGPSFP

SEQ ID NO: 2708283 - protein, 36 aa, Entamoeba histolytica
CNTGILFKTIQQTTLLIYLTGFVRLKIRVDDNTFTQ

SEQ ID NO: 2708284 - protein, 27 aa, Entamoeba histolytica
CNVGFGIPEFPKLLPCMHMICRDCLFQ

SEQ ID NO: 2708285 - protein, 24 aa, Entamoeba histolytica
CNYPIQLGCRLAKKAKIIKFKHND

SEQ ID NO: 2708286 - protein, 32 aa, Entamoeba histolytica
CPANIFDFSKFRVLLYITSSYQPLIPSFGTME

SEQ ID NO: 2708287 - protein, 27 aa, Entamoeba histolytica
CPDIEWHFIGRLQSNKLKLLVSTPHLK

SEQ ID NO: 2708288 - protein, 25 aa, Entamoeba histolytica
CPEGIDVVWLWVNGSDPTFRKQLEK

SEQ ID NO: 2708289 - protein, 28 aa, Entamoeba histolytica
CPGFLFEWYMVWFCRILPCDFCYAIIDL

SEQ ID NO: 2708290 - protein, 18 aa, Entamoeba histolytica
CPGVFIGTQLTAMNLNWL

SEQ ID NO: 2708291 - protein, 25 aa, Entamoeba histolytica
CPICLKFFKYFIPLSSTIKKYHHFG

SEQ ID NO: 2708292 - protein, 17 aa, Entamoeba histolytica
CPITCVFDLLFVNKKIK

SEQ ID NO: 2708293 - protein, 35 aa, Entamoeba histolytica
CPIYDKFLYDIIEHPFYKYFMRGMLVTLATDSPMH

SEQ ID NO: 2708294 - protein, 34 aa, Entamoeba histolytica
CPKKRFDYSTNTGYPQFLWRYSSLSNKVLPESIC

SEQ ID NO: 2708295 - protein, 18 aa, Entamoeba histolytica
CPKVWIKNPVLQNSMIKF

SEQ ID NO: 2708296 - protein, 19 aa, Entamoeba histolytica
CPLSFCPITIPVKGVLCKH

SEQ ID NO: 2708297 - protein, 22 aa, Entamoeba histolytica
CPNKRCVVTLPFLRILEIQRGT

SEQ ID NO: 2708298 - protein, 17 aa, Entamoeba histolytica
CPNLINQDIHLSLPSMN

SEQ ID NO: 2708299 - protein, 23 aa, Entamoeba histolytica
CPNPAFIMQLYEWQRKYHSCVGN

SEQ ID NO: 2708300 - protein, 23 aa, Entamoeba histolytica
CPNPFQLPPMTPDSFRKAFENIH

SEQ ID NO: 2708301 - protein, 20 aa, Entamoeba histolytica
CPNSTCQTFYHLLCLKRLGR

SEQ ID NO: 2708302 - protein, 18 aa, Entamoeba histolytica
CPTALLIPSYLPNIPYEL

SEQ ID NO: 2708303 - protein, 24 aa, Entamoeba histolytica
CPTNLLCKSLFEAIIPEVFVDKVK

SEQ ID NO: 2708304 - protein, 23 aa, Entamoeba histolytica
CPVIYKLLSILIINNLPIDIIIS

SEQ ID NO: 2708305 - protein, 17 aa, Entamoeba histolytica
CQCEFVCQLYLSAAFSN

SEQ ID NO: 2708306 - protein, 26 aa, Entamoeba histolytica
CQESIPIQLPSLLPPIQFVYEIVPNN

SEQ ID NO: 2708307 - protein, 19 aa, Entamoeba histolytica
CQKFFTAIGIHVFPFCLQF

SEQ ID NO: 2708308 - protein, 23 aa, Entamoeba histolytica
CQKKEMKILVKAMAKKLNKKEMK

SEQ ID NO: 2708309 - protein, 17 aa, Entamoeba histolytica
CQLTPIVLSPQTSSKFP

SEQ ID NO: 2708310 - protein, 17 aa, Entamoeba histolytica
CQPDHLIAVPRVLQRIK

SEQ ID NO: 2708311 - protein, 24 aa, Entamoeba histolytica
CQQPIRLHQQLIYTLPSSITSAIA

SEQ ID NO: 2708312 - protein, 17 aa, Entamoeba histolytica
CQQPLINPLLHNPLIKQ

SEQ ID NO: 2708313 - protein, 23 aa, Entamoeba histolytica
CQQPRIFELLKQLELLIKKINPS

SEQ ID NO: 2708314 - protein, 23 aa, Entamoeba histolytica
CQSNLLKKPLPLLLPNFTQNDTE

SEQ ID NO: 2708315 - protein, 18 aa, Entamoeba histolytica
CQSQELFKKIFTPSVLEV

SEQ ID NO: 2708316 - protein, 24 aa, Entamoeba histolytica
CQTQNHIFYLYNDHLECYSLIHDQ

SEQ ID NO: 2708317 - protein, 28 aa, Entamoeba histolytica
CQTSNDHFCIFDLPAGSYEIFAYNDESL

SEQ ID NO: 2708318 - protein, 21 aa, Entamoeba histolytica
CQYALDKPFLPLPCTLKAMDK

SEQ ID NO: 2708319 - protein, 44 aa, Entamoeba histolytica
CQYNLYPVHFLVFLKMVHSFIYYYPYQFGFNSTLIHFLYQHCNS

SEQ ID NO: 2708320 - protein, 23 aa, Entamoeba histolytica
CQYPLSSYTLQLGYSLTISNIII

SEQ ID NO: 2708321 - protein, 26 aa, Entamoeba histolytica
CQYYEEIVLFVLIMEKIMGRIDLPFI

SEQ ID NO: 2708322 - protein, 22 aa, Entamoeba histolytica
CRFRGHLNMIQGALFIPGFVVS

SEQ ID NO: 2708323 - protein, 18 aa, Entamoeba histolytica
CRILPCDFCYAIIDLCLL

SEQ ID NO: 2708324 - protein, 29 aa, Entamoeba histolytica
CRKDNRERYFYLFNDLLVYGIGDENKIKV

SEQ ID NO: 2708325 - protein, 24 aa, Entamoeba histolytica
CRKQLLPTPIIKLPITLDIVMHPK

SEQ ID NO: 2708326 - protein, 24 aa, Entamoeba histolytica
CRKSAFQWVQLPSNCYIIDSADNE

SEQ ID NO: 2708327 - protein, 27 aa, Entamoeba histolytica
CRKTPKPRYFILFNDQLIYGTETMGIV

SEQ ID NO: 2708328 - protein, 28 aa, Entamoeba histolytica
CRLTSYNYMYIIPSFRKIVIQLVSQLRH

SEQ ID NO: 2708329 - protein, 18 aa, Entamoeba histolytica
CRQTNIEQFLPILNRFLP

SEQ ID NO: 2708330 - protein, 28 aa, Entamoeba histolytica
CRTILNVARVIWLKNQQFIGDAGLVKYC

SEQ ID NO: 2708331 - protein, 24 aa, Entamoeba histolytica
CRYERFFQRFIPKTDFVYDGELSS

SEQ ID NO: 2708332 - protein, 24 aa, Entamoeba histolytica
CRYERFFQRFIPKTDFVYDSELSS

SEQ ID NO: 2708333 - protein, 25 aa, Entamoeba histolytica
CRYPNLLEGWIKYLYGRLKDPSALV

SEQ ID NO: 2708334 - protein, 23 aa, Entamoeba histolytica
CSALRALMYVDLSAAVRYVIKKS

SEQ ID NO: 2708335 - protein, 24 aa, Entamoeba histolytica
CSDCLNIIFDTPGIHYCPICKQKI

SEQ ID NO: 2708336 - protein, 27 aa, Entamoeba histolytica
CSDDGNIIFYKLSPKKVDLINKIHVSK

SEQ ID NO: 2708337 - protein, 25 aa, Entamoeba histolytica
CSFTGAPELPPCPPPPEPINEEINP

SEQ ID NO: 2708338 - protein, 21 aa, Entamoeba histolytica
CSGIHMEFGHRVKSVSLAIFS

SEQ ID NO: 2708339 - protein, 22 aa, Entamoeba histolytica
CSHNTFIRYLQNSISSFYKNAF

SEQ ID NO: 2708340 - protein, 30 aa, Entamoeba histolytica; identical to SEQ ID NO: 2519882

SEQ ID NO: 2708341 - protein, 17 aa, Entamoeba histolytica
CSINFPSIGFEIPSTAQ

SEQ ID NO: 2708342 - protein, 26 aa, Entamoeba histolytica
CSIRKFSTIYLFNFPEMDLSPFILKL

SEQ ID NO: 2708343 - protein, 32 aa, Entamoeba histolytica
CSKGKIAHNTLLPWNVYVYDGGNDVYLWIGTR

SEQ ID NO: 2708344 - protein, 22 aa, Entamoeba histolytica
CSKIPIIYDAIDFTPYGPIYIV

SEQ ID NO: 2708345 - protein, 24 aa, Entamoeba histolytica
CSLGSFLLCHGGISPKLNVLDDIR

SEQ ID NO: 2708346 - protein, 19 aa, Entamoeba histolytica
CSLPFLFKPYGNCISGMVI

SEQ ID NO: 2708347 - protein, 27 aa, Entamoeba histolytica
CSLQPSHLVLIPYNAFTAVLHALGSSL

SEQ ID NO: 2708348 - protein, 20 aa, Entamoeba histolytica
CSLSMYYSDYYSYQQGFANS

SEQ ID NO: 2708349 - protein, 29 aa, Entamoeba histolytica
CSLVELLLDKYYRTLEGFIVLIEKDWKSF

SEQ ID NO: 2708350 - protein, 19 aa, Entamoeba histolytica
CSMAIRVIAQEPSLLQLKA

SEQ ID NO: 2708351 - protein, 23 aa, Entamoeba histolytica
CSNISDFIFNPYLVDVNVISPNV

SEQ ID NO: 2708352 - protein, 35 aa, Entamoeba histolytica
CSNTKLAKLLSSKLGFPYELLLQINKEVAGLMKSN

SEQ ID NO: 2708353 - protein, 25 aa, Entamoeba histolytica
CSPAFWKFMNLIGTKKPLKGWQNFS

SEQ ID NO: 2708354 - protein, 20 aa, Entamoeba histolytica
CSPIVLHKGLPPLWERFYNF

SEQ ID NO: 2708355 - protein, 22 aa, Entamoeba histolytica
CSQDVYLFKPYMDKIFENINPL

SEQ ID NO: 2708356 - protein, 19 aa, Entamoeba histolytica
CSQILKFKQILSQDAFEFG

SEQ ID NO: 2708357 - protein, 17 aa, Entamoeba histolytica
CSQKNQFIFVLSNLEHL

SEQ ID NO: 2708358 - protein, 34 aa, Entamoeba histolytica
CSQLSKIVLPPLKVLPKGLFYNCGFKEFDVPKGV

SEQ ID NO: 2708359 - protein, 21 aa, Entamoeba histolytica
CSRLILFDPDWNPAKDKQAMA

SEQ ID NO: 2708360 - protein, 24 aa, Entamoeba histolytica
CSRNFGLGTLIPWDKRYLIESLSD

SEQ ID NO: 2708361 - protein, 31 aa, Entamoeba histolytica
CSSIEELELFLKSTCRVLGLNWDEMKQFFNT

SEQ ID NO: 2708362 - protein, 22 aa, Entamoeba histolytica
CSSLFQFPKRLNYLTKMVMINS

SEQ ID NO: 2708363 - protein, 17 aa, Entamoeba histolytica
CSSLFYPVEFHEDKIFE

SEQ ID NO: 2708364 - protein, 18 aa, Entamoeba histolytica
CSSLKWILQVVSKDEFMA

SEQ ID NO: 2708365 - protein, 17 aa, Entamoeba histolytica
CSSLLQTAYCRKEKRCF

SEQ ID NO: 2708366 - protein, 37 aa, Entamoeba histolytica
CSTDVYWSIILKLIIYDLIRDYTDLLLLLIHENNLNY

SEQ ID NO: 2708367 - protein, 27 aa, Entamoeba histolytica
CSTEQYCVMLYHQLLEKIKKGTPVTQM

SEQ ID NO: 2708368 - protein, 25 aa, Entamoeba histolytica
CSTIRTIFMSQPVFLALDAPLTIVG

SEQ ID NO: 2708369 - protein, 26 aa, Entamoeba histolytica
CSTVKISMLLLRTYFIMLEPSLFNED

SEQ ID NO: 2708370 - protein, 24 aa, Entamoeba histolytica
CSVYNKICITVGLGFDSFVVMRHG

SEQ ID NO: 2708371 - protein, 25 aa, Entamoeba histolytica
CSYCYGFAAVRRFLIKNDLVCIVRG

SEQ ID NO: 2708372 - protein, 23 aa, Entamoeba histolytica
CSYKLFLHQLHNILNYGPEIIVC

SEQ ID NO: 2708373 - protein, 22 aa, Entamoeba histolytica
CSYQLLCSLPSLSFLNLSFEII

SEQ ID NO: 2708374 - protein, 18 aa, Entamoeba histolytica
CTCGLDGFINFYTISDYG

SEQ ID NO: 2708375 - protein, 24 aa, Entamoeba histolytica
CTDDIYLIIAVNNKIYFISINTKE

SEQ ID NO: 2708376 - protein, 18 aa, Entamoeba histolytica
CTESIEKQYWRINNKLLK

SEQ ID NO: 2708377 - protein, 32 aa, Entamoeba histolytica
CTEYDCLFPALRSPRLVLLGDIQQLKPVILSD

SEQ ID NO: 2708378 - protein, 23 aa, Entamoeba histolytica
CTGYCYLPCFLPQNQSQSNSLES

SEQ ID NO: 2708379 - protein, 17 aa, Entamoeba histolytica
CTKFTIFHQDYIMREKR

SEQ ID NO: 2708380 - protein, 18 aa, Entamoeba histolytica
CTKPSINPFPPFINETGI

SEQ ID NO: 2708381 - protein, 17 aa, Entamoeba histolytica
CTKQILCIVLQMVYNNV

SEQ ID NO: 2708382 - protein, 24 aa, Entamoeba histolytica
CTLKELPVCTFFNCIELEKIEIPS

SEQ ID NO: 2708383 - protein, 28 aa, Entamoeba histolytica
CTLKGHGDWVLNLDWHYGNKLLASGDKL

SEQ ID NO: 2708384 - protein, 24 aa, Entamoeba histolytica
CTNTSRFQLLLDKSTFTDWQKVKV

SEQ ID NO: 2708385 - protein, 23 aa, Entamoeba histolytica
CTPLPLCVRINQKSKYRDLLKTL

SEQ ID NO: 2708386 - protein, 21 aa, Entamoeba histolytica
CTSLIEQFKVMMGHLSLIDKR

SEQ ID NO: 2708387 - protein, 22 aa, Entamoeba histolytica
CTSLTSVYIPTSLTALCDSAFE

SEQ ID NO: 2708388 - protein, 25 aa, Entamoeba histolytica
CTVKGWNLPFPTKLGETITPSFSLQ

SEQ ID NO: 2708389 - protein, 20 aa, Entamoeba histolytica
CTYTHFAMINPFITIDHTTN

SEQ ID NO: 2708390 - protein, 23 aa, Entamoeba histolytica
CVAKIMWMLYEHPELKLQDIPTQ

SEQ ID NO: 2708391 - protein, 26 aa, Entamoeba histolytica
CVCIHQSIVFLMKLTELLNVAFMRND

SEQ ID NO: 2708392 - protein, 28 aa, Entamoeba histolytica
CVDSDYLIKSYLDDFKKWTGKSQYQVIY

SEQ ID NO: 2708393 - protein, 26 aa, Entamoeba histolytica
CVDVTDIPLLTFARAIGDLLTSYQNL

SEQ ID NO: 2708394 - protein, 18 aa, Entamoeba histolytica
CVEDLKFIDWKCIVGKLT

SEQ ID NO: 2708395 - protein, 17 aa, Entamoeba histolytica
CVFKIGFFLSEMKLRCH

SEQ ID NO: 2708396 - protein, 17 aa, Entamoeba histolytica
CVFLKFTDEYKHHRVIR

SEQ ID NO: 2708397 - protein, 24 aa, Entamoeba histolytica
CVFNIFIQFNLFKQMKEIYNYAKE

SEQ ID NO: 2708398 - protein, 30 aa, Entamoeba histolytica
CVFTALTEWVFSPSFIFFKALSPEIIVDLL

SEQ ID NO: 2708399 - protein, 30 aa, Entamoeba histolytica
CVHQIYLRIIQEIILFYSQKTWNLSQYLTI

SEQ ID NO: 2708400 - protein, 27 aa, Entamoeba histolytica
CVIGSFYGYITYPPAPAMLFMNVDGNE

SEQ ID NO: 2708401 - protein, 20 aa, Entamoeba histolytica
CVIRDYPLMIEINCPSIHNN

SEQ ID NO: 2708402 - protein, 18 aa, Entamoeba histolytica
CVKQPNLTVIFPIPIYPE

SEQ ID NO: 2708403 - protein, 18 aa, Entamoeba histolytica
CVLHIIRKDTKMICGGGC

SEQ ID NO: 2708404 - protein, 19 aa, Entamoeba histolytica
CVLPRLTRWWYEVKQSCVV

SEQ ID NO: 2708405 - protein, 26 aa, Entamoeba histolytica
CVNSKPFLPLLLYTIIQADLSQIWSN

SEQ ID NO: 2708406 - protein, 17 aa, Entamoeba histolytica
CVPFIIMEAVIESSGFI

SEQ ID NO: 2708407 - protein, 18 aa, Entamoeba histolytica
CVQCTLIALLNEQYSFLI

SEQ ID NO: 2708408 - protein, 27 aa, Entamoeba histolytica
CVQKKILRAFLINEHNLIKLAAAKSNL

SEQ ID NO: 2708409 - protein, 21 aa, Entamoeba histolytica
CVQLVNFVPQVFLKAAQVVGE

SEQ ID NO: 2708410 - protein, 19 aa, Entamoeba histolytica
CVSKYKYHIKLTPGNTKAG

SEQ ID NO: 2708411 - protein, 30 aa, Entamoeba histolytica
CVSVYQAKYHLLPQIEILPENKFAIKYLDK

SEQ ID NO: 2708412 - protein, 18 aa, Entamoeba histolytica
CVVCGCPLLFTGHLFDPP

SEQ ID NO: 2708413 - protein, 26 aa, Entamoeba histolytica
CVVHEILLFLYHSLLFENKYFEDKPI

SEQ ID NO: 2708414 - protein, 38 aa, Entamoeba histolytica
CVVPQYAQFELPSNSILQIANSLFFVSINQPDKNSQIL

SEQ ID NO: 2708415 - protein, 27 aa, Entamoeba histolytica
CVYDSYFIFYERIVSLMPKILKELPQL

SEQ ID NO: 2708416 - protein, 17 aa, Entamoeba histolytica
CVYKVFHEEFSINLKDH

SEQ ID NO: 2708417 - protein, 17 aa, Entamoeba histolytica
CWAIGLDPKRSAEISVR

SEQ ID NO: 2708418 - protein, 27 aa, Entamoeba histolytica
CWFKGFDWEGLFQKKLSPPFVPVLKDK

SEQ ID NO: 2708419 - protein, 17 aa, Entamoeba histolytica
CWLVIQDKKYPVWVVLL

SEQ ID NO: 2708420 - protein, 17 aa, Entamoeba histolytica
CWNPLSSQLISGYGRNV

SEQ ID NO: 2708421 - protein, 17 aa, Entamoeba histolytica
CWPAKLFVQKIFTACNR

SEQ ID NO: 2708422 - protein, 26 aa, Entamoeba histolytica
CYAHSDLITSLLFYQSGNSFISTSMD

SEQ ID NO: 2708423 - protein, 18 aa, Entamoeba histolytica
CYAKIAWCPYRWCSHYGQ

SEQ ID NO: 2708424 - protein, 25 aa, Entamoeba histolytica
CYCELPIQCKICNAILLLSHHFARS

SEQ ID NO: 2708425 - protein, 26 aa, Entamoeba histolytica
CYDEKFNVFIVITKLTVENYPSTTNF

SEQ ID NO: 2708426 - protein, 19 aa, Entamoeba histolytica
CYFCNFVAAVSFITQMNEN

SEQ ID NO: 2708427 - protein, 23 aa, Entamoeba histolytica
CYFTYCYSIMKPAELLFTINLID

SEQ ID NO: 2708428 - protein, 24 aa, Entamoeba histolytica
CYGNELIGLLLPFLSEQLKSTEWK

SEQ ID NO: 2708429 - protein, 23 aa, Entamoeba histolytica
CYGSPIPIFTQQGGYTLSISSSV

SEQ ID NO: 2708430 - protein, 25 aa, Entamoeba histolytica
CYHRTFSEYIPIPQYMMRIVSIQTF

SEQ ID NO: 2708431 - protein, 32 aa, Entamoeba histolytica; identical to SEQ ID NO: 2555755

SEQ ID NO: 2708432 - protein, 21 aa, Entamoeba histolytica
CYLLKQIKPAQLTKLVLCGCS

SEQ ID NO: 2708433 - protein, 20 aa, Entamoeba histolytica
CYLNLFRIYIKHYRIIKTYV

SEQ ID NO: 2708434 - protein, 18 aa, Entamoeba histolytica
CYPNTVAAWRQGVEMPLN

SEQ ID NO: 2708435 - protein, 17 aa, Entamoeba histolytica
CYRLFTENTFKYDLLES

SEQ ID NO: 2708436 - protein, 25 aa, Entamoeba histolytica
CYSFKNDTFLLKKKELPMIPNIIIE

SEQ ID NO: 2708437 - protein, 18 aa, Entamoeba histolytica
CYSLAQYQWSLISNRTYY

SEQ ID NO: 2708438 - protein, 26 aa, Entamoeba histolytica
CYSRNDFLLLNKIYSSHIPYFASSCC

SEQ ID NO: 2708439 - protein, 25 aa, Entamoeba histolytica
DAAGNIILWDYFNNTPLISYSNVSN

SEQ ID NO: 2708440 - protein, 24 aa, Entamoeba histolytica
DAALDPLGWTGHSGMAILAPHLTR

SEQ ID NO: 2708441 - protein, 30 aa, Entamoeba histolytica
DAAQQSFLIGLLVNNGFLVKLKKLYKRGKT

SEQ ID NO: 2708442 - protein, 27 aa, Entamoeba histolytica
DACSLYPSAMKRLLIPTGYPKMITQSI

SEQ ID NO: 2708443 - protein, 24 aa, Entamoeba histolytica
DACWTLQYIALIPEQFKLVLTKQV

SEQ ID NO: 2708444 - protein, 26 aa, Entamoeba histolytica
DADEFIRLIQWSISTCFYKLDDERSW

SEQ ID NO: 2708445 - protein, 23 aa, Entamoeba histolytica
DADFGILPSRRFICCGPMYLTNN

SEQ ID NO: 2708446 - protein, 19 aa, Entamoeba histolytica
DAEFPLTLEPKIEKLTFGS

SEQ ID NO: 2708447 - protein, 18 aa, Entamoeba histolytica
DAEGVPSMLFSTIKKCPL

SEQ ID NO: 2708448 - protein, 30 aa, Entamoeba histolytica
DAEMCIKIKPDFIKGYNRKAFSHFCMKEYN

SEQ ID NO: 2708449 - protein, 33 aa, Entamoeba histolytica; identical to SEQ ID NO: 2520000

SEQ ID NO: 2708450 - protein, 28 aa, Entamoeba histolytica
DAFFKLRTYQVYQQGVLLVLLNNHFEIT

SEQ ID NO: 2708451 - protein, 27 aa, Entamoeba histolytica
DAFKYQIKGYKYFLLSHFHSDHYLGLS

SEQ ID NO: 2708452 - protein, 27 aa, Entamoeba histolytica
DAFPTAFHIAGLWKIDRLIAEMKLCYE

SEQ ID NO: 2708453 - protein, 18 aa, Entamoeba histolytica
DAFVVMYSVTNKNSFLHL

SEQ ID NO: 2708454 - protein, 34 aa, Entamoeba histolytica
DAGNIISNPKWYENPQFLLTLTGKLHIKVCLKQD

SEQ ID NO: 2708455 - protein, 31 aa, Entamoeba histolytica
DAIDFGYVRFYMITLPYFTTPETVLHFICDN

SEQ ID NO: 2708456 - protein, 28 aa, Entamoeba histolytica
DAILALCSQFLLFGIKNENIRITISKIL

SEQ ID NO: 2708457 - protein, 26 aa, Entamoeba histolytica
DAILRRFSRRILVDLPTKEDRENILK

SEQ ID NO: 2708458 - protein, 34 aa, Entamoeba histolytica; identical to SEQ ID NO: 2520005

SEQ ID NO: 2708459 - protein, 23 aa, Entamoeba histolytica
DAKFNIYFNYWDDTFRSLVSEIK

SEQ ID NO: 2708460 - protein, 30 aa, Entamoeba histolytica
DAKHRNYVHYIILMLLKTISIKYNIEELAT

SEQ ID NO: 2708461 - protein, 19 aa, Entamoeba histolytica
DAKLILQYCLLSIKFRQDY

SEQ ID NO: 2708462 - protein, 36 aa, Entamoeba histolytica
DAKTAFKRLVYSRYRGIPLYLEWAPEKVFDEEKVNK

SEQ ID NO: 2708463 - protein, 20 aa, Entamoeba histolytica
DALCVLRRVLESNTVIVGGG

SEQ ID NO: 2708464 - protein, 20 aa, Entamoeba histolytica
DALFAIQQKLFHNKLTIVIL

SEQ ID NO: 2708465 - protein, 20 aa, Entamoeba histolytica
DALKLFHIFLQRMKDYGMKK

SEQ ID NO: 2708466 - protein, 25 aa, Entamoeba histolytica
DALKRYGFENIPVDTFLTLGSLAEG

SEQ ID NO: 2708467 - protein, 20 aa, Entamoeba histolytica
DALLAVPHALAENSGLNAIE

SEQ ID NO: 2708468 - protein, 20 aa, Entamoeba histolytica
DALLIVIDLTQSTSLEWARN

SEQ ID NO: 2708469 - protein, 20 aa, Entamoeba histolytica
DALQFAYYRTISGDEESKRV

SEQ ID NO: 2708470 - protein, 23 aa, Entamoeba histolytica
DALSAYCRYLPPAGTLFQPLVAS

SEQ ID NO: 2708471 - protein, 24 aa, Entamoeba histolytica
DALTLVYNHLLKEGLIKAAETLRQ

SEQ ID NO: 2708472 - protein, 18 aa, Entamoeba histolytica
DALTRRNTVKRKPTIMCT

SEQ ID NO: 2708473 - protein, 21 aa, Entamoeba histolytica
DALVKIKLSFRPGAVDAEKAV

SEQ ID NO: 2708474 - protein, 20 aa, Entamoeba histolytica
DAMDDAELIMFLPQLIQALK

SEQ ID NO: 2708475 - protein, 24 aa, Entamoeba histolytica
DAMIFKPLCRSLLGTNIKAIVIGG

SEQ ID NO: 2708476 - protein, 23 aa, Entamoeba histolytica
DAMRDIKQLEYDKVALNGEITEL

SEQ ID NO: 2708477 - protein, 19 aa, Entamoeba histolytica
DAMRFALLAYMTQGHDINL

SEQ ID NO: 2708478 - protein, 26 aa, Entamoeba histolytica
DANDEQLLLLLLKTTLKLCNFDYRTN

SEQ ID NO: 2708479 - protein, 28 aa, Entamoeba histolytica
DANWENVYSIQFLLINYPSDLPNVNTFI

SEQ ID NO: 2708480 - protein, 24 aa, Entamoeba histolytica
DAPRAVFPSIVGRPRHVSVMAGMG

SEQ ID NO: 2708481 - protein, 18 aa, Entamoeba histolytica
DAQKLLKIAQRSSASMGN

SEQ ID NO: 2708482 - protein, 18 aa, Entamoeba histolytica
DARKPCVVFATLASFSVG

SEQ ID NO: 2708483 - protein, 20 aa, Entamoeba histolytica
DASDPWISQILSLQQTNNQN

SEQ ID NO: 2708484 - protein, 23 aa, Entamoeba histolytica
DATEFYLLLLDHLHEAIIGKGKN

SEQ ID NO: 2708485 - protein, 26 aa, Entamoeba histolytica
DATVVDFICSFGRILEILILNKEMTE

SEQ ID NO: 2708486 - protein, 22 aa, Entamoeba histolytica
DAVIERYLQIVLKLAQVRFVEK

SEQ ID NO: 2708487 - protein, 33 aa, Entamoeba histolytica; identical to SEQ ID NO: 2520041

SEQ ID NO: 2708488 - protein, 61 aa, Entamoeba histolytica; identical to SEQ ID NO: 2520043

SEQ ID NO: 2708489 - protein, 41 aa, Entamoeba histolytica; identical to SEQ ID NO: 2520044

SEQ ID NO: 2708490 - protein, 24 aa, Entamoeba histolytica
DCDDPFFMTTYAKDIFKYLKEEEE

SEQ ID NO: 2708491 - protein, 19 aa, Entamoeba histolytica
DCDTQHLEYLWSLVKGMNS

SEQ ID NO: 2708492 - protein, 23 aa, Entamoeba histolytica
DCEIALICFNSTNNKIFVYSSGD

SEQ ID NO: 2708493 - protein, 27 aa, Entamoeba histolytica
DCEKILDLYFRLLSTFKLLRQESIENN

SEQ ID NO: 2708494 - protein, 34 aa, Entamoeba histolytica
DCEKMAKINGLYRSLQLFGISTTDFYQQYRSLLL

SEQ ID NO: 2708495 - protein, 17 aa, Entamoeba histolytica
DCENEMFLWLGNKCQVK

SEQ ID NO: 2708496 - protein, 24 aa, Entamoeba histolytica
DCESLVQYLKAFDIINLVLQTKDN

SEQ ID NO: 2708497 - protein, 19 aa, Entamoeba histolytica
DCFCRCFNLTYINLPCSIT

SEQ ID NO: 2708498 - protein, 22 aa, Entamoeba histolytica
DCFKKFFVFDDGYSSLKEVGIN

SEQ ID NO: 2708499 - protein, 17 aa, Entamoeba histolytica
DCGKSYLLKFEVPGIDK

SEQ ID NO: 2708500 - protein, 27 aa, Entamoeba histolytica
DCHQQSFLIGLLISLGYSITIKKPHKK

SEQ ID NO: 2708501 - protein, 19 aa, Entamoeba histolytica
DCIILPYENKWTFWDCGSS

SEQ ID NO: 2708502 - protein, 23 aa, Entamoeba histolytica
DCILELPLFIEKLSAIQSQIEYL

SEQ ID NO: 2708503 - protein, 17 aa, Entamoeba histolytica
DCILVAKTNERFVDVFC

SEQ ID NO: 2708504 - protein, 24 aa, Entamoeba histolytica
DCKDFILGLLTVKASSRLSSQQAI

SEQ ID NO: 2708505 - protein, 24 aa, Entamoeba histolytica
DCLNLKMVTQKILLPSLKGYTKQG

SEQ ID NO: 2708506 - protein, 25 aa, Entamoeba histolytica
DCLSQYNPILPNPILFSVIKVMESI

SEQ ID NO: 2708507 - protein, 20 aa, Entamoeba histolytica
DCLTPILSKQFSITKTIIVE

SEQ ID NO: 2708508 - protein, 20 aa, Entamoeba histolytica
DCMEITSITLPWRISAVHSI

SEQ ID NO: 2708509 - protein, 23 aa, Entamoeba histolytica
DCNSVFLKDKLVWMGLCDQNTGK

SEQ ID NO: 2708510 - protein, 21 aa, Entamoeba histolytica
DCPQIHIPWFKMIANEHEKRG

SEQ ID NO: 2708511 - protein, 22 aa, Entamoeba histolytica
DCRLFHYSLRECKVKKIVGTGH

SEQ ID NO: 2708512 - protein, 32 aa, Entamoeba histolytica
DCRNNSFIYCYLSNLLYPFRKMNRCLFCSQPF

SEQ ID NO: 2708513 - protein, 21 aa, Entamoeba histolytica
DCSHFLPPTSLIYKDIPGFTS

SEQ ID NO: 2708514 - protein, 25 aa, Entamoeba histolytica
DCSIQFFQLSDLWLSTVRLGGVGDE

SEQ ID NO: 2708515 - protein, 30 aa, Entamoeba histolytica
DCSVGRIPPSPLLPIIANLAAQKQLSDIKV

SEQ ID NO: 2708516 - protein, 26 aa, Entamoeba histolytica
DCSYSYCLPLFIISYGVNQPVTYLPP

SEQ ID NO: 2708517 - protein, 25 aa, Entamoeba histolytica
DCTGLAVRAALLNTLIPIVNVISGD

SEQ ID NO: 2708518 - protein, 24 aa, Entamoeba histolytica
DCTSIINLLLSFIYQMLQTVPIEY

SEQ ID NO: 2708519 - protein, 27 aa, Entamoeba histolytica
DCVHLLPSHFHQLLRFISVEVGNKKSV

SEQ ID NO: 2708520 - protein, 22 aa, Entamoeba histolytica
DCVLMLLFVINEYNMGFFTPTL

SEQ ID NO: 2708521 - protein, 21 aa, Entamoeba histolytica
DCWISLWLRSIDNELLFIKKK

SEQ ID NO: 2708522 - protein, 24 aa, Entamoeba histolytica
DDAKTDIFLCIVLKYIYDNCWPKA

SEQ ID NO: 2708523 - protein, 26 aa, Entamoeba histolytica
DDARDKLIRYIGFDIIDLSPIIEQSI

SEQ ID NO: 2708524 - protein, 30 aa, Entamoeba histolytica
DDARNLFLLLREVFFVHSPPKLFGGSLEDI

SEQ ID NO: 2708525 - protein, 27 aa, Entamoeba histolytica
DDAYKHYFDCIFGPYTSFVLKGINILE

SEQ ID NO: 2708526 - protein, 21 aa, Entamoeba histolytica
DDAYLFLTNLLDILNEDNKAL

SEQ ID NO: 2708527 - protein, 36 aa, Entamoeba histolytica
DDCLKLIQQALPLPEAMFILYKITKDMQYLICAADS

SEQ ID NO: 2708528 - protein, 27 aa, Entamoeba histolytica
DDDDIAAALAKKRSERAKKFAISDSDS

SEQ ID NO: 2708529 - protein, 24 aa, Entamoeba histolytica
DDDKKKLFNKLKDDIKKIGGKVKG

SEQ ID NO: 2708530 - protein, 23 aa, Entamoeba histolytica
DDDMIFKIRFDAGVTDLIWRNQT

SEQ ID NO: 2708531 - protein, 39 aa, Entamoeba histolytica
DDDNCFIIFTQLQKFIKQYPFILQSIYKLSIEYDSVTLG

SEQ ID NO: 2708532 - protein, 26 aa, Entamoeba histolytica
DDDPYQLNFSQAYIRSVLPPELWKRI

SEQ ID NO: 2708533 - protein, 21 aa, Entamoeba histolytica
DDEDFTVEQPPFLGNGNDPDI

SEQ ID NO: 2708534 - protein, 20 aa, Entamoeba histolytica
DDEKLKEKIAKRKQEVAAAR

SEQ ID NO: 2708535 - protein, 29 aa, Entamoeba histolytica
DDENLTDLRFLLFPCHYESHWFTVIVCNK

SEQ ID NO: 2708536 - protein, 25 aa, Entamoeba histolytica
DDEQYTLYFVLRHLHNIYSNNDFNE

SEQ ID NO: 2708537 - protein, 24 aa, Entamoeba histolytica
DDFDWEEALGLVQSNLNKEEEKEE

SEQ ID NO: 2708538 - protein, 23 aa, Entamoeba histolytica
DDFITKLVTLPRISLEKSKEVLR

SEQ ID NO: 2708539 - protein, 30 aa, Entamoeba histolytica
DDFLNDPTLIRLFLQNGLFKEFFEKHPEME

SEQ ID NO: 2708540 - protein, 31 aa, Entamoeba histolytica; identical to SEQ ID NO: 2520096

SEQ ID NO: 2708541 - protein, 25 aa, Entamoeba histolytica
DDGISLLRWSLLRPSDYKGVSPLTN

SEQ ID NO: 2708542 - protein, 22 aa, Entamoeba histolytica
DDGQYFLLGYQNGSIDLFQSQT

SEQ ID NO: 2708543 - protein, 26 aa, Entamoeba histolytica
DDGRIIELCIYLLLAVVIEKLPLPST

SEQ ID NO: 2708544 - protein, 18 aa, Entamoeba histolytica
DDGTLPPVPPKPRSGLMN

SEQ ID NO: 2708545 - protein, 22 aa, Entamoeba histolytica
DDGYLWVAMEYMDGGCLTDLLN

SEQ ID NO: 2708546 - protein, 24 aa, Entamoeba histolytica
DDIHKYYHIYDRWDNPQSSVSPLT

SEQ ID NO: 2708547 - protein, 24 aa, Entamoeba histolytica
DDIIFQNFAMRLLQAVGLRDSQGV

SEQ ID NO: 2708548 - protein, 17 aa, Entamoeba histolytica
DDIIFYEYQCGLAMMLF

SEQ ID NO: 2708549 - protein, 29 aa, Entamoeba histolytica
DDIKKKIMIFVEKLYYYNPSRLFIITSSF

SEQ ID NO: 2708550 - protein, 22 aa, Entamoeba histolytica
DDILELQAMVSNLKQNLAGLQQ

SEQ ID NO: 2708551 - protein, 20 aa, Entamoeba histolytica
DDILFIIPDHKLKSNELHCI

SEQ ID NO: 2708552 - protein, 23 aa, Entamoeba histolytica
DDIMNTLLFHLQIKDSLAIHSLL

SEQ ID NO: 2708553 - protein, 23 aa, Entamoeba histolytica
DDIPQLCSIYSPTKAYKIGEWCK

SEQ ID NO: 2708554 - protein, 29 aa, Entamoeba histolytica
DDIQPCEWGIPCDLLLLKEVKKYGLEPPK

SEQ ID NO: 2708555 - protein, 28 aa, Entamoeba histolytica
DDISNLIKLWFRELPRPILNVLSCDQIF

SEQ ID NO: 2708556 - protein, 27 aa, Entamoeba histolytica
DDIVKINIFPLYKWTTSIVNFSENILG

SEQ ID NO: 2708557 - protein, 20 aa, Entamoeba histolytica
DDIVPCCSVPVRLPSVGFDN

SEQ ID NO: 2708558 - protein, 22 aa, Entamoeba histolytica
DDKALIVLLTFINSFGLILNQE

SEQ ID NO: 2708559 - protein, 24 aa, Entamoeba histolytica
DDKDLPVCFILTKSDQLQQTVELS

SEQ ID NO: 2708560 - protein, 24 aa, Entamoeba histolytica
DDKKKLIERLSQIKIIEPEQLRKV

SEQ ID NO: 2708561 - protein, 28 aa, Entamoeba histolytica
DDKNVKGIITWFSLHNCQTRFEGTRKEN

SEQ ID NO: 2708562 - protein, 28 aa, Entamoeba histolytica
DDKNYWCTAKPNLLLKLKHINPCPYRPF

SEQ ID NO: 2708563 - protein, 30 aa, Entamoeba histolytica
DDLESLAYMFIYFLKGKLPWQGFNRQNNTE

SEQ ID NO: 2708564 - protein, 28 aa, Entamoeba histolytica
DDLESLGYLFVYLLKGSLPWQDLSSSPD

SEQ ID NO: 2708565 - protein, 34 aa, Entamoeba histolytica
DDLHCTITINLLQSLTGFKLTIPFLDGSEVSKKI

SEQ ID NO: 2708566 - protein, 24 aa, Entamoeba histolytica
DDLHCTKNITLLQALTGCEIEIPH

SEQ ID NO: 2708567 - protein, 30 aa, Entamoeba histolytica
DDLHFECVSILLLDLHKFIQKKTTIGLYNK

SEQ ID NO: 2708568 - protein, 18 aa, Entamoeba histolytica
DDLKYLCSDFLDCFDKEQ

SEQ ID NO: 2708569 - protein, 19 aa, Entamoeba histolytica
DDLLLLIKNIYENPTPIQC

SEQ ID NO: 2708570 - protein, 22 aa, Entamoeba histolytica
DDLLNLLTFEMIKDISNNYPSC

SEQ ID NO: 2708571 - protein, 26 aa, Entamoeba histolytica
DDLQILQIDYFLKTPFLEELCLNRCS

SEQ ID NO: 2708572 - protein, 24 aa, Entamoeba histolytica
DDLYKKILFSVIPIEKVQTHQSLI

SEQ ID NO: 2708573 - protein, 32 aa, Entamoeba histolytica; identical to SEQ ID NO: 2520123

SEQ ID NO: 2708574 - protein, 28 aa, Entamoeba histolytica
DDMESLAYMFIYFMKGNLPWQGIKGTTK

SEQ ID NO: 2708575 - protein, 28 aa, Entamoeba histolytica
DDMESLAYSVIYLLRGSLPWQGLHVAKG

SEQ ID NO: 2708576 - protein, 26 aa, Entamoeba histolytica
DDMVRYWVNKMALVSKTFGVFGYPLS

SEQ ID NO: 2708577 - protein, 27 aa, Entamoeba histolytica
DDNGRKFATPFFLLKKAFECCVIKSQF

SEQ ID NO: 2708578 - protein, 21 aa, Entamoeba histolytica
DDNKNYHCWSHRVWVCNKFNC

SEQ ID NO: 2708579 - protein, 24 aa, Entamoeba histolytica
DDNLTKYWKYWTDNLPTKTSKQPL

SEQ ID NO: 2708580 - protein, 27 aa, Entamoeba histolytica
DDNNEYEYYYLLPDGSLGKDTGFGVFK

SEQ ID NO: 2708581 - protein, 17 aa, Entamoeba histolytica
DDNPIVSPIIRVFGESL

SEQ ID NO: 2708582 - protein, 26 aa, Entamoeba histolytica
DDPGWTYALDLLLIRSIATKGYKKMF

SEQ ID NO: 2708583 - protein, 25 aa, Entamoeba histolytica
DDPKTIIIFKYNENVLKDGRFSQTY

SEQ ID NO: 2708584 - protein, 19 aa, Entamoeba histolytica
DDPLRVFRGIRFSAKYGFK

SEQ ID NO: 2708585 - protein, 26 aa, Entamoeba histolytica
DDPNNYFYFQKCHGCALVFDRTSQES

SEQ ID NO: 2708586 - protein, 22 aa, Entamoeba histolytica
DDQHFIFSLKKENKTCPKRWFI

SEQ ID NO: 2708587 - protein, 18 aa, Entamoeba histolytica
DDQHVLLNRLKIITKING

SEQ ID NO: 2708588 - protein, 22 aa, Entamoeba histolytica
DDQSFLFTLVNPSKVPMKVIRK

SEQ ID NO: 2708589 - protein, 19 aa, Entamoeba histolytica
DDRPNVCGLILAGIADFKT

SEQ ID NO: 2708590 - protein, 29 aa, Entamoeba histolytica
DDRTIRIWNWMSRQCILILPGHEHYVMSA

SEQ ID NO: 2708591 - protein, 27 aa, Entamoeba histolytica
DDRTIRIWNYLSFKCIAILTGHDHYVL

SEQ ID NO: 2708592 - protein, 26 aa, Entamoeba histolytica
DDSDYYITGLLKIAKLLLPKVEIIPE

SEQ ID NO: 2708593 - protein, 25 aa, Entamoeba histolytica
DDSHCLLLFRKGLSQGILDLCIASI

SEQ ID NO: 2708594 - protein, 42 aa, Entamoeba histolytica
DDSIGDRLGINTLKLFKICYNSTTFNNYRDWLLQYIKGEISI

SEQ ID NO: 2708595 - protein, 22 aa, Entamoeba histolytica
DDSINKFCSFDWWCQAIESGEK

SEQ ID NO: 2708596 - protein, 23 aa, Entamoeba histolytica
DDSLTALTLSKYLEKMDLNAFQE

SEQ ID NO: 2708597 - protein, 23 aa, Entamoeba histolytica
DDSLYIIIPVFLELLGEQVSVGL

SEQ ID NO: 2708598 - protein, 20 aa, Entamoeba histolytica
DDSPEFWDNFVKLVYERGIL

SEQ ID NO: 2708599 - protein, 21 aa, Entamoeba histolytica
DDSVLFVGNKYKLICVSNRIC

SEQ ID NO: 2708600 - protein, 28 aa, Entamoeba histolytica
DDTEGLMAALLKYLKKATSLKNLILEGG

SEQ ID NO: 2708601 - protein, 24 aa, Entamoeba histolytica
DDTPVVVQMNLPPPPPPVTEVEEE

SEQ ID NO: 2708602 - protein, 25 aa, Entamoeba histolytica
DDTTLIEIFMFKPGHFEIAPEARYG

SEQ ID NO: 2708603 - protein, 25 aa, Entamoeba histolytica
DDTTSLYQYLLTQLMQLQKQNVETQ

SEQ ID NO: 2708604 - protein, 25 aa, Entamoeba histolytica
DDVKRLTHFACLYSKLIGANTELFE

SEQ ID NO: 2708605 - protein, 20 aa, Entamoeba histolytica
DDVKTHIQLLRVTPKKRKGE

SEQ ID NO: 2708606 - protein, 17 aa, Entamoeba histolytica
DDWAIGVLTFELCTGSV

SEQ ID NO: 2708607 - protein, 18 aa, Entamoeba histolytica
DDYLIFDAMRTCNQCLGK

SEQ ID NO: 2708608 - protein, 24 aa, Entamoeba histolytica
DDYTYYRYCELLITGFIEGNKDFL

SEQ ID NO: 2708609 - protein, 24 aa, Entamoeba histolytica
DEARYFLADFRYILQAITILPAHV

SEQ ID NO: 2708610 - protein, 20 aa, Entamoeba histolytica
DECSRLLFFVEHHAFDVCKI

SEQ ID NO: 2708611 - protein, 34 aa, Entamoeba histolytica
DECVSPRRHPFYGGSPMPCMMIAEELNKRNKREP

SEQ ID NO: 2708612 - protein, 23 aa, Entamoeba histolytica
DEDILFKVLTLLKTFYSINDDKR

SEQ ID NO: 2708613 - protein, 26 aa, Entamoeba histolytica
DEDIPLELMRILRIVNLSIIESNQYF

SEQ ID NO: 2708614 - protein, 28 aa, Entamoeba histolytica
DEDQLIPNLFRYILPWETEFKDSQRVWM

SEQ ID NO: 2708615 - protein, 30 aa, Entamoeba histolytica
DEDRRIEPKYYFPIIPTVLVNGADGIGTGW

SEQ ID NO: 2708616 - protein, 34 aa, Entamoeba histolytica
DEEDKKVLFNSLALGIKMVMPKEVLKIDNTMLYN

SEQ ID NO: 2708617 - protein, 22 aa, Entamoeba histolytica
DEEHLVIKFLRNSQPQYLQSKL

SEQ ID NO: 2708618 - protein, 26 aa, Entamoeba histolytica
DEEIKYIYTIIKGIRSLNGIYSQAII

SEQ ID NO: 2708619 - protein, 33 aa, Entamoeba histolytica
DEEKEPFWLNIYHTMLLHGLIYMKHRPYPDHRT

SEQ ID NO: 2708620 - protein, 17 aa, Entamoeba histolytica
DEEKIELMFRKKNAKPV

SEQ ID NO: 2708621 - protein, 23 aa, Entamoeba histolytica
DEEPKIIRIVLTGGPGGGKTTSL

SEQ ID NO: 2708622 - protein, 18 aa, Entamoeba histolytica
DEFLKFYKEHYHPSNSLT

SEQ ID NO: 2708623 - protein, 28 aa, Entamoeba histolytica
DEFLSTHYYWIAKQYQLLALIYERSKIN

SEQ ID NO: 2708624 - protein, 24 aa, Entamoeba histolytica
DEFPSSICKCPLLKLYMDNNNISS

SEQ ID NO: 2708625 - protein, 18 aa, Entamoeba histolytica
DEFQCLKPITLGINLTHL

SEQ ID NO: 2708626 - protein, 31 aa, Entamoeba histolytica
DEFTLSMILQLYPSYIPLSFCELIIQATKLN

SEQ ID NO: 2708627 - protein, 22 aa, Entamoeba histolytica
DEFVTWMYNHLLVGYSNEFPLT

SEQ ID NO: 2708628 - protein, 27 aa, Entamoeba histolytica
DEGGVVHFLDLYYDYTKQLLGGVEASI

SEQ ID NO: 2708629 - protein, 23 aa, Entamoeba histolytica
DEGIYWIIGDISMTFVPAFGGRI

SEQ ID NO: 2708630 - protein, 22 aa, Entamoeba histolytica
DEGNIRIWKAFASESTKIKDKR

SEQ ID NO: 2708631 - protein, 36 aa, Entamoeba histolytica; identical to SEQ ID NO: 2520203

SEQ ID NO: 2708632 - protein, 26 aa, Entamoeba histolytica
DEHEGAFIFMQLLEGMNYLHSQHIIH

SEQ ID NO: 2708633 - protein, 23 aa, Entamoeba histolytica
DEHGAVCPLNWKPGKDTIEPTPD

SEQ ID NO: 2708634 - protein, 32 aa, Entamoeba histolytica
DEHWQPLEYILKKYQIYVLDEVATIENCFVNA

SEQ ID NO: 2708635 - protein, 20 aa, Entamoeba histolytica
DEIFGTSSKLKPVSVIDILF

SEQ ID NO: 2708636 - protein, 22 aa, Entamoeba histolytica
DEIHIKLIDFGFGKELTGTIHA

SEQ ID NO: 2708637 - protein, 25 aa, Entamoeba histolytica
DEIIRLACKFYYLSRLESIDAILNG

SEQ ID NO: 2708638 - protein, 17 aa, Entamoeba histolytica
DEILGNTLILISASYKD

SEQ ID NO: 2708639 - protein, 26 aa, Entamoeba histolytica
DEIPKLLQKEFILESTNLFPTIKEDD

SEQ ID NO: 2708640 - protein, 28 aa, Entamoeba histolytica
DEIPKRFYELMFLIAEKIKLEGFGAYSG

SEQ ID NO: 2708641 - protein, 35 aa, Entamoeba histolytica; identical to SEQ ID NO: 2395793

SEQ ID NO: 2708642 - protein, 24 aa, Entamoeba histolytica
DEITEFFINYFKNIKPKLLNKNDI

SEQ ID NO: 2708643 - protein, 35 aa, Entamoeba histolytica
DEIVLLPLSFNIIQWLFFGIPFTKDTIISFFNPSF

SEQ ID NO: 2708644 - protein, 26 aa, Entamoeba histolytica
DEKEPDRNIILPRPPRENRNTIKQWI

SEQ ID NO: 2708645 - protein, 26 aa, Entamoeba histolytica
DEKFNTLTNFLYWSEKKIQPSVDEWR

SEQ ID NO: 2708646 - protein, 23 aa, Entamoeba histolytica
DEKKKWGMIKLKKRRDLMKEIYE

SEQ ID NO: 2708647 - protein, 24 aa, Entamoeba histolytica
DEKKLGWFEGFKIKGEILEKIHTA

SEQ ID NO: 2708648 - protein, 22 aa, Entamoeba histolytica
DEKPELFMIDQFGTLVPETYAS

SEQ ID NO: 2708649 - protein, 42 aa, Entamoeba histolytica
DEKVRRVFHILFPYFLKQSFRRIIILLWKSIDWGKVPLDQLQ

SEQ ID NO: 2708650 - protein, 23 aa, Entamoeba histolytica
DEKYRIYSIFRNKQFHLQEWKRK

SEQ ID NO: 2708651 - protein, 25 aa, Entamoeba histolytica
DELEFPLCFTVFSASLYSLNNKSGS

SEQ ID NO: 2708652 - protein, 17 aa, Entamoeba histolytica
DELIITRIYAALPSDIQ

SEQ ID NO: 2708653 - protein, 25 aa, Entamoeba histolytica
DELIKYYNDFTFFIALRNCINETTK

SEQ ID NO: 2708654 - protein, 19 aa, Entamoeba histolytica
DELIRIFCLHQSNKRIDKL

SEQ ID NO: 2708655 - protein, 25 aa, Entamoeba histolytica
DELKDLVYWYCLFNEPLDRLHYIYT

SEQ ID NO: 2708656 - protein, 27 aa, Entamoeba histolytica
DELKHYMNYLFFDEYCNWIQSADDQIR

SEQ ID NO: 2708657 - protein, 17 aa, Entamoeba histolytica
DELLKIPNFLERFSLDD

SEQ ID NO: 2708658 - protein, 18 aa, Entamoeba histolytica
DELLLPKKLRIKKLIIDC

SEQ ID NO: 2708659 - protein, 21 aa, Entamoeba histolytica
DELLSIRFKTPYKALQLAQFL

SEQ ID NO: 2708660 - protein, 25 aa, Entamoeba histolytica
DELNIPIYCFLFEDTILLISSDQKQ

SEQ ID NO: 2708661 - protein, 19 aa, Entamoeba histolytica
DELPTQRFEPAFYAASLSS

SEQ ID NO: 2708662 - protein, 27 aa, Entamoeba histolytica
DELTDEIINFLIEFIPELQCYFNGDEL

SEQ ID NO: 2708663 - protein, 23 aa, Entamoeba histolytica
DELTPFIEDILFELCFDSVKDIF

SEQ ID NO: 2708664 - protein, 34 aa, Entamoeba histolytica
DEMGMKLINYIVDSLFTIIYTMKEIPIIRTRTSS

SEQ ID NO: 2708665 - protein, 17 aa, Entamoeba histolytica
DEMKLIWKLRYTVKKTK

SEQ ID NO: 2708666 - protein, 22 aa, Entamoeba histolytica
DENELIVIDNWGSSIFSIDPKQ

SEQ ID NO: 2708667 - protein, 24 aa, Entamoeba histolytica
DENIIKIFCYCNNGFFSPLDTAFG

SEQ ID NO: 2708668 - protein, 26 aa, Entamoeba histolytica
DENIKKQMWYFVSTYTNLTPHEVIEI

SEQ ID NO: 2708669 - protein, 25 aa, Entamoeba histolytica
DENIKSFFYSRPVFKPSTIFNTSNM

SEQ ID NO: 2708670 - protein, 33 aa, Entamoeba histolytica
DENKPKKPKNAYLLFSSEKYPQYKKQFPDLKIS

SEQ ID NO: 2708671 - protein, 28 aa, Entamoeba histolytica
DENTLEPLMTFLINTLPSPLHTKILVEV

SEQ ID NO: 2708672 - protein, 22 aa, Entamoeba histolytica
DENWYSLYFINSMKEVMGSLPF

SEQ ID NO: 2708673 - protein, 24 aa, Entamoeba histolytica
DENYINLIVQYLLPIASSKDKPVA

SEQ ID NO: 2708674 - protein, 17 aa, Entamoeba histolytica
DEPLNVQLALLTASVKL

SEQ ID NO: 2708675 - protein, 36 aa, Entamoeba histolytica
DEPPKYDLKDKTFGDLWVEFLLRESGSLDAQQPTNQ

SEQ ID NO: 2708676 - protein, 24 aa, Entamoeba histolytica
DEQKKVLMRLSSRSYYMLDEILDD

SEQ ID NO: 2708677 - protein, 23 aa, Entamoeba histolytica
DEQKPTIYFISKQPFCESEGQNV

SEQ ID NO: 2708678 - protein, 23 aa, Entamoeba histolytica
DEQPLLYTPRKVIKSNYFPTTVL

SEQ ID NO: 2708679 - protein, 22 aa, Entamoeba histolytica
DEQPTLILYKSRQYLVSFVDSS

SEQ ID NO: 2708680 - protein, 22 aa, Entamoeba histolytica
DEQRLSIMEKWHSKTTMMNISK

SEQ ID NO: 2708681 - protein, 24 aa, Entamoeba histolytica
DEQSLKLTSILYNNKINITTEVTG

SEQ ID NO: 2708682 - protein, 30 aa, Entamoeba histolytica
DERAELYQPWRRSLDLKPCDIHIVVNFARQ

SEQ ID NO: 2708683 - protein, 24 aa, Entamoeba histolytica
DERELSYISSLIKEDDKSHLESII

SEQ ID NO: 2708684 - protein, 27 aa, Entamoeba histolytica
DERIKELLPHKLFPGNRPTNSIVFKKM

SEQ ID NO: 2708685 - protein, 33 aa, Entamoeba histolytica; identical to SEQ ID NO: 2520270

SEQ ID NO: 2708686 - protein, 26 aa, Entamoeba histolytica
DERKTLAFIPFFTTTGHIVLSTLILK

SEQ ID NO: 2708687 - protein, 24 aa, Entamoeba histolytica
DERLLDELWMFCFPNGMKASQYKR

SEQ ID NO: 2708688 - protein, 18 aa, Entamoeba histolytica
DESITLINPFQNLDILLI

SEQ ID NO: 2708689 - protein, 25 aa, Entamoeba histolytica
DESKSLWLIALRNAFAKFNIATAVS

SEQ ID NO: 2708690 - protein, 22 aa, Entamoeba histolytica
DESLLFVIMNLLTNGFTKQKKV

SEQ ID NO: 2708691 - protein, 18 aa, Entamoeba histolytica
DESLPLGTIIILNQKQLS

SEQ ID NO: 2708692 - protein, 18 aa, Entamoeba histolytica
DESVWKRFNATFAYLPIL

SEQ ID NO: 2708693 - protein, 17 aa, Entamoeba histolytica
DETIKFFPNINTYNLFS

SEQ ID NO: 2708694 - protein, 17 aa, Entamoeba histolytica
DETLFIILQVIVTNSLC

SEQ ID NO: 2708695 - protein, 21 aa, Entamoeba histolytica
DETLIIKIEEIKRKLETLKKN

SEQ ID NO: 2708696 - protein, 24 aa, Entamoeba histolytica
DETNHWFIESFGKGVYIIICSHAN

SEQ ID NO: 2708697 - protein, 35 aa, Entamoeba histolytica
DETQNRSFGRSWLSPRNLLQSPKFNTLCKIDEKNE

SEQ ID NO: 2708698 - protein, 25 aa, Entamoeba histolytica
DETSKNIILYLQQENNRLHQLISLN

SEQ ID NO: 2708699 - protein, 32 aa, Entamoeba histolytica
DETSLSYYYNQLPFLFPGVPITYIVNPSNDPQ

SEQ ID NO: 2708700 - protein, 28 aa, Entamoeba histolytica
DEVKEIRASLYDFLLRCFVYNPKDRLTP

SEQ ID NO: 2708701 - protein, 28 aa, Entamoeba histolytica
DEVLFQCIPFILLQARLSQILEGFVWAD

SEQ ID NO: 2708702 - protein, 27 aa, Entamoeba histolytica
DEVLFQCIPFILLQARLSQVLEGFVWV

SEQ ID NO: 2708703 - protein, 21 aa, Entamoeba histolytica
DEVLIQEINVNSTSPSPEGIH

SEQ ID NO: 2708704 - protein, 25 aa, Entamoeba histolytica
DEVQLEEKLLAELALKKQSQRKASG

SEQ ID NO: 2708705 - protein, 28 aa, Entamoeba histolytica
DEVTNQISMFFAFAAPMILCLCEALNED

SEQ ID NO: 2708706 - protein, 21 aa, Entamoeba histolytica
DEVVPLISPIIQALMRIVLGV

SEQ ID NO: 2708707 - protein, 26 aa, Entamoeba histolytica
DEWEFFVITERFHFFNRFRIKGIQHL

SEQ ID NO: 2708708 - protein, 17 aa, Entamoeba histolytica
DEYITTFLTYSSVPFLT

SEQ ID NO: 2708709 - protein, 20 aa, Entamoeba histolytica
DEYSLLLTLLLYSDTIKNQI

SEQ ID NO: 2708710 - protein, 26 aa, Entamoeba histolytica
DEYTNFVEMCIPISVLKGFVVTNKKD

SEQ ID NO: 2708711 - protein, 20 aa, Entamoeba histolytica
DEYVRNFLLSKKEIKKDIDD

SEQ ID NO: 2708712 - protein, 24 aa, Entamoeba histolytica
DFCIDYHTFLKKQNFGVVWKRIKF

SEQ ID NO: 2708713 - protein, 24 aa, Entamoeba histolytica
DFCIKYDKYFVPFLQEALIDPEVS

SEQ ID NO: 2708714 - protein, 21 aa, Entamoeba histolytica
DFDAVLMELIEKKIYSSGLVD

SEQ ID NO: 2708715 - protein, 17 aa, Entamoeba histolytica
DFDFMLNGVYDIIISES

SEQ ID NO: 2708716 - protein, 25 aa, Entamoeba histolytica
DFDPNLGYIGLPPEWERFLNEGGIT

SEQ ID NO: 2708717 - protein, 19 aa, Entamoeba histolytica
DFDTKLLELVLNKWKEEDK

SEQ ID NO: 2708718 - protein, 20 aa, Entamoeba histolytica
DFDVLKLLGFTELKLNKINE

SEQ ID NO: 2708719 - protein, 24 aa, Entamoeba histolytica
DFEEELFISIQIPNPIKINKLKNN

SEQ ID NO: 2708720 - protein, 30 aa, Entamoeba histolytica
DFEGITPILLKWDFPTPRVLPLIDSLEKAV

SEQ ID NO: 2708721 - protein, 20 aa, Entamoeba histolytica
DFEIKYFEYSKSSYPLVEYL

SEQ ID NO: 2708722 - protein, 22 aa, Entamoeba histolytica
DFELYRVVIFRHALDDFKNECR

SEQ ID NO: 2708723 - protein, 29 aa, Entamoeba histolytica
DFERDIWRRDFYFWEGKKSTPLYYSQFLK

SEQ ID NO: 2708724 - protein, 23 aa, Entamoeba histolytica
DFFATWCGPCRSISPYFEELAGQ

SEQ ID NO: 2708725 - protein, 21 aa, Entamoeba histolytica
DFFAVYSRIDAVSLLFVCKKG

SEQ ID NO: 2708726 - protein, 22 aa, Entamoeba histolytica
DFFETLAKILLKQKLVSTQKLS

SEQ ID NO: 2708727 - protein, 17 aa, Entamoeba histolytica
DFFITMHSNLFYHMILH

SEQ ID NO: 2708728 - protein, 17 aa, Entamoeba histolytica
DFFSRPPICFKGTSSTA

SEQ ID NO: 2708729 - protein, 17 aa, Entamoeba histolytica
DFGDKLYHLNLKPQNPI

SEQ ID NO: 2708730 - protein, 20 aa, Entamoeba histolytica
DFGHLRQRKSSFKKWMISSP

SEQ ID NO: 2708731 - protein, 20 aa, Entamoeba histolytica
DFHFEMKYSRTKGATKTVKM

SEQ ID NO: 2708732 - protein, 35 aa, Entamoeba histolytica; identical to SEQ ID NO: 2520318

SEQ ID NO: 2708733 - protein, 18 aa, Entamoeba histolytica
DFIELFDVTFDMFKSWKQ

SEQ ID NO: 2708734 - protein, 18 aa, Entamoeba histolytica
DFIELNIEWSNGIIVCPL

SEQ ID NO: 2708735 - protein, 17 aa, Entamoeba histolytica
DFILPLFNSSNICCISD

SEQ ID NO: 2708736 - protein, 20 aa, Entamoeba histolytica
DFINDLSQPLLLRCLHSLSQ

SEQ ID NO: 2708737 - protein, 24 aa, Entamoeba histolytica
DFINVRDIFKFLSVHWDVLSHLEQ

SEQ ID NO: 2708738 - protein, 23 aa, Entamoeba histolytica
DFIQKLLQLDLSTSNLPYPTLTI

SEQ ID NO: 2708739 - protein, 21 aa, Entamoeba histolytica
DFIRLFDITNIIPYFIDMLKE

SEQ ID NO: 2708740 - protein, 20 aa, Entamoeba histolytica
DFKQALLVAKLALANRVDKI

SEQ ID NO: 2708741 - protein, 18 aa, Entamoeba histolytica
DFLCVIRDYPLMIEINCP

SEQ ID NO: 2708742 - protein, 18 aa, Entamoeba histolytica
DFLLKWSFSNMKGVIENL

SEQ ID NO: 2708743 - protein, 19 aa, Entamoeba histolytica
DFLMKKNGSLGLSLVRRFA

SEQ ID NO: 2708744 - protein, 18 aa, Entamoeba histolytica
DFLPYLDIFIPELKKNIT

SEQ ID NO: 2708745 - protein, 27 aa, Entamoeba histolytica
DFLRFQQFTFNFPIVQPLNGYLQQLTS

SEQ ID NO: 2708746 - protein, 17 aa, Entamoeba histolytica
DFLTFQLLTALTNNSRY

SEQ ID NO: 2708747 - protein, 25 aa, Entamoeba histolytica
DFMDGGKEALLPLLDQFIKQNENDT

SEQ ID NO: 2708748 - protein, 23 aa, Entamoeba histolytica
DFMDIYQCNILPFSLSQIGDTFN

SEQ ID NO: 2708749 - protein, 20 aa, Entamoeba histolytica
DFMLNGVYDIIISESIEYVN

SEQ ID NO: 2708750 - protein, 26 aa, Entamoeba histolytica
DFNEYYPLPLLHSLHLRFNKNNSYYV

SEQ ID NO: 2708751 - protein, 19 aa, Entamoeba histolytica
DFNIFYEDIFNELAKHGEI

SEQ ID NO: 2708752 - protein, 19 aa, Entamoeba histolytica
DFNMSYLVFSCLSTSFSQC

SEQ ID NO: 2708753 - protein, 23 aa, Entamoeba histolytica
DFNSNKMIIWINGGFTPFEEIEL

SEQ ID NO: 2708754 - protein, 17 aa, Entamoeba histolytica
DFNVLVMDYLGPSLEDL

SEQ ID NO: 2708755 - protein, 18 aa, Entamoeba histolytica
DFPGLFPYGLSVPPSPDC

SEQ ID NO: 2708756 - protein, 23 aa, Entamoeba histolytica
DFPLHTFMRKWLKSLYEINVEND

SEQ ID NO: 2708757 - protein, 19 aa, Entamoeba histolytica
DFPYDWIASIPIPIQNDIE

SEQ ID NO: 2708758 - protein, 25 aa, Entamoeba histolytica
DFRFGEFNSLLRLFQVKCEYDPKTL

SEQ ID NO: 2708759 - protein, 21 aa, Entamoeba histolytica
DFRIPFQGVHPPPPLNIPFAN

SEQ ID NO: 2708760 - protein, 32 aa, Entamoeba histolytica; identical to SEQ ID NO: 2520350

SEQ ID NO: 2708761 - protein, 19 aa, Entamoeba histolytica
DFSLNFLLNEGERINNLIC

SEQ ID NO: 2708762 - protein, 31 aa, Entamoeba histolytica
DFSQYNTLHFILLMRSLIITPFNKQNGYKEH

SEQ ID NO: 2708763 - protein, 27 aa, Entamoeba histolytica
DFSTEVVFYLFALKICYPNNIKMLRGN

SEQ ID NO: 2708764 - protein, 18 aa, Entamoeba histolytica
DFTDGQPITLYWSHGNQN

SEQ ID NO: 2708765 - protein, 22 aa, Entamoeba histolytica
DFTGCIIFSSKDPYYYVNTEFD

SEQ ID NO: 2708766 - protein, 19 aa, Entamoeba histolytica
DFTSIYKFLNILNETIIAV

SEQ ID NO: 2708767 - protein, 25 aa, Entamoeba histolytica
DFVKHTIWITYRKNMPLIKEKTTDS

SEQ ID NO: 2708768 - protein, 19 aa, Entamoeba histolytica
DFWVHLRRSNTEPIVRVIA

SEQ ID NO: 2708769 - protein, 21 aa, Entamoeba histolytica
DFYGKYFKHMSIFNELVELTS

SEQ ID NO: 2708770 - protein, 21 aa, Entamoeba histolytica
DFYLNIIHWNTQHELLVALTD

SEQ ID NO: 2708771 - protein, 20 aa, Entamoeba histolytica
DGAEKAIISVLKKWKESGKG

SEQ ID NO: 2708772 - protein, 31 aa, Entamoeba histolytica
DGCALRYFNYLYELLVSIFFPQQQLKKVNKQ

SEQ ID NO: 2708773 - protein, 24 aa, Entamoeba histolytica
DGCNFAQWKYWPYSLHCHRLMIYA

SEQ ID NO: 2708774 - protein, 32 aa, Entamoeba histolytica; identical to SEQ ID NO: 2520365

SEQ ID NO: 2708775 - protein, 25 aa, Entamoeba histolytica
DGDKRINIIIKCLNKIILDKKEIDS

SEQ ID NO: 2708776 - protein, 20 aa, Entamoeba histolytica
DGDLEIFRKSLDLSREPNQQ

SEQ ID NO: 2708777 - protein, 24 aa, Entamoeba histolytica
DGDSLRFDIFSPEKSFSIIAANEQ

SEQ ID NO: 2708778 - protein, 34 aa, Entamoeba histolytica
DGEARITFSLFPKLIICRGFGMYILNILTKEVEI

SEQ ID NO: 2708779 - protein, 23 aa, Entamoeba histolytica
DGEFELMNYRLTSNIRQLIWVES

SEQ ID NO: 2708780 - protein, 31 aa, Entamoeba histolytica; identical to SEQ ID NO: 2520368

SEQ ID NO: 2708781 - protein, 24 aa, Entamoeba histolytica
DGEPADCILYYNYRDKYTYERFFE

SEQ ID NO: 2708782 - protein, 30 aa, Entamoeba histolytica
DGERFHINMEQPILLRLPEDEAKVLREQIR

SEQ ID NO: 2708783 - protein, 24 aa, Entamoeba histolytica
DGFGLVVGGYFRPFTSMKNQLSIE

SEQ ID NO: 2708784 - protein, 20 aa, Entamoeba histolytica
DGFIIVYSIIEQQSFFDVST

SEQ ID NO: 2708785 - protein, 18 aa, Entamoeba histolytica
DGFLVGVPLKVISGRIGK

SEQ ID NO: 2708786 - protein, 29 aa, Entamoeba histolytica
DGFNKIYEMIRLYDLKLLNSMLTSVSYIF

SEQ ID NO: 2708787 - protein, 25 aa, Entamoeba histolytica
DGFSFSLPYLLEHCVRILQDLVISI

SEQ ID NO: 2708788 - protein, 25 aa, Entamoeba histolytica
DGFVSLFVRIFIEITSKKLKGGEGM

SEQ ID NO: 2708789 - protein, 17 aa, Entamoeba histolytica
DGGLIQILDYKGVLRRS

SEQ ID NO: 2708790 - protein, 26 aa, Entamoeba histolytica
DGGNQEIWVISKIARYAVGKNVFILD

SEQ ID NO: 2708791 - protein, 23 aa, Entamoeba histolytica
DGGVFFVEIIFKISQTSFGLSPK

SEQ ID NO: 2708792 - protein, 19 aa, Entamoeba histolytica
DGHFSIPNIPKVLPCTHVI

SEQ ID NO: 2708793 - protein, 20 aa, Entamoeba histolytica
DGHIFLTTPVGLRASYKCGY

SEQ ID NO: 2708794 - protein, 23 aa, Entamoeba histolytica
DGICMGMKPGFKVALRQVKVRRG

SEQ ID NO: 2708795 - protein, 25 aa, Entamoeba histolytica
DGIKILSPLNSLKYLEVLRLSNVHI

SEQ ID NO: 2708796 - protein, 19 aa, Entamoeba histolytica
DGIVTLKYIPTLNLQTNST

SEQ ID NO: 2708797 - protein, 24 aa, Entamoeba histolytica
DGIYMTYENIFPKQPKHLSNEQIK

SEQ ID NO: 2708798 - protein, 24 aa, Entamoeba histolytica
DGKEPFVFTNYFHGWRVNKKQVIS

SEQ ID NO: 2708799 - protein, 17 aa, Entamoeba histolytica
DGKFPFEFINDRTAFKE

SEQ ID NO: 2708800 - protein, 26 aa, Entamoeba histolytica
DGKGTLHYLIKKAMDLVRINELKIVG

SEQ ID NO: 2708801 - protein, 21 aa, Entamoeba histolytica
DGKIFYVNCKTKILTEEKPDI

SEQ ID NO: 2708802 - protein, 17 aa, Entamoeba histolytica
DGKISRRSVSGPKGRRR

SEQ ID NO: 2708803 - protein, 20 aa, Entamoeba histolytica
DGKLTFFNDALKAKSCISSL

SEQ ID NO: 2708804 - protein, 23 aa, Entamoeba histolytica
DGKQLICVKWKGLSYLHIEWISE

SEQ ID NO: 2708805 - protein, 25 aa, Entamoeba histolytica
DGKSYQIWLPLGKIQPAKVRPNSFQ

SEQ ID NO: 2708806 - protein, 22 aa, Entamoeba histolytica
DGLDELKLIKTIWAITGISGKV

SEQ ID NO: 2708807 - protein, 23 aa, Entamoeba histolytica
DGLFALLTNPSLSLASLIHRRYS

SEQ ID NO: 2708808 - protein, 24 aa, Entamoeba histolytica
DGLHGSFGCCIWFEKQKSCECITQ

SEQ ID NO: 2708809 - protein, 22 aa, Entamoeba histolytica
DGLKLCIQKFMNNLQGTVACFY

SEQ ID NO: 2708810 - protein, 22 aa, Entamoeba histolytica
DGLKPIALSLIKMEKYQEARRV

SEQ ID NO: 2708811 - protein, 28 aa, Entamoeba histolytica
DGLNPILIEYSIWLEMNKFHMESKHLKE

SEQ ID NO: 2708812 - protein, 29 aa, Entamoeba histolytica
DGLRFTKIKFVLLQIIRYEKDYPFGSWRR

SEQ ID NO: 2708813 - protein, 27 aa, Entamoeba histolytica
DGLSIPKSYTLLASFKSICENRVGSLY

SEQ ID NO: 2708814 - protein, 26 aa, Entamoeba histolytica
DGLSIPKTLKLLTTFKSIVESRIGSL

SEQ ID NO: 2708815 - protein, 29 aa, Entamoeba histolytica
DGLSRFVVCGTAFVWHQVRYMVGALFAIG

SEQ ID NO: 2708816 - protein, 25 aa, Entamoeba histolytica
DGMSAWINMYYAFDQKYNIILSQEK

SEQ ID NO: 2708817 - protein, 20 aa, Entamoeba histolytica
DGMYLKALPLLLNNIENLEN

SEQ ID NO: 2708818 - protein, 19 aa, Entamoeba histolytica
DGNFTDRLFEWLAESHITE

SEQ ID NO: 2708819 - protein, 17 aa, Entamoeba histolytica
DGNKKMISWKKSFFDVS

SEQ ID NO: 2708820 - protein, 32 aa, Entamoeba histolytica
DGNPPYMDYPPMRALFLITTKGIPPLKDKEKW

SEQ ID NO: 2708821 - protein, 26 aa, Entamoeba histolytica
DGNRTYILGMVWTMILKYKINANQQK

SEQ ID NO: 2708822 - protein, 17 aa, Entamoeba histolytica
DGNTIIKLFGEPLAQVV

SEQ ID NO: 2708823 - protein, 24 aa, Entamoeba histolytica
DGNTLLHHLVLLNEPKMVELVLNK

SEQ ID NO: 2708824 - protein, 24 aa, Entamoeba histolytica
DGQVKLQFILPVDKDIKDGTKFLF

SEQ ID NO: 2708825 - protein, 19 aa, Entamoeba histolytica
DGQYFIKNGTLMYKLSSKD

SEQ ID NO: 2708826 - protein, 17 aa, Entamoeba histolytica
DGRIFAMKILRKDIVKE

SEQ ID NO: 2708827 - protein, 25 aa, Entamoeba histolytica
DGRIFKQIIWYKVEYSRYLKEKNEM

SEQ ID NO: 2708828 - protein, 25 aa, Entamoeba histolytica
DGRIIKQIIWYDVSYSRYLEEKKVL

SEQ ID NO: 2708829 - protein, 25 aa, Entamoeba histolytica
DGRIIKYVIWYKVEYSRYLEEKEEG

SEQ ID NO: 2708830 - protein, 24 aa, Entamoeba histolytica
DGRLLYVVPSERLWMETYSCNEYF

SEQ ID NO: 2708831 - protein, 24 aa, Entamoeba histolytica
DGRPYLQKPFYTEFKKRDPPFDSP

SEQ ID NO: 2708832 - protein, 17 aa, Entamoeba histolytica
DGSEYWTYFGTAYKNMC

SEQ ID NO: 2708833 - protein, 29 aa, Entamoeba histolytica
DGSFDLLHAGHYELFRKAHELGTYLIVGV

SEQ ID NO: 2708834 - protein, 17 aa, Entamoeba histolytica
DGSPIYIVPTSSKLFCC

SEQ ID NO: 2708835 - protein, 21 aa, Entamoeba histolytica
DGTIRLWSVKSLSALRTLQGH

SEQ ID NO: 2708836 - protein, 17 aa, Entamoeba histolytica
DGTLLIVSHQRQFLNAI

SEQ ID NO: 2708837 - protein, 26 aa, Entamoeba histolytica
DGVISFDHNRFLFNGNAKVIDENAMD

SEQ ID NO: 2708838 - protein, 24 aa, Entamoeba histolytica
DGYDYSQHFAERGNGIFIQSDGKI

SEQ ID NO: 2708839 - protein, 31 aa, Entamoeba histolytica
DGYEYSNYFILFLLCINFLYRQNNYAFEFDE

SEQ ID NO: 2708840 - protein, 19 aa, Entamoeba histolytica
DGYFQECFVLAYRLVTTPE

SEQ ID NO: 2708841 - protein, 24 aa, Entamoeba histolytica
DGYHPYRVILCRVVLGREGRDYVV

SEQ ID NO: 2708842 - protein, 21 aa, Entamoeba histolytica
DGYNLLMKMFEYNPGKRISAR

SEQ ID NO: 2708843 - protein, 18 aa, Entamoeba histolytica
DGYYSKILCCNKIQLTKT

SEQ ID NO: 2708844 - protein, 20 aa, Entamoeba histolytica
DGYYSKILCCNKIQLTKTKE

SEQ ID NO: 2708845 - protein, 18 aa, Entamoeba histolytica
DHCESLTTLLLPSSLTKV

SEQ ID NO: 2708846 - protein, 24 aa, Entamoeba histolytica
DHCKDWLDLFYSSISSGFTPPVLL

SEQ ID NO: 2708847 - protein, 24 aa, Entamoeba histolytica
DHDDLTWIQWFCSLSGNEYFVEVD

SEQ ID NO: 2708848 - protein, 18 aa, Entamoeba histolytica
DHFLFNRHICIVFELLGM

SEQ ID NO: 2708849 - protein, 19 aa, Entamoeba histolytica
DHHPPKFNFLLQIVNEIVN

SEQ ID NO: 2708850 - protein, 26 aa, Entamoeba histolytica
DHILRDCPEPRTGKLAFSTCFVCHQM

SEQ ID NO: 2708851 - protein, 34 aa, Entamoeba histolytica
DHILTYQEWFKMLWYKGLFTYYREDLHLSEDEIQ

SEQ ID NO: 2708852 - protein, 30 aa, Entamoeba histolytica
DHKTLYYDVEPFYFYVLCEFNYNEQWKSDD

SEQ ID NO: 2708853 - protein, 27 aa, Entamoeba histolytica
DHLAQFIELLGYFNKKYLNIAPNTPKY

SEQ ID NO: 2708854 - protein, 25 aa, Entamoeba histolytica
DHLKISLWIYGSVCSLIHFHSIHSP

SEQ ID NO: 2708855 - protein, 19 aa, Entamoeba histolytica
DHLLTPFPSIPLNQISSKK

SEQ ID NO: 2708856 - protein, 19 aa, Entamoeba histolytica
DHLPYLPSKFLFTLLSDYS

SEQ ID NO: 2708857 - protein, 32 aa, Entamoeba histolytica
DHLRGFVPTFKQKWIIKLKEMMLFTVEISEIK

SEQ ID NO: 2708858 - protein, 24 aa, Entamoeba histolytica
DHLSYYYFYLTFHSRKDIFDNIES

SEQ ID NO: 2708859 - protein, 20 aa, Entamoeba histolytica
DHLTINQCYLMHLALQLCHS

SEQ ID NO: 2708860 - protein, 25 aa, Entamoeba histolytica
DHNIFKAGFYHPMPVQKATIPIVLD

SEQ ID NO: 2708861 - protein, 26 aa, Entamoeba histolytica
DHSFYSCKLLESLFIPSSVQSYGSYV

SEQ ID NO: 2708862 - protein, 26 aa, Entamoeba histolytica
DHSVEQFLNLFYEFTKTLLNTTEHSV

SEQ ID NO: 2708863 - protein, 19 aa, Entamoeba histolytica
DHTLRLWDLNKMESVRRFV

SEQ ID NO: 2708864 - protein, 27 aa, Entamoeba histolytica
DHTVKRLFLMYLSCIKRVDEQGKLLSE

SEQ ID NO: 2708865 - protein, 28 aa, Entamoeba histolytica
DHVSGIIALLFNWILNDCDVYLPEGGDD

SEQ ID NO: 2708866 - protein, 26 aa, Entamoeba histolytica
DIAAALAKKRAERAKKFAISDSDSDD

SEQ ID NO: 2708867 - protein, 18 aa, Entamoeba histolytica
DIAIIMSSIKHISLFEFV

SEQ ID NO: 2708868 - protein, 17 aa, Entamoeba histolytica
DIAIYGTLIGLLTQKHQ

SEQ ID NO: 2708869 - protein, 28 aa, Entamoeba histolytica
DIALQRQMMFLTRFFKTLVDLPSNISDV

SEQ ID NO: 2708870 - protein, 20 aa, Entamoeba histolytica
DIANGVIPLFKIMGAFEQHV

SEQ ID NO: 2708871 - protein, 25 aa, Entamoeba histolytica
DIAQHYLQKAGISALRRVRKNDNLR

SEQ ID NO: 2708872 - protein, 21 aa, Entamoeba histolytica
DIAQRLDSRMFSIDIEIGKDK

SEQ ID NO: 2708873 - protein, 17 aa, Entamoeba histolytica
DIARYYKLRKDEDTSFF

SEQ ID NO: 2708874 - protein, 19 aa, Entamoeba histolytica
DICFYGPYGIPVKTPIIAP

SEQ ID NO: 2708875 - protein, 30 aa, Entamoeba histolytica
DIDERALAIYASLFHHAFKTFKELQAMKNE

SEQ ID NO: 2708876 - protein, 22 aa, Entamoeba histolytica
DIDGIKFDFILTLNTESPADMM

SEQ ID NO: 2708877 - protein, 33 aa, Entamoeba histolytica
DIDLALQCNPLYVKALLRRALISMHFKKYFEAK

SEQ ID NO: 2708878 - protein, 27 aa, Entamoeba histolytica
DIDVPPLFISSFLQRIRIILKYCYPDG

SEQ ID NO: 2708879 - protein, 24 aa, Entamoeba histolytica
DIDYLIRMKGIPKKVILGTAKEKF

SEQ ID NO: 2708880 - protein, 36 aa, Entamoeba histolytica; identical to SEQ ID NO: 2520472

SEQ ID NO: 2708881 - protein, 23 aa, Entamoeba histolytica
DIEALCVFRIAQAVLLCCDGQVD

SEQ ID NO: 2708882 - protein, 27 aa, Entamoeba histolytica
DIEELSHAVYIYWRAKEMVKTKEYEVD

SEQ ID NO: 2708883 - protein, 25 aa, Entamoeba histolytica
DIEEYLKILTLYTFGKKKQEGKEII

SEQ ID NO: 2708884 - protein, 19 aa, Entamoeba histolytica
DIEFLILLNNIRHYIFEED

SEQ ID NO: 2708885 - protein, 26 aa, Entamoeba histolytica
DIEGAWEIFFRIYKRIHKSINAVAVL

SEQ ID NO: 2708886 - protein, 22 aa, Entamoeba histolytica
DIEIIKMLLNKKADRALKNERM

SEQ ID NO: 2708887 - protein, 23 aa, Entamoeba histolytica
DIEKYCLRVKKGQPPYCCFEYID

SEQ ID NO: 2708888 - protein, 26 aa, Entamoeba histolytica
DIEKYDFLVLVLLVLFCKTTMTEKMK

SEQ ID NO: 2708889 - protein, 18 aa, Entamoeba histolytica
DIELFKKGCKKFPVGTEG

SEQ ID NO: 2708890 - protein, 24 aa, Entamoeba histolytica
DIEMRRKELEFTGINNDNPNKDLI

SEQ ID NO: 2708891 - protein, 17 aa, Entamoeba histolytica
DIENIINNVLFDCPMNS

SEQ ID NO: 2708892 - protein, 26 aa, Entamoeba histolytica
DIESELLGLVYLKKYIMYRAFCDGCL

SEQ ID NO: 2708893 - protein, 34 aa, Entamoeba histolytica; identical to SEQ ID NO: 2520481

SEQ ID NO: 2708894 - protein, 30 aa, Entamoeba histolytica
DIETHQYLFELLNILTLKLLEIHIPPHRNS

SEQ ID NO: 2708895 - protein, 20 aa, Entamoeba histolytica
DIEYLCGVLQMIVSFSMPSF

SEQ ID NO: 2708896 - protein, 23 aa, Entamoeba histolytica
DIFEPYIIDIFNLVRPIVSEANQ

SEQ ID NO: 2708897 - protein, 23 aa, Entamoeba histolytica
DIFGALHSIWSSKKKKKEVPMIE

SEQ ID NO: 2708898 - protein, 22 aa, Entamoeba histolytica
DIFGQITDPFYIFDGTTDIGQD

SEQ ID NO: 2708899 - protein, 18 aa, Entamoeba histolytica
DIFLLCFAVDNDRSIKNI

SEQ ID NO: 2708900 - protein, 26 aa, Entamoeba histolytica
DIFNEFIIINDLYTVTLYSINNWKIL

SEQ ID NO: 2708901 - protein, 26 aa, Entamoeba histolytica
DIFSLGCVLAYLFLENSLFDVSNILD

SEQ ID NO: 2708902 - protein, 18 aa, Entamoeba histolytica
DIFYLTRQPYQNSFINHF

SEQ ID NO: 2708903 - protein, 23 aa, Entamoeba histolytica
DIGDNIEVVLKWRRGDKKENKGT

SEQ ID NO: 2708904 - protein, 17 aa, Entamoeba histolytica
DIGPRLKLHLLSINSDF

SEQ ID NO: 2708905 - protein, 25 aa, Entamoeba histolytica
DIHGQFFDLMKLFSIGGSLPENSYI

SEQ ID NO: 2708906 - protein, 31 aa, Entamoeba histolytica; identical to SEQ ID NO: 2520504

SEQ ID NO: 2708907 - protein, 22 aa, Entamoeba histolytica
DIHHPAILGMAGIVLSSSTILL

SEQ ID NO: 2708908 - protein, 26 aa, Entamoeba histolytica
DIHSEQLLWQKILNSKTLYQVSEIRR

SEQ ID NO: 2708909 - protein, 34 aa, Entamoeba histolytica
DIHSFFYCFAEDQFFWVYKFLKGVQEREVFRISY

SEQ ID NO: 2708910 - protein, 24 aa, Entamoeba histolytica
DIHSQYTYDLNVLDGSIREEQKQK

SEQ ID NO: 2708911 - protein, 25 aa, Entamoeba histolytica
DIIACLLKCFLQKMPIHIIDTMKSL

SEQ ID NO: 2708912 - protein, 17 aa, Entamoeba histolytica
DIIDLLTRIRVVYGIDA

SEQ ID NO: 2708913 - protein, 18 aa, Entamoeba histolytica
DIIEWLKKQLKEIKEKDK

SEQ ID NO: 2708914 - protein, 19 aa, Entamoeba histolytica
DIIINFYIEFLQNELQQKQ

SEQ ID NO: 2708915 - protein, 17 aa, Entamoeba histolytica
DIIIPLYQIFNEEFIGE

SEQ ID NO: 2708916 - protein, 21 aa, Entamoeba histolytica
DIIITLKPNFVLPLQTDGEPF

SEQ ID NO: 2708917 - protein, 21 aa, Entamoeba histolytica
DIIKFHFISIKYNIPKHIYAN

SEQ ID NO: 2708918 - protein, 18 aa, Entamoeba histolytica
DIIKVMELLMVLIKLQGI

SEQ ID NO: 2708919 - protein, 28 aa, Entamoeba histolytica
DIINIHKLAFIISKLTSISFLLSQKIIS

SEQ ID NO: 2708920 - protein, 17 aa, Entamoeba histolytica
DIINIYDNSGDWWMAEL

SEQ ID NO: 2708921 - protein, 17 aa, Entamoeba histolytica
DIIPMDDILFGIEKKTI

SEQ ID NO: 2708922 - protein, 24 aa, Entamoeba histolytica
DIIQSFAYQFPTPFVKSLKPGDKT

SEQ ID NO: 2708923 - protein, 30 aa, Entamoeba histolytica
DIIQSLQMQSFQPLYYLVTEYNEITAKLIG

SEQ ID NO: 2708924 - protein, 20 aa, Entamoeba histolytica
DIIRFNILSLLIEINKEAES

SEQ ID NO: 2708925 - protein, 18 aa, Entamoeba histolytica
DIISPLGSFHKKTPIRIK

SEQ ID NO: 2708926 - protein, 23 aa, Entamoeba histolytica
DIISPLGSFHKKTPIRIKECIMQ

SEQ ID NO: 2708927 - protein, 20 aa, Entamoeba histolytica
DIISTDLCLCDCEPASFLSL

SEQ ID NO: 2708928 - protein, 24 aa, Entamoeba histolytica
DIKCRIFCTTLQKFSFVETQLPSD

SEQ ID NO: 2708929 - protein, 29 aa, Entamoeba histolytica
DIKCVNWNVKVPHIIALTLSTGSIVIFDC

SEQ ID NO: 2708930 - protein, 19 aa, Entamoeba histolytica
DIKILRHPKTKYSRVILIR

SEQ ID NO: 2708931 - protein, 24 aa, Entamoeba histolytica
DIKKILPFLLDRRNIKKFFKSTST

SEQ ID NO: 2708932 - protein, 31 aa, Entamoeba histolytica; identical to SEQ ID NO: 2520535

SEQ ID NO: 2708933 - protein, 17 aa, Entamoeba histolytica
DIKMFKFVYAKVGITYP

SEQ ID NO: 2708934 - protein, 38 aa, Entamoeba histolytica
DIKNEEMLCWLLDGLYYIFQCFDFETVPFFSQIQFNSS

SEQ ID NO: 2708935 - protein, 17 aa, Entamoeba histolytica
DIKPENILFVNKLDYFI

SEQ ID NO: 2708936 - protein, 36 aa, Entamoeba histolytica
DIKQLPGLYILMLLGYLFKYIEKYPSLLSLLKEKDI

SEQ ID NO: 2708937 - protein, 22 aa, Entamoeba histolytica
DIKREVLSLREKYEKVKPNDNI

SEQ ID NO: 2708938 - protein, 24 aa, Entamoeba histolytica
DIKRLCEDYMIKLIDKYPPTKIKK

SEQ ID NO: 2708939 - protein, 18 aa, Entamoeba histolytica
DIKTFADYNFNPLTAVAK

SEQ ID NO: 2708940 - protein, 25 aa, Entamoeba histolytica
DIKTKDNIIIGLKTDLNNTDEKIEG

SEQ ID NO: 2708941 - protein, 26 aa, Entamoeba histolytica
DIKTKHFIMFYHPYCEWCKEMRTLLI

SEQ ID NO: 2708942 - protein, 17 aa, Entamoeba histolytica
DIKTTYFEKINIEMPKE

SEQ ID NO: 2708943 - protein, 24 aa, Entamoeba histolytica
DIKVGVLGCPNFEGGLIVAAQKGC

SEQ ID NO: 2708944 - protein, 29 aa, Entamoeba histolytica
DIKVILGYNKIIYNNLIDLQKKGYYYGQG

SEQ ID NO: 2708945 - protein, 26 aa, Entamoeba histolytica
DIKYGYEYIFPLIPIIIVNKEDYINF

SEQ ID NO: 2708946 - protein, 22 aa, Entamoeba histolytica
DIKYQIAWFFTNLAVSLDSETS

SEQ ID NO: 2708947 - protein, 36 aa, Entamoeba histolytica
DILDPALLRPGRLDQLLFIPLPDKASRISILQAKLR

SEQ ID NO: 2708948 - protein, 29 aa, Entamoeba histolytica
DILFQQIGRLLFQKNLVLSINTPQPFPKL

SEQ ID NO: 2708949 - protein, 17 aa, Entamoeba histolytica
DILIFLTGQEEVDECAE

SEQ ID NO: 2708950 - protein, 21 aa, Entamoeba histolytica
DILISTLRLIRTFPFNSIVSD

SEQ ID NO: 2708951 - protein, 17 aa, Entamoeba histolytica
DILKIHSKKMNLVRGID

SEQ ID NO: 2708952 - protein, 20 aa, Entamoeba histolytica
DILKKYCLIGLNQILRSIKK

SEQ ID NO: 2708953 - protein, 27 aa, Entamoeba histolytica
DILKNPVIISPRPLDWIYDPNKSFFHI

SEQ ID NO: 2708954 - protein, 26 aa, Entamoeba histolytica
DILLGPPNLQLFKSLELFESFRLRWK

SEQ ID NO: 2708955 - protein, 30 aa, Entamoeba histolytica; identical to SEQ ID NO: 2520564

SEQ ID NO: 2708956 - protein, 19 aa, Entamoeba histolytica
DINEFIIPTTITKLTDECF

SEQ ID NO: 2708957 - protein, 27 aa, Entamoeba histolytica
DINEFSRLMLVPLKRLSSGDEKVIEVV

SEQ ID NO: 2708958 - protein, 22 aa, Entamoeba histolytica
DINEIIVIGLWDGNILIFDING

SEQ ID NO: 2708959 - protein, 26 aa, Entamoeba histolytica
DINENLYIPMFINVPKKLTPTQEFRI

SEQ ID NO: 2708960 - protein, 22 aa, Entamoeba histolytica
DINISFDVPLICPIGLNRIENP

SEQ ID NO: 2708961 - protein, 25 aa, Entamoeba histolytica
DINISIVMELLPGGTLFSRVSKCES

SEQ ID NO: 2708962 - protein, 23 aa, Entamoeba histolytica
DINKFCRIFNPPTCNCNLLPVDE

SEQ ID NO: 2708963 - protein, 21 aa, Entamoeba histolytica
DINKLIIRRIIRTEYKVAYPN

SEQ ID NO: 2708964 - protein, 21 aa, Entamoeba histolytica
DINKLLRWLIQRQKPIEGGFD

SEQ ID NO: 2708965 - protein, 18 aa, Entamoeba histolytica
DINKSLQPLNIIEKTMKQ

SEQ ID NO: 2708966 - protein, 21 aa, Entamoeba histolytica
DINLIQPWRYFLRENKVSLNG

SEQ ID NO: 2708967 - protein, 18 aa, Entamoeba histolytica
DINLLLLSNAYHFKRYPI

SEQ ID NO: 2708968 - protein, 23 aa, Entamoeba histolytica
DINNVHAYWSLSSLLRTSDCITS

SEQ ID NO: 2708969 - protein, 24 aa, Entamoeba histolytica
DINQIYSMKNWILIPAKTTSTPHI

SEQ ID NO: 2708970 - protein, 19 aa, Entamoeba histolytica
DINRIYVNLFIPHITSIFI

SEQ ID NO: 2708971 - protein, 22 aa, Entamoeba histolytica
DINSCILKLLQKRPISYSLSDD

SEQ ID NO: 2708972 - protein, 27 aa, Entamoeba histolytica
DINSEWVLALLSFIPGALFPATDKLKS

SEQ ID NO: 2708973 - protein, 24 aa, Entamoeba histolytica
DINYLSSFNFPFLKQPFQNGSPHH

SEQ ID NO: 2708974 - protein, 17 aa, Entamoeba histolytica
DIPLPKEVDGYFPVVFI

SEQ ID NO: 2708975 - protein, 23 aa, Entamoeba histolytica
DIPQPLNWIKKDAGHFIFTLINH

SEQ ID NO: 2708976 - protein, 36 aa, Entamoeba histolytica
DIPSMFHYNPIPLTKKLLKIFPNIQTQYIYSTSERR

SEQ ID NO: 2708977 - protein, 27 aa, Entamoeba histolytica
DIQFFNGIIVIAFKKEIYRISLTDFMQ

SEQ ID NO: 2708978 - protein, 20 aa, Entamoeba histolytica
DIQIYAFVDIVGPSIFRIPA

SEQ ID NO: 2708979 - protein, 24 aa, Entamoeba histolytica
DIQKFPMTITKLQRLKTLTAQYIR

SEQ ID NO: 2708980 - protein, 27 aa, Entamoeba histolytica
DIQKIFYGIKPLAYSLPIILNGFLKKL

SEQ ID NO: 2708981 - protein, 21 aa, Entamoeba histolytica
DIQLLLIQLNSSYFYFSRIIN

SEQ ID NO: 2708982 - protein, 17 aa, Entamoeba histolytica
DIQNSWIFGVGYGFHIR

SEQ ID NO: 2708983 - protein, 21 aa, Entamoeba histolytica
DIQRYILINAFQFDSGENDPN

SEQ ID NO: 2708984 - protein, 17 aa, Entamoeba histolytica
DIQTFADKNFNPLTAVA

SEQ ID NO: 2708985 - protein, 24 aa, Entamoeba histolytica
DIQTLIEIIILLKQLLCQSLKSEQ

SEQ ID NO: 2708986 - protein, 24 aa, Entamoeba histolytica
DIREALFSFIRIVIEYCSEMICES

SEQ ID NO: 2708987 - protein, 39 aa, Entamoeba histolytica
DIRMYPNYIPTCPFPIDFNLILQRLINDNYYRTYDQVEW

SEQ ID NO: 2708988 - protein, 19 aa, Entamoeba histolytica
DIRPRNDIDEIKESFTAFK

SEQ ID NO: 2708989 - protein, 18 aa, Entamoeba histolytica
DISAIIKYITKKGKGMFK

SEQ ID NO: 2708990 - protein, 17 aa, Entamoeba histolytica
DISFLRRKKQESVAAIS

SEQ ID NO: 2708991 - protein, 32 aa, Entamoeba histolytica
DISGDTIIPIIIYLLLHSSIPNINLLICCIDL

SEQ ID NO: 2708992 - protein, 26 aa, Entamoeba histolytica
DISHAAIMFYSFYSFQINCDNYDFAK

SEQ ID NO: 2708993 - protein, 24 aa, Entamoeba histolytica
DISKLPINIDLFPTTLTSLRILMG

SEQ ID NO: 2708994 - protein, 27 aa, Entamoeba histolytica
DISLNPIKSIKPLLLVSSIKELTISQC

SEQ ID NO: 2708995 - protein, 24 aa, Entamoeba histolytica
DISYITAFYYNDSQGVLLMVDLSN

SEQ ID NO: 2708996 - protein, 26 aa, Entamoeba histolytica
DITEDEFTQMFWKLGMKNFDDFISKL

SEQ ID NO: 2708997 - protein, 18 aa, Entamoeba histolytica
DITELTQSYLIAKQNAEM

SEQ ID NO: 2708998 - protein, 36 aa, Entamoeba histolytica
DITEVHTVPLPPSTVPSFVPPPPPLSEDAYTTEMTS

SEQ ID NO: 2708999 - protein, 29 aa, Entamoeba histolytica
DITGIKITRNYLFIVFENMVSIMDLSSKT

SEQ ID NO: 2709000 - protein, 23 aa, Entamoeba histolytica
DITKFKLSISPLEGYYQGGKWSF

SEQ ID NO: 2709001 - protein, 17 aa, Entamoeba histolytica
DITQEQNGWIRQAKEAS

SEQ ID NO: 2709002 - protein, 58 aa, Entamoeba histolytica
DITQKQIMIQVITYMSYFVINTLIQNDKFINCSKGLQLKFFFSIMEAELCENRDIFYL

SEQ ID NO: 2709003 - protein, 22 aa, Entamoeba histolytica
DITQYDLAIRWISSEEFSQETL

SEQ ID NO: 2709004 - protein, 24 aa, Entamoeba histolytica
DITRILQEALGGQGFLIAIGCISS

SEQ ID NO: 2709005 - protein, 18 aa, Entamoeba histolytica
DITSDFWNECKNKIIPDV

SEQ ID NO: 2709006 - protein, 17 aa, Entamoeba histolytica
DITSKVLLRFLKERGCR

SEQ ID NO: 2709007 - protein, 25 aa, Entamoeba histolytica
DIVESVFIFVKVLLLLPDEKISDEI

SEQ ID NO: 2709008 - protein, 24 aa, Entamoeba histolytica
DIVIGNCQFFYFGLKQSICAYESV

SEQ ID NO: 2709009 - protein, 23 aa, Entamoeba histolytica
DIVLLEKAQIFAVPLISSMNYNV

SEQ ID NO: 2709010 - protein, 26 aa, Entamoeba histolytica
DIVPQELSLVFIVRKYLSNIVRSLSK

SEQ ID NO: 2709011 - protein, 21 aa, Entamoeba histolytica
DIVSRKFNDLVLLLADKINKS

SEQ ID NO: 2709012 - protein, 20 aa, Entamoeba histolytica
DIVVLVFLEEGVKHFDPRLF

SEQ ID NO: 2709013 - protein, 18 aa, Entamoeba histolytica
DIWSLGAMYYYLRTGMFP

SEQ ID NO: 2709014 - protein, 29 aa, Entamoeba histolytica
DIWSLGVLIFVLFCNRFPFPPNKVFETLS

SEQ ID NO: 2709015 - protein, 17 aa, Entamoeba histolytica
DIWSVGCIIAELLTGQI

SEQ ID NO: 2709016 - protein, 27 aa, Entamoeba histolytica
DIWSYGCILAEMFLGKPLFPGSSTSDQ

SEQ ID NO: 2709017 - protein, 18 aa, Entamoeba histolytica
DIYLCPYHIIATGPDCGI

SEQ ID NO: 2709018 - protein, 27 aa, Entamoeba histolytica
DIYLKKGVILLFYTDYYLQVSNQMVFD

SEQ ID NO: 2709019 - protein, 24 aa, Entamoeba histolytica
DIYQLLTFLHLYCEFESDLKLPLW

SEQ ID NO: 2709020 - protein, 17 aa, Entamoeba histolytica
DIYSAGIVLFELLEGYP

SEQ ID NO: 2709021 - protein, 25 aa, Entamoeba histolytica
DIYSLGLVIWFVFESKGTDPFPKTT

SEQ ID NO: 2709022 - protein, 21 aa, Entamoeba histolytica
DIYYHPLIQSCTWDTLAAQVI

SEQ ID NO: 2709023 - protein, 29 aa, Entamoeba histolytica
DKAYRNMFPFFILASQINGLPLFLHHFRI

SEQ ID NO: 2709024 - protein, 25 aa, Entamoeba histolytica
DKCDQLMCFPAGLPAIFSFSNSNSI

SEQ ID NO: 2709025 - protein, 24 aa, Entamoeba histolytica
DKCLSKLIPYLIAVKEHIPRLSLQ

SEQ ID NO: 2709026 - protein, 17 aa, Entamoeba histolytica
DKCLSYRIVLPKQLQEC

SEQ ID NO: 2709027 - protein, 40 aa, Entamoeba histolytica
DKCYQFICYNKTDYFQWINTIPLFCNFTGVFGYPLQATAS

SEQ ID NO: 2709028 - protein, 21 aa, Entamoeba histolytica
DKDEFILQKYYWKAKCLSKRE

SEQ ID NO: 2709029 - protein, 25 aa, Entamoeba histolytica
DKDGTLFYCYTYLVKNKGGDEHPQK

SEQ ID NO: 2709030 - protein, 24 aa, Entamoeba histolytica
DKDKKHFVFIFNTTTNKGEKYQKI

SEQ ID NO: 2709031 - protein, 24 aa, Entamoeba histolytica
DKDNPLLKLQQLSNSQPQPTQETK

SEQ ID NO: 2709032 - protein, 26 aa, Entamoeba histolytica
DKDTVRIFIWFYNNVTLRYYKIKDYY

SEQ ID NO: 2709033 - protein, 27 aa, Entamoeba histolytica
DKDVFEEWYLKLLAKRLLNKEATNTSM

SEQ ID NO: 2709034 - protein, 21 aa, Entamoeba histolytica
DKDVINFLKSYFSFNSADILS

SEQ ID NO: 2709035 - protein, 23 aa, Entamoeba histolytica
DKDWGRCVCNLSDLAPVLVNGVK

SEQ ID NO: 2709036 - protein, 17 aa, Entamoeba histolytica
DKEILDILEFRPPRHID

SEQ ID NO: 2709037 - protein, 20 aa, Entamoeba histolytica
DKELASLINEKERRLRQLEI

SEQ ID NO: 2709038 - protein, 27 aa, Entamoeba histolytica
DKENNLKLILEFIKSQNIKVTTTVQDI

SEQ ID NO: 2709039 - protein, 21 aa, Entamoeba histolytica
DKEQYLAFIKQTVNRIGSLMR

SEQ ID NO: 2709040 - protein, 22 aa, Entamoeba histolytica
DKESLVMVLKQFKQIQSVDLSS

SEQ ID NO: 2709041 - protein, 20 aa, Entamoeba histolytica
DKFHYNPIPVYDLNFFRNIE

SEQ ID NO: 2709042 - protein, 32 aa, Entamoeba histolytica
DKFIALTILEHLLLYGYPFALKIVLILIEQSA

SEQ ID NO: 2709043 - protein, 28 aa, Entamoeba histolytica
DKFKKQILMYLVPLKLRCGMYLPMEEMK

SEQ ID NO: 2709044 - protein, 25 aa, Entamoeba histolytica
DKFNYQILSIFTPLSMATSLLVCED

SEQ ID NO: 2709045 - protein, 17 aa, Entamoeba histolytica
DKFPDFFEKIDVITGVS

SEQ ID NO: 2709046 - protein, 28 aa, Entamoeba histolytica
DKFQDEYIIQFYGGVFIPNKICMVTEFA

SEQ ID NO: 2709047 - protein, 25 aa, Entamoeba histolytica
DKFRNEYIIQFYGAVFIPSKICMVT

SEQ ID NO: 2709048 - protein, 23 aa, Entamoeba histolytica
DKGEYKWAVELLNHLVFTNPNNE

SEQ ID NO: 2709049 - protein, 22 aa, Entamoeba histolytica
DKGTFLYPKEPWWDGYFKSETE

SEQ ID NO: 2709050 - protein, 23 aa, Entamoeba histolytica
DKGVLVPFYDKLTTIPIYNNIPP

SEQ ID NO: 2709051 - protein, 26 aa, Entamoeba histolytica
DKHGWTLLHYAAWFNKSHICSMLMRY

SEQ ID NO: 2709052 - protein, 20 aa, Entamoeba histolytica
DKIDEFIQLLYSKKQYHLQL

SEQ ID NO: 2709053 - protein, 24 aa, Entamoeba histolytica
DKIFKCVFISLISFIPLKKDNFEL

SEQ ID NO: 2709054 - protein, 17 aa, Entamoeba histolytica
DKIIHSVWLYLESGRTA

SEQ ID NO: 2709055 - protein, 18 aa, Entamoeba histolytica
DKIIIFCNELKPAGFYKE

SEQ ID NO: 2709056 - protein, 27 aa, Entamoeba histolytica
DKIISIEEMIMKDKLFRKPKETDTITS

SEQ ID NO: 2709057 - protein, 24 aa, Entamoeba histolytica
DKIPSNIWLFCFPDGLRLSEFPIE

SEQ ID NO: 2709058 - protein, 18 aa, Entamoeba histolytica
DKIRLFSEQKRTAKKDDT

SEQ ID NO: 2709059 - protein, 20 aa, Entamoeba histolytica
DKIVNVFSEDTIRKGLKIYT

SEQ ID NO: 2709060 - protein, 28 aa, Entamoeba histolytica
DKKATVIFIPLRMMRICRASFEKVIEAL

SEQ ID NO: 2709061 - protein, 32 aa, Entamoeba histolytica
DKKDPNRPKRPPTPYFIYLNEHRASIKEEHPD

SEQ ID NO: 2709062 - protein, 35 aa, Entamoeba histolytica
DKKEEFNCMLTFTDFLLFGRTKLLGKIKISKYIEL

SEQ ID NO: 2709063 - protein, 27 aa, Entamoeba histolytica
DKKETLYNKVEIPYLLEDNKTSKTKSF

SEQ ID NO: 2709064 - protein, 17 aa, Entamoeba histolytica
DKKIGTPIYMPPEQWNS

SEQ ID NO: 2709065 - protein, 22 aa, Entamoeba histolytica
DKKIQFNPIFKSSPKHFSQLLS

SEQ ID NO: 2709066 - protein, 18 aa, Entamoeba histolytica
DKKIYVYNFKDLRPLYQY

SEQ ID NO: 2709067 - protein, 31 aa, Entamoeba histolytica
DKKKEFTPTAYLGWTPFKNSTIVWEAYGNEI

SEQ ID NO: 2709068 - protein, 22 aa, Entamoeba histolytica
DKKLKRILPSNRTDPIFIALEG

SEQ ID NO: 2709069 - protein, 26 aa, Entamoeba histolytica
DKKVINVKLIYSKNYLLLLREGNRGL

SEQ ID NO: 2709070 - protein, 22 aa, Entamoeba histolytica
DKKYLNEFNLLLIRSVFDFLTT

SEQ ID NO: 2709071 - protein, 23 aa, Entamoeba histolytica
DKKYRINLCSFLVSIPQIYIEEI

SEQ ID NO: 2709072 - protein, 17 aa, Entamoeba histolytica
DKKYWLDVESRMSWIIC

SEQ ID NO: 2709073 - protein, 19 aa, Entamoeba histolytica
DKLAAAKVMGLRRAKRRNM

SEQ ID NO: 2709074 - protein, 26 aa, Entamoeba histolytica
DKLAYIYISLRIVEMTIIFVTGNVSG

SEQ ID NO: 2709075 - protein, 24 aa, Entamoeba histolytica
DKLIQIYPINKFQYSLQRFCENEQ

SEQ ID NO: 2709076 - protein, 22 aa, Entamoeba histolytica
DKLKTIIKIFSPIITEELLPRF

SEQ ID NO: 2709077 - protein, 31 aa, Entamoeba histolytica
DKLYIFNHIPGIYGIIGLPLVLSVKKSGWRV

SEQ ID NO: 2709078 - protein, 17 aa, Entamoeba histolytica
DKMFIKYRPVDFNENML

SEQ ID NO: 2709079 - protein, 19 aa, Entamoeba histolytica
DKMFLFVMAAILSMHREFI

SEQ ID NO: 2709080 - protein, 19 aa, Entamoeba histolytica
DKMFNSAFLENNPPKLILP

SEQ ID NO: 2709081 - protein, 20 aa, Entamoeba histolytica
DKMIDDYYGMDFEDIVNGEK

SEQ ID NO: 2709082 - protein, 30 aa, Entamoeba histolytica; identical to SEQ ID NO: 2520715

SEQ ID NO: 2709083 - protein, 19 aa, Entamoeba histolytica
DKMNQLQDVMLNRQRLLTQ

SEQ ID NO: 2709084 - protein, 25 aa, Entamoeba histolytica
DKMVIQMILLFSDFFCRTCSYGCDT

SEQ ID NO: 2709085 - protein, 21 aa, Entamoeba histolytica
DKNIPFGCFDLLLARVQLTHT

SEQ ID NO: 2709086 - protein, 22 aa, Entamoeba histolytica
DKNKVYITYLCSINGGYAVVDS

SEQ ID NO: 2709087 - protein, 25 aa, Entamoeba histolytica
DKNPINVLFIGSKKEECISLSGICD

SEQ ID NO: 2709088 - protein, 23 aa, Entamoeba histolytica
DKNRLINRLQYLNRLWEVGIYAE

SEQ ID NO: 2709089 - protein, 23 aa, Entamoeba histolytica
DKNTLFDFGWVPVLADRKRKVGT

SEQ ID NO: 2709090 - protein, 28 aa, Entamoeba histolytica
DKNVNFYTILFTWKQKKIWKTTPKRFSE

SEQ ID NO: 2709091 - protein, 21 aa, Entamoeba histolytica
DKNVPYVFVGSKAALGRACGV

SEQ ID NO: 2709092 - protein, 22 aa, Entamoeba histolytica
DKNVPYVFVGSKAALGRACGVS

SEQ ID NO: 2709093 - protein, 19 aa, Entamoeba histolytica
DKNYFIWIHREPVDELKSD

SEQ ID NO: 2709094 - protein, 23 aa, Entamoeba histolytica
DKNYKPLFIKKVGTVVKIVEGKS

SEQ ID NO: 2709095 - protein, 33 aa, Entamoeba histolytica
DKPFLEYDLEWFPPQWKVNFAKRLPIGNVKKYP

SEQ ID NO: 2709096 - protein, 21 aa, Entamoeba histolytica
DKPIYQVLLQNEPILEHIEEK

SEQ ID NO: 2709097 - protein, 24 aa, Entamoeba histolytica
DKPQYIQMFLQLQSLLYNNAALLK

SEQ ID NO: 2709098 - protein, 22 aa, Entamoeba histolytica
DKPSTCFFLNRETNQIGRLCEI

SEQ ID NO: 2709099 - protein, 23 aa, Entamoeba histolytica
DKPSTLKMLPSYAPIPTGKEVGT

SEQ ID NO: 2709100 - protein, 18 aa, Entamoeba histolytica
DKQFKIVIADECHYLKNS

SEQ ID NO: 2709101 - protein, 24 aa, Entamoeba histolytica
DKQLHRVFIFNKKTGDFRSFGGYG

SEQ ID NO: 2709102 - protein, 18 aa, Entamoeba histolytica
DKQYIYFCDAHSLFYSSS

SEQ ID NO: 2709103 - protein, 20 aa, Entamoeba histolytica
DKRFLSWAQKNTRKCPKCNA

SEQ ID NO: 2709104 - protein, 23 aa, Entamoeba histolytica
DKRHLFPNWIKPSDTEPAPLLVY

SEQ ID NO: 2709105 - protein, 23 aa, Entamoeba histolytica
DKRYPKLIALPIYASLSTEQQKR

SEQ ID NO: 2709106 - protein, 28 aa, Entamoeba histolytica
DKSHIFTLCDVSYVIQCLLMALEYIHSQ

SEQ ID NO: 2709107 - protein, 31 aa, Entamoeba histolytica; identical to SEQ ID NO: 2520742

SEQ ID NO: 2709108 - protein, 23 aa, Entamoeba histolytica
DKSLLIIRGIAENKFELKKQLMQ

SEQ ID NO: 2709109 - protein, 27 aa, Entamoeba histolytica
DKSLMYIGEYYFVKFIGIEWGELENKE

SEQ ID NO: 2709110 - protein, 26 aa, Entamoeba histolytica
DKSLNRCCFIIFTGNHFDVLCLSHSL

SEQ ID NO: 2709111 - protein, 24 aa, Entamoeba histolytica
DKSNITPPLTPPIEKKVMFSVTQA

SEQ ID NO: 2709112 - protein, 27 aa, Entamoeba histolytica
DKSSMTLCLVLLLKNGRNIPWDKDVFT

SEQ ID NO: 2709113 - protein, 17 aa, Entamoeba histolytica
DKSVIIIGLVEEGGSNV

SEQ ID NO: 2709114 - protein, 26 aa, Entamoeba histolytica
DKTAMLWRVDPLVSMGAYSCAGAVSS

SEQ ID NO: 2709115 - protein, 23 aa, Entamoeba histolytica
DKTILWKNIPLPYKSNGYTSSQV

SEQ ID NO: 2709116 - protein, 22 aa, Entamoeba histolytica
DKTKLKFKIPGLLVMDTPGHEA

SEQ ID NO: 2709117 - protein, 20 aa, Entamoeba histolytica
DKTLRVIEYPDPSILGFGQR

SEQ ID NO: 2709118 - protein, 25 aa, Entamoeba histolytica
DKTMTRIIFLSPFNSFVSCWKSQVE

SEQ ID NO: 2709119 - protein, 17 aa, Entamoeba histolytica
DKTPLLMTSGRDQFLHL

SEQ ID NO: 2709120 - protein, 25 aa, Entamoeba histolytica
DKTVEHILLFINKQLRDTTTTYRLY

SEQ ID NO: 2709121 - protein, 30 aa, Entamoeba histolytica
DKVRELIAVWGTYFPCELSEYALLYKRYCA

SEQ ID NO: 2709122 - protein, 25 aa, Entamoeba histolytica
DKYCNYEVDNGWMYLNKYPNDKCNS

SEQ ID NO: 2709123 - protein, 25 aa, Entamoeba histolytica
DKYHNLVCRVLFKQPKWLNTNKQWN

SEQ ID NO: 2709124 - protein, 25 aa, Entamoeba histolytica
DKYISKGVYFPVLDKLPEQAQPEHS

SEQ ID NO: 2709125 - protein, 23 aa, Entamoeba histolytica
DKYKSVIDLVKKWKFVVVENIDI

SEQ ID NO: 2709126 - protein, 26 aa, Entamoeba histolytica
DKYQHNQFFSQFLIAKLINAERSAQD

SEQ ID NO: 2709127 - protein, 24 aa, Entamoeba histolytica
DLAKYKMFNIYKFMMRDNPEDCKM

SEQ ID NO: 2709128 - protein, 28 aa, Entamoeba histolytica
DLALNSVPLNWINPIYTTTGIIQIRYQQ

SEQ ID NO: 2709129 - protein, 30 aa, Entamoeba histolytica
DLAPTHPIRLGLALNFSVFYYEIMNDADKA

SEQ ID NO: 2709130 - protein, 25 aa, Entamoeba histolytica
DLAYKQPHLLLLDEPSNHLDIETVE

SEQ ID NO: 2709131 - protein, 18 aa, Entamoeba histolytica
DLDALRFLFNIIAPEKKL

SEQ ID NO: 2709132 - protein, 25 aa, Entamoeba histolytica
DLDKMIQETRLKSFSLKQVEDKIRP

SEQ ID NO: 2709133 - protein, 21 aa, Entamoeba histolytica
DLDLVGTNWKFFSLERVVVVH

SEQ ID NO: 2709134 - protein, 26 aa, Entamoeba histolytica
DLDTEFCLMLLRKFLSKTTVRLIIMS

SEQ ID NO: 2709135 - protein, 20 aa, Entamoeba histolytica
DLDWIDCLFTRFSSIPQLHQ

SEQ ID NO: 2709136 - protein, 27 aa, Entamoeba histolytica
DLEALGYMFVYFMKGSLPWQGIKGKKV

SEQ ID NO: 2709137 - protein, 25 aa, Entamoeba histolytica
DLECLTFIRDVWKSSSVRWQMARNY

SEQ ID NO: 2709138 - protein, 20 aa, Entamoeba histolytica
DLEGYFPGFNEYRELVSCSN

SEQ ID NO: 2709139 - protein, 19 aa, Entamoeba histolytica
DLEIFIKNYETEKKRILVE

SEQ ID NO: 2709140 - protein, 17 aa, Entamoeba histolytica
DLEKLRMRLIKKNTIRV

SEQ ID NO: 2709141 - protein, 17 aa, Entamoeba histolytica
DLELYKNHLQKEIQLLY

SEQ ID NO: 2709142 - protein, 19 aa, Entamoeba histolytica
DLEQPYLAPVFIPNQINPS

SEQ ID NO: 2709143 - protein, 21 aa, Entamoeba histolytica
DLEVLDILLAIESKGNEDTYL

SEQ ID NO: 2709144 - protein, 27 aa, Entamoeba histolytica
DLFDFHSYIFNRFSADTYLACVRCCKD

SEQ ID NO: 2709145 - protein, 25 aa, Entamoeba histolytica
DLFDNKLLYTVSYYDIPKNGSSSHI

SEQ ID NO: 2709146 - protein, 32 aa, Entamoeba histolytica
DLFDSHWQEILLKIPMIIQCGGDYFNQWISFI

SEQ ID NO: 2709147 - protein, 22 aa, Entamoeba histolytica
DLFHCMRLKPLALPITVSQLYI

SEQ ID NO: 2709148 - protein, 23 aa, Entamoeba histolytica
DLFIKEMMKKFKEQYLPSKTIVK

SEQ ID NO: 2709149 - protein, 17 aa, Entamoeba histolytica
DLFMKQLIFSQYDFISD

SEQ ID NO: 2709150 - protein, 27 aa, Entamoeba histolytica
DLFMPYIPKILEYCKNKLIGCTDTSTI

SEQ ID NO: 2709151 - protein, 18 aa, Entamoeba histolytica
DLFNEMFGGMGGVPKGGR

SEQ ID NO: 2709152 - protein, 17 aa, Entamoeba histolytica
DLFVFRQNVLEITIDRL

SEQ ID NO: 2709153 - protein, 28 aa, Entamoeba histolytica
DLGARCLCYSIIGYYKLLLKDNNGARDE

SEQ ID NO: 2709154 - protein, 21 aa, Entamoeba histolytica
DLGMNALWMTPIFNSNGGSKL

SEQ ID NO: 2709155 - protein, 24 aa, Entamoeba histolytica
DLHLISELLVFVIYAARKSNDGIS

SEQ ID NO: 2709156 - protein, 23 aa, Entamoeba histolytica
DLHSRQYIFEKDRFYNITDSWDC

SEQ ID NO: 2709157 - protein, 28 aa, Entamoeba histolytica
DLIHCNDFRLTPMWKYLTQLQIKEQFEQ

SEQ ID NO: 2709158 - protein, 29 aa, Entamoeba histolytica
DLIHCNDFRLTPMWKYLTQLQIKEQFEQE

SEQ ID NO: 2709159 - protein, 27 aa, Entamoeba histolytica
DLIHCNDFRLTPMWNYLTQLQIKEQFE

SEQ ID NO: 2709160 - protein, 30 aa, Entamoeba histolytica
DLIIVQLKLIPLQSIPFYFLPSSSNTISSS

SEQ ID NO: 2709161 - protein, 17 aa, Entamoeba histolytica
DLILFTDIILFVEKSKT

SEQ ID NO: 2709162 - protein, 22 aa, Entamoeba histolytica
DLIRIWDSIFAFPERHLYYFIS

SEQ ID NO: 2709163 - protein, 19 aa, Entamoeba histolytica
DLIYQSCSVSPYLSDEELT

SEQ ID NO: 2709164 - protein, 20 aa, Entamoeba histolytica
DLIYTLTMLSKFEGRDMILA

SEQ ID NO: 2709165 - protein, 19 aa, Entamoeba histolytica
DLKEIAFLSLYSLKKVTLP

SEQ ID NO: 2709166 - protein, 18 aa, Entamoeba histolytica
DLKGINKGYAFVEYNHRS

SEQ ID NO: 2709167 - protein, 25 aa, Entamoeba histolytica
DLKIQYIRPEGTFFIFPKVEASLDE

SEQ ID NO: 2709168 - protein, 25 aa, Entamoeba histolytica
DLKIRSRYYLNLIDTNLMKLKEIVF

SEQ ID NO: 2709169 - protein, 18 aa, Entamoeba histolytica
DLKLCQPTYFGTVPRVLQ

SEQ ID NO: 2709170 - protein, 26 aa, Entamoeba histolytica
DLKLENFLLCTPPKTMKYPRLKIADY

SEQ ID NO: 2709171 - protein, 25 aa, Entamoeba histolytica
DLKLISDDFLLRYRKDQFDPLKQIS

SEQ ID NO: 2709172 - protein, 17 aa, Entamoeba histolytica
DLKNITYTFPLSTLMSW

SEQ ID NO: 2709173 - protein, 18 aa, Entamoeba histolytica
DLKPENILLVDYTKQIKL

SEQ ID NO: 2709174 - protein, 21 aa, Entamoeba histolytica
DLKSLIEIFYILLNQSEHPGV

SEQ ID NO: 2709175 - protein, 19 aa, Entamoeba histolytica
DLKTLLLDNLSSSLTPYLS

SEQ ID NO: 2709176 - protein, 23 aa, Entamoeba histolytica
DLKTLLQPYGKISEVKRILKMNK

SEQ ID NO: 2709177 - protein, 17 aa, Entamoeba histolytica
DLKTLPRTLVREGILRK

SEQ ID NO: 2709178 - protein, 26 aa, Entamoeba histolytica
DLLAESYNYIPLLQSDPNDLDKFIQL

SEQ ID NO: 2709179 - protein, 21 aa, Entamoeba histolytica
DLLGKVYFSFELNNSLFTVKF

SEQ ID NO: 2709180 - protein, 19 aa, Entamoeba histolytica
DLLGTLWRNMDSSNIPKGE

SEQ ID NO: 2709181 - protein, 18 aa, Entamoeba histolytica
DLLHIGHYKLLKHAKEIG

SEQ ID NO: 2709182 - protein, 24 aa, Entamoeba histolytica
DLLIGLLRLRLPTNEKFMPELKGK

SEQ ID NO: 2709183 - protein, 18 aa, Entamoeba histolytica
DLLILDEPTNHLDLNAVI

SEQ ID NO: 2709184 - protein, 17 aa, Entamoeba histolytica
DLLILNEQKRIFGMIYG

SEQ ID NO: 2709185 - protein, 18 aa, Entamoeba histolytica
DLLKIFYQGIEQIKNEFK

SEQ ID NO: 2709186 - protein, 22 aa, Entamoeba histolytica
DLLKMIQILKNGFEVYLRLIPM

SEQ ID NO: 2709187 - protein, 20 aa, Entamoeba histolytica
DLLLANAIVRVILQMAQFYK

SEQ ID NO: 2709188 - protein, 29 aa, Entamoeba histolytica
DLLLFSRTHDTPYNSLYFISHGKVNQMIA

SEQ ID NO: 2709189 - protein, 26 aa, Entamoeba histolytica
DLLNQSYLVLGQCYFVVLDEADKMID

SEQ ID NO: 2709190 - protein, 18 aa, Entamoeba histolytica
DLLPRMQVEWRNVVQFVT

SEQ ID NO: 2709191 - protein, 17 aa, Entamoeba histolytica
DLLPWREDMEEIKTIRK

SEQ ID NO: 2709192 - protein, 34 aa, Entamoeba histolytica
DLLSLLITPIQRLPRYRLLLKDLLKHLRPSDVDY

SEQ ID NO: 2709193 - protein, 35 aa, Entamoeba histolytica
DLLSLLITPIQRLPRYRLLLKDLLKHLRPSDVDYE

SEQ ID NO: 2709194 - protein, 29 aa, Entamoeba histolytica
DLLSRKIYQSFLCTPILIAAHRTLNLYSF

SEQ ID NO: 2709195 - protein, 30 aa, Entamoeba histolytica
DLLSRKIYQSFLCTPILIAAHRTLNLYSFV

SEQ ID NO: 2709196 - protein, 17 aa, Entamoeba histolytica
DLLTWVHCLKPISVDKI

SEQ ID NO: 2709197 - protein, 21 aa, Entamoeba histolytica
DLLVFHYFQQFNEFISLTAVV

SEQ ID NO: 2709198 - protein, 25 aa, Entamoeba histolytica
DLMCHDFNLIMYYMNNTLPKYVTAV

SEQ ID NO: 2709199 - protein, 24 aa, Entamoeba histolytica
DLMDNTYLYPVGMGAYHSGVCIFG

SEQ ID NO: 2709200 - protein, 18 aa, Entamoeba histolytica
DLMKNELPVLPLPKKESL

SEQ ID NO: 2709201 - protein, 18 aa, Entamoeba histolytica
DLNAICFVAPSSNVKLTA

SEQ ID NO: 2709202 - protein, 26 aa, Entamoeba histolytica
DLNDGLILISLFEALRKQKVQFRYNK

SEQ ID NO: 2709203 - protein, 31 aa, Entamoeba histolytica
DLNEIRHFYLYLLWILKNMDLRTLINLINKD

SEQ ID NO: 2709204 - protein, 24 aa, Entamoeba histolytica
DLNFDLICPLIYKDSVLIACYEDK

SEQ ID NO: 2709205 - protein, 24 aa, Entamoeba histolytica
DLNFQSKTWFPDMPSHFILKENEP

SEQ ID NO: 2709206 - protein, 21 aa, Entamoeba histolytica
DLNIIMYRLLASGVNTITLDI

SEQ ID NO: 2709207 - protein, 31 aa, Entamoeba histolytica
DLNKMVEHLLLPYIKTMLIPQQSYENVVITH

SEQ ID NO: 2709208 - protein, 19 aa, Entamoeba histolytica
DLNLTLEEIFFGTKKEVRF

SEQ ID NO: 2709209 - protein, 20 aa, Entamoeba histolytica
DLNSFLIMPVQRVPRYRLLL

SEQ ID NO: 2709210 - protein, 17 aa, Entamoeba histolytica
DLPFPDYANYHFLLPIK

SEQ ID NO: 2709211 - protein, 21 aa, Entamoeba histolytica
DLPFVVKIHLPKELITQIGNT

SEQ ID NO: 2709212 - protein, 18 aa, Entamoeba histolytica
DLPPVKPWQDTTVTDALV

SEQ ID NO: 2709213 - protein, 31 aa, Entamoeba histolytica
DLQEIYYKRLRFLQVKLFNTSLKSYSKLPLK

SEQ ID NO: 2709214 - protein, 27 aa, Entamoeba histolytica
DLQGRTLPLLLTKVNLLTASAFIEDDN

SEQ ID NO: 2709215 - protein, 27 aa, Entamoeba histolytica
DLQPDLVAAVFKRFLRDLPTHVIDKQQ

SEQ ID NO: 2709216 - protein, 32 aa, Entamoeba histolytica
DLQRLCEILDKPEYFIFGRILIGEYRVELKES

SEQ ID NO: 2709217 - protein, 29 aa, Entamoeba histolytica
DLQRQLYPYMKELVPLPSIYYKSYIAANQ

SEQ ID NO: 2709218 - protein, 18 aa, Entamoeba histolytica
DLRFVPDDTEFPYKAVDV

SEQ ID NO: 2709219 - protein, 23 aa, Entamoeba histolytica
DLRGFLIMPVQRLPRYNLLLTDL

SEQ ID NO: 2709220 - protein, 17 aa, Entamoeba histolytica
DLRKERNALRLQIDSLK

SEQ ID NO: 2709221 - protein, 35 aa, Entamoeba histolytica
DLRLMIQIAKYGVGVYELYLNDSLLNYSLTMKMHL

SEQ ID NO: 2709222 - protein, 19 aa, Entamoeba histolytica
DLSFCSCFYDDKLLFLGDK

SEQ ID NO: 2709223 - protein, 24 aa, Entamoeba histolytica
DLSGPTSFAPLIKKAIEIVKETKQ

SEQ ID NO: 2709224 - protein, 19 aa, Entamoeba histolytica
DLSILLLPSIGFICQYSTT

SEQ ID NO: 2709225 - protein, 25 aa, Entamoeba histolytica
DLSNTLFLRLNTFQLLIKTSAGNCV

SEQ ID NO: 2709226 - protein, 17 aa, Entamoeba histolytica
DLSPDLFVFRQNVLEIT

SEQ ID NO: 2709227 - protein, 24 aa, Entamoeba histolytica
DLSSCLLTCRKLRSFILSDDLIWQ

SEQ ID NO: 2709228 - protein, 26 aa, Entamoeba histolytica
DLSVQKTFLMRILKKVFIEEKTDGES

SEQ ID NO: 2709229 - protein, 20 aa, Entamoeba histolytica
DLSYFNGLSIKKLSIDYSLL

SEQ ID NO: 2709230 - protein, 26 aa, Entamoeba histolytica
DLTAQGYIYILNITQLIELVTHPFKF

SEQ ID NO: 2709231 - protein, 26 aa, Entamoeba histolytica
DLTGVNYNLKEKFWYCFEQRNNVFDY

SEQ ID NO: 2709232 - protein, 17 aa, Entamoeba histolytica
DLTIKLQLWDTAGQERF

SEQ ID NO: 2709233 - protein, 19 aa, Entamoeba histolytica
DLTYILPNLIAMGIPTTGI

SEQ ID NO: 2709234 - protein, 21 aa, Entamoeba histolytica
DLVCAWYLNNTCCVWSIESSQ

SEQ ID NO: 2709235 - protein, 26 aa, Entamoeba histolytica
DLVCMSSYYLFRKGIEPKWEDAQNKN

SEQ ID NO: 2709236 - protein, 27 aa, Entamoeba histolytica
DLVESIRFILERLIPFNQQLNPRRMQL

SEQ ID NO: 2709237 - protein, 25 aa, Entamoeba histolytica
DLVLDGCNLIYFPDALLDQQNSMNY

SEQ ID NO: 2709238 - protein, 23 aa, Entamoeba histolytica
DLVLLPEGLTKLSSLIFLNLSEN

SEQ ID NO: 2709239 - protein, 24 aa, Entamoeba histolytica
DLVQFYFQLLVHIGVIKDVITSRN

SEQ ID NO: 2709240 - protein, 27 aa, Entamoeba histolytica
DLVYAFFIYFENILGSLPWNSLNDSPQ

SEQ ID NO: 2709241 - protein, 17 aa, Entamoeba histolytica
DLVYQYPNSIETLIFRV

SEQ ID NO: 2709242 - protein, 18 aa, Entamoeba histolytica
DLWSVSIFFFSSIAKKCT

SEQ ID NO: 2709243 - protein, 18 aa, Entamoeba histolytica
DLYELWFIKNEQVPQAIL

SEQ ID NO: 2709244 - protein, 18 aa, Entamoeba histolytica
DLYLKYCNSLTTLCLPSL

SEQ ID NO: 2709245 - protein, 21 aa, Entamoeba histolytica
DLYNIPRFDDCHFTRVDSCKY

SEQ ID NO: 2709246 - protein, 22 aa, Entamoeba histolytica
DLYNNPIDFQPLLGRGNCGGLD

SEQ ID NO: 2709247 - protein, 20 aa, Entamoeba histolytica
DLYNYIAHHIELFKGKKVLE

SEQ ID NO: 2709248 - protein, 28 aa, Entamoeba histolytica
DLYTNHLLLFYTFIGDNFIYSSPLNDLY

SEQ ID NO: 2709249 - protein, 22 aa, Entamoeba histolytica
DMARLVIVVGIPYPSLGDINVN

SEQ ID NO: 2709250 - protein, 20 aa, Entamoeba histolytica
DMDLNKFSSLTFLDISFNKL

SEQ ID NO: 2709251 - protein, 19 aa, Entamoeba histolytica
DMEHLKIVYISPLKALATE

SEQ ID NO: 2709252 - protein, 24 aa, Entamoeba histolytica
DMELVKEFMQLYSLLPLTQSSQLT

SEQ ID NO: 2709253 - protein, 20 aa, Entamoeba histolytica
DMENGVVYVLTSLKLKEFKY

SEQ ID NO: 2709254 - protein, 18 aa, Entamoeba histolytica
DMEYIIRTIYPVIPQQIV

SEQ ID NO: 2709255 - protein, 24 aa, Entamoeba histolytica
DMFANPYVFFAVKTPLHIIKYTIH

SEQ ID NO: 2709256 - protein, 17 aa, Entamoeba histolytica
DMFFFVTSQGLLLKMSS

SEQ ID NO: 2709257 - protein, 22 aa, Entamoeba histolytica
DMFGCYLEDKVDFDHWIYDEHH

SEQ ID NO: 2709258 - protein, 19 aa, Entamoeba histolytica
DMFIPYIQNTDFAGILLME

SEQ ID NO: 2709259 - protein, 21 aa, Entamoeba histolytica
DMGYEVLVVSQFTLYAVLNGT

SEQ ID NO: 2709260 - protein, 35 aa, Entamoeba histolytica
DMILQSICPELCGLRMCKLAVMLVATGGISRIDKE

SEQ ID NO: 2709261 - protein, 29 aa, Entamoeba histolytica
DMISIIDLFARYRYLKEITALILDTLDGD

SEQ ID NO: 2709262 - protein, 34 aa, Entamoeba histolytica
DMKFIEILKEKNNLLRLLVHSLCPPIYGHYIVKT

SEQ ID NO: 2709263 - protein, 17 aa, Entamoeba histolytica
DMKQLKITALFFCGEHK

SEQ ID NO: 2709264 - protein, 20 aa, Entamoeba histolytica
DMKSRMYLNFTICFSSRISS

SEQ ID NO: 2709265 - protein, 19 aa, Entamoeba histolytica
DMKWKTEMLDFKESLQIEQ

SEQ ID NO: 2709266 - protein, 17 aa, Entamoeba histolytica
DMLANGYIRHIPSPTYP

SEQ ID NO: 2709267 - protein, 25 aa, Entamoeba histolytica
DMLDCIELLLPLLSKLLRCKPIGQI

SEQ ID NO: 2709268 - protein, 17 aa, Entamoeba histolytica
DMLKKTQKIEYGLCATL

SEQ ID NO: 2709269 - protein, 20 aa, Entamoeba histolytica
DMLLFECYKISNFTPIVTII

SEQ ID NO: 2709270 - protein, 30 aa, Entamoeba histolytica; identical to SEQ ID NO: 2520904

SEQ ID NO: 2709271 - protein, 19 aa, Entamoeba histolytica
DMLSNFKKFAYKIGGICYT

SEQ ID NO: 2709272 - protein, 20 aa, Entamoeba histolytica
DMLYPHLSGLSYFTKRHEFS

SEQ ID NO: 2709273 - protein, 33 aa, Entamoeba histolytica
DMMVLLTRYLDYIIDIVRPRKLLYLAVDGVAPR

SEQ ID NO: 2709274 - protein, 23 aa, Entamoeba histolytica
DMNDIFAQFFPGMAGMGGFEQRS

SEQ ID NO: 2709275 - protein, 19 aa, Entamoeba histolytica
DMNKSCRRFIVSGYCKYLD

SEQ ID NO: 2709276 - protein, 21 aa, Entamoeba histolytica
DMPRAFSKFLARNTFYFGSNE

SEQ ID NO: 2709277 - protein, 25 aa, Entamoeba histolytica
DMQHLLIQLFIRCDHTLFIWSSKSF

SEQ ID NO: 2709278 - protein, 25 aa, Entamoeba histolytica
DMQNIFKPHIIIKTKLQSSLSGFNI

SEQ ID NO: 2709279 - protein, 28 aa, Entamoeba histolytica
DMQSYFNSIYQRLLYLLQNNLSDFKLNT

SEQ ID NO: 2709280 - protein, 18 aa, Entamoeba histolytica
DMQYFQMVSIRQTSCCLV

SEQ ID NO: 2709281 - protein, 23 aa, Entamoeba histolytica
DMSKIFEILLAYEKTNLCITQFS

SEQ ID NO: 2709282 - protein, 18 aa, Entamoeba histolytica
DMSKLPDDEILGNTLILI

SEQ ID NO: 2709283 - protein, 25 aa, Entamoeba histolytica
DMSRIGEQLLFKLKPFQVQGVEFGI

SEQ ID NO: 2709284 - protein, 33 aa, Entamoeba histolytica; identical to SEQ ID NO: 2520916

SEQ ID NO: 2709285 - protein, 23 aa, Entamoeba histolytica
DMSYFLINNLDKNTLYKLNYIHS

SEQ ID NO: 2709286 - protein, 25 aa, Entamoeba histolytica
DMTIEKYHKPIPYPKGIICVEFGKE

SEQ ID NO: 2709287 - protein, 29 aa, Entamoeba histolytica
DMTKYSQYFKDYPAPFNALITRKKDKKSG

SEQ ID NO: 2709288 - protein, 18 aa, Entamoeba histolytica
DMTLLFIASKEGGIFVFP

SEQ ID NO: 2709289 - protein, 17 aa, Entamoeba histolytica
DMTVLTPYVYFGNSQTD

SEQ ID NO: 2709290 - protein, 23 aa, Entamoeba histolytica
DMVIEWLCLNIPSRLLPNSLGGT

SEQ ID NO: 2709291 - protein, 28 aa, Entamoeba histolytica
DMVLRMAVRCSKQFKLNGIGIALCCHMK

SEQ ID NO: 2709292 - protein, 20 aa, Entamoeba histolytica
DMVVPFLVVYIDEYYFGSYE

SEQ ID NO: 2709293 - protein, 26 aa, Entamoeba histolytica
DMWSFGCVVAELFLGIPLFAGSSEHN

SEQ ID NO: 2709294 - protein, 31 aa, Entamoeba histolytica; identical to SEQ ID NO: 2520922

SEQ ID NO: 2709295 - protein, 27 aa, Entamoeba histolytica
DMWSVGVMLYVCLCGYLPFDGDTIAEN

SEQ ID NO: 2709296 - protein, 27 aa, Entamoeba histolytica
DMYNRNYLGYLIHRILSYDPTLEEAEQ

SEQ ID NO: 2709297 - protein, 26 aa, Entamoeba histolytica
DNAFYNYLLPLYLENKFHAQFVIDQQ

SEQ ID NO: 2709298 - protein, 34 aa, Entamoeba histolytica
DNAIIPLKDIMYKLNILILCRSDIKEYSLLNEEI

SEQ ID NO: 2709299 - protein, 32 aa, Entamoeba histolytica
DNARKIAFNEYYKHKFRIITSIGSIVEKNSLM

SEQ ID NO: 2709300 - protein, 19 aa, Entamoeba histolytica
DNCIIFSFKANKKEPIIIT

SEQ ID NO: 2709301 - protein, 27 aa, Entamoeba histolytica
DNCKMDCTIPLILDSYSLVKDITFFLT

SEQ ID NO: 2709302 - protein, 24 aa, Entamoeba histolytica
DNCKYIPCIYVINKIDAMEPSEVE

SEQ ID NO: 2709303 - protein, 30 aa, Entamoeba histolytica
DNCPPEQLPESWKIILREAGVKKKDLQNPE

SEQ ID NO: 2709304 - protein, 25 aa, Entamoeba histolytica
DNDCKRWFWELLQNAKDSIAHDPTK

SEQ ID NO: 2709305 - protein, 20 aa, Entamoeba histolytica
DNDDEFFSDSLFGDDFFEDD

SEQ ID NO: 2709306 - protein, 26 aa, Entamoeba histolytica
DNDGLYTVFVFLKGLVVYFLHEGLLD

SEQ ID NO: 2709307 - protein, 20 aa, Entamoeba histolytica
DNDIFLARQVLRNLTHNTVN

SEQ ID NO: 2709308 - protein, 21 aa, Entamoeba histolytica
DNDLILFKAYKFIVTVEGQNN

SEQ ID NO: 2709309 - protein, 21 aa, Entamoeba histolytica
DNDLMKYLQSLYSFSIEDFNA

SEQ ID NO: 2709310 - protein, 23 aa, Entamoeba histolytica
DNDLQFYFQQYNPIQSRVIYDDR

SEQ ID NO: 2709311 - protein, 17 aa, Entamoeba histolytica
DNDLWPIPLHKGSGEFM

SEQ ID NO: 2709312 - protein, 25 aa, Entamoeba histolytica
DNDNFKINLPFKQEIIRENEELTEK

SEQ ID NO: 2709313 - protein, 25 aa, Entamoeba histolytica
DNDPYVRRNAVLGLLKLLHIPNTSI

SEQ ID NO: 2709314 - protein, 27 aa, Entamoeba histolytica
DNDVIQTFFVIHLLKERFSENKVEWKL

SEQ ID NO: 2709315 - protein, 23 aa, Entamoeba histolytica
DNEELFIQYINSLKTFTFEDNDI

SEQ ID NO: 2709316 - protein, 17 aa, Entamoeba histolytica
DNELLFILRSNKDLILS

SEQ ID NO: 2709317 - protein, 24 aa, Entamoeba histolytica
DNELPIVAIFPCDSTSFITAFPDA

SEQ ID NO: 2709318 - protein, 25 aa, Entamoeba histolytica
DNELRLTALWLLANLLGLAPSLSVV

SEQ ID NO: 2709319 - protein, 23 aa, Entamoeba histolytica
DNEYNGFLTLQKYSRFLQKSGFD

SEQ ID NO: 2709320 - protein, 22 aa, Entamoeba histolytica
DNEYVLNQFVILSALDFIEEKK

SEQ ID NO: 2709321 - protein, 30 aa, Entamoeba histolytica
DNFIDDGYDYSLPRCTVRPEIRIENAEKVQ

SEQ ID NO: 2709322 - protein, 25 aa, Entamoeba histolytica
DNFIIDQFFVFITQKYDNKYQQQFN

SEQ ID NO: 2709323 - protein, 23 aa, Entamoeba histolytica
DNFQEQLIALRLLHTIVSLQIEQ

SEQ ID NO: 2709324 - protein, 19 aa, Entamoeba histolytica
DNFTLTRFPLPYDIKQSTK

SEQ ID NO: 2709325 - protein, 27 aa, Entamoeba histolytica
DNFVCNGPIRWYCCGPTVYDDSHLGHA

SEQ ID NO: 2709326 - protein, 19 aa, Entamoeba histolytica
DNFWYITNPSDVRAYSICL

SEQ ID NO: 2709327 - protein, 36 aa, Entamoeba histolytica
DNGKVSLRFIFKKQEFFIPVVLLLRVYGGMSDREIF

SEQ ID NO: 2709328 - protein, 29 aa, Entamoeba histolytica
DNIALQIVCFYFINYFNLLEKSNNQYVVG

SEQ ID NO: 2709329 - protein, 23 aa, Entamoeba histolytica
DNICKSISLIQVMFEKNLTPCFK

SEQ ID NO: 2709330 - protein, 20 aa, Entamoeba histolytica
DNIHLKYFDSIPTALSLQFS

SEQ ID NO: 2709331 - protein, 21 aa, Entamoeba histolytica
DNIKYIMPRYTMKGIPMVLNK

SEQ ID NO: 2709332 - protein, 27 aa, Entamoeba histolytica
DNIPYFHKLFISLLNEKYLFPSDSLLY

SEQ ID NO: 2709333 - protein, 26 aa, Entamoeba histolytica
DNIQNYLKDLLTFYKPRKFNVQTDRI

SEQ ID NO: 2709334 - protein, 25 aa, Entamoeba histolytica
DNITFKSLPIEQINYLKNQLIKQFV

SEQ ID NO: 2709335 - protein, 27 aa, Entamoeba histolytica
DNKCKAIQWINPFATASLCCDLSKLLV

SEQ ID NO: 2709336 - protein, 28 aa, Entamoeba histolytica
DNKDDIIRLYYVCLLNNFPVDEINQLMN

SEQ ID NO: 2709337 - protein, 24 aa, Entamoeba histolytica
DNKDKQFIYFYILAKECVTNKMRW

SEQ ID NO: 2709338 - protein, 23 aa, Entamoeba histolytica
DNKEWVLLKEGYFGLVKFLNEEQ

SEQ ID NO: 2709339 - protein, 24 aa, Entamoeba histolytica
DNKIIEKYLKIIRIYIKKQSSSYE

SEQ ID NO: 2709340 - protein, 20 aa, Entamoeba histolytica
DNKRYILINKRNTDISGTTP

SEQ ID NO: 2709341 - protein, 25 aa, Entamoeba histolytica
DNKYDLYDYFLNNYPFFKNTNFDQF

SEQ ID NO: 2709342 - protein, 20 aa, Entamoeba histolytica
DNLFVKNRYLIWSCSVINKK

SEQ ID NO: 2709343 - protein, 24 aa, Entamoeba histolytica
DNLIQIFQIYKDNPGILLLCFQVY

SEQ ID NO: 2709344 - protein, 37 aa, Entamoeba histolytica; identical to SEQ ID NO: 2520973

SEQ ID NO: 2709345 - protein, 22 aa, Entamoeba histolytica
DNLPDVWFEPKDVWEIKGADLS

SEQ ID NO: 2709346 - protein, 23 aa, Entamoeba histolytica
DNNCSLFTLGNRIGFIHIAKTKN

SEQ ID NO: 2709347 - protein, 21 aa, Entamoeba histolytica
DNNFNILFTLGGDGTLRGANA

SEQ ID NO: 2709348 - protein, 25 aa, Entamoeba histolytica
DNNIKFIETLLITYRQYLSPTEFFN

SEQ ID NO: 2709349 - protein, 21 aa, Entamoeba histolytica
DNNTEKCHIILLTDGYVDNKT

SEQ ID NO: 2709350 - protein, 22 aa, Entamoeba histolytica
DNNTEKCHIILLTDGYVNNKTS

SEQ ID NO: 2709351 - protein, 27 aa, Entamoeba histolytica
DNPDDEFLKKYILEKKWEEIEDGKEDV

SEQ ID NO: 2709352 - protein, 30 aa, Entamoeba histolytica
DNPYNLIEPYFLHQLLFSSKSKLYLFDCRY

SEQ ID NO: 2709353 - protein, 23 aa, Entamoeba histolytica
DNQKEYVVVQPTYQLSTNDYIPQ

SEQ ID NO: 2709354 - protein, 26 aa, Entamoeba histolytica
DNQKNLVYFLCKYIHEKHPDLSHWME

SEQ ID NO: 2709355 - protein, 26 aa, Entamoeba histolytica
DNQTEYFFDKLLPNGIYDFHLLNMKD

SEQ ID NO: 2709356 - protein, 23 aa, Entamoeba histolytica
DNRKLLPLFGIKQDTQFFSIKNR

SEQ ID NO: 2709357 - protein, 18 aa, Entamoeba histolytica
DNRLWYFASKTAEEAKGF

SEQ ID NO: 2709358 - protein, 25 aa, Entamoeba histolytica
DNRPASALPFKISAAKLDALSGQLL

SEQ ID NO: 2709359 - protein, 26 aa, Entamoeba histolytica
DNRPASALPFKISAAKLDALSGQLLN

SEQ ID NO: 2709360 - protein, 23 aa, Entamoeba histolytica
DNSDLICFGANKKPSQLKNDTTT

SEQ ID NO: 2709361 - protein, 21 aa, Entamoeba histolytica
DNSFLIKYKKVYLIPNYSQTP

SEQ ID NO: 2709362 - protein, 18 aa, Entamoeba histolytica
DNSIEWIKLMQCFIQRKE

SEQ ID NO: 2709363 - protein, 22 aa, Entamoeba histolytica
DNSIEWIKLMQCFIQRKEIDEA

SEQ ID NO: 2709364 - protein, 25 aa, Entamoeba histolytica
DNSKTHLIFKQYKPLYPQNMPEYPD

SEQ ID NO: 2709365 - protein, 26 aa, Entamoeba histolytica
DNSPLIQYVIMWVIQRVGSNIGFILT

SEQ ID NO: 2709366 - protein, 34 aa, Entamoeba histolytica
DNSQTTPLHLLPSKIFRKVMSIMLHGFTEETILS

SEQ ID NO: 2709367 - protein, 21 aa, Entamoeba histolytica
DNSYNQLFYFESFNLSEKKLD

SEQ ID NO: 2709368 - protein, 44 aa, Entamoeba histolytica
DNTEDEFTQMFWKLGMKNFDDFISKLLKLPRKSLEKSREVLKRR

SEQ ID NO: 2709369 - protein, 27 aa, Entamoeba histolytica
DNTEDEFTQMFWKLGMKNFDDFISKLV

SEQ ID NO: 2709370 - protein, 28 aa, Entamoeba histolytica
DNTEDEFTQMFWKLGMKNFDDFISKLVK

SEQ ID NO: 2709371 - protein, 28 aa, Entamoeba histolytica
DNTEDEFTQMFWKLGMKNFDDFITKLVK

SEQ ID NO: 2709372 - protein, 24 aa, Entamoeba histolytica
DNTEDIFTQMFWELSMKNFDDFIT

SEQ ID NO: 2709373 - protein, 25 aa, Entamoeba histolytica
DNTLLYAIYIFLLTYHREDITTVYK

SEQ ID NO: 2709374 - protein, 27 aa, Entamoeba histolytica
DNTLPSSWRFWEVMAQDFCATSKESFH

SEQ ID NO: 2709375 - protein, 30 aa, Entamoeba histolytica
DNTPNFPQKFYFFVLKSLQFIYQKEFVIIY

SEQ ID NO: 2709376 - protein, 19 aa, Entamoeba histolytica
DNVCWLLVGCKSDLVNSVD

SEQ ID NO: 2709377 - protein, 29 aa, Entamoeba histolytica
DNVLQTLYILDLYLKYFSKLEDLFILKDI

SEQ ID NO: 2709378 - protein, 26 aa, Entamoeba histolytica
DNVSGTYILIPYIRGNQSRTSFKLMI

SEQ ID NO: 2709379 - protein, 34 aa, Entamoeba histolytica
DNVVTFYEAFYLPAKKLMWMSMEYMDGGCLTDIL

SEQ ID NO: 2709380 - protein, 23 aa, Entamoeba histolytica
DNYKFFKELFFGKSQTQFYVFRD

SEQ ID NO: 2709381 - protein, 29 aa, Entamoeba histolytica
DNYLNILFNYYSIIIFDIQHYFEIFSQYD

SEQ ID NO: 2709382 - protein, 25 aa, Entamoeba histolytica
DNYNFYIEKIILQLTFVFAHNPSSQ

SEQ ID NO: 2709383 - protein, 25 aa, Entamoeba histolytica
DPDATPIYRIVILTHSDLPDDDDVE

SEQ ID NO: 2709384 - protein, 29 aa, Entamoeba histolytica
DPDDSISYKWKLFTIWDTVKGEIVAMKMK

SEQ ID NO: 2709385 - protein, 26 aa, Entamoeba histolytica
DPDHFEYAFLLLYSTLLCFSLIDVFD

SEQ ID NO: 2709386 - protein, 19 aa, Entamoeba histolytica
DPDHFIFTLHNPHNIEPSK

SEQ ID NO: 2709387 - protein, 20 aa, Entamoeba histolytica
DPFNIIREFGKKYLGLKCPH

SEQ ID NO: 2709388 - protein, 20 aa, Entamoeba histolytica
DPFSFKILLPRIVLNQKEEL

SEQ ID NO: 2709389 - protein, 20 aa, Entamoeba histolytica
DPFWEGRYSTSIYLGDYVDR

SEQ ID NO: 2709390 - protein, 24 aa, Entamoeba histolytica
DPGDLPYCEFATWNKVKFVDQSMT

SEQ ID NO: 2709391 - protein, 32 aa, Entamoeba histolytica
DPIDCHPKFMIFTLIPVPPPCVRPSIVSEGAK

SEQ ID NO: 2709392 - protein, 27 aa, Entamoeba histolytica
DPIIKNDFFILVRVYGIYGSCYNLDID

SEQ ID NO: 2709393 - protein, 23 aa, Entamoeba histolytica
DPIIPSKPLILILGSMPGTESLK

SEQ ID NO: 2709394 - protein, 26 aa, Entamoeba histolytica
DPIKRRYLIFMLNLYYSITQQQEINK

SEQ ID NO: 2709395 - protein, 19 aa, Entamoeba histolytica
DPKRILILHMTMVQRKIKS

SEQ ID NO: 2709396 - protein, 20 aa, Entamoeba histolytica
DPLINQQLLEKFPFCRGSSA

SEQ ID NO: 2709397 - protein, 23 aa, Entamoeba histolytica
DPLLFVPALTCCHLKKLSFPNEM

SEQ ID NO: 2709398 - protein, 29 aa, Entamoeba histolytica
DPLTSSFYLGYNMLLNLMKLEAADPEGLI

SEQ ID NO: 2709399 - protein, 31 aa, Entamoeba histolytica
DPMKLNTFVVQLSDEYYLEMTAKEVERRLNE

SEQ ID NO: 2709400 - protein, 20 aa, Entamoeba histolytica
DPMMMYQQFFLQPMAGAQQP

SEQ ID NO: 2709401 - protein, 24 aa, Entamoeba histolytica
DPMRSHLLIELYGLEIQLYSKLND

SEQ ID NO: 2709402 - protein, 24 aa, Entamoeba histolytica
DPNDSILLCLCNERNLHEIDKLMN

SEQ ID NO: 2709403 - protein, 17 aa, Entamoeba histolytica
DPNETILLFPSPDAKRL

SEQ ID NO: 2709404 - protein, 27 aa, Entamoeba histolytica
DPNKSFFHIGLLLITPTKGNILQLRCI

SEQ ID NO: 2709405 - protein, 27 aa, Entamoeba histolytica
DPNKSFFHIGLLLITPTKGNLFQLRYI

SEQ ID NO: 2709406 - protein, 23 aa, Entamoeba histolytica
DPNLSNHILITPKTPNVTSTPLV

SEQ ID NO: 2709407 - protein, 22 aa, Entamoeba histolytica
DPNRQLLYHGSRLTNFVGILST

SEQ ID NO: 2709408 - protein, 30 aa, Entamoeba histolytica
DPNVNSFLKKFFYTMREPSYIDWKLNNSDK

SEQ ID NO: 2709409 - protein, 22 aa, Entamoeba histolytica
DPREILLLPCRHITMCAGCYEE

SEQ ID NO: 2709410 - protein, 25 aa, Entamoeba histolytica
DPRFPTIQGLIRRGLTLEAMKEFCL

SEQ ID NO: 2709411 - protein, 21 aa, Entamoeba histolytica
DPRMGIVLTLLASTSPFGGDA

SEQ ID NO: 2709412 - protein, 17 aa, Entamoeba histolytica
DPRSSIMPFRDGGHLIW

SEQ ID NO: 2709413 - protein, 24 aa, Entamoeba histolytica
DPSCPEWFLHHKHMFVYTLAGKPA

SEQ ID NO: 2709414 - protein, 24 aa, Entamoeba histolytica
DPSLDNNAIMSMKFMKRARAKEIE

SEQ ID NO: 2709415 - protein, 21 aa, Entamoeba histolytica
DPSLVAYLKSLGIDPDYVPPK

SEQ ID NO: 2709416 - protein, 17 aa, Entamoeba histolytica
DPSSPIPLIKLTNLFSL

SEQ ID NO: 2709417 - protein, 17 aa, Entamoeba histolytica
DPSTLFIPASCLMKMTP

SEQ ID NO: 2709418 - protein, 24 aa, Entamoeba histolytica
DPTKMELYIKLAGIKPRKHKGTDK

SEQ ID NO: 2709419 - protein, 23 aa, Entamoeba histolytica
DPTKQGFHLDYLEKVHLSDDISI

SEQ ID NO: 2709420 - protein, 22 aa, Entamoeba histolytica
DPTLIRPLNILEKSFEFVKSKY

SEQ ID NO: 2709421 - protein, 26 aa, Entamoeba histolytica
DPTMVMMCLWIMMLKQKNIGSSNIRK

SEQ ID NO: 2709422 - protein, 20 aa, Entamoeba histolytica
DPTPFHNNVKWFPFPDHHNP

SEQ ID NO: 2709423 - protein, 25 aa, Entamoeba histolytica
DPTSNYLIPILSLNEGYHYGIFICS

SEQ ID NO: 2709424 - protein, 22 aa, Entamoeba histolytica
DPTVLVFILTTRVGGLGINLTG

SEQ ID NO: 2709425 - protein, 17 aa, Entamoeba histolytica
DPVIFPNVSYPTADCKR

SEQ ID NO: 2709426 - protein, 20 aa, Entamoeba histolytica
DPVRDQWYVDTMLLATCLGG

SEQ ID NO: 2709427 - protein, 17 aa, Entamoeba histolytica
DPYSKYRIATKKEFGLL

SEQ ID NO: 2709428 - protein, 23 aa, Entamoeba histolytica
DPYTNKLVIYWDVERNGKSEIID

SEQ ID NO: 2709429 - protein, 18 aa, Entamoeba histolytica
DQALSVNYLLFIQGNMQV

SEQ ID NO: 2709430 - protein, 18 aa, Entamoeba histolytica
DQASLLQLLIPFLQSLYF

SEQ ID NO: 2709431 - protein, 25 aa, Entamoeba histolytica
DQCAKGIIWALLTIKGVIQNEPDLN

SEQ ID NO: 2709432 - protein, 23 aa, Entamoeba histolytica
DQCDIVFQKPFKISKKTLQFLTI

SEQ ID NO: 2709433 - protein, 23 aa, Entamoeba histolytica
DQCFEFYSRPLLYRVQPTVLSKN

SEQ ID NO: 2709434 - protein, 36 aa, Entamoeba histolytica
DQDKILDAVLRFCYLWFNFMPLTRGTAGCGMYWMFG

SEQ ID NO: 2709435 - protein, 31 aa, Entamoeba histolytica
DQEINLRLPLKDLLVFFESALIQTESRVDIY

SEQ ID NO: 2709436 - protein, 21 aa, Entamoeba histolytica
DQFITFQWELFDTDLNPINYF

SEQ ID NO: 2709437 - protein, 20 aa, Entamoeba histolytica
DQFLLFIIEDTTITFCHQKR

SEQ ID NO: 2709438 - protein, 17 aa, Entamoeba histolytica
DQFRNIISKCTKPHFIC

SEQ ID NO: 2709439 - protein, 21 aa, Entamoeba histolytica
DQKRHGRIAFRLANAYLEVKE

SEQ ID NO: 2709440 - protein, 17 aa, Entamoeba histolytica
DQLFLSLDLNNTLSISS

SEQ ID NO: 2709441 - protein, 19 aa, Entamoeba histolytica
DQLLVRHDLLKYLKEFPTV

SEQ ID NO: 2709442 - protein, 29 aa, Entamoeba histolytica
DQLPEELKTLFIHLLRLCYKIAQNEKINS

SEQ ID NO: 2709443 - protein, 31 aa, Entamoeba histolytica
DQLQQFIHLPFYSMINPLKLMKCSFPNLPAD

SEQ ID NO: 2709444 - protein, 25 aa, Entamoeba histolytica
DQMESQMFTIIKIKTNKPIDIINKA

SEQ ID NO: 2709445 - protein, 20 aa, Entamoeba histolytica
DQMLKYMEIIWNLLETNKKC

SEQ ID NO: 2709446 - protein, 37 aa, Entamoeba histolytica
DQMTCTYLNIFIQQLYSWLQDFLHICSVRVFPSNEPS

SEQ ID NO: 2709447 - protein, 20 aa, Entamoeba histolytica
DQMYLAFDLGGGTLDVTILE

SEQ ID NO: 2709448 - protein, 21 aa, Entamoeba histolytica
DQNQMWLFKQIVELCKIDMKD

SEQ ID NO: 2709449 - protein, 18 aa, Entamoeba histolytica
DQPHLLLLEGTLNKYCRK

SEQ ID NO: 2709450 - protein, 28 aa, Entamoeba histolytica
DQPNLQLLLQIKSLRLLILKQSKQIFLS

SEQ ID NO: 2709451 - protein, 24 aa, Entamoeba histolytica
DQQKNPFLPIFYHHQFVSVLEKYI

SEQ ID NO: 2709452 - protein, 21 aa, Entamoeba histolytica
DQQRIITLLLNEQFELRSSVI

SEQ ID NO: 2709453 - protein, 26 aa, Entamoeba histolytica
DQQYVTFMLFILPHTTLNYNELLSAH

SEQ ID NO: 2709454 - protein, 22 aa, Entamoeba histolytica
DQRDLPVKGPFKKLLNKLNLSH

SEQ ID NO: 2709455 - protein, 23 aa, Entamoeba histolytica
DQRDLPVKGPFKKLLNKLNLSHN

SEQ ID NO: 2709456 - protein, 24 aa, Entamoeba histolytica
DQRIINKEHIIIIIKDEEGNKFGG

SEQ ID NO: 2709457 - protein, 30 aa, Entamoeba histolytica
DQRVCLVKTLYRPVPLEHYVFCKKKEELPS

SEQ ID NO: 2709458 - protein, 26 aa, Entamoeba histolytica
DQSIHYELLPFVQDILTIIKSKKTEK

SEQ ID NO: 2709459 - protein, 18 aa, Entamoeba histolytica
DQSIKWINSLLNLTQSVE

SEQ ID NO: 2709460 - protein, 20 aa, Entamoeba histolytica
DQSLDCIYPYVKNLVRSYKQ

SEQ ID NO: 2709461 - protein, 25 aa, Entamoeba histolytica
DQTILHLSPILLQKGTTRIALYGMS

SEQ ID NO: 2709462 - protein, 25 aa, Entamoeba histolytica
DQVEWEIFKLIRNAVTYNGPNSPIG

SEQ ID NO: 2709463 - protein, 25 aa, Entamoeba histolytica
DQVGSDDVFFLLSSSFPESLSDPHS

SEQ ID NO: 2709464 - protein, 18 aa, Entamoeba histolytica
DQWILHRLNVMITSVQQW

SEQ ID NO: 2709465 - protein, 24 aa, Entamoeba histolytica
DQWKRLATELYLLKKQVPTQIKTE

SEQ ID NO: 2709466 - protein, 28 aa, Entamoeba histolytica
DQYFLMKCVCHFMTPIPFFNIMCSDEIE

SEQ ID NO: 2709467 - protein, 26 aa, Entamoeba histolytica
DQYVYSLKFIFTPVNKIPPTEILPPE

SEQ ID NO: 2709468 - protein, 25 aa, Entamoeba histolytica
DRAIDPRTPYQYTPYSRRYDQDYQY

SEQ ID NO: 2709469 - protein, 33 aa, Entamoeba histolytica
DRAIPYDRDFLQDQFLLDGFNFLRGYNDIVDGC

SEQ ID NO: 2709470 - protein, 23 aa, Entamoeba histolytica
DRAKVRMKMLYSSTKARFRTTLG

SEQ ID NO: 2709471 - protein, 18 aa, Entamoeba histolytica
DRCFMNCFALKEIDLKNI

SEQ ID NO: 2709472 - protein, 20 aa, Entamoeba histolytica
DRCFMNCFALKEIDLKNIQK

SEQ ID NO: 2709473 - protein, 40 aa, Entamoeba histolytica
DRCLTTLFEMKQFPVIILKDNPVIFLLRSHRETLKKEYEN

SEQ ID NO: 2709474 - protein, 24 aa, Entamoeba histolytica
DRDELPMYLIWLEENASAQTLKFK

SEQ ID NO: 2709475 - protein, 17 aa, Entamoeba histolytica
DRDFPELSNFKMIGKFE

SEQ ID NO: 2709476 - protein, 18 aa, Entamoeba histolytica
DREFLKDQFLLDGFDFPS

SEQ ID NO: 2709477 - protein, 25 aa, Entamoeba histolytica
DREMTKLIFIAMRGNNYFAFESMID

SEQ ID NO: 2709478 - protein, 25 aa, Entamoeba histolytica
DRETALYWGLVLIQKMFAYEQMMGK

SEQ ID NO: 2709479 - protein, 28 aa, Entamoeba histolytica
DREYPILSPIRLLFFNYIQQSINNIPSS

SEQ ID NO: 2709480 - protein, 26 aa, Entamoeba histolytica
DRFITDDKLWFIIQTKTDLGKMDIPV

SEQ ID NO: 2709481 - protein, 30 aa, Entamoeba histolytica; identical to SEQ ID NO: 2521140

SEQ ID NO: 2709482 - protein, 21 aa, Entamoeba histolytica
DRHFIPELIEQIPITTQPLIK

SEQ ID NO: 2709483 - protein, 27 aa, Entamoeba histolytica
DRIEGKKLFVLEKYPKIVYLQNGSYLQ

SEQ ID NO: 2709484 - protein, 22 aa, Entamoeba histolytica
DRIEQNLYGIRYYLPIIQYVGE

SEQ ID NO: 2709485 - protein, 22 aa, Entamoeba histolytica
DRKALIWDLYPIEKSSDPVALQ

SEQ ID NO: 2709486 - protein, 23 aa, Entamoeba histolytica
DRKALIWDLYPIEKSSDPVALQY

SEQ ID NO: 2709487 - protein, 23 aa, Entamoeba histolytica
DRKKDILDLISPSSTVIISNPRL

SEQ ID NO: 2709488 - protein, 24 aa, Entamoeba histolytica
DRKLEQITELLPLLLKGVGMHHSG

SEQ ID NO: 2709489 - protein, 25 aa, Entamoeba histolytica
DRKRLRIGFKLVFEFEKNEWFEETE

SEQ ID NO: 2709490 - protein, 22 aa, Entamoeba histolytica
DRKVRLWTLPNPSTKTSQVFSG

SEQ ID NO: 2709491 - protein, 22 aa, Entamoeba histolytica
DRLIGRIKFELFREICPKTVEN

SEQ ID NO: 2709492 - protein, 18 aa, Entamoeba histolytica
DRLINSINIINKNLTLCL

SEQ ID NO: 2709493 - protein, 23 aa, Entamoeba histolytica
DRLLFYIDDWWLRDGIYDVYDVA

SEQ ID NO: 2709494 - protein, 26 aa, Entamoeba histolytica
DRLRERLYYDIYSFITRRAKEITITI

SEQ ID NO: 2709495 - protein, 24 aa, Entamoeba histolytica
DRMEVLNNLPLYFSPTTFIGYKMA

SEQ ID NO: 2709496 - protein, 18 aa, Entamoeba histolytica
DRNIILPKPPRENRHSIK

SEQ ID NO: 2709497 - protein, 20 aa, Entamoeba histolytica
DRNIIPPKPPRENRNTIKQW

SEQ ID NO: 2709498 - protein, 20 aa, Entamoeba histolytica
DRNIIPPRPPRENRNTIKQW

SEQ ID NO: 2709499 - protein, 29 aa, Entamoeba histolytica
DRNNYYEVYIFISNIFKPLVISEFLNLYN

SEQ ID NO: 2709500 - protein, 30 aa, Entamoeba histolytica; identical to SEQ ID NO: 2521159

SEQ ID NO: 2709501 - protein, 21 aa, Entamoeba histolytica
DRRRKIMSISIKRNEYDFLHH

SEQ ID NO: 2709502 - protein, 25 aa, Entamoeba histolytica
DRSKRRTLFFFKKKDKKELPKSLTP

SEQ ID NO: 2709503 - protein, 20 aa, Entamoeba histolytica
DRWLNACEWVIRNISQSSPE

SEQ ID NO: 2709504 - protein, 17 aa, Entamoeba histolytica
DRYIIISQPYGNLLIHD

SEQ ID NO: 2709505 - protein, 23 aa, Entamoeba histolytica
DSAMFMSYEFDKCYYTDEFESQM

SEQ ID NO: 2709506 - protein, 26 aa, Entamoeba histolytica
DSAQQSFLFRILVDNGFTVCLKKLYK

SEQ ID NO: 2709507 - protein, 26 aa, Entamoeba histolytica
DSCDDKMKYVILNNTVIKYEYSSGEE

SEQ ID NO: 2709508 - protein, 23 aa, Entamoeba histolytica
DSCYPLFAIVDPCHSFTLPDNQI

SEQ ID NO: 2709509 - protein, 29 aa, Entamoeba histolytica
DSDEWVYYLFILIKNILKKYPSLLIESVY

SEQ ID NO: 2709510 - protein, 36 aa, Entamoeba histolytica
DSDSDTITILLNAKIIFFIVKVLFRCDAVDPPESKK

SEQ ID NO: 2709511 - protein, 40 aa, Entamoeba histolytica
DSDTNWAIDKWLFTNLYDFIFEPMMYYINDSSPFKGLLES

SEQ ID NO: 2709512 - protein, 24 aa, Entamoeba histolytica
DSDVLLFPVIVLYPESNQSDCLRD

SEQ ID NO: 2709513 - protein, 25 aa, Entamoeba histolytica
DSEKLYKLFNKWISSGLFSSKKLLE

SEQ ID NO: 2709514 - protein, 25 aa, Entamoeba histolytica
DSELWDLRMLKLKKTTDLLNGCYSR

SEQ ID NO: 2709515 - protein, 29 aa, Entamoeba histolytica
DSESGYKFILGMMFSLYRKYCICRSVSDE

SEQ ID NO: 2709516 - protein, 26 aa, Entamoeba histolytica
DSESIIFPFLYENEIIQWLTQKAILY

SEQ ID NO: 2709517 - protein, 27 aa, Entamoeba histolytica
DSETIQTYIVMIRTIQRNRDRAMIDST

SEQ ID NO: 2709518 - protein, 17 aa, Entamoeba histolytica
DSEYYWESYSHPGIHDE

SEQ ID NO: 2709519 - protein, 33 aa, Entamoeba histolytica
DSFDYVISKLFTSLTQWLDYVLLDCCERMVYLT

SEQ ID NO: 2709520 - protein, 18 aa, Entamoeba histolytica
DSFEFYNVTPGTMATFTV

SEQ ID NO: 2709521 - protein, 19 aa, Entamoeba histolytica
DSFFFLLQKSLEESIEFIE

SEQ ID NO: 2709522 - protein, 26 aa, Entamoeba histolytica
DSFKIKEYVPYPQPFWDKNGLNEYQR

SEQ ID NO: 2709523 - protein, 24 aa, Entamoeba histolytica
DSFKMNISTVMPIFQTGITADITL

SEQ ID NO: 2709524 - protein, 20 aa, Entamoeba histolytica
DSFKMYLNNVFYNAGISQVN

SEQ ID NO: 2709525 - protein, 19 aa, Entamoeba histolytica
DSFTRFYIKKKPTQKLTMC

SEQ ID NO: 2709526 - protein, 25 aa, Entamoeba histolytica
DSFVPIVIYTLLKANLPHLSSTVKY

SEQ ID NO: 2709527 - protein, 31 aa, Entamoeba histolytica
DSFWRNARSKLNAYFLQPMIGELKEELSRQI

SEQ ID NO: 2709528 - protein, 29 aa, Entamoeba histolytica
DSFYDYINRIFFYYQLLNITINREESTNY

SEQ ID NO: 2709529 - protein, 23 aa, Entamoeba histolytica
DSGKLVLSTWLGTNSFLPRSEAH

SEQ ID NO: 2709530 - protein, 25 aa, Entamoeba histolytica
DSGTFKYLYDRGLSYRYNQIDGDPV

SEQ ID NO: 2709531 - protein, 25 aa, Entamoeba histolytica
DSGVGKSCLLLRFSDDVFSDTYITT

SEQ ID NO: 2709532 - protein, 17 aa, Entamoeba histolytica
DSHIPYRNSKLTELLQN

SEQ ID NO: 2709533 - protein, 21 aa, Entamoeba histolytica
DSHNLICQLFLRVNSKFNVSN

SEQ ID NO: 2709534 - protein, 17 aa, Entamoeba histolytica
DSIDKFIALTILEHLLL

SEQ ID NO: 2709535 - protein, 23 aa, Entamoeba histolytica
DSIEEYFILSKQKAKFLDLHIDL

SEQ ID NO: 2709536 - protein, 18 aa, Entamoeba histolytica
DSIELMIDLFGNYVIQKL

SEQ ID NO: 2709537 - protein, 24 aa, Entamoeba histolytica
DSIELYKRFDLESLKLQIQQEELE

SEQ ID NO: 2709538 - protein, 19 aa, Entamoeba histolytica
DSIFNLFLNDSLGAFCRMT

SEQ ID NO: 2709539 - protein, 27 aa, Entamoeba histolytica
DSIHWDYFISKVKRINPALFYLCEGRP

SEQ ID NO: 2709540 - protein, 25 aa, Entamoeba histolytica
DSIIRIYPPIPYSTFYPRLLEEAEQ

SEQ ID NO: 2709541 - protein, 30 aa, Entamoeba histolytica
DSIISFLMKYKFAELALLFVRDVHAKFAIA

SEQ ID NO: 2709542 - protein, 31 aa, Entamoeba histolytica; identical to SEQ ID NO: 2477779

SEQ ID NO: 2709543 - protein, 25 aa, Entamoeba histolytica
DSIKLIGKYAFKSSILLQPPNIPNG

SEQ ID NO: 2709544 - protein, 17 aa, Entamoeba histolytica
DSIMEHVLPVLEKRFRL

SEQ ID NO: 2709545 - protein, 24 aa, Entamoeba histolytica
DSIQFYQSLIDLSSFFICADSGAD

SEQ ID NO: 2709546 - protein, 27 aa, Entamoeba histolytica
DSIQRSIFFILPDLLVEYFASLISLMK

SEQ ID NO: 2709547 - protein, 22 aa, Entamoeba histolytica
DSIQTGFVLCSPSDVCHFTNLF

SEQ ID NO: 2709548 - protein, 21 aa, Entamoeba histolytica
DSIVFYKIKEQFGGKLKFIFN

SEQ ID NO: 2709549 - protein, 32 aa, Entamoeba histolytica
DSKALVFCGCFPRRHFDNFIKVCPINAPELPS

SEQ ID NO: 2709550 - protein, 23 aa, Entamoeba histolytica
DSKPIIYPQISESPFRPIQFSKL

SEQ ID NO: 2709551 - protein, 22 aa, Entamoeba histolytica
DSLEGFFFCHSICGGTGSGLGS

SEQ ID NO: 2709552 - protein, 20 aa, Entamoeba histolytica
DSLELFGTLVSWIDISFSTN

SEQ ID NO: 2709553 - protein, 17 aa, Entamoeba histolytica
DSLIQFLDQIEANDNQE

SEQ ID NO: 2709554 - protein, 32 aa, Entamoeba histolytica
DSLKGDLLLRVLKLLRLLIRNEGNLQKFCEEG

SEQ ID NO: 2709555 - protein, 22 aa, Entamoeba histolytica
DSLLFFMNNQFKTKSIGITANI

SEQ ID NO: 2709556 - protein, 26 aa, Entamoeba histolytica
DSLLLNSRNHFLFAFDNTEDLSGHPR

SEQ ID NO: 2709557 - protein, 21 aa, Entamoeba histolytica
DSLMKRFRTYKSETLPVIESF

SEQ ID NO: 2709558 - protein, 25 aa, Entamoeba histolytica
DSLNIGLIHIFFKQKLEISLVPQSL

SEQ ID NO: 2709559 - protein, 25 aa, Entamoeba histolytica
DSLNKDIMILLTQKLIHKETKKPIS

SEQ ID NO: 2709560 - protein, 27 aa, Entamoeba histolytica
DSLREMFFSPKNTLLYCFCDSLLKHDV

SEQ ID NO: 2709561 - protein, 26 aa, Entamoeba histolytica
DSLSQLYSIFMSKLSPLFSAFEYDGT

SEQ ID NO: 2709562 - protein, 19 aa, Entamoeba histolytica
DSLSYIISLYKQKGDYKTA

SEQ ID NO: 2709563 - protein, 22 aa, Entamoeba histolytica
DSLWLSMNSFVLAIFSYLKEAS

SEQ ID NO: 2709564 - protein, 24 aa, Entamoeba histolytica
DSMQRHNIWRIIFSSSATVYGEPE

SEQ ID NO: 2709565 - protein, 17 aa, Entamoeba histolytica
DSNAHPILLCFQSSPIF

SEQ ID NO: 2709566 - protein, 25 aa, Entamoeba histolytica
DSNDKKFIVWTKRSTIRKTAPIGVN

SEQ ID NO: 2709567 - protein, 20 aa, Entamoeba histolytica
DSNERLNIRWAYDDPNPIAK

SEQ ID NO: 2709568 - protein, 17 aa, Entamoeba histolytica
DSNGGYLLYGIKVGEIS

SEQ ID NO: 2709569 - protein, 27 aa, Entamoeba histolytica
DSNGNIIKRWYGITLISVRGNLFYPRS

SEQ ID NO: 2709570 - protein, 30 aa, Entamoeba histolytica
DSNIIVCGYKHFSMIWDVAGGGAFAVIPYT

SEQ ID NO: 2709571 - protein, 27 aa, Entamoeba histolytica
DSNKIRKLLKIYYSEDNRLLFPRSVSE

SEQ ID NO: 2709572 - protein, 42 aa, Entamoeba histolytica
DSNLILEILMKYMFSLKYGFKYLYYIIPKIISLSNSIDTNGK

SEQ ID NO: 2709573 - protein, 17 aa, Entamoeba histolytica
DSPLMWKSLGNAAMISG

SEQ ID NO: 2709574 - protein, 31 aa, Entamoeba histolytica
DSPSSPIPHLLLSPLAFVLPMTILPNMNITK

SEQ ID NO: 2709575 - protein, 21 aa, Entamoeba histolytica
DSPVIPVMLYHTGKIKDICRI

SEQ ID NO: 2709576 - protein, 23 aa, Entamoeba histolytica
DSQIAFVMKEIIMGLAYLHGNNM

SEQ ID NO: 2709577 - protein, 49 aa, Entamoeba histolytica
DSQLNIIEFFIAMACLNHYILFKKLPIKIPVYFISFLKKKFGATENDIF

SEQ ID NO: 2709578 - protein, 26 aa, Entamoeba histolytica
DSQQLIPELCLSPRVIRIGVHPKRAV

SEQ ID NO: 2709579 - protein, 34 aa, Entamoeba histolytica
DSQQYFSDGLVQRKWYDDVVFKNQAKEPPKQAKY

SEQ ID NO: 2709580 - protein, 20 aa, Entamoeba histolytica
DSQYIIDYYNNINLKYKEEK

SEQ ID NO: 2709581 - protein, 34 aa, Entamoeba histolytica
DSRGYAAIPMMYIRNTIIRLMSIDVKQAVAVALK

SEQ ID NO: 2709582 - protein, 20 aa, Entamoeba histolytica
DSRIKLWDLRTKNCIKEMGG

SEQ ID NO: 2709583 - protein, 22 aa, Entamoeba histolytica
DSRILFQSIVQSKDLCLIFYCN

SEQ ID NO: 2709584 - protein, 25 aa, Entamoeba histolytica
DSRYELLYHLQTFSPSLLSEFVPLL

SEQ ID NO: 2709585 - protein, 28 aa, Entamoeba histolytica
DSSDNEWSLPAFLPKRIRSISKEEVIKL

SEQ ID NO: 2709586 - protein, 21 aa, Entamoeba histolytica
DSSDPFDYPIEKLPDIIGKYQ

SEQ ID NO: 2709587 - protein, 24 aa, Entamoeba histolytica
DSSENILLQPELSLRFIHVPTDVG

SEQ ID NO: 2709588 - protein, 27 aa, Entamoeba histolytica
DSSKIPKFYFLVDLIDKLIPKKTQSKL

SEQ ID NO: 2709589 - protein, 26 aa, Entamoeba histolytica
DSSMIFFNDAYLPNASLSIDGTCIFK

SEQ ID NO: 2709590 - protein, 29 aa, Entamoeba histolytica
DSSQNFLTWSALPQPFRYNKLKYPNEYYS

SEQ ID NO: 2709591 - protein, 26 aa, Entamoeba histolytica
DSSSLALIHYILLRGLSDPTHLIRAK

SEQ ID NO: 2709592 - protein, 23 aa, Entamoeba histolytica
DSSSLISRLFRITEGIAGSSGDD

SEQ ID NO: 2709593 - protein, 24 aa, Entamoeba histolytica
DSSSSLTPTTESEKKEVIEEDKKE

SEQ ID NO: 2709594 - protein, 25 aa, Entamoeba histolytica
DSSSTDFLLYDSQGSLFFDEVILPQ

SEQ ID NO: 2709595 - protein, 29 aa, Entamoeba histolytica
DSSTVKQCILDWSFKSLFDQYAKGKSYIS

SEQ ID NO: 2709596 - protein, 24 aa, Entamoeba histolytica
DSTDFVFLLSTRAGGLGINLTTAD

SEQ ID NO: 2709597 - protein, 20 aa, Entamoeba histolytica
DSTFFDFRHFTNYLSIGIDA

SEQ ID NO: 2709598 - protein, 22 aa, Entamoeba histolytica
DSTGKICLCIGKKYMKVVDLYR

SEQ ID NO: 2709599 - protein, 24 aa, Entamoeba histolytica
DSTKNFRFVTNLYQTVNAPKKEIS

SEQ ID NO: 2709600 - protein, 17 aa, Entamoeba histolytica
DSTLKEHKLVLDTLSKV

SEQ ID NO: 2709601 - protein, 18 aa, Entamoeba histolytica
DSVAFIPLFSKNGGIMDS

SEQ ID NO: 2709602 - protein, 23 aa, Entamoeba histolytica
DSVDLLFTAVFVFASSMTQQQVM

SEQ ID NO: 2709603 - protein, 23 aa, Entamoeba histolytica
DSVLKGNYYLRPRDSRTSVDIYQ

SEQ ID NO: 2709604 - protein, 24 aa, Entamoeba histolytica
DSVSDALWAFYYVSSKPKFSDLID

SEQ ID NO: 2709605 - protein, 18 aa, Entamoeba histolytica
DSWMDMPANTLKHKKDIN

SEQ ID NO: 2709606 - protein, 29 aa, Entamoeba histolytica
DSYKEPPFAYWIYYVYTNVHVLNNLRRTL

SEQ ID NO: 2709607 - protein, 25 aa, Entamoeba histolytica
DSYLHCEWAYPIKFTVIPRPVRKNN

SEQ ID NO: 2709608 - protein, 18 aa, Entamoeba histolytica
DSYLHWIAASPPSSLKNS

SEQ ID NO: 2709609 - protein, 17 aa, Entamoeba histolytica
DSYSFDLLFRNYEYYHF

SEQ ID NO: 2709610 - protein, 39 aa, Entamoeba histolytica
DTAGQERFATLTGNYFRNAMAAIIMFDVSNKESFENIPN

SEQ ID NO: 2709611 - protein, 23 aa, Entamoeba histolytica
DTALDIRVKMQGILGDVNSLPLS

SEQ ID NO: 2709612 - protein, 25 aa, Entamoeba histolytica
DTANCFMKALYQKAIFINKNKVRDE

SEQ ID NO: 2709613 - protein, 17 aa, Entamoeba histolytica
DTCIFFENRKHTDLYLW

SEQ ID NO: 2709614 - protein, 24 aa, Entamoeba histolytica
DTDLIDYLTFRINIDKVKSLPIFK

SEQ ID NO: 2709615 - protein, 19 aa, Entamoeba histolytica
DTDLLFNFLSQVEGRKIFT

SEQ ID NO: 2709616 - protein, 26 aa, Entamoeba histolytica
DTENDSEMPPLDDLQLLDPRVYTEEF

SEQ ID NO: 2709617 - protein, 23 aa, Entamoeba histolytica
DTEPSITSLFKYLSTHSFVSLTR

SEQ ID NO: 2709618 - protein, 18 aa, Entamoeba histolytica
DTEYASCLVKLPLILPFI

SEQ ID NO: 2709619 - protein, 19 aa, Entamoeba histolytica
DTFCLPIACFQFNQPEEFK

SEQ ID NO: 2709620 - protein, 28 aa, Entamoeba histolytica
DTFEQHYQLLLSKRLLYKGFQAEDEKIV

SEQ ID NO: 2709621 - protein, 22 aa, Entamoeba histolytica
DTFFNKLPQWISLLLQDDSYKE

SEQ ID NO: 2709622 - protein, 25 aa, Entamoeba histolytica
DTGSHPPFIVSWGKEYWMKKDEYDE

SEQ ID NO: 2709623 - protein, 22 aa, Entamoeba histolytica
DTIEMIHMTYYLSLIANSTSKE

SEQ ID NO: 2709624 - protein, 19 aa, Entamoeba histolytica
DTIILTFKKHSITSGNILR

SEQ ID NO: 2709625 - protein, 22 aa, Entamoeba histolytica
DTKILNIFPLIIQISHSFENDV

SEQ ID NO: 2709626 - protein, 25 aa, Entamoeba histolytica
DTKKRIIGLLKIWTSTVSPNIIQAV

SEQ ID NO: 2709627 - protein, 24 aa, Entamoeba histolytica
DTKRELIHILRIMLPLKKENNNNN

SEQ ID NO: 2709628 - protein, 30 aa, Entamoeba histolytica
DTKYDIVAIPQIICFIKNYYFDDGILTDEK

SEQ ID NO: 2709629 - protein, 19 aa, Entamoeba histolytica
DTLIDLYQVISVNQSVIFC

SEQ ID NO: 2709630 - protein, 22 aa, Entamoeba histolytica
DTMFNLEQILEKPLPSLFLTRC

SEQ ID NO: 2709631 - protein, 23 aa, Entamoeba histolytica
DTMLKIFFSKYPSVQKVKVIINP

SEQ ID NO: 2709632 - protein, 26 aa, Entamoeba histolytica
DTMTNNLMILLLKQNNIFLKERSTRK

SEQ ID NO: 2709633 - protein, 18 aa, Entamoeba histolytica
DTNFIGLIIGPRGDNQKR

SEQ ID NO: 2709634 - protein, 17 aa, Entamoeba histolytica
DTNIFLRDTGAKLNRFA

SEQ ID NO: 2709635 - protein, 27 aa, Entamoeba histolytica
DTNRRRFKVVLYGVNQMLRYNTEKDVF

SEQ ID NO: 2709636 - protein, 26 aa, Entamoeba histolytica
DTNVGKTCLLLTYTTNSFPDSYVPTV

SEQ ID NO: 2709637 - protein, 26 aa, Entamoeba histolytica
DTNVGKTCLLLTYTTNSFPDTYVPTV

SEQ ID NO: 2709638 - protein, 27 aa, Entamoeba histolytica
DTPLYKSKLVPSGVLCIVFLTKDKIQS

SEQ ID NO: 2709639 - protein, 21 aa, Entamoeba histolytica
DTPNTLFYHPADYQYLTVSAP

SEQ ID NO: 2709640 - protein, 24 aa, Entamoeba histolytica
DTPQKDVQPLLLFGDLEDKQQPQQ

SEQ ID NO: 2709641 - protein, 26 aa, Entamoeba histolytica
DTPVVKWLWEILHSYSIELKKKFLFF

SEQ ID NO: 2709642 - protein, 25 aa, Entamoeba histolytica
DTRIVLRMFFINFIKLLKVNNRPME

SEQ ID NO: 2709643 - protein, 33 aa, Entamoeba histolytica
DTRNTYQAIRNLIPKYKIVVERCILFDKAEQQM

SEQ ID NO: 2709644 - protein, 22 aa, Entamoeba histolytica
DTRTTFIQRKITINFPTEFPEE

SEQ ID NO: 2709645 - protein, 27 aa, Entamoeba histolytica
DTRVRFSILLNLPIIHSFPLPLREKFL

SEQ ID NO: 2709646 - protein, 24 aa, Entamoeba histolytica
DTSDSFYRQLISFGIHPWHCGDET

SEQ ID NO: 2709647 - protein, 25 aa, Entamoeba histolytica
DTSIWVCPICNSRYPLPPDSRTYSS

SEQ ID NO: 2709648 - protein, 25 aa, Entamoeba histolytica
DTSKPYKVVPLSLQTKPTITFEQQV

SEQ ID NO: 2709649 - protein, 29 aa, Entamoeba histolytica
DTSKYSYWVFHYLLPLQKSLLFHRKYPFF

SEQ ID NO: 2709650 - protein, 18 aa, Entamoeba histolytica
DTSYQPLLSTQQRNILPA

SEQ ID NO: 2709651 - protein, 24 aa, Entamoeba histolytica
DTTAPFILRGGLCGTFRQLIRSCN

SEQ ID NO: 2709652 - protein, 25 aa, Entamoeba histolytica
DTTKNYQYYLGSIKNEVFELEDNET

SEQ ID NO: 2709653 - protein, 24 aa, Entamoeba histolytica
DTTLYIYCVVGYLIYLRQRILDAK

SEQ ID NO: 2709654 - protein, 23 aa, Entamoeba histolytica
DTTMDCVPTPYKTVETIKNEEVF

SEQ ID NO: 2709655 - protein, 19 aa, Entamoeba histolytica
DTTSDSAWPLLFDSFVSSF

SEQ ID NO: 2709656 - protein, 23 aa, Entamoeba histolytica
DTTTTYRLYFNNCLLNPDDTIAD

SEQ ID NO: 2709657 - protein, 23 aa, Entamoeba histolytica
DTTVYFTWRDSYPYNPNSVQALH

SEQ ID NO: 2709658 - protein, 19 aa, Entamoeba histolytica
DTVDLVPVGAWMGEGKRAG

SEQ ID NO: 2709659 - protein, 25 aa, Entamoeba histolytica
DTVEFEVQWLPWHNEHVLDKFIMNL

SEQ ID NO: 2709660 - protein, 26 aa, Entamoeba histolytica
DTVGKKYVRGVKLFGMKFTPNDEGCL

SEQ ID NO: 2709661 - protein, 31 aa, Entamoeba histolytica; identical to SEQ ID NO: 2521332

SEQ ID NO: 2709662 - protein, 24 aa, Entamoeba histolytica
DTVTLFPNKILDSQFYYINNKLTN

SEQ ID NO: 2709663 - protein, 17 aa, Entamoeba histolytica
DTVYILFYKRKVNSAGY

SEQ ID NO: 2709664 - protein, 25 aa, Entamoeba histolytica
DTYVLNLHDFFLWNIDGTCDAICKS

SEQ ID NO: 2709665 - protein, 25 aa, Entamoeba histolytica
DVATIFKVLIPKGKSVTFKPLQSTF

SEQ ID NO: 2709666 - protein, 25 aa, Entamoeba histolytica
DVCGYVFAFYVQKLIHHKTDILGKY

SEQ ID NO: 2709667 - protein, 23 aa, Entamoeba histolytica
DVCRLIVKQILEALKYLHSKNII

SEQ ID NO: 2709668 - protein, 41 aa, Entamoeba histolytica; identical to SEQ ID NO: 2521342

SEQ ID NO: 2709669 - protein, 21 aa, Entamoeba histolytica
DVDIALLFPQLPSLSIGRKIR

SEQ ID NO: 2709670 - protein, 20 aa, Entamoeba histolytica
DVDYLFKDKTVLSKAYGSLI

SEQ ID NO: 2709671 - protein, 34 aa, Entamoeba histolytica
DVECLLLLLNKIIPYSYDYYSNIIPPLIFDQQFE

SEQ ID NO: 2709672 - protein, 27 aa, Entamoeba histolytica
DVEEMAQALYIYWKSRDIVKAGECDYD

SEQ ID NO: 2709673 - protein, 27 aa, Entamoeba histolytica
DVEPEFDLQFLRSVLQTNITIISEEYN

SEQ ID NO: 2709674 - protein, 38 aa, Entamoeba histolytica
DVEPYQPRRGFFSSLYQLIFHPIKFFTPTEKKVGEVKL

SEQ ID NO: 2709675 - protein, 27 aa, Entamoeba histolytica
DVERNAFVTLLYREKNGWTLVKQGDKI

SEQ ID NO: 2709676 - protein, 33 aa, Entamoeba histolytica
DVFCGKVVELFLDTLKGYRIKFPHLKYCNIENS

SEQ ID NO: 2709677 - protein, 35 aa, Entamoeba histolytica
DVFCGKVVELFLDTLKGYRIKFPHLKYCNIENSTR

SEQ ID NO: 2709678 - protein, 30 aa, Entamoeba histolytica
DVFCGKVVKLFLDTLKGYRIDFPHLQYCNI

SEQ ID NO: 2709679 - protein, 34 aa, Entamoeba histolytica
DVFCGKVVKLFLDTLKGYRIKFPHLQYCNIENST

SEQ ID NO: 2709680 - protein, 18 aa, Entamoeba histolytica
DVFFERRKLWEQLINQNK

SEQ ID NO: 2709681 - protein, 28 aa, Entamoeba histolytica
DVFQPDKYYFIIQQLYDQINICVLTLVI

SEQ ID NO: 2709682 - protein, 23 aa, Entamoeba histolytica
DVGRYAVLCALQFSLTLCLPHDT

SEQ ID NO: 2709683 - protein, 19 aa, Entamoeba histolytica
DVGYTPVVPGMHKIEVLVN

SEQ ID NO: 2709684 - protein, 29 aa, Entamoeba histolytica
DVHDLLVETLKNFLLYYTETETSKNVVYI

SEQ ID NO: 2709685 - protein, 31 aa, Entamoeba histolytica; identical to SEQ ID NO: 2517815

SEQ ID NO: 2709686 - protein, 30 aa, Entamoeba histolytica
DVIDITILPFLFDSLNKSYLHLGVFLSVMN

SEQ ID NO: 2709687 - protein, 17 aa, Entamoeba histolytica
DVIFDKRNDLPSLLLLP

SEQ ID NO: 2709688 - protein, 18 aa, Entamoeba histolytica
DVIFDPKKDWTFDSLSTC

SEQ ID NO: 2709689 - protein, 19 aa, Entamoeba histolytica
DVIFVIKTKEHPIFERKGS

SEQ ID NO: 2709690 - protein, 25 aa, Entamoeba histolytica
DVIGYTVLVLLRKINFLDERFVLHY

SEQ ID NO: 2709691 - protein, 18 aa, Entamoeba histolytica
DVIKKAKELLLLAKAMKE

SEQ ID NO: 2709692 - protein, 30 aa, Entamoeba histolytica
DVIKKLIMKRLLQKPKEDVQFFAKTFRISL

SEQ ID NO: 2709693 - protein, 20 aa, Entamoeba histolytica
DVILIAPPWGGPTKCRNKRS

SEQ ID NO: 2709694 - protein, 25 aa, Entamoeba histolytica
DVIMSSYFINYIGLGVKHALKVIGI

SEQ ID NO: 2709695 - protein, 20 aa, Entamoeba histolytica
DVIQWKLKRVICSHKGWVSS

SEQ ID NO: 2709696 - protein, 23 aa, Entamoeba histolytica
DVIVLFEDYYYFSYTIMRNNFYE

SEQ ID NO: 2709697 - protein, 17 aa, Entamoeba histolytica
DVIVLKNTWLSEPNTLP

SEQ ID NO: 2709698 - protein, 17 aa, Entamoeba histolytica
DVKEILHLFRKKILENK

SEQ ID NO: 2709699 - protein, 26 aa, Entamoeba histolytica
DVKIQLKICSFLQPKHLFSLMQTNNH

SEQ ID NO: 2709700 - protein, 26 aa, Entamoeba histolytica
DVKKELVLPYQVLKDIDDGFKPDSYG

SEQ ID NO: 2709701 - protein, 17 aa, Entamoeba histolytica
DVKKLIQQVLDDKIPIV

SEQ ID NO: 2709702 - protein, 23 aa, Entamoeba histolytica
DVKKNFIAMLTFCDGEEPKVINA

SEQ ID NO: 2709703 - protein, 23 aa, Entamoeba histolytica
DVKKNFIAMLTFCDGEEPQVINA

SEQ ID NO: 2709704 - protein, 23 aa, Entamoeba histolytica
DVKKNFIAMLTFCDGQTPQVINS

SEQ ID NO: 2709705 - protein, 19 aa, Entamoeba histolytica
DVKNHFFGRLKKLNCIEKE

SEQ ID NO: 2709706 - protein, 23 aa, Entamoeba histolytica
DVKPQNILLFNWTDIVKINAKLT

SEQ ID NO: 2709707 - protein, 24 aa, Entamoeba histolytica
DVKQAVAVALKFGLEKEIWDEMVK

SEQ ID NO: 2709708 - protein, 28 aa, Entamoeba histolytica
DVKWFELASHYFWGTWALIQAALSTIDF

SEQ ID NO: 2709709 - protein, 22 aa, Entamoeba histolytica
DVLAQSLIVGNIILYHKEHVEK

SEQ ID NO: 2709710 - protein, 22 aa, Entamoeba histolytica
DVLDDVLLLSYSDYIANESNDS

SEQ ID NO: 2709711 - protein, 20 aa, Entamoeba histolytica
DVLIDFLKKIFVYDPNERMT

SEQ ID NO: 2709712 - protein, 20 aa, Entamoeba histolytica
DVLIRIIDTLSSYINAVATA

SEQ ID NO: 2709713 - protein, 17 aa, Entamoeba histolytica
DVLKHLSQFTYFYECNA

SEQ ID NO: 2709714 - protein, 23 aa, Entamoeba histolytica
DVLKTLCEFINKTQQRKLIEEVY

SEQ ID NO: 2709715 - protein, 37 aa, Entamoeba histolytica
DVLKYMCLILSIQPIYSKFIRLGGFVRLFNSLRSVKR

SEQ ID NO: 2709716 - protein, 18 aa, Entamoeba histolytica
DVLLKLSNVNLNEEWLKK

SEQ ID NO: 2709717 - protein, 36 aa, Entamoeba histolytica; identical to SEQ ID NO: 2521395

SEQ ID NO: 2709718 - protein, 21 aa, Entamoeba histolytica
DVLPTRNLIGVTILYGPDSSA

SEQ ID NO: 2709719 - protein, 32 aa, Entamoeba histolytica
DVLSMDNMYSAWNPQLLISIKTPQAVNVANAC

SEQ ID NO: 2709720 - protein, 19 aa, Entamoeba histolytica
DVLYIIYVTLVNATEKWEE

SEQ ID NO: 2709721 - protein, 21 aa, Entamoeba histolytica
DVLYTIKIVFVGDPCTLDDRK

SEQ ID NO: 2709722 - protein, 19 aa, Entamoeba histolytica
DVMDGHFVPNLTLGAPIVK

SEQ ID NO: 2709723 - protein, 25 aa, Entamoeba histolytica
DVMEKLFTFIFDEIPKRFPDELKVI

SEQ ID NO: 2709724 - protein, 24 aa, Entamoeba histolytica
DVMFRYFNCIGNILSFKICSIDDK

SEQ ID NO: 2709725 - protein, 26 aa, Entamoeba histolytica
DVMKKITYWMLVREKYFAENLPQVMN

SEQ ID NO: 2709726 - protein, 26 aa, Entamoeba histolytica
DVNALNCLILFPCLKFVEFCLIEEKQ

SEQ ID NO: 2709727 - protein, 24 aa, Entamoeba histolytica
DVNDSPRRWYFDLRPEHEDYVDCI

SEQ ID NO: 2709728 - protein, 17 aa, Entamoeba histolytica
DVNIWVCLPGTLTVSIS

SEQ ID NO: 2709729 - protein, 19 aa, Entamoeba histolytica
DVNNRNRIIRRFVDSHYEE

SEQ ID NO: 2709730 - protein, 27 aa, Entamoeba histolytica
DVNPELIPYIPTLTKFLSYQKCNEHSV

SEQ ID NO: 2709731 - protein, 22 aa, Entamoeba histolytica
DVNYNLVIDVMKKIIEQGKSVA

SEQ ID NO: 2709732 - protein, 24 aa, Entamoeba histolytica
DVPFRHEIITFIETDKYVVLNVFQ

SEQ ID NO: 2709733 - protein, 22 aa, Entamoeba histolytica
DVPFRHGIITFIETDKYVVLNV

SEQ ID NO: 2709734 - protein, 21 aa, Entamoeba histolytica
DVPHLSLFGPIGAWKLNTCPL

SEQ ID NO: 2709735 - protein, 17 aa, Entamoeba histolytica
DVPIQYLWSVTNNLGLS

SEQ ID NO: 2709736 - protein, 35 aa, Entamoeba histolytica
DVPNCLFFIDKYSQVPWILSPVLHTSYKLLEKKFI

SEQ ID NO: 2709737 - protein, 24 aa, Entamoeba histolytica
DVPNCLFFIDKYSQVPWIVAPIVK

SEQ ID NO: 2709738 - protein, 27 aa, Entamoeba histolytica
DVQGFVNFFPMNKRPRFFYFEESKTHE

SEQ ID NO: 2709739 - protein, 24 aa, Entamoeba histolytica
DVQGRRYEFYPTFNKEECYNLMHY

SEQ ID NO: 2709740 - protein, 29 aa, Entamoeba histolytica
DVQHKTILKILFMLSKWMSSFPHDFMDGG

SEQ ID NO: 2709741 - protein, 36 aa, Entamoeba histolytica; identical to SEQ ID NO: 2521418

SEQ ID NO: 2709742 - protein, 17 aa, Entamoeba histolytica
DVRKKANRYLAGKVTLA

SEQ ID NO: 2709743 - protein, 24 aa, Entamoeba histolytica
DVSLKQMIYLYISAYASIDEQQAI

SEQ ID NO: 2709744 - protein, 20 aa, Entamoeba histolytica
DVSLKYPLHPNAMYSLISVR

SEQ ID NO: 2709745 - protein, 28 aa, Entamoeba histolytica
DVSNNNIKWFPLLGVIKLKYLDISNNPI

SEQ ID NO: 2709746 - protein, 25 aa, Entamoeba histolytica
DVSTDILWKKYSLCLVKQIVKKHNS

SEQ ID NO: 2709747 - protein, 26 aa, Entamoeba histolytica
DVTAAVYKKFLRELPNHIFNQSQTME

SEQ ID NO: 2709748 - protein, 18 aa, Entamoeba histolytica
DVTEYIRMIIPPDKILSS

SEQ ID NO: 2709749 - protein, 17 aa, Entamoeba histolytica
DVTGCVFLKFTDEYKHH

SEQ ID NO: 2709750 - protein, 20 aa, Entamoeba histolytica
DVTKMLLDDLIDLSMQKFSS

SEQ ID NO: 2709751 - protein, 24 aa, Entamoeba histolytica
DVTLCKYCDFIYIAVTEDENYKKH

SEQ ID NO: 2709752 - protein, 17 aa, Entamoeba histolytica
DVTLLYREGGGSYIQIY

SEQ ID NO: 2709753 - protein, 24 aa, Entamoeba histolytica
DVTMVKMFGVEFPLKAMRKRRGTM

SEQ ID NO: 2709754 - protein, 19 aa, Entamoeba histolytica
DVTRLFYKAAIMENTMLGD

SEQ ID NO: 2709755 - protein, 28 aa, Entamoeba histolytica
DVVALYEYLYAGYPLTFDLSKYGPHFVI

SEQ ID NO: 2709756 - protein, 17 aa, Entamoeba histolytica
DVVFIFEEAIRACLKKS

SEQ ID NO: 2709757 - protein, 27 aa, Entamoeba histolytica
DVVGCIEIITFILVDYPHIYPNDVDVN

SEQ ID NO: 2709758 - protein, 25 aa, Entamoeba histolytica
DVVIKICWLTDKFGPDIKWKFDSML

SEQ ID NO: 2709759 - protein, 17 aa, Entamoeba histolytica
DVVLLCFAVNNRTSFDN

SEQ ID NO: 2709760 - protein, 18 aa, Entamoeba histolytica
DVVLLCFAVNNRTSFDNI

SEQ ID NO: 2709761 - protein, 18 aa, Entamoeba histolytica
DVVTIEGIYLPDEFFSRK

SEQ ID NO: 2709762 - protein, 17 aa, Entamoeba histolytica
DVWNNMFMRLMCIGKSS

SEQ ID NO: 2709763 - protein, 26 aa, Entamoeba histolytica
DVWSGQWKYHIYRYDKPKPNNISVCI

SEQ ID NO: 2709764 - protein, 26 aa, Entamoeba histolytica
DVWSYGVVFWEILTKGIIPYSSISKA

SEQ ID NO: 2709765 - protein, 18 aa, Entamoeba histolytica
DVYISFKGSIPFLRKTSP

SEQ ID NO: 2709766 - protein, 23 aa, Entamoeba histolytica
DVYSFFNCISLHSIHFNTISLKS

SEQ ID NO: 2709767 - protein, 22 aa, Entamoeba histolytica
DVYTAVFFGWQNSPTTCVMGIT

SEQ ID NO: 2709768 - protein, 18 aa, Entamoeba histolytica
DWAFSPSCIFPKALTPEL

SEQ ID NO: 2709769 - protein, 25 aa, Entamoeba histolytica
DWFNKLIGQFWGGNDYYLVAHDFAS

SEQ ID NO: 2709770 - protein, 26 aa, Entamoeba histolytica
DWIKNTLKGFKLLRLASQIDSVGVVS

SEQ ID NO: 2709771 - protein, 24 aa, Entamoeba histolytica
DWKEKIYQDLPVLQRVREIVYPLQ

SEQ ID NO: 2709772 - protein, 25 aa, Entamoeba histolytica
DWKNARQLLFLEFTKHKRFCQRISK

SEQ ID NO: 2709773 - protein, 19 aa, Entamoeba histolytica
DWKRLPAWCDRVMFRVYQA

SEQ ID NO: 2709774 - protein, 17 aa, Entamoeba histolytica
DWNLMVMELLGPSLEDL

SEQ ID NO: 2709775 - protein, 28 aa, Entamoeba histolytica
DWRIDPEIILIRRGVHWLKGKTLKEILE

SEQ ID NO: 2709776 - protein, 31 aa, Entamoeba histolytica
DWRIDPEIILIRRGVHWLKGKTLKEILEKKG

SEQ ID NO: 2709777 - protein, 18 aa, Entamoeba histolytica
DWTFYCHKCDGMASLRTC

SEQ ID NO: 2709778 - protein, 24 aa, Entamoeba histolytica
DYALYLQYLLLNTTNEVYLTIILS

SEQ ID NO: 2709779 - protein, 28 aa, Entamoeba histolytica
DYCIHSDTMFVFVLYSNGRFSDPTRFKC

SEQ ID NO: 2709780 - protein, 23 aa, Entamoeba histolytica
DYCKWTIRLVFGYNKMVSMGVDS

SEQ ID NO: 2709781 - protein, 19 aa, Entamoeba histolytica
DYCYEEHPRYLLRKNIVAD

SEQ ID NO: 2709782 - protein, 21 aa, Entamoeba histolytica
DYCYTHLIHKLFRNYDKLKQY

SEQ ID NO: 2709783 - protein, 18 aa, Entamoeba histolytica
DYDAEASCIECISACSSQ

SEQ ID NO: 2709784 - protein, 21 aa, Entamoeba histolytica
DYDGLIDIIKLRKGKITNKIN

SEQ ID NO: 2709785 - protein, 33 aa, Entamoeba histolytica
DYDRIRPLSYPQTDVFLLCFSVVSPPSFENISS

SEQ ID NO: 2709786 - protein, 27 aa, Entamoeba histolytica
DYDSLCNLPFNLNLFKHIESFTSEIMT

SEQ ID NO: 2709787 - protein, 22 aa, Entamoeba histolytica
DYEHNPRLHLTWFNKMAAENRK

SEQ ID NO: 2709788 - protein, 17 aa, Entamoeba histolytica
DYEIPKLYYKMVFEDEL

SEQ ID NO: 2709789 - protein, 30 aa, Entamoeba histolytica; identical to SEQ ID NO: 2521464

SEQ ID NO: 2709790 - protein, 24 aa, Entamoeba histolytica
DYEYSFIHDFNTFIQTRPTEIHLQ

SEQ ID NO: 2709791 - protein, 35 aa, Entamoeba histolytica
DYFIRNNVNYLFCYRWIVLLFKRDFSSRDCLNVWD

SEQ ID NO: 2709792 - protein, 20 aa, Entamoeba histolytica
DYFLFSLKNPTNKAPLLWNS

SEQ ID NO: 2709793 - protein, 20 aa, Entamoeba histolytica
DYGLKFWLRILHCCGNPSSI

SEQ ID NO: 2709794 - protein, 17 aa, Entamoeba histolytica
DYIFQLKRPNEDPTITC

SEQ ID NO: 2709795 - protein, 24 aa, Entamoeba histolytica
DYIKITEMFLGPAPKDFVYVPKHQ

SEQ ID NO: 2709796 - protein, 32 aa, Entamoeba histolytica
DYIKQRTKTTPFYPYLILSINRSRLNDAYETI

SEQ ID NO: 2709797 - protein, 23 aa, Entamoeba histolytica
DYINRIFYYYQLANFTLNNKDSS

SEQ ID NO: 2709798 - protein, 18 aa, Entamoeba histolytica
DYIQIEVVHGYQGTFHYS

SEQ ID NO: 2709799 - protein, 21 aa, Entamoeba histolytica
DYIRLIQIMDQLADGGFPFIT

SEQ ID NO: 2709800 - protein, 25 aa, Entamoeba histolytica
DYIVKQLEFLVRKKTFTQFGACEFM

SEQ ID NO: 2709801 - protein, 21 aa, Entamoeba histolytica
DYKMIIYEKTLNQRMTCGLHN

SEQ ID NO: 2709802 - protein, 23 aa, Entamoeba histolytica
DYKTFERYVIPMKLFKDVEKKIP

SEQ ID NO: 2709803 - protein, 26 aa, Entamoeba histolytica
DYKYDYLVSPLMRQADFEAKPMVLFL

SEQ ID NO: 2709804 - protein, 30 aa, Entamoeba histolytica
DYLDLKPRNVGMWWKYDLKEYIIINRWCNC

SEQ ID NO: 2709805 - protein, 17 aa, Entamoeba histolytica
DYLIYFTTKDNCKNIKL

SEQ ID NO: 2709806 - protein, 26 aa, Entamoeba histolytica
DYLKVKIFSFPLIRNIIKMMNDKEVT

SEQ ID NO: 2709807 - protein, 24 aa, Entamoeba histolytica
DYLLKVDHTFIIRNLLLSQNSNIR

SEQ ID NO: 2709808 - protein, 23 aa, Entamoeba histolytica
DYLPYIKELCKVSIYGKISAAKL

SEQ ID NO: 2709809 - protein, 20 aa, Entamoeba histolytica
DYMFCWRSIALLFKRELNPQ

SEQ ID NO: 2709810 - protein, 24 aa, Entamoeba histolytica
DYMSDFIVMLYGSPGAYGVCTMPF

SEQ ID NO: 2709811 - protein, 38 aa, Entamoeba histolytica
DYNGLREMLFRCLSPSLPMSLLQIVVRSVIFASGTLSP

SEQ ID NO: 2709812 - protein, 18 aa, Entamoeba histolytica
DYNGYFMKGLFNVGMWER

SEQ ID NO: 2709813 - protein, 19 aa, Entamoeba histolytica
DYNIMVMEFLGPSLEDLFQ

SEQ ID NO: 2709814 - protein, 18 aa, Entamoeba histolytica
DYNIWYNRYSGFESKQTR

SEQ ID NO: 2709815 - protein, 17 aa, Entamoeba histolytica
DYPIIHFHCGHSYHKKC

SEQ ID NO: 2709816 - protein, 21 aa, Entamoeba histolytica
DYPIQVIFPKNGGELIFSDLF

SEQ ID NO: 2709817 - protein, 22 aa, Entamoeba histolytica
DYPMKPPFFFTDPSPDMVIVPQ

SEQ ID NO: 2709818 - protein, 32 aa, Entamoeba histolytica
DYPPKEVFFELQQLQKIFFPDFFMNHRHISQA

SEQ ID NO: 2709819 - protein, 17 aa, Entamoeba histolytica
DYPSYSLPPNSANNGKE

SEQ ID NO: 2709820 - protein, 28 aa, Entamoeba histolytica
DYQCFIKHWIIYIKDKEWFDVFQLKGYT

SEQ ID NO: 2709821 - protein, 35 aa, Entamoeba histolytica
DYQGLKQTLPHLTGSTIYAILSRFKSDNLNHQSID

SEQ ID NO: 2709822 - protein, 26 aa, Entamoeba histolytica
DYQKEFIKWCLKVPGYYPSWFVGIRQ

SEQ ID NO: 2709823 - protein, 26 aa, Entamoeba histolytica
DYQLNDFLDIIKTILGRLMIEKRRDE

SEQ ID NO: 2709824 - protein, 27 aa, Entamoeba histolytica
DYQQLSYIPQQRIIYVPMQQVIDPYTG

SEQ ID NO: 2709825 - protein, 28 aa, Entamoeba histolytica
DYQVSLQSIFIGLINRYAKIILKRRTVK

SEQ ID NO: 2709826 - protein, 20 aa, Entamoeba histolytica
DYRIEICKNLPPFMFEEDED

SEQ ID NO: 2709827 - protein, 19 aa, Entamoeba histolytica
DYRILYWKRILGIEEISQE

SEQ ID NO: 2709828 - protein, 21 aa, Entamoeba histolytica
DYSACIIGARLLRKWNNIIIA

SEQ ID NO: 2709829 - protein, 21 aa, Entamoeba histolytica
DYSFVGKILPYVLLSMNKHIE

SEQ ID NO: 2709830 - protein, 20 aa, Entamoeba histolytica
DYVCALKVIFKRQLQKCEMG

SEQ ID NO: 2709831 - protein, 37 aa, Entamoeba histolytica; identical to SEQ ID NO: 2521504

SEQ ID NO: 2709832 - protein, 19 aa, Entamoeba histolytica
DYVISVDKICDFTGSSKEV

SEQ ID NO: 2709833 - protein, 17 aa, Entamoeba histolytica
DYVLLDCCERMVYLTQK

SEQ ID NO: 2709834 - protein, 24 aa, Entamoeba histolytica
DYVMRKIKVLLQRYEKNLPFNKKV

SEQ ID NO: 2709835 - protein, 20 aa, Entamoeba histolytica
DYVPVTPFFIKQYELNLIGK

SEQ ID NO: 2709836 - protein, 20 aa, Entamoeba histolytica
DYVWIKFCRNLIRLEEIHVK

SEQ ID NO: 2709837 - protein, 21 aa, Entamoeba histolytica
DYYAFVQYNLHLQLKEASEYA

SEQ ID NO: 2709838 - protein, 17 aa, Entamoeba histolytica
DYYIYPPIDYNNIQIHK

SEQ ID NO: 2709839 - protein, 22 aa, Entamoeba histolytica
DYYPFDDLKVELLLDFYNDMND

SEQ ID NO: 2709840 - protein, 16 aa, Entamoeba histolytica
EVYIPFIAIGHCVKQI

SEQ ID NO: 2709841 - protein, 23 aa, Entamoeba histolytica
EAAIKFAPTFKIKIGKQGMYEEN

SEQ ID NO: 2709842 - protein, 24 aa, Entamoeba histolytica
EAAKSLIYYLRSEEDIKIFITQFV

SEQ ID NO: 2709843 - protein, 23 aa, Entamoeba histolytica
EAALLIRANWSIVNVIWETRIDE

SEQ ID NO: 2709844 - protein, 23 aa, Entamoeba histolytica
EADFVLWVRHPIESLEIFCKNND

SEQ ID NO: 2709845 - protein, 17 aa, Entamoeba histolytica
EADKRFLSWAQKNTRKC

SEQ ID NO: 2709846 - protein, 25 aa, Entamoeba histolytica
EADVYSFGIILWEIAHRLYPYEKNK

SEQ ID NO: 2709847 - protein, 25 aa, Entamoeba histolytica
EADVYWSFCWILQSIQSHYTYDQPG

SEQ ID NO: 2709848 - protein, 29 aa, Entamoeba histolytica
EAEGLLRQASMTWYLNNVKKFRDVWREQH

SEQ ID NO: 2709849 - protein, 25 aa, Entamoeba histolytica
EAEKYVKALFTLASKLSPCVIFVDE

SEQ ID NO: 2709850 - protein, 24 aa, Entamoeba histolytica
EAENAFELFLSTTEIKYVYYKESH

SEQ ID NO: 2709851 - protein, 24 aa, Entamoeba histolytica
EAENSIVIELRKLIRKSIERITVV

SEQ ID NO: 2709852 - protein, 20 aa, Entamoeba histolytica
EAEVVILVNLPLLQSISLPK

SEQ ID NO: 2709853 - protein, 22 aa, Entamoeba histolytica
EAFDVIGVPPFLYTKKSQKDNR

SEQ ID NO: 2709854 - protein, 20 aa, Entamoeba histolytica
EAFEIIPYTLAENAGLNPME

SEQ ID NO: 2709855 - protein, 21 aa, Entamoeba histolytica
EAFISLCQRLRKFAKPEMKVL

SEQ ID NO: 2709856 - protein, 19 aa, Entamoeba histolytica
EAFQMVPRVLAENAGLDAT

SEQ ID NO: 2709857 - protein, 30 aa, Entamoeba histolytica; identical to SEQ ID NO: 2521528

SEQ ID NO: 2709858 - protein, 34 aa, Entamoeba histolytica; identical to SEQ ID NO: 2521530

SEQ ID NO: 2709859 - protein, 21 aa, Entamoeba histolytica
EAGICEIQAVYYIYRVTKGND

SEQ ID NO: 2709860 - protein, 29 aa, Entamoeba histolytica
EAHCNGMIEILFDILQFASLVPEASQVIM

SEQ ID NO: 2709861 - protein, 36 aa, Entamoeba histolytica
EAHWNSYFNIPLLSPEYFLLQCFVYLNAQEFLEHIY

SEQ ID NO: 2709862 - protein, 32 aa, Entamoeba histolytica
EAIEHNKPLHFTSRYLYLTLWGDEVGNETQFK

SEQ ID NO: 2709863 - protein, 24 aa, Entamoeba histolytica
EAIELLDFRYPDPQIRGFALRCID

SEQ ID NO: 2709864 - protein, 19 aa, Entamoeba histolytica
EAIEMILKTNYFSGYSIVL

SEQ ID NO: 2709865 - protein, 27 aa, Entamoeba histolytica
EAIFPVLVTLFQKFIGLVPLSSRIFPQ

SEQ ID NO: 2709866 - protein, 29 aa, Entamoeba histolytica
EAIKEIEQLLILFSPQVFSLKTILEGLKE

SEQ ID NO: 2709867 - protein, 20 aa, Entamoeba histolytica
EAIKVIPAPELLYCVPERVV

SEQ ID NO: 2709868 - protein, 17 aa, Entamoeba histolytica
EAIVIVFNFTNAKPLYN

SEQ ID NO: 2709869 - protein, 25 aa, Entamoeba histolytica
EAIYSRIPSLSRTLLLTTPNGTELF

SEQ ID NO: 2709870 - protein, 25 aa, Entamoeba histolytica
EAKELFMVFVFLLNSNTSINGPQIA

SEQ ID NO: 2709871 - protein, 24 aa, Entamoeba histolytica
EAKIKQVFDAMNGKNVWEVIEAGK

SEQ ID NO: 2709872 - protein, 25 aa, Entamoeba histolytica
EAKKPTFIFIQKYPQKEVALEEYIT

SEQ ID NO: 2709873 - protein, 24 aa, Entamoeba histolytica
EAKVKQVFDAMNGKNVWEVIEAGK

SEQ ID NO: 2709874 - protein, 27 aa, Entamoeba histolytica
EALAQKYLIQIWSEAVGWMVHSHQYNI

SEQ ID NO: 2709875 - protein, 23 aa, Entamoeba histolytica
EALDLLVEAIAKAGYTGKIEIAM

SEQ ID NO: 2709876 - protein, 28 aa, Entamoeba histolytica
EALETWPVPMFENLLPRHLQICYEINSR

SEQ ID NO: 2709877 - protein, 22 aa, Entamoeba histolytica
EALIRQLRQQIYLLEQTHTNQL

SEQ ID NO: 2709878 - protein, 27 aa, Entamoeba histolytica
EALLCYCESLLCYGQLILRKEMTRVSI

SEQ ID NO: 2709879 - protein, 18 aa, Entamoeba histolytica
EALLIQLNELKRNLREAE

SEQ ID NO: 2709880 - protein, 18 aa, Entamoeba histolytica
EALLLGINIIDRLPETMN

SEQ ID NO: 2709881 - protein, 18 aa, Entamoeba histolytica
EALNLISLNFKFTTTLYF

SEQ ID NO: 2709882 - protein, 22 aa, Entamoeba histolytica
EALQFVFYCWQDTPGNVKQLLN

SEQ ID NO: 2709883 - protein, 21 aa, Entamoeba histolytica
EALQSKTLLPYPNPITPLVRL

SEQ ID NO: 2709884 - protein, 23 aa, Entamoeba histolytica
EALWTVLYVPLAKEKLYIPFGQN

SEQ ID NO: 2709885 - protein, 24 aa, Entamoeba histolytica
EAMERSVRWLARCKNEYLKTKEKQ

SEQ ID NO: 2709886 - protein, 27 aa, Entamoeba histolytica
EAMFILDHLKRYLFFRYKSVGFSVQKI

SEQ ID NO: 2709887 - protein, 30 aa, Entamoeba histolytica
EAMKKLPPSSMLFWVLHPTLNEPSKGIIMT

SEQ ID NO: 2709888 - protein, 21 aa, Entamoeba histolytica
EAMKLKLIKINGPNLIRIVDT

SEQ ID NO: 2709889 - protein, 24 aa, Entamoeba histolytica
EANQIIPKILKYTKEPWLSKHVIM

SEQ ID NO: 2709890 - protein, 18 aa, Entamoeba histolytica
EANYAKRLKSQTTTPLKI

SEQ ID NO: 2709891 - protein, 25 aa, Entamoeba histolytica
EAPIPLDFTNKCELDYLGVKNVLCG

SEQ ID NO: 2709892 - protein, 19 aa, Entamoeba histolytica
EAPPIPEHLSVNASQRNKE

SEQ ID NO: 2709893 - protein, 24 aa, Entamoeba histolytica
EAPPPVPAPRRGLMLGRRSSSISS

SEQ ID NO: 2709894 - protein, 25 aa, Entamoeba histolytica
EAQINNGLLYLLKTLGYSFDIKQTK

SEQ ID NO: 2709895 - protein, 33 aa, Entamoeba histolytica
EAQINNGLLYLLKTLGYSFGIKQTKRTKCTERL

SEQ ID NO: 2709896 - protein, 23 aa, Entamoeba histolytica
EAQKFLLEIMTNSSLSQLSQTIE

SEQ ID NO: 2709897 - protein, 22 aa, Entamoeba histolytica
EAQKGIIKMLRDKKFQTVHIEL

SEQ ID NO: 2709898 - protein, 33 aa, Entamoeba histolytica
EAQNLIFKLKDPNLFKMFLEKLQSIYDLHMQNI

SEQ ID NO: 2709899 - protein, 24 aa, Entamoeba histolytica
EAQQLLLNSHILAVGYDPLMSEIL

SEQ ID NO: 2709900 - protein, 25 aa, Entamoeba histolytica
EARACSRIFYHPTTALPFSLSGVSF

SEQ ID NO: 2709901 - protein, 20 aa, Entamoeba histolytica
EARGLYERFINKIKQITQKK

SEQ ID NO: 2709902 - protein, 19 aa, Entamoeba histolytica
EARQMIFDRFLQIKDVTKL

SEQ ID NO: 2709903 - protein, 22 aa, Entamoeba histolytica
EARSWWIMMQEDAKQMSASISK

SEQ ID NO: 2709904 - protein, 47 aa, Entamoeba histolytica
EARVSILAFQFFKQVYKLFEKCPYYEKYFFLFLRCLKSFGRLESVEE

SEQ ID NO: 2709905 - protein, 24 aa, Entamoeba histolytica
EASEKLPKLPTSQQKERIKNAKKQ

SEQ ID NO: 2709906 - protein, 18 aa, Entamoeba histolytica
EASFSNAYLFFLLSECGA

SEQ ID NO: 2709907 - protein, 33 aa, Entamoeba histolytica
EASKHVLETLIFLRFILPPLAQTPQLLKKLQSL

SEQ ID NO: 2709908 - protein, 26 aa, Entamoeba histolytica
EASQLKLRMIKLEKKNDKIIQMLDQK

SEQ ID NO: 2709909 - protein, 22 aa, Entamoeba histolytica
EATENIFTKNFFKSLSAVTTAL

SEQ ID NO: 2709910 - protein, 17 aa, Entamoeba histolytica
EATGWKRGKGLGKNEDG

SEQ ID NO: 2709911 - protein, 26 aa, Entamoeba histolytica
EATIYWLQRLIEMGENPKYIVRRMIK

SEQ ID NO: 2709912 - protein, 23 aa, Entamoeba histolytica
EATKLFILSNPLHADNCPSVRKM

SEQ ID NO: 2709913 - protein, 27 aa, Entamoeba histolytica
EATLADGYLYILIREFGFSAKLKQTKH

SEQ ID NO: 2709914 - protein, 21 aa, Entamoeba histolytica
EAVGLFLTYNPIVKEILNLSE

SEQ ID NO: 2709915 - protein, 30 aa, Entamoeba histolytica; identical to SEQ ID NO: 2521586

SEQ ID NO: 2709916 - protein, 19 aa, Entamoeba histolytica
EAVMFPFGFHCTGMPIKAC

SEQ ID NO: 2709917 - protein, 29 aa, Entamoeba histolytica
EAVQQAVLIALLNYLGYSIEIKHPERLAA

SEQ ID NO: 2709918 - protein, 24 aa, Entamoeba histolytica
EAVTPLLIKMFLKYQLKCSSIQEA

SEQ ID NO: 2709919 - protein, 23 aa, Entamoeba histolytica
EAVVAFILRNYPQIRLVDVSTEL

SEQ ID NO: 2709920 - protein, 17 aa, Entamoeba histolytica
EAYFTPFMFIQQNYKQP

SEQ ID NO: 2709921 - protein, 17 aa, Entamoeba histolytica
EAYLNEMLYPVEVAGQR

SEQ ID NO: 2709922 - protein, 19 aa, Entamoeba histolytica
EAYLYLLHHLNNNCSLEAL

SEQ ID NO: 2709923 - protein, 27 aa, Entamoeba histolytica
EAYQQGVMIYLLVKSGFEVRVKRLDKS

SEQ ID NO: 2709924 - protein, 17 aa, Entamoeba histolytica
EAYSVIKYSFVFEFFIK

SEQ ID NO: 2709925 - protein, 22 aa, Entamoeba histolytica
EAYSYYLLQGFVGLLPDWMESI

SEQ ID NO: 2709926 - protein, 20 aa, Entamoeba histolytica
ECAYGYYLDSTYECNKYMNG

SEQ ID NO: 2709927 - protein, 27 aa, Entamoeba histolytica
ECDIWSIGIILYIILSGTHPFSMEDEN

SEQ ID NO: 2709928 - protein, 17 aa, Entamoeba histolytica
ECEGISCNEAMGALYLF

SEQ ID NO: 2709929 - protein, 17 aa, Entamoeba histolytica
ECFQFAFRWFNCFLLRE

SEQ ID NO: 2709930 - protein, 17 aa, Entamoeba histolytica
ECFSFYSILTPINIPNI

SEQ ID NO: 2709931 - protein, 27 aa, Entamoeba histolytica
ECFVCSVCKAPFPRGQFYNLDGKPVCA

SEQ ID NO: 2709932 - protein, 31 aa, Entamoeba histolytica; identical to SEQ ID NO: 2521610

SEQ ID NO: 2709933 - protein, 24 aa, Entamoeba histolytica
ECGFNPYLVELLKTLFESFPQTKK

SEQ ID NO: 2709934 - protein, 27 aa, Entamoeba histolytica
ECGKLEPEWISLNLGIVICLECCGAHR

SEQ ID NO: 2709935 - protein, 23 aa, Entamoeba histolytica
ECILIDGIFGMCLCFSSEGIDII

SEQ ID NO: 2709936 - protein, 18 aa, Entamoeba histolytica
ECINTLSAIALNDKITGS

SEQ ID NO: 2709937 - protein, 23 aa, Entamoeba histolytica
ECLRVYVSSFWDQPFKDTLFTSL

SEQ ID NO: 2709938 - protein, 17 aa, Entamoeba histolytica
ECMKIIKTIIIKSFNYI

SEQ ID NO: 2709939 - protein, 24 aa, Entamoeba histolytica
ECNCKYFITRINDSSLPRPSLGML

SEQ ID NO: 2709940 - protein, 28 aa, Entamoeba histolytica
ECPAPEQLPLKLGALVMLLKNTQPEIGL

SEQ ID NO: 2709941 - protein, 18 aa, Entamoeba histolytica
ECPFRINLNYRTKTRTWN

SEQ ID NO: 2709942 - protein, 22 aa, Entamoeba histolytica
ECQVISLHLPLTKETKGKIGYE

SEQ ID NO: 2709943 - protein, 41 aa, Entamoeba histolytica
ECSFNPISTIIFLPLVNLQSFVMQFCHLTQLPFSLEQASKL

SEQ ID NO: 2709944 - protein, 27 aa, Entamoeba histolytica
ECSLTFIDYSPFCRIHMFDGIIDSKNS

SEQ ID NO: 2709945 - protein, 17 aa, Entamoeba histolytica
ECSSDWYVELFVDYVRN

SEQ ID NO: 2709946 - protein, 18 aa, Entamoeba histolytica
ECSSLDDFNKWTVTLAPL

SEQ ID NO: 2709947 - protein, 36 aa, Entamoeba histolytica; identical to SEQ ID NO: 2521638

SEQ ID NO: 2709948 - protein, 17 aa, Entamoeba histolytica
ECTSSISRFGKLINHTI

SEQ ID NO: 2709949 - protein, 23 aa, Entamoeba histolytica
ECVDYNLRWLTKELEIELDDITL

SEQ ID NO: 2709950 - protein, 29 aa, Entamoeba histolytica
ECYGKILAIVIRWVMYRYGKTIETCENDV

SEQ ID NO: 2709951 - protein, 26 aa, Entamoeba histolytica
ECYQIGFMIYLMVKNKREVVIQRLEK

SEQ ID NO: 2709952 - protein, 25 aa, Entamoeba histolytica
EDAKNDPLLLYPKQSTKTKPTSIAS

SEQ ID NO: 2709953 - protein, 21 aa, Entamoeba histolytica
EDALKYYFKSITIIGYIDAEM

SEQ ID NO: 2709954 - protein, 28 aa, Entamoeba histolytica
EDAQKKFPFIPLILKYIEAMTFYSNDFS

SEQ ID NO: 2709955 - protein, 26 aa, Entamoeba histolytica
EDATNFPFNLTLNAPFDSYLSNNIQI

SEQ ID NO: 2709956 - protein, 28 aa, Entamoeba histolytica
EDCFEYINELWILLVDTIAISFKDLIIS

SEQ ID NO: 2709957 - protein, 23 aa, Entamoeba histolytica
EDCTTLRLIIIPTSVSELGEYCF

SEQ ID NO: 2709958 - protein, 28 aa, Entamoeba histolytica
EDCVNAHQPFLQLVARPNKSKKSTPSTP

SEQ ID NO: 2709959 - protein, 19 aa, Entamoeba histolytica
EDCYIYLYIHGEHSYFQYT

SEQ ID NO: 2709960 - protein, 22 aa, Entamoeba histolytica
EDDLKCYLRKESDKKILLATCD

SEQ ID NO: 2709961 - protein, 19 aa, Entamoeba histolytica
EDDNEFYNKIFTCFFKEQC

SEQ ID NO: 2709962 - protein, 23 aa, Entamoeba histolytica
EDDQPLFLKGYYKSCIEVNYILP

SEQ ID NO: 2709963 - protein, 22 aa, Entamoeba histolytica
EDEAMLFLMKVFPLSCFNEVLA

SEQ ID NO: 2709964 - protein, 25 aa, Entamoeba histolytica
EDEDDLFIFYQLLDLGCEVTGQTTR

SEQ ID NO: 2709965 - protein, 29 aa, Entamoeba histolytica
EDEDSLDLMLNDEEFWDNIKRGFKNTVDK

SEQ ID NO: 2709966 - protein, 23 aa, Entamoeba histolytica
EDEEFLCPAPTIEKPRTISKPMR

SEQ ID NO: 2709967 - protein, 34 aa, Entamoeba histolytica
EDEFQQFNFSGLFMLLYEFLSNLSPKQLDILSFS

SEQ ID NO: 2709968 - protein, 23 aa, Entamoeba histolytica
EDEIRLFPLISPKLKNKEIIVKQ

SEQ ID NO: 2709969 - protein, 24 aa, Entamoeba histolytica
EDEKQYYYLKAMNGYLSLITSSSE

SEQ ID NO: 2709970 - protein, 26 aa, Entamoeba histolytica
EDELNLKISYLLQQTKKLNQIAITEA

SEQ ID NO: 2709971 - protein, 27 aa, Entamoeba histolytica
EDELRTVLMIAPWFPHKSIQQISLRMK

SEQ ID NO: 2709972 - protein, 26 aa, Entamoeba histolytica
EDEMIQLIVQAMKKLHDPLEEKYITK

SEQ ID NO: 2709973 - protein, 24 aa, Entamoeba histolytica
EDEREYWKALLRVCILNSIDNFGY

SEQ ID NO: 2709974 - protein, 28 aa, Entamoeba histolytica
EDESIIQLILLILFKASNEINLIKIHGW

SEQ ID NO: 2709975 - protein, 17 aa, Entamoeba histolytica
EDEVITALRNILSDRRK

SEQ ID NO: 2709976 - protein, 21 aa, Entamoeba histolytica
EDFIAIGRYNGVSTIPIPGSG

SEQ ID NO: 2709977 - protein, 24 aa, Entamoeba histolytica
EDFPYYEHFFYRNNSVKHYFDKTN

SEQ ID NO: 2709978 - protein, 26 aa, Entamoeba histolytica
EDFVPKAIMHFLINQTCKDLQKALVE

SEQ ID NO: 2709979 - protein, 18 aa, Entamoeba histolytica
EDGEYWKDSFRKLINQVR

SEQ ID NO: 2709980 - protein, 25 aa, Entamoeba histolytica
EDGFKLHYFMQNIDLPPCITVFSAP

SEQ ID NO: 2709981 - protein, 33 aa, Entamoeba histolytica
EDGQTIIWDLINGLHPILFFTRDDYHDKDLRSL

SEQ ID NO: 2709982 - protein, 26 aa, Entamoeba histolytica
EDGRIFKQIIWYKVSYSRYLEEKKEG

SEQ ID NO: 2709983 - protein, 27 aa, Entamoeba histolytica
EDGRIFKQIIWYKVSYSRYLEEKKEMN

SEQ ID NO: 2709984 - protein, 26 aa, Entamoeba histolytica
EDGRIIKYVIWYKVNYSRYLKEKKEK

SEQ ID NO: 2709985 - protein, 26 aa, Entamoeba histolytica
EDGRIIKYVIWYKVSYSRYLKEKEEG

SEQ ID NO: 2709986 - protein, 26 aa, Entamoeba histolytica
EDGRIIKYVIWYKVSYSRYLKEKEEM

SEQ ID NO: 2709987 - protein, 26 aa, Entamoeba histolytica
EDHDQIYYLMIKLEYSRLIIKIRTIA

SEQ ID NO: 2709988 - protein, 24 aa, Entamoeba histolytica
EDHGMSYVFLLKKIQEIRMKENMK

SEQ ID NO: 2709989 - protein, 19 aa, Entamoeba histolytica
EDHLIPFISGKWGCGVFGG

SEQ ID NO: 2709990 - protein, 22 aa, Entamoeba histolytica
EDIATIKFYRKDAGSLMAPMDA

SEQ ID NO: 2709991 - protein, 26 aa, Entamoeba histolytica
EDIDAAHQLFILWESRKIHVKFLQMW

SEQ ID NO: 2709992 - protein, 21 aa, Entamoeba histolytica
EDIFKQMFWELSMKSFDDFIT

SEQ ID NO: 2709993 - protein, 17 aa, Entamoeba histolytica
EDIITHLHFPILSEEQK

SEQ ID NO: 2709994 - protein, 22 aa, Entamoeba histolytica
EDIPILIELPSSLCIRLMDEND

SEQ ID NO: 2709995 - protein, 30 aa, Entamoeba histolytica; identical to SEQ ID NO: 2521685

SEQ ID NO: 2709996 - protein, 24 aa, Entamoeba histolytica
EDIQLLIQLFKFDQPYIVSKIQLS

SEQ ID NO: 2709997 - protein, 32 aa, Entamoeba histolytica
EDKISQIEISQVKLLINKFSQNQNISEGDSFT

SEQ ID NO: 2709998 - protein, 23 aa, Entamoeba histolytica
EDKITTKILKYKGIPVAGKQLLV

SEQ ID NO: 2709999 - protein, 23 aa, Entamoeba histolytica
EDKMVMLRLRELGEPIMLFGEEF

SEQ ID NO: 2710000 - protein, 24 aa, Entamoeba histolytica
EDKNPLYYHYIELLAANCLTKMNS

SEQ ID NO: 2710001 - protein, 17 aa, Entamoeba histolytica
EDKNYFNSLIPLGVNII

SEQ ID NO: 2710002 - protein, 35 aa, Entamoeba histolytica
EDKQYFTVLQRLLYTRVFKYIWPPSINTIEKMNLK

SEQ ID NO: 2710003 - protein, 19 aa, Entamoeba histolytica
EDKRIKTFSLEKALNGIKI

SEQ ID NO: 2710004 - protein, 24 aa, Entamoeba histolytica
EDKTIYNDIIKLPKTLYQEYENLC

SEQ ID NO: 2710005 - protein, 24 aa, Entamoeba histolytica
EDLDPRKVLSIFRSLIREDIETMD

SEQ ID NO: 2710006 - protein, 17 aa, Entamoeba histolytica
EDLIRRRIKEQSWDDVV

SEQ ID NO: 2710007 - protein, 24 aa, Entamoeba histolytica
EDLLFRVHVKLLLGDSVIGSIYSH

SEQ ID NO: 2710008 - protein, 18 aa, Entamoeba histolytica
EDLLVSMQPMMSAMGTMQ

SEQ ID NO: 2710009 - protein, 18 aa, Entamoeba histolytica
EDLWKNLIIISIDIKDYR

SEQ ID NO: 2710010 - protein, 28 aa, Entamoeba histolytica
EDMAPRIYSILNNKPLLFELCGISAMGN

SEQ ID NO: 2710011 - protein, 19 aa, Entamoeba histolytica
EDMLFRIKFDLYNPQREKI

SEQ ID NO: 2710012 - protein, 20 aa, Entamoeba histolytica
EDMPLTICFLGDNKTPALSV

SEQ ID NO: 2710013 - protein, 29 aa, Entamoeba histolytica
EDNEKFNFHLRQILAGLRKNKKLVDNLCS

SEQ ID NO: 2710014 - protein, 35 aa, Entamoeba histolytica
EDNELDIKLPTNQKFYILLWRTFGLTEYCLDSNGF

SEQ ID NO: 2710015 - protein, 21 aa, Entamoeba histolytica
EDNFLTFRAVVVNSLCSFMMV

SEQ ID NO: 2710016 - protein, 29 aa, Entamoeba histolytica
EDNLTAIDLIPIFFTLQSNNYFTKVTVEN

SEQ ID NO: 2710017 - protein, 22 aa, Entamoeba histolytica
EDNQLIPDLELLEALRLENGNF

SEQ ID NO: 2710018 - protein, 23 aa, Entamoeba histolytica
EDNVIWMLVGCKSDLQTNVEETK

SEQ ID NO: 2710019 - protein, 29 aa, Entamoeba histolytica
EDNYLIEYTIDDPPLPLYCNCWMEEDNLL

SEQ ID NO: 2710020 - protein, 21 aa, Entamoeba histolytica
EDPILLLNKTPIQTMHYGEIH

SEQ ID NO: 2710021 - protein, 22 aa, Entamoeba histolytica
EDPMVAYRRRQAERQAEREKAR

SEQ ID NO: 2710022 - protein, 22 aa, Entamoeba histolytica
EDPYDILLIVACWRAEKRHHWI

SEQ ID NO: 2710023 - protein, 29 aa, Entamoeba histolytica
EDQQNVLLVPQRLFVQPTLVSPMGIQKES

SEQ ID NO: 2710024 - protein, 18 aa, Entamoeba histolytica
EDQWYYDNKINFWRNVYG

SEQ ID NO: 2710025 - protein, 29 aa, Entamoeba histolytica
EDRCYIGNILFGILIYLLDEFDKIKDVHY

SEQ ID NO: 2710026 - protein, 17 aa, Entamoeba histolytica
EDRFTQYFLPKKIFNTD

SEQ ID NO: 2710027 - protein, 20 aa, Entamoeba histolytica
EDRIILFGYEHGCGPALQYA

SEQ ID NO: 2710028 - protein, 23 aa, Entamoeba histolytica
EDRYLPMNMLFSGKNHLPNLPLF

SEQ ID NO: 2710029 - protein, 23 aa, Entamoeba histolytica
EDSIDIIKLLRNKKIKELNKGIQ

SEQ ID NO: 2710030 - protein, 22 aa, Entamoeba histolytica
EDSLLTFVQYPPQFGARMVRCS

SEQ ID NO: 2710031 - protein, 17 aa, Entamoeba histolytica
EDSPLEAFSIFIGSSNK

SEQ ID NO: 2710032 - protein, 35 aa, Entamoeba histolytica
EDSVGELFLKFSPFFIVYRNFLINHNKAFTLLTKL

SEQ ID NO: 2710033 - protein, 25 aa, Entamoeba histolytica
EDTIDLHGLQIEGAIIMMKEEIEKR

SEQ ID NO: 2710034 - protein, 23 aa, Entamoeba histolytica
EDTIEMLTIEKQCLQKRVEYLEK

SEQ ID NO: 2710035 - protein, 25 aa, Entamoeba histolytica
EDTIVLYVISLLDPSIRYSIKCKKM

SEQ ID NO: 2710036 - protein, 20 aa, Entamoeba histolytica
EDTLYILRGIREKYENHYGL

SEQ ID NO: 2710037 - protein, 24 aa, Entamoeba histolytica
EDTPSLIQYTIYPKIKYTLIKREQ

SEQ ID NO: 2710038 - protein, 22 aa, Entamoeba histolytica
EDTRAFFLELYDSLLKDEKVVQ

SEQ ID NO: 2710039 - protein, 24 aa, Entamoeba histolytica
EDTTPITPLISIEPIIEELNYTMN

SEQ ID NO: 2710040 - protein, 22 aa, Entamoeba histolytica
EDTYKNLKFFLDVVSQRKTTLI

SEQ ID NO: 2710041 - protein, 24 aa, Entamoeba histolytica
EDVASFALRCEGHYLNVLKDMKDL

SEQ ID NO: 2710042 - protein, 20 aa, Entamoeba histolytica
EDVFRHLWLNNDVFASLCEV

SEQ ID NO: 2710043 - protein, 22 aa, Entamoeba histolytica
EDVGKRFEAYNWNVLKCNGDNV

SEQ ID NO: 2710044 - protein, 23 aa, Entamoeba histolytica
EDVGKRFEAYNWNVLKCNGDNVN

SEQ ID NO: 2710045 - protein, 21 aa, Entamoeba histolytica
EDVLFNVCKLCKILMTDSDSD

SEQ ID NO: 2710046 - protein, 21 aa, Entamoeba histolytica
EDVLHTFIIPPIYKENAYEPK

SEQ ID NO: 2710047 - protein, 24 aa, Entamoeba histolytica
EDVVKLFKQLYKLMLERHSHFFKK

SEQ ID NO: 2710048 - protein, 27 aa, Entamoeba histolytica
EDYDRLRPLSYPSTDVFLVCFSVIAPA

SEQ ID NO: 2710049 - protein, 19 aa, Entamoeba histolytica
EDYEFAPFSYQKEINYLFI

SEQ ID NO: 2710050 - protein, 25 aa, Entamoeba histolytica
EDYEWNFPMALVTGIYIPPLTMEIG

SEQ ID NO: 2710051 - protein, 17 aa, Entamoeba histolytica
EDYKYIVLGCDGLWDTL

SEQ ID NO: 2710052 - protein, 17 aa, Entamoeba histolytica
EDYTPLDILTLDRVPPT

SEQ ID NO: 2710053 - protein, 23 aa, Entamoeba histolytica
EEADILCCTLNTSGSDIFLNCIK

SEQ ID NO: 2710054 - protein, 18 aa, Entamoeba histolytica
EEAKGFIELPPGTETKDV

SEQ ID NO: 2710055 - protein, 17 aa, Entamoeba histolytica
EEALPIHDMFQALLTLI

SEQ ID NO: 2710056 - protein, 24 aa, Entamoeba histolytica
EEALPIHDMFQALLTLINEVIPAA

SEQ ID NO: 2710057 - protein, 24 aa, Entamoeba histolytica
EEANKYQYYWIKYGIEGDAPKCIK

SEQ ID NO: 2710058 - protein, 18 aa, Entamoeba histolytica
EEASLFAFCVALLSQYFK

SEQ ID NO: 2710059 - protein, 32 aa, Entamoeba histolytica
EECDERLALLNLFLPEPVLSTSIIILNKFGVV

SEQ ID NO: 2710060 - protein, 24 aa, Entamoeba histolytica
EECKDIIILLSQFIGASGKIESIG

SEQ ID NO: 2710061 - protein, 27 aa, Entamoeba histolytica
EECMTFPFFCLLKIKITEHNGVCYTFY

SEQ ID NO: 2710062 - protein, 32 aa, Entamoeba histolytica
EECQRMAFLIGLLNYRGVGFIIAKRPKKAEKA

SEQ ID NO: 2710063 - protein, 25 aa, Entamoeba histolytica
EECQVISLHLPLTKETKGKIGYELI

SEQ ID NO: 2710064 - protein, 26 aa, Entamoeba histolytica
EECVFQYNCYGLYFAHCMALPQYKDV

SEQ ID NO: 2710065 - protein, 24 aa, Entamoeba histolytica
EEDALLCFRIISNKIYILKFDNCE

SEQ ID NO: 2710066 - protein, 27 aa, Entamoeba histolytica
EEDDKFVFLRKPRFIIQSLLRPYIQKC

SEQ ID NO: 2710067 - protein, 26 aa, Entamoeba histolytica
EEDHQNIIFKKFLLGDKKFPQNLVGR

SEQ ID NO: 2710068 - protein, 17 aa, Entamoeba histolytica
EEDLLWSAFEETLTEEA

SEQ ID NO: 2710069 - protein, 23 aa, Entamoeba histolytica
EEDMMQWACWFHNAGTEIDLPTP

SEQ ID NO: 2710070 - protein, 23 aa, Entamoeba histolytica
EEDRKILIAYRKYWFEGNIEQND

SEQ ID NO: 2710071 - protein, 24 aa, Entamoeba histolytica
EEDRKLLDAVNKFGKSRWVEIAEF

SEQ ID NO: 2710072 - protein, 23 aa, Entamoeba histolytica
EEDSQREIFQPKVVRRKDRVSED

SEQ ID NO: 2710073 - protein, 20 aa, Entamoeba histolytica
EEDVEKIVGWAFAHEIEKRP

SEQ ID NO: 2710074 - protein, 26 aa, Entamoeba histolytica
EEEDALLCFRIISNKIYILKFDNCED

SEQ ID NO: 2710075 - protein, 37 aa, Entamoeba histolytica
EEEDRFGKFCLWFSYVCDFLMIYENYIYNLPLAQKVI

SEQ ID NO: 2710076 - protein, 28 aa, Entamoeba histolytica
EEEEERAFMEKALRLNPNADPEKLQQMR

SEQ ID NO: 2710077 - protein, 28 aa, Entamoeba histolytica
EEEEKSEEVIPFRLPPELVQVSVQQEKP

SEQ ID NO: 2710078 - protein, 24 aa, Entamoeba histolytica
EEEFKYFKECIINVGLTYDDIKDL

SEQ ID NO: 2710079 - protein, 28 aa, Entamoeba histolytica
EEEIDQIFRLIYSDSIELMIDLFGNYVI

SEQ ID NO: 2710080 - protein, 28 aa, Entamoeba histolytica
EEEIKWFMDKWYFFYFVSIDAEDNGCPR

SEQ ID NO: 2710081 - protein, 27 aa, Entamoeba histolytica
EEEKGIYALFVDILQNLSQQYSDCIEQ

SEQ ID NO: 2710082 - protein, 25 aa, Entamoeba histolytica
EEEKNPVIVIAYLELPRYDKKQNKE

SEQ ID NO: 2710083 - protein, 23 aa, Entamoeba histolytica
EEELFFMEGLAHSYIFSTSLPRW

SEQ ID NO: 2710084 - protein, 18 aa, Entamoeba histolytica
EEELILEKPSIYKDPFEL

SEQ ID NO: 2710085 - protein, 23 aa, Entamoeba histolytica
EEEMFFTEMLGLTLVFAQALPRL

SEQ ID NO: 2710086 - protein, 29 aa, Entamoeba histolytica
EEENSYELCIIFILINEGFPENIVREAIK

SEQ ID NO: 2710087 - protein, 30 aa, Entamoeba histolytica
EEEQKKWNRLKIQFWDSIIYRNEEEKRRNN

SEQ ID NO: 2710088 - protein, 28 aa, Entamoeba histolytica
EEEQQIRSELMGFFNHLTKSKEMKKALN

SEQ ID NO: 2710089 - protein, 29 aa, Entamoeba histolytica
EEERMTIARPIMSSLLVCYTKYLNSVSKG

SEQ ID NO: 2710090 - protein, 26 aa, Entamoeba histolytica
EEERNKYLNYIGIDKFKILASENITS

SEQ ID NO: 2710091 - protein, 17 aa, Entamoeba histolytica
EEETIAIDPWKLALKRK

SEQ ID NO: 2710092 - protein, 24 aa, Entamoeba histolytica
EEEWSYIPSFLKTKPPKPKDQIDV

SEQ ID NO: 2710093 - protein, 27 aa, Entamoeba histolytica
EEEWYNWNNIWRIMKQKPNNKILQLFD

SEQ ID NO: 2710094 - protein, 24 aa, Entamoeba histolytica
EEEYHEFISKYPLILDANGKIQCT

SEQ ID NO: 2710095 - protein, 17 aa, Entamoeba histolytica
EEFDIENAFLWADPQIK

SEQ ID NO: 2710096 - protein, 27 aa, Entamoeba histolytica
EEFDIPKLLKCKKCGGLLTQACFMRCC

SEQ ID NO: 2710097 - protein, 19 aa, Entamoeba histolytica
EEFIIPHYTSILNLLKMPQ

SEQ ID NO: 2710098 - protein, 35 aa, Entamoeba histolytica
EEFIKKIMFEILTALLYLHSIGIIHRDLKPENIMI

SEQ ID NO: 2710099 - protein, 22 aa, Entamoeba histolytica
EEFKCIKCKSGYYLNSNNKCQE

SEQ ID NO: 2710100 - protein, 23 aa, Entamoeba histolytica
EEFLHLFYCYSIHTQKDFFKIQV

SEQ ID NO: 2710101 - protein, 17 aa, Entamoeba histolytica
EEFLVLDAKIVLDKNMI

SEQ ID NO: 2710102 - protein, 22 aa, Entamoeba histolytica
EEFRLFNLIKKEGTPKAEVEHL

SEQ ID NO: 2710103 - protein, 27 aa, Entamoeba histolytica
EEGFEIPIPLFYEIKKEKVLLPSIGNY

SEQ ID NO: 2710104 - protein, 26 aa, Entamoeba histolytica
EEGIVFPLRHETLSSGLTISSILPPE

SEQ ID NO: 2710105 - protein, 18 aa, Entamoeba histolytica
EEGIWSDQIPLNIYDHSL

SEQ ID NO: 2710106 - protein, 24 aa, Entamoeba histolytica
EEGLSILDRFFNDNSDWGRAMTSA

SEQ ID NO: 2710107 - protein, 29 aa, Entamoeba histolytica
EEGVFKGKLLLVWKWTPSVILNIECKEES

SEQ ID NO: 2710108 - protein, 23 aa, Entamoeba histolytica
EEGYVWVVMEFMDSGCLTEVLTE

SEQ ID NO: 2710109 - protein, 25 aa, Entamoeba histolytica
EEHFVYIVNMLTPDFVISVMEKVLE

SEQ ID NO: 2710110 - protein, 29 aa, Entamoeba histolytica
EEHGLKLIGFWDFHQFYREWIKFQEYNEL

SEQ ID NO: 2710111 - protein, 18 aa, Entamoeba histolytica
EEIDPLTPLLKLSEKEVL

SEQ ID NO: 2710112 - protein, 17 aa, Entamoeba histolytica
EEIDSFRMLNLNQIAYV

SEQ ID NO: 2710113 - protein, 19 aa, Entamoeba histolytica
EEIEILRAYELYNQHLLLS

SEQ ID NO: 2710114 - protein, 24 aa, Entamoeba histolytica
EEIFPLHNLEPYKEKFRKCKCAKI

SEQ ID NO: 2710115 - protein, 23 aa, Entamoeba histolytica
EEIHLLMDILTEYGYYFTAHPMK

SEQ ID NO: 2710116 - protein, 20 aa, Entamoeba histolytica
EEIKAKYIKQKVLLGKCRVA

SEQ ID NO: 2710117 - protein, 18 aa, Entamoeba histolytica
EEIKFLKPFTLLPTSRVS

SEQ ID NO: 2710118 - protein, 26 aa, Entamoeba histolytica
EEIKKAYRKLALKLHPDKLIDVDPEE

SEQ ID NO: 2710119 - protein, 25 aa, Entamoeba histolytica
EEIKLSFEIVFDKEYYFICKDKCEY

SEQ ID NO: 2710120 - protein, 23 aa, Entamoeba histolytica
EEIKSFDFFLKLDEDIPLELMRI

SEQ ID NO: 2710121 - protein, 22 aa, Entamoeba histolytica
EEILFIKRMIVSEVIAETIALE

SEQ ID NO: 2710122 - protein, 24 aa, Entamoeba histolytica
EEILKLYTGIMKYGADFGLIELMF

SEQ ID NO: 2710123 - protein, 20 aa, Entamoeba histolytica
EEILSLLERLVYLGNAEVSV

SEQ ID NO: 2710124 - protein, 20 aa, Entamoeba histolytica
EEILYITDFKLKGCPVSAIL

SEQ ID NO: 2710125 - protein, 18 aa, Entamoeba histolytica
EEINLIHPPIGSGTFGIV

SEQ ID NO: 2710126 - protein, 32 aa, Entamoeba histolytica
EEINSIDQIYRNLICKILIRNVGKNELPNEYT

SEQ ID NO: 2710127 - protein, 17 aa, Entamoeba histolytica
EEIPTQEFELIKKKQIE

SEQ ID NO: 2710128 - protein, 24 aa, Entamoeba histolytica
EEIRPISIKLLQKIQLMFTEQRDQ

SEQ ID NO: 2710129 - protein, 27 aa, Entamoeba histolytica
EEKGVFQCIVFWQRDLFEIYGFEEKDQ

SEQ ID NO: 2710130 - protein, 32 aa, Entamoeba histolytica
EEKIIKKGKKEGMYYYYTGNEEEIRKEIIEIM

SEQ ID NO: 2710131 - protein, 19 aa, Entamoeba histolytica
EEKILLSAKKKLVLDHLII

SEQ ID NO: 2710132 - protein, 17 aa, Entamoeba histolytica
EEKKFFRGRKKMTSFWR

SEQ ID NO: 2710133 - protein, 34 aa, Entamoeba histolytica
EEKKKVLIMFVNYYIYFFPLLDQITADQITQIIT

SEQ ID NO: 2710134 - protein, 23 aa, Entamoeba histolytica
EEKLRKLRRRIQNRWSSKMCRDK

SEQ ID NO: 2710135 - protein, 18 aa, Entamoeba histolytica
EEKLTKLTLIFVTDMLIF

SEQ ID NO: 2710136 - protein, 26 aa, Entamoeba histolytica
EEKNEWNMCFLFNDLFVVSKAIVIGA

SEQ ID NO: 2710137 - protein, 21 aa, Entamoeba histolytica
EEKNRIITIIEKVPDLVTENK

SEQ ID NO: 2710138 - protein, 23 aa, Entamoeba histolytica
EEKVQIIYQYCQGKYGRFKEIYS

SEQ ID NO: 2710139 - protein, 20 aa, Entamoeba histolytica
EELAYPLLDSLLKDRTEPLG

SEQ ID NO: 2710140 - protein, 28 aa, Entamoeba histolytica
EELFFMEMLGQCFIISSAIPRLEQFRVN

SEQ ID NO: 2710141 - protein, 19 aa, Entamoeba histolytica
EELFQYVKKYQKIASINIL

SEQ ID NO: 2710142 - protein, 17 aa, Entamoeba histolytica
EELFYKNCYYNPPEYLK

SEQ ID NO: 2710143 - protein, 20 aa, Entamoeba histolytica
EELILATCPWKEIEQDGKVV

SEQ ID NO: 2710144 - protein, 17 aa, Entamoeba histolytica
EELLHLERKAIKLAKEI

SEQ ID NO: 2710145 - protein, 19 aa, Entamoeba histolytica
EELLKSFIPLGNGAFQPIY

SEQ ID NO: 2710146 - protein, 20 aa, Entamoeba histolytica
EELLQLPHFILKNKEQRKSE

SEQ ID NO: 2710147 - protein, 25 aa, Entamoeba histolytica
EELLRHMFEPLFDATLNPEKHPELV

SEQ ID NO: 2710148 - protein, 43 aa, Entamoeba histolytica
EELMKDHFYHRLMFLHIQNKCISILNPTFIQYGYTTNVAIEQL

SEQ ID NO: 2710149 - protein, 18 aa, Entamoeba histolytica
EELNKILSQSFVIVAEIQ

SEQ ID NO: 2710150 - protein, 22 aa, Entamoeba histolytica
EELPPHALSFILAYANHWNTEE

SEQ ID NO: 2710151 - protein, 21 aa, Entamoeba histolytica
EELQFEKLRYQLEINKYNIPE

SEQ ID NO: 2710152 - protein, 19 aa, Entamoeba histolytica
EELSKFTLLSCVLFSLIVQ

SEQ ID NO: 2710153 - protein, 25 aa, Entamoeba histolytica
EELSYLETFTISGLPELPAGAVRFE

SEQ ID NO: 2710154 - protein, 27 aa, Entamoeba histolytica
EELTQLLLCLYQRIQIIIPTILQCHET

SEQ ID NO: 2710155 - protein, 17 aa, Entamoeba histolytica
EELYRRCTIHYRESSII

SEQ ID NO: 2710156 - protein, 24 aa, Entamoeba histolytica
EEMADLIKIWPGISPIQVIGLLDV

SEQ ID NO: 2710157 - protein, 24 aa, Entamoeba histolytica
EEMDLMLAFLIRDFGKLLVNESNC

SEQ ID NO: 2710158 - protein, 26 aa, Entamoeba histolytica
EEMEESLFWELLVMLSEMKECGCFEE

SEQ ID NO: 2710159 - protein, 21 aa, Entamoeba histolytica
EEMEQFILQAQHEVKKKIYQE

SEQ ID NO: 2710160 - protein, 24 aa, Entamoeba histolytica
EEMEQFILQAQHEVKKKIYQENEM

SEQ ID NO: 2710161 - protein, 24 aa, Entamoeba histolytica
EEMGLLFNELFPGFGFEKKKTGIN

SEQ ID NO: 2710162 - protein, 19 aa, Entamoeba histolytica
EEMLLSLQTIGMSIGEVLK

SEQ ID NO: 2710163 - protein, 27 aa, Entamoeba histolytica
EEMPFDQWDLCIYARTLEYALQDEERF

SEQ ID NO: 2710164 - protein, 18 aa, Entamoeba histolytica
EEMQLMEGIKRYGTNNWE

SEQ ID NO: 2710165 - protein, 24 aa, Entamoeba histolytica
EEMRKFLFNFPSLLLNSYCNALIK

SEQ ID NO: 2710166 - protein, 17 aa, Entamoeba histolytica
EEMSLPLDSRFRIKKPI

SEQ ID NO: 2710167 - protein, 28 aa, Entamoeba histolytica
EENDGVGFLYGWYLYLVDIVNDFDIKMI

SEQ ID NO: 2710168 - protein, 20 aa, Entamoeba histolytica
EENDILLNKLKKLLDEKDIT

SEQ ID NO: 2710169 - protein, 27 aa, Entamoeba histolytica
EENEFYTIFGTYFKKNAKWSINKNVPD

SEQ ID NO: 2710170 - protein, 29 aa, Entamoeba histolytica
EENFGQIAYYFLLLSGFLQKPHHQFRGLL

SEQ ID NO: 2710171 - protein, 18 aa, Entamoeba histolytica
EENLKHFKWMCQGRYGEG

SEQ ID NO: 2710172 - protein, 25 aa, Entamoeba histolytica
EENQFIIEEIFLSKMTFSDKQHPLT

SEQ ID NO: 2710173 - protein, 30 aa, Entamoeba histolytica
EENVFGQWGFLIYYILLKGGSVTIKPFVKK

SEQ ID NO: 2710174 - protein, 25 aa, Entamoeba histolytica
EEPDYLSMRKLFWSIAKRENIQFDG

SEQ ID NO: 2710175 - protein, 26 aa, Entamoeba histolytica
EEPHGIIYLSVIHKGLNPGIIKGIFS

SEQ ID NO: 2710176 - protein, 23 aa, Entamoeba histolytica
EEPIKLYNKFVVSRVLQDFKREY

SEQ ID NO: 2710177 - protein, 29 aa, Entamoeba histolytica
EEPINGTLNFLLFKLGRESFHILYDSKQH

SEQ ID NO: 2710178 - protein, 25 aa, Entamoeba histolytica
EEPKKVLQILPILPKEKRSAITEIC

SEQ ID NO: 2710179 - protein, 30 aa, Entamoeba histolytica
EEPKNLYIQQIIWLVVSTFPDKLPSVLPNL

SEQ ID NO: 2710180 - protein, 25 aa, Entamoeba histolytica
EEQENLIVLQLFKENVRCFDSNSVV

SEQ ID NO: 2710181 - protein, 22 aa, Entamoeba histolytica
EEQFKFIQLYCPTITLRYANPY

SEQ ID NO: 2710182 - protein, 17 aa, Entamoeba histolytica
EEQIIGLHALNERLEEM

SEQ ID NO: 2710183 - protein, 21 aa, Entamoeba histolytica
EEQLIDLNPMLEAFGNAKTVK

SEQ ID NO: 2710184 - protein, 29 aa, Entamoeba histolytica
EERFLCPEILFRPELFISDDVLAKGLDVA

SEQ ID NO: 2710185 - protein, 19 aa, Entamoeba histolytica
EERITLVKKILSLGIKAHA

SEQ ID NO: 2710186 - protein, 24 aa, Entamoeba histolytica
EERKEYYLHLFLEEQPDLNWENIE

SEQ ID NO: 2710187 - protein, 22 aa, Entamoeba histolytica
EERKRLFQINPYSQQGPTTIPL

SEQ ID NO: 2710188 - protein, 24 aa, Entamoeba histolytica
EERKVDYPLWMLCLYDACGKVSKV

SEQ ID NO: 2710189 - protein, 17 aa, Entamoeba histolytica
EERKYFFEFIKKNSKNI

SEQ ID NO: 2710190 - protein, 28 aa, Entamoeba histolytica
EERMVKLVQFFLSGFYITPKACKKPYNP

SEQ ID NO: 2710191 - protein, 19 aa, Entamoeba histolytica
EERNHVIYTLPLKSTKIIQ

SEQ ID NO: 2710192 - protein, 26 aa, Entamoeba histolytica
EESIKALPIIILFDNITDINYNIIYQ

SEQ ID NO: 2710193 - protein, 24 aa, Entamoeba histolytica
EESKELLIEIGFNKYAVQKQEIAD

SEQ ID NO: 2710194 - protein, 30 aa, Entamoeba histolytica
EESKKLQIKYNGPLVILPEANVIEVSEAEE

SEQ ID NO: 2710195 - protein, 26 aa, Entamoeba histolytica
EESKRVKFVFISWAGEGIKKPKLRAV

SEQ ID NO: 2710196 - protein, 25 aa, Entamoeba histolytica
EESKSPSFDIKPSSSFSLFGGDIIN

SEQ ID NO: 2710197 - protein, 17 aa, Entamoeba histolytica
EESLRNILWGEHFINMK

SEQ ID NO: 2710198 - protein, 21 aa, Entamoeba histolytica
EESLRRNIELQNQIEVLQKQL

SEQ ID NO: 2710199 - protein, 25 aa, Entamoeba histolytica
EESQAFKSFTIPVKSKPKFFGKKGK

SEQ ID NO: 2710200 - protein, 24 aa, Entamoeba histolytica
EETDTILFWEVIENMIKSMYNEDR

SEQ ID NO: 2710201 - protein, 30 aa, Entamoeba histolytica; identical to SEQ ID NO: 2521916

SEQ ID NO: 2710202 - protein, 34 aa, Entamoeba histolytica; identical to SEQ ID NO: 2521919

SEQ ID NO: 2710203 - protein, 20 aa, Entamoeba histolytica
EETLIRFSGFPHGGACTVVL

SEQ ID NO: 2710204 - protein, 25 aa, Entamoeba histolytica
EETLISMLRPFLSKDILYEPIKELK

SEQ ID NO: 2710205 - protein, 28 aa, Entamoeba histolytica
EETRKSIIQFLKLMKPNSFKVFDVNLRQ

SEQ ID NO: 2710206 - protein, 23 aa, Entamoeba histolytica
EETRLVLDPYYPENFYIDQDFHT

SEQ ID NO: 2710207 - protein, 23 aa, Entamoeba histolytica
EETSLFSFDKPNLSSLINSGLSR

SEQ ID NO: 2710208 - protein, 32 aa, Entamoeba histolytica
EEVFLSNYSIFGPSWIKFNGLTVVRTSVEQKS

SEQ ID NO: 2710209 - protein, 17 aa, Entamoeba histolytica
EEVFSKPIDASVNSFVY

SEQ ID NO: 2710210 - protein, 24 aa, Entamoeba histolytica
EEVHLIVCIAMRKILKFLNNIDKA

SEQ ID NO: 2710211 - protein, 23 aa, Entamoeba histolytica
EEVHQLLPSFKQIIQSHSISVVV

SEQ ID NO: 2710212 - protein, 24 aa, Entamoeba histolytica
EEVIALICQYLKEQKLQETRIALV

SEQ ID NO: 2710213 - protein, 26 aa, Entamoeba histolytica
EEVKCLYDPIIKLYAIVEGECSNLVH

SEQ ID NO: 2710214 - protein, 26 aa, Entamoeba histolytica
EEVKNHPFFERIRWNTLLSESREDIF

SEQ ID NO: 2710215 - protein, 29 aa, Entamoeba histolytica
EEVMKEIWIGLYFWYWHSDGRDYQEKVRK

SEQ ID NO: 2710216 - protein, 23 aa, Entamoeba histolytica
EEVPLPILKAMYGIYFTPRSLEG

SEQ ID NO: 2710217 - protein, 28 aa, Entamoeba histolytica
EEVPLTLPAFHFYRWDHEYEGQQMSKII

SEQ ID NO: 2710218 - protein, 24 aa, Entamoeba histolytica
EEVRETFRRAAVVQDIMLGNAMGK

SEQ ID NO: 2710219 - protein, 46 aa, Entamoeba histolytica
EEVVCEKYILKPCRFLRLREKEQVEFPCIPPRIKTPPLEHHMVEEE

SEQ ID NO: 2710220 - protein, 18 aa, Entamoeba histolytica
EEVVPLTQSLFSVTTGLQ

SEQ ID NO: 2710221 - protein, 25 aa, Entamoeba histolytica
EEVYQRYYHVFIKGELEQVIEKVKD

SEQ ID NO: 2710222 - protein, 25 aa, Entamoeba histolytica
EEWEHIIFYCCFLMMIQNNRIMMNE

SEQ ID NO: 2710223 - protein, 28 aa, Entamoeba histolytica
EEYARLRPLSYPATDVFIVLFSITDADS

SEQ ID NO: 2710224 - protein, 34 aa, Entamoeba histolytica
EEYDRLRPLSYPSTDIFLICYSIMSKASYENVEG

SEQ ID NO: 2710225 - protein, 35 aa, Entamoeba histolytica; identical to SEQ ID NO: 2521941

SEQ ID NO: 2710226 - protein, 31 aa, Entamoeba histolytica
EEYHPRINFVINTYYILPKSIITLTGREITY

SEQ ID NO: 2710227 - protein, 24 aa, Entamoeba histolytica
EEYIAMPVESFGEAMLRGMGWKEK

SEQ ID NO: 2710228 - protein, 27 aa, Entamoeba histolytica
EEYIFGQWGLLIKYVILKGGKVEILCP

SEQ ID NO: 2710229 - protein, 22 aa, Entamoeba histolytica
EEYIMVLCLNMLFCFDKEMEYV

SEQ ID NO: 2710230 - protein, 26 aa, Entamoeba histolytica
EEYKDTFNHWIRMTHYSIVYNSSKDG

SEQ ID NO: 2710231 - protein, 22 aa, Entamoeba histolytica
EEYKKFFIKYSYDDLVNKKFPK

SEQ ID NO: 2710232 - protein, 17 aa, Entamoeba histolytica
EEYLIRMKGIPASVIRG

SEQ ID NO: 2710233 - protein, 34 aa, Entamoeba histolytica; identical to SEQ ID NO: 2521950

SEQ ID NO: 2710234 - protein, 25 aa, Entamoeba histolytica
EEYSKDITLYLKTYAKILIKSKFVG

SEQ ID NO: 2710235 - protein, 25 aa, Entamoeba histolytica
EFAHPEFALYYLFNKDTYCINMYSF

SEQ ID NO: 2710236 - protein, 26 aa, Entamoeba histolytica
EFALNDNICDVFLLNKPLFNRFGPYI

SEQ ID NO: 2710237 - protein, 18 aa, Entamoeba histolytica
EFARLMMYKIISTTLCSN

SEQ ID NO: 2710238 - protein, 25 aa, Entamoeba histolytica
EFASNLVILLTGFFDSIETLILKDN

SEQ ID NO: 2710239 - protein, 19 aa, Entamoeba histolytica
EFATKLYNFLTASEAKIPD

SEQ ID NO: 2710240 - protein, 18 aa, Entamoeba histolytica
EFCFSLRSLFSKEPLMLL

SEQ ID NO: 2710241 - protein, 29 aa, Entamoeba histolytica
EFCGHYMFPYCILNKHLPFWGGYVGSHFE

SEQ ID NO: 2710242 - protein, 35 aa, Entamoeba histolytica; identical to SEQ ID NO: 2521960

SEQ ID NO: 2710243 - protein, 34 aa, Entamoeba histolytica; identical to SEQ ID NO: 2521961

SEQ ID NO: 2710244 - protein, 25 aa, Entamoeba histolytica
EFDDHLIRFLFCSYLSNRFSEFNEK

SEQ ID NO: 2710245 - protein, 25 aa, Entamoeba histolytica
EFDFKDIIVLKIVNLKIIPSKTIDD

SEQ ID NO: 2710246 - protein, 29 aa, Entamoeba histolytica
EFDGGIILFRLYSLIIRMLFIQKSSKSIT

SEQ ID NO: 2710247 - protein, 22 aa, Entamoeba histolytica
EFDQGYLELIPILLGLSNDDQI

SEQ ID NO: 2710248 - protein, 26 aa, Entamoeba histolytica
EFDRIRPLSYKDTDIFLLCFAVDNDR

SEQ ID NO: 2710249 - protein, 17 aa, Entamoeba histolytica
EFDSIIADCWKVAKARP

SEQ ID NO: 2710250 - protein, 36 aa, Entamoeba histolytica
EFDSLRPLSYPGTDIFLLCFAVIYEPSFHNLKDKWQ

SEQ ID NO: 2710251 - protein, 29 aa, Entamoeba histolytica
EFDTIFGIYLHYPLMSPFKYPRDPQHFIF

SEQ ID NO: 2710252 - protein, 24 aa, Entamoeba histolytica
EFDVQIYVYSIKFGDKKYLIKQRN

SEQ ID NO: 2710253 - protein, 25 aa, Entamoeba histolytica
EFDYDGIHYYFCEQFLMGCKAKLFG

SEQ ID NO: 2710254 - protein, 25 aa, Entamoeba histolytica
EFDYTIFIKNIMFIIEKLRSDELAK

SEQ ID NO: 2710255 - protein, 23 aa, Entamoeba histolytica
EFEIQYRELATDKSIVDFAVNFL

SEQ ID NO: 2710256 - protein, 18 aa, Entamoeba histolytica
EFELMLNAIKQNNEDEGC

SEQ ID NO: 2710257 - protein, 21 aa, Entamoeba histolytica
EFELMNYRLTSNIRQLIWVES

SEQ ID NO: 2710258 - protein, 20 aa, Entamoeba histolytica
EFERTLKMSTYLIAFINGEF

SEQ ID NO: 2710259 - protein, 21 aa, Entamoeba histolytica
EFESIAKKLDYLQHLTKGYAS

SEQ ID NO: 2710260 - protein, 30 aa, Entamoeba histolytica
EFETRLFDMILMTITIPRMLQIFQKAIDNE

SEQ ID NO: 2710261 - protein, 21 aa, Entamoeba histolytica
EFEVTEHFLFQPNTRKPNPNG

SEQ ID NO: 2710262 - protein, 28 aa, Entamoeba histolytica
EFFDRDVGCIKTFFWKRFGFGTEEVITL

SEQ ID NO: 2710263 - protein, 17 aa, Entamoeba histolytica
EFGFFFDSIYAKKTCKT

SEQ ID NO: 2710264 - protein, 18 aa, Entamoeba histolytica
EFHCLITLLLQIIQTPPV

SEQ ID NO: 2710265 - protein, 24 aa, Entamoeba histolytica
EFHNLKLVYRRYVGLYFICGVDET

SEQ ID NO: 2710266 - protein, 20 aa, Entamoeba histolytica
EFHPRKLLLQPNEIKELTIC

SEQ ID NO: 2710267 - protein, 18 aa, Entamoeba histolytica
EFHTEEMIVLLTVLLKII

SEQ ID NO: 2710268 - protein, 33 aa, Entamoeba histolytica
EFIEADLVIFAFPIYWYAMPGQLKVFIDRTVMM

SEQ ID NO: 2710269 - protein, 24 aa, Entamoeba histolytica
EFIEYGYCMILETLIEQRKKDMMK

SEQ ID NO: 2710270 - protein, 18 aa, Entamoeba histolytica
EFIFFIDEIGYQLTPTSI

SEQ ID NO: 2710271 - protein, 18 aa, Entamoeba histolytica
EFILNKIKTILKTQKDFL

SEQ ID NO: 2710272 - protein, 18 aa, Entamoeba histolytica
EFIRHMQILAKFKKEDVL

SEQ ID NO: 2710273 - protein, 30 aa, Entamoeba histolytica
EFISGPIQLYCDALLLVLSGLHKCVIFYSF

SEQ ID NO: 2710274 - protein, 25 aa, Entamoeba histolytica
EFISWIMFRMFHLFEKLNQFKEMVE

SEQ ID NO: 2710275 - protein, 21 aa, Entamoeba histolytica
EFITIGNMLWGWKIETYNKLT

SEQ ID NO: 2710276 - protein, 20 aa, Entamoeba histolytica
EFIVSHLIRRHPKSKAFMAL

SEQ ID NO: 2710277 - protein, 25 aa, Entamoeba histolytica
EFKEMKPWFRGWTGQLRKNKDGSGY

SEQ ID NO: 2710278 - protein, 29 aa, Entamoeba histolytica
EFKKSAGKWLIPYCVYRALIKSVDTPLPP

SEQ ID NO: 2710279 - protein, 23 aa, Entamoeba histolytica
EFKQFFKIIQIAQNIKICQKMNY

SEQ ID NO: 2710280 - protein, 17 aa, Entamoeba histolytica
EFKRKTEQYILELERSL

SEQ ID NO: 2710281 - protein, 23 aa, Entamoeba histolytica
EFKSQLFLFFNNFFSKDSEAKEL

SEQ ID NO: 2710282 - protein, 23 aa, Entamoeba histolytica
EFKTYFVQFLEYLNIPAVSKAEK

SEQ ID NO: 2710283 - protein, 23 aa, Entamoeba histolytica
EFLATLVVDLFGPKGAVDFMEAN

SEQ ID NO: 2710284 - protein, 18 aa, Entamoeba histolytica
EFLLLPNAKVITGELYSI

SEQ ID NO: 2710285 - protein, 25 aa, Entamoeba histolytica
EFLSLLINYPFYNLFDWNDDMNTPL

SEQ ID NO: 2710286 - protein, 21 aa, Entamoeba histolytica
EFLTINLTNYGCRLIDIITQG

SEQ ID NO: 2710287 - protein, 18 aa, Entamoeba histolytica
EFLVIASDGFWDVFSYEN

SEQ ID NO: 2710288 - protein, 20 aa, Entamoeba histolytica
EFMYLIDGFTMTPKYLLKGC

SEQ ID NO: 2710289 - protein, 25 aa, Entamoeba histolytica
EFNCAVRIILFKFINVMLNEYRDYI

SEQ ID NO: 2710290 - protein, 21 aa, Entamoeba histolytica
EFNDPAPVFNMPRDPRRLQEK

SEQ ID NO: 2710291 - protein, 19 aa, Entamoeba histolytica
EFNEIYVKALLATTTYKKL

SEQ ID NO: 2710292 - protein, 25 aa, Entamoeba histolytica
EFNEKNLIIWGNLPRRRIDLMDENT

SEQ ID NO: 2710293 - protein, 17 aa, Entamoeba histolytica
EFNHLASLYFIDKKKEG

SEQ ID NO: 2710294 - protein, 17 aa, Entamoeba histolytica
EFNQLFKITDMLGLPPK

SEQ ID NO: 2710295 - protein, 27 aa, Entamoeba histolytica
EFNVIRTNWYWKHQKRIIRFSKDKFYR

SEQ ID NO: 2710296 - protein, 17 aa, Entamoeba histolytica
EFNWNNCIFYIFDIEDI

SEQ ID NO: 2710297 - protein, 19 aa, Entamoeba histolytica
EFPEEPAVFVFHLSVTGTS

SEQ ID NO: 2710298 - protein, 20 aa, Entamoeba histolytica
EFPFYETYFYNKKTVKHYLD

SEQ ID NO: 2710299 - protein, 17 aa, Entamoeba histolytica
EFPLEPPLAKMLIVSEQ

SEQ ID NO: 2710300 - protein, 17 aa, Entamoeba histolytica
EFPLLFGVSLIDGERII

SEQ ID NO: 2710301 - protein, 23 aa, Entamoeba histolytica
EFPQQETLEDVLLKLSNVNLNEE

SEQ ID NO: 2710302 - protein, 17 aa, Entamoeba histolytica
EFPSSDFIIFGPGTVEQ

SEQ ID NO: 2710303 - protein, 18 aa, Entamoeba histolytica
EFPTFPGAILFTTNCLMK

SEQ ID NO: 2710304 - protein, 19 aa, Entamoeba histolytica
EFQHPSFISYQPIKREPID

SEQ ID NO: 2710305 - protein, 19 aa, Entamoeba histolytica
EFRCELPFHLFNQNYKLIP

SEQ ID NO: 2710306 - protein, 23 aa, Entamoeba histolytica
EFRFDELLIYLQSLQGLLKTDII

SEQ ID NO: 2710307 - protein, 18 aa, Entamoeba histolytica
EFRKQMFDIIKQKLEDNA

SEQ ID NO: 2710308 - protein, 23 aa, Entamoeba histolytica
EFRKVFIQFILVIQKNYLLHYNT

SEQ ID NO: 2710309 - protein, 17 aa, Entamoeba histolytica
EFRLVAIPNRNIEMNEM

SEQ ID NO: 2710310 - protein, 29 aa, Entamoeba histolytica
EFRLYLTEGLPYFLLYKEVPKEILEKYRD

SEQ ID NO: 2710311 - protein, 22 aa, Entamoeba histolytica
EFSDWVYDFKLFTESALPSLSV

SEQ ID NO: 2710312 - protein, 30 aa, Entamoeba histolytica
EFSEHYIIMPDIAKIIYRLAYHVYKTKELI

SEQ ID NO: 2710313 - protein, 26 aa, Entamoeba histolytica
EFSGGWRMRISIAKAIYMHPDLLLLD

SEQ ID NO: 2710314 - protein, 19 aa, Entamoeba histolytica
EFSIPSWVEIFKGGDGLKK

SEQ ID NO: 2710315 - protein, 24 aa, Entamoeba histolytica
EFSLPITFTCWPAEAQNGLTLSMS

SEQ ID NO: 2710316 - protein, 24 aa, Entamoeba histolytica
EFSNYFFNILNKFGEMELRAFLVF

SEQ ID NO: 2710317 - protein, 25 aa, Entamoeba histolytica
EFSTDFFCKYGVSPLPKLDYDHSLY

SEQ ID NO: 2710318 - protein, 22 aa, Entamoeba histolytica
EFSYFIPEFMYMTGLSSKMKSD

SEQ ID NO: 2710319 - protein, 18 aa, Entamoeba histolytica
EFTFWNGLQFNFACLSGA

SEQ ID NO: 2710320 - protein, 26 aa, Entamoeba histolytica
EFTHSFYHRLEWLCGFSGFTGEIVIT

SEQ ID NO: 2710321 - protein, 21 aa, Entamoeba histolytica
EFTLVIPHRTLTLTPEFLLTH

SEQ ID NO: 2710322 - protein, 17 aa, Entamoeba histolytica
EFVLFQNIQKECPLLVV

SEQ ID NO: 2710323 - protein, 19 aa, Entamoeba histolytica
EFVLPDIISFIREQLKIEK

SEQ ID NO: 2710324 - protein, 20 aa, Entamoeba histolytica
EFVRSGHRLSPTDKIPIAII

SEQ ID NO: 2710325 - protein, 17 aa, Entamoeba histolytica
EFWSVYSSMSSLQVMPK

SEQ ID NO: 2710326 - protein, 18 aa, Entamoeba histolytica
EFYELLRRIIQYCISRYN

SEQ ID NO: 2710327 - protein, 22 aa, Entamoeba histolytica
EFYFCDLNLIQDTFLKGVIETS

SEQ ID NO: 2710328 - protein, 30 aa, Entamoeba histolytica; identical to SEQ ID NO: 2522057

SEQ ID NO: 2710329 - protein, 19 aa, Entamoeba histolytica
EFYKMKPWCRDKLKHSVYL

SEQ ID NO: 2710330 - protein, 19 aa, Entamoeba histolytica
EFYLFIKRDKQGFAGFIIE

SEQ ID NO: 2710331 - protein, 18 aa, Entamoeba histolytica
EFYLMGNMKMFAKDYGGE

SEQ ID NO: 2710332 - protein, 19 aa, Entamoeba histolytica
EFYNNLPPLPDNDALLVLK

SEQ ID NO: 2710333 - protein, 20 aa, Entamoeba histolytica
EFYPKLCEWVGLSNYEVLYN

SEQ ID NO: 2710334 - protein, 27 aa, Entamoeba histolytica
EGALWSFAINSVIYFRLLSPFCISIGD

SEQ ID NO: 2710335 - protein, 18 aa, Entamoeba histolytica
EGDEQVLEQIFLSDVYTA

SEQ ID NO: 2710336 - protein, 21 aa, Entamoeba histolytica
EGDHKIACSFKPYGLYDGNKN

SEQ ID NO: 2710337 - protein, 24 aa, Entamoeba histolytica
EGDKDLLWIQQRPGIKIICKGNHD

SEQ ID NO: 2710338 - protein, 27 aa, Entamoeba histolytica
EGEARAKEFGLKYFEVSAKTGVGINEM

SEQ ID NO: 2710339 - protein, 22 aa, Entamoeba histolytica
EGEILNCLILANYVVQNSPCFR

SEQ ID NO: 2710340 - protein, 31 aa, Entamoeba histolytica
EGENKECVQIIQLLNAHRRALDWMERSTNEL

SEQ ID NO: 2710341 - protein, 23 aa, Entamoeba histolytica
EGERYYSILPSNFKIISVAWNKD

SEQ ID NO: 2710342 - protein, 29 aa, Entamoeba histolytica
EGESKKFFGLIPYWIAQLIEIENNIQCVN

SEQ ID NO: 2710343 - protein, 27 aa, Entamoeba histolytica
EGFDYISKAHWYFYPPTSQFMEYVNKL

SEQ ID NO: 2710344 - protein, 23 aa, Entamoeba histolytica
EGFIADRNIGLPQLIAVIREFFT

SEQ ID NO: 2710345 - protein, 17 aa, Entamoeba histolytica
EGFLPLTGTAFVAWGDK

SEQ ID NO: 2710346 - protein, 24 aa, Entamoeba histolytica
EGFRLFVNLCCDTFLILRKNYHGL

SEQ ID NO: 2710347 - protein, 23 aa, Entamoeba histolytica
EGFSFVLNLLIIPGNRICADCLF

SEQ ID NO: 2710348 - protein, 21 aa, Entamoeba histolytica
EGGIFVFPNMPVISKKSIDIF

SEQ ID NO: 2710349 - protein, 27 aa, Entamoeba histolytica
EGGVFNLRMFFPDDFPSNPPKLVFKSE

SEQ ID NO: 2710350 - protein, 38 aa, Entamoeba histolytica
EGHEEQILHLKFDIGLLLRLILCLSKSLSYDGDKRINI

SEQ ID NO: 2710351 - protein, 25 aa, Entamoeba histolytica
EGHLFIKKKFGWVSNYFILKDGKLI

SEQ ID NO: 2710352 - protein, 22 aa, Entamoeba histolytica
EGHTFIKFQPYLNQNVLSGISP

SEQ ID NO: 2710353 - protein, 26 aa, Entamoeba histolytica
EGIEGMIRIILFFQYAQFQEASIVKE

SEQ ID NO: 2710354 - protein, 21 aa, Entamoeba histolytica
EGIIQFILQKCSYFEVIIPFL

SEQ ID NO: 2710355 - protein, 40 aa, Entamoeba histolytica
EGIIVYQSFRNKTLFYLIHTDLEAIKYLHNIYKTLKTIDI

SEQ ID NO: 2710356 - protein, 43 aa, Entamoeba histolytica
EGIKALRNMLQLFLRQLPLNSKFQIISFGSTYDFIFKEMTEYN

SEQ ID NO: 2710357 - protein, 23 aa, Entamoeba histolytica
EGIKRPHQPPTNDLLPPTHQTFE

SEQ ID NO: 2710358 - protein, 17 aa, Entamoeba histolytica
EGILYNPTPTKTDSTGI

SEQ ID NO: 2710359 - protein, 21 aa, Entamoeba histolytica
EGISCNEAMGALYLFPKITFP

SEQ ID NO: 2710360 - protein, 22 aa, Entamoeba histolytica
EGKEVVLKWRRGKKDTNKGKFN

SEQ ID NO: 2710361 - protein, 20 aa, Entamoeba histolytica
EGKFFDSFDKAYGCCGFPIC

SEQ ID NO: 2710362 - protein, 20 aa, Entamoeba histolytica
EGKKIYFSKIFELKKVNVEV

SEQ ID NO: 2710363 - protein, 28 aa, Entamoeba histolytica
EGKLLFGERFLRVDPILPGQILLDNVEQ

SEQ ID NO: 2710364 - protein, 28 aa, Entamoeba histolytica
EGKMIRKIMKWMLKCLICQEQIFDMTKM

SEQ ID NO: 2710365 - protein, 26 aa, Entamoeba histolytica
EGKNQLRFVLTPTGLFQFAANETLLN

SEQ ID NO: 2710366 - protein, 24 aa, Entamoeba histolytica
EGKQGWTISFIPLTLSVTNVTISG

SEQ ID NO: 2710367 - protein, 17 aa, Entamoeba histolytica
EGKSSFRWTPPQQFFQS

SEQ ID NO: 2710368 - protein, 22 aa, Entamoeba histolytica
EGKTILVFDIGGGTFDITLIRM

SEQ ID NO: 2710369 - protein, 20 aa, Entamoeba histolytica
EGKYHEWFINQFITRYEQVD

SEQ ID NO: 2710370 - protein, 19 aa, Entamoeba histolytica
EGLGRFYDNLDLIHAYLSE

SEQ ID NO: 2710371 - protein, 36 aa, Entamoeba histolytica
EGLIVEKLILLPMDRFRRFIPIIDAFVHNTPDCCVE

SEQ ID NO: 2710372 - protein, 20 aa, Entamoeba histolytica
EGLKIVGKIPGAAAWKVNKK

SEQ ID NO: 2710373 - protein, 23 aa, Entamoeba histolytica
EGLLMKVLHWINTSKAFPYSSVK

SEQ ID NO: 2710374 - protein, 19 aa, Entamoeba histolytica
EGLMMWVNALLDGSGIEVE

SEQ ID NO: 2710375 - protein, 26 aa, Entamoeba histolytica
EGNAHMSYFIRTLIEMGYKAEGMKLM

SEQ ID NO: 2710376 - protein, 22 aa, Entamoeba histolytica
EGNDIILLCSFKDTLNNKNFTI

SEQ ID NO: 2710377 - protein, 22 aa, Entamoeba histolytica
EGNIFLIFEYMPHDLQSLLYST

SEQ ID NO: 2710378 - protein, 25 aa, Entamoeba histolytica
EGNVKCLIKMKLALFYFQNAKHELA

SEQ ID NO: 2710379 - protein, 25 aa, Entamoeba histolytica
EGQMWRSVVIVGIIFRQGNSYDFQE

SEQ ID NO: 2710380 - protein, 22 aa, Entamoeba histolytica
EGQTLMVLPFKNMIVATETKMN

SEQ ID NO: 2710381 - protein, 19 aa, Entamoeba histolytica
EGQYGIPKGIFFSMPVVCY

SEQ ID NO: 2710382 - protein, 36 aa, Entamoeba histolytica
EGRDYVVKYGKYLLKKVCAIPAFIVTFTVCIDEVVA

SEQ ID NO: 2710383 - protein, 28 aa, Entamoeba histolytica
EGREEQTLSLLFSMLGHNFNANQLSHVS

SEQ ID NO: 2710384 - protein, 17 aa, Entamoeba histolytica
EGRLHPNALIRILKRIQ

SEQ ID NO: 2710385 - protein, 32 aa, Entamoeba histolytica
EGRPYYQLPRIIENILIYLYNKGCTTHGIFRE

SEQ ID NO: 2710386 - protein, 19 aa, Entamoeba histolytica
EGRWKYLRILSNDGNFDTI

SEQ ID NO: 2710387 - protein, 26 aa, Entamoeba histolytica
EGSEHWLLMKSALYIIQFLSMMCSFD

SEQ ID NO: 2710388 - protein, 23 aa, Entamoeba histolytica
EGSGIPSFFNGLLGKSTSKKGSP

SEQ ID NO: 2710389 - protein, 24 aa, Entamoeba histolytica
EGSGKYTRALLYLKNIYGDGVMKI

SEQ ID NO: 2710390 - protein, 25 aa, Entamoeba histolytica
EGSGQGTIWFMQREVLEKKKFMPTN

SEQ ID NO: 2710391 - protein, 29 aa, Entamoeba histolytica
EGSPPYRELGMFKGLFKTATVGAPGLRNP

SEQ ID NO: 2710392 - protein, 19 aa, Entamoeba histolytica
EGSVIMIRVWSGQLMICDT

SEQ ID NO: 2710393 - protein, 18 aa, Entamoeba histolytica
EGTEVILKWRRGEKKENK

SEQ ID NO: 2710394 - protein, 30 aa, Entamoeba histolytica; identical to SEQ ID NO: 2478852

SEQ ID NO: 2710395 - protein, 17 aa, Entamoeba histolytica
EGTKVFLCLIQKLPEIK

SEQ ID NO: 2710396 - protein, 24 aa, Entamoeba histolytica
EGTRLEGTWLLIEKVELGSMFSIK

SEQ ID NO: 2710397 - protein, 27 aa, Entamoeba histolytica
EGTVAKLIMIIKLIKDIIIMADIGIDA

SEQ ID NO: 2710398 - protein, 26 aa, Entamoeba histolytica
EGVPPYIDDPPLRALFKISTKGIPPV

SEQ ID NO: 2710399 - protein, 18 aa, Entamoeba histolytica
EGVQQFGIGHWKLILNNF

SEQ ID NO: 2710400 - protein, 27 aa, Entamoeba histolytica
EGVSDLALHFLAKLKIMVVKDIERDDI

SEQ ID NO: 2710401 - protein, 24 aa, Entamoeba histolytica
EGVSIKIIIYESPFFMDVVKGEKK

SEQ ID NO: 2710402 - protein, 30 aa, Entamoeba histolytica; identical to SEQ ID NO: 2522149

SEQ ID NO: 2710403 - protein, 39 aa, Entamoeba histolytica
EGVSSFKVFMVYDFFVTDGLFYKILKKTKSSGGLLGVHA

SEQ ID NO: 2710404 - protein, 17 aa, Entamoeba histolytica
EGWIYINGKTYSPSEIS

SEQ ID NO: 2710405 - protein, 26 aa, Entamoeba histolytica
EGYIDFNYFNYISIRFTMAGLIEEDD

SEQ ID NO: 2710406 - protein, 35 aa, Entamoeba histolytica
EGYITLTFDKPIFIKNILVCLSLVHYSGITPLGGT

SEQ ID NO: 2710407 - protein, 27 aa, Entamoeba histolytica
EGYQIISSSLFLFYDYDDPLSTIDFKM

SEQ ID NO: 2710408 - protein, 33 aa, Entamoeba histolytica; identical to SEQ ID NO: 2522153

SEQ ID NO: 2710409 - protein, 32 aa, Entamoeba histolytica; identical to SEQ ID NO: 2522154

SEQ ID NO: 2710410 - protein, 23 aa, Entamoeba histolytica
EHAKFVEGLALFHKDWKKIKEYI

SEQ ID NO: 2710411 - protein, 20 aa, Entamoeba histolytica
EHDFNEKSLICIIQVFGDQE

SEQ ID NO: 2710412 - protein, 24 aa, Entamoeba histolytica
EHDYITAASYFYEAFENYHSLSLK

SEQ ID NO: 2710413 - protein, 21 aa, Entamoeba histolytica
EHEFNEKSLICIIQVFGDQEM

SEQ ID NO: 2710414 - protein, 27 aa, Entamoeba histolytica
EHEKEGHLLYLLLDLIGDKEQTVVFCA

SEQ ID NO: 2710415 - protein, 18 aa, Entamoeba histolytica
EHFAVLCEILRAITKKRS

SEQ ID NO: 2710416 - protein, 24 aa, Entamoeba histolytica
EHFKAIYPIELLSIELNVWKNTIS

SEQ ID NO: 2710417 - protein, 23 aa, Entamoeba histolytica
EHFKQIFQFMKTYFHYHDTDVQQ

SEQ ID NO: 2710418 - protein, 23 aa, Entamoeba histolytica
EHFNYWFWDYRSPYWEDIKRLVL

SEQ ID NO: 2710419 - protein, 25 aa, Entamoeba histolytica
EHGDLYIYFEIKFPNNAEIKNSLDV

SEQ ID NO: 2710420 - protein, 21 aa, Entamoeba histolytica
EHGFIMPDIIKMSVKRVAEKG

SEQ ID NO: 2710421 - protein, 20 aa, Entamoeba histolytica
EHGIIRSPIAGGLLVMYLLS

SEQ ID NO: 2710422 - protein, 25 aa, Entamoeba histolytica
EHGLIPLVELVFGGRRRRFIINLEN

SEQ ID NO: 2710423 - protein, 23 aa, Entamoeba histolytica
EHHFDESFIYQLFLHCIIFEPNS

SEQ ID NO: 2710424 - protein, 22 aa, Entamoeba histolytica
EHHIPFCVVVIDKKGVWNTFYG

SEQ ID NO: 2710425 - protein, 20 aa, Entamoeba histolytica
EHHPIFIQQTIGNICPLMAV

SEQ ID NO: 2710426 - protein, 24 aa, Entamoeba histolytica
EHHRQLPIQKFQKLKVPINCRYYC

SEQ ID NO: 2710427 - protein, 17 aa, Entamoeba histolytica
EHICAHKDIYLALPNEP

SEQ ID NO: 2710428 - protein, 19 aa, Entamoeba histolytica
EHIEPFRVFSTTLPVEGGN

SEQ ID NO: 2710429 - protein, 21 aa, Entamoeba histolytica
EHIFLETYYQASGCSSKISEH

SEQ ID NO: 2710430 - protein, 22 aa, Entamoeba histolytica
EHIPIKLGPFDIACFQFSLYKP

SEQ ID NO: 2710431 - protein, 30 aa, Entamoeba histolytica; identical to SEQ ID NO: 2522175

SEQ ID NO: 2710432 - protein, 20 aa, Entamoeba histolytica
EHIRGWYKDLKDAVPDVAVA

SEQ ID NO: 2710433 - protein, 20 aa, Entamoeba histolytica
EHISLKPKTKSKPLLFANRL

SEQ ID NO: 2710434 - protein, 27 aa, Entamoeba histolytica
EHKGKGFFPKLLNFICNPNGVIVMVFE

SEQ ID NO: 2710435 - protein, 24 aa, Entamoeba histolytica
EHKKGNFYSIKLQEKDAKKEKRNA

SEQ ID NO: 2710436 - protein, 21 aa, Entamoeba histolytica
EHMLQCVLYAMKYEPTLRIGF

SEQ ID NO: 2710437 - protein, 18 aa, Entamoeba histolytica
EHMSLFINLKIFKTGKWR

SEQ ID NO: 2710438 - protein, 30 aa, Entamoeba histolytica
EHNLHPNDFNKWLSTIFGREVYVEKEYMDE

SEQ ID NO: 2710439 - protein, 25 aa, Entamoeba histolytica
EHNTKTIKILPRRLFIQSDTNELFK

SEQ ID NO: 2710440 - protein, 20 aa, Entamoeba histolytica
EHNVMLIIDFLKDCIKKRTE

SEQ ID NO: 2710441 - protein, 40 aa, Entamoeba histolytica
EHPAVTTWNIPPTTDIVFSLRNLFNSPPIIIKQNVQNKLV

SEQ ID NO: 2710442 - protein, 17 aa, Entamoeba histolytica
EHPSIIPIVIDSLVYKD

SEQ ID NO: 2710443 - protein, 23 aa, Entamoeba histolytica
EHQFNFTFFLYCSDIEVQYKRIT

SEQ ID NO: 2710444 - protein, 19 aa, Entamoeba histolytica
EHQIQLIDLPYFSPSSYWE

SEQ ID NO: 2710445 - protein, 30 aa, Entamoeba histolytica
EHSFICFSSLKIFLNFLKKCQILYDEIAER

SEQ ID NO: 2710446 - protein, 22 aa, Entamoeba histolytica
EHSYYGFVCLLQISTRSSDYII

SEQ ID NO: 2710447 - protein, 18 aa, Entamoeba histolytica
EHTTSLVNILYSVFQFNK

SEQ ID NO: 2710448 - protein, 18 aa, Entamoeba histolytica
EHVLPVLEKRFRLKSILV

SEQ ID NO: 2710449 - protein, 19 aa, Entamoeba histolytica
EHVTIVNQCLQQLFQCCRV

SEQ ID NO: 2710450 - protein, 32 aa, Entamoeba histolytica
EHWEKRKEVFYSSFLSLFFNDSLEELCFNLYN

SEQ ID NO: 2710451 - protein, 20 aa, Entamoeba histolytica
EIACLLVEKYQIENDFTLIK

SEQ ID NO: 2710452 - protein, 21 aa, Entamoeba histolytica
EIADIYTFVATLSEELETLKN

SEQ ID NO: 2710453 - protein, 33 aa, Entamoeba histolytica
EIAIREYRRLFDELNFIVTENLRIIKRVNEAVE

SEQ ID NO: 2710454 - protein, 34 aa, Entamoeba histolytica
EIANQLMICEFSFLELLQPKDYYINIFSTTRPNS

SEQ ID NO: 2710455 - protein, 26 aa, Entamoeba histolytica
EIAQEIYIRWKVRKLLREQSYDVERA

SEQ ID NO: 2710456 - protein, 18 aa, Entamoeba histolytica
EIARVCYKAPWPVTAREF

SEQ ID NO: 2710457 - protein, 21 aa, Entamoeba histolytica
EIAYFSQFLLSQLGYTPLKEN

SEQ ID NO: 2710458 - protein, 18 aa, Entamoeba histolytica
EICGKRLKLLYDELNIQS

SEQ ID NO: 2710459 - protein, 38 aa, Entamoeba histolytica
EICMNAFVIIRKHGPLFIYLFRLMLATGIPELQSAKDI

SEQ ID NO: 2710460 - protein, 23 aa, Entamoeba histolytica
EIDDIHHPLFQTKIKTTQDIIHN

SEQ ID NO: 2710461 - protein, 30 aa, Entamoeba histolytica
EIDELRKKLLYLFYKIIKPTATENYVTVSQ

SEQ ID NO: 2710462 - protein, 17 aa, Entamoeba histolytica
EIDEPWYLKFNNSAIYS

SEQ ID NO: 2710463 - protein, 25 aa, Entamoeba histolytica
EIDEPYLYGHLLDCEHIFIVSDIRV

SEQ ID NO: 2710464 - protein, 29 aa, Entamoeba histolytica
EIDGNMKAIFYFFVVNGKVLELMEWVSIK

SEQ ID NO: 2710465 - protein, 30 aa, Entamoeba histolytica
EIDGTTLDEFARRLTVRKVGNSVSEEKKPK

SEQ ID NO: 2710466 - protein, 32 aa, Entamoeba histolytica; identical to SEQ ID NO: 2522217

SEQ ID NO: 2710467 - protein, 31 aa, Entamoeba histolytica; identical to SEQ ID NO: 2522218

SEQ ID NO: 2710468 - protein, 23 aa, Entamoeba histolytica
EIDKLLTQITTYKNPFNVIGVLP

SEQ ID NO: 2710469 - protein, 24 aa, Entamoeba histolytica
EIDKMIFKIRTYLHLPRNTEQDII

SEQ ID NO: 2710470 - protein, 18 aa, Entamoeba histolytica
EIDLFFPGKALNYSFKYI

SEQ ID NO: 2710471 - protein, 20 aa, Entamoeba histolytica
EIDNPWYLKFNNSAIYDDNT

SEQ ID NO: 2710472 - protein, 22 aa, Entamoeba histolytica
EIDYIDQLLLYKNELETIDSII

SEQ ID NO: 2710473 - protein, 17 aa, Entamoeba histolytica
EIEARQMIFDRFLQIKD

SEQ ID NO: 2710474 - protein, 30 aa, Entamoeba histolytica
EIEEEFGITKGRFKFKKTEKKREGEERIGG

SEQ ID NO: 2710475 - protein, 17 aa, Entamoeba histolytica
EIEEIIKTSPILEREPE

SEQ ID NO: 2710476 - protein, 26 aa, Entamoeba histolytica
EIEELFEFIIKDSFELMTDLFGNYVI

SEQ ID NO: 2710477 - protein, 24 aa, Entamoeba histolytica
EIEGGIPFLALSDLTGMPVKRIST

SEQ ID NO: 2710478 - protein, 27 aa, Entamoeba histolytica
EIEIDAIFEKLLLLRKKRYAATMILDG

SEQ ID NO: 2710479 - protein, 22 aa, Entamoeba histolytica
EIEIERLIEWGRGLKLVDEKEI

SEQ ID NO: 2710480 - protein, 27 aa, Entamoeba histolytica
EIEINKQIFTIPISVGLSDGAEFNYKG

SEQ ID NO: 2710481 - protein, 20 aa, Entamoeba histolytica
EIEISLCIVIFDGYGNVIGF

SEQ ID NO: 2710482 - protein, 27 aa, Entamoeba histolytica
EIEKEGIFFTPRYYGKFKAADALSKIS

SEQ ID NO: 2710483 - protein, 22 aa, Entamoeba histolytica
EIEKLKHDVNFTKQVTGDDAND

SEQ ID NO: 2710484 - protein, 25 aa, Entamoeba histolytica
EIEKNIIQLLELVRSYFSFECSLNN

SEQ ID NO: 2710485 - protein, 17 aa, Entamoeba histolytica
EIELLNSLKRTPLNDEK

SEQ ID NO: 2710486 - protein, 17 aa, Entamoeba histolytica
EIELLVYSYEWYSLLTS

SEQ ID NO: 2710487 - protein, 22 aa, Entamoeba histolytica
EIELWKVLTNCYGKWIINQSVV

SEQ ID NO: 2710488 - protein, 26 aa, Entamoeba histolytica
EIENKSILLILDKQLHCLPWESMPTF

SEQ ID NO: 2710489 - protein, 26 aa, Entamoeba histolytica
EIENLQYGFEFFINEASHQTFPTTKK

SEQ ID NO: 2710490 - protein, 18 aa, Entamoeba histolytica
EIENRRQVLRNEYQFGII

SEQ ID NO: 2710491 - protein, 28 aa, Entamoeba histolytica
EIEQTIMNLIFFWYVNYNEDFHTPYCDT

SEQ ID NO: 2710492 - protein, 23 aa, Entamoeba histolytica
EIERRLIEAINKIKPTNKTWDEI

SEQ ID NO: 2710493 - protein, 17 aa, Entamoeba histolytica
EIESWKNLVDGIIVCWI

SEQ ID NO: 2710494 - protein, 17 aa, Entamoeba histolytica
EIEVLHFPLERIHDLMF

SEQ ID NO: 2710495 - protein, 27 aa, Entamoeba histolytica
EIEYVNPFYELLLPTQSSTGLILDFGS

SEQ ID NO: 2710496 - protein, 18 aa, Entamoeba histolytica
EIFDKEKNGYISASELKH

SEQ ID NO: 2710497 - protein, 22 aa, Entamoeba histolytica
EIFDPAYFIVVIDSLKTISVVI

SEQ ID NO: 2710498 - protein, 17 aa, Entamoeba histolytica
EIFILKYIIGKITENEL

SEQ ID NO: 2710499 - protein, 17 aa, Entamoeba histolytica
EIFLRLKKKLNISEHQT

SEQ ID NO: 2710500 - protein, 26 aa, Entamoeba histolytica
EIFSPLKWQHLLVPFLPIKYTELTET

SEQ ID NO: 2710501 - protein, 21 aa, Entamoeba histolytica
EIFYTSLVVIVYYLSPNSKEM

SEQ ID NO: 2710502 - protein, 28 aa, Entamoeba histolytica
EIGFYYSKTYIFTLFFDEKPQMCLIDEM

SEQ ID NO: 2710503 - protein, 21 aa, Entamoeba histolytica
EIGGYFIINGIERYLRMIVYA

SEQ ID NO: 2710504 - protein, 23 aa, Entamoeba histolytica
EIGIMKPLVPTLLKQICDKNIEL

SEQ ID NO: 2710505 - protein, 24 aa, Entamoeba histolytica
EIGKGCFNRCYSLRSIEIPTSVSK

SEQ ID NO: 2710506 - protein, 24 aa, Entamoeba histolytica
EIGKGCFNRCYSLRTIEIPTSVNE

SEQ ID NO: 2710507 - protein, 17 aa, Entamoeba histolytica
EIGKLIIHLFIQNNKIQ

SEQ ID NO: 2710508 - protein, 26 aa, Entamoeba histolytica
EIGSSMIPFKFILPKNIKKITVIGDL

SEQ ID NO: 2710509 - protein, 17 aa, Entamoeba histolytica
EIGVEEGLINVDDFVKL

SEQ ID NO: 2710510 - protein, 19 aa, Entamoeba histolytica
EIHFSKIHFISYKAKFIPN

SEQ ID NO: 2710511 - protein, 17 aa, Entamoeba histolytica
EIHFVDVLPKNEEKEIS

SEQ ID NO: 2710512 - protein, 23 aa, Entamoeba histolytica
EIHIQIIYGLTVGAPVHRCPPPM

SEQ ID NO: 2710513 - protein, 18 aa, Entamoeba histolytica
EIHLYNRFQIISSLPYKT

SEQ ID NO: 2710514 - protein, 23 aa, Entamoeba histolytica
EIICKIFLELIDAIVILHKNGSF

SEQ ID NO: 2710515 - protein, 28 aa, Entamoeba histolytica
EIIDQLYLFPPIFIIQLSFTIDGNNEIP

SEQ ID NO: 2710516 - protein, 21 aa, Entamoeba histolytica
EIIELLPLYIELLEHWYNKND

SEQ ID NO: 2710517 - protein, 20 aa, Entamoeba histolytica
EIIFHLFDRDTFTSDDSLGD

SEQ ID NO: 2710518 - protein, 20 aa, Entamoeba histolytica
EIIFKTIWRRYTPSTIENIL

SEQ ID NO: 2710519 - protein, 17 aa, Entamoeba histolytica
EIIGFTSANHFAVCKSG

SEQ ID NO: 2710520 - protein, 21 aa, Entamoeba histolytica
EIIHLLIKKHLTFSSAESCSA

SEQ ID NO: 2710521 - protein, 17 aa, Entamoeba histolytica
EIIHRKPLQRKKKKKKH

SEQ ID NO: 2710522 - protein, 23 aa, Entamoeba histolytica
EIIKEIILFIKFVCQKHNIIKEE

SEQ ID NO: 2710523 - protein, 18 aa, Entamoeba histolytica
EIILCERIIFTCKNYNTI

SEQ ID NO: 2710524 - protein, 20 aa, Entamoeba histolytica
EIIPFDITPLIKVLESSKTM

SEQ ID NO: 2710525 - protein, 27 aa, Entamoeba histolytica
EIIPSSDFFPLFWQIASQFVNNPLPGV

SEQ ID NO: 2710526 - protein, 33 aa, Entamoeba histolytica
EIIQPGQWLDDSKLFLFSYTPGQNKPLFYSNIM

SEQ ID NO: 2710527 - protein, 24 aa, Entamoeba histolytica
EIIQQLKLLFPEVHYFIQNQFGIT

SEQ ID NO: 2710528 - protein, 26 aa, Entamoeba histolytica
EIIQRIRLLFVDLINTTLQSINTFYF

SEQ ID NO: 2710529 - protein, 24 aa, Entamoeba histolytica
EIIQYQFGYRRLSAYEKGGWTFNF

SEQ ID NO: 2710530 - protein, 20 aa, Entamoeba histolytica
EIISFSPYEYSFPISLKSLV

SEQ ID NO: 2710531 - protein, 27 aa, Entamoeba histolytica
EIISGTKFILYCWSRPDLRGYLNSQGV

SEQ ID NO: 2710532 - protein, 25 aa, Entamoeba histolytica
EIISTPPFNNLNKFKIHILHSSVPL

SEQ ID NO: 2710533 - protein, 18 aa, Entamoeba histolytica
EIIVYIQYSGKCVGCAAA

SEQ ID NO: 2710534 - protein, 17 aa, Entamoeba histolytica
EIKAIIPKKYYIEVPLS

SEQ ID NO: 2710535 - protein, 28 aa, Entamoeba histolytica
EIKDTLFYYRMMWNLNVGPSYSLPPKST

SEQ ID NO: 2710536 - protein, 37 aa, Entamoeba histolytica
EIKDVILVGGPTKLCCFKKMIKEFFGKQPLTTIDTML

SEQ ID NO: 2710537 - protein, 25 aa, Entamoeba histolytica
EIKEIGIGFPRKYPLMCIDRKEKYF

SEQ ID NO: 2710538 - protein, 30 aa, Entamoeba histolytica
EIKERLIHRQIFFYYNSFNIINGKQGAGKT

SEQ ID NO: 2710539 - protein, 23 aa, Entamoeba histolytica
EIKESFTAFKTEMDKMADIEETW

SEQ ID NO: 2710540 - protein, 29 aa, Entamoeba histolytica
EIKEYTSQNYYLHAILLINRACNASKSPA

SEQ ID NO: 2710541 - protein, 19 aa, Entamoeba histolytica
EIKFPQNGLYYFIDSLFSL

SEQ ID NO: 2710542 - protein, 25 aa, Entamoeba histolytica
EIKGVQYRAIITKAVPTANVVKCID

SEQ ID NO: 2710543 - protein, 25 aa, Entamoeba histolytica
EIKHPERLAAKTVQFLIVTELFYEG

SEQ ID NO: 2710544 - protein, 25 aa, Entamoeba histolytica
EIKKKKILFTTYKKGSPFTSGIPLT

SEQ ID NO: 2710545 - protein, 17 aa, Entamoeba histolytica
EIKKMYAECYLLCDQRK

SEQ ID NO: 2710546 - protein, 24 aa, Entamoeba histolytica
EIKKPIYIVALPRSGSTFTHTMLG

SEQ ID NO: 2710547 - protein, 21 aa, Entamoeba histolytica
EIKLAFFDLITPISTVMAKDL

SEQ ID NO: 2710548 - protein, 29 aa, Entamoeba histolytica
EIKMFIHNRLFKWKLKEITAKQLDKIGIK

SEQ ID NO: 2710549 - protein, 18 aa, Entamoeba histolytica
EIKMFLFDLCHMNSIQNI

SEQ ID NO: 2710550 - protein, 17 aa, Entamoeba histolytica
EIKMNYIQRGWIDKIEK

SEQ ID NO: 2710551 - protein, 24 aa, Entamoeba histolytica
EIKNAMSFMFASLYEKIINIEVQL

SEQ ID NO: 2710552 - protein, 23 aa, Entamoeba histolytica
EIKNDVEIIPTTEFKELIPSNDI

SEQ ID NO: 2710553 - protein, 28 aa, Entamoeba histolytica
EIKNEDILFTVWWVLQSIVQNNPIGQRA

SEQ ID NO: 2710554 - protein, 19 aa, Entamoeba histolytica
EIKNRILYKIIKLNKINTR

SEQ ID NO: 2710555 - protein, 27 aa, Entamoeba histolytica
EIKQIVQVFPLILPLFTELNCTDKMIL

SEQ ID NO: 2710556 - protein, 26 aa, Entamoeba histolytica
EIKQNISVYLLHPTKLVINSFQSLFK

SEQ ID NO: 2710557 - protein, 23 aa, Entamoeba histolytica
EIKQVSIIKLFGLLFEHCKYEKS

SEQ ID NO: 2710558 - protein, 25 aa, Entamoeba histolytica
EIKRKTKIPKLSEKTIKLPANEIQN

SEQ ID NO: 2710559 - protein, 23 aa, Entamoeba histolytica
EIKRYGVLIDKTNIIFCYEEKGI

SEQ ID NO: 2710560 - protein, 29 aa, Entamoeba histolytica
EIKSNFPELLPPYTLPKSSAALFTFCEFN

SEQ ID NO: 2710561 - protein, 25 aa, Entamoeba histolytica
EIKSPIIHFQIISPPLHFNSLEDLT

SEQ ID NO: 2710562 - protein, 27 aa, Entamoeba histolytica
EIKTKKGIFFYTIYSFIGNTIESYLNY

SEQ ID NO: 2710563 - protein, 23 aa, Entamoeba histolytica
EILHFLAEIASGLWYLHFCKHII

SEQ ID NO: 2710564 - protein, 20 aa, Entamoeba histolytica
EILHLFRKKILENKNLYFNR

SEQ ID NO: 2710565 - protein, 19 aa, Entamoeba histolytica
EILHYKKFKYYLNGALKRN

SEQ ID NO: 2710566 - protein, 24 aa, Entamoeba histolytica
EILKDQWLKGIKNYRPKSTVFEID

SEQ ID NO: 2710567 - protein, 18 aa, Entamoeba histolytica
EILKPLPSLIGLTGMITL

SEQ ID NO: 2710568 - protein, 24 aa, Entamoeba histolytica
EILLKNYAILPQVVSFITGFSSTT

SEQ ID NO: 2710569 - protein, 30 aa, Entamoeba histolytica
EILMSMMSNQWFWTEIEKFSYYQTNFTSQL

SEQ ID NO: 2710570 - protein, 24 aa, Entamoeba histolytica
EILNIPIIVACDVNNPFYGKNGAA

SEQ ID NO: 2710571 - protein, 19 aa, Entamoeba histolytica
EILPRRYLMKYEGIEIFFM

SEQ ID NO: 2710572 - protein, 25 aa, Entamoeba histolytica
EILSFTIYELLNFDPEIVFKKFFDE

SEQ ID NO: 2710573 - protein, 24 aa, Entamoeba histolytica
EILSPYKYAGYSLLIPALQDTQLR

SEQ ID NO: 2710574 - protein, 17 aa, Entamoeba histolytica
EILTYDNNTLKILEDII

SEQ ID NO: 2710575 - protein, 26 aa, Entamoeba histolytica
EIMERVLFLWALRHPASGYVQGINDL

SEQ ID NO: 2710576 - protein, 17 aa, Entamoeba histolytica
EIMGRHKIEPKYDAIPI

SEQ ID NO: 2710577 - protein, 25 aa, Entamoeba histolytica
EIMKLCEPYLNEGIHPRLLVEGIEL

SEQ ID NO: 2710578 - protein, 26 aa, Entamoeba histolytica
EIMMYYFHHGRMNSLFTWAFEKELCN

SEQ ID NO: 2710579 - protein, 19 aa, Entamoeba histolytica
EIMTLPIPLSESGSLQLKI

SEQ ID NO: 2710580 - protein, 28 aa, Entamoeba histolytica
EINEIFFKQIYWFEINVLTTINLINSQY

SEQ ID NO: 2710581 - protein, 20 aa, Entamoeba histolytica
EINERFKRNFLSDPKKKALP

SEQ ID NO: 2710582 - protein, 21 aa, Entamoeba histolytica
EINEYLRKLLIERGIIFSTES

SEQ ID NO: 2710583 - protein, 34 aa, Entamoeba histolytica
EINFAMFLTAIQRWLHLKMKSPILISLLSGRELR

SEQ ID NO: 2710584 - protein, 32 aa, Entamoeba histolytica
EINGHELFWIYYCSLPLFTSKVPVVDFWLDRI

SEQ ID NO: 2710585 - protein, 25 aa, Entamoeba histolytica
EINGKNYLYLFYNSNRLDPSVHFEG

SEQ ID NO: 2710586 - protein, 23 aa, Entamoeba histolytica
EINGMKYIMCLCDRPTLVSICKG

SEQ ID NO: 2710587 - protein, 30 aa, Entamoeba histolytica
EINIDKLLTNFFYFYVPNGSNLMDKETLEK

SEQ ID NO: 2710588 - protein, 18 aa, Entamoeba histolytica
EINIDLFKSTIEPVSRVL

SEQ ID NO: 2710589 - protein, 23 aa, Entamoeba histolytica
EINIPFPTFIKKIQLVVVSCFTG

SEQ ID NO: 2710590 - protein, 25 aa, Entamoeba histolytica
EINKINPKYPLICLSHEPPFNMMDY

SEQ ID NO: 2710591 - protein, 27 aa, Entamoeba histolytica
EINKNPLYDILTAYGAFSITGKLEICY

SEQ ID NO: 2710592 - protein, 23 aa, Entamoeba histolytica
EINKQIFTIPISVGLSDGAEFNY

SEQ ID NO: 2710593 - protein, 21 aa, Entamoeba histolytica
EINKRCVGIIYLALGYNENTI

SEQ ID NO: 2710594 - protein, 17 aa, Entamoeba histolytica
EINLKKFDFLRSLSFDK

SEQ ID NO: 2710595 - protein, 28 aa, Entamoeba histolytica
EINLLISQIPFSFPSILGLKDIVINDVL

SEQ ID NO: 2710596 - protein, 24 aa, Entamoeba histolytica
EINQIHQIDWYFSSIHPNKNHLNT

SEQ ID NO: 2710597 - protein, 25 aa, Entamoeba histolytica
EINSFRRIIIIYATKSLSLLNLMSR

SEQ ID NO: 2710598 - protein, 26 aa, Entamoeba histolytica
EINSPLHCLTLLQLGLTSIKIPSTII

SEQ ID NO: 2710599 - protein, 21 aa, Entamoeba histolytica
EINTVLNRWLEIEFSEHGFIM

SEQ ID NO: 2710600 - protein, 37 aa, Entamoeba histolytica
EIPCDVVASVFKKFLRNLPIHIFDRTTTKKIFQRWIE

SEQ ID NO: 2710601 - protein, 19 aa, Entamoeba histolytica
EIPETIQLFSSLKKISFAS

SEQ ID NO: 2710602 - protein, 29 aa, Entamoeba histolytica
EIPIDNIIYSYRFLQVNSLSLTLTTGNRV

SEQ ID NO: 2710603 - protein, 18 aa, Entamoeba histolytica
EIPKKWMEIIQKCKKTEK

SEQ ID NO: 2710604 - protein, 24 aa, Entamoeba histolytica
EIPKLYIEPIPYSNSQTITFETLQ

SEQ ID NO: 2710605 - protein, 20 aa, Entamoeba histolytica
EIPLHSFLNQFRILSRRDCE

SEQ ID NO: 2710606 - protein, 29 aa, Entamoeba histolytica
EIPRPSYHCKLFSEWILKQAERLGLQAKR

SEQ ID NO: 2710607 - protein, 26 aa, Entamoeba histolytica
EIPSTYPKLLPFIKLNLPHVPHCSVL

SEQ ID NO: 2710608 - protein, 36 aa, Entamoeba histolytica; identical to SEQ ID NO: 2396280

SEQ ID NO: 2710609 - protein, 18 aa, Entamoeba histolytica
EIQHDLLELAKRKATLTL

SEQ ID NO: 2710610 - protein, 24 aa, Entamoeba histolytica
EIQIDPAFLARAIEIYSIYHSIVK

SEQ ID NO: 2710611 - protein, 21 aa, Entamoeba histolytica
EIQLLFKRSILSRTDKLRTIA

SEQ ID NO: 2710612 - protein, 25 aa, Entamoeba histolytica
EIQQQRFLSYSFIPPFFKQEQIKEY

SEQ ID NO: 2710613 - protein, 23 aa, Entamoeba histolytica
EIQRTMLELLNQLDGFDTRGEVK

SEQ ID NO: 2710614 - protein, 22 aa, Entamoeba histolytica
EIQRTMLELLNQLDGFSKTDDV

SEQ ID NO: 2710615 - protein, 20 aa, Entamoeba histolytica
EIRCTVLSAIKMIQAIFLET

SEQ ID NO: 2710616 - protein, 21 aa, Entamoeba histolytica
EIREWYRVYKVAEGKKLNKYA

SEQ ID NO: 2710617 - protein, 19 aa, Entamoeba histolytica
EIRITIMKLLDERFDSFLA

SEQ ID NO: 2710618 - protein, 24 aa, Entamoeba histolytica
EIRKKYALIVPRRPAWTPDMTAEE

SEQ ID NO: 2710619 - protein, 26 aa, Entamoeba histolytica
EIRNMLLSFIFLLNCFVINGEQFSFG

SEQ ID NO: 2710620 - protein, 25 aa, Entamoeba histolytica
EIRNYLMCQQGVLLLLLNQHFDITI

SEQ ID NO: 2710621 - protein, 18 aa, Entamoeba histolytica
EIRPGFTKSWDDFDRIFR

SEQ ID NO: 2710622 - protein, 18 aa, Entamoeba histolytica
EIRQFLGRFGLKGDTPKQ

SEQ ID NO: 2710623 - protein, 25 aa, Entamoeba histolytica
EIRQYFPEPIVFKVLFEVYKRLYGI

SEQ ID NO: 2710624 - protein, 18 aa, Entamoeba histolytica
EIRRYVQETLVRAHSGWA

SEQ ID NO: 2710625 - protein, 24 aa, Entamoeba histolytica
EIRVRLYEIAAPFLIHRVNSNVQV

SEQ ID NO: 2710626 - protein, 26 aa, Entamoeba histolytica
EISALRGLFFIRLLGNYLVSNLESKS

SEQ ID NO: 2710627 - protein, 22 aa, Entamoeba histolytica
EISEKDFVLASLKNNKPFTTDR

SEQ ID NO: 2710628 - protein, 29 aa, Entamoeba histolytica
EISHSKCKFPYPKIIKTPFQSMEAANVLI

SEQ ID NO: 2710629 - protein, 24 aa, Entamoeba histolytica
EISKEHYLFLNKIQSKLVKSNWRE

SEQ ID NO: 2710630 - protein, 22 aa, Entamoeba histolytica
EISKLKLEIIDMNKKIACFINE

SEQ ID NO: 2710631 - protein, 25 aa, Entamoeba histolytica
EISNKKWCIVGLGSIGKNVARVAKG

SEQ ID NO: 2710632 - protein, 18 aa, Entamoeba histolytica
EISNPPFHILHHKNLKQN

SEQ ID NO: 2710633 - protein, 32 aa, Entamoeba histolytica
EITEESLIILHILNYLLLWNKINNETNNSFGY

SEQ ID NO: 2710634 - protein, 18 aa, Entamoeba histolytica
EITELNLELDKQKQLVTK

SEQ ID NO: 2710635 - protein, 23 aa, Entamoeba histolytica
EITEVRFIQSVIPFKVIERKERE

SEQ ID NO: 2710636 - protein, 21 aa, Entamoeba histolytica
EITKIPLGCNFSLLTHLDLSQ

SEQ ID NO: 2710637 - protein, 24 aa, Entamoeba histolytica
EITKQKLDCYFIMKGTVICEKKKD

SEQ ID NO: 2710638 - protein, 20 aa, Entamoeba histolytica
EITLIKKHLLKYPQQTVFIF

SEQ ID NO: 2710639 - protein, 22 aa, Entamoeba histolytica
EITNYEYLIYLNFIAGRSYNDL

SEQ ID NO: 2710640 - protein, 23 aa, Entamoeba histolytica
EITPPPMLINLEFLEIQPIEGNF

SEQ ID NO: 2710641 - protein, 34 aa, Entamoeba histolytica
EITPQCVAAWKKEALLCLIINYSLYPVSKQFNYF

SEQ ID NO: 2710642 - protein, 24 aa, Entamoeba histolytica
EITQQIFFEWSKINKNESIPELKI

SEQ ID NO: 2710643 - protein, 20 aa, Entamoeba histolytica
EITRIYRCYSGILNITGTEI

SEQ ID NO: 2710644 - protein, 20 aa, Entamoeba histolytica
EITVIQLIKKYSIPINLVID

SEQ ID NO: 2710645 - protein, 27 aa, Entamoeba histolytica
EITYEEYPYFIIAESRPFTIKTSLENT

SEQ ID NO: 2710646 - protein, 18 aa, Entamoeba histolytica
EIVDNIIYNLLKYGSMIQ

SEQ ID NO: 2710647 - protein, 17 aa, Entamoeba histolytica
EIVLDIILGIYSLTINT

SEQ ID NO: 2710648 - protein, 30 aa, Entamoeba histolytica
EIVQIFITRIIDTINLWPESYRYLCYSLYS

SEQ ID NO: 2710649 - protein, 23 aa, Entamoeba histolytica
EIVQKLWDIVKFYLFRENDTHTR

SEQ ID NO: 2710650 - protein, 21 aa, Entamoeba histolytica
EIVRKLISLMNQKKRMNVLTP

SEQ ID NO: 2710651 - protein, 20 aa, Entamoeba histolytica
EIVVLLIHQWIENGGTGNVD

SEQ ID NO: 2710652 - protein, 19 aa, Entamoeba histolytica
EIWNIAFVCAHIMQMKEKC

SEQ ID NO: 2710653 - protein, 20 aa, Entamoeba histolytica
EIYDDIVGVFWKRNLNEKEE

SEQ ID NO: 2710654 - protein, 29 aa, Entamoeba histolytica
EIYDFLIDIRYAFSITNLLPRIICIGNKE

SEQ ID NO: 2710655 - protein, 21 aa, Entamoeba histolytica
EIYFFNKYLTSVVSLPFILTY

SEQ ID NO: 2710656 - protein, 17 aa, Entamoeba histolytica
EIYGGIAGLYDMGPLGC

SEQ ID NO: 2710657 - protein, 18 aa, Entamoeba histolytica
EIYHDFYNTLFISPIEVS

SEQ ID NO: 2710658 - protein, 21 aa, Entamoeba histolytica
EIYKRIYDIVDITDYIKEEPV

SEQ ID NO: 2710659 - protein, 17 aa, Entamoeba histolytica
EIYLHKKYHTKLSFISF

SEQ ID NO: 2710660 - protein, 24 aa, Entamoeba histolytica
EIYQIRIRIKEGCKWRTGYKVVCC

SEQ ID NO: 2710661 - protein, 22 aa, Entamoeba histolytica
EKAEEWFKLERSYITDCLMLKE

SEQ ID NO: 2710662 - protein, 40 aa, Entamoeba histolytica
EKAEEWFRKVIFIDPNYGDAWIWIYKIIYEKKGKITDFEM

SEQ ID NO: 2710663 - protein, 25 aa, Entamoeba histolytica
EKAHPQVFNVLLQLLDEGRLTDGRG

SEQ ID NO: 2710664 - protein, 25 aa, Entamoeba histolytica
EKAKTQMTLFFAKMGSLMTQKQFKQ

SEQ ID NO: 2710665 - protein, 17 aa, Entamoeba histolytica
EKALMQALYKQVKLGVS

SEQ ID NO: 2710666 - protein, 19 aa, Entamoeba histolytica
EKALTPFSSLLHKWYDIDL

SEQ ID NO: 2710667 - protein, 20 aa, Entamoeba histolytica
EKAMIFNFKKDVPIPHFDFK

SEQ ID NO: 2710668 - protein, 27 aa, Entamoeba histolytica
EKASRSYLFIYENGKLKNPMKTQVQSK

SEQ ID NO: 2710669 - protein, 17 aa, Entamoeba histolytica
EKAVIVLIMNALLEYED

SEQ ID NO: 2710670 - protein, 24 aa, Entamoeba histolytica
EKAYDYFHKLPEPKVIREGMSQQE

SEQ ID NO: 2710671 - protein, 18 aa, Entamoeba histolytica
EKCSSLTTLTLPSSLRFL

SEQ ID NO: 2710672 - protein, 26 aa, Entamoeba histolytica
EKDHQPIIFKFFFKDDVKLGNVIIVC

SEQ ID NO: 2710673 - protein, 20 aa, Entamoeba histolytica
EKDILPIAQLMRTHYLFQQS

SEQ ID NO: 2710674 - protein, 24 aa, Entamoeba histolytica
EKDKIRFEYLYASALNEFKRENLT

SEQ ID NO: 2710675 - protein, 29 aa, Entamoeba histolytica
EKDLRDEIKDLRLDIVDLKGELESKEQEV

SEQ ID NO: 2710676 - protein, 24 aa, Entamoeba histolytica
EKDNEFIIHQKKFAQLNLRELLQI

SEQ ID NO: 2710677 - protein, 26 aa, Entamoeba histolytica
EKDNFRIELISYLPELNREIEFILNE

SEQ ID NO: 2710678 - protein, 21 aa, Entamoeba histolytica
EKDTIFMILDLAEGSLDKLMS

SEQ ID NO: 2710679 - protein, 25 aa, Entamoeba histolytica
EKEENDILLRGIQNKLKELKIEIKS

SEQ ID NO: 2710680 - protein, 18 aa, Entamoeba histolytica
EKEFKKCLNLIFLNSFSV

SEQ ID NO: 2710681 - protein, 21 aa, Entamoeba histolytica
EKEHYFIKHINLLDRMVVEFD

SEQ ID NO: 2710682 - protein, 25 aa, Entamoeba histolytica
EKEIPKSILLLYSTTLRLFAILRHD

SEQ ID NO: 2710683 - protein, 19 aa, Entamoeba histolytica
EKEIRYYEAFDRLSLLINN

SEQ ID NO: 2710684 - protein, 22 aa, Entamoeba histolytica
EKEKEISMFFFNFHQQEISTKR

SEQ ID NO: 2710685 - protein, 25 aa, Entamoeba histolytica
EKEKGCTRWQLKNGILYAYLQEEKG

SEQ ID NO: 2710686 - protein, 25 aa, Entamoeba histolytica
EKEKKYTEQIATLKKGKKTSFFGKK

SEQ ID NO: 2710687 - protein, 26 aa, Entamoeba histolytica
EKEKNNLIIKFEEDKKIFESEKTKQI

SEQ ID NO: 2710688 - protein, 32 aa, Entamoeba histolytica
EKEKRKYLINTLKNISLVIKKLQTINSIESET

SEQ ID NO: 2710689 - protein, 24 aa, Entamoeba histolytica
EKENKWILAYVFKENDLECLTFIR

SEQ ID NO: 2710690 - protein, 25 aa, Entamoeba histolytica
EKEPDRNIIPPRPPRENRHSIKQWI

SEQ ID NO: 2710691 - protein, 25 aa, Entamoeba histolytica
EKEPDRNIIPPRPPRENRNTIKEWI

SEQ ID NO: 2710692 - protein, 25 aa, Entamoeba histolytica
EKEPFMLPLNVILDEYLDKFKRYFR

SEQ ID NO: 2710693 - protein, 26 aa, Entamoeba histolytica
EKEPPEHIIIVMKYIVKYLQSKGKIV

SEQ ID NO: 2710694 - protein, 21 aa, Entamoeba histolytica
EKERFGERLIFNKEGNPQIKL

SEQ ID NO: 2710695 - protein, 30 aa, Entamoeba histolytica; identical to SEQ ID NO: 2593318

SEQ ID NO: 2710696 - protein, 19 aa, Entamoeba histolytica
EKEYLIKCSFPTLSLILNV

SEQ ID NO: 2710697 - protein, 28 aa, Entamoeba histolytica
EKEYMDEHFWEKLINYFRVDSVLEKEFT

SEQ ID NO: 2710698 - protein, 23 aa, Entamoeba histolytica
EKFIKEMIITLKRLKIGIGEDKQ

SEQ ID NO: 2710699 - protein, 26 aa, Entamoeba histolytica
EKFLDQLISIYFLNVKFSVSLLCPHC

SEQ ID NO: 2710700 - protein, 19 aa, Entamoeba histolytica
EKFRYNPISISNLRLFPKI

SEQ ID NO: 2710701 - protein, 30 aa, Entamoeba histolytica
EKGEFQWAITLLNHLIFANPKNTKARELAA

SEQ ID NO: 2710702 - protein, 24 aa, Entamoeba histolytica
EKGEKLLCIDFEPPKPINTSTYLC

SEQ ID NO: 2710703 - protein, 17 aa, Entamoeba histolytica
EKGEWITVISTDGEWWE

SEQ ID NO: 2710704 - protein, 25 aa, Entamoeba histolytica
EKGRLIPRFFSYCTSVAISRGINEE

SEQ ID NO: 2710705 - protein, 23 aa, Entamoeba histolytica
EKGWDFPIIQTATLPKMIQVITS

SEQ ID NO: 2710706 - protein, 25 aa, Entamoeba histolytica
EKGYLSLSPKDLGLAAPLTFEITPF

SEQ ID NO: 2710707 - protein, 25 aa, Entamoeba histolytica
EKHFPYYRTAIPKILFDPPFCSNPQ

SEQ ID NO: 2710708 - protein, 24 aa, Entamoeba histolytica
EKHLRLLWIALIPCLNVSSLTPIN

SEQ ID NO: 2710709 - protein, 18 aa, Entamoeba histolytica
EKHPQFLKNIDLVCGCSV

SEQ ID NO: 2710710 - protein, 24 aa, Entamoeba histolytica
EKIESYRFIPFLNSLIEMTQSPIK

SEQ ID NO: 2710711 - protein, 26 aa, Entamoeba histolytica
EKIHPQVIIEGWRIALKAAQEKLETM

SEQ ID NO: 2710712 - protein, 19 aa, Entamoeba histolytica
EKIISSFETYSLFTTQTTS

SEQ ID NO: 2710713 - protein, 18 aa, Entamoeba histolytica
EKIKDFIKLTKWNDINYA

SEQ ID NO: 2710714 - protein, 18 aa, Entamoeba histolytica
EKIKIKNISLLSKSWNKL

SEQ ID NO: 2710715 - protein, 25 aa, Entamoeba histolytica
EKIKKEHEALLEKLRLAKEEEEKIK

SEQ ID NO: 2710716 - protein, 20 aa, Entamoeba histolytica
EKILAAKTIMWNGPCGVFEI

SEQ ID NO: 2710717 - protein, 19 aa, Entamoeba histolytica
EKILHIHSMILKTTPSREA

SEQ ID NO: 2710718 - protein, 24 aa, Entamoeba histolytica
EKILKFYEKEGRKLPWRETTDKYK

SEQ ID NO: 2710719 - protein, 17 aa, Entamoeba histolytica
EKILRLLQQKVKDNEVK

SEQ ID NO: 2710720 - protein, 17 aa, Entamoeba histolytica
EKILSIVDILIHYSDDE

SEQ ID NO: 2710721 - protein, 23 aa, Entamoeba histolytica
EKINRLLFELFVTLIFNEREEDV

SEQ ID NO: 2710722 - protein, 20 aa, Entamoeba histolytica
EKIPLSGFPVTVIALEPLEL

SEQ ID NO: 2710723 - protein, 30 aa, Entamoeba histolytica
EKIQTILRDTLSKKIIVIPVDLPHTHDDDL

SEQ ID NO: 2710724 - protein, 18 aa, Entamoeba histolytica
EKIVIKALEECGCKVLNC

SEQ ID NO: 2710725 - protein, 27 aa, Entamoeba histolytica
EKIVIKNLFREGIIKTIFLTFNEIEYF

SEQ ID NO: 2710726 - protein, 28 aa, Entamoeba histolytica
EKIVTLLDFLVDICLDLGYFFETTRMRN

SEQ ID NO: 2710727 - protein, 26 aa, Entamoeba histolytica
EKKCLFVRKSIMPEKRYTCVAGFLEV

SEQ ID NO: 2710728 - protein, 28 aa, Entamoeba histolytica
EKKCLKKRMTFIPLNKIAPQMPNLNQIK

SEQ ID NO: 2710729 - protein, 24 aa, Entamoeba histolytica
EKKDGVLYVFDFGGGTLDISVIKF

SEQ ID NO: 2710730 - protein, 17 aa, Entamoeba histolytica
EKKDINEFIIPSTITKL

SEQ ID NO: 2710731 - protein, 25 aa, Entamoeba histolytica
EKKDLILHNILSNELPFPLIAHAIL

SEQ ID NO: 2710732 - protein, 19 aa, Entamoeba histolytica
EKKDMLNIDLLCDGLPENP

SEQ ID NO: 2710733 - protein, 25 aa, Entamoeba histolytica
EKKDVAEMILYLTKNRVSKTLIRVY

SEQ ID NO: 2710734 - protein, 23 aa, Entamoeba histolytica
EKKERYKPTLPARNTPSIAQPSK

SEQ ID NO: 2710735 - protein, 30 aa, Entamoeba histolytica
EKKETKDEKKLWLPPRKRISTYITEDQKKE

SEQ ID NO: 2710736 - protein, 31 aa, Entamoeba histolytica
EKKGILSFMYQILSKYRLGNCPVKMIDFTKW

SEQ ID NO: 2710737 - protein, 32 aa, Entamoeba histolytica
EKKIDVVGIEWIYDCLTCQLKIDRTGYCLNEE

SEQ ID NO: 2710738 - protein, 25 aa, Entamoeba histolytica
EKKIRLLNLFNLEKENEHFKCGIKN

SEQ ID NO: 2710739 - protein, 28 aa, Entamoeba histolytica
EKKKDLTVHFVFVSLNILCFRTSYKIIK

SEQ ID NO: 2710740 - protein, 23 aa, Entamoeba histolytica
EKKKFIITKPYDSTIRFVGVYGK

SEQ ID NO: 2710741 - protein, 25 aa, Entamoeba histolytica
EKKKIDIIKVFKIMWAKNSPKKQKT

SEQ ID NO: 2710742 - protein, 23 aa, Entamoeba histolytica
EKKKPITFKAKIHRKRKNEDVSQ

SEQ ID NO: 2710743 - protein, 22 aa, Entamoeba histolytica
EKKKQLKLFQHQNFFIVYQKEL

SEQ ID NO: 2710744 - protein, 33 aa, Entamoeba histolytica
EKKKVLIMFVNYYIYFFPLLDQITADQITQIIT

SEQ ID NO: 2710745 - protein, 25 aa, Entamoeba histolytica
EKKLDVMMKLLQFPSKFDDCSRNVK

SEQ ID NO: 2710746 - protein, 17 aa, Entamoeba histolytica
EKKLKYQIDKLLAETIA

SEQ ID NO: 2710747 - protein, 18 aa, Entamoeba histolytica
EKKLTKEPFLNMFIKRTV

SEQ ID NO: 2710748 - protein, 21 aa, Entamoeba histolytica
EKKMMGMDINKIVISLIETVS

SEQ ID NO: 2710749 - protein, 36 aa, Entamoeba histolytica
EKKNRVLFMYFDLFMKYLQFVQPILTLKVSISQQIY

SEQ ID NO: 2710750 - protein, 24 aa, Entamoeba histolytica
EKKNVGMIKMFNPRLHEVDLQKEV

SEQ ID NO: 2710751 - protein, 17 aa, Entamoeba histolytica
EKKPRRPGLIQHETLQQ

SEQ ID NO: 2710752 - protein, 29 aa, Entamoeba histolytica
EKKRQMEKALKQGAAAGGVKKVKKVKKVK

SEQ ID NO: 2710753 - protein, 24 aa, Entamoeba histolytica
EKKVQMMLNIVNSKPLPRSDNGET

SEQ ID NO: 2710754 - protein, 24 aa, Entamoeba histolytica
EKKVTLVLPSFDGSTRPGLAKLEP

SEQ ID NO: 2710755 - protein, 25 aa, Entamoeba histolytica
EKKYDIAITTSCGMLDYIVVESIEG

SEQ ID NO: 2710756 - protein, 44 aa, Entamoeba histolytica; identical to SEQ ID NO: 2522533

SEQ ID NO: 2710757 - protein, 21 aa, Entamoeba histolytica
EKLFCLYNLPFYFDDQTEVLN

SEQ ID NO: 2710758 - protein, 22 aa, Entamoeba histolytica
EKLGYKFKYRTTKPAKMTKKLE

SEQ ID NO: 2710759 - protein, 27 aa, Entamoeba histolytica
EKLHVQYLPISLQLIKMRLYLTINYNT

SEQ ID NO: 2710760 - protein, 25 aa, Entamoeba histolytica
EKLKCQEIHIFYYRGQELNLDKSTA

SEQ ID NO: 2710761 - protein, 26 aa, Entamoeba histolytica
EKLKCQEIHIFYYRGQELNLDKSTAK

SEQ ID NO: 2710762 - protein, 17 aa, Entamoeba histolytica
EKLLLLVRDFVEVLKQL

SEQ ID NO: 2710763 - protein, 26 aa, Entamoeba histolytica
EKLMSKAVLILYPTGLQIYIIPLHDC

SEQ ID NO: 2710764 - protein, 19 aa, Entamoeba histolytica
EKLNKEARKYCRKGDKENA

SEQ ID NO: 2710765 - protein, 25 aa, Entamoeba histolytica
EKLPDVCYSWWVLTSLIILGKVDWI

SEQ ID NO: 2710766 - protein, 21 aa, Entamoeba histolytica
EKLPLRIYGRINESGLGLTTW

SEQ ID NO: 2710767 - protein, 19 aa, Entamoeba histolytica
EKLPRLFIYGDYQINQFDI

SEQ ID NO: 2710768 - protein, 21 aa, Entamoeba histolytica
EKLQTLPYFCCISAAQGLGLD

SEQ ID NO: 2710769 - protein, 20 aa, Entamoeba histolytica
EKLRMRLIKKNTIRVKHPTP

SEQ ID NO: 2710770 - protein, 22 aa, Entamoeba histolytica
EKLSLSIFFRITKVIQRLIDSL

SEQ ID NO: 2710771 - protein, 26 aa, Entamoeba histolytica
EKMEPLTTMLFKSANVVFIVYQIGHP

SEQ ID NO: 2710772 - protein, 25 aa, Entamoeba histolytica
EKMERVHLMYFLKGQIKGSDIILVV

SEQ ID NO: 2710773 - protein, 17 aa, Entamoeba histolytica
EKMLLSCDVGITSAVIQ

SEQ ID NO: 2710774 - protein, 23 aa, Entamoeba histolytica
EKMNIIEYRNNITKWKRLMNMKK

SEQ ID NO: 2710775 - protein, 17 aa, Entamoeba histolytica
EKMSILNSLKRKAKLLY

SEQ ID NO: 2710776 - protein, 32 aa, Entamoeba histolytica
EKMVRVSGKFFLKWRITELKPEYLNSGDVFII

SEQ ID NO: 2710777 - protein, 22 aa, Entamoeba histolytica
EKNCDYLIFTRVTKGNYKDISV

SEQ ID NO: 2710778 - protein, 28 aa, Entamoeba histolytica
EKNDIIIELLQLLKYLHSIDIVHRDIKP

SEQ ID NO: 2710779 - protein, 24 aa, Entamoeba histolytica
EKNDQFAFHLFLFATQMGNQKAQI

SEQ ID NO: 2710780 - protein, 23 aa, Entamoeba histolytica
EKNEFLINTLPIKIYQPITIQRK

SEQ ID NO: 2710781 - protein, 32 aa, Entamoeba histolytica
EKNEIFFMDNFMMPIYLHDSLLRAQKFSALSK

SEQ ID NO: 2710782 - protein, 22 aa, Entamoeba histolytica
EKNKFTYIITQTESFISASISY

SEQ ID NO: 2710783 - protein, 35 aa, Entamoeba histolytica; identical to SEQ ID NO: 2522556

SEQ ID NO: 2710784 - protein, 30 aa, Entamoeba histolytica; identical to SEQ ID NO: 2522557

SEQ ID NO: 2710785 - protein, 38 aa, Entamoeba histolytica
EKNKRIFTQNFLFDLCLEYGFWFESKPSRKSKKSHQME

SEQ ID NO: 2710786 - protein, 24 aa, Entamoeba histolytica
EKNKYIRFFTKYCVKYYHKLKKGY

SEQ ID NO: 2710787 - protein, 22 aa, Entamoeba histolytica
EKNTQDLLLFGPSPGLGSAEAY

SEQ ID NO: 2710788 - protein, 31 aa, Entamoeba histolytica
EKPIFEEFLMTWGVVLIMKGDYTLIPELTKI

SEQ ID NO: 2710789 - protein, 18 aa, Entamoeba histolytica
EKQDWKSFLFPFAADIRP

SEQ ID NO: 2710790 - protein, 24 aa, Entamoeba histolytica
EKQFAQHIFISLTGFFDGIKKLKV

SEQ ID NO: 2710791 - protein, 21 aa, Entamoeba histolytica
EKQFQFFDYVFSSAKQIAGLF

SEQ ID NO: 2710792 - protein, 25 aa, Entamoeba histolytica
EKQIQFIPTTLFISNSFKGIYDEKI

SEQ ID NO: 2710793 - protein, 26 aa, Entamoeba histolytica
EKQKELRSMIYLLFSVSNELTKFNEN

SEQ ID NO: 2710794 - protein, 17 aa, Entamoeba histolytica
EKQPFEIKLKYIETFIP

SEQ ID NO: 2710795 - protein, 26 aa, Entamoeba histolytica
EKQQGVSFVMPKFHDITISQIVEGIK

SEQ ID NO: 2710796 - protein, 23 aa, Entamoeba histolytica
EKQRYLEDIGSLAGFKVPQVPEE

SEQ ID NO: 2710797 - protein, 37 aa, Entamoeba histolytica
EKQYKTIFWEILPIYHINCIFLHRFERYYGTINSIDR

SEQ ID NO: 2710798 - protein, 33 aa, Entamoeba histolytica
EKRDFERGIYLEELQQFLPIEEKEEREEAINET

SEQ ID NO: 2710799 - protein, 19 aa, Entamoeba histolytica
EKRELRLKSDRLSNVNEAT

SEQ ID NO: 2710800 - protein, 27 aa, Entamoeba histolytica
EKRERKTLLEMYGIKGLKEESIKVLVA

SEQ ID NO: 2710801 - protein, 26 aa, Entamoeba histolytica
EKRIIQNLFYIWSMFNKEKVLKAITF

SEQ ID NO: 2710802 - protein, 22 aa, Entamoeba histolytica
EKRKDCILVAKTNEKFVDVFCG

SEQ ID NO: 2710803 - protein, 25 aa, Entamoeba histolytica
EKRKPVPLYLDLNDTGLLLNEAVVP

SEQ ID NO: 2710804 - protein, 29 aa, Entamoeba histolytica
EKRKSVVAPKKPLSPASKKIVRIGGVEKS

SEQ ID NO: 2710805 - protein, 17 aa, Entamoeba histolytica
EKRLSKRIRKLKRQLYD

SEQ ID NO: 2710806 - protein, 28 aa, Entamoeba histolytica
EKRTIFSPVMFPMAPSFPPVIFPSYEEK

SEQ ID NO: 2710807 - protein, 24 aa, Entamoeba histolytica
EKRVIPFLIFYSSRGKITQLLCQV

SEQ ID NO: 2710808 - protein, 17 aa, Entamoeba histolytica
EKRWSLYRLMYNEETNS

SEQ ID NO: 2710809 - protein, 22 aa, Entamoeba histolytica
EKRYIRLLCIVYRLMDVDADGF

SEQ ID NO: 2710810 - protein, 32 aa, Entamoeba histolytica
EKSKENYHQIRLFKFTFWVTSVDIEEIEQPSQ

SEQ ID NO: 2710811 - protein, 20 aa, Entamoeba histolytica
EKSLNPFWCEEFPAVVEDGE

SEQ ID NO: 2710812 - protein, 18 aa, Entamoeba histolytica
EKSVIQIFDEIVSKKIPI

SEQ ID NO: 2710813 - protein, 21 aa, Entamoeba histolytica
EKTDTTLLWAIPKTGRMHQIR

SEQ ID NO: 2710814 - protein, 24 aa, Entamoeba histolytica
EKTGKVVKLWQPSLSDFKEKVKED

SEQ ID NO: 2710815 - protein, 24 aa, Entamoeba histolytica
EKTLFKYQMSHYHWFSSFEYYHMI

SEQ ID NO: 2710816 - protein, 18 aa, Entamoeba histolytica
EKTLKGLQEGLKSTIILI

SEQ ID NO: 2710817 - protein, 24 aa, Entamoeba histolytica
EKTNRPYYLRLSLNKETPKIEVHG

SEQ ID NO: 2710818 - protein, 26 aa, Entamoeba histolytica
EKTQNLIPPLVSLLEEAKQTIPDWLE

SEQ ID NO: 2710819 - protein, 28 aa, Entamoeba histolytica
EKTTRCLLFYLMYFLGHSQMFDGNESFQ

SEQ ID NO: 2710820 - protein, 26 aa, Entamoeba histolytica
EKVEGISPHFIFNVDEFGFQLKIFDD

SEQ ID NO: 2710821 - protein, 18 aa, Entamoeba histolytica
EKVFIQNIDFTTSASMKP

SEQ ID NO: 2710822 - protein, 22 aa, Entamoeba histolytica
EKVFLKTIIQYFTDCSTILKFV

SEQ ID NO: 2710823 - protein, 24 aa, Entamoeba histolytica
EKVKDACVPFILPTIKDIHGVYEK

SEQ ID NO: 2710824 - protein, 27 aa, Entamoeba histolytica
EKVKEALNLLLIWQTRQILPVQIEATI

SEQ ID NO: 2710825 - protein, 19 aa, Entamoeba histolytica
EKVLDHLLTPFPSIPLNQI

SEQ ID NO: 2710826 - protein, 34 aa, Entamoeba histolytica
EKVQIRQIILYPPAVIKKLKYIVKLNYLRDVVVA

SEQ ID NO: 2710827 - protein, 24 aa, Entamoeba histolytica
EKVQQRKGFLSRRSETQSQTNELV

SEQ ID NO: 2710828 - protein, 31 aa, Entamoeba histolytica
EKVRRIVLPHQLRFLMVYGCKDIVALDNLKN

SEQ ID NO: 2710829 - protein, 22 aa, Entamoeba histolytica
EKYFNRIRHSFKILTGILMSEV

SEQ ID NO: 2710830 - protein, 26 aa, Entamoeba histolytica
EKYFPRDRSFVDWLLCKTINGERASL

SEQ ID NO: 2710831 - protein, 27 aa, Entamoeba histolytica
EKYLYVSRMLLYHRNIPLNECFVSTTL

SEQ ID NO: 2710832 - protein, 27 aa, Entamoeba histolytica
EKYPKPQKLCYSARVSPYFTFSKTNES

SEQ ID NO: 2710833 - protein, 30 aa, Entamoeba histolytica
EKYPPSMFIHPYDFFPFDRKYEEQRKEDGM

SEQ ID NO: 2710834 - protein, 23 aa, Entamoeba histolytica
EKYPRNLKIIELLISLSKENTSN

SEQ ID NO: 2710835 - protein, 25 aa, Entamoeba histolytica
EKYRSMVGMYYRGASGAIIVYDITS

SEQ ID NO: 2710836 - protein, 29 aa, Entamoeba histolytica
EKYSARQLRILFLMQSWDAVINFSDSALD

SEQ ID NO: 2710837 - protein, 38 aa, Entamoeba histolytica
EKYSKFVGIKLTKKCCFSYPGKLQSIIGLYLCREIENK

SEQ ID NO: 2710838 - protein, 25 aa, Entamoeba histolytica
EKYVNNLMILVKLFHIIHDHKSEIL

SEQ ID NO: 2710839 - protein, 17 aa, Entamoeba histolytica
ELAAYYFSKANTSFSHV

SEQ ID NO: 2710840 - protein, 27 aa, Entamoeba histolytica
ELAIYEFIHFLVQIYDLLFDNACEIDI

SEQ ID NO: 2710841 - protein, 32 aa, Entamoeba histolytica; identical to SEQ ID NO: 2522625

SEQ ID NO: 2710842 - protein, 17 aa, Entamoeba histolytica
ELALIPQSDKKTGNENE

SEQ ID NO: 2710843 - protein, 27 aa, Entamoeba histolytica
ELALKKFFKFFTPETLDRPYLTTDISI

SEQ ID NO: 2710844 - protein, 26 aa, Entamoeba histolytica
ELANRCYWYRPNVLKRKWGSYRSIHN

SEQ ID NO: 2710845 - protein, 21 aa, Entamoeba histolytica
ELAPTHPIRLGLALNFSVFYF

SEQ ID NO: 2710846 - protein, 17 aa, Entamoeba histolytica
ELAQMMYIPILDGVLDI

SEQ ID NO: 2710847 - protein, 20 aa, Entamoeba histolytica
ELARQHLFDYLPKVVKKIDC

SEQ ID NO: 2710848 - protein, 17 aa, Entamoeba histolytica
ELASRLCLNALIKKNSK

SEQ ID NO: 2710849 - protein, 32 aa, Entamoeba histolytica
ELCENRDIFYLRDYLQLAIETSGLLVLDHSNE

SEQ ID NO: 2710850 - protein, 32 aa, Entamoeba histolytica
ELCINKILLMNLYQFFMLPEQISLSQVKYFVE

SEQ ID NO: 2710851 - protein, 23 aa, Entamoeba histolytica
ELCLRWQSLIELSLPPKTYECIF

SEQ ID NO: 2710852 - protein, 19 aa, Entamoeba histolytica
ELCNDKIYFFGKKEKKNVL

SEQ ID NO: 2710853 - protein, 22 aa, Entamoeba histolytica
ELCQQYWRDTLLSLIGETIPSA

SEQ ID NO: 2710854 - protein, 18 aa, Entamoeba histolytica
ELDEFIFLLSSKAGGCGL

SEQ ID NO: 2710855 - protein, 17 aa, Entamoeba histolytica
ELDELLKAKWPKDMKMN

SEQ ID NO: 2710856 - protein, 33 aa, Entamoeba histolytica
ELDIIPIDIFNIINPLPFILSPIHLFNECSTPV

SEQ ID NO: 2710857 - protein, 17 aa, Entamoeba histolytica
ELDKIKRKYTAFKKVFE

SEQ ID NO: 2710858 - protein, 18 aa, Entamoeba histolytica
ELDKIKRKYTAFKKVFEE

SEQ ID NO: 2710859 - protein, 24 aa, Entamoeba histolytica
ELDKLSARLFFKSTIIYVGENDMS

SEQ ID NO: 2710860 - protein, 26 aa, Entamoeba histolytica
ELDLFVELFRSLCNVPIISSGHKFKT

SEQ ID NO: 2710861 - protein, 26 aa, Entamoeba histolytica
ELDMNKLLKFMLVNKIVRATSTSKEW

SEQ ID NO: 2710862 - protein, 23 aa, Entamoeba histolytica
ELEAPIPRIYILQKLVISAEANI

SEQ ID NO: 2710863 - protein, 29 aa, Entamoeba histolytica
ELEESKIKDIFLLMKRMLINLDMDQIEFK

SEQ ID NO: 2710864 - protein, 18 aa, Entamoeba histolytica
ELELTYCPLLKKIHIPSS

SEQ ID NO: 2710865 - protein, 18 aa, Entamoeba histolytica
ELENFHKSMQTLLEDLKG

SEQ ID NO: 2710866 - protein, 21 aa, Entamoeba histolytica
ELEQILPLIYQAIMNKLNHPN

SEQ ID NO: 2710867 - protein, 19 aa, Entamoeba histolytica
ELERLLKKMGLQIESDDIE

SEQ ID NO: 2710868 - protein, 26 aa, Entamoeba histolytica
ELESEVFWFFKDLMEIMGDWFKGGDD

SEQ ID NO: 2710869 - protein, 28 aa, Entamoeba histolytica
ELETPFNEYLFIKILTAIHNQWSSYTSN

SEQ ID NO: 2710870 - protein, 18 aa, Entamoeba histolytica
ELEWLIEIEFIHDGDISS

SEQ ID NO: 2710871 - protein, 28 aa, Entamoeba histolytica
ELFDVKRNFLILLNFFVKTGHFNDQMVE

SEQ ID NO: 2710872 - protein, 24 aa, Entamoeba histolytica
ELFHEQRVCFSLKGAKIIMVSSEE

SEQ ID NO: 2710873 - protein, 20 aa, Entamoeba histolytica
ELFKMLYREMTMGLTGPFIF

SEQ ID NO: 2710874 - protein, 17 aa, Entamoeba histolytica
ELFLWAFKEENCNLKTA

SEQ ID NO: 2710875 - protein, 20 aa, Entamoeba histolytica
ELFMKGVILYTDYKGLIIVE

SEQ ID NO: 2710876 - protein, 44 aa, Entamoeba histolytica; identical to SEQ ID NO: 2522665

SEQ ID NO: 2710877 - protein, 20 aa, Entamoeba histolytica
ELFTILQRICEIIGASLDTL

SEQ ID NO: 2710878 - protein, 24 aa, Entamoeba histolytica
ELGASCFAHWFQPLSQTTARKYDS

SEQ ID NO: 2710879 - protein, 24 aa, Entamoeba histolytica
ELGDCLSMVFMFASYRVSKGEKAE

SEQ ID NO: 2710880 - protein, 24 aa, Entamoeba histolytica
ELGDLPLSVFLMEKPEDIKKVEEI

SEQ ID NO: 2710881 - protein, 23 aa, Entamoeba histolytica
ELGIEKIIQLDLKLSKNSYALND

SEQ ID NO: 2710882 - protein, 24 aa, Entamoeba histolytica
ELGKKILPPPQLRTKLLGQMRLLN

SEQ ID NO: 2710883 - protein, 17 aa, Entamoeba histolytica
ELGLIFVTSLFSCSKFE

SEQ ID NO: 2710884 - protein, 18 aa, Entamoeba histolytica
ELGPFHESFTAIVGANGC

SEQ ID NO: 2710885 - protein, 27 aa, Entamoeba histolytica
ELHHQSNLAYFLLRRALRNKNIIGHQF

SEQ ID NO: 2710886 - protein, 24 aa, Entamoeba histolytica
ELHKWLLKAFSILNGLPKKKYEYD

SEQ ID NO: 2710887 - protein, 34 aa, Entamoeba histolytica
ELHNPVIRMFPPNTPILCEKPILGYDLLPNIRMG

SEQ ID NO: 2710888 - protein, 21 aa, Entamoeba histolytica
ELIDFIVSSLPKRDSIKFKVS

SEQ ID NO: 2710889 - protein, 22 aa, Entamoeba histolytica
ELIDPALLRPGRFDCLIEVPKP

SEQ ID NO: 2710890 - protein, 19 aa, Entamoeba histolytica
ELIEDVFGFLPEEIADTLT

SEQ ID NO: 2710891 - protein, 27 aa, Entamoeba histolytica
ELIELFDSLFILEQLYFHGKMWNHTMK

SEQ ID NO: 2710892 - protein, 33 aa, Entamoeba histolytica
ELIELPIQHFGRLGAFLFYLMSKTSEPSQIIKQ

SEQ ID NO: 2710893 - protein, 24 aa, Entamoeba histolytica
ELIEQLLIEFILEFTLKIRQDEPT

SEQ ID NO: 2710894 - protein, 36 aa, Entamoeba histolytica
ELIETLIIPDIPITSPPVFSPCDSLLFSSRRLFDMR

SEQ ID NO: 2710895 - protein, 25 aa, Entamoeba histolytica
ELIHSYKYPPIRPLNPILADINEIN

SEQ ID NO: 2710896 - protein, 23 aa, Entamoeba histolytica
ELIKEYFPQLSQYSRLNLTAIYI

SEQ ID NO: 2710897 - protein, 19 aa, Entamoeba histolytica
ELIKNYLLEWTNSYDYEKL

SEQ ID NO: 2710898 - protein, 22 aa, Entamoeba histolytica
ELIKSMIIVDPLKRASIAAMLD

SEQ ID NO: 2710899 - protein, 28 aa, Entamoeba histolytica
ELIKSMKYLELFKIKKFNVFPRIINSQK

SEQ ID NO: 2710900 - protein, 19 aa, Entamoeba histolytica
ELILDLFQFDQIIEDAQYI

SEQ ID NO: 2710901 - protein, 23 aa, Entamoeba histolytica
ELINNYMIPLQKNGLITEKQYKT

SEQ ID NO: 2710902 - protein, 26 aa, Entamoeba histolytica
ELIPEFYYLPEFLINENHFNFGILPD

SEQ ID NO: 2710903 - protein, 22 aa, Entamoeba histolytica
ELIPGVLFIDEVHMLDAECFAF

SEQ ID NO: 2710904 - protein, 17 aa, Entamoeba histolytica
ELIPVIKIREMQIFKLI

SEQ ID NO: 2710905 - protein, 31 aa, Entamoeba histolytica
ELIQDMCLMMNMVVKYRSTLFRAVVELEMKK

SEQ ID NO: 2710906 - protein, 17 aa, Entamoeba histolytica
ELIRIKEFQPAFPDLTR

SEQ ID NO: 2710907 - protein, 19 aa, Entamoeba histolytica
ELIRLIKRFRYSKKTTVVI

SEQ ID NO: 2710908 - protein, 20 aa, Entamoeba histolytica
ELISFVEYLWNIISMDDIQN

SEQ ID NO: 2710909 - protein, 22 aa, Entamoeba histolytica
ELISLYENTFLKAPALIVVGNT

SEQ ID NO: 2710910 - protein, 22 aa, Entamoeba histolytica
ELIYYYNLYRYANDPANWIAAA

SEQ ID NO: 2710911 - protein, 22 aa, Entamoeba histolytica
ELKDAFDMFDSSKKGYLDKDDV

SEQ ID NO: 2710912 - protein, 18 aa, Entamoeba histolytica
ELKDKLHLILPYKENELI

SEQ ID NO: 2710913 - protein, 26 aa, Entamoeba histolytica
ELKDQTIFGWFLCGTIPLMESKDTLE

SEQ ID NO: 2710914 - protein, 18 aa, Entamoeba histolytica
ELKFNIETQIKKLTQKRV

SEQ ID NO: 2710915 - protein, 25 aa, Entamoeba histolytica
ELKGSLRCGILYLSNTTKIIGYAGS

SEQ ID NO: 2710916 - protein, 21 aa, Entamoeba histolytica
ELKHFIAESLVPPIDFFIPQE

SEQ ID NO: 2710917 - protein, 20 aa, Entamoeba histolytica
ELKKAYKKLALKWHPDRNIN

SEQ ID NO: 2710918 - protein, 20 aa, Entamoeba histolytica
ELKKAYRKKALKYHPDKNPG

SEQ ID NO: 2710919 - protein, 19 aa, Entamoeba histolytica
ELKKRKVHQLITREMLENT

SEQ ID NO: 2710920 - protein, 21 aa, Entamoeba histolytica
ELKKVLFLSLFIRITNINQQD

SEQ ID NO: 2710921 - protein, 25 aa, Entamoeba histolytica
ELKLFYNSKVIVYKHLIENGYKVRP

SEQ ID NO: 2710922 - protein, 23 aa, Entamoeba histolytica
ELKMVLFKGSKRFDSLKLIFDKF

SEQ ID NO: 2710923 - protein, 26 aa, Entamoeba histolytica
ELKNDQMILILIRHGASLNITNKENK

SEQ ID NO: 2710924 - protein, 17 aa, Entamoeba histolytica
ELKPILEYYQTLVMKIT

SEQ ID NO: 2710925 - protein, 18 aa, Entamoeba histolytica
ELKQILKSARLKPSHLAN

SEQ ID NO: 2710926 - protein, 25 aa, Entamoeba histolytica
ELKQNHLPFYLLKNRHSKDSIFLFD

SEQ ID NO: 2710927 - protein, 22 aa, Entamoeba histolytica
ELKSKLYSKFSGEFPFNKSIEH

SEQ ID NO: 2710928 - protein, 17 aa, Entamoeba histolytica
ELKTFFVALIDNYYELF

SEQ ID NO: 2710929 - protein, 20 aa, Entamoeba histolytica
ELKYLLTTVMIRRLKHDVLK

SEQ ID NO: 2710930 - protein, 17 aa, Entamoeba histolytica
ELLFQLYSCYFCNFRFN

SEQ ID NO: 2710931 - protein, 22 aa, Entamoeba histolytica
ELLGLMYCGIPSINSLESLYMC

SEQ ID NO: 2710932 - protein, 24 aa, Entamoeba histolytica
ELLGMALLPTQTFYKSLNIGYKIF

SEQ ID NO: 2710933 - protein, 20 aa, Entamoeba histolytica
ELLHQIFSYLPLEDLSSCLL

SEQ ID NO: 2710934 - protein, 20 aa, Entamoeba histolytica
ELLIIGWSKERVKGTLVWLL

SEQ ID NO: 2710935 - protein, 24 aa, Entamoeba histolytica
ELLLDNNKLLSPPLLSTLSNLRSL

SEQ ID NO: 2710936 - protein, 17 aa, Entamoeba histolytica
ELLLFESKLVVTQYKFG

SEQ ID NO: 2710937 - protein, 20 aa, Entamoeba histolytica
ELLLYIALTHIYFHSEIKEL

SEQ ID NO: 2710938 - protein, 24 aa, Entamoeba histolytica
ELLNRYIFCHTKVSEVLKLFNGNA

SEQ ID NO: 2710939 - protein, 23 aa, Entamoeba histolytica
ELLPPGLTFGYYKNQRYIVDFCN

SEQ ID NO: 2710940 - protein, 24 aa, Entamoeba histolytica
ELLPPGLTFGYYKNQRYIVDFCNK

SEQ ID NO: 2710941 - protein, 19 aa, Entamoeba histolytica
ELLPSICLHQVIIPLPAHR

SEQ ID NO: 2710942 - protein, 19 aa, Entamoeba histolytica
ELLQKIKAFRKDTGSLMAP

SEQ ID NO: 2710943 - protein, 18 aa, Entamoeba histolytica
ELLQMSEKLGYKFKYRTT

SEQ ID NO: 2710944 - protein, 27 aa, Entamoeba histolytica
ELLQSLHLSVVLLPLLFTNDELNKNIN

SEQ ID NO: 2710945 - protein, 17 aa, Entamoeba histolytica
ELLRRIYVAKYKELCQN

SEQ ID NO: 2710946 - protein, 19 aa, Entamoeba histolytica
ELLTADKRKIPLPGDIIYC

SEQ ID NO: 2710947 - protein, 17 aa, Entamoeba histolytica
ELLTDKFITLSCHKNGF

SEQ ID NO: 2710948 - protein, 17 aa, Entamoeba histolytica
ELLWEVIDPIFNNNVED

SEQ ID NO: 2710949 - protein, 18 aa, Entamoeba histolytica
ELMFRKKNAKPVSSIPKT

SEQ ID NO: 2710950 - protein, 18 aa, Entamoeba histolytica
ELMFTDLLAESYNYIPLL

SEQ ID NO: 2710951 - protein, 21 aa, Entamoeba histolytica
ELMKEYVLFVNSLIAYQKNGS

SEQ ID NO: 2710952 - protein, 20 aa, Entamoeba histolytica
ELMKLGAKFIYLSNGSFMQK

SEQ ID NO: 2710953 - protein, 26 aa, Entamoeba histolytica
ELMTQAEGLLRMGLHPTIIADGYRTG

SEQ ID NO: 2710954 - protein, 29 aa, Entamoeba histolytica
ELMYKYHHELMYIYTYDRDWYYPYISRDY

SEQ ID NO: 2710955 - protein, 39 aa, Entamoeba histolytica; identical to SEQ ID NO: 2522753

SEQ ID NO: 2710956 - protein, 35 aa, Entamoeba histolytica
ELNIPFKNLLPFYYNLKHPFIPTSLTGIIIEAWEC

SEQ ID NO: 2710957 - protein, 22 aa, Entamoeba histolytica
ELNIYNVEILLKLISLQGIAND

SEQ ID NO: 2710958 - protein, 23 aa, Entamoeba histolytica
ELNKKLWVGIFVVMRQFSNQYCQ

SEQ ID NO: 2710959 - protein, 25 aa, Entamoeba histolytica
ELNKNYAPALIGLALCELKDHKDGV

SEQ ID NO: 2710960 - protein, 26 aa, Entamoeba histolytica
ELNKYKTLLLYPNLPTNFQEIISNNT

SEQ ID NO: 2710961 - protein, 25 aa, Entamoeba histolytica
ELNLANAVLFCILDLNNDGKIPTDD

SEQ ID NO: 2710962 - protein, 35 aa, Entamoeba histolytica
ELNLENQMEIWPRIVKLYHYIGNESDILLDGTFEY

SEQ ID NO: 2710963 - protein, 18 aa, Entamoeba histolytica
ELNMYCSASLLTYYSKDL

SEQ ID NO: 2710964 - protein, 32 aa, Entamoeba histolytica
ELNNKPIFVFGYLDQGYWPDGLYTAPTDEALK

SEQ ID NO: 2710965 - protein, 23 aa, Entamoeba histolytica
ELNNVFLIIAIYNSYIFDKPFKD

SEQ ID NO: 2710966 - protein, 24 aa, Entamoeba histolytica
ELNPWNSYVLLCKEGIYVWRGQYS

SEQ ID NO: 2710967 - protein, 26 aa, Entamoeba histolytica
ELNQIQTFYLNPLFIHLAHSDYRKRT

SEQ ID NO: 2710968 - protein, 20 aa, Entamoeba histolytica
ELNQSYRIQCQCGCYINSWC

SEQ ID NO: 2710969 - protein, 27 aa, Entamoeba histolytica
ELNRNEFLLALALLKNQKAGFAIPKKV

SEQ ID NO: 2710970 - protein, 33 aa, Entamoeba histolytica
ELNVLPMIMDDYKQCVWLLIGMKDLGGKIRKPG

SEQ ID NO: 2710971 - protein, 26 aa, Entamoeba histolytica
ELNVTPLENFPLPLSQQFFLNYGDIT

SEQ ID NO: 2710972 - protein, 22 aa, Entamoeba histolytica
ELPDCILPCIVSTALELIKRHE

SEQ ID NO: 2710973 - protein, 23 aa, Entamoeba histolytica
ELPIEIWLHVVPQIIARIQSEVG

SEQ ID NO: 2710974 - protein, 35 aa, Entamoeba histolytica
ELPIFKRCIWRYPPQYFYILLNPRFVAQKLTEAHV

SEQ ID NO: 2710975 - protein, 20 aa, Entamoeba histolytica
ELPIKIVIIGDLGVGKTSLI

SEQ ID NO: 2710976 - protein, 20 aa, Entamoeba histolytica
ELPLIKKLIGSVEPTIIVII

SEQ ID NO: 2710977 - protein, 28 aa, Entamoeba histolytica
ELPLVHCPYFFFRWMNYTYKQTDLFNTS

SEQ ID NO: 2710978 - protein, 17 aa, Entamoeba histolytica
ELPPINFLTTKPTRRHN

SEQ ID NO: 2710979 - protein, 27 aa, Entamoeba histolytica
ELPSEKQFIFLNILRNNLLKEESIDVI

SEQ ID NO: 2710980 - protein, 30 aa, Entamoeba histolytica; identical to SEQ ID NO: 2522778

SEQ ID NO: 2710981 - protein, 32 aa, Entamoeba histolytica
ELPTNPVLTKQIKLLISLFDKKKKQEVQMEVE

SEQ ID NO: 2710982 - protein, 24 aa, Entamoeba histolytica
ELQAIVCDFINIPIKWEESSFEGC

SEQ ID NO: 2710983 - protein, 23 aa, Entamoeba histolytica
ELQFKTYPIVLYPQLSVNEQTKH

SEQ ID NO: 2710984 - protein, 20 aa, Entamoeba histolytica
ELQMAWYKDDYTRCYKQTAT

SEQ ID NO: 2710985 - protein, 25 aa, Entamoeba histolytica
ELQQLFPFVDPDIIKTALIDCNYDK

SEQ ID NO: 2710986 - protein, 18 aa, Entamoeba histolytica
ELQVFLRKMTPKQFLCVL

SEQ ID NO: 2710987 - protein, 17 aa, Entamoeba histolytica
ELRAFCLFSPYTNKQRS

SEQ ID NO: 2710988 - protein, 35 aa, Entamoeba histolytica
ELRAILCTLTPEHPQYFAEIIVAGPSADFELIGDD

SEQ ID NO: 2710989 - protein, 24 aa, Entamoeba histolytica
ELREYNVLYLKYVNEGIITISSHK

SEQ ID NO: 2710990 - protein, 18 aa, Entamoeba histolytica
ELRKLGFKPLEQVSLEPF

SEQ ID NO: 2710991 - protein, 21 aa, Entamoeba histolytica
ELRKYKRMYDSLKPNELKLEY

SEQ ID NO: 2710992 - protein, 21 aa, Entamoeba histolytica
ELRLKQQFFFTSASLQDIVRR

SEQ ID NO: 2710993 - protein, 22 aa, Entamoeba histolytica
ELRPELILAINGLLQDLNHPNE

SEQ ID NO: 2710994 - protein, 18 aa, Entamoeba histolytica
ELRRQLIPILVEKDKLKE

SEQ ID NO: 2710995 - protein, 21 aa, Entamoeba histolytica
ELRYLNDEILLPVNPKAQSLI

SEQ ID NO: 2710996 - protein, 24 aa, Entamoeba histolytica
ELSAKYLPRFFKHNNFSSFVRQLN

SEQ ID NO: 2710997 - protein, 23 aa, Entamoeba histolytica
ELSFPLQFILLEVISINQYQYLE

SEQ ID NO: 2710998 - protein, 27 aa, Entamoeba histolytica
ELSLPFKNYSTNSLFFSLPLVSLNNII

SEQ ID NO: 2710999 - protein, 35 aa, Entamoeba histolytica
ELSNDFINLLKFKIVLKREWLFDEIDINEYLRIIV

SEQ ID NO: 2711000 - protein, 28 aa, Entamoeba histolytica
ELSYFIADINIPLFHVLLSRMNDITEES

SEQ ID NO: 2711001 - protein, 26 aa, Entamoeba histolytica
ELTDLARGIYMKWKGRELVRENPTLT

SEQ ID NO: 2711002 - protein, 21 aa, Entamoeba histolytica
ELTEVQMLCLLEIIDYTVKHQ

SEQ ID NO: 2711003 - protein, 31 aa, Entamoeba histolytica
ELTISYTFPSILPHRLKYFKENYGFFCDCPL

SEQ ID NO: 2711004 - protein, 24 aa, Entamoeba histolytica
ELTLFNVQVLLNNLFGVKLEQVIQ

SEQ ID NO: 2711005 - protein, 24 aa, Entamoeba histolytica
ELTNCYSYNNGYYVYVLCPGKNVT

SEQ ID NO: 2711006 - protein, 25 aa, Entamoeba histolytica
ELTQRQLAERTIILKNQVKLQKDDN

SEQ ID NO: 2711007 - protein, 21 aa, Entamoeba histolytica
ELTRAFGIAIRKLLSKHIISE

SEQ ID NO: 2711008 - protein, 22 aa, Entamoeba histolytica
ELTSSLFDPNSLMIQCDDINKG

SEQ ID NO: 2711009 - protein, 25 aa, Entamoeba histolytica
ELTTALFCEKYIDTLFKLKRINEFG

SEQ ID NO: 2711010 - protein, 27 aa, Entamoeba histolytica
ELTVFDLYQKFLFNYLKIETHPEVREA

SEQ ID NO: 2711011 - protein, 20 aa, Entamoeba histolytica
ELVDGYYNSLFIVSLKGKSI

SEQ ID NO: 2711012 - protein, 26 aa, Entamoeba histolytica
ELVDVVSFIHFISRYPIIPCNITDYI

SEQ ID NO: 2711013 - protein, 24 aa, Entamoeba histolytica
ELVEDILFAFTLDGQLHIYSTTQN

SEQ ID NO: 2711014 - protein, 22 aa, Entamoeba histolytica
ELVGALFLYLSSLEAPLFGHLS

SEQ ID NO: 2711015 - protein, 17 aa, Entamoeba histolytica
ELVIAPGFLPQKQEKKK

SEQ ID NO: 2711016 - protein, 18 aa, Entamoeba histolytica
ELVILLKAIVLGDESVSN

SEQ ID NO: 2711017 - protein, 22 aa, Entamoeba histolytica
ELVKYINNFKLPESIFDGILVN

SEQ ID NO: 2711018 - protein, 24 aa, Entamoeba histolytica
ELVQLMSIISYLSQPSLNETIFCM

SEQ ID NO: 2711019 - protein, 19 aa, Entamoeba histolytica
ELVVLNKITDYITKFIIEC

SEQ ID NO: 2711020 - protein, 20 aa, Entamoeba histolytica
ELWRQWAQPPPLKNKVVIAY

SEQ ID NO: 2711021 - protein, 17 aa, Entamoeba histolytica
ELYKILIQAVVVDKKVI

SEQ ID NO: 2711022 - protein, 18 aa, Entamoeba histolytica
ELYLLTLFEEYNILDLLK

SEQ ID NO: 2711023 - protein, 23 aa, Entamoeba histolytica
ELYNILSVLIKDIGTKESFGKRY

SEQ ID NO: 2711024 - protein, 29 aa, Entamoeba histolytica
ELYQNLMERNINCLLLHGGIDQIDRQNTI

SEQ ID NO: 2711025 - protein, 17 aa, Entamoeba histolytica
ELYRKRLLSFINSVFMV

SEQ ID NO: 2711026 - protein, 18 aa, Entamoeba histolytica
ELYSLFYETISIGLPMMP

SEQ ID NO: 2711027 - protein, 20 aa, Entamoeba histolytica
ELYTSKMLFAIADVGEFYFR

SEQ ID NO: 2711028 - protein, 19 aa, Entamoeba histolytica
EMCLSLLQNKYSCFCCTCE

SEQ ID NO: 2711029 - protein, 27 aa, Entamoeba histolytica
EMDYLYEQAALWLKWDKTPETRKEIED

SEQ ID NO: 2711030 - protein, 34 aa, Entamoeba histolytica
EMEIEKEFIIYNYLIYYILKLNTESPNTGIFRFC

SEQ ID NO: 2711031 - protein, 33 aa, Entamoeba histolytica
EMEIEKTFIIYNYLIYYILKLNTESPNTGLIRF

SEQ ID NO: 2711032 - protein, 26 aa, Entamoeba histolytica
EMEKKRMLIKLTLKDYIFARHDIGKG

SEQ ID NO: 2711033 - protein, 23 aa, Entamoeba histolytica
EMESYLVQMIYLMDFIYNDRTDS

SEQ ID NO: 2711034 - protein, 20 aa, Entamoeba histolytica
EMEYYFKGIFGGYSKIIFTL

SEQ ID NO: 2711035 - protein, 18 aa, Entamoeba histolytica
EMFMERFRIIKEFTEYMI

SEQ ID NO: 2711036 - protein, 23 aa, Entamoeba histolytica
EMGEKWRISEKKLKLLQNENDQL

SEQ ID NO: 2711037 - protein, 20 aa, Entamoeba histolytica
EMGYPLFEYGINSLYQTMGF

SEQ ID NO: 2711038 - protein, 25 aa, Entamoeba histolytica
EMHLDRPESYKLIYQNKKSPQELNV

SEQ ID NO: 2711039 - protein, 32 aa, Entamoeba histolytica; identical to SEQ ID NO: 2522843

SEQ ID NO: 2711040 - protein, 17 aa, Entamoeba histolytica
EMIINLTSVFYKLDYTN

SEQ ID NO: 2711041 - protein, 30 aa, Entamoeba histolytica
EMILLSMITCFGYKVQFVRPKHGCKALPYV

SEQ ID NO: 2711042 - protein, 19 aa, Entamoeba histolytica
EMINHYPIELPNEPKSLIH

SEQ ID NO: 2711043 - protein, 18 aa, Entamoeba histolytica
EMIVKYNVILLKDLDDMS

SEQ ID NO: 2711044 - protein, 26 aa, Entamoeba histolytica
EMIVLFTTFGLLYKANRLKNNPSTMH

SEQ ID NO: 2711045 - protein, 28 aa, Entamoeba histolytica
EMKAFLSWKYVRLERLVLSWLDIMATMI

SEQ ID NO: 2711046 - protein, 26 aa, Entamoeba histolytica
EMKHLQLFGIIVWALDGTLELRCKII

SEQ ID NO: 2711047 - protein, 22 aa, Entamoeba histolytica
EMKKFIALLVMKAGTKEKAIKI

SEQ ID NO: 2711048 - protein, 20 aa, Entamoeba histolytica
EMKLDCDYLLNGINLFNCYK

SEQ ID NO: 2711049 - protein, 17 aa, Entamoeba histolytica
EMKLYRLSETVMPSLNY

SEQ ID NO: 2711050 - protein, 20 aa, Entamoeba histolytica
EMKQLDTVYLMKVIPHIRDM

SEQ ID NO: 2711051 - protein, 26 aa, Entamoeba histolytica
EMLLCQMIQKYLYFISQHGWNIEMIK

SEQ ID NO: 2711052 - protein, 17 aa, Entamoeba histolytica
EMLLTWASSLPSLNVER

SEQ ID NO: 2711053 - protein, 33 aa, Entamoeba histolytica
EMLNKGFMPIIYDIFKYLPIKRQIVLCSATLTP

SEQ ID NO: 2711054 - protein, 25 aa, Entamoeba histolytica
EMLPQDYLQRLVSLSPRDVDLCLKA

SEQ ID NO: 2711055 - protein, 27 aa, Entamoeba histolytica
EMLSSNFIFFVNLFQRSSLDMAKEFSS

SEQ ID NO: 2711056 - protein, 17 aa, Entamoeba histolytica
EMMGFIDELSFNSLPDI

SEQ ID NO: 2711057 - protein, 20 aa, Entamoeba histolytica
EMNKKYLYVPKNPIVIKSFN

SEQ ID NO: 2711058 - protein, 17 aa, Entamoeba histolytica
EMNPWYTIAFKGVPDSV

SEQ ID NO: 2711059 - protein, 31 aa, Entamoeba histolytica; identical to SEQ ID NO: 2522872

SEQ ID NO: 2711060 - protein, 22 aa, Entamoeba histolytica
EMPQLTKAKWLSNSTFIVGDEL

SEQ ID NO: 2711061 - protein, 17 aa, Entamoeba histolytica
EMPVFTAFTAKGKLLEI

SEQ ID NO: 2711062 - protein, 20 aa, Entamoeba histolytica
EMQDSIICIPNFTAPDFFLF

SEQ ID NO: 2711063 - protein, 17 aa, Entamoeba histolytica
EMQQIVIAFIYSTINDY

SEQ ID NO: 2711064 - protein, 22 aa, Entamoeba histolytica
EMQYYFKHFPINQSIVSIISLL

SEQ ID NO: 2711065 - protein, 25 aa, Entamoeba histolytica
EMRESYLEDGFLLEKKFGTAQKHKV

SEQ ID NO: 2711066 - protein, 17 aa, Entamoeba histolytica
EMRNHLRKVGVTSFKKI

SEQ ID NO: 2711067 - protein, 43 aa, Entamoeba histolytica
EMRNHLRKVGVTSFKKISMINFLIFIYGYDWAEVVNAPQGGNV

SEQ ID NO: 2711068 - protein, 29 aa, Entamoeba histolytica
EMSNTLDYISLFLLTCVTTLIGESTKFLK

SEQ ID NO: 2711069 - protein, 18 aa, Entamoeba histolytica
EMVEFFNRFIKTCLKYIG

SEQ ID NO: 2711070 - protein, 30 aa, Entamoeba histolytica
EMVMTYKENFLLPCLSLADIPDLLNDKHPV

SEQ ID NO: 2711071 - protein, 26 aa, Entamoeba histolytica
EMVQYKWSLLINPYFGEGELKGIRVM

SEQ ID NO: 2711072 - protein, 24 aa, Entamoeba histolytica
EMYEFNSVRGCSYCYGFAAVRRFL

SEQ ID NO: 2711073 - protein, 22 aa, Entamoeba histolytica
ENAAVPIRKLIGLAGITEGDCK

SEQ ID NO: 2711074 - protein, 24 aa, Entamoeba histolytica
ENAINLMIICKQVFQVFLRKTNEN

SEQ ID NO: 2711075 - protein, 25 aa, Entamoeba histolytica
ENAKKILVILTKIYQSFIPQGETPL

SEQ ID NO: 2711076 - protein, 22 aa, Entamoeba histolytica
ENALPGMAIRTGANPLVYDCNL

SEQ ID NO: 2711077 - protein, 28 aa, Entamoeba histolytica
ENAQEFVQLFYDNIPRRSPTHLSASVNP

SEQ ID NO: 2711078 - protein, 25 aa, Entamoeba histolytica
ENATKKFFTLLFNGKSNLTKKIMKL

SEQ ID NO: 2711079 - protein, 19 aa, Entamoeba histolytica
ENCCFLKKIEIPTGITSIG

SEQ ID NO: 2711080 - protein, 25 aa, Entamoeba histolytica
ENCIFLESVLFYNSLERLEDCCFLF

SEQ ID NO: 2711081 - protein, 25 aa, Entamoeba histolytica
ENCKSLRHVVLPLLIKEIPDNCFKE

SEQ ID NO: 2711082 - protein, 20 aa, Entamoeba histolytica
ENCRMMLMIYDTLKSLSSEL

SEQ ID NO: 2711083 - protein, 26 aa, Entamoeba histolytica
ENDELFQYCMLIKGTQLKNILVEKKK

SEQ ID NO: 2711084 - protein, 24 aa, Entamoeba histolytica
ENDGEFVVENGENDDWGLLEDEGE

SEQ ID NO: 2711085 - protein, 18 aa, Entamoeba histolytica
ENDIKKLEPMDASLAQKV

SEQ ID NO: 2711086 - protein, 38 aa, Entamoeba histolytica
ENDVYRFMEYFKEKYIIPGEFWLYYVIDVNKHKEEYLK

SEQ ID NO: 2711087 - protein, 23 aa, Entamoeba histolytica
ENEAFIGKVLYKVSLIGKKECPE

SEQ ID NO: 2711088 - protein, 25 aa, Entamoeba histolytica
ENEEEFILKGIERKLKSLESLKKCR

SEQ ID NO: 2711089 - protein, 24 aa, Entamoeba histolytica
ENEENTFIFLGDYVDRGSFSTEII

SEQ ID NO: 2711090 - protein, 25 aa, Entamoeba histolytica
ENEGKTIVIILPDCGERYLSTDLYK

SEQ ID NO: 2711091 - protein, 23 aa, Entamoeba histolytica
ENEHILFVQYLKQELEEEGINVF

SEQ ID NO: 2711092 - protein, 37 aa, Entamoeba histolytica
ENEIITFVHYVPSFWHFHIHFCTIHSPLFQSLNSVIG

SEQ ID NO: 2711093 - protein, 24 aa, Entamoeba histolytica
ENEIPFKIIPIRNVPRMYMNKNEV

SEQ ID NO: 2711094 - protein, 34 aa, Entamoeba histolytica
ENEIRYCLNPTFLNTLLYEWYELRKLKAIDCRKI

SEQ ID NO: 2711095 - protein, 23 aa, Entamoeba histolytica
ENEIRYCLTPTFLNTLLYEWYEL

SEQ ID NO: 2711096 - protein, 24 aa, Entamoeba histolytica
ENEISEHYIIMPDIIKMLVKQVAE

SEQ ID NO: 2711097 - protein, 26 aa, Entamoeba histolytica
ENEKWLKTHLQHVIWKQSGYYFHNRN

SEQ ID NO: 2711098 - protein, 17 aa, Entamoeba histolytica
ENEKYFYYVGMNVKRDC

SEQ ID NO: 2711099 - protein, 25 aa, Entamoeba histolytica
ENEKYLLLNGIIVTLKMANPDYADT

SEQ ID NO: 2711100 - protein, 17 aa, Entamoeba histolytica
ENELHKIFKKYIPTMRI

SEQ ID NO: 2711101 - protein, 32 aa, Entamoeba histolytica
ENELLLISRFTPPIFRCFDPNKLLPFTHFLEY

SEQ ID NO: 2711102 - protein, 27 aa, Entamoeba histolytica
ENELPFVQRALPGVKVVMVLIGTHKSE

SEQ ID NO: 2711103 - protein, 58 aa, Entamoeba histolytica
ENESMKQMIMNKKSLLDNTDDFILMSLEYLYFDSVWVTLKMELLDEEDLDDSIGDRLG

SEQ ID NO: 2711104 - protein, 33 aa, Entamoeba histolytica
ENEWKKVNILIYQNLIFLLKPGSDTVLAIIYIS

SEQ ID NO: 2711105 - protein, 36 aa, Entamoeba histolytica; identical to SEQ ID NO: 2522928

SEQ ID NO: 2711106 - protein, 24 aa, Entamoeba histolytica
ENGNLLINIISMIKERILNEELVG

SEQ ID NO: 2711107 - protein, 25 aa, Entamoeba histolytica
ENGNTFTMLSWVKEGLEKEGINTEI

SEQ ID NO: 2711108 - protein, 24 aa, Entamoeba histolytica
ENGNWYEPILKRNPHLFLMGFNQP

SEQ ID NO: 2711109 - protein, 20 aa, Entamoeba histolytica
ENGVCYWKIPSMYSGQIIYD

SEQ ID NO: 2711110 - protein, 19 aa, Entamoeba histolytica
ENGYKYLFNNHLLSLFSCS

SEQ ID NO: 2711111 - protein, 23 aa, Entamoeba histolytica
ENHKLGIIPPTYPAIIPISSISS

SEQ ID NO: 2711112 - protein, 26 aa, Entamoeba histolytica
ENIATWFELYSWWKDNEDAQTFTKIV

SEQ ID NO: 2711113 - protein, 27 aa, Entamoeba histolytica
ENIDDPFVKFLFPHNKPVIRHDTKHVM

SEQ ID NO: 2711114 - protein, 25 aa, Entamoeba histolytica
ENIEKLLQRLLGLIVFRIDIHISKR

SEQ ID NO: 2711115 - protein, 18 aa, Entamoeba histolytica
ENIFACVGSNKILLQPLG

SEQ ID NO: 2711116 - protein, 20 aa, Entamoeba histolytica
ENIFSICQLLNMKITLVNET

SEQ ID NO: 2711117 - protein, 24 aa, Entamoeba histolytica
ENIHTIASLFKLYFRELPDSLVTE

SEQ ID NO: 2711118 - protein, 33 aa, Entamoeba histolytica; identical to SEQ ID NO: 2522942

SEQ ID NO: 2711119 - protein, 17 aa, Entamoeba histolytica
ENILLKENKPYPTIKIA

SEQ ID NO: 2711120 - protein, 17 aa, Entamoeba histolytica
ENILLSIEKESLKNDVN

SEQ ID NO: 2711121 - protein, 29 aa, Entamoeba histolytica
ENIQFEGDVFERLIIQRNIPREFYDSVSY

SEQ ID NO: 2711122 - protein, 30 aa, Entamoeba histolytica; identical to SEQ ID NO: 2522952

SEQ ID NO: 2711123 - protein, 28 aa, Entamoeba histolytica
ENIVVDVMCILPNGKQIWININKDDDPN

SEQ ID NO: 2711124 - protein, 21 aa, Entamoeba histolytica
ENIWTDVPFNSFRKILATMEP

SEQ ID NO: 2711125 - protein, 17 aa, Entamoeba histolytica
ENIYGEIPFTSFRKVLK

SEQ ID NO: 2711126 - protein, 20 aa, Entamoeba histolytica
ENIYPSYPYNFLQLSIKEMA

SEQ ID NO: 2711127 - protein, 24 aa, Entamoeba histolytica
ENKEIEFGVIPRSFIDPYIYQIQE

SEQ ID NO: 2711128 - protein, 21 aa, Entamoeba histolytica
ENKFIKLWEGKRQRFSFNSLT

SEQ ID NO: 2711129 - protein, 26 aa, Entamoeba histolytica
ENKFTLFPNVLLNLSHLSKLYISSNY

SEQ ID NO: 2711130 - protein, 24 aa, Entamoeba histolytica
ENKIGYIRTLLKYFFDKFDRTGAG

SEQ ID NO: 2711131 - protein, 20 aa, Entamoeba histolytica
ENKIKMLIPLEILRAQKQKE

SEQ ID NO: 2711132 - protein, 24 aa, Entamoeba histolytica
ENKKSLTVFFNLYSTVYPSSPIAH

SEQ ID NO: 2711133 - protein, 27 aa, Entamoeba histolytica
ENKMVDVIVNWHRKKPNKEFQEEWEQE

SEQ ID NO: 2711134 - protein, 17 aa, Entamoeba histolytica
ENKNIILIYERESPIKQ

SEQ ID NO: 2711135 - protein, 18 aa, Entamoeba histolytica
ENKNIILIYERESPIKQE

SEQ ID NO: 2711136 - protein, 28 aa, Entamoeba histolytica
ENKQNNAMIYLVIKEGYKVTIRRNKKEN

SEQ ID NO: 2711137 - protein, 32 aa, Entamoeba histolytica
ENKQQSREIAIQNIELWKQNDELKKAALEALE

SEQ ID NO: 2711138 - protein, 20 aa, Entamoeba histolytica
ENKSFYDCVLFFSPSKKCCI

SEQ ID NO: 2711139 - protein, 19 aa, Entamoeba histolytica
ENKVEWKLVVKKAENWLSS

SEQ ID NO: 2711140 - protein, 27 aa, Entamoeba histolytica
ENKYYSISILLQAWKKRYLLKQSFPEI

SEQ ID NO: 2711141 - protein, 24 aa, Entamoeba histolytica
ENLCKKFPFAQEDTLYLLQYLVDE

SEQ ID NO: 2711142 - protein, 25 aa, Entamoeba histolytica
ENLDKAGEAVFWNNPKDFVSSTNEN

SEQ ID NO: 2711143 - protein, 24 aa, Entamoeba histolytica
ENLEMEISILSLISSGLKWVRFGA

SEQ ID NO: 2711144 - protein, 30 aa, Entamoeba histolytica
ENLITLMTDKFGHYCILYLLRHVDDKMALK

SEQ ID NO: 2711145 - protein, 20 aa, Entamoeba histolytica
ENLKALLRRGKAYLEKGQVE

SEQ ID NO: 2711146 - protein, 21 aa, Entamoeba histolytica
ENLLIMFKKYIQNKFKQIIIT

SEQ ID NO: 2711147 - protein, 24 aa, Entamoeba histolytica
ENLREILYISLLNNWGFSFVFVKP

SEQ ID NO: 2711148 - protein, 25 aa, Entamoeba histolytica
ENLTEQIYILPFNNLNISLPSNNIN

SEQ ID NO: 2711149 - protein, 19 aa, Entamoeba histolytica
ENMILLLKKGVFHPKFVNR

SEQ ID NO: 2711150 - protein, 19 aa, Entamoeba histolytica
ENMMGKIQYYIMKEEWKES

SEQ ID NO: 2711151 - protein, 28 aa, Entamoeba histolytica
ENMSYICWDPMGLFLGAVRSYLYSPHAK

SEQ ID NO: 2711152 - protein, 17 aa, Entamoeba histolytica
ENNDLDYLLNELKIQIN

SEQ ID NO: 2711153 - protein, 26 aa, Entamoeba histolytica
ENNEKEYCWCYKRKGTTRSSLVIFNN

SEQ ID NO: 2711154 - protein, 17 aa, Entamoeba histolytica
ENNFYINGFFNGVGGIN

SEQ ID NO: 2711155 - protein, 27 aa, Entamoeba histolytica
ENNHLECTLFLLTCGINNLIAAQTRIE

SEQ ID NO: 2711156 - protein, 21 aa, Entamoeba histolytica
ENNKLFGKPWKEKLKTEPSDQ

SEQ ID NO: 2711157 - protein, 29 aa, Entamoeba histolytica
ENNKTLTMPLLMEIIWNCVMSNNLLNNQI

SEQ ID NO: 2711158 - protein, 23 aa, Entamoeba histolytica
ENNKYLLLNGICVALKMGNPDYE

SEQ ID NO: 2711159 - protein, 24 aa, Entamoeba histolytica
ENNKYLLPTINGDGLLMIDAKWND

SEQ ID NO: 2711160 - protein, 22 aa, Entamoeba histolytica
ENNPCVCAFPYIFGERGLGIDI

SEQ ID NO: 2711161 - protein, 23 aa, Entamoeba histolytica
ENNPFIIAGFKYLDKVFTDAQTF

SEQ ID NO: 2711162 - protein, 23 aa, Entamoeba histolytica
ENNQLIEMIRGKIWRISMNKNGS

SEQ ID NO: 2711163 - protein, 25 aa, Entamoeba histolytica
ENNQRQCLWIILEPISPLTVSDYIN

SEQ ID NO: 2711164 - protein, 26 aa, Entamoeba histolytica
ENNVDYFIYDKITPNPLYTSVKECVD

SEQ ID NO: 2711165 - protein, 29 aa, Entamoeba histolytica
ENNVKDLHKLYLMLVEKANIQLQVLNERK

SEQ ID NO: 2711166 - protein, 22 aa, Entamoeba histolytica
ENNVYAQFYIRDEYFVERKIDL

SEQ ID NO: 2711167 - protein, 27 aa, Entamoeba histolytica
ENPELIKQICFFLIPSVSLGYKDCFKE

SEQ ID NO: 2711168 - protein, 22 aa, Entamoeba histolytica
ENPEVEMKFKYGIIQKELTNEE

SEQ ID NO: 2711169 - protein, 17 aa, Entamoeba histolytica
ENPLYVSMIIRKDFDMS

SEQ ID NO: 2711170 - protein, 22 aa, Entamoeba histolytica
ENPLYVSMIIRKDFDMSQELIK

SEQ ID NO: 2711171 - protein, 28 aa, Entamoeba histolytica
ENPNIKWRWETIGFLPNSPRNCSFIYGY

SEQ ID NO: 2711172 - protein, 31 aa, Entamoeba histolytica
ENPNKIYIYNLNLTMKLNKLIQNNIKRICNF

SEQ ID NO: 2711173 - protein, 23 aa, Entamoeba histolytica
ENPSNEIIILKNRINELLYQNEE

SEQ ID NO: 2711174 - protein, 33 aa, Entamoeba histolytica
ENQLYLMNINTEKLLFTFKFPEKIVGIAQSPDV

SEQ ID NO: 2711175 - protein, 22 aa, Entamoeba histolytica
ENQPTLPALLLKKISEADSDLL

SEQ ID NO: 2711176 - protein, 22 aa, Entamoeba histolytica
ENQRMYFMEELFIVTTHKMNLN

SEQ ID NO: 2711177 - protein, 29 aa, Entamoeba histolytica
ENQTLEFLLIQPVQRVMRYPMLIKEIIKL

SEQ ID NO: 2711178 - protein, 30 aa, Entamoeba histolytica
ENQVLKQKALCLFYERYPEAVSEVMFPFEQ

SEQ ID NO: 2711179 - protein, 38 aa, Entamoeba histolytica
ENRENIVIGFFSSKKFVGAVDLPLWRVVENGIEEWFQL

SEQ ID NO: 2711180 - protein, 27 aa, Entamoeba histolytica
ENRQMLHRILFLFAIKHPELNYTQGMN

SEQ ID NO: 2711181 - protein, 40 aa, Entamoeba histolytica; identical to SEQ ID NO: 2523018

SEQ ID NO: 2711182 - protein, 28 aa, Entamoeba histolytica
ENSAPMATLFFARLGPMMKEEILKKVCN

SEQ ID NO: 2711183 - protein, 20 aa, Entamoeba histolytica
ENSPIFLQFIEVTALFLRHS

SEQ ID NO: 2711184 - protein, 26 aa, Entamoeba histolytica
ENSTCLLVDIPLTSNIRKGKTFYGVD

SEQ ID NO: 2711185 - protein, 25 aa, Entamoeba histolytica
ENTDIQIFVIALNSIDSYEFVEGAP

SEQ ID NO: 2711186 - protein, 17 aa, Entamoeba histolytica
ENTFLLNNYTEAYQRIV

SEQ ID NO: 2711187 - protein, 17 aa, Entamoeba histolytica
ENTIGAAFLTKTLIVDG

SEQ ID NO: 2711188 - protein, 24 aa, Entamoeba histolytica
ENTKRVIQFLAMTAGQSKKAGQLG

SEQ ID NO: 2711189 - protein, 17 aa, Entamoeba histolytica
ENTLSDFNAFFTKDVHI

SEQ ID NO: 2711190 - protein, 37 aa, Entamoeba histolytica
ENTNGWAYCQVGYRFGYVPIKYLEKVNLAKELGGRNR

SEQ ID NO: 2711191 - protein, 23 aa, Entamoeba histolytica
ENTPFTCFSLHPGVYNSSLHNSY

SEQ ID NO: 2711192 - protein, 29 aa, Entamoeba histolytica
ENTSLKRALLFAHFQRRVITDGRMVSVPE

SEQ ID NO: 2711193 - protein, 31 aa, Entamoeba histolytica; identical to SEQ ID NO: 2523035

SEQ ID NO: 2711194 - protein, 18 aa, Entamoeba histolytica
ENVDGIIFLVGNKIDVTN

SEQ ID NO: 2711195 - protein, 23 aa, Entamoeba histolytica
ENVELPMILLGKLSAKERKERAI

SEQ ID NO: 2711196 - protein, 22 aa, Entamoeba histolytica
ENVFYYYAYNAFGGWVPTWVVN

SEQ ID NO: 2711197 - protein, 23 aa, Entamoeba histolytica
ENVINIFFDCGLMSYLINVIKKP

SEQ ID NO: 2711198 - protein, 26 aa, Entamoeba histolytica
ENVISLFTQLLLFKGTFAKVKNIENN

SEQ ID NO: 2711199 - protein, 25 aa, Entamoeba histolytica
ENVKKVFLDLLKFMKPKERSEVTCI

SEQ ID NO: 2711200 - protein, 32 aa, Entamoeba histolytica
ENVKNMIYRAFISLPYKTFPKYQLNLFDEGNG

SEQ ID NO: 2711201 - protein, 19 aa, Entamoeba histolytica
ENVQSFLQFLKSKSAKKEN

SEQ ID NO: 2711202 - protein, 24 aa, Entamoeba histolytica
ENVRYDIRLFDDANLNDITWPEFK

SEQ ID NO: 2711203 - protein, 36 aa, Entamoeba histolytica
ENVSNWIDACNKIEEKRVLVLAGNKTDLDERVITKE

SEQ ID NO: 2711204 - protein, 25 aa, Entamoeba histolytica
ENWCGLKNHLILFDSSLPNGNSNET

SEQ ID NO: 2711205 - protein, 18 aa, Entamoeba histolytica
ENWMFEKEKLFLDTFFFP

SEQ ID NO: 2711206 - protein, 27 aa, Entamoeba histolytica
ENWPKGVFQIFSTKIQRLLPSVIKDLD

SEQ ID NO: 2711207 - protein, 22 aa, Entamoeba histolytica
ENYKYLRMLLLQPHNQICTDCS

SEQ ID NO: 2711208 - protein, 19 aa, Entamoeba histolytica
ENYMIRWLSDNETSTIILV

SEQ ID NO: 2711209 - protein, 28 aa, Entamoeba histolytica
ENYNFKEKPFPPARIRKLTKINIDNKQL

SEQ ID NO: 2711210 - protein, 17 aa, Entamoeba histolytica
ENYPKGKAYLHPLGGSD

SEQ ID NO: 2711211 - protein, 17 aa, Entamoeba histolytica
ENYSIVAKFILITYGDL

SEQ ID NO: 2711212 - protein, 23 aa, Entamoeba histolytica
ENYSLLFEQPIKEQKPIENCMVP

SEQ ID NO: 2711213 - protein, 29 aa, Entamoeba histolytica
ENYTMKYYYYHLLLWPSITYLAECVDGKV

SEQ ID NO: 2711214 - protein, 21 aa, Entamoeba histolytica
EPCILLLLDRSIDGYTPLYIS

SEQ ID NO: 2711215 - protein, 23 aa, Entamoeba histolytica
EPDEFWDCIIGKKQLIMIIQMET

SEQ ID NO: 2711216 - protein, 18 aa, Entamoeba histolytica
EPDFPNRLAIYLSIALEP

SEQ ID NO: 2711217 - protein, 24 aa, Entamoeba histolytica
EPDLMEIEICFFKGLEMRSKYQDE

SEQ ID NO: 2711218 - protein, 30 aa, Entamoeba histolytica
EPEAKTKYRSVYLFLFNDTVILTKINSAGT

SEQ ID NO: 2711219 - protein, 24 aa, Entamoeba histolytica
EPEYLIISPKRKATITIYLTLFCT

SEQ ID NO: 2711220 - protein, 22 aa, Entamoeba histolytica
EPFCGWYHSHPSYKCWLSGIDV

SEQ ID NO: 2711221 - protein, 18 aa, Entamoeba histolytica
EPFSKKYLIGDQKEIKNI

SEQ ID NO: 2711222 - protein, 23 aa, Entamoeba histolytica
EPFSLLQLPIIKNLSFFKKVNFK

SEQ ID NO: 2711223 - protein, 30 aa, Entamoeba histolytica
EPGVNGLLKRYFYLMKEPSYIDWKLNNSEK

SEQ ID NO: 2711224 - protein, 21 aa, Entamoeba histolytica
EPIISDIPRFGSLIIERMTIA

SEQ ID NO: 2711225 - protein, 25 aa, Entamoeba histolytica
EPIPVRFMLTKINPYNFSLFVFHSA

SEQ ID NO: 2711226 - protein, 24 aa, Entamoeba histolytica
EPIRKLYLLPSQKVVVLFQRSMFM

SEQ ID NO: 2711227 - protein, 18 aa, Entamoeba histolytica
EPITIKPILPINTKPIFP

SEQ ID NO: 2711228 - protein, 18 aa, Entamoeba histolytica
EPIVIDKSVIIIGLVEEG

SEQ ID NO: 2711229 - protein, 20 aa, Entamoeba histolytica
EPIVIDKSVIIIGLVEEGGS

SEQ ID NO: 2711230 - protein, 24 aa, Entamoeba histolytica
EPIVKNKYDILAQIQLEQQQQSSS

SEQ ID NO: 2711231 - protein, 24 aa, Entamoeba histolytica
EPKAKLCELLMQLIIRSPGVVQTQ

SEQ ID NO: 2711232 - protein, 23 aa, Entamoeba histolytica
EPKKLEFNGLQAVLNKVKTVSPG

SEQ ID NO: 2711233 - protein, 24 aa, Entamoeba histolytica
EPKNCLLCKQPFTFVNRKHHCRLC

SEQ ID NO: 2711234 - protein, 24 aa, Entamoeba histolytica
EPKPKLSRLFLMLKQHTKQSSIYQ

SEQ ID NO: 2711235 - protein, 26 aa, Entamoeba histolytica
EPKRDKLIILLRLVEKCNENQIDHII

SEQ ID NO: 2711236 - protein, 18 aa, Entamoeba histolytica
EPKRFLIDILPSVPPTIV

SEQ ID NO: 2711237 - protein, 23 aa, Entamoeba histolytica
EPKSAIWELFKQNSNKAQISLEK

SEQ ID NO: 2711238 - protein, 23 aa, Entamoeba histolytica
EPKTLLHPLLKCLIQYENQTLQN

SEQ ID NO: 2711239 - protein, 25 aa, Entamoeba histolytica
EPLENLYGLYPLLQNVFIYGESTDT

SEQ ID NO: 2711240 - protein, 27 aa, Entamoeba histolytica
EPLIENGIFLVEPLLHGEFIKFNCNNG

SEQ ID NO: 2711241 - protein, 17 aa, Entamoeba histolytica
EPLIKRVIRVAGNLICL

SEQ ID NO: 2711242 - protein, 29 aa, Entamoeba histolytica
EPLQIPTFSFYWIEFITPSFILNRVEYNP

SEQ ID NO: 2711243 - protein, 17 aa, Entamoeba histolytica
EPLVFYDNQFISQCSVR

SEQ ID NO: 2711244 - protein, 24 aa, Entamoeba histolytica
EPLYENIPYINFKPILISSKANED

SEQ ID NO: 2711245 - protein, 24 aa, Entamoeba histolytica
EPNRPFIDIITSFKPFVSKISKAK

SEQ ID NO: 2711246 - protein, 29 aa, Entamoeba histolytica
EPNVNAFLKKFYYTMKEPSYIDWKINNSD

SEQ ID NO: 2711247 - protein, 22 aa, Entamoeba histolytica
EPPHMLESFKFLLDRYKKVEDN

SEQ ID NO: 2711248 - protein, 21 aa, Entamoeba histolytica
EPPIKLLSYENLYIPDKSQFG

SEQ ID NO: 2711249 - protein, 30 aa, Entamoeba histolytica
EPPPIRSHQLAYSHFPPKPTTNTFDSDEFN

SEQ ID NO: 2711250 - protein, 21 aa, Entamoeba histolytica
EPPRGILLHGPPGCGKTLLAK

SEQ ID NO: 2711251 - protein, 21 aa, Entamoeba histolytica
EPQIGLIIYVANLHFDITEEL

SEQ ID NO: 2711252 - protein, 17 aa, Entamoeba histolytica
EPQKKWGFGSIKSSIVS

SEQ ID NO: 2711253 - protein, 30 aa, Entamoeba histolytica
EPQSNQYIFPYKTLPLLRKLRNIIGINNRI

SEQ ID NO: 2711254 - protein, 19 aa, Entamoeba histolytica
EPRTCSTFRDISFGSPCNC

SEQ ID NO: 2711255 - protein, 27 aa, Entamoeba histolytica
EPSDQTHLFINSLTLKYINTQPLNNED

SEQ ID NO: 2711256 - protein, 39 aa, Entamoeba histolytica
EPSLSYSIKFKLFKKLKKVMDLGFKGPFLIITNKENLGF

SEQ ID NO: 2711257 - protein, 23 aa, Entamoeba histolytica
EPSWESQWGPGRPGWHIECSAMA

SEQ ID NO: 2711258 - protein, 23 aa, Entamoeba histolytica
EPTKWELFAKRKGIKKTKKSGKV

SEQ ID NO: 2711259 - protein, 19 aa, Entamoeba histolytica
EPTLLIQIKGRRRLRSYVI

SEQ ID NO: 2711260 - protein, 22 aa, Entamoeba histolytica
EPTRDEFLLFLSRRVQKGTIPN

SEQ ID NO: 2711261 - protein, 19 aa, Entamoeba histolytica
EPVALFPVTVDPMKLNTFV

SEQ ID NO: 2711262 - protein, 28 aa, Entamoeba histolytica
EPVEQLKSFIPLLIATKGRFEYDLGKDD

SEQ ID NO: 2711263 - protein, 36 aa, Entamoeba histolytica; identical to SEQ ID NO: 2523096

SEQ ID NO: 2711264 - protein, 33 aa, Entamoeba histolytica
EPVVNSQLLLLLLKLHPTPFIPITFHSQIKEKY

SEQ ID NO: 2711265 - protein, 17 aa, Entamoeba histolytica
EPVYLTTVLLYCNSEAV

SEQ ID NO: 2711266 - protein, 22 aa, Entamoeba histolytica
EPYEHLKSWKFSSEAVIFDFGK

SEQ ID NO: 2711267 - protein, 27 aa, Entamoeba histolytica
EPYSIYTYRYFLKSWPHLCFFAKDKTT

SEQ ID NO: 2711268 - protein, 17 aa, Entamoeba histolytica
EPYTLFYNNYEKVKFTQ

SEQ ID NO: 2711269 - protein, 22 aa, Entamoeba histolytica
EQAILVLQDLLRTNPRGNLQII

SEQ ID NO: 2711270 - protein, 23 aa, Entamoeba histolytica
EQAIRSLIFLLKKYENDSEFTKH

SEQ ID NO: 2711271 - protein, 23 aa, Entamoeba histolytica
EQALCHPWFKGIAQPTITEGIVP

SEQ ID NO: 2711272 - protein, 28 aa, Entamoeba histolytica
EQALLYNKLFDVFPLLLKQTLSLLTSNS

SEQ ID NO: 2711273 - protein, 26 aa, Entamoeba histolytica
EQAYDIKYPLPKCDWIALPDFEAGAM

SEQ ID NO: 2711274 - protein, 23 aa, Entamoeba histolytica
EQCDHELLVGFLKYGFESRELIQ

SEQ ID NO: 2711275 - protein, 26 aa, Entamoeba histolytica
EQDQMVLKLIREINFFISCKQADFKA

SEQ ID NO: 2711276 - protein, 27 aa, Entamoeba histolytica
EQEALCIYLLMSHGVKFTLLKPRKTHT

SEQ ID NO: 2711277 - protein, 26 aa, Entamoeba histolytica
EQEFIFCAFCSFWITNKGRIGIHPLM

SEQ ID NO: 2711278 - protein, 23 aa, Entamoeba histolytica
EQENLMVLQLFKQNLECFEKSSE

SEQ ID NO: 2711279 - protein, 23 aa, Entamoeba histolytica
EQESVLLALLNKFYDITFTAHKK

SEQ ID NO: 2711280 - protein, 23 aa, Entamoeba histolytica
EQFHFNPIPLNEYSRKLFPNIET

SEQ ID NO: 2711281 - protein, 24 aa, Entamoeba histolytica
EQFKLTLCCLPIFELYGIFLLQLF

SEQ ID NO: 2711282 - protein, 18 aa, Entamoeba histolytica
EQFKYNGMQLERIGRKFS

SEQ ID NO: 2711283 - protein, 23 aa, Entamoeba histolytica
EQFLKYFETFGPIKCGADGKKFY

SEQ ID NO: 2711284 - protein, 24 aa, Entamoeba histolytica
EQFMKVIKTPLPTSFRLTKSSETF

SEQ ID NO: 2711285 - protein, 24 aa, Entamoeba histolytica
EQFQKLFNVLLPKCTTFNTSEMKG

SEQ ID NO: 2711286 - protein, 25 aa, Entamoeba histolytica
EQFVENLLIGIRRLLVLGEEMINDE

SEQ ID NO: 2711287 - protein, 23 aa, Entamoeba histolytica
EQGHSFLFSNKLALWKGDITKLC

SEQ ID NO: 2711288 - protein, 23 aa, Entamoeba histolytica
EQGILIKPLGVVVCNFLPPNNDT

SEQ ID NO: 2711289 - protein, 25 aa, Entamoeba histolytica
EQHIQILKIFHRSYNNFLNKSQLFH

SEQ ID NO: 2711290 - protein, 17 aa, Entamoeba histolytica
EQHLHTIIKANGPYVGL

SEQ ID NO: 2711291 - protein, 24 aa, Entamoeba histolytica
EQHNIDNASSIFILLSTFTLTLLF

SEQ ID NO: 2711292 - protein, 25 aa, Entamoeba histolytica
EQHPPTEYITLKSVVSKFVVNCLQP

SEQ ID NO: 2711293 - protein, 24 aa, Entamoeba histolytica
EQHVNASLFLYKLTIVQNNPIEIK

SEQ ID NO: 2711294 - protein, 26 aa, Entamoeba histolytica
EQIELLATIVVQYKLSHQQVYEKSVI

SEQ ID NO: 2711295 - protein, 22 aa, Entamoeba histolytica
EQIIEEEFTCLFELVDHVKDML

SEQ ID NO: 2711296 - protein, 26 aa, Entamoeba histolytica
EQIITILIQRLLTSKPLQLGVLVTFM

SEQ ID NO: 2711297 - protein, 18 aa, Entamoeba histolytica
EQIIVLGATNRPFDLDDA

SEQ ID NO: 2711298 - protein, 25 aa, Entamoeba histolytica
EQIIYTCFIGFRYYFDRDELISMDE

SEQ ID NO: 2711299 - protein, 25 aa, Entamoeba histolytica
EQIQWSIGLSLSLFGISFFGKGAKE

SEQ ID NO: 2711300 - protein, 20 aa, Entamoeba histolytica
EQITELLTLLLKGVGMHHSG

SEQ ID NO: 2711301 - protein, 23 aa, Entamoeba histolytica
EQKADMFYITSFTTISDAELQKI

SEQ ID NO: 2711302 - protein, 23 aa, Entamoeba histolytica
EQKKKLMLVDIRNYKKGMKKYTD

SEQ ID NO: 2711303 - protein, 29 aa, Entamoeba histolytica
EQKKPTIDYFFFVHGLLSLSINPKEHWAP

SEQ ID NO: 2711304 - protein, 20 aa, Entamoeba histolytica
EQLCNLLLYLPSELSINEML

SEQ ID NO: 2711305 - protein, 28 aa, Entamoeba histolytica
EQLEIEKNIIFNILVDHINIDTIAIAID

SEQ ID NO: 2711306 - protein, 22 aa, Entamoeba histolytica
EQLERKRFIGNDIVVIIFKEQN

SEQ ID NO: 2711307 - protein, 23 aa, Entamoeba histolytica
EQLKFPNFLQRYTTQYYVPNIDD

SEQ ID NO: 2711308 - protein, 25 aa, Entamoeba histolytica
EQLKTLRIVLQQLFPPIQASVAKIK

SEQ ID NO: 2711309 - protein, 17 aa, Entamoeba histolytica
EQLLLSMFQLGLQRYIS

SEQ ID NO: 2711310 - protein, 18 aa, Entamoeba histolytica
EQLLLYQAMLHKNNLEMK

SEQ ID NO: 2711311 - protein, 23 aa, Entamoeba histolytica
EQLLNDIWRLRRSLFIVCKQNKE

SEQ ID NO: 2711312 - protein, 27 aa, Entamoeba histolytica
EQLQPYHALFLFKNPEEWINNLIESDE

SEQ ID NO: 2711313 - protein, 25 aa, Entamoeba histolytica
EQLQQLLEIILLYSSLPQAGKQLTK

SEQ ID NO: 2711314 - protein, 24 aa, Entamoeba histolytica
EQLSLAFEIIYDKEYLFFCKTKEE

SEQ ID NO: 2711315 - protein, 20 aa, Entamoeba histolytica
EQMIQMLYSLKIKEAIKMGL

SEQ ID NO: 2711316 - protein, 24 aa, Entamoeba histolytica
EQMKQYLIKIVFVPKKLKEATMPL

SEQ ID NO: 2711317 - protein, 23 aa, Entamoeba histolytica
EQNDFNFLFTFIRELRSKFNEYP

SEQ ID NO: 2711318 - protein, 26 aa, Entamoeba histolytica
EQNGFTLDKLIDYQPKRSLEPSRGKS

SEQ ID NO: 2711319 - protein, 18 aa, Entamoeba histolytica
EQNGWIRQAKEASKQIDS

SEQ ID NO: 2711320 - protein, 23 aa, Entamoeba histolytica
EQNKILIEELLNQQMLQFNIYGQ

SEQ ID NO: 2711321 - protein, 24 aa, Entamoeba histolytica
EQNKLFFRYLSLIQNSVYHRFALF

SEQ ID NO: 2711322 - protein, 29 aa, Entamoeba histolytica
EQNKYDWALNFIKFLKEMVVYIKQYHTTG

SEQ ID NO: 2711323 - protein, 30 aa, Entamoeba histolytica
EQNLLPIKLLHLFTAPFYLPPTSYLQCKLI

SEQ ID NO: 2711324 - protein, 23 aa, Entamoeba histolytica
EQNPGYFKAYEFRLALKSQISRY

SEQ ID NO: 2711325 - protein, 23 aa, Entamoeba histolytica
EQNSKLMQMPFLQMLRTYYCSMS

SEQ ID NO: 2711326 - protein, 23 aa, Entamoeba histolytica
EQPIHIFNNYFSIGLDAAIALAF

SEQ ID NO: 2711327 - protein, 23 aa, Entamoeba histolytica
EQPIRFYVIKNKQVIARIAENCQ

SEQ ID NO: 2711328 - protein, 28 aa, Entamoeba histolytica
EQQEYQPIDFFIQPLPSVNDRLGITPEL

SEQ ID NO: 2711329 - protein, 20 aa, Entamoeba histolytica
EQQKRLALLSLNTHEDTSKE

SEQ ID NO: 2711330 - protein, 19 aa, Entamoeba histolytica
EQQLYLGMLLNSTTEVCLL

SEQ ID NO: 2711331 - protein, 25 aa, Entamoeba histolytica
EQQNFFVCPLINCLLTHNNKLYSDA

SEQ ID NO: 2711332 - protein, 25 aa, Entamoeba histolytica
EQQPIKGIMICCYGTTIDIPKEIEN

SEQ ID NO: 2711333 - protein, 35 aa, Entamoeba histolytica
EQQPLTPYNLRFFKNFYWFEKVARINEWLEVSPDL

SEQ ID NO: 2711334 - protein, 25 aa, Entamoeba histolytica
EQQPPFPYPNWRSVVLPQGYVMYYY

SEQ ID NO: 2711335 - protein, 23 aa, Entamoeba histolytica
EQQSQIECPFWLAPEIFKGEQWT

SEQ ID NO: 2711336 - protein, 27 aa, Entamoeba histolytica
EQRANAELLISYYNTRIEVLKTNIEMT

SEQ ID NO: 2711337 - protein, 23 aa, Entamoeba histolytica
EQREMSVVFIGGGLFHAEAVAYN

SEQ ID NO: 2711338 - protein, 21 aa, Entamoeba histolytica
EQRLSIMEKWHSKTTMMNISK

SEQ ID NO: 2711339 - protein, 23 aa, Entamoeba histolytica
EQRNEIIFKPKIGTEQLLRNAMN

SEQ ID NO: 2711340 - protein, 21 aa, Entamoeba histolytica
EQRYKVISLVVNKLGDLNGKV

SEQ ID NO: 2711341 - protein, 25 aa, Entamoeba histolytica
EQSIRQIIQLPLSKPAYNAYGHIIY

SEQ ID NO: 2711342 - protein, 24 aa, Entamoeba histolytica
EQSKPIVMIMKKNPMEFPNGIQAK

SEQ ID NO: 2711343 - protein, 22 aa, Entamoeba histolytica
EQSMNLLGLCILATKKYSAGIT

SEQ ID NO: 2711344 - protein, 23 aa, Entamoeba histolytica
EQSNEYLNIVLFVIDCKINEINE

SEQ ID NO: 2711345 - protein, 18 aa, Entamoeba histolytica
EQTKKIDDLFTFDDISKP

SEQ ID NO: 2711346 - protein, 24 aa, Entamoeba histolytica
EQTLAKLNLVPGAILLIVFEDYKS

SEQ ID NO: 2711347 - protein, 26 aa, Entamoeba histolytica
EQTLFIWINIGIIKRLFDFYGTDNLV

SEQ ID NO: 2711348 - protein, 24 aa, Entamoeba histolytica
EQTLKLTFILHDNKVNITTEGIDV

SEQ ID NO: 2711349 - protein, 25 aa, Entamoeba histolytica
EQTLSLEDLIRRRIKEQSWDDVVRK

SEQ ID NO: 2711350 - protein, 24 aa, Entamoeba histolytica
EQTNVIRMLFKVPVITNREFVFDC

SEQ ID NO: 2711351 - protein, 25 aa, Entamoeba histolytica
EQTSIPLYNQLFHATPEQLERIYDI

SEQ ID NO: 2711352 - protein, 28 aa, Entamoeba histolytica
EQTYVCYESALFIIRRNGMKEYIPKVSK

SEQ ID NO: 2711353 - protein, 28 aa, Entamoeba histolytica
EQTYVCYESALFLIRRNGMKEYIPKVSK

SEQ ID NO: 2711354 - protein, 24 aa, Entamoeba histolytica
EQVEQIWCKLLCYCIGEIFSQHQL

SEQ ID NO: 2711355 - protein, 24 aa, Entamoeba histolytica
EQVETACYQLEMLKYLIHCHNEAE

SEQ ID NO: 2711356 - protein, 19 aa, Entamoeba histolytica
EQVFRNWVNSLVSQKGIGV

SEQ ID NO: 2711357 - protein, 25 aa, Entamoeba histolytica
EQVHKPISWLIGRKVKRGTDWKWSD

SEQ ID NO: 2711358 - protein, 19 aa, Entamoeba histolytica
EQVIGKMMMLPKAIEIESA

SEQ ID NO: 2711359 - protein, 31 aa, Entamoeba histolytica
EQVIITFKTIFFLRFLFPALNSAEKYVSIQL

SEQ ID NO: 2711360 - protein, 24 aa, Entamoeba histolytica
EQVKLLGDKIGELQLEKSKYLEDI

SEQ ID NO: 2711361 - protein, 30 aa, Entamoeba histolytica
EQVKNKKIPLCQWPLYVSTTFDNEVNERNE

SEQ ID NO: 2711362 - protein, 23 aa, Entamoeba histolytica
EQVLFNHVNLAYKYFSIKKICDL

SEQ ID NO: 2711363 - protein, 23 aa, Entamoeba histolytica
EQVMNIIYKFDFFDFVLTELRDS

SEQ ID NO: 2711364 - protein, 34 aa, Entamoeba histolytica; identical to SEQ ID NO: 2523184

SEQ ID NO: 2711365 - protein, 24 aa, Entamoeba histolytica
EQVTFFIENELLYGSLLLDHSSVL

SEQ ID NO: 2711366 - protein, 32 aa, Entamoeba histolytica; identical to SEQ ID NO: 2523186

SEQ ID NO: 2711367 - protein, 30 aa, Entamoeba histolytica; identical to SEQ ID NO: 2523187

SEQ ID NO: 2711368 - protein, 21 aa, Entamoeba histolytica
EQYFILPYPFCVIDPVSQTVG

SEQ ID NO: 2711369 - protein, 22 aa, Entamoeba histolytica
EQYIVTGGLYLKPSKFTSQPVP

SEQ ID NO: 2711370 - protein, 30 aa, Entamoeba histolytica
EQYSIRIPMPAILKPIPKWTGKQVVTAILM

SEQ ID NO: 2711371 - protein, 31 aa, Entamoeba histolytica
ERAALKTIQYFYIQQLFYFDEKVDFEYSIDK

SEQ ID NO: 2711372 - protein, 28 aa, Entamoeba histolytica
ERADQRKQRELENLRLQEQLRKQKEEEE

SEQ ID NO: 2711373 - protein, 17 aa, Entamoeba histolytica
ERAFAIRYFISVAHYLK

SEQ ID NO: 2711374 - protein, 20 aa, Entamoeba histolytica
ERDIAKIFETPLPGPIVPPQ

SEQ ID NO: 2711375 - protein, 29 aa, Entamoeba histolytica
ERDINTDFLLLLIKKLITRNKTIKIIIMS

SEQ ID NO: 2711376 - protein, 23 aa, Entamoeba histolytica
ERDNTFYFQYGQRVKYVVVRTSS

SEQ ID NO: 2711377 - protein, 27 aa, Entamoeba histolytica
ERDRNYEFKLYQLLHVGLTVDIFCYSL

SEQ ID NO: 2711378 - protein, 25 aa, Entamoeba histolytica
ERDSTVIWIYYHLINELEEESKKQI

SEQ ID NO: 2711379 - protein, 21 aa, Entamoeba histolytica
ERDYFIKLDAPTIYSPFTSII

SEQ ID NO: 2711380 - protein, 19 aa, Entamoeba histolytica
EREDFIRSGKLIEEYYKNI

SEQ ID NO: 2711381 - protein, 19 aa, Entamoeba histolytica
EREDFIRSGKLIEEYYKNM

SEQ ID NO: 2711382 - protein, 24 aa, Entamoeba histolytica
EREEFFRLKLIQNKKKKAIAIKEA

SEQ ID NO: 2711383 - protein, 25 aa, Entamoeba histolytica
EREQAERIKRAIAERKAQLAQRLEL

SEQ ID NO: 2711384 - protein, 17 aa, Entamoeba histolytica
ERERLVFEYLFQLQEIK

SEQ ID NO: 2711385 - protein, 18 aa, Entamoeba histolytica
EREWKRKLEEDRKVLEED

SEQ ID NO: 2711386 - protein, 22 aa, Entamoeba histolytica
ERFHFNPIPLNQYSRKLFPNIE

SEQ ID NO: 2711387 - protein, 25 aa, Entamoeba histolytica
ERFHLPIISLFYPSVEFVISTIQIK

SEQ ID NO: 2711388 - protein, 19 aa, Entamoeba histolytica
ERFINKIKQITQKKGYKKG

SEQ ID NO: 2711389 - protein, 22 aa, Entamoeba histolytica
ERFKTISLSLLFFVVQHPNQKK

SEQ ID NO: 2711390 - protein, 19 aa, Entamoeba histolytica
ERFRTITSSYYRGAHGIIV

SEQ ID NO: 2711391 - protein, 21 aa, Entamoeba histolytica
ERGIHLEELQQFLPLEEKQER

SEQ ID NO: 2711392 - protein, 17 aa, Entamoeba histolytica
ERGMAFPCGLSVNSCAA

SEQ ID NO: 2711393 - protein, 18 aa, Entamoeba histolytica
ERGVYVFDCPYSERLFKW

SEQ ID NO: 2711394 - protein, 26 aa, Entamoeba histolytica
ERGYLKHWIPRLSELFPSVTFYQSEC

SEQ ID NO: 2711395 - protein, 17 aa, Entamoeba histolytica
ERIANLLKILQVALKYI

SEQ ID NO: 2711396 - protein, 18 aa, Entamoeba histolytica
ERIEKRELRLKSDRLSNV

SEQ ID NO: 2711397 - protein, 25 aa, Entamoeba histolytica
ERIGQYKYNWVIRNYLRAIECSNKS

SEQ ID NO: 2711398 - protein, 27 aa, Entamoeba histolytica
ERIKNDPYIKLILTYMEKKSNQLIDLC

SEQ ID NO: 2711399 - protein, 25 aa, Entamoeba histolytica
ERILNSMYELWILGALDEIGNITEL

SEQ ID NO: 2711400 - protein, 20 aa, Entamoeba histolytica
ERIMIILEEKLSKSSKLYEA

SEQ ID NO: 2711401 - protein, 18 aa, Entamoeba histolytica
ERIPLIELQLLETPFVEI

SEQ ID NO: 2711402 - protein, 26 aa, Entamoeba histolytica
ERIQELAKLRGLMFYEEIKARRQNKI

SEQ ID NO: 2711403 - protein, 25 aa, Entamoeba histolytica
ERIQSPPIPSILMQNSEYPTVLDDI

SEQ ID NO: 2711404 - protein, 18 aa, Entamoeba histolytica
ERIRPIKRNPDTVNIPVP

SEQ ID NO: 2711405 - protein, 38 aa, Entamoeba histolytica
ERIYYAMNKMLLTFYRYPQAWIICAQYFQRRGNIELAI

SEQ ID NO: 2711406 - protein, 25 aa, Entamoeba histolytica
ERKFSFHSFFILGMTKNQIIQHSLF

SEQ ID NO: 2711407 - protein, 24 aa, Entamoeba histolytica
ERKHRINIKLNPWKETNPVVQGAR

SEQ ID NO: 2711408 - protein, 41 aa, Entamoeba histolytica
ERKKIIYNLTVMNLAIHAFFSQPCLNLLFIQNKLLNRNEMA

SEQ ID NO: 2711409 - protein, 33 aa, Entamoeba histolytica
ERKKLTPLELFWLLNEFADLLGPSPLIVEKKLG

SEQ ID NO: 2711410 - protein, 24 aa, Entamoeba histolytica
ERKKQYYCLLKTISQKHFIGVVGG

SEQ ID NO: 2711411 - protein, 25 aa, Entamoeba histolytica
ERKPVPLAIHHIPITVSFGITESGV

SEQ ID NO: 2711412 - protein, 23 aa, Entamoeba histolytica
ERKQINLALLKQVYRNNSTLMIV

SEQ ID NO: 2711413 - protein, 24 aa, Entamoeba histolytica
ERKRRTVDWLGDRLVEKIDRDHYM

SEQ ID NO: 2711414 - protein, 38 aa, Entamoeba histolytica
ERKSPPIDLTIDKKLFRDITQEFFGWNQNKVIDDIIAN

SEQ ID NO: 2711415 - protein, 29 aa, Entamoeba histolytica
ERKVFGVPMLIAFTYNYPLSPPELSCFIS

SEQ ID NO: 2711416 - protein, 22 aa, Entamoeba histolytica
ERLDDILLFSGFKDIKQRELAT

SEQ ID NO: 2711417 - protein, 21 aa, Entamoeba histolytica
ERLETAIYLQFHSNPTVRVTD

SEQ ID NO: 2711418 - protein, 34 aa, Entamoeba histolytica
ERLKTRPAFVLFIKHFYIYVLQITPEDLTHAVII

SEQ ID NO: 2711419 - protein, 20 aa, Entamoeba histolytica
ERLLPILKSFNNLVATKPPI

SEQ ID NO: 2711420 - protein, 30 aa, Entamoeba histolytica
ERLRQKKLEYLFSQLIRYVPQFNKEAQIAL

SEQ ID NO: 2711421 - protein, 21 aa, Entamoeba histolytica
ERLTEKKLRFGVGQYEYIIQF

SEQ ID NO: 2711422 - protein, 25 aa, Entamoeba histolytica
ERMRRKRILALKKNLRKMYLERRDM

SEQ ID NO: 2711423 - protein, 23 aa, Entamoeba histolytica
ERMTPFCRIVLNDLLTQYNIIHY

SEQ ID NO: 2711424 - protein, 24 aa, Entamoeba histolytica
ERMVRLNPPFKLVKTSPEKAKEYV

SEQ ID NO: 2711425 - protein, 20 aa, Entamoeba histolytica
ERNEEIIDILKSLKPSDNTN

SEQ ID NO: 2711426 - protein, 21 aa, Entamoeba histolytica
ERNIEIIPKVLPQRLDAKGVI

SEQ ID NO: 2711427 - protein, 28 aa, Entamoeba histolytica
ERNQVIQLFQYFGLNWKSINSFKHPIII

SEQ ID NO: 2711428 - protein, 17 aa, Entamoeba histolytica
ERNRKIFNYQEFDIFGG

SEQ ID NO: 2711429 - protein, 19 aa, Entamoeba histolytica
ERNVNFYIIKYFNNQYKEE

SEQ ID NO: 2711430 - protein, 24 aa, Entamoeba histolytica
ERNYGKVIYLYKKLIESGIKEDLH

SEQ ID NO: 2711431 - protein, 20 aa, Entamoeba histolytica
ERPERMVKGPYLGSVVFGTK

SEQ ID NO: 2711432 - protein, 18 aa, Entamoeba histolytica
ERPKTRLRERKNIGMIDF

SEQ ID NO: 2711433 - protein, 20 aa, Entamoeba histolytica
ERPRKFSLTLQRGKVPIQLN

SEQ ID NO: 2711434 - protein, 20 aa, Entamoeba histolytica
ERRAWRKDHPPGFVARPIMK

SEQ ID NO: 2711435 - protein, 23 aa, Entamoeba histolytica
ERRIREFMKLKYQDKKWFDQAAY

SEQ ID NO: 2711436 - protein, 28 aa, Entamoeba histolytica
ERRKQIINFFNYYPTNITFIVRAMSITG

SEQ ID NO: 2711437 - protein, 30 aa, Entamoeba histolytica
ERRSQKTLQLFLIETLTLPSGKIIEYENDV

SEQ ID NO: 2711438 - protein, 19 aa, Entamoeba histolytica
ERRTLTSFKLLLSSCFRNE

SEQ ID NO: 2711439 - protein, 19 aa, Entamoeba histolytica
ERRVVAQLLTLMDGMKSRS

SEQ ID NO: 2711440 - protein, 26 aa, Entamoeba histolytica
ERSDHLLIDFADVLHVSVRRLGRTFI

SEQ ID NO: 2711441 - protein, 25 aa, Entamoeba histolytica
ERSKQITSFLIPPIDFFIPDEHISP

SEQ ID NO: 2711442 - protein, 23 aa, Entamoeba histolytica
ERSQEYFQLLRSYLLCQISKSEY

SEQ ID NO: 2711443 - protein, 18 aa, Entamoeba histolytica
ERSYPTCERIRPLDLAIS

SEQ ID NO: 2711444 - protein, 31 aa, Entamoeba histolytica
ERTGNGYTIKFYYSGMFMEGLMSEIIDNVVI

SEQ ID NO: 2711445 - protein, 26 aa, Entamoeba histolytica
ERTKNAQFTIISLRPEMFELADRLMG

SEQ ID NO: 2711446 - protein, 21 aa, Entamoeba histolytica
ERTRYLVKWQKLPYTECTWEN

SEQ ID NO: 2711447 - protein, 17 aa, Entamoeba histolytica
ERTTIIFRLNWLRDEDI

SEQ ID NO: 2711448 - protein, 18 aa, Entamoeba histolytica
ERVEGMLKNLILSTAFDS

SEQ ID NO: 2711449 - protein, 33 aa, Entamoeba histolytica
ERVEYLLLHEFIKQTTLYILPDKKFGEGSQHKK

SEQ ID NO: 2711450 - protein, 19 aa, Entamoeba histolytica
ERVILGRLTNHLRMGIVGL

SEQ ID NO: 2711451 - protein, 20 aa, Entamoeba histolytica
ERVKKMMEILEPKVVDEKNK

SEQ ID NO: 2711452 - protein, 21 aa, Entamoeba histolytica
ERVMQLFGLVNDLLASNSETS

SEQ ID NO: 2711453 - protein, 24 aa, Entamoeba histolytica
ERVQYYSHVIPRLYLMCTIGSICI

SEQ ID NO: 2711454 - protein, 22 aa, Entamoeba histolytica
ERYDYFILLDKIQKSICLLKIY

SEQ ID NO: 2711455 - protein, 22 aa, Entamoeba histolytica
ERYFKDIFSVKKLSVIDLIYRT

SEQ ID NO: 2711456 - protein, 19 aa, Entamoeba histolytica
ERYIRLINGYLADLRKHRR

SEQ ID NO: 2711457 - protein, 19 aa, Entamoeba histolytica
ERYMIDGNKFILNVPSKSA

SEQ ID NO: 2711458 - protein, 28 aa, Entamoeba histolytica
ERYPSKYLTLLSFLSHSLTIKGVKFQTA

SEQ ID NO: 2711459 - protein, 23 aa, Entamoeba histolytica
ERYRLNIVFNLCKSQLIFKNNEG

SEQ ID NO: 2711460 - protein, 34 aa, Entamoeba histolytica
ERYRSLSQIYYRDATVALLVYDITRLETFNAVTD

SEQ ID NO: 2711461 - protein, 18 aa, Entamoeba histolytica
ERYSLIVDLYSNGNICLC

SEQ ID NO: 2711462 - protein, 17 aa, Entamoeba histolytica
ERYYALCVKYRSSPLLH

SEQ ID NO: 2711463 - protein, 19 aa, Entamoeba histolytica
ESAILLYLYGQYETALEYL

SEQ ID NO: 2711464 - protein, 32 aa, Entamoeba histolytica
ESAKQIFLFVVDMIDLLNAFIPLPNEFQQVKN

SEQ ID NO: 2711465 - protein, 17 aa, Entamoeba histolytica
ESALYLKSFSSKMIKFF

SEQ ID NO: 2711466 - protein, 19 aa, Entamoeba histolytica
ESAMNSIIIIWKNNIKNVD

SEQ ID NO: 2711467 - protein, 26 aa, Entamoeba histolytica
ESAVVLKLIDFIKLTIIDKLNNSQQE

SEQ ID NO: 2711468 - protein, 17 aa, Entamoeba histolytica
ESAYTFFKLNEAYINAP

SEQ ID NO: 2711469 - protein, 17 aa, Entamoeba histolytica
ESCFLGDFRAKSITVPK

SEQ ID NO: 2711470 - protein, 26 aa, Entamoeba histolytica
ESDEIIPFNLILPTEKLSPSFKTIEG

SEQ ID NO: 2711471 - protein, 28 aa, Entamoeba histolytica
ESDENLFFQIIDVLFIRKGENGLGQLQV

SEQ ID NO: 2711472 - protein, 19 aa, Entamoeba histolytica
ESDFKYGFPMVVVGTKSDL

SEQ ID NO: 2711473 - protein, 27 aa, Entamoeba histolytica
ESDIKLLKILFYFPMIQTVQVQYHDLG

SEQ ID NO: 2711474 - protein, 23 aa, Entamoeba histolytica
ESDKKILLATCDVLKLLENGDVY

SEQ ID NO: 2711475 - protein, 23 aa, Entamoeba histolytica
ESDMIIEMLDLGIPYHKATVALS

SEQ ID NO: 2711476 - protein, 26 aa, Entamoeba histolytica
ESDVFTLVFFHCPQLQHISIIGISQT

SEQ ID NO: 2711477 - protein, 22 aa, Entamoeba histolytica
ESEFLYLLCSFYNKSIENPFSL

SEQ ID NO: 2711478 - protein, 22 aa, Entamoeba histolytica
ESEIINGFVLQTTPSGSILEVQ

SEQ ID NO: 2711479 - protein, 32 aa, Entamoeba histolytica; identical to SEQ ID NO: 2523320

SEQ ID NO: 2711480 - protein, 24 aa, Entamoeba histolytica
ESEKGIIKIIKARHPLIENNSINS

SEQ ID NO: 2711481 - protein, 26 aa, Entamoeba histolytica
ESERKKRMVILYERKLDSMRELLQIT

SEQ ID NO: 2711482 - protein, 23 aa, Entamoeba histolytica
ESESLIHFQIKKLFYSTVDSVVI

SEQ ID NO: 2711483 - protein, 28 aa, Entamoeba histolytica
ESEYNKFKLTFFFFQCFIKSCVVADKEI

SEQ ID NO: 2711484 - protein, 24 aa, Entamoeba histolytica
ESFELSWKLTRPNGIVALVAMYES

SEQ ID NO: 2711485 - protein, 28 aa, Entamoeba histolytica
ESFKRSRIFVILLMVFNPNSLPTISNEL

SEQ ID NO: 2711486 - protein, 24 aa, Entamoeba histolytica
ESFKTIIKPSLPQQPLIVSTKCLI

SEQ ID NO: 2711487 - protein, 35 aa, Entamoeba histolytica
ESFNSYVILPIQRIPRYGLLLKELIKTVPPQHDEY

SEQ ID NO: 2711488 - protein, 20 aa, Entamoeba histolytica
ESFPHLFGKQKIRCLIPCAI

SEQ ID NO: 2711489 - protein, 24 aa, Entamoeba histolytica
ESFQSIIPMYFRNASCIILVFDVS

SEQ ID NO: 2711490 - protein, 25 aa, Entamoeba histolytica
ESFTRAFFRKTLAYFVIVESTIEAA

SEQ ID NO: 2711491 - protein, 22 aa, Entamoeba histolytica
ESGKRTQPMRACKGKPLIRFRE

SEQ ID NO: 2711492 - protein, 26 aa, Entamoeba histolytica
ESGNAFKYLILLSHLFVCDEFNNPKR

SEQ ID NO: 2711493 - protein, 25 aa, Entamoeba histolytica
ESGRKPFPNIFYLEEFVPTFISIGR

SEQ ID NO: 2711494 - protein, 25 aa, Entamoeba histolytica
ESHGFLYIIMEYMESGSLLNIVKKF

SEQ ID NO: 2711495 - protein, 37 aa, Entamoeba histolytica
ESHVFELLFKLLRKKNTLIIIPILKILEAYSYEDERY

SEQ ID NO: 2711496 - protein, 25 aa, Entamoeba histolytica
ESIFENCGFIQISLPSTLRSLNNNV

SEQ ID NO: 2711497 - protein, 18 aa, Entamoeba histolytica
ESIFSFIIDFIEKKIESD

SEQ ID NO: 2711498 - protein, 19 aa, Entamoeba histolytica
ESIHQIYLNGFFNNLHKNN

SEQ ID NO: 2711499 - protein, 20 aa, Entamoeba histolytica
ESIIFTRSLTFLLTLFGEQT

SEQ ID NO: 2711500 - protein, 20 aa, Entamoeba histolytica
ESIINYYINIPNNDPRVFTT

SEQ ID NO: 2711501 - protein, 25 aa, Entamoeba histolytica
ESIIRTKYLMLSKKNLFVFELTISE

SEQ ID NO: 2711502 - protein, 35 aa, Entamoeba histolytica
ESILQRLFSEYGEIKKIVIIKDLKGINKGYAFVEY

SEQ ID NO: 2711503 - protein, 19 aa, Entamoeba histolytica
ESILRNYMTLTLNTTITFQ

SEQ ID NO: 2711504 - protein, 17 aa, Entamoeba histolytica
ESILTGFGYIIQTLDNE

SEQ ID NO: 2711505 - protein, 20 aa, Entamoeba histolytica
ESIPFTPLRSAYLSIPFGVL

SEQ ID NO: 2711506 - protein, 20 aa, Entamoeba histolytica
ESIPLQQKYAIKVAYDYAEE

SEQ ID NO: 2711507 - protein, 26 aa, Entamoeba histolytica
ESIQQSILLALLNKYCEFTLELPTKL

SEQ ID NO: 2711508 - protein, 25 aa, Entamoeba histolytica
ESISIFHKRITFAHIIFTDKQSCAK

SEQ ID NO: 2711509 - protein, 20 aa, Entamoeba histolytica
ESISLLGYLYHVQDCHGPHI

SEQ ID NO: 2711510 - protein, 31 aa, Entamoeba histolytica
ESISPQQYFFDYLQTLLITTPLLLTHSNTVF

SEQ ID NO: 2711511 - protein, 17 aa, Entamoeba histolytica
ESISWYELTIKPEDYIN

SEQ ID NO: 2711512 - protein, 26 aa, Entamoeba histolytica
ESITFNIGLFEPLIISLSIYNYKTRE

SEQ ID NO: 2711513 - protein, 20 aa, Entamoeba histolytica
ESITVNIRKLLKKKYGQYPT

SEQ ID NO: 2711514 - protein, 17 aa, Entamoeba histolytica
ESITYVAFKMFLGINAE

SEQ ID NO: 2711515 - protein, 29 aa, Entamoeba histolytica
ESIYCQELKQPLLPLFIKGIKSGNEELMI

SEQ ID NO: 2711516 - protein, 20 aa, Entamoeba histolytica
ESIYMTMIPNIFSLRKETGM

SEQ ID NO: 2711517 - protein, 22 aa, Entamoeba histolytica
ESKDILILFVQTISPSTYLPEE

SEQ ID NO: 2711518 - protein, 27 aa, Entamoeba histolytica
ESKEKIEMFAKLPFLISNVVEILDLPP

SEQ ID NO: 2711519 - protein, 25 aa, Entamoeba histolytica
ESKEMMPLTHVLSTKLILRLQECRE

SEQ ID NO: 2711520 - protein, 26 aa, Entamoeba histolytica
ESKEMMPLTHVLSTKLILRLQECREK

SEQ ID NO: 2711521 - protein, 24 aa, Entamoeba histolytica
ESKERKFYGVMYFYKMAEQDIEDA

SEQ ID NO: 2711522 - protein, 26 aa, Entamoeba histolytica
ESKERLRFIKIVQSLAPRHKGRTNTI

SEQ ID NO: 2711523 - protein, 25 aa, Entamoeba histolytica
ESKEWEPFRKQIFMEYPMIEERYKR

SEQ ID NO: 2711524 - protein, 32 aa, Entamoeba histolytica
ESKFPIPFLSLISHCLLIPLLPQGQYNKLCDY

SEQ ID NO: 2711525 - protein, 33 aa, Entamoeba histolytica
ESKIRDLFQLASQRAPALLFIDEIDAITPKRDN

SEQ ID NO: 2711526 - protein, 26 aa, Entamoeba histolytica
ESKKEKFLPAFIKLAKETTGEEIVKI

SEQ ID NO: 2711527 - protein, 23 aa, Entamoeba histolytica
ESKKKYFLTSSQMKPFTPMELQN

SEQ ID NO: 2711528 - protein, 25 aa, Entamoeba histolytica
ESKKLFFSIINDFPSIKLKFKKKFH

SEQ ID NO: 2711529 - protein, 18 aa, Entamoeba histolytica
ESKKNRLKFMMRNGLINN

SEQ ID NO: 2711530 - protein, 23 aa, Entamoeba histolytica
ESKKQMNGFYFDFSLKPTGEKSL

SEQ ID NO: 2711531 - protein, 23 aa, Entamoeba histolytica
ESKLFSQSFFKKYTPITSCGWWE

SEQ ID NO: 2711532 - protein, 26 aa, Entamoeba histolytica
ESKNTFLHWIIKVLRIVLIIGEKYKS

SEQ ID NO: 2711533 - protein, 37 aa, Entamoeba histolytica
ESKSLRAYFFCILLKIFRVYMKIARYQTIGLGLSERI

SEQ ID NO: 2711534 - protein, 23 aa, Entamoeba histolytica
ESKWWKMMVTQICSRRGFSDVLI

SEQ ID NO: 2711535 - protein, 23 aa, Entamoeba histolytica
ESKYFDESLLGNVPTIEKIGGTE

SEQ ID NO: 2711536 - protein, 18 aa, Entamoeba histolytica
ESLDYWIDLTRKSGGDDI

SEQ ID NO: 2711537 - protein, 22 aa, Entamoeba histolytica
ESLELHLTWYEKLIVNQEKRDN

SEQ ID NO: 2711538 - protein, 24 aa, Entamoeba histolytica
ESLELYFIIWGNLCLLGGNAIKYI

SEQ ID NO: 2711539 - protein, 18 aa, Entamoeba histolytica
ESLFMVIDLAEGCLLDYV

SEQ ID NO: 2711540 - protein, 20 aa, Entamoeba histolytica
ESLIYFSYASDEIIEIIIQN

SEQ ID NO: 2711541 - protein, 21 aa, Entamoeba histolytica
ESLKYFYKWTELSQCQLIFDS

SEQ ID NO: 2711542 - protein, 26 aa, Entamoeba histolytica
ESLKYYESALRLLPSHKKLPLKIKQI

SEQ ID NO: 2711543 - protein, 27 aa, Entamoeba histolytica
ESLRKAIIQPKIKAGLEIIERHLSKEE

SEQ ID NO: 2711544 - protein, 17 aa, Entamoeba histolytica
ESLRLKVKYALKLSTGK

SEQ ID NO: 2711545 - protein, 24 aa, Entamoeba histolytica
ESLSNILYIPYFKPERLIEIEDGI

SEQ ID NO: 2711546 - protein, 31 aa, Entamoeba histolytica
ESLVSILQPYFAHWIVVFMDGFIKSIPLISS

SEQ ID NO: 2711547 - protein, 17 aa, Entamoeba histolytica
ESLYKINPQEWFKTFRI

SEQ ID NO: 2711548 - protein, 29 aa, Entamoeba histolytica
ESLYLPLQEIFLPIFIEIVAQPNPLITEK

SEQ ID NO: 2711549 - protein, 20 aa, Entamoeba histolytica
ESMDWAILGMRFLFTDMKYN

SEQ ID NO: 2711550 - protein, 22 aa, Entamoeba histolytica
ESMIEMIPVQKIEVTKKGHLGA

SEQ ID NO: 2711551 - protein, 24 aa, Entamoeba histolytica
ESNAFYQCTLLTSIIFSTSLKVIE

SEQ ID NO: 2711552 - protein, 23 aa, Entamoeba histolytica
ESNEKALILYEDPLKIINDTLIT

SEQ ID NO: 2711553 - protein, 23 aa, Entamoeba histolytica
ESNELIIGIKYPTSFKITYHFRS

SEQ ID NO: 2711554 - protein, 27 aa, Entamoeba histolytica
ESNELSYETKWLLLQRHSPDASQSKLR

SEQ ID NO: 2711555 - protein, 31 aa, Entamoeba histolytica
ESNEQLSLIYIFAQLLEKLLVIDPTKRFNSI

SEQ ID NO: 2711556 - protein, 35 aa, Entamoeba histolytica
ESNFIEHFAIFSIFIIDPLLFIEYLEKITCYLGDE

SEQ ID NO: 2711557 - protein, 25 aa, Entamoeba histolytica
ESNKEIISIRFSLIKAKQSIKEFCE

SEQ ID NO: 2711558 - protein, 17 aa, Entamoeba histolytica
ESNKYIHSFYNGSLMDV

SEQ ID NO: 2711559 - protein, 26 aa, Entamoeba histolytica
ESNLPYLRINLLVRPVPPKFSKKPTK

SEQ ID NO: 2711560 - protein, 26 aa, Entamoeba histolytica
ESNPQDMFYLIDLINWGNQHHNRHVN

SEQ ID NO: 2711561 - protein, 25 aa, Entamoeba histolytica
ESNSILFLNLVNYINIYYSHINPSL

SEQ ID NO: 2711562 - protein, 17 aa, Entamoeba histolytica
ESPFIPLQQMNDDTIGE

SEQ ID NO: 2711563 - protein, 24 aa, Entamoeba histolytica
ESPKEVFTPRLFKTPRLTSTEVQS

SEQ ID NO: 2711564 - protein, 22 aa, Entamoeba histolytica
ESPMRIQFCKYSIPNNYYSKKV

SEQ ID NO: 2711565 - protein, 44 aa, Entamoeba histolytica
ESPVKKRMPVGARGIPGMPMGGIRMGIPVGFNPASVQLKATGGR

SEQ ID NO: 2711566 - protein, 17 aa, Entamoeba histolytica
ESQARNRYLIYAKTAKK

SEQ ID NO: 2711567 - protein, 17 aa, Entamoeba histolytica
ESQHFSFFLQNFPKRHD

SEQ ID NO: 2711568 - protein, 35 aa, Entamoeba histolytica
ESQKDFIKYIKGYGNIYLILFDQNMNVFGCFIHSP

SEQ ID NO: 2711569 - protein, 19 aa, Entamoeba histolytica
ESQLIPFETLPSFISSVLL

SEQ ID NO: 2711570 - protein, 32 aa, Entamoeba histolytica; identical to SEQ ID NO: 2523404

SEQ ID NO: 2711571 - protein, 25 aa, Entamoeba histolytica
ESQVQPPQLLFTPNLMEIKTNEMMP

SEQ ID NO: 2711572 - protein, 18 aa, Entamoeba histolytica
ESQYEMIKWIASTIKFSQ

SEQ ID NO: 2711573 - protein, 33 aa, Entamoeba histolytica; identical to SEQ ID NO: 2523406

SEQ ID NO: 2711574 - protein, 35 aa, Entamoeba histolytica
ESRIKLFVEFLTKKWFFTLFTHWNYYVRQAFHHFI

SEQ ID NO: 2711575 - protein, 26 aa, Entamoeba histolytica
ESRMRQILDAIYFSKSKEITNNCRCQ

SEQ ID NO: 2711576 - protein, 17 aa, Entamoeba histolytica
ESSFWNFDSLYQPQQHP

SEQ ID NO: 2711577 - protein, 22 aa, Entamoeba histolytica
ESSGFIMMPFNPTYTSDQLSRL

SEQ ID NO: 2711578 - protein, 24 aa, Entamoeba histolytica
ESSQSFFLIYPISGETINGLDFIG

SEQ ID NO: 2711579 - protein, 26 aa, Entamoeba histolytica
ESSSLALRFQMLGVIPIVNIKEILLM

SEQ ID NO: 2711580 - protein, 38 aa, Entamoeba histolytica; identical to SEQ ID NO: 2523420

SEQ ID NO: 2711581 - protein, 23 aa, Entamoeba histolytica
ESTDDFFLFGYNNYTNNPIYRKE

SEQ ID NO: 2711582 - protein, 18 aa, Entamoeba histolytica
ESTDSWMDMPANTLKHKK

SEQ ID NO: 2711583 - protein, 22 aa, Entamoeba histolytica
ESTDSWMDMPANTLKHKKDIND

SEQ ID NO: 2711584 - protein, 42 aa, Entamoeba histolytica
ESTEIFFALTKLFMSKDLTMRRLLYVVLNDMIPLTSNSFIIV

SEQ ID NO: 2711585 - protein, 23 aa, Entamoeba histolytica
ESTEIILFFSKLMNSLLSTVETH

SEQ ID NO: 2711586 - protein, 23 aa, Entamoeba histolytica
ESTHFLVPTQIQSIGSLLLFNSG

SEQ ID NO: 2711587 - protein, 27 aa, Entamoeba histolytica
ESTILSQWYLILCELSKILQQHKIHKN

SEQ ID NO: 2711588 - protein, 23 aa, Entamoeba histolytica
ESTKRAPKIMTLADLADISADED

SEQ ID NO: 2711589 - protein, 20 aa, Entamoeba histolytica
ESTRGWFGFGYQVPELSEEA

SEQ ID NO: 2711590 - protein, 18 aa, Entamoeba histolytica
ESTTRFKFVLYEESKELP

SEQ ID NO: 2711591 - protein, 21 aa, Entamoeba histolytica
ESTVQTLLFSATMPAWVKEIS

SEQ ID NO: 2711592 - protein, 27 aa, Entamoeba histolytica
ESVDMTFIPLLLLKYNKFEHCVIQVMG

SEQ ID NO: 2711593 - protein, 24 aa, Entamoeba histolytica
ESVKDIFLLIQQYISYKIDNLQSV

SEQ ID NO: 2711594 - protein, 20 aa, Entamoeba histolytica
ESVKMTWDQAIKEALECPDY

SEQ ID NO: 2711595 - protein, 33 aa, Entamoeba histolytica
ESVLDRMNDLRETILASLIKFSKVEQDEGLKKV

SEQ ID NO: 2711596 - protein, 33 aa, Entamoeba histolytica; identical to SEQ ID NO: 2523434

SEQ ID NO: 2711597 - protein, 34 aa, Entamoeba histolytica
ESWISGTEWLLRVLSGMLFVPLIQRVFETKEIKK

SEQ ID NO: 2711598 - protein, 21 aa, Entamoeba histolytica
ESYIHRIGRSARFGRKGVAID

SEQ ID NO: 2711599 - protein, 17 aa, Entamoeba histolytica
ESYMYFFQIDESIDAEF

SEQ ID NO: 2711600 - protein, 23 aa, Entamoeba histolytica
ESYTFKFFSKFNELIINIDELKK

SEQ ID NO: 2711601 - protein, 18 aa, Entamoeba histolytica
ETAYHILPIDYTKKVLMI

SEQ ID NO: 2711602 - protein, 26 aa, Entamoeba histolytica
ETCIRRSLIYPVVRNWELSMKTLEET

SEQ ID NO: 2711603 - protein, 20 aa, Entamoeba histolytica
ETCLWIFINITSMSDVYVFH

SEQ ID NO: 2711604 - protein, 29 aa, Entamoeba histolytica
ETDGVRFVFRLCEDVYIVLITTLSSNVIE

SEQ ID NO: 2711605 - protein, 26 aa, Entamoeba histolytica
ETDKLLTIPALFPLLNIIKKQYISPQ

SEQ ID NO: 2711606 - protein, 21 aa, Entamoeba histolytica
ETDKRLIIYSANEYIYIANEE

SEQ ID NO: 2711607 - protein, 33 aa, Entamoeba histolytica; identical to SEQ ID NO: 2523449

SEQ ID NO: 2711608 - protein, 25 aa, Entamoeba histolytica
ETDRKVLFNSLALAIKIVVPNRIIE

SEQ ID NO: 2711609 - protein, 47 aa, Entamoeba histolytica
ETDRVFEQINWRKMEMGIQFKAIDKGKYYVMYARIKGMRDEDIDVNI

SEQ ID NO: 2711610 - protein, 22 aa, Entamoeba histolytica
ETDRWYYGGGLYMGKKMPEVCS

SEQ ID NO: 2711611 - protein, 27 aa, Entamoeba histolytica
ETDYKYDYLISPTMRPADFDAKPMVLF

SEQ ID NO: 2711612 - protein, 49 aa, Entamoeba histolytica
ETECQIKKPVPATSINLFNSSILQPRGTRTKTLPCLNSNGRLCSLETDM

SEQ ID NO: 2711613 - protein, 23 aa, Entamoeba histolytica
ETEEFVFIKWKTGKNKKGIIEDI

SEQ ID NO: 2711614 - protein, 30 aa, Entamoeba histolytica
ETEELKYFGIFMNKSFFFLNDSMIKMVQPN

SEQ ID NO: 2711615 - protein, 17 aa, Entamoeba histolytica
ETEFLRRPVERWKDLIP

SEQ ID NO: 2711616 - protein, 26 aa, Entamoeba histolytica
ETEKCKYFYVSFLNKRGLTIKGFQES

SEQ ID NO: 2711617 - protein, 29 aa, Entamoeba histolytica
ETFDTLSTTLLPFISPFTMTPIELTVTRT

SEQ ID NO: 2711618 - protein, 20 aa, Entamoeba histolytica
ETFIQLFEAINFDESHLPKG

SEQ ID NO: 2711619 - protein, 31 aa, Entamoeba histolytica; identical to SEQ ID NO: 2523461

SEQ ID NO: 2711620 - protein, 24 aa, Entamoeba histolytica
ETGDLIKYFNYTDGILEANSGVHD

SEQ ID NO: 2711621 - protein, 25 aa, Entamoeba histolytica
ETGDLIPWTLTQQFLDDEFAGLMGA

SEQ ID NO: 2711622 - protein, 29 aa, Entamoeba histolytica
ETGKSRGFGYLDFVDLEAANKFVEEHQGE

SEQ ID NO: 2711623 - protein, 23 aa, Entamoeba histolytica
ETGLSFILNRLYNPKFSEILIQI

SEQ ID NO: 2711624 - protein, 22 aa, Entamoeba histolytica
ETGYQMQLQYLLCDFKEQKEFE

SEQ ID NO: 2711625 - protein, 19 aa, Entamoeba histolytica
ETHRIVLEVICRLLKNKKD

SEQ ID NO: 2711626 - protein, 21 aa, Entamoeba histolytica
ETIILNCQIVQQLSFNIPDTL

SEQ ID NO: 2711627 - protein, 23 aa, Entamoeba histolytica
ETIKIFGMIRGEQRLTLTGHIGA

SEQ ID NO: 2711628 - protein, 22 aa, Entamoeba histolytica
ETIKRCHQLGIWIEITTLIIPG

SEQ ID NO: 2711629 - protein, 17 aa, Entamoeba histolytica
ETILLKGKRRKETVCLV

SEQ ID NO: 2711630 - protein, 26 aa, Entamoeba histolytica
ETIMEYSMLLLSYANLRNIKREEYKE

SEQ ID NO: 2711631 - protein, 28 aa, Entamoeba histolytica
ETIQNPYFLYILFTLLTTTHCIENKIID

SEQ ID NO: 2711632 - protein, 24 aa, Entamoeba histolytica
ETKAVFALFTPQLGLRIRHGSVGE

SEQ ID NO: 2711633 - protein, 22 aa, Entamoeba histolytica
ETKELVVLNKITDYITKFIIEC

SEQ ID NO: 2711634 - protein, 23 aa, Entamoeba histolytica
ETKGFIVSLPYPIQNIHFYENNY

SEQ ID NO: 2711635 - protein, 26 aa, Entamoeba histolytica
ETKKYQLHFNYHPIPFSFFMENGTKT

SEQ ID NO: 2711636 - protein, 22 aa, Entamoeba histolytica
ETKLFPSLIFKSSKCVFGGNIT

SEQ ID NO: 2711637 - protein, 30 aa, Entamoeba histolytica
ETKNSFIEGYRIDWFLWSYGEKNKEQLPPH

SEQ ID NO: 2711638 - protein, 21 aa, Entamoeba histolytica
ETKPRKIVPFQIEKKLDEIVK

SEQ ID NO: 2711639 - protein, 17 aa, Entamoeba histolytica
ETKQFIIDLFGSDLNEA

SEQ ID NO: 2711640 - protein, 23 aa, Entamoeba histolytica
ETKRSFFFWNQENDINSFYKGIE

SEQ ID NO: 2711641 - protein, 26 aa, Entamoeba histolytica
ETKSQILFIPIFYKTMTDFFDNKKGF

SEQ ID NO: 2711642 - protein, 24 aa, Entamoeba histolytica
ETKVESFFDLFYPQELALNNDIND

SEQ ID NO: 2711643 - protein, 25 aa, Entamoeba histolytica
ETKVKKYWKGMIKPVMIRVKTCFIE

SEQ ID NO: 2711644 - protein, 31 aa, Entamoeba histolytica
ETLEKVLIQFKLPSSPVLIQKLLTSSNSFNM

SEQ ID NO: 2711645 - protein, 17 aa, Entamoeba histolytica
ETLFIKKLHKDAIIPTR

SEQ ID NO: 2711646 - protein, 24 aa, Entamoeba histolytica
ETLKKIFHPNVLLIMGIIAEKGIT

SEQ ID NO: 2711647 - protein, 27 aa, Entamoeba histolytica
ETLMQNPLWCAYLQFFQNNNVLVHGQL

SEQ ID NO: 2711648 - protein, 26 aa, Entamoeba histolytica
ETLNESNVLIYYQFKMPVVSNRDYVF

SEQ ID NO: 2711649 - protein, 23 aa, Entamoeba histolytica
ETLQLQWNSFFPEQKKRWKDIDS

SEQ ID NO: 2711650 - protein, 25 aa, Entamoeba histolytica
ETLQQTWIQPMSSIQYRDALNSFDF

SEQ ID NO: 2711651 - protein, 19 aa, Entamoeba histolytica
ETLRFLLSNVKYYAEEFGF

SEQ ID NO: 2711652 - protein, 29 aa, Entamoeba histolytica
ETLSSFIVKLFPEFSLLFNGAELEKMKPN

SEQ ID NO: 2711653 - protein, 18 aa, Entamoeba histolytica
ETLTKEIVALPKAEAQNN

SEQ ID NO: 2711654 - protein, 32 aa, Entamoeba histolytica; identical to SEQ ID NO: 2523492

SEQ ID NO: 2711655 - protein, 19 aa, Entamoeba histolytica
ETLTYDEFLKFYKEHYHPS

SEQ ID NO: 2711656 - protein, 21 aa, Entamoeba histolytica
ETLVLLLCKDQTILPLLHSVQ

SEQ ID NO: 2711657 - protein, 22 aa, Entamoeba histolytica
ETLVNLPLDKGIKKPLLQQVNE

SEQ ID NO: 2711658 - protein, 26 aa, Entamoeba histolytica
ETLYESITLPLLRPELFKKGSLTKRS

SEQ ID NO: 2711659 - protein, 22 aa, Entamoeba histolytica
ETMFPPPVFYEMKNGALLIFPQ

SEQ ID NO: 2711660 - protein, 25 aa, Entamoeba histolytica
ETMTAFWLMKTIFIGLKRSKFKQEI

SEQ ID NO: 2711661 - protein, 33 aa, Entamoeba histolytica; identical to SEQ ID NO: 2523498

SEQ ID NO: 2711662 - protein, 34 aa, Entamoeba histolytica; identical to SEQ ID NO: 2523499

SEQ ID NO: 2711663 - protein, 17 aa, Entamoeba histolytica
ETNNANCLLYEKGDVII

SEQ ID NO: 2711664 - protein, 25 aa, Entamoeba histolytica
ETNQLYLNTLFMPSLMESAVDNFAY

SEQ ID NO: 2711665 - protein, 25 aa, Entamoeba histolytica
ETPHIQPVTVPLFTVTNKLSEVPSF

SEQ ID NO: 2711666 - protein, 17 aa, Entamoeba histolytica
ETPIEFILPIDIQIQNK

SEQ ID NO: 2711667 - protein, 18 aa, Entamoeba histolytica
ETPIVWMPGKDPRVSRPF

SEQ ID NO: 2711668 - protein, 33 aa, Entamoeba histolytica
ETPLHKAVFNKCIRLILVELLLKAGAEVDATTK

SEQ ID NO: 2711669 - protein, 17 aa, Entamoeba histolytica
ETPLYFIADNNTSLPFS

SEQ ID NO: 2711670 - protein, 21 aa, Entamoeba histolytica
ETQLLNEEVKRLMASYQNEKQ

SEQ ID NO: 2711671 - protein, 24 aa, Entamoeba histolytica
ETQRRFIGIYLSTYYKKSVEELSS

SEQ ID NO: 2711672 - protein, 28 aa, Entamoeba histolytica
ETQTLPIEFDQFLDEIPFTLTSPESTQT

SEQ ID NO: 2711673 - protein, 30 aa, Entamoeba histolytica; identical to SEQ ID NO: 2523514

SEQ ID NO: 2711674 - protein, 23 aa, Entamoeba histolytica
ETRIHNLTSLFYAQKWVPEEKIV

SEQ ID NO: 2711675 - protein, 24 aa, Entamoeba histolytica
ETRKKVYAYMRQSVYVKKTQEELD

SEQ ID NO: 2711676 - protein, 24 aa, Entamoeba histolytica
ETRRTLPNIIQKLIEQGLDSKEIL

SEQ ID NO: 2711677 - protein, 25 aa, Entamoeba histolytica
ETRWYRAPEILLGSQRYSFAIDLWS

SEQ ID NO: 2711678 - protein, 19 aa, Entamoeba histolytica
ETRYHFAVQLYPFAEQMKE

SEQ ID NO: 2711679 - protein, 32 aa, Entamoeba histolytica; identical to SEQ ID NO: 2523522

SEQ ID NO: 2711680 - protein, 25 aa, Entamoeba histolytica
ETSDSLIIFPNRGINLFTIFGCYQI

SEQ ID NO: 2711681 - protein, 18 aa, Entamoeba histolytica
ETSFPYSTTFDWGNIVDR

SEQ ID NO: 2711682 - protein, 22 aa, Entamoeba histolytica
ETSKFFCKLFIDTIKKNVNLFE

SEQ ID NO: 2711683 - protein, 26 aa, Entamoeba histolytica
ETSKIHLFIHCYDVIPLSPMSGLIGW

SEQ ID NO: 2711684 - protein, 18 aa, Entamoeba histolytica
ETSKLFPICVEYLHEHTL

SEQ ID NO: 2711685 - protein, 24 aa, Entamoeba histolytica
ETSLRLLLRMIKILQFIHKEGIVH

SEQ ID NO: 2711686 - protein, 17 aa, Entamoeba histolytica
ETSSHFVPVPTSKDNVP

SEQ ID NO: 2711687 - protein, 21 aa, Entamoeba histolytica
ETTFTDPRFFWNESLVSILQP

SEQ ID NO: 2711688 - protein, 34 aa, Entamoeba histolytica
ETTLEESMLQPIQTTPFELKFGKNSNEESRRLRV

SEQ ID NO: 2711689 - protein, 21 aa, Entamoeba histolytica
ETTMYIVMEYVSGGSLQQLIE

SEQ ID NO: 2711690 - protein, 29 aa, Entamoeba histolytica
ETTNIKLIDPFFEALFSLDDTEYWLKEQA

SEQ ID NO: 2711691 - protein, 24 aa, Entamoeba histolytica
ETTQTGLFNYFFGKTDEYDEPPKY

SEQ ID NO: 2711692 - protein, 23 aa, Entamoeba histolytica
ETTRKPPHSLLMFATNYLTEKKD

SEQ ID NO: 2711693 - protein, 24 aa, Entamoeba histolytica
ETTYFIFGRIDGCLDLLEFKNKSF

SEQ ID NO: 2711694 - protein, 25 aa, Entamoeba histolytica
ETVEYIMKTLFFLANKKSYLCEVTT

SEQ ID NO: 2711695 - protein, 26 aa, Entamoeba histolytica
ETVRKIFKRLFRVYAHMFYNHMEHLE

SEQ ID NO: 2711696 - protein, 20 aa, Entamoeba histolytica
ETVSAIIEAFLLIGDPNGTK

SEQ ID NO: 2711697 - protein, 22 aa, Entamoeba histolytica
ETVTPPILPKPENMTPLQRKRW

SEQ ID NO: 2711698 - protein, 26 aa, Entamoeba histolytica
ETVYHIARYLVYWGKAKIIEAIQLDD

SEQ ID NO: 2711699 - protein, 20 aa, Entamoeba histolytica
ETWFIREVILARASITTPEA

SEQ ID NO: 2711700 - protein, 18 aa, Entamoeba histolytica
ETWRQLWRVVERSQVVLM

SEQ ID NO: 2711701 - protein, 17 aa, Entamoeba histolytica
ETYILFIHSHSFYRYST

SEQ ID NO: 2711702 - protein, 19 aa, Entamoeba histolytica
ETYILKMRTSVQIFREVNN

SEQ ID NO: 2711703 - protein, 32 aa, Entamoeba histolytica
ETYPPYYDMPPMRVLMLIAQNPPPKLKNESEH

SEQ ID NO: 2711704 - protein, 27 aa, Entamoeba histolytica
ETYRFFTTFNYLYAIDNFFDYSKEVIK

SEQ ID NO: 2711705 - protein, 28 aa, Entamoeba histolytica
ETYSGISLRVIFPAFGGDAKTIQQLSGG

SEQ ID NO: 2711706 - protein, 26 aa, Entamoeba histolytica
ETYTKIGCVRSLLLNKCENIEFEIYG

SEQ ID NO: 2711707 - protein, 25 aa, Entamoeba histolytica
EVALAWVDITLRLQKTFLAAVESKQ

SEQ ID NO: 2711708 - protein, 18 aa, Entamoeba histolytica
EVARQIQTSFVYEPPPGY

SEQ ID NO: 2711709 - protein, 25 aa, Entamoeba histolytica
EVCTFLFCLKLQYPNRVHLLRGNHE

SEQ ID NO: 2711710 - protein, 27 aa, Entamoeba histolytica
EVDELEKRYRLLAKDISLNYKPTQKKE

SEQ ID NO: 2711711 - protein, 28 aa, Entamoeba histolytica
EVDELEKRYRLLAKDISLNYKPTQKKEE

SEQ ID NO: 2711712 - protein, 27 aa, Entamoeba histolytica
EVDELEKRYRLLTKDALHNYKPTQKKE

SEQ ID NO: 2711713 - protein, 23 aa, Entamoeba histolytica
EVDGRPLFLDLADGKKGGDKDNN

SEQ ID NO: 2711714 - protein, 38 aa, Entamoeba histolytica
EVDGYFPVVFIGKEGLPKLFYIWTEIRPNMKELKERIE

SEQ ID NO: 2711715 - protein, 20 aa, Entamoeba histolytica
EVDKTVPLKKLLLVHSKEYV

SEQ ID NO: 2711716 - protein, 19 aa, Entamoeba histolytica
EVEEIKKGIEIQEKQVKEI

SEQ ID NO: 2711717 - protein, 24 aa, Entamoeba histolytica
EVEELSLAVIALKGSDDINTIKKS

SEQ ID NO: 2711718 - protein, 27 aa, Entamoeba histolytica
EVEIDPYLLTEAFPGLLVTSQERKNLF

SEQ ID NO: 2711719 - protein, 24 aa, Entamoeba histolytica
EVEIKRLLPFLEDKFIEKGIDNNR

SEQ ID NO: 2711720 - protein, 25 aa, Entamoeba histolytica
EVEKQPCYFVPELMRLTGMSDDMRA

SEQ ID NO: 2711721 - protein, 26 aa, Entamoeba histolytica
EVEKRIPGFPIVLHGSSSVPQEWVAV

SEQ ID NO: 2711722 - protein, 24 aa, Entamoeba histolytica
EVESYLKYKVIWIVCGTMADLPKH

SEQ ID NO: 2711723 - protein, 19 aa, Entamoeba histolytica
EVEYLFWEDVCLKESKFEE

SEQ ID NO: 2711724 - protein, 26 aa, Entamoeba histolytica
EVEYLKTLKYLPPTYIEFIKNFHYDP

SEQ ID NO: 2711725 - protein, 19 aa, Entamoeba histolytica
EVFCVPFKTFWKNDAERQK

SEQ ID NO: 2711726 - protein, 28 aa, Entamoeba histolytica
EVFMEPSPKMLLFYRALKLDDMNYNELC

SEQ ID NO: 2711727 - protein, 20 aa, Entamoeba histolytica
EVFMKYNTFMLRGDSLFDTY

SEQ ID NO: 2711728 - protein, 25 aa, Entamoeba histolytica
EVGDIFYVEKIIGSWAVVVVDQEQF

SEQ ID NO: 2711729 - protein, 25 aa, Entamoeba histolytica
EVHELHRLLSKWPLLDPREAIELLD

SEQ ID NO: 2711730 - protein, 23 aa, Entamoeba histolytica
EVHPYVFDFVSGKYSLIQDKILK

SEQ ID NO: 2711731 - protein, 23 aa, Entamoeba histolytica
EVHRLEILITRRTFSLQDLKDID

SEQ ID NO: 2711732 - protein, 25 aa, Entamoeba histolytica
EVHVGMLVDCQVPYVILGHSERRQI

SEQ ID NO: 2711733 - protein, 27 aa, Entamoeba histolytica
EVICKRAFQLFLLEQISKEQYIEKAPS

SEQ ID NO: 2711734 - protein, 26 aa, Entamoeba histolytica
EVICLLLALKIIAPDTVYLLRGNHEG

SEQ ID NO: 2711735 - protein, 23 aa, Entamoeba histolytica
EVIEKRYHFIFISDSEEMKKFIA

SEQ ID NO: 2711736 - protein, 17 aa, Entamoeba histolytica
EVIKEKVELFRKGSWDY

SEQ ID NO: 2711737 - protein, 25 aa, Entamoeba histolytica
EVIKMYTEPLPIYPKSKLFCTENFK

SEQ ID NO: 2711738 - protein, 18 aa, Entamoeba histolytica
EVILNDRLGKKFRVKVHE

SEQ ID NO: 2711739 - protein, 17 aa, Entamoeba histolytica
EVINAFLTCGYVGASSL

SEQ ID NO: 2711740 - protein, 20 aa, Entamoeba histolytica
EVISIISKYLKKYTKEIYLY

SEQ ID NO: 2711741 - protein, 27 aa, Entamoeba histolytica
EVISKKFLHYWKYILESLKGMKRTSYT

SEQ ID NO: 2711742 - protein, 26 aa, Entamoeba histolytica
EVISVPSFFFIFSDATSYISTSFNVA

SEQ ID NO: 2711743 - protein, 43 aa, Entamoeba histolytica
EVITKDPKHFIFSLLNPNGIQPRAFYLQDNESKSLCIYSSKSK

SEQ ID NO: 2711744 - protein, 31 aa, Entamoeba histolytica
EVKALLNIRIHLWLEYYTINKAISTSHDNDL

SEQ ID NO: 2711745 - protein, 23 aa, Entamoeba histolytica
EVKEIIFQVIWALMIGQKELSFM

SEQ ID NO: 2711746 - protein, 17 aa, Entamoeba histolytica
EVKELYKLFPTLFTYWI

SEQ ID NO: 2711747 - protein, 18 aa, Entamoeba histolytica
EVKENIDYLLISKKNKKM

SEQ ID NO: 2711748 - protein, 19 aa, Entamoeba histolytica
EVKIFGLEYLSEFSSLNNS

SEQ ID NO: 2711749 - protein, 28 aa, Entamoeba histolytica
EVKIISTPIGYSRGFAFIEFATPQEAEK

SEQ ID NO: 2711750 - protein, 23 aa, Entamoeba histolytica
EVKIKYLTPITILISYNEEKPSF

SEQ ID NO: 2711751 - protein, 28 aa, Entamoeba histolytica
EVKKKVAILSPIPQLLEALKPLIKCELI

SEQ ID NO: 2711752 - protein, 19 aa, Entamoeba histolytica
EVKKLLQLMGIPCIEANCE

SEQ ID NO: 2711753 - protein, 25 aa, Entamoeba histolytica
EVKKNYIMYLIMKIRIGIERIHQED

SEQ ID NO: 2711754 - protein, 23 aa, Entamoeba histolytica
EVKKPLNYNNLYDILGGINEEPK

SEQ ID NO: 2711755 - protein, 17 aa, Entamoeba histolytica
EVKNILDDFTRPAMLHY

SEQ ID NO: 2711756 - protein, 24 aa, Entamoeba histolytica
EVKNLFSILLREYKVIRNVEKDFP

SEQ ID NO: 2711757 - protein, 29 aa, Entamoeba histolytica
EVKNLNIFSYLILPIQRVPRYELFIRGVL

SEQ ID NO: 2711758 - protein, 28 aa, Entamoeba histolytica
EVKRLKYRNGRFLPFLMAGNPVNFGRPF

SEQ ID NO: 2711759 - protein, 33 aa, Entamoeba histolytica
EVKSLFEKFGTLKQFLMPKSKALALVEFEVAND

SEQ ID NO: 2711760 - protein, 28 aa, Entamoeba histolytica
EVKWAEFEYCVLFPFNVLKMTNTKVMIK

SEQ ID NO: 2711761 - protein, 17 aa, Entamoeba histolytica
EVKYILSRYPLIRTIEH

SEQ ID NO: 2711762 - protein, 27 aa, Entamoeba histolytica
EVKYKRHEPLTPYLYLDVPGVIDDFYL

SEQ ID NO: 2711763 - protein, 25 aa, Entamoeba histolytica
EVLEQFNSLMTLYNKIRDERDEMKK

SEQ ID NO: 2711764 - protein, 20 aa, Entamoeba histolytica
EVLEYGFDFAQKKMGIDRLL

SEQ ID NO: 2711765 - protein, 27 aa, Entamoeba histolytica
EVLFFLMAHKINYPKQFFFLRGNHESK

SEQ ID NO: 2711766 - protein, 24 aa, Entamoeba histolytica
EVLFYLLAHKICYPERVFMLRGNH

SEQ ID NO: 2711767 - protein, 17 aa, Entamoeba histolytica
EVLHFPLERIHDLMFMT

SEQ ID NO: 2711768 - protein, 19 aa, Entamoeba histolytica
EVLHLLLDFLTEFGYFFEV

SEQ ID NO: 2711769 - protein, 17 aa, Entamoeba histolytica
EVLIEKYKFLPEVAEPI

SEQ ID NO: 2711770 - protein, 18 aa, Entamoeba histolytica
EVLKNNSFWWKEDGDWTD

SEQ ID NO: 2711771 - protein, 20 aa, Entamoeba histolytica
EVLKRYNEITPSVRLSGPTN

SEQ ID NO: 2711772 - protein, 21 aa, Entamoeba histolytica
EVLKTWAMMGLSSGKGLIHIT

SEQ ID NO: 2711773 - protein, 19 aa, Entamoeba histolytica
EVLKVVEYLGYKKPTRIQE

SEQ ID NO: 2711774 - protein, 25 aa, Entamoeba histolytica
EVLMSILQQVPYFKNTIPLKENQKL

SEQ ID NO: 2711775 - protein, 24 aa, Entamoeba histolytica
EVLRINPLYLQYPKVSIFIETVDK

SEQ ID NO: 2711776 - protein, 23 aa, Entamoeba histolytica
EVLSFQTLDFYELINMIGHTKKI

SEQ ID NO: 2711777 - protein, 25 aa, Entamoeba histolytica
EVLSKHPQYQLLHPDSPQFVNYTSD

SEQ ID NO: 2711778 - protein, 22 aa, Entamoeba histolytica
EVLSKLPLLTFLDLSNNNIKEF

SEQ ID NO: 2711779 - protein, 18 aa, Entamoeba histolytica
EVLVKRKKLHEPEIAYWM

SEQ ID NO: 2711780 - protein, 20 aa, Entamoeba histolytica
EVMFPFEQIINKAENKPDEV

SEQ ID NO: 2711781 - protein, 19 aa, Entamoeba histolytica
EVMIYNVTLLFQTISIIKC

SEQ ID NO: 2711782 - protein, 28 aa, Entamoeba histolytica
EVMNCVIRTYQFIGALIAIEIPVSAYIC

SEQ ID NO: 2711783 - protein, 18 aa, Entamoeba histolytica
EVNDYLFSLTGLEYICLN

SEQ ID NO: 2711784 - protein, 25 aa, Entamoeba histolytica
EVNEFWICSKCNKIFWIGSQTKHII

SEQ ID NO: 2711785 - protein, 24 aa, Entamoeba histolytica
EVNELIQIQGLLDNQLKVLYDKLK

SEQ ID NO: 2711786 - protein, 25 aa, Entamoeba histolytica
EVNHVMMLVLLFKEAKVSVLRYDET

SEQ ID NO: 2711787 - protein, 17 aa, Entamoeba histolytica
EVNIFDLHPPAVPAWEL

SEQ ID NO: 2711788 - protein, 29 aa, Entamoeba histolytica
EVNPKIYRFRPFIIKLTINTSFGIEFTGE

SEQ ID NO: 2711789 - protein, 30 aa, Entamoeba histolytica
EVNPKIYRFRPFIIKLTINTSFGIEFTGEE

SEQ ID NO: 2711790 - protein, 22 aa, Entamoeba histolytica
EVPLGFDNYVLWVKGEDADLKV

SEQ ID NO: 2711791 - protein, 28 aa, Entamoeba histolytica
EVQLIPNKINCGWTITLLLDLIKEEEIF

SEQ ID NO: 2711792 - protein, 23 aa, Entamoeba histolytica
EVRELYELLFSLLTRNDVDFVQR

SEQ ID NO: 2711793 - protein, 23 aa, Entamoeba histolytica
EVRGYLIGVVLKLVEMRKYDSLI

SEQ ID NO: 2711794 - protein, 25 aa, Entamoeba histolytica
EVRIIEEYYIYLQNWSNLNEYQILF

SEQ ID NO: 2711795 - protein, 17 aa, Entamoeba histolytica
EVRILVYQFYKVFINYY

SEQ ID NO: 2711796 - protein, 29 aa, Entamoeba histolytica
EVRKVYVSILIMFPLWEWNKLLVHSIEIP

SEQ ID NO: 2711797 - protein, 21 aa, Entamoeba histolytica
EVRLLDHLNLLKKVMDGISQS

SEQ ID NO: 2711798 - protein, 27 aa, Entamoeba histolytica
EVRQSIYKMMKWWFDKGIDGFRMDVIN

SEQ ID NO: 2711799 - protein, 20 aa, Entamoeba histolytica
EVSCDIFYQDSKRKYIEFES

SEQ ID NO: 2711800 - protein, 26 aa, Entamoeba histolytica
EVSEMFKKWAIQRNAFIDKFDSTRKD

SEQ ID NO: 2711801 - protein, 23 aa, Entamoeba histolytica
EVSFLEYTPINYYIKYIDVFLHM

SEQ ID NO: 2711802 - protein, 30 aa, Entamoeba histolytica; identical to SEQ ID NO: 2523651

SEQ ID NO: 2711803 - protein, 31 aa, Entamoeba histolytica
EVSLCFACQFHLLRLLYYKNLSIPIENACHN

SEQ ID NO: 2711804 - protein, 21 aa, Entamoeba histolytica
EVSLLMKYFVRVYDNKRIIEI

SEQ ID NO: 2711805 - protein, 27 aa, Entamoeba histolytica
EVSRSLLYAIISLYLRSGFYGRVNDVD

SEQ ID NO: 2711806 - protein, 21 aa, Entamoeba histolytica
EVSSVPPLPPKPRQQQGETYI

SEQ ID NO: 2711807 - protein, 28 aa, Entamoeba histolytica
EVSTAFFGHLIHLFGVFYKSKDVFKSMI

SEQ ID NO: 2711808 - protein, 21 aa, Entamoeba histolytica
EVTISYRNKLLYSIKDINRKA

SEQ ID NO: 2711809 - protein, 29 aa, Entamoeba histolytica
EVTQKFLNKWIGIKSCLLTSTPMVASIQY

SEQ ID NO: 2711810 - protein, 19 aa, Entamoeba histolytica
EVTQLKYEIQSFILKQQKA

SEQ ID NO: 2711811 - protein, 22 aa, Entamoeba histolytica
EVVDIITFIPYNNWQVFFEPFD

SEQ ID NO: 2711812 - protein, 30 aa, Entamoeba histolytica; identical to SEQ ID NO: 2523665

SEQ ID NO: 2711813 - protein, 26 aa, Entamoeba histolytica
EVVDSKMVGILIRRSFHNTGVDIVRI

SEQ ID NO: 2711814 - protein, 20 aa, Entamoeba histolytica
EVVFKILKLLTNIASIDGSF

SEQ ID NO: 2711815 - protein, 31 aa, Entamoeba histolytica
EVVFNCQAVLPPCSITYLLDTNGSVEIGSSG

SEQ ID NO: 2711816 - protein, 21 aa, Entamoeba histolytica
EVVLYAHYMKLQYFSVECTYA

SEQ ID NO: 2711817 - protein, 22 aa, Entamoeba histolytica
EVVNDVLKKAIDLASEIIGENE

SEQ ID NO: 2711818 - protein, 18 aa, Entamoeba histolytica
EVVNITCPNPFQLPPMTP

SEQ ID NO: 2711819 - protein, 20 aa, Entamoeba histolytica
EVVRNIYIELTPFSEANGLL

SEQ ID NO: 2711820 - protein, 25 aa, Entamoeba histolytica
EVVRRDVFDLPLKRKEPILTTEESN

SEQ ID NO: 2711821 - protein, 26 aa, Entamoeba histolytica
EVWVAPLYFEFPGYEQAMFKERFCDF

SEQ ID NO: 2711822 - protein, 25 aa, Entamoeba histolytica
EVYLRQLYNYKCDIWSLGAMYYYLR

SEQ ID NO: 2711823 - protein, 17 aa, Entamoeba histolytica
EVYLVCKDFLAPSKYDP

SEQ ID NO: 2711824 - protein, 28 aa, Entamoeba histolytica
EVYVYKDHFVFFDLPTKIANKLLKSKSK

SEQ ID NO: 2711825 - protein, 21 aa, Entamoeba histolytica
EWCGPCRFISPLFEQYSRQYP

SEQ ID NO: 2711826 - protein, 18 aa, Entamoeba histolytica
EWDVTGKLLSLFSAPKYE

SEQ ID NO: 2711827 - protein, 26 aa, Entamoeba histolytica
EWEEKKRCTPLPRKFIKFVEGPEVKN

SEQ ID NO: 2711828 - protein, 26 aa, Entamoeba histolytica
EWIEENIKSIDFWENFDSQRPKGVFI

SEQ ID NO: 2711829 - protein, 26 aa, Entamoeba histolytica
EWIPKELLTNIFIKKIISLLTQEHQL

SEQ ID NO: 2711830 - protein, 27 aa, Entamoeba histolytica
EWKEYRDKIITKIRSISPVFNSVYPKR

SEQ ID NO: 2711831 - protein, 17 aa, Entamoeba histolytica
EWKGKKLIHFGAVDYEA

SEQ ID NO: 2711832 - protein, 33 aa, Entamoeba histolytica; identical to SEQ ID NO: 2523678

SEQ ID NO: 2711833 - protein, 23 aa, Entamoeba histolytica
EWKKSIELVIKNADYHYLVNEMN

SEQ ID NO: 2711834 - protein, 20 aa, Entamoeba histolytica
EWLFWDVSGAAKFRGLWKSY

SEQ ID NO: 2711835 - protein, 20 aa, Entamoeba histolytica
EWLNRINPLYPFLQPELQEQ

SEQ ID NO: 2711836 - protein, 18 aa, Entamoeba histolytica
EWLRVCTGAYIMQSYGLT

SEQ ID NO: 2711837 - protein, 24 aa, Entamoeba histolytica
EWNSNDIELFKKGCKKFPVGTEGR

SEQ ID NO: 2711838 - protein, 22 aa, Entamoeba histolytica
EWQKVLNWLTRNGYLLTDNDFR

SEQ ID NO: 2711839 - protein, 24 aa, Entamoeba histolytica
EWRRLQFCFVINRVNYYLTRQEEL

SEQ ID NO: 2711840 - protein, 21 aa, Entamoeba histolytica
EYAFAIVNAINKLRNIPFITG

SEQ ID NO: 2711841 - protein, 23 aa, Entamoeba histolytica
EYAKHLIQQCSTPMRVGTLLLKK

SEQ ID NO: 2711842 - protein, 18 aa, Entamoeba histolytica
EYAQKYPFVCFAKITWED

SEQ ID NO: 2711843 - protein, 24 aa, Entamoeba histolytica
EYASMLDQYFRNGHGFLIVYSVTD

SEQ ID NO: 2711844 - protein, 26 aa, Entamoeba histolytica
EYCEKHPKFIILLPSKNEAAQEIQQS

SEQ ID NO: 2711845 - protein, 21 aa, Entamoeba histolytica
EYCFRLQKDRVYYVRLSIAEQ

SEQ ID NO: 2711846 - protein, 18 aa, Entamoeba histolytica
EYCLMIKKWFSSIKNGTE

SEQ ID NO: 2711847 - protein, 28 aa, Entamoeba histolytica
EYCTDLFQFFIMTLFKQINAQGYHLLLP

SEQ ID NO: 2711848 - protein, 27 aa, Entamoeba histolytica
EYDESENGFYTIYNNLFNSILEEEGGG

SEQ ID NO: 2711849 - protein, 24 aa, Entamoeba histolytica
EYDKYGIIIKTMFRKEGSLQQLNA

SEQ ID NO: 2711850 - protein, 25 aa, Entamoeba histolytica
EYDQLRPLSYSSASIFLICFSVTSS

SEQ ID NO: 2711851 - protein, 25 aa, Entamoeba histolytica
EYDRLRPMSYPDTNILIICFAIDSK

SEQ ID NO: 2711852 - protein, 26 aa, Entamoeba histolytica
EYDRLRPMSYPNTNILIICFSIDSRS

SEQ ID NO: 2711853 - protein, 19 aa, Entamoeba histolytica
EYDVFVYYKHRVKALTLII

SEQ ID NO: 2711854 - protein, 24 aa, Entamoeba histolytica
EYDYATAYEILYSNAHSCIIQYNE

SEQ ID NO: 2711855 - protein, 17 aa, Entamoeba histolytica
EYENKIKMLIPLEILRA

SEQ ID NO: 2711856 - protein, 23 aa, Entamoeba histolytica
EYEVFGPIGEFIRLKDNKWNHAT

SEQ ID NO: 2711857 - protein, 26 aa, Entamoeba histolytica
EYFEKTIHFILITFPSLETISVPYKF

SEQ ID NO: 2711858 - protein, 19 aa, Entamoeba histolytica
EYFIKLLITKHFNVNENQL

SEQ ID NO: 2711859 - protein, 22 aa, Entamoeba histolytica
EYFPNLINYSYMVFISFSSIQL

SEQ ID NO: 2711860 - protein, 23 aa, Entamoeba histolytica
EYFRNALFKYFDKYLREITMNKG

SEQ ID NO: 2711861 - protein, 18 aa, Entamoeba histolytica
EYGEIKKIVIIKDLKGIN

SEQ ID NO: 2711862 - protein, 19 aa, Entamoeba histolytica
EYGGGIMQILLKKTKGIDI

SEQ ID NO: 2711863 - protein, 30 aa, Entamoeba histolytica
EYGKISRQALFSIFLDFIQKQTNCEIAFIS

SEQ ID NO: 2711864 - protein, 22 aa, Entamoeba histolytica
EYGYESIMKYLDGIRYKKSDLI

SEQ ID NO: 2711865 - protein, 21 aa, Entamoeba histolytica
EYHFKTISKFQLFNKVKINAS

SEQ ID NO: 2711866 - protein, 27 aa, Entamoeba histolytica
EYICCEQLFLIYTYFLKDIDKTPQSTY

SEQ ID NO: 2711867 - protein, 20 aa, Entamoeba histolytica
EYIEIVLSTTPKFFERMYCM

SEQ ID NO: 2711868 - protein, 18 aa, Entamoeba histolytica
EYIHLYYKNDSILSFIEL

SEQ ID NO: 2711869 - protein, 23 aa, Entamoeba histolytica
EYIIINRWCNCTINFLSSSGCFK

SEQ ID NO: 2711870 - protein, 20 aa, Entamoeba histolytica
EYIQPLIIGCWRLCNEDKCQ

SEQ ID NO: 2711871 - protein, 25 aa, Entamoeba histolytica
EYKEKCVFMIKYSLELRQWKEMKNN

SEQ ID NO: 2711872 - protein, 21 aa, Entamoeba histolytica
EYKEKILTFDGINLGGNKIEV

SEQ ID NO: 2711873 - protein, 25 aa, Entamoeba histolytica
EYKNTKYFIIRSKIIMNIRSEQLFE

SEQ ID NO: 2711874 - protein, 25 aa, Entamoeba histolytica
EYKSAFYLMLNGRKKYLGDLGLDDY

SEQ ID NO: 2711875 - protein, 29 aa, Entamoeba histolytica
EYKYDYLISPLMRQADFDAKPMVLFLGQY

SEQ ID NO: 2711876 - protein, 17 aa, Entamoeba histolytica
EYLFYNKSRNDPYHIRQ

SEQ ID NO: 2711877 - protein, 19 aa, Entamoeba histolytica
EYLHNSPIFNYPVANKTKT

SEQ ID NO: 2711878 - protein, 18 aa, Entamoeba histolytica
EYLQTILTPFFDSLQRKE

SEQ ID NO: 2711879 - protein, 28 aa, Entamoeba histolytica
EYLRELPDPLIPFQYYNEFVILGRLKDG

SEQ ID NO: 2711880 - protein, 26 aa, Entamoeba histolytica
EYLTDKLVPFSIPTYIFQLQEMPRTS

SEQ ID NO: 2711881 - protein, 18 aa, Entamoeba histolytica
EYLVFFNNHLREINTVLN

SEQ ID NO: 2711882 - protein, 20 aa, Entamoeba histolytica
EYLYVNMGIVIQADPFGAPY

SEQ ID NO: 2711883 - protein, 20 aa, Entamoeba histolytica
EYLYVNMGIVIQANPFGAPY

SEQ ID NO: 2711884 - protein, 19 aa, Entamoeba histolytica
EYMEKKYTDIFKGIRNNKG

SEQ ID NO: 2711885 - protein, 18 aa, Entamoeba histolytica
EYMKYLQDPKFKDNFREF

SEQ ID NO: 2711886 - protein, 26 aa, Entamoeba histolytica
EYMLLANVWVAKKIYDAFPHCAMLRR

SEQ ID NO: 2711887 - protein, 28 aa, Entamoeba histolytica
EYMREIIAIDPQWLIELAPAFYQKSDGT

SEQ ID NO: 2711888 - protein, 33 aa, Entamoeba histolytica
EYNDYLQILLNNMPFGLQRILGNFTFSNVLSIV

SEQ ID NO: 2711889 - protein, 17 aa, Entamoeba histolytica
EYNFRELNYGKSLLKFF

SEQ ID NO: 2711890 - protein, 24 aa, Entamoeba histolytica
EYNPRIIWLHREPIGNIKSAILLY

SEQ ID NO: 2711891 - protein, 23 aa, Entamoeba histolytica
EYNQLYKIISMIGPPPTEMLETA

SEQ ID NO: 2711892 - protein, 17 aa, Entamoeba histolytica
EYPLDIQTFLQPSLPTT

SEQ ID NO: 2711893 - protein, 19 aa, Entamoeba histolytica
EYPLLLMSDGWYTIQIQID

SEQ ID NO: 2711894 - protein, 28 aa, Entamoeba histolytica
EYQIEQEIAFIIIVGNKIDLPSKVTNEQ

SEQ ID NO: 2711895 - protein, 21 aa, Entamoeba histolytica
EYQLYIGWYDGNPAHLDQLQP

SEQ ID NO: 2711896 - protein, 20 aa, Entamoeba histolytica
EYQNALVKVYLLSKDQTISQ

SEQ ID NO: 2711897 - protein, 18 aa, Entamoeba histolytica
EYQSPEMILLYENQPISR

SEQ ID NO: 2711898 - protein, 22 aa, Entamoeba histolytica
EYQTMIDPYIRQTNSFLIVYSI

SEQ ID NO: 2711899 - protein, 21 aa, Entamoeba histolytica
EYRTFFDNIKPSKKLIPLINA

SEQ ID NO: 2711900 - protein, 19 aa, Entamoeba histolytica
EYRVWNPYRSKLGCTILKG

SEQ ID NO: 2711901 - protein, 32 aa, Entamoeba histolytica; identical to SEQ ID NO: 2523758

SEQ ID NO: 2711902 - protein, 24 aa, Entamoeba histolytica
EYSHYIICYIIKNYPKESKVYLEQ

SEQ ID NO: 2711903 - protein, 27 aa, Entamoeba histolytica
EYSRYSTIFTLYRSLGKKTIEAFLIVS

SEQ ID NO: 2711904 - protein, 25 aa, Entamoeba histolytica
EYSTDIYDLIFFNDTYCYNLSLLSP

SEQ ID NO: 2711905 - protein, 25 aa, Entamoeba histolytica
EYTDLLNMPSLVKKNYFEIFNMIDQ

SEQ ID NO: 2711906 - protein, 31 aa, Entamoeba histolytica
EYTGWVIPDPLCLMCYLFPEIITHTDVVETS

SEQ ID NO: 2711907 - protein, 29 aa, Entamoeba histolytica
EYTNKLKDFIRLLILRHKHFLFEGTSQFS

SEQ ID NO: 2711908 - protein, 20 aa, Entamoeba histolytica
EYTNLYIGNIPYSSTEKDVK

SEQ ID NO: 2711909 - protein, 17 aa, Entamoeba histolytica
EYTPFGPRFDNTVLHLL

SEQ ID NO: 2711910 - protein, 17 aa, Entamoeba histolytica
EYTPLVFHPIEVTDFKG

SEQ ID NO: 2711911 - protein, 19 aa, Entamoeba histolytica
EYTWAFPPTKASGFFVGPF

SEQ ID NO: 2711912 - protein, 22 aa, Entamoeba histolytica
EYVEILIMRALSLGLVKGYISQ

SEQ ID NO: 2711913 - protein, 18 aa, Entamoeba histolytica
EYVHCDCIHFSLSKLNIE

SEQ ID NO: 2711914 - protein, 22 aa, Entamoeba histolytica
EYVIFQFVEIATKALVSFLSEI

SEQ ID NO: 2711915 - protein, 17 aa, Entamoeba histolytica
EYVSLPQTPQDTSLLFV

SEQ ID NO: 2711916 - protein, 23 aa, Entamoeba histolytica
EYVSRLYIGPKIAPLFVNKFEHC

SEQ ID NO: 2711917 - protein, 17 aa, Entamoeba histolytica
EYWHDCIPISKKGFLYV

SEQ ID NO: 2711918 - protein, 31 aa, Entamoeba histolytica; identical to SEQ ID NO: 2523774

SEQ ID NO: 2711919 - protein, 17 aa, Entamoeba histolytica
EYYKMYCERVRIRDIVI

SEQ ID NO: 2711920 - protein, 19 aa, Entamoeba histolytica
EYYLVKWKDYSILECSWVE

SEQ ID NO: 2711921 - protein, 23 aa, Entamoeba histolytica
EYYQIAKYCTKFTIFHQDYIMRE

SEQ ID NO: 2711922 - protein, 38 aa, Entamoeba histolytica
FAALFVPDEPIRFLPPVEKHWFPNYSGVSSYLTMFDEL

SEQ ID NO: 2711923 - protein, 27 aa, Entamoeba histolytica
FAASPRALITLLFFPQQPEPDFPNRLA

SEQ ID NO: 2711924 - protein, 18 aa, Entamoeba histolytica
FACNCFGNIWDVSLQRKI

SEQ ID NO: 2711925 - protein, 35 aa, Entamoeba histolytica
FADEPPLLDIRINLTAPVIYFYYDGKEKGMDNNIA

SEQ ID NO: 2711926 - protein, 20 aa, Entamoeba histolytica
FAELPLFLCVALINKYSSEL

SEQ ID NO: 2711927 - protein, 23 aa, Entamoeba histolytica
FAEMIVSYLLRFGNDIDSWNSGN

SEQ ID NO: 2711928 - protein, 23 aa, Entamoeba histolytica
FAEQLMVYDINLFGNIPLKEIIL

SEQ ID NO: 2711929 - protein, 25 aa, Entamoeba histolytica
FAFAQKFPSPRLGLIEVIKGDPAKQ

SEQ ID NO: 2711930 - protein, 18 aa, Entamoeba histolytica
FAFDDAINLLINCNKWIG

SEQ ID NO: 2711931 - protein, 18 aa, Entamoeba histolytica
FAFIGNRFEFRAVGSEQN

SEQ ID NO: 2711932 - protein, 19 aa, Entamoeba histolytica
FAFIGNRFEFRAVGSSQNP

SEQ ID NO: 2711933 - protein, 28 aa, Entamoeba histolytica
FAFPTSKFYYFLVVALIKEYADDIIDNQ

SEQ ID NO: 2711934 - protein, 22 aa, Entamoeba histolytica
FAFRWFNCFLLREMSLEKGLRL

SEQ ID NO: 2711935 - protein, 17 aa, Entamoeba histolytica
FAFTKEFDNLLKESIQP

SEQ ID NO: 2711936 - protein, 26 aa, Entamoeba histolytica
FAHPENWDFIFPITVLIKNNDRIRTY

SEQ ID NO: 2711937 - protein, 35 aa, Entamoeba histolytica
FAIGTTLLCGLIGQIPNIPYWIWDEHLEKNEEPIK

SEQ ID NO: 2711938 - protein, 29 aa, Entamoeba histolytica
FAKALFNRFQQWPPNLYFKGYSTFDVSNI

SEQ ID NO: 2711939 - protein, 26 aa, Entamoeba histolytica
FAKRCYYWIHFGFTELGDLGGLGIGM

SEQ ID NO: 2711940 - protein, 29 aa, Entamoeba histolytica
FAKTNSVQLFIPFRPMLAKPKKSITDITS

SEQ ID NO: 2711941 - protein, 26 aa, Entamoeba histolytica
FAKVDIPQFVPFIPKVLQSIGSMLSR

SEQ ID NO: 2711942 - protein, 18 aa, Entamoeba histolytica
FALDFFNIALQPSEDQSN

SEQ ID NO: 2711943 - protein, 18 aa, Entamoeba histolytica
FALKYLPKCVYSLNISHT

SEQ ID NO: 2711944 - protein, 24 aa, Entamoeba histolytica
FAMQRQGIIIIPMYGTFGIDALDY

SEQ ID NO: 2711945 - protein, 25 aa, Entamoeba histolytica
FANCYSLINLVLPTSLVLIKRLCFS

SEQ ID NO: 2711946 - protein, 28 aa, Entamoeba histolytica
FANSVFQVLCSLPPFVEYLKKVNPTDDM

SEQ ID NO: 2711947 - protein, 18 aa, Entamoeba histolytica
FANYVIQKAIEFIPESRH

SEQ ID NO: 2711948 - protein, 19 aa, Entamoeba histolytica
FAPKGRKLPITFEGEYFNA

SEQ ID NO: 2711949 - protein, 27 aa, Entamoeba histolytica
FAQETPCQMLFTFRFNTAEICKQFKEA

SEQ ID NO: 2711950 - protein, 31 aa, Entamoeba histolytica; identical to SEQ ID NO: 2523819

SEQ ID NO: 2711951 - protein, 28 aa, Entamoeba histolytica
FATDDFINVIIFLILRSHVKNPFGMTSL

SEQ ID NO: 2711952 - protein, 17 aa, Entamoeba histolytica
FAVIPYTKVGKQVDVCL

SEQ ID NO: 2711953 - protein, 21 aa, Entamoeba histolytica
FAVRLMELDLLSRVIARREVI

SEQ ID NO: 2711954 - protein, 24 aa, Entamoeba histolytica
FAWNLLHLDYYCDITLPIITPRPV

SEQ ID NO: 2711955 - protein, 26 aa, Entamoeba histolytica
FAYDSYRRFVSLFGKIALNVDDEVYD

SEQ ID NO: 2711956 - protein, 20 aa, Entamoeba histolytica
FCALIHRHRPDLLDWETVGE

SEQ ID NO: 2711957 - protein, 17 aa, Entamoeba histolytica
FCCEKHLSGTRVVIEIK

SEQ ID NO: 2711958 - protein, 17 aa, Entamoeba histolytica
FCCTSLTSIYLPTHLTS

SEQ ID NO: 2711959 - protein, 23 aa, Entamoeba histolytica
FCCYFDCLFYGKAHLTTKPGQPT

SEQ ID NO: 2711960 - protein, 26 aa, Entamoeba histolytica
FCDENEWFYFHEIKPLIKQTFPTINK

SEQ ID NO: 2711961 - protein, 25 aa, Entamoeba histolytica
FCEDTTEPYFRAPASFLPIRERREE

SEQ ID NO: 2711962 - protein, 23 aa, Entamoeba histolytica
FCEKKLVLPDNLPKIVILDEADS

SEQ ID NO: 2711963 - protein, 19 aa, Entamoeba histolytica
FCEQTLDLRFVPDDTEFPY

SEQ ID NO: 2711964 - protein, 18 aa, Entamoeba histolytica
FCEYSPEYLANITTSPLL

SEQ ID NO: 2711965 - protein, 19 aa, Entamoeba histolytica
FCFHKYRDLYESTIGIEMS

SEQ ID NO: 2711966 - protein, 19 aa, Entamoeba histolytica
FCFLHSLIQQQPLLRKTSP

SEQ ID NO: 2711967 - protein, 18 aa, Entamoeba histolytica
FCFVINRVNYYLTREEEL

SEQ ID NO: 2711968 - protein, 18 aa, Entamoeba histolytica
FCHVLPHRFIANALREKK

SEQ ID NO: 2711969 - protein, 18 aa, Entamoeba histolytica
FCIALLNRHCDINLKKRS

SEQ ID NO: 2711970 - protein, 21 aa, Entamoeba histolytica
FCIYCSSYGYWPTFTLVKVEQ

SEQ ID NO: 2711971 - protein, 17 aa, Entamoeba histolytica
FCKLRRTLYAKALMIRY

SEQ ID NO: 2711972 - protein, 18 aa, Entamoeba histolytica
FCLAKIFSYDSSLISHYL

SEQ ID NO: 2711973 - protein, 18 aa, Entamoeba histolytica
FCLCGQRFCFKCLGEYHA

SEQ ID NO: 2711974 - protein, 17 aa, Entamoeba histolytica
FCLVCVRQIFRKDNICP

SEQ ID NO: 2711975 - protein, 18 aa, Entamoeba histolytica
FCLVDYVLCNSPSFRRQV

SEQ ID NO: 2711976 - protein, 19 aa, Entamoeba histolytica
FCMIRSMCKIRVGSEAKDY

SEQ ID NO: 2711977 - protein, 18 aa, Entamoeba histolytica
FCNDDLLNLLTFEMIKDI

SEQ ID NO: 2711978 - protein, 17 aa, Entamoeba histolytica
FCNEDLFELLMNELLNE

SEQ ID NO: 2711979 - protein, 18 aa, Entamoeba histolytica
FCNSYFCRKLESGNFNEL

SEQ ID NO: 2711980 - protein, 24 aa, Entamoeba histolytica
FCPKCGYHDLRRISYYVLANGSIK

SEQ ID NO: 2711981 - protein, 18 aa, Entamoeba histolytica
FCPYGAIISKSVPCVKAC

SEQ ID NO: 2711982 - protein, 18 aa, Entamoeba histolytica
FCQMFNTNELYYIWDILF

SEQ ID NO: 2711983 - protein, 22 aa, Entamoeba histolytica
FCQNRNGVIGIGEWYEKFKQLI

SEQ ID NO: 2711984 - protein, 36 aa, Entamoeba histolytica
FCQSKFLATFFVYSITHLIFYHKNDIRIMASLCLLE

SEQ ID NO: 2711985 - protein, 29 aa, Entamoeba histolytica
FCQTHNKYFQYYFFSQPILMVRMSITEVP

SEQ ID NO: 2711986 - protein, 17 aa, Entamoeba histolytica
FCRVCSYRLGITKLDIP

SEQ ID NO: 2711987 - protein, 19 aa, Entamoeba histolytica
FCSALKERFSDFIGEGLLL

SEQ ID NO: 2711988 - protein, 17 aa, Entamoeba histolytica
FCSKIRKIRIDGYYCKK

SEQ ID NO: 2711989 - protein, 37 aa, Entamoeba histolytica
FCSNKTVLKVFWFLGPRDLFVLPFVCRKFRAALTSEV

SEQ ID NO: 2711990 - protein, 23 aa, Entamoeba histolytica
FCTSPLITIIIPIAYHQEIEIKT

SEQ ID NO: 2711991 - protein, 35 aa, Entamoeba histolytica
FCVECYKRLCLTLGTPQQFISNKARWKCFVCSCCE

SEQ ID NO: 2711992 - protein, 18 aa, Entamoeba histolytica
FCVICGCPLLLDEDIRSM

SEQ ID NO: 2711993 - protein, 22 aa, Entamoeba histolytica
FCVLLRLFQLNPTPDDIRMMST

SEQ ID NO: 2711994 - protein, 17 aa, Entamoeba histolytica
FCVPRKSEFFQDDIFPN

SEQ ID NO: 2711995 - protein, 33 aa, Entamoeba histolytica
FCYVINNPLDWSYSYCLPLFIVSYRNHSEVDYV

SEQ ID NO: 2711996 - protein, 26 aa, Entamoeba histolytica
FDAARDWMTLFAKIATHILIVKDYKE

SEQ ID NO: 2711997 - protein, 19 aa, Entamoeba histolytica
FDAGVTDLIWRNQTNFLAG

SEQ ID NO: 2711998 - protein, 22 aa, Entamoeba histolytica
FDAKILEIVQPKPGTFIGDGIT

SEQ ID NO: 2711999 - protein, 18 aa, Entamoeba histolytica
FDAKLDAFTYTSTPERTG

SEQ ID NO: 2712000 - protein, 20 aa, Entamoeba histolytica
FDCLPLCALINQNVNGRILC

SEQ ID NO: 2712001 - protein, 19 aa, Entamoeba histolytica
FDCLPLCGIVNSNLGSFFC

SEQ ID NO: 2712002 - protein, 20 aa, Entamoeba histolytica
FDCMTRMYVWMGDESIPLQQ

SEQ ID NO: 2712003 - protein, 17 aa, Entamoeba histolytica
FDCPYSERLFKWFTKRN

SEQ ID NO: 2712004 - protein, 20 aa, Entamoeba histolytica
FDDDRLIPVFGFGDSKTGDR

SEQ ID NO: 2712005 - protein, 26 aa, Entamoeba histolytica
FDDFISKLVKLPRKSLEKSREVLKRR

SEQ ID NO: 2712006 - protein, 25 aa, Entamoeba histolytica
FDDHKLLSLLNDLPYFTNNLSLLHI

SEQ ID NO: 2712007 - protein, 30 aa, Entamoeba histolytica
FDDILFVTVHPIFNNPFIIVELPDGSSHKI

SEQ ID NO: 2712008 - protein, 25 aa, Entamoeba histolytica
FDDKYNYLTYFPLYVKFATTSVQHR

SEQ ID NO: 2712009 - protein, 21 aa, Entamoeba histolytica
FDDLFQAKRKIDLNMIFSIPF

SEQ ID NO: 2712010 - protein, 35 aa, Entamoeba histolytica; identical to SEQ ID NO: 2523874

SEQ ID NO: 2712011 - protein, 17 aa, Entamoeba histolytica
FDDSLIKIILDKIKESV

SEQ ID NO: 2712012 - protein, 23 aa, Entamoeba histolytica
FDDVVFIIECGNSVWVGLNTNQL

SEQ ID NO: 2712013 - protein, 27 aa, Entamoeba histolytica
FDDYDSLIPVPILYDIIRTAIDHKRTI

SEQ ID NO: 2712014 - protein, 28 aa, Entamoeba histolytica
FDEDEQLWYWNYDGTKLPLYINSTIRFK

SEQ ID NO: 2712015 - protein, 38 aa, Entamoeba histolytica
FDEFMNGLTEISFKLKEMYYLLTQGGVAELELVDTLNP

SEQ ID NO: 2712016 - protein, 27 aa, Entamoeba histolytica
FDEQKLHLKGYIPLAFGTITRSPEMKK

SEQ ID NO: 2712017 - protein, 17 aa, Entamoeba histolytica
FDFYVDSILPRVLSEEL

SEQ ID NO: 2712018 - protein, 26 aa, Entamoeba histolytica
FDGNIKKFYILYPVTYNAFLNEKENG

SEQ ID NO: 2712019 - protein, 47 aa, Entamoeba histolytica; identical to SEQ ID NO: 2523895

SEQ ID NO: 2712020 - protein, 19 aa, Entamoeba histolytica
FDHIALLVYGIFNVKVSTD

SEQ ID NO: 2712021 - protein, 18 aa, Entamoeba histolytica
FDHIHPRNKLKRFQSCVF

SEQ ID NO: 2712022 - protein, 25 aa, Entamoeba histolytica
FDHSIKLWSLKNWNWKLVCKYEEHS

SEQ ID NO: 2712023 - protein, 26 aa, Entamoeba histolytica
FDIYNQCFQLIPLAQEYYQLLVRALA

SEQ ID NO: 2712024 - protein, 34 aa, Entamoeba histolytica
FDKDLGICTAILKKFLYELPTPLIPQTNIKYLRD

SEQ ID NO: 2712025 - protein, 23 aa, Entamoeba histolytica
FDKEKIQLKLMQRLGVFEIIGGN

SEQ ID NO: 2712026 - protein, 18 aa, Entamoeba histolytica
FDKEPMIFFINRKSGNLL

SEQ ID NO: 2712027 - protein, 35 aa, Entamoeba histolytica
FDKGTLILFQLSSSLLHILAYKYPNFTLPIYDSIE

SEQ ID NO: 2712028 - protein, 26 aa, Entamoeba histolytica
FDKHVGYLAFVLLFSNVPESSRMIIN

SEQ ID NO: 2712029 - protein, 17 aa, Entamoeba histolytica
FDKIIIEFLNDLGKKSF

SEQ ID NO: 2712030 - protein, 24 aa, Entamoeba histolytica
FDKIVKIWDIKMMKAPKAMYKISY

SEQ ID NO: 2712031 - protein, 32 aa, Entamoeba histolytica
FDKKNDLPSLLLLPIKFLPQFYSLIKEYHKCL

SEQ ID NO: 2712032 - protein, 31 aa, Entamoeba histolytica
FDKRNDLPSLLLLPIKFLPQFYSLIKEYHKC

SEQ ID NO: 2712033 - protein, 25 aa, Entamoeba histolytica
FDLEQYLYIILGEKKFHTIYDSRQD

SEQ ID NO: 2712034 - protein, 17 aa, Entamoeba histolytica
FDLKHFIQINHKCQRVC

SEQ ID NO: 2712035 - protein, 17 aa, Entamoeba histolytica
FDLLKKKCDEFETIGAT

SEQ ID NO: 2712036 - protein, 26 aa, Entamoeba histolytica
FDLNGTIYHCYLPKSLPSSSQVYFKM

SEQ ID NO: 2712037 - protein, 17 aa, Entamoeba histolytica
FDMFHWGHANVIRQAAA

SEQ ID NO: 2712038 - protein, 26 aa, Entamoeba histolytica
FDMKNALLYIRHFQSLLQQNHHGLTC

SEQ ID NO: 2712039 - protein, 29 aa, Entamoeba histolytica
FDNDILKKRFLLHKLLLLHQLDTQFEYVQ

SEQ ID NO: 2712040 - protein, 21 aa, Entamoeba histolytica
FDNFPVLCEILRAVTKKRCVT

SEQ ID NO: 2712041 - protein, 26 aa, Entamoeba histolytica
FDNKSSFLLHPIFNHPKNDFLSQDVY

SEQ ID NO: 2712042 - protein, 26 aa, Entamoeba histolytica
FDNNNTINLLLFNYPEVTIPHLMDEF

SEQ ID NO: 2712043 - protein, 17 aa, Entamoeba histolytica
FDPNYSTLFITGGGIDG

SEQ ID NO: 2712044 - protein, 27 aa, Entamoeba histolytica
FDPRPNTIRAFYRLLEQHRKNAQGDPF

SEQ ID NO: 2712045 - protein, 19 aa, Entamoeba histolytica
FDPRQYLGPARQALKELYL

SEQ ID NO: 2712046 - protein, 21 aa, Entamoeba histolytica
FDPSLPRSGSLSPKPGSRKIK

SEQ ID NO: 2712047 - protein, 24 aa, Entamoeba histolytica
FDQFQLFMIVYERSLNPDTLSLAL

SEQ ID NO: 2712048 - protein, 21 aa, Entamoeba histolytica
FDQICLAFRSVLRRESNLIVD

SEQ ID NO: 2712049 - protein, 26 aa, Entamoeba histolytica
FDQKCPPFLIGPLKKNILPIESVEMI

SEQ ID NO: 2712050 - protein, 27 aa, Entamoeba histolytica
FDQNKKQILQLFNTLVRKYHYKEHNLH

SEQ ID NO: 2712051 - protein, 21 aa, Entamoeba histolytica
FDQQIALAFMYGYGSVGFNSA

SEQ ID NO: 2712052 - protein, 17 aa, Entamoeba histolytica
FDQSEVHPLIYNNLHAS

SEQ ID NO: 2712053 - protein, 22 aa, Entamoeba histolytica
FDRINVIVIIHSFSKMLLDELK

SEQ ID NO: 2712054 - protein, 25 aa, Entamoeba histolytica
FDRIRNRAYPDTDVFLICYAVDDQN

SEQ ID NO: 2712055 - protein, 19 aa, Entamoeba histolytica
FDRVFQRYSAIAERLWSKE

SEQ ID NO: 2712056 - protein, 20 aa, Entamoeba histolytica
FDSCIPILISILNKNTRGNG

SEQ ID NO: 2712057 - protein, 26 aa, Entamoeba histolytica
FDSDVLPTIKLLLQNGTPIIKSALLA

SEQ ID NO: 2712058 - protein, 17 aa, Entamoeba histolytica
FDSFPIAVRVGTKELGD

SEQ ID NO: 2712059 - protein, 18 aa, Entamoeba histolytica
FDSKFNYKELFTDVKNRK

SEQ ID NO: 2712060 - protein, 18 aa, Entamoeba histolytica
FDSLKLIFDKFYSIDSSQ

SEQ ID NO: 2712061 - protein, 22 aa, Entamoeba histolytica
FDSLVKHITLKDKQYDIVLCDT

SEQ ID NO: 2712062 - protein, 35 aa, Entamoeba histolytica
FDTIKYRHLWSYILHIIRLFISFSFKNPKLPCFNC

SEQ ID NO: 2712063 - protein, 25 aa, Entamoeba histolytica
FDTYKKLLDLLKKYNKNYFVKTTNV

SEQ ID NO: 2712064 - protein, 29 aa, Entamoeba histolytica
FDVDTWRNFCEVFRYLPVSALIEGKILCL

SEQ ID NO: 2712065 - protein, 17 aa, Entamoeba histolytica
FDVIIIDQLYQSTLQKL

SEQ ID NO: 2712066 - protein, 19 aa, Entamoeba histolytica
FDVILSLTLLRNVSQFKRS

SEQ ID NO: 2712067 - protein, 18 aa, Entamoeba histolytica
FDWITLFEKVHSTIIKST

SEQ ID NO: 2712068 - protein, 19 aa, Entamoeba histolytica
FDYLRIKQYLNTENFRCIC

SEQ ID NO: 2712069 - protein, 26 aa, Entamoeba histolytica
FDYRIFTTSFYIPLGSSIIFSSPFAF

SEQ ID NO: 2712070 - protein, 19 aa, Entamoeba histolytica
FDYSTIDGWLLLSIPGIHK

SEQ ID NO: 2712071 - protein, 27 aa, Entamoeba histolytica
FDYVSFYFFRIFFSNSILHLSFSQIHE

SEQ ID NO: 2712072 - protein, 37 aa, Entamoeba histolytica
FEACRKLFDLVIDSFDLLPPGVKLLARIFNEYAAQFF

SEQ ID NO: 2712073 - protein, 23 aa, Entamoeba histolytica
FEAEQRLGIVSYGRTVKDSLRKE

SEQ ID NO: 2712074 - protein, 19 aa, Entamoeba histolytica
FEAIQQAFILSLLNNEGVG

SEQ ID NO: 2712075 - protein, 26 aa, Entamoeba histolytica
FEAIQQALILSILNINGYGFKIKKPE

SEQ ID NO: 2712076 - protein, 26 aa, Entamoeba histolytica
FEAKQIFLQAPILQFSYLSNNKLNQC

SEQ ID NO: 2712077 - protein, 18 aa, Entamoeba histolytica
FEAYLEFYKKYGGDYLLT

SEQ ID NO: 2712078 - protein, 18 aa, Entamoeba histolytica
FEAYQRQYLEKQYNMQEM

SEQ ID NO: 2712079 - protein, 27 aa, Entamoeba histolytica
FEDGERTLLLLRFFESAIIGKTLQTCQ

SEQ ID NO: 2712080 - protein, 27 aa, Entamoeba histolytica
FEDGRIFKYVIWYKVDYSRYLEEKEEM

SEQ ID NO: 2712081 - protein, 19 aa, Entamoeba histolytica
FEDKLKRILNEIYRVVLRG

SEQ ID NO: 2712082 - protein, 18 aa, Entamoeba histolytica
FEDKSLVLVVLTSSADYN

SEQ ID NO: 2712083 - protein, 23 aa, Entamoeba histolytica
FEDNKYVYILLNLCNQETLKEVL

SEQ ID NO: 2712084 - protein, 26 aa, Entamoeba histolytica
FEEANRKMNFSFRYSLPSADFDRNRV

SEQ ID NO: 2712085 - protein, 18 aa, Entamoeba histolytica
FEEHYNSLERFPAVKIPK

SEQ ID NO: 2712086 - protein, 17 aa, Entamoeba histolytica
FEEIKKYYKIQEEQLRK

SEQ ID NO: 2712087 - protein, 24 aa, Entamoeba histolytica
FEELHNIKFILSKVYYFQTQSKVM

SEQ ID NO: 2712088 - protein, 34 aa, Entamoeba histolytica
FEELISWITPLQYQFFEVLKYLHSLHIVHRDIKP

SEQ ID NO: 2712089 - protein, 17 aa, Entamoeba histolytica
FEEMINHYPIELPNEPK

SEQ ID NO: 2712090 - protein, 28 aa, Entamoeba histolytica
FEEQEQLWIFTQPIYPISIHSYVFKQHI

SEQ ID NO: 2712091 - protein, 30 aa, Entamoeba histolytica
FEERQRFARMYLLNTPTLYGKINVSKLPYG

SEQ ID NO: 2712092 - protein, 17 aa, Entamoeba histolytica
FEETWKRAEERKGRREN

SEQ ID NO: 2712093 - protein, 27 aa, Entamoeba histolytica
FEEVRRIIYIINLLPSTCYYLDKSGIN

SEQ ID NO: 2712094 - protein, 20 aa, Entamoeba histolytica
FEEWRNYYIPSPSEYFKTAE

SEQ ID NO: 2712095 - protein, 25 aa, Entamoeba histolytica
FEEYFEKYFPLDKIPQLPPQEGESG

SEQ ID NO: 2712096 - protein, 17 aa, Entamoeba histolytica
FEFFYKRKYESRKLQWV

SEQ ID NO: 2712097 - protein, 27 aa, Entamoeba histolytica
FEFNESLLHFIFYHYNSRVFKDFNQND

SEQ ID NO: 2712098 - protein, 19 aa, Entamoeba histolytica
FEFRYFKNCSSIANTTAPS

SEQ ID NO: 2712099 - protein, 17 aa, Entamoeba histolytica
FEGELVIPTIEEEKKIK

SEQ ID NO: 2712100 - protein, 28 aa, Entamoeba histolytica
FEGGRIFKYVIWYKVSYSRYLEEKEKGN

SEQ ID NO: 2712101 - protein, 18 aa, Entamoeba histolytica
FEGLYPFVQTVVGSSLGC

SEQ ID NO: 2712102 - protein, 26 aa, Entamoeba histolytica
FEHDISIGILFYLYTICCGESNYMSI

SEQ ID NO: 2712103 - protein, 19 aa, Entamoeba histolytica
FEIKKLPIVLKVWEVDCSE

SEQ ID NO: 2712104 - protein, 20 aa, Entamoeba histolytica
FEILYFFTKAVKIDCSYNFM

SEQ ID NO: 2712105 - protein, 18 aa, Entamoeba histolytica
FEIQRFIEFSALKNSLNE

SEQ ID NO: 2712106 - protein, 18 aa, Entamoeba histolytica
FEISNGLYLPVTINKPKT

SEQ ID NO: 2712107 - protein, 25 aa, Entamoeba histolytica
FEISPKKFLIINITPEFIISMNNLF

SEQ ID NO: 2712108 - protein, 28 aa, Entamoeba histolytica
FEKEKLFLDTFFFPIKMRVQNGLFEIDA

SEQ ID NO: 2712109 - protein, 23 aa, Entamoeba histolytica
FEKFGGITDCKVMRTPQGNSRKF

SEQ ID NO: 2712110 - protein, 17 aa, Entamoeba histolytica
FEKINVQLFYKMLTQHQ

SEQ ID NO: 2712111 - protein, 25 aa, Entamoeba histolytica
FEKKAFCYAMIIFGIIVIRDDMLDN

SEQ ID NO: 2712112 - protein, 21 aa, Entamoeba histolytica
FEKMIICWINIMGNAIREECS

SEQ ID NO: 2712113 - protein, 30 aa, Entamoeba histolytica; identical to SEQ ID NO: 2523987

SEQ ID NO: 2712114 - protein, 25 aa, Entamoeba histolytica
FEKNLIIDKMTLLEAFYSCVLNNQT

SEQ ID NO: 2712115 - protein, 28 aa, Entamoeba histolytica
FELMERKEFFDLFKQSSYFKDLTHRLTA

SEQ ID NO: 2712116 - protein, 28 aa, Entamoeba histolytica
FELNVMEPVMFYDLLTSLEIMKNAFFTF

SEQ ID NO: 2712117 - protein, 17 aa, Entamoeba histolytica
FEMCRVTGIPLSYLLPR

SEQ ID NO: 2712118 - protein, 29 aa, Entamoeba histolytica
FEMGNGWLKVFELLLEKMPIIRLNEVFKQ

SEQ ID NO: 2712119 - protein, 17 aa, Entamoeba histolytica
FEMIEFVELYNFNPILQ

SEQ ID NO: 2712120 - protein, 18 aa, Entamoeba histolytica
FEMIGIDGVLAVWLALLE

SEQ ID NO: 2712121 - protein, 23 aa, Entamoeba histolytica
FEMNTFEFIGMLQAQGFPKVIGC

SEQ ID NO: 2712122 - protein, 17 aa, Entamoeba histolytica
FEMRFFDGNIKKFYILY

SEQ ID NO: 2712123 - protein, 18 aa, Entamoeba histolytica
FEMSETCIMVNIQRISLD

SEQ ID NO: 2712124 - protein, 18 aa, Entamoeba histolytica
FENIPFVKLGDIIPLSVI

SEQ ID NO: 2712125 - protein, 24 aa, Entamoeba histolytica
FENIPKLKHINIPVEVIFVQEDEL

SEQ ID NO: 2712126 - protein, 28 aa, Entamoeba histolytica
FENITGCKLLYQLLIQPDERIRSVFVKI

SEQ ID NO: 2712127 - protein, 27 aa, Entamoeba histolytica
FENKAFPKIPILSLWMHDIVNINEQDT

SEQ ID NO: 2712128 - protein, 24 aa, Entamoeba histolytica
FENKKYCPLLFSKISFKYRIMNRF

SEQ ID NO: 2712129 - protein, 22 aa, Entamoeba histolytica
FENLTMLFKIYCIDKTNVISIT

SEQ ID NO: 2712130 - protein, 18 aa, Entamoeba histolytica
FENSTARHKKYFKTELNL

SEQ ID NO: 2712131 - protein, 23 aa, Entamoeba histolytica
FENTLQLNELFYLKEWTGQHEFR

SEQ ID NO: 2712132 - protein, 17 aa, Entamoeba histolytica
FEPAFYAASLSSQCPQG

SEQ ID NO: 2712133 - protein, 25 aa, Entamoeba histolytica
FEPYDEFEWFLFNGNEMIVLRKGGI

SEQ ID NO: 2712134 - protein, 32 aa, Entamoeba histolytica
FEQANIDYFFCYKWNALLFKRFFINEDLIRIW

SEQ ID NO: 2712135 - protein, 21 aa, Entamoeba histolytica
FEQIILFTFKSHLLKSVRIIT

SEQ ID NO: 2712136 - protein, 19 aa, Entamoeba histolytica
FEQKMFAVEKVRLIGLTKA

SEQ ID NO: 2712137 - protein, 19 aa, Entamoeba histolytica
FEQMDCSHFLPPTSLIYKD

SEQ ID NO: 2712138 - protein, 19 aa, Entamoeba histolytica
FEQMLPIITLLMSDPFGNY

SEQ ID NO: 2712139 - protein, 27 aa, Entamoeba histolytica
FEQNDIICDVLLFRKTLFDCYNEYIRN

SEQ ID NO: 2712140 - protein, 18 aa, Entamoeba histolytica
FEQSVRGLMDCWSTLRLC

SEQ ID NO: 2712141 - protein, 28 aa, Entamoeba histolytica
FEQTKFESLPRPIKLIKDVLTPEAPNKK

SEQ ID NO: 2712142 - protein, 28 aa, Entamoeba histolytica
FERCLDDFIFFCFLVGNDFLPHIPSLDI

SEQ ID NO: 2712143 - protein, 25 aa, Entamoeba histolytica
FERGKKFFVVIVLPVFSEGQLRQKS

SEQ ID NO: 2712144 - protein, 18 aa, Entamoeba histolytica
FERKLKIDQIRIKKLLKM

SEQ ID NO: 2712145 - protein, 18 aa, Entamoeba histolytica
FERPWNAPKYLKQKKENK

SEQ ID NO: 2712146 - protein, 28 aa, Entamoeba histolytica
FESDLKLPLWHLFPSHIELLFKSICSSW

SEQ ID NO: 2712147 - protein, 25 aa, Entamoeba histolytica
FESEFPFYKEFFYRNPNVKHYLSKE

SEQ ID NO: 2712148 - protein, 23 aa, Entamoeba histolytica
FESGCFLFKTPAFSIQSVRGRKG

SEQ ID NO: 2712149 - protein, 32 aa, Entamoeba histolytica; identical to SEQ ID NO: 2524026

SEQ ID NO: 2712150 - protein, 19 aa, Entamoeba histolytica
FESLKIPYRVVNIVSGALN

SEQ ID NO: 2712151 - protein, 20 aa, Entamoeba histolytica
FESLKIPYRVVNIVSGALNN

SEQ ID NO: 2712152 - protein, 29 aa, Entamoeba histolytica
FESNCWNKVIPYCYYLTTVHRQNDQKFIT

SEQ ID NO: 2712153 - protein, 27 aa, Entamoeba histolytica
FESSFDVFIFKLKKFFDPIMCTVSNDI

SEQ ID NO: 2712154 - protein, 25 aa, Entamoeba histolytica
FETDSPLWYCIISQTNESCKVLRAQ

SEQ ID NO: 2712155 - protein, 25 aa, Entamoeba histolytica
FETKFPPIIYYEQATTLLFQLQGHI

SEQ ID NO: 2712156 - protein, 26 aa, Entamoeba histolytica
FETKSRGFIIVTYYDIRSAKIAIKIL

SEQ ID NO: 2712157 - protein, 18 aa, Entamoeba histolytica
FETLLYYQSDLAEIKDEI

SEQ ID NO: 2712158 - protein, 21 aa, Entamoeba histolytica
FETRYEILGGLLAFIRTMDRE

SEQ ID NO: 2712159 - protein, 25 aa, Entamoeba histolytica
FETVKTLFPSLKKSGSLVVYCQYLD

SEQ ID NO: 2712160 - protein, 20 aa, Entamoeba histolytica
FETVVALVYIFMVSPRHTRA

SEQ ID NO: 2712161 - protein, 30 aa, Entamoeba histolytica
FEVFIDDGEKLFLHGLHLYSKKLQDMEKQD

SEQ ID NO: 2712162 - protein, 21 aa, Entamoeba histolytica
FEVGVKYLKLMWKGTKDIKEK

SEQ ID NO: 2712163 - protein, 24 aa, Entamoeba histolytica
FEVYLRLIPMNYFTMLNGISKLLD

SEQ ID NO: 2712164 - protein, 24 aa, Entamoeba histolytica
FEWLDHFYEVLSNNALKRFNNFID

SEQ ID NO: 2712165 - protein, 17 aa, Entamoeba histolytica
FEWQGVLIPMLPIEESY

SEQ ID NO: 2712166 - protein, 30 aa, Entamoeba histolytica
FEYHNFDTLLCILLLFNTSSIHRLKRSFDS

SEQ ID NO: 2712167 - protein, 17 aa, Entamoeba histolytica
FEYHSILEIPMTPPTPL

SEQ ID NO: 2712168 - protein, 17 aa, Entamoeba histolytica
FEYLLMQVVMNRQKESE

SEQ ID NO: 2712169 - protein, 19 aa, Entamoeba histolytica
FEYLQDWVNDVSNYCPQGV

SEQ ID NO: 2712170 - protein, 26 aa, Entamoeba histolytica
FEYQRIGVQFGLRKKGRLLIGDEMGL

SEQ ID NO: 2712171 - protein, 19 aa, Entamoeba histolytica
FEYRIWNEYYLREFDQICI

SEQ ID NO: 2712172 - protein, 33 aa, Entamoeba histolytica
FFATTKLFYSPNVPLRQLLFTALRSVIPYACDV

SEQ ID NO: 2712173 - protein, 18 aa, Entamoeba histolytica
FFDEVMTIAYQLVKIMNY

SEQ ID NO: 2712174 - protein, 17 aa, Entamoeba histolytica
FFDGILVSMKSFSLAER

SEQ ID NO: 2712175 - protein, 29 aa, Entamoeba histolytica
FFDINTFYSYVYYQIFFSKGISLEKQVDA

SEQ ID NO: 2712176 - protein, 18 aa, Entamoeba histolytica
FFDKLFTAVIRMKSKSSN

SEQ ID NO: 2712177 - protein, 31 aa, Entamoeba histolytica
FFDRNNPLTFFFKIVYFISIASFGEVIQLKK

SEQ ID NO: 2712178 - protein, 23 aa, Entamoeba histolytica
FFDRVFQRYSAIAERLWSKESVV

SEQ ID NO: 2712179 - protein, 17 aa, Entamoeba histolytica
FFEFIKKNSKNIDIIEP

SEQ ID NO: 2712180 - protein, 19 aa, Entamoeba histolytica
FFELFNPYLELRIDRDNLL

SEQ ID NO: 2712181 - protein, 25 aa, Entamoeba histolytica
FFESTFTLLFKEAPHVFHVLKAMIS

SEQ ID NO: 2712182 - protein, 23 aa, Entamoeba histolytica
FFGCAHLISFQIPLLVHQLTDYT

SEQ ID NO: 2712183 - protein, 20 aa, Entamoeba histolytica
FFHKMSLSLYSFYNQRLFFF

SEQ ID NO: 2712184 - protein, 25 aa, Entamoeba histolytica
FFHNIILHQIVPVNVLFMSSFQLLE

SEQ ID NO: 2712185 - protein, 26 aa, Entamoeba histolytica
FFHPEHHHWLKINFPKAFDNIIKEYD

SEQ ID NO: 2712186 - protein, 29 aa, Entamoeba histolytica
FFHSTTIKTLLIHLTLRLTVYSQILPSKD

SEQ ID NO: 2712187 - protein, 26 aa, Entamoeba histolytica
FFISVFHGLFFYNEFNGAYLIYNILS

SEQ ID NO: 2712188 - protein, 18 aa, Entamoeba histolytica
FFKVFGNVSVIKYIKKTD

SEQ ID NO: 2712189 - protein, 28 aa, Entamoeba histolytica
FFMNKNKVVLIPLVKKYFRVSKTMKSNP

SEQ ID NO: 2712190 - protein, 18 aa, Entamoeba histolytica
FFMRKDLISITIPTRVRC

SEQ ID NO: 2712191 - protein, 19 aa, Entamoeba histolytica
FFNQIWICYQPTEIELWKV

SEQ ID NO: 2712192 - protein, 27 aa, Entamoeba histolytica
FFNRFRIKGIQHLLFYEVPTPTHYVAE

SEQ ID NO: 2712193 - protein, 17 aa, Entamoeba histolytica
FFNVFDELLMMNDDYSE

SEQ ID NO: 2712194 - protein, 25 aa, Entamoeba histolytica
FFPDINITFLLDRPTTVPLQKIRKD

SEQ ID NO: 2712195 - protein, 17 aa, Entamoeba histolytica
FFPIPIPERIQQVVITS

SEQ ID NO: 2712196 - protein, 17 aa, Entamoeba histolytica
FFPNINTYNLFSLQDTF

SEQ ID NO: 2712197 - protein, 20 aa, Entamoeba histolytica
FFQAICNLIITIPKVHFSVL

SEQ ID NO: 2712198 - protein, 17 aa, Entamoeba histolytica
FFQGRVIDDIVFLTAYN

SEQ ID NO: 2712199 - protein, 20 aa, Entamoeba histolytica
FFQLYPFEIVVQFDSLGIFE

SEQ ID NO: 2712200 - protein, 26 aa, Entamoeba histolytica
FFQTKEFLIILPFLSSLNTITNICPL

SEQ ID NO: 2712201 - protein, 39 aa, Entamoeba histolytica; identical to SEQ ID NO: 2524079

SEQ ID NO: 2712202 - protein, 24 aa, Entamoeba histolytica
FFRGRKKMTSFWRRHLEDVIVGEQ

SEQ ID NO: 2712203 - protein, 23 aa, Entamoeba histolytica
FFTHLVVEACHRTLHGYEFNVDN

SEQ ID NO: 2712204 - protein, 17 aa, Entamoeba histolytica
FFTLILPFESKYVSTII

SEQ ID NO: 2712205 - protein, 23 aa, Entamoeba histolytica
FFTLSFLILSYTIQVTPEHLNGG

SEQ ID NO: 2712206 - protein, 18 aa, Entamoeba histolytica
FFVFEFCVYAIQFGQWET

SEQ ID NO: 2712207 - protein, 17 aa, Entamoeba histolytica
FFVMNIGCKLDLPSILI

SEQ ID NO: 2712208 - protein, 18 aa, Entamoeba histolytica
FFVSINQPDKNSQILIDE

SEQ ID NO: 2712209 - protein, 18 aa, Entamoeba histolytica
FFYRAEFVEVATGANVLK

SEQ ID NO: 2712210 - protein, 17 aa, Entamoeba histolytica
FFYYYPSGTDEFRKVFF

SEQ ID NO: 2712211 - protein, 19 aa, Entamoeba histolytica
FGAHRFFEKEGIPFSVQEM

SEQ ID NO: 2712212 - protein, 19 aa, Entamoeba histolytica
FGANKIPCVGFSVGLERIM

SEQ ID NO: 2712213 - protein, 23 aa, Entamoeba histolytica
FGASFVPLLSQMEKVRLLTVVSL

SEQ ID NO: 2712214 - protein, 24 aa, Entamoeba histolytica
FGCMVATMFFVKEPLFKGSNNKDQ

SEQ ID NO: 2712215 - protein, 31 aa, Entamoeba histolytica; identical to SEQ ID NO: 2396691

SEQ ID NO: 2712216 - protein, 26 aa, Entamoeba histolytica
FGEALDLFFYVLQQSAERVVLTKSFQ

SEQ ID NO: 2712217 - protein, 21 aa, Entamoeba histolytica
FGEFYNPLPILPKHNPYTCLE

SEQ ID NO: 2712218 - protein, 25 aa, Entamoeba histolytica
FGEKKTHKLFLKIKNGVLHYADSEK

SEQ ID NO: 2712219 - protein, 25 aa, Entamoeba histolytica
FGERIYGMYFALNAELHVIIAQPTD

SEQ ID NO: 2712220 - protein, 17 aa, Entamoeba histolytica
FGFATTKSILYFRLIGK

SEQ ID NO: 2712221 - protein, 21 aa, Entamoeba histolytica
FGGECMFMFINSQKLDNWKKE

SEQ ID NO: 2712222 - protein, 27 aa, Entamoeba histolytica
FGGFIEAPITFLPTYKFEKGTKNYDWK

SEQ ID NO: 2712223 - protein, 24 aa, Entamoeba histolytica
FGGFTRSYIPICKRNDFEYTQGTE

SEQ ID NO: 2712224 - protein, 29 aa, Entamoeba histolytica
FGGIQVIFSGDFFQLPPVSKGKEVKFVFE

SEQ ID NO: 2712225 - protein, 22 aa, Entamoeba histolytica
FGGRRRRFIINLENVDPQVFIN

SEQ ID NO: 2712226 - protein, 23 aa, Entamoeba histolytica
FGGRRRRFIINLENVDPQVFINK

SEQ ID NO: 2712227 - protein, 25 aa, Entamoeba histolytica
FGGYSKIIFTLVANEIFIFKNRTDS

SEQ ID NO: 2712228 - protein, 22 aa, Entamoeba histolytica
FGGYSVYWLAGHHQKRFKVFIA

SEQ ID NO: 2712229 - protein, 18 aa, Entamoeba histolytica
FGHEYILESLKQFINANQ

SEQ ID NO: 2712230 - protein, 22 aa, Entamoeba histolytica
FGIDILCNISFIIIGIVLHTND

SEQ ID NO: 2712231 - protein, 30 aa, Entamoeba histolytica
FGIEVMCLLYLFKIQFPNQFFLLRGNHESF

SEQ ID NO: 2712232 - protein, 25 aa, Entamoeba histolytica
FGIFDGLLHISIVFGTKYISEKANK

SEQ ID NO: 2712233 - protein, 17 aa, Entamoeba histolytica
FGILEFYSMQLPEVLCR

SEQ ID NO: 2712234 - protein, 27 aa, Entamoeba histolytica
FGIPRKVRGFVWYALLLRPKTTQEIRD

SEQ ID NO: 2712235 - protein, 19 aa, Entamoeba histolytica
FGISDFLFSITSPKISEYK

SEQ ID NO: 2712236 - protein, 28 aa, Entamoeba histolytica
FGITPTPEAIFLDWFPYDLEAYVIENQL

SEQ ID NO: 2712237 - protein, 28 aa, Entamoeba histolytica
FGIYDSLHLPKKLDLCDFFFTSIEISLC

SEQ ID NO: 2712238 - protein, 24 aa, Entamoeba histolytica
FGKDRILFHYNGHGVPLPTINHEC

SEQ ID NO: 2712239 - protein, 19 aa, Entamoeba histolytica
FGKKFIICLNKRNGLLYGF

SEQ ID NO: 2712240 - protein, 18 aa, Entamoeba histolytica
FGKKLVTTLLKKLSSKNT

SEQ ID NO: 2712241 - protein, 21 aa, Entamoeba histolytica
FGKRMLRERFLLKPLMDVNKI

SEQ ID NO: 2712242 - protein, 35 aa, Entamoeba histolytica
FGKRTEYRMLYFNFNLRKIFFLRHAKVREEILFSS

SEQ ID NO: 2712243 - protein, 17 aa, Entamoeba histolytica
FGLLKETIKRRPEFKLI

SEQ ID NO: 2712244 - protein, 24 aa, Entamoeba histolytica
FGMDSRIKLWDLRTKNCIKEMGGH

SEQ ID NO: 2712245 - protein, 17 aa, Entamoeba histolytica
FGMTSSPPIWLYETNEF

SEQ ID NO: 2712246 - protein, 24 aa, Entamoeba histolytica
FGNCPYSIILPKTLVKLTIEMWHE

SEQ ID NO: 2712247 - protein, 17 aa, Entamoeba histolytica
FGNETLLACKLRYIIEL

SEQ ID NO: 2712248 - protein, 18 aa, Entamoeba histolytica
FGPMNGTTLLILDRSFDP

SEQ ID NO: 2712249 - protein, 27 aa, Entamoeba histolytica
FGQNRDQIISILIKLENSMQIPMKDIE

SEQ ID NO: 2712250 - protein, 20 aa, Entamoeba histolytica
FGQYIRIDWDYGFVEGRQYG

SEQ ID NO: 2712251 - protein, 25 aa, Entamoeba histolytica
FGRAKVIVQTLNRLKMKWPSNESCI

SEQ ID NO: 2712252 - protein, 24 aa, Entamoeba histolytica
FGRNDPDFKWEFPKELEIPAELKP

SEQ ID NO: 2712253 - protein, 24 aa, Entamoeba histolytica
FGRPDSIRTIALLLQSSSPNEAII

SEQ ID NO: 2712254 - protein, 20 aa, Entamoeba histolytica
FGSAFVPQRLYDVKKCEIGR

SEQ ID NO: 2712255 - protein, 17 aa, Entamoeba histolytica
FGSEYRPVPLQQTFFGV

SEQ ID NO: 2712256 - protein, 20 aa, Entamoeba histolytica
FGSHFDGWFDLKGSPFGNEY

SEQ ID NO: 2712257 - protein, 25 aa, Entamoeba histolytica
FGSIIGSFALFFKSTGSSLTSSGDK

SEQ ID NO: 2712258 - protein, 30 aa, Entamoeba histolytica
FGSKRPVSWILICRIIIYSLMEIHKGVSYF

SEQ ID NO: 2712259 - protein, 25 aa, Entamoeba histolytica
FGSYEELRMIILTDFFKHAFDGSGA

SEQ ID NO: 2712260 - protein, 21 aa, Entamoeba histolytica
FGTLIFTGGLREKLAIYKKYG

SEQ ID NO: 2712261 - protein, 30 aa, Entamoeba histolytica; identical to SEQ ID NO: 2524139

SEQ ID NO: 2712262 - protein, 17 aa, Entamoeba histolytica
FGYSQFGFGLEGAEVPC

SEQ ID NO: 2712263 - protein, 29 aa, Entamoeba histolytica
FHAEILLNKISLYFGFPIAFHKAHCPLQT

SEQ ID NO: 2712264 - protein, 27 aa, Entamoeba histolytica
FHEPPLEGLFCDLLWGDPISEKRFEEQ

SEQ ID NO: 2712265 - protein, 17 aa, Entamoeba histolytica
FHESMMMVLSGIMDDKS

SEQ ID NO: 2712266 - protein, 34 aa, Entamoeba histolytica; identical to SEQ ID NO: 2524148

SEQ ID NO: 2712267 - protein, 19 aa, Entamoeba histolytica
FHILCIKKEFAQHPTPFAR

SEQ ID NO: 2712268 - protein, 18 aa, Entamoeba histolytica
FHISVPIDLPPTIKNDCV

SEQ ID NO: 2712269 - protein, 26 aa, Entamoeba histolytica
FHKDNGFFLPLRHYHNIVSQLKNMGF

SEQ ID NO: 2712270 - protein, 19 aa, Entamoeba histolytica
FHKGMVWDYSFNIDGTLLA

SEQ ID NO: 2712271 - protein, 24 aa, Entamoeba histolytica
FHKTQPLKMFSFQENLKISEKREE

SEQ ID NO: 2712272 - protein, 19 aa, Entamoeba histolytica
FHKVFQVNKYCLFGGAGLF

SEQ ID NO: 2712273 - protein, 19 aa, Entamoeba histolytica
FHLFNYLHIFSQMDDFLSS

SEQ ID NO: 2712274 - protein, 20 aa, Entamoeba histolytica
FHNAKPLPVPPKPSGLSKTD

SEQ ID NO: 2712275 - protein, 24 aa, Entamoeba histolytica
FHPEHFVCSFCVNPLTESSFKENS

SEQ ID NO: 2712276 - protein, 23 aa, Entamoeba histolytica
FHPLKPMIAIATLSKIVIIDLQK

SEQ ID NO: 2712277 - protein, 18 aa, Entamoeba histolytica
FHPQYPLHFEDENNFLLW

SEQ ID NO: 2712278 - protein, 21 aa, Entamoeba histolytica
FHRAVLLLRGLGINPVKAKKI

SEQ ID NO: 2712279 - protein, 24 aa, Entamoeba histolytica
FHSDRVHYVLNEFIQAGLILNNDI

SEQ ID NO: 2712280 - protein, 27 aa, Entamoeba histolytica
FHSLFSQFLRFVSVLSSKLLVGKKSGS

SEQ ID NO: 2712281 - protein, 17 aa, Entamoeba histolytica
FHSLGFTHKRIELKSFY

SEQ ID NO: 2712282 - protein, 25 aa, Entamoeba histolytica
FHTNNIKCILTVPAQFNDEQRNQTK

SEQ ID NO: 2712283 - protein, 24 aa, Entamoeba histolytica
FHVTNKISFIRWVGSLKLITCVEK

SEQ ID NO: 2712284 - protein, 17 aa, Entamoeba histolytica
FHYNKFIQMVCISSIVI

SEQ ID NO: 2712285 - protein, 18 aa, Entamoeba histolytica
FHYNPYDISINQLKYFPY

SEQ ID NO: 2712286 - protein, 33 aa, Entamoeba histolytica
FIAASFLKLYLREMLEPLIPFNLYEQFIQLPKG

SEQ ID NO: 2712287 - protein, 17 aa, Entamoeba histolytica
FIALGRFLIKGYDHLSE

SEQ ID NO: 2712288 - protein, 19 aa, Entamoeba histolytica
FIATLFDCSLAAKADPIIS

SEQ ID NO: 2712289 - protein, 17 aa, Entamoeba histolytica
FIATSYIKQGQEIKLAL

SEQ ID NO: 2712290 - protein, 29 aa, Entamoeba histolytica
FIAVVTRIPAKIPFIKKIAKPIYNGAKSL

SEQ ID NO: 2712291 - protein, 24 aa, Entamoeba histolytica
FIAYYTLFVKPVFEIYQKTSKIRD

SEQ ID NO: 2712292 - protein, 18 aa, Entamoeba histolytica
FICATSYLAQCRTIYQLT

SEQ ID NO: 2712293 - protein, 24 aa, Entamoeba histolytica
FICFNQEFICSVYLGRKCILIFKD

SEQ ID NO: 2712294 - protein, 18 aa, Entamoeba histolytica
FICPIENCGRCFTTKSYL

SEQ ID NO: 2712295 - protein, 26 aa, Entamoeba histolytica
FICSNERILFLLIKSILNIFEVESNY

SEQ ID NO: 2712296 - protein, 31 aa, Entamoeba histolytica
FIDDGEKLFLHGLHLYFKKLGDNDKRKTFMD

SEQ ID NO: 2712297 - protein, 17 aa, Entamoeba histolytica
FIDFFDYRLSAANRMKI

SEQ ID NO: 2712298 - protein, 18 aa, Entamoeba histolytica
FIDFQDKLHLTIGKKRSL

SEQ ID NO: 2712299 - protein, 23 aa, Entamoeba histolytica
FIDGYAVFIACSLANHSCKENVG

SEQ ID NO: 2712300 - protein, 18 aa, Entamoeba histolytica
FIDIRGPFIFISMNNKDK

SEQ ID NO: 2712301 - protein, 19 aa, Entamoeba histolytica
FIDLCILLGCDYCETIKGV

SEQ ID NO: 2712302 - protein, 18 aa, Entamoeba histolytica
FIEDMRIFINSDISLYRI

SEQ ID NO: 2712303 - protein, 20 aa, Entamoeba histolytica
FIEIYTLRLERNLTDSWVFV

SEQ ID NO: 2712304 - protein, 18 aa, Entamoeba histolytica
FIELPPGTETKDVSQNKK

SEQ ID NO: 2712305 - protein, 17 aa, Entamoeba histolytica
FIENFGYFEGKKGENKY

SEQ ID NO: 2712306 - protein, 26 aa, Entamoeba histolytica
FIENKIEWKLLVKKAEKWLATKLPLP

SEQ ID NO: 2712307 - protein, 20 aa, Entamoeba histolytica
FIESLHILALLFQAQIQLRN

SEQ ID NO: 2712308 - protein, 18 aa, Entamoeba histolytica
FIFICNEVHLITPAIQSR

SEQ ID NO: 2712309 - protein, 18 aa, Entamoeba histolytica
FIFKQHLYHQLVLLSNQI

SEQ ID NO: 2712310 - protein, 17 aa, Entamoeba histolytica
FIFTLQTSLSNVPTRWF

SEQ ID NO: 2712311 - protein, 20 aa, Entamoeba histolytica
FIGFTNRFVSDDKFFTCIVG

SEQ ID NO: 2712312 - protein, 32 aa, Entamoeba histolytica
FIGHLNLRGFVPSYFMITVIRELLKDCTDQSF

SEQ ID NO: 2712313 - protein, 32 aa, Entamoeba histolytica; identical to SEQ ID NO: 2675276

SEQ ID NO: 2712314 - protein, 23 aa, Entamoeba histolytica
FIGKIEVVLFQKIFIYSQVNVYD

SEQ ID NO: 2712315 - protein, 19 aa, Entamoeba histolytica
FIHDQTLRYANLGYTPNEI

SEQ ID NO: 2712316 - protein, 17 aa, Entamoeba histolytica
FIHLCNCKNPYEPNKIL

SEQ ID NO: 2712317 - protein, 17 aa, Entamoeba histolytica
FIHVKQLNKDRLKRLVF

SEQ ID NO: 2712318 - protein, 17 aa, Entamoeba histolytica
FIICLNKRNGLLYGFDQ

SEQ ID NO: 2712319 - protein, 19 aa, Entamoeba histolytica
FIIDGFPRNAENKEAWFLQ

SEQ ID NO: 2712320 - protein, 17 aa, Entamoeba histolytica
FIIDVRYPYEYNGGHVR

SEQ ID NO: 2712321 - protein, 18 aa, Entamoeba histolytica
FIIFCFVNEPSAKQPHFA

SEQ ID NO: 2712322 - protein, 19 aa, Entamoeba histolytica
FIIICSNTRLIFIKSKDFS

SEQ ID NO: 2712323 - protein, 23 aa, Entamoeba histolytica
FIILHQKFLLKRIIQNTIKSILL

SEQ ID NO: 2712324 - protein, 24 aa, Entamoeba histolytica
FIINHSIWIYTISGNIVRLIQKQP

SEQ ID NO: 2712325 - protein, 36 aa, Entamoeba histolytica
FIINKSNYSIYLATCGKLVFFAIKPSSPNKCPLKVE

SEQ ID NO: 2712326 - protein, 18 aa, Entamoeba histolytica
FIIQGGTIKVYVICDIQK

SEQ ID NO: 2712327 - protein, 23 aa, Entamoeba histolytica
FIIRECLLDLLQRILVYDPKERL

SEQ ID NO: 2712328 - protein, 18 aa, Entamoeba histolytica
FIITNLPDDIQMNLLLGI

SEQ ID NO: 2712329 - protein, 19 aa, Entamoeba histolytica
FIIYQILKAIQYLQKKHII

SEQ ID NO: 2712330 - protein, 25 aa, Entamoeba histolytica
FIKGMYTFLKLMGREPTIINLDPAN

SEQ ID NO: 2712331 - protein, 18 aa, Entamoeba histolytica
FIKKIPIEFTKLQTLHMF

SEQ ID NO: 2712332 - protein, 18 aa, Entamoeba histolytica
FIKLTKWNDINYAKLQDQ

SEQ ID NO: 2712333 - protein, 20 aa, Entamoeba histolytica
FIKQLLIKRMNLPKKTIIES

SEQ ID NO: 2712334 - protein, 18 aa, Entamoeba histolytica
FIKSIYHGFTCSLSLSEC

SEQ ID NO: 2712335 - protein, 18 aa, Entamoeba histolytica
FIKSKPLIVYSIHPQIVI

SEQ ID NO: 2712336 - protein, 20 aa, Entamoeba histolytica
FIKTFKPFIKSIPTNVIEPI

SEQ ID NO: 2712337 - protein, 18 aa, Entamoeba histolytica
FILACRIMKKFNYKPQSF

SEQ ID NO: 2712338 - protein, 18 aa, Entamoeba histolytica
FILEPYHINPFQDSQLFE

SEQ ID NO: 2712339 - protein, 17 aa, Entamoeba histolytica
FILGGPGAGKGTQCDKL

SEQ ID NO: 2712340 - protein, 27 aa, Entamoeba histolytica
FILLDKESLHFITLTQIPGIISDSSLR

SEQ ID NO: 2712341 - protein, 19 aa, Entamoeba histolytica
FILQKLVAFHILFDNNLSL

SEQ ID NO: 2712342 - protein, 17 aa, Entamoeba histolytica
FILQQPVVKPLSCNSRD

SEQ ID NO: 2712343 - protein, 17 aa, Entamoeba histolytica
FILVYTSLSSLNNYSFF

SEQ ID NO: 2712344 - protein, 19 aa, Entamoeba histolytica
FIMEMCIDIPFVLRKPFGK

SEQ ID NO: 2712345 - protein, 17 aa, Entamoeba histolytica
FIMHKNILQDAFIQNLF

SEQ ID NO: 2712346 - protein, 30 aa, Entamoeba histolytica
FINAKMIKCKLLQKTLFPSTLKRLTLEDCE

SEQ ID NO: 2712347 - protein, 36 aa, Entamoeba histolytica
FINALNEYVLKLKLYIPFILMKDKTLLVLSLEIEKV

SEQ ID NO: 2712348 - protein, 18 aa, Entamoeba histolytica
FINIEWYLSLPQVKFCYC

SEQ ID NO: 2712349 - protein, 17 aa, Entamoeba histolytica
FINIFVEDLLREINILF

SEQ ID NO: 2712350 - protein, 20 aa, Entamoeba histolytica
FINQFAPLLTLMNKFYENTA

SEQ ID NO: 2712351 - protein, 19 aa, Entamoeba histolytica
FINSLPLYLFDKIVLEFDT

SEQ ID NO: 2712352 - protein, 30 aa, Entamoeba histolytica
FIPENQNGRFFPFIMYGAKATLPTGAGDIT

SEQ ID NO: 2712353 - protein, 24 aa, Entamoeba histolytica
FIPKYVELKILPANPFEILDRPGV

SEQ ID NO: 2712354 - protein, 21 aa, Entamoeba histolytica
FIPLHYKIYVKPDPALSLNYG

SEQ ID NO: 2712355 - protein, 27 aa, Entamoeba histolytica
FIPSGLYMIYLPYIDDVLTPLLSEPEF

SEQ ID NO: 2712356 - protein, 28 aa, Entamoeba histolytica
FIPSLHPFTQIFVIVNPIQGFIPSLYST

SEQ ID NO: 2712357 - protein, 27 aa, Entamoeba histolytica
FIPVDYFTQFFLVCKSILMSNIHAISV

SEQ ID NO: 2712358 - protein, 18 aa, Entamoeba histolytica
FIPVLLKLQDDSSIINKL

SEQ ID NO: 2712359 - protein, 30 aa, Entamoeba histolytica
FIQINNSILYLFYQLKHWSIQPTNLNAKTL

SEQ ID NO: 2712360 - protein, 18 aa, Entamoeba histolytica
FIQKKTTIGLYNKIYEFI

SEQ ID NO: 2712361 - protein, 19 aa, Entamoeba histolytica
FIQLIITLFDKKANITWLL

SEQ ID NO: 2712362 - protein, 35 aa, Entamoeba histolytica; identical to SEQ ID NO: 2524244

SEQ ID NO: 2712363 - protein, 23 aa, Entamoeba histolytica
FIQSLMDFDIAIILKGYCCHVKE

SEQ ID NO: 2712364 - protein, 27 aa, Entamoeba histolytica
FIQYLGPIVQIILKRLLLKENPEAVII

SEQ ID NO: 2712365 - protein, 18 aa, Entamoeba histolytica
FIRDTLTPLSYYRDTSEW

SEQ ID NO: 2712366 - protein, 17 aa, Entamoeba histolytica
FIRFRDGIVTFMEKVSK

SEQ ID NO: 2712367 - protein, 20 aa, Entamoeba histolytica
FIRSGKLIEEYYKNIGEEIK

SEQ ID NO: 2712368 - protein, 19 aa, Entamoeba histolytica
FIRSGKLIEEYYKNMGEEI

SEQ ID NO: 2712369 - protein, 18 aa, Entamoeba histolytica
FIRVILKNQNKIIFEKRY

SEQ ID NO: 2712370 - protein, 37 aa, Entamoeba histolytica
FISDKMFVQPPPAQYIKRFFQFIRKLVRTYGDYLFKE

SEQ ID NO: 2712371 - protein, 22 aa, Entamoeba histolytica
FISKSVTLPRKSLEKSKEVLRK

SEQ ID NO: 2712372 - protein, 25 aa, Entamoeba histolytica
FISKTRLFYLKKYEYFEISYKSNIS

SEQ ID NO: 2712373 - protein, 17 aa, Entamoeba histolytica
FISPTPGNLITSGNVIA

SEQ ID NO: 2712374 - protein, 18 aa, Entamoeba histolytica
FISRIDGSYWNVVGFPSF

SEQ ID NO: 2712375 - protein, 19 aa, Entamoeba histolytica
FITAKYLVGWNEYIAVFNY

SEQ ID NO: 2712376 - protein, 23 aa, Entamoeba histolytica
FITDHWHLLGRLKLCLGFYKLKN

SEQ ID NO: 2712377 - protein, 26 aa, Entamoeba histolytica
FITGSKYWIYGVIPLNNVSALKQFGY

SEQ ID NO: 2712378 - protein, 23 aa, Entamoeba histolytica
FITHIQLFDYWCSIQHIELHEKS

SEQ ID NO: 2712379 - protein, 25 aa, Entamoeba histolytica
FITPNIFRHLLEINLPLNVVTPNLC

SEQ ID NO: 2712380 - protein, 24 aa, Entamoeba histolytica
FITQFNHVFIIVSPVVIKGVPLYR

SEQ ID NO: 2712381 - protein, 28 aa, Entamoeba histolytica
FITSVKIFSLIIHRFRMYFKKEIEIITK

SEQ ID NO: 2712382 - protein, 30 aa, Entamoeba histolytica
FIVEMVIVKKMILPSLLRIPIPQISEIARP

SEQ ID NO: 2712383 - protein, 17 aa, Entamoeba histolytica
FIVWMRSKEQIFVEEEE

SEQ ID NO: 2712384 - protein, 21 aa, Entamoeba histolytica
FIWIHREPVEQLKSFIPLLIA

SEQ ID NO: 2712385 - protein, 18 aa, Entamoeba histolytica
FIWNYSPVSLVNIGKMKL

SEQ ID NO: 2712386 - protein, 21 aa, Entamoeba histolytica
FIYCIFNPLKQPKFIDLLLLR

SEQ ID NO: 2712387 - protein, 18 aa, Entamoeba histolytica
FIYESELIQKLPPDVRKK

SEQ ID NO: 2712388 - protein, 21 aa, Entamoeba histolytica
FIYSFMMMLCSGVPQLKHVED

SEQ ID NO: 2712389 - protein, 22 aa, Entamoeba histolytica
FIYSQILTLWEVKTNLFGWNII

SEQ ID NO: 2712390 - protein, 17 aa, Entamoeba histolytica
FIYTDYQYFGKMYRTIS

SEQ ID NO: 2712391 - protein, 18 aa, Entamoeba histolytica
FKAKTMFLSSKYPIENRP

SEQ ID NO: 2712392 - protein, 19 aa, Entamoeba histolytica
FKCNKLPLLNLPQCITRLQ

SEQ ID NO: 2712393 - protein, 25 aa, Entamoeba histolytica
FKCTSLQQIFFYPKSKSFAITQFNN

SEQ ID NO: 2712394 - protein, 23 aa, Entamoeba histolytica
FKDAIWDVVSKEPKELIKSMIIV

SEQ ID NO: 2712395 - protein, 27 aa, Entamoeba histolytica
FKDGKIFKYVIWYKVEYSRYLEEKEEM

SEQ ID NO: 2712396 - protein, 27 aa, Entamoeba histolytica
FKDGKIFKYVIWYKVNYSKYLKEKEEG

SEQ ID NO: 2712397 - protein, 28 aa, Entamoeba histolytica
FKDGKIFKYVIWYKVSYSRYLEEKEEMN

SEQ ID NO: 2712398 - protein, 27 aa, Entamoeba histolytica
FKDGKIIKYVIWYKVSYSAYLEEKKEM

SEQ ID NO: 2712399 - protein, 19 aa, Entamoeba histolytica
FKDGKVFCALIHRHRPDLL

SEQ ID NO: 2712400 - protein, 27 aa, Entamoeba histolytica
FKDGRIFKYVIWYKVSYSKYLEEKEEM

SEQ ID NO: 2712401 - protein, 31 aa, Entamoeba histolytica
FKDHPYIQQYIPLLIETAQKNLILKLVKCFK

SEQ ID NO: 2712402 - protein, 20 aa, Entamoeba histolytica
FKDHYWGVMPKRVIDCLAEV

SEQ ID NO: 2712403 - protein, 18 aa, Entamoeba histolytica
FKDLMPQLIGLFKTIVGS

SEQ ID NO: 2712404 - protein, 23 aa, Entamoeba histolytica
FKDPYSILSSPLIKFPYIIDSTK

SEQ ID NO: 2712405 - protein, 26 aa, Entamoeba histolytica
FKDYEELLFEKRWGIRCSQECDIAVF

SEQ ID NO: 2712406 - protein, 21 aa, Entamoeba histolytica
FKECISLTNIILPTSLCEIGD

SEQ ID NO: 2712407 - protein, 24 aa, Entamoeba histolytica
FKEDDIYIKKLLLRISENDDFTYC

SEQ ID NO: 2712408 - protein, 20 aa, Entamoeba histolytica
FKEDGTFINLRPFTDSKTVS

SEQ ID NO: 2712409 - protein, 20 aa, Entamoeba histolytica
FKEELESLNSSFKNLFHRTT

SEQ ID NO: 2712410 - protein, 27 aa, Entamoeba histolytica
FKEGKIFKYVIWYKVSYSRYLKEKEEM

SEQ ID NO: 2712411 - protein, 21 aa, Entamoeba histolytica
FKEGLKKLAATLAIGAKLGGN

SEQ ID NO: 2712412 - protein, 17 aa, Entamoeba histolytica
FKEGQPLVYRLIWICFV

SEQ ID NO: 2712413 - protein, 26 aa, Entamoeba histolytica
FKEGRIFKYVIWYDVSYSKYLEEKEE

SEQ ID NO: 2712414 - protein, 24 aa, Entamoeba histolytica
FKEINIFEFPIHFFDFEFSSSKTD

SEQ ID NO: 2712415 - protein, 26 aa, Entamoeba histolytica
FKEMKMFQTLALPTPQKRILKDVFKG

SEQ ID NO: 2712416 - protein, 26 aa, Entamoeba histolytica
FKESEEGWFFGCWQPKDILSGKKNIY

SEQ ID NO: 2712417 - protein, 29 aa, Entamoeba histolytica
FKGKEWKLCLLFNDILLIAKIDVTEKYRN

SEQ ID NO: 2712418 - protein, 19 aa, Entamoeba histolytica
FKHQEAINCFLNALEIDQQ

SEQ ID NO: 2712419 - protein, 19 aa, Entamoeba histolytica
FKILMIGDSGVGKSCLLLR

SEQ ID NO: 2712420 - protein, 17 aa, Entamoeba histolytica
FKILMIGESSVGKTSLV

SEQ ID NO: 2712421 - protein, 18 aa, Entamoeba histolytica
FKINYKDIARYYKLRKDE

SEQ ID NO: 2712422 - protein, 26 aa, Entamoeba histolytica
FKITQSNIRFIPLGDGILTNKKEIEL

SEQ ID NO: 2712423 - protein, 26 aa, Entamoeba histolytica
FKKEIPRTLIFSKFNIIETIPCPKTP

SEQ ID NO: 2712424 - protein, 24 aa, Entamoeba histolytica
FKKKEIPKFSLPTKILKWSVNWSV

SEQ ID NO: 2712425 - protein, 29 aa, Entamoeba histolytica
FKKKGHCNLLGNPVPFDPLKHKPDTGMTK

SEQ ID NO: 2712426 - protein, 32 aa, Entamoeba histolytica
FKKVDLTLLNRLLRLIMDPLLADYITAKNNIT

SEQ ID NO: 2712427 - protein, 28 aa, Entamoeba histolytica
FKLASHSNFFLRPSWSPEGTQLVMVGAI

SEQ ID NO: 2712428 - protein, 18 aa, Entamoeba histolytica
FKLCKSLSSISFKGPIDI

SEQ ID NO: 2712429 - protein, 23 aa, Entamoeba histolytica
FKLELPQIISFTLNNTLLAISTS

SEQ ID NO: 2712430 - protein, 17 aa, Entamoeba histolytica
FKLFTKVKRVKTVDQEY

SEQ ID NO: 2712431 - protein, 27 aa, Entamoeba histolytica
FKLGDFNMAFIIYSCIIRASYKHSDEF

SEQ ID NO: 2712432 - protein, 19 aa, Entamoeba histolytica
FKLLLIGDSGVGKSCLLLR

SEQ ID NO: 2712433 - protein, 17 aa, Entamoeba histolytica
FKLQYIFCKDHTTSQLK

SEQ ID NO: 2712434 - protein, 24 aa, Entamoeba histolytica
FKLVCCPLFVGFFSRNICLSINTF

SEQ ID NO: 2712435 - protein, 23 aa, Entamoeba histolytica
FKMGIYKQKLLVNVIYDIGCESS

SEQ ID NO: 2712436 - protein, 19 aa, Entamoeba histolytica
FKMIRNWINALGDLANILG

SEQ ID NO: 2712437 - protein, 17 aa, Entamoeba histolytica
FKNATHIIIGAGAGLSV

SEQ ID NO: 2712438 - protein, 18 aa, Entamoeba histolytica
FKNCLIILDSFIETTKRA

SEQ ID NO: 2712439 - protein, 17 aa, Entamoeba histolytica
FKNNYFRLDPHLPIEVD

SEQ ID NO: 2712440 - protein, 17 aa, Entamoeba histolytica
FKNQLNIIVIYSKKIHN

SEQ ID NO: 2712441 - protein, 22 aa, Entamoeba histolytica
FKPRLYSYWMDASRWSSKMLEK

SEQ ID NO: 2712442 - protein, 29 aa, Entamoeba histolytica
FKQEQLHIIVVIQFILFGIDNVLKAINDK

SEQ ID NO: 2712443 - protein, 38 aa, Entamoeba histolytica
FKQMIRSLDLPQLGKIPVINKFFRDVSLIDPQSGTKVG

SEQ ID NO: 2712444 - protein, 36 aa, Entamoeba histolytica
FKQNTYLDSFFTFVTHYSFFRTAKRLVLFDFVVKTI

SEQ ID NO: 2712445 - protein, 30 aa, Entamoeba histolytica
FKQRECLDNFFRALLGLPCDNHLLLEGKTE

SEQ ID NO: 2712446 - protein, 31 aa, Entamoeba histolytica; identical to SEQ ID NO: 2524360

SEQ ID NO: 2712447 - protein, 35 aa, Entamoeba histolytica; identical to SEQ ID NO: 2524363

SEQ ID NO: 2712448 - protein, 18 aa, Entamoeba histolytica
FKRYGQPPSRGVLFYGPP

SEQ ID NO: 2712449 - protein, 20 aa, Entamoeba histolytica
FKSCIRLKTISLPPTITHLG

SEQ ID NO: 2712450 - protein, 35 aa, Entamoeba histolytica
FKSHLVILGLDGGIAKLWFISNTSVREKESIEVNI

SEQ ID NO: 2712451 - protein, 26 aa, Entamoeba histolytica
FKSINRKVLIFLYTEKLVVERLPIQV

SEQ ID NO: 2712452 - protein, 18 aa, Entamoeba histolytica
FKSSILLQPPNIPNGCVV

SEQ ID NO: 2712453 - protein, 34 aa, Entamoeba histolytica
FKTAHVYSFAIALYNFIIPYFISNKNYAELALAH

SEQ ID NO: 2712454 - protein, 20 aa, Entamoeba histolytica
FKTFDEQFLFKELKPPEYEA

SEQ ID NO: 2712455 - protein, 17 aa, Entamoeba histolytica
FKTGAPFSFRDSFSRVK

SEQ ID NO: 2712456 - protein, 19 aa, Entamoeba histolytica
FKTIHLFECFNPTLQINDS

SEQ ID NO: 2712457 - protein, 33 aa, Entamoeba histolytica
FKTMKKKQVLLIPYFCDIIDKLFPMQGKNILKD

SEQ ID NO: 2712458 - protein, 29 aa, Entamoeba histolytica
FKTRNLELLVIDIIYNLVKRPSLGRYFTP

SEQ ID NO: 2712459 - protein, 21 aa, Entamoeba histolytica
FKVIIVVPIWSEGELDSIIVK

SEQ ID NO: 2712460 - protein, 19 aa, Entamoeba histolytica
FKVLIIGEPSVGKTAIMER

SEQ ID NO: 2712461 - protein, 18 aa, Entamoeba histolytica
FKVRGVMNKFNSLTLAEK

SEQ ID NO: 2712462 - protein, 18 aa, Entamoeba histolytica
FKYAKGNLFSFVLQDKDG

SEQ ID NO: 2712463 - protein, 32 aa, Entamoeba histolytica
FKYLCQFLTNVGILIRYTYPEGILSINFNFRV

SEQ ID NO: 2712464 - protein, 19 aa, Entamoeba histolytica
FKYLQKNCYLSFFDDNMDV

SEQ ID NO: 2712465 - protein, 27 aa, Entamoeba histolytica
FLAKVGRKYLLDIYKPFVQEIIHSDIS

SEQ ID NO: 2712466 - protein, 18 aa, Entamoeba histolytica
FLAQYGIIGIVKKGHNIY

SEQ ID NO: 2712467 - protein, 24 aa, Entamoeba histolytica
FLASIDCFWETKKTFDYGCFNTSG

SEQ ID NO: 2712468 - protein, 17 aa, Entamoeba histolytica
FLATVNVPFPFFVNVLQ

SEQ ID NO: 2712469 - protein, 20 aa, Entamoeba histolytica
FLCGLYYMKVIDEKLLVELL

SEQ ID NO: 2712470 - protein, 18 aa, Entamoeba histolytica
FLCIAIKPEILFLHLEAK

SEQ ID NO: 2712471 - protein, 18 aa, Entamoeba histolytica
FLCKVHYSYFSGSKDASL

SEQ ID NO: 2712472 - protein, 19 aa, Entamoeba histolytica
FLCNSFVLLNGTFTQQFES

SEQ ID NO: 2712473 - protein, 17 aa, Entamoeba histolytica
FLDEIYIGTVSLSNVQQ

SEQ ID NO: 2712474 - protein, 17 aa, Entamoeba histolytica
FLDISFISKYFNQIQTF

SEQ ID NO: 2712475 - protein, 42 aa, Entamoeba histolytica; identical to SEQ ID NO: 2524385

SEQ ID NO: 2712476 - protein, 19 aa, Entamoeba histolytica
FLEEATVVSLPKKSVYRLG

SEQ ID NO: 2712477 - protein, 22 aa, Entamoeba histolytica
FLEELLKLYKLSKTKKCGSVWV

SEQ ID NO: 2712478 - protein, 25 aa, Entamoeba histolytica
FLEERYWNIVLDYWGLTVRCLAGES

SEQ ID NO: 2712479 - protein, 17 aa, Entamoeba histolytica
FLEGILLDNRLSLDKVE

SEQ ID NO: 2712480 - protein, 25 aa, Entamoeba histolytica
FLEKHDLDVSVKFKPKKMRGSTSLV

SEQ ID NO: 2712481 - protein, 25 aa, Entamoeba histolytica
FLENFENFAKWKFVPFIKQQEGNKN

SEQ ID NO: 2712482 - protein, 27 aa, Entamoeba histolytica
FLEPEPCFNDYYRLKPKCSLKEELCIV

SEQ ID NO: 2712483 - protein, 18 aa, Entamoeba histolytica
FLEQMGHSYLFPNSVPRL

SEQ ID NO: 2712484 - protein, 26 aa, Entamoeba histolytica
FLETQYVFISFFETIILLNAKNQSKR

SEQ ID NO: 2712485 - protein, 18 aa, Entamoeba histolytica
FLFCTICSIIPFPSIQSI

SEQ ID NO: 2712486 - protein, 17 aa, Entamoeba histolytica
FLFLGIGMKDGCCYGYK

SEQ ID NO: 2712487 - protein, 20 aa, Entamoeba histolytica
FLGCGFKFLSLPSTIVKLGV

SEQ ID NO: 2712488 - protein, 18 aa, Entamoeba histolytica
FLGGINKIIELLTIQINN

SEQ ID NO: 2712489 - protein, 17 aa, Entamoeba histolytica
FLGINVVLFNKLIQKIL

SEQ ID NO: 2712490 - protein, 25 aa, Entamoeba histolytica
FLGLNEYKDMIWRGYCRGKPVIIDY

SEQ ID NO: 2712491 - protein, 39 aa, Entamoeba histolytica
FLHDGITRPPFVQLLLKVNPAMYLYPLQTKPIGDCTSII

SEQ ID NO: 2712492 - protein, 20 aa, Entamoeba histolytica
FLHQIGHILLTLVQAYQVQT

SEQ ID NO: 2712493 - protein, 33 aa, Entamoeba histolytica
FLHYCCNKSFIYLLPLILKKFPLLMNFQDGCGR

SEQ ID NO: 2712494 - protein, 18 aa, Entamoeba histolytica
FLIHRALNKRSTIGRIFF

SEQ ID NO: 2712495 - protein, 19 aa, Entamoeba histolytica
FLINHSIPLLIDQKKLFII

SEQ ID NO: 2712496 - protein, 20 aa, Entamoeba histolytica
FLKDNDFPYDWIASIPIPIQ

SEQ ID NO: 2712497 - protein, 25 aa, Entamoeba histolytica
FLKFRKTSSFYLFRKCIDVLGNSAS

SEQ ID NO: 2712498 - protein, 24 aa, Entamoeba histolytica
FLKTKHEFLIKLFTKEVALNQLIK

SEQ ID NO: 2712499 - protein, 18 aa, Entamoeba histolytica
FLKYQNYEYGFTITDPLY

SEQ ID NO: 2712500 - protein, 18 aa, Entamoeba histolytica
FLLAKIYNCIGEDAFRII

SEQ ID NO: 2712501 - protein, 19 aa, Entamoeba histolytica
FLLDSLSLDITLSTSTQNP

SEQ ID NO: 2712502 - protein, 17 aa, Entamoeba histolytica
FLLECHSKYNIKIYDEF

SEQ ID NO: 2712503 - protein, 18 aa, Entamoeba histolytica
FLLSHFHSDHYLGLSSRW

SEQ ID NO: 2712504 - protein, 19 aa, Entamoeba histolytica
FLMQMHYSFQTPDKLYFIL

SEQ ID NO: 2712505 - protein, 25 aa, Entamoeba histolytica
FLNAKTCVFFRWTSDMKQPHIDRIV

SEQ ID NO: 2712506 - protein, 28 aa, Entamoeba histolytica
FLNASSNPILFIPPLPELKSLCLVNCPL

SEQ ID NO: 2712507 - protein, 20 aa, Entamoeba histolytica
FLNIVTVMWDWPKESIQRLN

SEQ ID NO: 2712508 - protein, 17 aa, Entamoeba histolytica
FLPHIPSLDIRDGAVDL

SEQ ID NO: 2712509 - protein, 18 aa, Entamoeba histolytica
FLPHIPSLDIRDGAVDLL

SEQ ID NO: 2712510 - protein, 25 aa, Entamoeba histolytica
FLPKKEMYYCLCLADFLVKQCPEFR

SEQ ID NO: 2712511 - protein, 26 aa, Entamoeba histolytica
FLPKKEMYYCLCLVDYLVLNCPQFRP

SEQ ID NO: 2712512 - protein, 21 aa, Entamoeba histolytica
FLQKYDVIPTLFRLMEFAIQN

SEQ ID NO: 2712513 - protein, 23 aa, Entamoeba histolytica
FLQRRYLFLCSLKELKLNDYTSI

SEQ ID NO: 2712514 - protein, 17 aa, Entamoeba histolytica
FLQTLNDFALKVHPNTI

SEQ ID NO: 2712515 - protein, 18 aa, Entamoeba histolytica
FLRESFIEALKTLFSNGA

SEQ ID NO: 2712516 - protein, 19 aa, Entamoeba histolytica
FLRRRACLMMYPMCKEYPD

SEQ ID NO: 2712517 - protein, 17 aa, Entamoeba histolytica
FLRSSLFDESPSLLFCY

SEQ ID NO: 2712518 - protein, 26 aa, Entamoeba histolytica
FLSCELLENIFLPNIQLIPISCFENC

SEQ ID NO: 2712519 - protein, 17 aa, Entamoeba histolytica
FLSFFQRPMKIQSISVV

SEQ ID NO: 2712520 - protein, 17 aa, Entamoeba histolytica
FLSFPSHPLLLTSDRSV

SEQ ID NO: 2712521 - protein, 30 aa, Entamoeba histolytica; identical to SEQ ID NO: 2524425

SEQ ID NO: 2712522 - protein, 23 aa, Entamoeba histolytica
FLSIFDGFFIQKVPKMKTLADPF

SEQ ID NO: 2712523 - protein, 17 aa, Entamoeba histolytica
FLSKIAKQLEKCQWLQC

SEQ ID NO: 2712524 - protein, 22 aa, Entamoeba histolytica
FLSKLQVIFPETINIQKAKSVE

SEQ ID NO: 2712525 - protein, 41 aa, Entamoeba histolytica; identical to SEQ ID NO: 2524430

SEQ ID NO: 2712526 - protein, 18 aa, Entamoeba histolytica
FLTGVPPQEFFFHCMAGR

SEQ ID NO: 2712527 - protein, 17 aa, Entamoeba histolytica
FLTLQNERKRIHLVWFV

SEQ ID NO: 2712528 - protein, 30 aa, Entamoeba histolytica
FLTNPSKLTSFYYLCSNCEFLKLNNSKINF

SEQ ID NO: 2712529 - protein, 28 aa, Entamoeba histolytica
FLTSYDPYHLLYYLLSLFVSSYSDNCNK

SEQ ID NO: 2712530 - protein, 18 aa, Entamoeba histolytica
FLTYFSTRLQRISQFFLT

SEQ ID NO: 2712531 - protein, 18 aa, Entamoeba histolytica
FLVPAVMTVLDPISLVNC

SEQ ID NO: 2712532 - protein, 17 aa, Entamoeba histolytica
FMDSRGYAAIPMMYIRN

SEQ ID NO: 2712533 - protein, 17 aa, Entamoeba histolytica
FMDVLEYFDSRESSTGS

SEQ ID NO: 2712534 - protein, 23 aa, Entamoeba histolytica
FMEDYIAFTPYICDFQTTFENFI

SEQ ID NO: 2712535 - protein, 17 aa, Entamoeba histolytica
FMFGAKAYEVAGIRANP

SEQ ID NO: 2712536 - protein, 17 aa, Entamoeba histolytica
FMFKSHLCIVCELLSIN

SEQ ID NO: 2712537 - protein, 20 aa, Entamoeba histolytica
FMHFNSHYFARRLINKTVSI

SEQ ID NO: 2712538 - protein, 20 aa, Entamoeba histolytica
FMKIVPDGVVPISFCVPRKS

SEQ ID NO: 2712539 - protein, 18 aa, Entamoeba histolytica
FMKPNIIMKFITDEWKRC

SEQ ID NO: 2712540 - protein, 23 aa, Entamoeba histolytica
FMLNNCSFLLSSILPLLCFNDED

SEQ ID NO: 2712541 - protein, 18 aa, Entamoeba histolytica
FMNEPVLISIEIPEKLKM

SEQ ID NO: 2712542 - protein, 25 aa, Entamoeba histolytica
FMNKKTRMMKLRRKARKVLRKKQQQ

SEQ ID NO: 2712543 - protein, 17 aa, Entamoeba histolytica
FMPIFTLDDLRKYFGAF

SEQ ID NO: 2712544 - protein, 25 aa, Entamoeba histolytica
FMQGKIPTLKISLIQIFRAHLWQKI

SEQ ID NO: 2712545 - protein, 19 aa, Entamoeba histolytica
FMQLVINYMYMTLQMKHLM

SEQ ID NO: 2712546 - protein, 30 aa, Entamoeba histolytica
FMTINFVNTKLLIWGLNKPKRLMLRRLVDV

SEQ ID NO: 2712547 - protein, 19 aa, Entamoeba histolytica
FMTNTMSILLPTLERYREI

SEQ ID NO: 2712548 - protein, 19 aa, Entamoeba histolytica
FMVGYVSYGALFCILDQFL

SEQ ID NO: 2712549 - protein, 25 aa, Entamoeba histolytica
FNAIKTFIVILPLVSGNIIQTRIKP

SEQ ID NO: 2712550 - protein, 20 aa, Entamoeba histolytica
FNALDLKKLLNKIMGEIVAL

SEQ ID NO: 2712551 - protein, 24 aa, Entamoeba histolytica
FNASFNHFITLPNSLLSMTSLTSL

SEQ ID NO: 2712552 - protein, 24 aa, Entamoeba histolytica
FNCAVRIILFKFINVMLNEYRDYI

SEQ ID NO: 2712553 - protein, 22 aa, Entamoeba histolytica
FNCPICYKPLPTKEVVIDNKIL

SEQ ID NO: 2712554 - protein, 17 aa, Entamoeba histolytica
FNDIITFLLCNKKCKEA

SEQ ID NO: 2712555 - protein, 18 aa, Entamoeba histolytica
FNDKISALVLPLARYDHN

SEQ ID NO: 2712556 - protein, 29 aa, Entamoeba histolytica
FNDNGEFKWLPKHKSYFLSVIKGFSFQLV

SEQ ID NO: 2712557 - protein, 25 aa, Entamoeba histolytica
FNDVAHPVLYFTPLSHSEPKPQLSK

SEQ ID NO: 2712558 - protein, 17 aa, Entamoeba histolytica
FNDYFSCPTSLITPSLQ

SEQ ID NO: 2712559 - protein, 29 aa, Entamoeba histolytica
FNEDTFSNFFYMAPFFLNSERIKKHGNTL

SEQ ID NO: 2712560 - protein, 19 aa, Entamoeba histolytica
FNEFCHSLLLFQGRQKLLL

SEQ ID NO: 2712561 - protein, 20 aa, Entamoeba histolytica
FNEILLRRKSSNELKKRKAS

SEQ ID NO: 2712562 - protein, 25 aa, Entamoeba histolytica
FNEILNYKIVFVVILNDSLYEDIKR

SEQ ID NO: 2712563 - protein, 28 aa, Entamoeba histolytica
FNEKTPIPLINFVRYIIQYAPFDELPDC

SEQ ID NO: 2712564 - protein, 18 aa, Entamoeba histolytica
FNELTYTNPFLMQNDCCN

SEQ ID NO: 2712565 - protein, 24 aa, Entamoeba histolytica
FNENAMYGLRMLCGALSSKALQSV

SEQ ID NO: 2712566 - protein, 19 aa, Entamoeba histolytica
FNENILVPFGLESSLSGVA

SEQ ID NO: 2712567 - protein, 34 aa, Entamoeba histolytica
FNENKFINEFNHQYILFSYGKHDRYKHPSTSVLA

SEQ ID NO: 2712568 - protein, 33 aa, Entamoeba histolytica
FNETLELILYKRATYLLLTLQPSIEIIQFIYLL

SEQ ID NO: 2712569 - protein, 24 aa, Entamoeba histolytica
FNETREVYLIKELEKIAPKEKGIV

SEQ ID NO: 2712570 - protein, 31 aa, Entamoeba histolytica
FNEYKAQKKIALDNFLFLYSKELQSKPITIS

SEQ ID NO: 2712571 - protein, 17 aa, Entamoeba histolytica
FNFLYYHKKSCCSKLRY

SEQ ID NO: 2712572 - protein, 25 aa, Entamoeba histolytica
FNFNKFIYQFISTYNPPQSTVIALI

SEQ ID NO: 2712573 - protein, 20 aa, Entamoeba histolytica
FNFPDFFDCFSYSLPTMMEM

SEQ ID NO: 2712574 - protein, 23 aa, Entamoeba histolytica
FNFQIPEYNLINFSMEHSYSLFN

SEQ ID NO: 2712575 - protein, 18 aa, Entamoeba histolytica
FNFTATVYDILVAIKERQ

SEQ ID NO: 2712576 - protein, 24 aa, Entamoeba histolytica
FNGKEFCATLVRLPCVVETHKSYD

SEQ ID NO: 2712577 - protein, 26 aa, Entamoeba histolytica
FNIIITLDYSVFMDVLEYFDSRESST

SEQ ID NO: 2712578 - protein, 18 aa, Entamoeba histolytica
FNILPKKMSHDQKRFQIF

SEQ ID NO: 2712579 - protein, 20 aa, Entamoeba histolytica
FNIQQIISRLILNSSLRAEH

SEQ ID NO: 2712580 - protein, 22 aa, Entamoeba histolytica
FNIQTYRCFINFLIDAKNNCHF

SEQ ID NO: 2712581 - protein, 22 aa, Entamoeba histolytica
FNIRTERWIYNNIFYYIKRIIR

SEQ ID NO: 2712582 - protein, 17 aa, Entamoeba histolytica
FNKAMEIVLVIIEENKS

SEQ ID NO: 2712583 - protein, 23 aa, Entamoeba histolytica
FNKKFKPFLKDIPNVEIKSITTR

SEQ ID NO: 2712584 - protein, 23 aa, Entamoeba histolytica
FNKKNMMLVGIGLGFYLEVSINE

SEQ ID NO: 2712585 - protein, 20 aa, Entamoeba histolytica
FNKLFKYQAALILFAMASRT

SEQ ID NO: 2712586 - protein, 19 aa, Entamoeba histolytica
FNKMFNIEQIFLEGNPTAE

SEQ ID NO: 2712587 - protein, 26 aa, Entamoeba histolytica
FNKPVYLRSTFWPLMNIDFYKRYQDT

SEQ ID NO: 2712588 - protein, 17 aa, Entamoeba histolytica
FNKSLKTFQCMRCMKLT

SEQ ID NO: 2712589 - protein, 31 aa, Entamoeba histolytica
FNKTIPPPMKLQLEKVYWPLVTVTKKRYFGM

SEQ ID NO: 2712590 - protein, 19 aa, Entamoeba histolytica
FNKTLWCSSLFYPVEFHED

SEQ ID NO: 2712591 - protein, 26 aa, Entamoeba histolytica
FNLKDVRLRPRYLMKFLDTDGDWVTL

SEQ ID NO: 2712592 - protein, 28 aa, Entamoeba histolytica
FNLKTAVSWLFVNIILYSEDDNIGNLLT

SEQ ID NO: 2712593 - protein, 20 aa, Entamoeba histolytica
FNLPKRITLLKKWAQGQKLY

SEQ ID NO: 2712594 - protein, 18 aa, Entamoeba histolytica
FNLQTYPAVEDYINTVLT

SEQ ID NO: 2712595 - protein, 18 aa, Entamoeba histolytica
FNMIERKLKTIGGYGNET

SEQ ID NO: 2712596 - protein, 23 aa, Entamoeba histolytica
FNNEFKGRFFATPIKIGAETEES

SEQ ID NO: 2712597 - protein, 17 aa, Entamoeba histolytica
FNNLGEVIAIPPLTALQ

SEQ ID NO: 2712598 - protein, 26 aa, Entamoeba histolytica
FNNNLRQLDLAAYKQKFSPYVKSCCN

SEQ ID NO: 2712599 - protein, 25 aa, Entamoeba histolytica
FNNSNYIPFSFITLESPHAGVKKSQ

SEQ ID NO: 2712600 - protein, 19 aa, Entamoeba histolytica
FNPFDLFNEMFGGMGGVPK

SEQ ID NO: 2712601 - protein, 17 aa, Entamoeba histolytica
FNPISIITKKLFPLIQT

SEQ ID NO: 2712602 - protein, 34 aa, Entamoeba histolytica
FNPISIQSLTLFPFIQTLFLYSSFDPFIKGINQV

SEQ ID NO: 2712603 - protein, 31 aa, Entamoeba histolytica; identical to SEQ ID NO: 2524549

SEQ ID NO: 2712604 - protein, 17 aa, Entamoeba histolytica
FNQEQLLPGDWFGLFKT

SEQ ID NO: 2712605 - protein, 17 aa, Entamoeba histolytica
FNQFLQKEFLEMLDNTE

SEQ ID NO: 2712606 - protein, 19 aa, Entamoeba histolytica
FNQLLSFGYLFDQSECSYK

SEQ ID NO: 2712607 - protein, 20 aa, Entamoeba histolytica
FNQLVKFMLKLFNQKKIPQN

SEQ ID NO: 2712608 - protein, 24 aa, Entamoeba histolytica
FNQNMMDFFITAYLPDFPTMVIQK

SEQ ID NO: 2712609 - protein, 19 aa, Entamoeba histolytica
FNQQTFVETLNLIRRFNKE

SEQ ID NO: 2712610 - protein, 20 aa, Entamoeba histolytica
FNQQTFVETLNLIRRFNKEV

SEQ ID NO: 2712611 - protein, 20 aa, Entamoeba histolytica
FNRHICIVFELLGMNLYDVL

SEQ ID NO: 2712612 - protein, 17 aa, Entamoeba histolytica
FNRLLQLVEKHGYKVKR

SEQ ID NO: 2712613 - protein, 26 aa, Entamoeba histolytica
FNSCQLPMLLIPTTCTYLNVYCSRLP

SEQ ID NO: 2712614 - protein, 30 aa, Entamoeba histolytica
FNSHNTIISELFNYQYFLVDTSDRLSQYNI

SEQ ID NO: 2712615 - protein, 24 aa, Entamoeba histolytica
FNSIKLKYILPQSLIRLIQLDISI

SEQ ID NO: 2712616 - protein, 17 aa, Entamoeba histolytica
FNSNTWFRISQNLYQHM

SEQ ID NO: 2712617 - protein, 31 aa, Entamoeba histolytica
FNSPKIIEFLNYRQFPLLAFTDFMSLFVKHF

SEQ ID NO: 2712618 - protein, 22 aa, Entamoeba histolytica
FNSSIFIRCFYLASSNNQSIKQ

SEQ ID NO: 2712619 - protein, 30 aa, Entamoeba histolytica
FNSSLIQRLQFDLSPSSSFLFIPIEDDDIL

SEQ ID NO: 2712620 - protein, 23 aa, Entamoeba histolytica
FNSTECYVFLLTNLNAICLAKGR

SEQ ID NO: 2712621 - protein, 18 aa, Entamoeba histolytica
FNTCCAGKLYFCTLCLLQ

SEQ ID NO: 2712622 - protein, 17 aa, Entamoeba histolytica
FNTKWFCSKIRKIRIDG

SEQ ID NO: 2712623 - protein, 17 aa, Entamoeba histolytica
FNTLPLWKRENLKKAKK

SEQ ID NO: 2712624 - protein, 33 aa, Entamoeba histolytica; identical to SEQ ID NO: 2524570

SEQ ID NO: 2712625 - protein, 19 aa, Entamoeba histolytica
FNVFNLMNNFFLTIGNHPK

SEQ ID NO: 2712626 - protein, 18 aa, Entamoeba histolytica
FNVLRLIGLLISTAPQQC

SEQ ID NO: 2712627 - protein, 29 aa, Entamoeba histolytica
FNYYCGNAFSWKWGYKCHYAPLLCHFVDY

SEQ ID NO: 2712628 - protein, 17 aa, Entamoeba histolytica
FPCFIEVVGIQSPGLTA

SEQ ID NO: 2712629 - protein, 25 aa, Entamoeba histolytica
FPCKDYLYHILEFTGNGIALHFSLS

SEQ ID NO: 2712630 - protein, 29 aa, Entamoeba histolytica
FPDINKNTLWLIMRFLSKVIQNTSVNQMT

SEQ ID NO: 2712631 - protein, 18 aa, Entamoeba histolytica
FPDKRPMFDVVKSVIETI

SEQ ID NO: 2712632 - protein, 26 aa, Entamoeba histolytica
FPELSNFKMIGKFEGKIKFFNGNFEF

SEQ ID NO: 2712633 - protein, 17 aa, Entamoeba histolytica
FPERYEVKDPLILEADS

SEQ ID NO: 2712634 - protein, 35 aa, Entamoeba histolytica
FPFNKSIEHNIKLRKAFDKLYKNLISQEIQNTSVG

SEQ ID NO: 2712635 - protein, 22 aa, Entamoeba histolytica
FPGLLVTSQERKNLFKELSICI

SEQ ID NO: 2712636 - protein, 17 aa, Entamoeba histolytica
FPGNSMNLLKFGLDFKF

SEQ ID NO: 2712637 - protein, 30 aa, Entamoeba histolytica
FPGTHAVPFSIIIPIVPHPSLHLKGEVGVR

SEQ ID NO: 2712638 - protein, 18 aa, Entamoeba histolytica
FPGVVYRLADPKMVLLIF

SEQ ID NO: 2712639 - protein, 40 aa, Entamoeba histolytica
FPIEFTGLTNIMILLVGKRLNIFGWYNTKKIPSYGFIKND

SEQ ID NO: 2712640 - protein, 25 aa, Entamoeba histolytica
FPIMKRSFYAFRIEGEIKLFGNNIE

SEQ ID NO: 2712641 - protein, 20 aa, Entamoeba histolytica
FPKFCEFLKQLGIHFCNGNI

SEQ ID NO: 2712642 - protein, 24 aa, Entamoeba histolytica
FPKGFYHPNIYPSGTVCLSILNEE

SEQ ID NO: 2712643 - protein, 28 aa, Entamoeba histolytica
FPKKGPRLCFLMSDMLLITVIKKVNDVP

SEQ ID NO: 2712644 - protein, 17 aa, Entamoeba histolytica
FPLISKKLEFYYAFVNT

SEQ ID NO: 2712645 - protein, 17 aa, Entamoeba histolytica
FPLKITAYYFVDNIDIG

SEQ ID NO: 2712646 - protein, 17 aa, Entamoeba histolytica
FPLTYRLSDFTKLYVTI

SEQ ID NO: 2712647 - protein, 23 aa, Entamoeba histolytica
FPNEYVDLYFTIIKHSYSTFDSL

SEQ ID NO: 2712648 - protein, 27 aa, Entamoeba histolytica
FPNIETHYLYFPFDKKLPSVKLEAICY

SEQ ID NO: 2712649 - protein, 17 aa, Entamoeba histolytica
FPNWLRNSKEDPYDILL

SEQ ID NO: 2712650 - protein, 20 aa, Entamoeba histolytica
FPPEYTLVERILFEKEINGE

SEQ ID NO: 2712651 - protein, 17 aa, Entamoeba histolytica
FPPYLDSGVYRMDLKFR

SEQ ID NO: 2712652 - protein, 19 aa, Entamoeba histolytica
FPQIIIPRRYYIGGDNYLV

SEQ ID NO: 2712653 - protein, 19 aa, Entamoeba histolytica
FPQPKRKVLKEKKGTKKTN

SEQ ID NO: 2712654 - protein, 29 aa, Entamoeba histolytica
FPQPNIFDLLLPYLYPDYPPALLSSVSAV

SEQ ID NO: 2712655 - protein, 33 aa, Entamoeba histolytica
FPQQQPPMQGFPQQPPMQGFPQKNQYPPIHENP

SEQ ID NO: 2712656 - protein, 19 aa, Entamoeba histolytica
FPQSDLCYCIKFFNKLEET

SEQ ID NO: 2712657 - protein, 32 aa, Entamoeba histolytica
FPQSKLLPFTMVGGFLFLRVICPSLAAPEASG

SEQ ID NO: 2712658 - protein, 17 aa, Entamoeba histolytica
FPSFKYQLFSISKYEEE

SEQ ID NO: 2712659 - protein, 24 aa, Entamoeba histolytica
FPSISIVFPFNGVSGQLLTVLKHN

SEQ ID NO: 2712660 - protein, 22 aa, Entamoeba histolytica
FPSQTFFERCKYKKRLAIFICY

SEQ ID NO: 2712661 - protein, 19 aa, Entamoeba histolytica
FPTIQQHIQPQITKSFIPV

SEQ ID NO: 2712662 - protein, 25 aa, Entamoeba histolytica
FPVCITKCQSLKILNLSDCHLYDIP

SEQ ID NO: 2712663 - protein, 18 aa, Entamoeba histolytica
FQAIFSSTQLINKLLFDC

SEQ ID NO: 2712664 - protein, 25 aa, Entamoeba histolytica
FQDCVDFILELLTKDKLLALRVIES

SEQ ID NO: 2712665 - protein, 30 aa, Entamoeba histolytica
FQEDPLIKEQWWYPLCMSLRIEEFRPLQEW

SEQ ID NO: 2712666 - protein, 17 aa, Entamoeba histolytica
FQEILKSIKINIKGYFQ

SEQ ID NO: 2712667 - protein, 23 aa, Entamoeba histolytica
FQEIRKYCSFLEFIGKIAGNPII

SEQ ID NO: 2712668 - protein, 24 aa, Entamoeba histolytica
FQEKYMLPITDYALGKYSFVTNLL

SEQ ID NO: 2712669 - protein, 25 aa, Entamoeba histolytica
FQENNFNRITYFPSISLVTNQSQRN

SEQ ID NO: 2712670 - protein, 19 aa, Entamoeba histolytica
FQETRAVLTPTKLVDFIVT

SEQ ID NO: 2712671 - protein, 25 aa, Entamoeba histolytica
FQFTKQFLWKWFNEQFIKKVNQTRE

SEQ ID NO: 2712672 - protein, 19 aa, Entamoeba histolytica
FQFYLVSHVPRKGLVKPSM

SEQ ID NO: 2712673 - protein, 21 aa, Entamoeba histolytica
FQGKRFILLDEYFQLCFNNMI

SEQ ID NO: 2712674 - protein, 24 aa, Entamoeba histolytica
FQKDILSVPSLLLIPFSISSVHEF

SEQ ID NO: 2712675 - protein, 20 aa, Entamoeba histolytica
FQKELFYNVNMQRGYDLEIL

SEQ ID NO: 2712676 - protein, 24 aa, Entamoeba histolytica
FQKFREMVYGLLLRQFHRLNEEVK

SEQ ID NO: 2712677 - protein, 23 aa, Entamoeba histolytica
FQKGLRIMIITPEMLALNEESLN

SEQ ID NO: 2712678 - protein, 26 aa, Entamoeba histolytica
FQKKEKPLPPIPINSSRPLPSIPQPK

SEQ ID NO: 2712679 - protein, 24 aa, Entamoeba histolytica
FQKVNQNFDLMFGKRAFVHHYVGE

SEQ ID NO: 2712680 - protein, 26 aa, Entamoeba histolytica
FQLENLRRLNLFSNKIRNVPIRLCFD

SEQ ID NO: 2712681 - protein, 34 aa, Entamoeba histolytica
FQLPSIITHLSYFRIPLPDILHWINIDISSQSGK

SEQ ID NO: 2712682 - protein, 20 aa, Entamoeba histolytica
FQQHLLPKRCLLNFQQQNFE

SEQ ID NO: 2712683 - protein, 19 aa, Entamoeba histolytica
FQQILNDELFFIEIEKHKL

SEQ ID NO: 2712684 - protein, 24 aa, Entamoeba histolytica
FQQILNDELFFIEIEKHKLISSTT

SEQ ID NO: 2712685 - protein, 17 aa, Entamoeba histolytica
FQQNELFRKIPYNEFLG

SEQ ID NO: 2712686 - protein, 27 aa, Entamoeba histolytica
FQRYVFQRSFYVNRIGILYGTFKQDRV

SEQ ID NO: 2712687 - protein, 20 aa, Entamoeba histolytica
FQSLDTWKNDFLSGANPTNA

SEQ ID NO: 2712688 - protein, 17 aa, Entamoeba histolytica
FQSPTILCYGKGACSEI

SEQ ID NO: 2712689 - protein, 25 aa, Entamoeba histolytica
FQTLMGEVAPVKKAFIITTHGSKEC

SEQ ID NO: 2712690 - protein, 17 aa, Entamoeba histolytica
FQWKSPLAIALTSSIQL

SEQ ID NO: 2712691 - protein, 17 aa, Entamoeba histolytica
FQYLVGITYIEKLVDQI

SEQ ID NO: 2712692 - protein, 17 aa, Entamoeba histolytica
FQYSKRNIVRPPKIHIE

SEQ ID NO: 2712693 - protein, 33 aa, Entamoeba histolytica
FRCNQRLIKHFWIMRELSLTSFINCKRSLYTES

SEQ ID NO: 2712694 - protein, 24 aa, Entamoeba histolytica
FRDGRAFAYIISKRRPDLLDPKYL

SEQ ID NO: 2712695 - protein, 24 aa, Entamoeba histolytica
FREDFVYGFSTWFDVSFPQSGEVL

SEQ ID NO: 2712696 - protein, 21 aa, Entamoeba histolytica
FREGYLLFFRICDVYFEELSK

SEQ ID NO: 2712697 - protein, 19 aa, Entamoeba histolytica
FREIRSDIASFFTNRYSLY

SEQ ID NO: 2712698 - protein, 17 aa, Entamoeba histolytica
FRGIIHISGENNSVFSG

SEQ ID NO: 2712699 - protein, 22 aa, Entamoeba histolytica
FRGKILPPKTTLMKVPILSISP

SEQ ID NO: 2712700 - protein, 28 aa, Entamoeba histolytica
FRGNMERFHFNPIPLNQYSIEFFPNIET

SEQ ID NO: 2712701 - protein, 30 aa, Entamoeba histolytica
FRGNTPFIRFYNFYLFFYCNEYLTKTTSAI

SEQ ID NO: 2712702 - protein, 32 aa, Entamoeba histolytica
FRIDKVFFFSYTFPELIKIRNEFKYFNVVQLK

SEQ ID NO: 2712703 - protein, 20 aa, Entamoeba histolytica
FRIFLDVFFEGVRSPSFIIY

SEQ ID NO: 2712704 - protein, 19 aa, Entamoeba histolytica
FRIINTIVTQIIIPPLTCS

SEQ ID NO: 2712705 - protein, 28 aa, Entamoeba histolytica
FRITFHSHKKLYDLFWKVVEPLSQIQRV

SEQ ID NO: 2712706 - protein, 18 aa, Entamoeba histolytica
FRKFICCGPMYFIENVNT

SEQ ID NO: 2712707 - protein, 22 aa, Entamoeba histolytica
FRKIYYLIEARCRIGITATPIR

SEQ ID NO: 2712708 - protein, 23 aa, Entamoeba histolytica
FRKKYMIFSYQFADFITNFEDMD

SEQ ID NO: 2712709 - protein, 22 aa, Entamoeba histolytica
FRKLEEKLNIWKALMQLEANHG

SEQ ID NO: 2712710 - protein, 18 aa, Entamoeba histolytica
FRLAMQEAVKFIRKIVVH

SEQ ID NO: 2712711 - protein, 27 aa, Entamoeba histolytica
FRLEEFTRSIWPTYRPIVIDIIDCLCD

SEQ ID NO: 2712712 - protein, 21 aa, Entamoeba histolytica
FRLFVNLCCDTFLILRKNYHG

SEQ ID NO: 2712713 - protein, 24 aa, Entamoeba histolytica
FRNASCIILVFDVSNFQSFKGIKS

SEQ ID NO: 2712714 - protein, 30 aa, Entamoeba histolytica
FRNEELRNLVFFKYPKWTGGLYCSPSIPGS

SEQ ID NO: 2712715 - protein, 25 aa, Entamoeba histolytica
FRNIETQFLYYPFEEKIQSNHLLYR

SEQ ID NO: 2712716 - protein, 20 aa, Entamoeba histolytica
FRNSISLLPYSKRKTLASDI

SEQ ID NO: 2712717 - protein, 18 aa, Entamoeba histolytica
FRPSMLSPFKNYLLHSSQ

SEQ ID NO: 2712718 - protein, 19 aa, Entamoeba histolytica
FRQRTFVILFSDKTERNEW

SEQ ID NO: 2712719 - protein, 35 aa, Entamoeba histolytica; identical to SEQ ID NO: 2524681

SEQ ID NO: 2712720 - protein, 31 aa, Entamoeba histolytica
FRRISTLWRICQTYDYFFVKTVVREYTDDSP

SEQ ID NO: 2712721 - protein, 19 aa, Entamoeba histolytica
FRSAFIYAKIKTANVREWV

SEQ ID NO: 2712722 - protein, 25 aa, Entamoeba histolytica
FRSIDFYIKHLLTQYSPTVFVIDSI

SEQ ID NO: 2712723 - protein, 18 aa, Entamoeba histolytica
FRSLASNFFRDAQGIIIC

SEQ ID NO: 2712724 - protein, 17 aa, Entamoeba histolytica
FRSPRTGLYFNLQKYNL

SEQ ID NO: 2712725 - protein, 25 aa, Entamoeba histolytica
FRSSSQFVLLMKRIVNFFREKLHEA

SEQ ID NO: 2712726 - protein, 32 aa, Entamoeba histolytica; identical to SEQ ID NO: 2524690

SEQ ID NO: 2712727 - protein, 18 aa, Entamoeba histolytica
FRTLFKKVKGSCKVYKKY

SEQ ID NO: 2712728 - protein, 17 aa, Entamoeba histolytica
FRTYLRYLRGSVFCEKK

SEQ ID NO: 2712729 - protein, 17 aa, Entamoeba histolytica
FRWEGCSWEWCWDSVDN

SEQ ID NO: 2712730 - protein, 17 aa, Entamoeba histolytica
FRYVIFAIKIKENRLFQ

SEQ ID NO: 2712731 - protein, 24 aa, Entamoeba histolytica
FSAPNTLFSRLKTLSPEPLNTQQG

SEQ ID NO: 2712732 - protein, 30 aa, Entamoeba histolytica
FSAYRIDHILGFFRIWSIPAGHRTGLLGRF

SEQ ID NO: 2712733 - protein, 28 aa, Entamoeba histolytica
FSCDFRQSVLELLLWCNEKNLPIEQFAL

SEQ ID NO: 2712734 - protein, 30 aa, Entamoeba histolytica; identical to SEQ ID NO: 2524700

SEQ ID NO: 2712735 - protein, 27 aa, Entamoeba histolytica
FSDSLFGDDFFEDDDIFGALHSIWSSK

SEQ ID NO: 2712736 - protein, 24 aa, Entamoeba histolytica
FSECFNLRFVPFPPSVHQLERFAF

SEQ ID NO: 2712737 - protein, 19 aa, Entamoeba histolytica
FSEFFKHFEKWFSESEWVN

SEQ ID NO: 2712738 - protein, 22 aa, Entamoeba histolytica
FSEHYIIMPDFVKMFVKQVAEK

SEQ ID NO: 2712739 - protein, 25 aa, Entamoeba histolytica
FSENFTVFSYLYLLNSLVKKYGFKN

SEQ ID NO: 2712740 - protein, 36 aa, Entamoeba histolytica
FSESEILYKFYQYLRSLLIFSRSYPKNLKQYFILFD

SEQ ID NO: 2712741 - protein, 31 aa, Entamoeba histolytica
FSEVPRIMVCVLYPKIIKIDAAFISPSSTGF

SEQ ID NO: 2712742 - protein, 38 aa, Entamoeba histolytica; identical to SEQ ID NO: 2517943

SEQ ID NO: 2712743 - protein, 17 aa, Entamoeba histolytica
FSFFELCFNTIVFSLTI

SEQ ID NO: 2712744 - protein, 25 aa, Entamoeba histolytica
FSFGMTMYHIFTNEIPYGDLSNAQI

SEQ ID NO: 2712745 - protein, 18 aa, Entamoeba histolytica
FSFIVDFLKEFPTVSSMK

SEQ ID NO: 2712746 - protein, 19 aa, Entamoeba histolytica
FSFMCAAKNYAKTNSIKIF

SEQ ID NO: 2712747 - protein, 17 aa, Entamoeba histolytica
FSFNLMLSIKCTDIQKW

SEQ ID NO: 2712748 - protein, 18 aa, Entamoeba histolytica
FSFSFQKPKKRSTVNFCF

SEQ ID NO: 2712749 - protein, 18 aa, Entamoeba histolytica
FSHCNLLRSIYINSPLQT

SEQ ID NO: 2712750 - protein, 19 aa, Entamoeba histolytica
FSHDAKIVIFVSSKSIRFI

SEQ ID NO: 2712751 - protein, 17 aa, Entamoeba histolytica
FSHFLMTSYTPLRQVNQ

SEQ ID NO: 2712752 - protein, 28 aa, Entamoeba histolytica
FSHPNYYYNNPKPLIRILKYITFDQKCP

SEQ ID NO: 2712753 - protein, 18 aa, Entamoeba histolytica
FSIIIPPHDFIIEKICNK

SEQ ID NO: 2712754 - protein, 23 aa, Entamoeba histolytica
FSINPPLYGIAWFNKYNYSQYLP

SEQ ID NO: 2712755 - protein, 18 aa, Entamoeba histolytica
FSIPSWVQLFKGGDGLKK

SEQ ID NO: 2712756 - protein, 18 aa, Entamoeba histolytica
FSIVIWEILTFKHPFESF

SEQ ID NO: 2712757 - protein, 20 aa, Entamoeba histolytica
FSIYRRSLVMVFATAAYMTY

SEQ ID NO: 2712758 - protein, 19 aa, Entamoeba histolytica
FSKLTLPTILDLKGANIKV

SEQ ID NO: 2712759 - protein, 17 aa, Entamoeba histolytica
FSKQYHYCYPDKIIPSI

SEQ ID NO: 2712760 - protein, 23 aa, Entamoeba histolytica
FSKYLKDITNEDLRTAMLGLGHS

SEQ ID NO: 2712761 - protein, 17 aa, Entamoeba histolytica
FSLGCYINNLPTLIKKT

SEQ ID NO: 2712762 - protein, 17 aa, Entamoeba histolytica
FSLIPYASKVCIKRTNC

SEQ ID NO: 2712763 - protein, 24 aa, Entamoeba histolytica
FSLPQCLIIPRDLFITHNNNTFVA

SEQ ID NO: 2712764 - protein, 23 aa, Entamoeba histolytica
FSLSVNILLYFNCLYDDNHITID

SEQ ID NO: 2712765 - protein, 17 aa, Entamoeba histolytica
FSLTTFSPSGKLVQIEY

SEQ ID NO: 2712766 - protein, 36 aa, Entamoeba histolytica
FSMKIHSLTIPQIQYPDLLLFELQRKYPSETWLEQI

SEQ ID NO: 2712767 - protein, 27 aa, Entamoeba histolytica
FSMQRFPQMPIMPPNRQFPPYVIPEPN

SEQ ID NO: 2712768 - protein, 23 aa, Entamoeba histolytica
FSNAYLFFLLSECGASASLKYTK

SEQ ID NO: 2712769 - protein, 25 aa, Entamoeba histolytica
FSNDIILNSLYYFKNQMEPYSDDDE

SEQ ID NO: 2712770 - protein, 38 aa, Entamoeba histolytica
FSNDLSFLQTKVQQLDILIQSLILIPETLIKEETNSDL

SEQ ID NO: 2712771 - protein, 24 aa, Entamoeba histolytica
FSNFSLLTLLRLRGNNINKFPDPI

SEQ ID NO: 2712772 - protein, 26 aa, Entamoeba histolytica
FSNIFHAFQTLFSTGDLFFSCNDTLT

SEQ ID NO: 2712773 - protein, 37 aa, Entamoeba histolytica
FSNPLISLTQIWIYHDSLKYVFFPGGSGNYCGNMNPT

SEQ ID NO: 2712774 - protein, 25 aa, Entamoeba histolytica
FSNQFQNGFIRILQTQYKRKQVNAN

SEQ ID NO: 2712775 - protein, 28 aa, Entamoeba histolytica
FSNQTLAQIKLWREKLPIDCITLPKELD

SEQ ID NO: 2712776 - protein, 17 aa, Entamoeba histolytica
FSNRLINGKWVCFNDRS

SEQ ID NO: 2712777 - protein, 24 aa, Entamoeba histolytica
FSPKDPHYFAFNKTSPNRHFSPLC

SEQ ID NO: 2712778 - protein, 18 aa, Entamoeba histolytica
FSQLALKPIWDIYNTVHQ

SEQ ID NO: 2712779 - protein, 18 aa, Entamoeba histolytica
FSQPPPPPPPAPDKSTQQ

SEQ ID NO: 2712780 - protein, 26 aa, Entamoeba histolytica
FSRQTFFRLGLFSLLLHEVMLEFNIS

SEQ ID NO: 2712781 - protein, 25 aa, Entamoeba histolytica
FSRQTFFRLGLFSLLLHEVMLEFNM

SEQ ID NO: 2712782 - protein, 25 aa, Entamoeba histolytica
FSRRRLEWHYLFIACSYIGARICSL

SEQ ID NO: 2712783 - protein, 24 aa, Entamoeba histolytica
FSSIYNDIIGKEYFVFTGTTVVKV

SEQ ID NO: 2712784 - protein, 29 aa, Entamoeba histolytica
FSSKYERLLQYFQLKSIIDLLGKVYFSFE

SEQ ID NO: 2712785 - protein, 23 aa, Entamoeba histolytica
FSSLPHLLAPELPVSSLKILLSA

SEQ ID NO: 2712786 - protein, 21 aa, Entamoeba histolytica
FSTAFLPMILNLAFDSTSNVR

SEQ ID NO: 2712787 - protein, 24 aa, Entamoeba histolytica
FSTGKTCMLIRLSQNFFDTQHNPT

SEQ ID NO: 2712788 - protein, 17 aa, Entamoeba histolytica
FSTKEHYPYFITSAKLH

SEQ ID NO: 2712789 - protein, 24 aa, Entamoeba histolytica
FSTLFPNYILYLKLDSLHLGNSMK

SEQ ID NO: 2712790 - protein, 17 aa, Entamoeba histolytica
FSVDHPFVPLWACKDEE

SEQ ID NO: 2712791 - protein, 28 aa, Entamoeba histolytica
FSVVVLLLLEILIPFEWQHIIITHLPVS

SEQ ID NO: 2712792 - protein, 19 aa, Entamoeba histolytica
FSVWYEWLVTSPVLSRLHN

SEQ ID NO: 2712793 - protein, 18 aa, Entamoeba histolytica
FSWAMPCKRICIEDIHPC

SEQ ID NO: 2712794 - protein, 25 aa, Entamoeba histolytica
FSYDSTILIILSSQSLRFIPINPKH

SEQ ID NO: 2712795 - protein, 30 aa, Entamoeba histolytica
FSYNPVPITTIYPFYNITSLIRYSSNDPII

SEQ ID NO: 2712796 - protein, 25 aa, Entamoeba histolytica
FTAAMFLPFVMQFLENFENFAKWKF

SEQ ID NO: 2712797 - protein, 17 aa, Entamoeba histolytica
FTAFTAKGKLLEITVWG

SEQ ID NO: 2712798 - protein, 30 aa, Entamoeba histolytica
FTATIKMICKIFPISDFWEHVCIVWTRCYC

SEQ ID NO: 2712799 - protein, 18 aa, Entamoeba histolytica
FTAVFRLLDIKDQGKIGA

SEQ ID NO: 2712800 - protein, 19 aa, Entamoeba histolytica
FTDGQPITLYWSHGNQNQM

SEQ ID NO: 2712801 - protein, 27 aa, Entamoeba histolytica
FTDKGDIQYFWKNYILQLTDIKDESLI

SEQ ID NO: 2712802 - protein, 19 aa, Entamoeba histolytica
FTEIFNKLVPQGKGTLVML

SEQ ID NO: 2712803 - protein, 25 aa, Entamoeba histolytica
FTEITLPPFLSKLGKNAFLGCTSLT

SEQ ID NO: 2712804 - protein, 28 aa, Entamoeba histolytica
FTELQKLRKIFFPDFFMKHQKITESHIA

SEQ ID NO: 2712805 - protein, 19 aa, Entamoeba histolytica
FTFDPFDDNILYIGGEDGK

SEQ ID NO: 2712806 - protein, 18 aa, Entamoeba histolytica
FTGDYFFADICLPMLKEA

SEQ ID NO: 2712807 - protein, 19 aa, Entamoeba histolytica
FTIELLELLQKTPNIIFFI

SEQ ID NO: 2712808 - protein, 20 aa, Entamoeba histolytica
FTIGIKSRGLEKKQRFTRVS

SEQ ID NO: 2712809 - protein, 30 aa, Entamoeba histolytica
FTIIDFESDFPFYKEFFYGNDQVKHYLSKE

SEQ ID NO: 2712810 - protein, 18 aa, Entamoeba histolytica
FTILLNRELLNNLVSMAT

SEQ ID NO: 2712811 - protein, 25 aa, Entamoeba histolytica
FTINDIQFMIKRLIKTILNPQVKTE

SEQ ID NO: 2712812 - protein, 24 aa, Entamoeba histolytica
FTIQEMIYPSRFILRKTNNESADM

SEQ ID NO: 2712813 - protein, 22 aa, Entamoeba histolytica
FTKRFHRTFRKGISVISVLEET

SEQ ID NO: 2712814 - protein, 22 aa, Entamoeba histolytica
FTKVKEMFLLSLTPSSCIQFIK

SEQ ID NO: 2712815 - protein, 20 aa, Entamoeba histolytica
FTLHGQAFVFPLSINQNNNI

SEQ ID NO: 2712816 - protein, 28 aa, Entamoeba histolytica
FTLIQCGVDWIYIKTLPNLYLNIITYVN

SEQ ID NO: 2712817 - protein, 19 aa, Entamoeba histolytica
FTLPYYINEVYPKYTFLVI

SEQ ID NO: 2712818 - protein, 18 aa, Entamoeba histolytica
FTMLVQKVNIALQKHGIE

SEQ ID NO: 2712819 - protein, 32 aa, Entamoeba histolytica; identical to SEQ ID NO: 2524798

SEQ ID NO: 2712820 - protein, 19 aa, Entamoeba histolytica
FTNSCCEVGYWLSPKFQHH

SEQ ID NO: 2712821 - protein, 23 aa, Entamoeba histolytica
FTNTLFFYLRDNFLKFHGDSEYD

SEQ ID NO: 2712822 - protein, 17 aa, Entamoeba histolytica
FTPFSSYYQKQSSYYPP

SEQ ID NO: 2712823 - protein, 25 aa, Entamoeba histolytica
FTPHYLYIHFPLIHQKLMSYINTVL

SEQ ID NO: 2712824 - protein, 18 aa, Entamoeba histolytica
FTPPVLLVGNKCDLIGSS

SEQ ID NO: 2712825 - protein, 26 aa, Entamoeba histolytica
FTQFIPSFIHLLRGCGYLGSLAIICA

SEQ ID NO: 2712826 - protein, 30 aa, Entamoeba histolytica; identical to SEQ ID NO: 2524806

SEQ ID NO: 2712827 - protein, 36 aa, Entamoeba histolytica
FTSKEIETIYYWKYYLNLVLPQQMSVFVLLLADIKS

SEQ ID NO: 2712828 - protein, 27 aa, Entamoeba histolytica
FTTCQSLPLNLFLFVDKKPIIDIDVIN

SEQ ID NO: 2712829 - protein, 25 aa, Entamoeba histolytica
FTTEPTLFDFFNTRDRRLPLIDVIS

SEQ ID NO: 2712830 - protein, 24 aa, Entamoeba histolytica
FTTNRLIIQKVRMGCLAVVAQKSI

SEQ ID NO: 2712831 - protein, 25 aa, Entamoeba histolytica
FTTPCLPFIGTYLTDYTFLDDGNLD

SEQ ID NO: 2712832 - protein, 31 aa, Entamoeba histolytica; identical to SEQ ID NO: 2524814

SEQ ID NO: 2712833 - protein, 22 aa, Entamoeba histolytica
FTTVSMWFEAWGALFDSSIADS

SEQ ID NO: 2712834 - protein, 18 aa, Entamoeba histolytica
FTVLRPFGTEMWDIEMIN

SEQ ID NO: 2712835 - protein, 20 aa, Entamoeba histolytica
FTVLVIEIQTYRVFYRQVIA

SEQ ID NO: 2712836 - protein, 17 aa, Entamoeba histolytica
FTVNEFIYCSLHLKYFQ

SEQ ID NO: 2712837 - protein, 29 aa, Entamoeba histolytica
FTVNNVICPYFFFPLTTFNEYNTAGWFKG

SEQ ID NO: 2712838 - protein, 25 aa, Entamoeba histolytica
FTYMEASIFYKLEPSEFFGQAWAKA

SEQ ID NO: 2712839 - protein, 17 aa, Entamoeba histolytica
FVADPRMLKPAEIDPRT

SEQ ID NO: 2712840 - protein, 19 aa, Entamoeba histolytica
FVAHGNICLLFKQIAKHGI

SEQ ID NO: 2712841 - protein, 18 aa, Entamoeba histolytica
FVALQHWSYFYTSKRLLF

SEQ ID NO: 2712842 - protein, 18 aa, Entamoeba histolytica
FVAMIALLKDCADDTFME

SEQ ID NO: 2712843 - protein, 17 aa, Entamoeba histolytica
FVAMLTFCDGEKPQVIN

SEQ ID NO: 2712844 - protein, 22 aa, Entamoeba histolytica
FVCFEEGFHYNEFWDILHGVEK

SEQ ID NO: 2712845 - protein, 17 aa, Entamoeba histolytica
FVCHQMGHISRDCPNNP

SEQ ID NO: 2712846 - protein, 18 aa, Entamoeba histolytica
FVCNLKPSKLRGVASEAM

SEQ ID NO: 2712847 - protein, 24 aa, Entamoeba histolytica
FVCQGRFIFKELPTTISSLEDVLM

SEQ ID NO: 2712848 - protein, 25 aa, Entamoeba histolytica
FVDINQFFVKSLLPPPQALINAQKI

SEQ ID NO: 2712849 - protein, 19 aa, Entamoeba histolytica
FVDIVGPSIFRIPAEKYGE

SEQ ID NO: 2712850 - protein, 30 aa, Entamoeba histolytica
FVDMLKIQYRMHPLIREFPSNQFYSGELID

SEQ ID NO: 2712851 - protein, 23 aa, Entamoeba histolytica
FVDSLFNHIIPSTTIAPLLLDIC

SEQ ID NO: 2712852 - protein, 18 aa, Entamoeba histolytica
FVDYPLINKPNELNQNNE

SEQ ID NO: 2712853 - protein, 17 aa, Entamoeba histolytica
FVEAFTWLIAHDVLIRV

SEQ ID NO: 2712854 - protein, 21 aa, Entamoeba histolytica
FVEINPFPQTLTKIKLMDINS

SEQ ID NO: 2712855 - protein, 27 aa, Entamoeba histolytica
FVEKNRKWLLPYIVYKCCGMNGVPTME

SEQ ID NO: 2712856 - protein, 18 aa, Entamoeba histolytica
FVEMHASEFILLTKQEHQ

SEQ ID NO: 2712857 - protein, 27 aa, Entamoeba histolytica
FVEPLQCPGVFPFFIKTECSDQVNFIS

SEQ ID NO: 2712858 - protein, 18 aa, Entamoeba histolytica
FVESWMNYKNFSPLVIDI

SEQ ID NO: 2712859 - protein, 17 aa, Entamoeba histolytica
FVETLNLIRRFNKEVSS

SEQ ID NO: 2712860 - protein, 21 aa, Entamoeba histolytica
FVFESKKYPLLHQKGMYDESF

SEQ ID NO: 2712861 - protein, 17 aa, Entamoeba histolytica
FVFLHPFNSHFIDQNIF

SEQ ID NO: 2712862 - protein, 27 aa, Entamoeba histolytica
FVFSDYCRPTIRLAALSHYPSIFVFTH

SEQ ID NO: 2712863 - protein, 18 aa, Entamoeba histolytica
FVGSLVPFTFVLKENGFL

SEQ ID NO: 2712864 - protein, 36 aa, Entamoeba histolytica
FVHPELIKFTKSITSLYRTLLLTIPKGGMKHLSRVV

SEQ ID NO: 2712865 - protein, 20 aa, Entamoeba histolytica
FVIFHKSNYVFCVPYAFAIV

SEQ ID NO: 2712866 - protein, 17 aa, Entamoeba histolytica
FVIFKDRVTKFAEWVDN

SEQ ID NO: 2712867 - protein, 22 aa, Entamoeba histolytica
FVIKDVIMILPKFINDLCHHPI

SEQ ID NO: 2712868 - protein, 19 aa, Entamoeba histolytica
FVIQAFLDALPEKTKEEMA

SEQ ID NO: 2712869 - protein, 30 aa, Entamoeba histolytica
FVIRMNKDNIFYFKWRYCFIDDINIKDRLQ

SEQ ID NO: 2712870 - protein, 23 aa, Entamoeba histolytica
FVITEVFFKGQPLCFGKKIDKYV

SEQ ID NO: 2712871 - protein, 19 aa, Entamoeba histolytica
FVKAPILHLKIPFHLKESL

SEQ ID NO: 2712872 - protein, 24 aa, Entamoeba histolytica
FVKDKDHFLFSLNANGRIVTPIRF

SEQ ID NO: 2712873 - protein, 19 aa, Entamoeba histolytica
FVKGYYRQASAFAALGQLQ

SEQ ID NO: 2712874 - protein, 28 aa, Entamoeba histolytica
FVKIKADLVIVLFIEIFRAIDSDMNGTV

SEQ ID NO: 2712875 - protein, 17 aa, Entamoeba histolytica
FVKILTLKTQPSSWFFS

SEQ ID NO: 2712876 - protein, 23 aa, Entamoeba histolytica
FVKIQKFVKPYRKEYTEGITHFK

SEQ ID NO: 2712877 - protein, 24 aa, Entamoeba histolytica
FVKKGLVDGWYDPRFPTIQGLIRR

SEQ ID NO: 2712878 - protein, 19 aa, Entamoeba histolytica
FVKQLYLIVYAVKTQNGIS

SEQ ID NO: 2712879 - protein, 34 aa, Entamoeba histolytica
FVLLEKPEQFSIITYLGVMYQMFQLKGGSVAEEN

SEQ ID NO: 2712880 - protein, 17 aa, Entamoeba histolytica
FVLLKSLCDLAVVSLEV

SEQ ID NO: 2712881 - protein, 22 aa, Entamoeba histolytica
FVLQVNYIPIQYTFTVKPNEVS

SEQ ID NO: 2712882 - protein, 25 aa, Entamoeba histolytica
FVLRAREFAADKPIILLKAGKSSEG

SEQ ID NO: 2712883 - protein, 37 aa, Entamoeba histolytica
FVMDDPQHFIFTLKNPLSIPPTKFVKKSIFGPSVGIN

SEQ ID NO: 2712884 - protein, 18 aa, Entamoeba histolytica
FVMDGAIGQAAFGQAKAF

SEQ ID NO: 2712885 - protein, 24 aa, Entamoeba histolytica
FVNALYGIKITDDFRYIIINEDNL

SEQ ID NO: 2712886 - protein, 26 aa, Entamoeba histolytica
FVNGLYGIRITDDFRYIIINEGDLKQ

SEQ ID NO: 2712887 - protein, 24 aa, Entamoeba histolytica
FVNKGRLQIERPNFFILPQGRCAE

SEQ ID NO: 2712888 - protein, 20 aa, Entamoeba histolytica
FVPFCFELKLVIIQQLICCN

SEQ ID NO: 2712889 - protein, 18 aa, Entamoeba histolytica
FVPIVICLSFRRGVQCIE

SEQ ID NO: 2712890 - protein, 25 aa, Entamoeba histolytica
FVPNELYLSLIPKFTSFSTPFTSTS

SEQ ID NO: 2712891 - protein, 17 aa, Entamoeba histolytica
FVPNLTLGAPIVKCLHN

SEQ ID NO: 2712892 - protein, 30 aa, Entamoeba histolytica
FVPNNASYPLGIRPLYLPLDTEVIVKNIQP

SEQ ID NO: 2712893 - protein, 17 aa, Entamoeba histolytica
FVPPPRQTIIPNKPLFL

SEQ ID NO: 2712894 - protein, 19 aa, Entamoeba histolytica
FVQLVGVACLHLCVKFQEI

SEQ ID NO: 2712895 - protein, 17 aa, Entamoeba histolytica
FVQRQRYLREQQDLEAQ

SEQ ID NO: 2712896 - protein, 32 aa, Entamoeba histolytica
FVRDIIHAPIIKHFFTTLGYPNQPYQSVYVSS

SEQ ID NO: 2712897 - protein, 20 aa, Entamoeba histolytica
FVRDSFLRSLATQFDTFPPS

SEQ ID NO: 2712898 - protein, 18 aa, Entamoeba histolytica
FVRQLNIYGFHKLEYKTG

SEQ ID NO: 2712899 - protein, 18 aa, Entamoeba histolytica
FVRQLNIYGFHKVDHPQG

SEQ ID NO: 2712900 - protein, 18 aa, Entamoeba histolytica
FVSDAPFDLLTKCPTIGL

SEQ ID NO: 2712901 - protein, 25 aa, Entamoeba histolytica
FVSKRIFYCFIHQLPKCNLEILSYS

SEQ ID NO: 2712902 - protein, 24 aa, Entamoeba histolytica
FVSSSFVVYPFLDSVYFISRTGNS

SEQ ID NO: 2712903 - protein, 19 aa, Entamoeba histolytica
FVSVQQWFKELQDITLTRT

SEQ ID NO: 2712904 - protein, 18 aa, Entamoeba histolytica
FVTKYTSVAFIPPSSISL

SEQ ID NO: 2712905 - protein, 27 aa, Entamoeba histolytica
FVTQLNMVIVLFKKPLEDAKGKILPKL

SEQ ID NO: 2712906 - protein, 28 aa, Entamoeba histolytica
FVTRAELNAFRDFYEPLIEKQGSRLQNI

SEQ ID NO: 2712907 - protein, 23 aa, Entamoeba histolytica
FVVNKILPCSQVLFLENNTPRDC

SEQ ID NO: 2712908 - protein, 19 aa, Entamoeba histolytica
FVVPNLKDKLKDLYYFFLF

SEQ ID NO: 2712909 - protein, 21 aa, Entamoeba histolytica
FVYSFKLITTTTKLLKLLIIL

SEQ ID NO: 2712910 - protein, 17 aa, Entamoeba histolytica
FWEGFKLLSSTTAEPYD

SEQ ID NO: 2712911 - protein, 20 aa, Entamoeba histolytica
FWNVIGGKRILKTKSVEWKN

SEQ ID NO: 2712912 - protein, 20 aa, Entamoeba histolytica
FWVVWRQRAFNRCLQLKQSK

SEQ ID NO: 2712913 - protein, 18 aa, Entamoeba histolytica
FYCKSICGTIIYTKLFIP

SEQ ID NO: 2712914 - protein, 22 aa, Entamoeba histolytica
FYCPHHLCFRAFSSIQPKQEII

SEQ ID NO: 2712915 - protein, 24 aa, Entamoeba histolytica
FYCQNDWCEIAYYVSPLMGKEDRT

SEQ ID NO: 2712916 - protein, 19 aa, Entamoeba histolytica
FYEKYLCVWDYAAASLIVK

SEQ ID NO: 2712917 - protein, 18 aa, Entamoeba histolytica
FYEMKNGALLIFPQQQNS

SEQ ID NO: 2712918 - protein, 25 aa, Entamoeba histolytica
FYEVSKYFLKIKLNGLSSVYPQSED

SEQ ID NO: 2712919 - protein, 18 aa, Entamoeba histolytica
FYEYLLHSHGYPSDLETI

SEQ ID NO: 2712920 - protein, 18 aa, Entamoeba histolytica
FYGCSNLTLIDFGYGWNT

SEQ ID NO: 2712921 - protein, 25 aa, Entamoeba histolytica
FYGNKQLFIVITRTFLNLIHRNKVI

SEQ ID NO: 2712922 - protein, 18 aa, Entamoeba histolytica
FYIKCQIAAFCELLRDYS

SEQ ID NO: 2712923 - protein, 19 aa, Entamoeba histolytica
FYILFKEGFVCIRFELFGN

SEQ ID NO: 2712924 - protein, 19 aa, Entamoeba histolytica
FYKAYIVSSLWDDSKNYRF

SEQ ID NO: 2712925 - protein, 32 aa, Entamoeba histolytica
FYKEKMALVELMSLVLNVYHVIEIFSEQTREI

SEQ ID NO: 2712926 - protein, 17 aa, Entamoeba histolytica
FYKHSIPMQIDLMFLIS

SEQ ID NO: 2712927 - protein, 33 aa, Entamoeba histolytica
FYMTKDDGFFCFILKSPLIKKPIKVVRKDPFYS

SEQ ID NO: 2712928 - protein, 18 aa, Entamoeba histolytica
FYMVRELHDQLLQLKSIL

SEQ ID NO: 2712929 - protein, 23 aa, Entamoeba histolytica
FYNDEFILALNRNDLNMAYHILR

SEQ ID NO: 2712930 - protein, 32 aa, Entamoeba histolytica
FYNEYSKLFLIDYLKHVLTPVLDLIVNSTLNI

SEQ ID NO: 2712931 - protein, 21 aa, Entamoeba histolytica
FYNHANCIIALFDLSNKDSLQ

SEQ ID NO: 2712932 - protein, 24 aa, Entamoeba histolytica
FYNKLYNNKYNNTFLLLNCLACGD

SEQ ID NO: 2712933 - protein, 17 aa, Entamoeba histolytica
FYNLFDWNDDMNTPLHY

SEQ ID NO: 2712934 - protein, 19 aa, Entamoeba histolytica
FYQFHPCKHVLCLSCLILN

SEQ ID NO: 2712935 - protein, 19 aa, Entamoeba histolytica
FYREFNVIPINWNSNTIKE

SEQ ID NO: 2712936 - protein, 18 aa, Entamoeba histolytica
FYRGIITGPLSFATSFKG

SEQ ID NO: 2712937 - protein, 19 aa, Entamoeba histolytica
FYRIEYDKNLYPYIPVHVS

SEQ ID NO: 2712938 - protein, 25 aa, Entamoeba histolytica
FYRKSCGIFLVFDLSDEESFKNLTN

SEQ ID NO: 2712939 - protein, 26 aa, Entamoeba histolytica
FYRKSCGIFLVFDLTDETSFKNLTNW

SEQ ID NO: 2712940 - protein, 18 aa, Entamoeba histolytica
FYSPHHFYICVLELIWYV

SEQ ID NO: 2712941 - protein, 22 aa, Entamoeba histolytica
FYTLFCHTVGPFLLYEIEKKQY

SEQ ID NO: 2712942 - protein, 28 aa, Entamoeba histolytica
FYTTSGIIYWNCLLNTKNLLPPTDVDSF

SEQ ID NO: 2712943 - protein, 31 aa, Entamoeba histolytica
FYVNHIQIHLRLLFALNFKEGCDPLPQTYLN

SEQ ID NO: 2712944 - protein, 17 aa, Entamoeba histolytica
FYVPDIIGALILSMSKR

SEQ ID NO: 2712945 - protein, 17 aa, Entamoeba histolytica
FYYVGMNVKRDCPVDIS

SEQ ID NO: 2712946 - protein, 22 aa, Entamoeba histolytica
GAAFKPLFNQAIQMHLKRYEES

SEQ ID NO: 2712947 - protein, 23 aa, Entamoeba histolytica
GAAFLTKTLIVDGETIKFEIWDT

SEQ ID NO: 2712948 - protein, 25 aa, Entamoeba histolytica
GADGKKFYRFLYDEKYEKNKGFVNY

SEQ ID NO: 2712949 - protein, 24 aa, Entamoeba histolytica
GAEAPSEFVFYIPSMKAFCASEEI

SEQ ID NO: 2712950 - protein, 19 aa, Entamoeba histolytica
GAFKIKLPRLIINTNDENL

SEQ ID NO: 2712951 - protein, 17 aa, Entamoeba histolytica
GAGIGLIPGYGLYQGIR

SEQ ID NO: 2712952 - protein, 27 aa, Entamoeba histolytica
GAGQRPLFSLRTLCLALQYITDVTPFF

SEQ ID NO: 2712953 - protein, 28 aa, Entamoeba histolytica
GAILVVDCTFTTPVFLPALELGADVVLH

SEQ ID NO: 2712954 - protein, 23 aa, Entamoeba histolytica
GAKDLLEYLYAKNFAPFEIDERG

SEQ ID NO: 2712955 - protein, 24 aa, Entamoeba histolytica
GAKKGYFLIGLIGSNKTFEISIVN

SEQ ID NO: 2712956 - protein, 26 aa, Entamoeba histolytica
GAKQSYKHIFGISKQAKDLRQICGEY

SEQ ID NO: 2712957 - protein, 21 aa, Entamoeba histolytica
GALIKPWIYTEIKEKRDWDIS

SEQ ID NO: 2712958 - protein, 17 aa, Entamoeba histolytica
GALRLPSLPEKMSALEE

SEQ ID NO: 2712959 - protein, 17 aa, Entamoeba histolytica
GALWEHYSKKVKDHMDN

SEQ ID NO: 2712960 - protein, 17 aa, Entamoeba histolytica
GAMKILNYFKKHHIPIA

SEQ ID NO: 2712961 - protein, 27 aa, Entamoeba histolytica
GANALGLTRWRDLYRGYLCCALTDTFT

SEQ ID NO: 2712962 - protein, 28 aa, Entamoeba histolytica
GANINRINIIFGLSLIKELYAPFKNETF

SEQ ID NO: 2712963 - protein, 25 aa, Entamoeba histolytica
GANLLSLNISFNPILTLPTEISSLT

SEQ ID NO: 2712964 - protein, 21 aa, Entamoeba histolytica
GANLYRLTIPFIKNLKNEITI

SEQ ID NO: 2712965 - protein, 23 aa, Entamoeba histolytica
GAQYYEQLVKILSALKGKTVQFI

SEQ ID NO: 2712966 - protein, 25 aa, Entamoeba histolytica
GAREYANATLLRNLAKGAVEYSKEI

SEQ ID NO: 2712967 - protein, 25 aa, Entamoeba histolytica
GASLHAITILIQIIDAVLRNETQIK

SEQ ID NO: 2712968 - protein, 19 aa, Entamoeba histolytica
GASSIPPPPPPPGASSVPP

SEQ ID NO: 2712969 - protein, 23 aa, Entamoeba histolytica
GATDICYIYEWFVEKKQSIPFMS

SEQ ID NO: 2712970 - protein, 17 aa, Entamoeba histolytica
GATILQKRLMYSFDLFP

SEQ ID NO: 2712971 - protein, 19 aa, Entamoeba histolytica
GAVALAGLLSKKLPIEKGS

SEQ ID NO: 2712972 - protein, 31 aa, Entamoeba histolytica
GAYAKQLIVPLQNTLIWLIQNNRFDDFDNAS

SEQ ID NO: 2712973 - protein, 34 aa, Entamoeba histolytica
GAYENQWFNITPQKNIIIFPYRLNYNDSTKRLTL

SEQ ID NO: 2712974 - protein, 22 aa, Entamoeba histolytica
GAYFGMTFPHLLMLNVSGMKKA

SEQ ID NO: 2712975 - protein, 33 aa, Entamoeba histolytica; identical to SEQ ID NO: 2524955

SEQ ID NO: 2712976 - protein, 25 aa, Entamoeba histolytica
GAYQCDGLKLYPCLVIRGTRLYEMW

SEQ ID NO: 2712977 - protein, 26 aa, Entamoeba histolytica
GCALKQNILQFWRKHFTTYENFFEVE

SEQ ID NO: 2712978 - protein, 21 aa, Entamoeba histolytica
GCCTLCLAKWDYEKVRIQKQE

SEQ ID NO: 2712979 - protein, 25 aa, Entamoeba histolytica
GCDLFNLCCAAAMRPIRDYIAKENK

SEQ ID NO: 2712980 - protein, 23 aa, Entamoeba histolytica
GCDSLVQLKLPLINNIYPSATND

SEQ ID NO: 2712981 - protein, 31 aa, Entamoeba histolytica
GCGAPPPPPPLNAPPPPPPPAHGTGCGVPPP

SEQ ID NO: 2712982 - protein, 27 aa, Entamoeba histolytica
GCGKPIGMSFLEVFGKKWHEGCVKCVK

SEQ ID NO: 2712983 - protein, 25 aa, Entamoeba histolytica
GCHHVKIMIILYEGGLRFVLSTANL

SEQ ID NO: 2712984 - protein, 27 aa, Entamoeba histolytica
GCIAAEFFLGIPLFAGTSEYNLLFKMI

SEQ ID NO: 2712985 - protein, 28 aa, Entamoeba histolytica
GCIDSMHQPWLFILMTLCSEDVSKLRCG

SEQ ID NO: 2712986 - protein, 28 aa, Entamoeba histolytica
GCIRLQKFPFLSRFYHNLKFRSIPTTCA

SEQ ID NO: 2712987 - protein, 30 aa, Entamoeba histolytica
GCKNLQYIFGKKKLCFPQDGRWWNFTIVKN

SEQ ID NO: 2712988 - protein, 19 aa, Entamoeba histolytica
GCLGTLSSFKRVFAIPIQK

SEQ ID NO: 2712989 - protein, 26 aa, Entamoeba histolytica
GCLKDTIMFVYIKVQIEGETAIVART

SEQ ID NO: 2712990 - protein, 24 aa, Entamoeba histolytica
GCLSSLLCLPITQLMMLFSSILNE

SEQ ID NO: 2712991 - protein, 18 aa, Entamoeba histolytica
GCMLIREYLSGKGRFKYV

SEQ ID NO: 2712992 - protein, 18 aa, Entamoeba histolytica
GCMVLPGQIHPGLGIGHE

SEQ ID NO: 2712993 - protein, 18 aa, Entamoeba histolytica
GCNFIRCDLKKGGCGCGF

SEQ ID NO: 2712994 - protein, 29 aa, Entamoeba histolytica
GCNMKIKLLPYHSLPFAWINPIKERKLLI

SEQ ID NO: 2712995 - protein, 25 aa, Entamoeba histolytica
GCPIFMIHFPSKMKAFYMSKVPGHP

SEQ ID NO: 2712996 - protein, 25 aa, Entamoeba histolytica
GCPPPMGGYPPQPMGAYPPPMGAYP

SEQ ID NO: 2712997 - protein, 34 aa, Entamoeba histolytica
GCRICGTNCIKLLQIVYGATFKKLAAEQEKMREL

SEQ ID NO: 2712998 - protein, 22 aa, Entamoeba histolytica
GCRLPIIPEEITRLALTGLDVS

SEQ ID NO: 2712999 - protein, 33 aa, Entamoeba histolytica
GCTNIDQLLIFLYPLFFDLYRSPTLSSSMKQRM

SEQ ID NO: 2713000 - protein, 20 aa, Entamoeba histolytica
GCTSLIYLDLSYNSLQSFID

SEQ ID NO: 2713001 - protein, 27 aa, Entamoeba histolytica
GCVVKRIFDIAFYFKLNALRSNTTTYI

SEQ ID NO: 2713002 - protein, 23 aa, Entamoeba histolytica
GDAKWKIDPLFNNQWKKFKLQID

SEQ ID NO: 2713003 - protein, 27 aa, Entamoeba histolytica
GDASIETFFLIGLLAQYATITFSILHP

SEQ ID NO: 2713004 - protein, 28 aa, Entamoeba histolytica
GDCFQYIEYLKLLPFNIALNSYNKSEKT

SEQ ID NO: 2713005 - protein, 28 aa, Entamoeba histolytica
GDCTSIINLLLSFIYQMLQTVPIEYSDL

SEQ ID NO: 2713006 - protein, 22 aa, Entamoeba histolytica
GDDHFIYLNKFTENRSISHVHG

SEQ ID NO: 2713007 - protein, 32 aa, Entamoeba histolytica; identical to SEQ ID NO: 2524994

SEQ ID NO: 2713008 - protein, 30 aa, Entamoeba histolytica
GDDISPFGMLIIFKTSFRSSFCASLSNVYE

SEQ ID NO: 2713009 - protein, 28 aa, Entamoeba histolytica
GDDLKKFIIVQLGIESWLVRSMFVFKKM

SEQ ID NO: 2713010 - protein, 17 aa, Entamoeba histolytica
GDDLYNYIAHHIELFKG

SEQ ID NO: 2713011 - protein, 23 aa, Entamoeba histolytica
GDDPARIFQMAPIVIGDETEFIG

SEQ ID NO: 2713012 - protein, 32 aa, Entamoeba histolytica
GDDSIHSLLTLKYLKKFKLFDGKISTLSFLSH

SEQ ID NO: 2713013 - protein, 22 aa, Entamoeba histolytica
GDEHYNLISAFQKSIRGSDEDA

SEQ ID NO: 2713014 - protein, 28 aa, Entamoeba histolytica
GDEKKSIFGIFDGYGGIGAARETRRTLP

SEQ ID NO: 2713015 - protein, 29 aa, Entamoeba histolytica
GDEKNELTMKIKYMELQMSAPQKEIEEKL

SEQ ID NO: 2713016 - protein, 25 aa, Entamoeba histolytica
GDESLDLKLFYPQKSNIRKGEVEMT

SEQ ID NO: 2713017 - protein, 25 aa, Entamoeba histolytica
GDETAAMLLDRFHKYFAGNPDEKEM

SEQ ID NO: 2713018 - protein, 23 aa, Entamoeba histolytica
GDGCFKWCYSLTTINIPTSVSKI

SEQ ID NO: 2713019 - protein, 18 aa, Entamoeba histolytica
GDGFAIVYSITSLNTFLE

SEQ ID NO: 2713020 - protein, 21 aa, Entamoeba histolytica
GDGPLLPLLVGMSPFAKEKNG

SEQ ID NO: 2713021 - protein, 19 aa, Entamoeba histolytica
GDHPPITPLNYPNEYLNDS

SEQ ID NO: 2713022 - protein, 24 aa, Entamoeba histolytica
GDIELVIAFFKKFTDNGSQMFVHF

SEQ ID NO: 2713023 - protein, 24 aa, Entamoeba histolytica
GDIHGQFYDMLNFMDLLGSPEDNK

SEQ ID NO: 2713024 - protein, 23 aa, Entamoeba histolytica
GDISAIIRYITKKGAGMCKGDPS

SEQ ID NO: 2713025 - protein, 33 aa, Entamoeba histolytica
GDIVLEKYFPVYLLIRQYLLISQKSTILSKMGI

SEQ ID NO: 2713026 - protein, 17 aa, Entamoeba histolytica
GDKFRILSLDGGGIKCI

SEQ ID NO: 2713027 - protein, 27 aa, Entamoeba histolytica
GDKPIPVELFNKLLLVKSQTNVALICQ

SEQ ID NO: 2713028 - protein, 28 aa, Entamoeba histolytica
GDKQFHPPLSCLPSIDIISLSTIKSILV

SEQ ID NO: 2713029 - protein, 23 aa, Entamoeba histolytica
GDKSILLDEIYKKHYANVDKAHD

SEQ ID NO: 2713030 - protein, 23 aa, Entamoeba histolytica
GDKTISFWLMDKEMYTGMSCLWQ

SEQ ID NO: 2713031 - protein, 31 aa, Entamoeba histolytica
GDKTVINYILSFLFYFIQKNAIIDCAANSIG

SEQ ID NO: 2713032 - protein, 18 aa, Entamoeba histolytica
GDKYFEYCTSLRIINIPT

SEQ ID NO: 2713033 - protein, 24 aa, Entamoeba histolytica
GDKYRRFIMGGFVRLQGHPNKFNL

SEQ ID NO: 2713034 - protein, 27 aa, Entamoeba histolytica
GDLFETYIRPYFSDVFRPIKKDDHFLC

SEQ ID NO: 2713035 - protein, 38 aa, Entamoeba histolytica
GDLGYFTPVLTPELSPEHPPRFSITKAPALSEMELENK

SEQ ID NO: 2713036 - protein, 23 aa, Entamoeba histolytica
GDLHGQFYDMLTIFDVRPPENEE

SEQ ID NO: 2713037 - protein, 27 aa, Entamoeba histolytica
GDLPFAEIKPLENVLFICKMNPITNEE

SEQ ID NO: 2713038 - protein, 18 aa, Entamoeba histolytica
GDNAFFCCTSLTSIYLPT

SEQ ID NO: 2713039 - protein, 23 aa, Entamoeba histolytica
GDNEAYILDLSPVKETPGWTVRT

SEQ ID NO: 2713040 - protein, 25 aa, Entamoeba histolytica
GDNQPLIVYSLLSLLEGLMETFPHI

SEQ ID NO: 2713041 - protein, 21 aa, Entamoeba histolytica
GDQLYLYEPMLAYHCYEFGSQ

SEQ ID NO: 2713042 - protein, 23 aa, Entamoeba histolytica
GDQNFIIEPFNKPVNKHNCIYVT

SEQ ID NO: 2713043 - protein, 26 aa, Entamoeba histolytica
GDRIGLWIKFQLEPSAYATMLFRELL

SEQ ID NO: 2713044 - protein, 24 aa, Entamoeba histolytica
GDRVAKLIKKWYFHRQNKAPSSIK

SEQ ID NO: 2713045 - protein, 17 aa, Entamoeba histolytica
GDRYRMGNLFIVGPTKT

SEQ ID NO: 2713046 - protein, 22 aa, Entamoeba histolytica
GDSFYYDALYLVADFAALLCSS

SEQ ID NO: 2713047 - protein, 20 aa, Entamoeba histolytica
GDTFTNEKLLLLVRDFVEVL

SEQ ID NO: 2713048 - protein, 24 aa, Entamoeba histolytica
GDTKGVLLSVIRKNDRKLLSCEQI

SEQ ID NO: 2713049 - protein, 21 aa, Entamoeba histolytica
GDTTLYYYCVEDRSFNFKNYF

SEQ ID NO: 2713050 - protein, 17 aa, Entamoeba histolytica
GDTTPCYWVLTRSVLSL

SEQ ID NO: 2713051 - protein, 25 aa, Entamoeba histolytica
GDTVRFKNEFILGTNGIKVGEKENK

SEQ ID NO: 2713052 - protein, 25 aa, Entamoeba histolytica
GDVFKILLIHQDRILRNTLTTFPEE

SEQ ID NO: 2713053 - protein, 26 aa, Entamoeba histolytica
GDVYYEVVFNFIIFSPFQGELIEGRV

SEQ ID NO: 2713054 - protein, 26 aa, Entamoeba histolytica
GDYGVELFLLLCSLKVVFPSQFIILR

SEQ ID NO: 2713055 - protein, 27 aa, Entamoeba histolytica
GEADKPFICKDYLHTFEILNAYKGDVE

SEQ ID NO: 2713056 - protein, 18 aa, Entamoeba histolytica
GEAVTSIIRTFLDESMRN

SEQ ID NO: 2713057 - protein, 18 aa, Entamoeba histolytica
GECDLENSVYLLNSIIEV

SEQ ID NO: 2713058 - protein, 21 aa, Entamoeba histolytica
GEDHFKVLTAFQKSITHSDEE

SEQ ID NO: 2713059 - protein, 24 aa, Entamoeba histolytica
GEDNYPCWFEGPPFKFKKSMKDIH

SEQ ID NO: 2713060 - protein, 23 aa, Entamoeba histolytica
GEECSKILQRKGGPWLKEILKDM

SEQ ID NO: 2713061 - protein, 27 aa, Entamoeba histolytica
GEEEFEYDWEFAGQNIKLTGTEAEIMK

SEQ ID NO: 2713062 - protein, 27 aa, Entamoeba histolytica
GEEFKAFDRVYTPKLRYAGLLEYDSDN

SEQ ID NO: 2713063 - protein, 29 aa, Entamoeba histolytica
GEEILEKLLSIYFIIRNNSSIYRQYLNDI

SEQ ID NO: 2713064 - protein, 30 aa, Entamoeba histolytica; identical to SEQ ID NO: 2525055

SEQ ID NO: 2713065 - protein, 25 aa, Entamoeba histolytica
GEEPHAFMQLFEDKYLIHIGNYFER

SEQ ID NO: 2713066 - protein, 29 aa, Entamoeba histolytica
GEEWVKQCDILLYRGAWQEWEIERADLIV

SEQ ID NO: 2713067 - protein, 22 aa, Entamoeba histolytica
GEEYIEPPPWRPTRRMEINNNR

SEQ ID NO: 2713068 - protein, 25 aa, Entamoeba histolytica
GEFEKKIFDLVLSKQTIKSAQAIIN

SEQ ID NO: 2713069 - protein, 18 aa, Entamoeba histolytica
GEFIAYYNGNFYIGKPEH

SEQ ID NO: 2713070 - protein, 26 aa, Entamoeba histolytica
GEFINSIPFILFDELHLPKVLLLNHK

SEQ ID NO: 2713071 - protein, 21 aa, Entamoeba histolytica
GEFPIKYKGIYMTPEESRLNF

SEQ ID NO: 2713072 - protein, 23 aa, Entamoeba histolytica
GEFRKLIPNLLNNLKLLVHSSFI

SEQ ID NO: 2713073 - protein, 19 aa, Entamoeba histolytica
GEFYLPQQLATCHYCKKRK

SEQ ID NO: 2713074 - protein, 19 aa, Entamoeba histolytica
GEGWIYINGKTYSPSEISS

SEQ ID NO: 2713075 - protein, 20 aa, Entamoeba histolytica
GEGWIYINGKTYSPSEISSF

SEQ ID NO: 2713076 - protein, 32 aa, Entamoeba histolytica
GEIEFENLPSTWVAFFKKAGIRKKDLSDKETR

SEQ ID NO: 2713077 - protein, 25 aa, Entamoeba histolytica
GEIICKIFLELIDAIVILHKNGSFH

SEQ ID NO: 2713078 - protein, 32 aa, Entamoeba histolytica
GEILDFIGESKWNIIRIIIYNKSLKSSTVNTI

SEQ ID NO: 2713079 - protein, 26 aa, Entamoeba histolytica
GEIMKLCEPYLNEGIHPRLLVEGIEL

SEQ ID NO: 2713080 - protein, 23 aa, Entamoeba histolytica
GEIPWPSIIKKIYDQRTVIVQVF

SEQ ID NO: 2713081 - protein, 27 aa, Entamoeba histolytica
GEIPYLQKIIPFEYFKGIFTQSLSLIL

SEQ ID NO: 2713082 - protein, 35 aa, Entamoeba histolytica
GEISKEWKMCILFTDILIIARPFAFGKKTAKEREV

SEQ ID NO: 2713083 - protein, 26 aa, Entamoeba histolytica
GEKESTIVCLRWLMGAEFIVESCKPL

SEQ ID NO: 2713084 - protein, 22 aa, Entamoeba histolytica
GEKKVLIFDLRGGTFDVSVLAI

SEQ ID NO: 2713085 - protein, 23 aa, Entamoeba histolytica
GEKKVLIFDLRGGTFDVSVLAIE

SEQ ID NO: 2713086 - protein, 29 aa, Entamoeba histolytica
GELFFEKFETPGLYFELTGNCALIPLDLE

SEQ ID NO: 2713087 - protein, 18 aa, Entamoeba histolytica
GELIGKVYALNEKNLREI

SEQ ID NO: 2713088 - protein, 18 aa, Entamoeba histolytica
GELKGMINAKQGIDIQNI

SEQ ID NO: 2713089 - protein, 27 aa, Entamoeba histolytica
GELTGELYYLGIIDILMDYTARKKLET

SEQ ID NO: 2713090 - protein, 24 aa, Entamoeba histolytica
GEMGWIGIYPYHPTTRNEDYIICT

SEQ ID NO: 2713091 - protein, 26 aa, Entamoeba histolytica
GEMLPQTVILCELLMILSGAQYVGTE

SEQ ID NO: 2713092 - protein, 17 aa, Entamoeba histolytica
GENIYNPLYNYTNPMQN

SEQ ID NO: 2713093 - protein, 25 aa, Entamoeba histolytica
GENKNGLFLILNISKCYQKETDKIP

SEQ ID NO: 2713094 - protein, 20 aa, Entamoeba histolytica
GENKYRIEPSFVLAILCGIV

SEQ ID NO: 2713095 - protein, 24 aa, Entamoeba histolytica
GENWQNIPIHWYFGSQRRYTDCIP

SEQ ID NO: 2713096 - protein, 25 aa, Entamoeba histolytica
GEPLHAHTFPIFQTSTYLFDDTQMG

SEQ ID NO: 2713097 - protein, 27 aa, Entamoeba histolytica
GEPNEDVFFYFTKYISFQANKGLKKSH

SEQ ID NO: 2713098 - protein, 30 aa, Entamoeba histolytica
GEQSKPIPPVPQKKIAPPTPSKCAPPLPTK

SEQ ID NO: 2713099 - protein, 27 aa, Entamoeba histolytica
GERIVQPPWFVCVICRRQFKDNDELQK

SEQ ID NO: 2713100 - protein, 20 aa, Entamoeba histolytica
GERKYVRLNQFRGTKYIDVR

SEQ ID NO: 2713101 - protein, 25 aa, Entamoeba histolytica
GERNYHIFYQLLAGAPENYYNDFYL

SEQ ID NO: 2713102 - protein, 31 aa, Entamoeba histolytica; identical to SEQ ID NO: 2525092

SEQ ID NO: 2713103 - protein, 26 aa, Entamoeba histolytica
GESQGKFIVLMPIALQLFGKIMNSGN

SEQ ID NO: 2713104 - protein, 18 aa, Entamoeba histolytica
GESYYGEDGYYYVYDHNT

SEQ ID NO: 2713105 - protein, 25 aa, Entamoeba histolytica
GETPQTLHLLAFDSLVDSAKPGDRI

SEQ ID NO: 2713106 - protein, 24 aa, Entamoeba histolytica
GETRKLIFNNYFSIGLDAGIALNF

SEQ ID NO: 2713107 - protein, 34 aa, Entamoeba histolytica
GETTSHIIGTFYRTIKLIESGIKPIYVFDGKPPE

SEQ ID NO: 2713108 - protein, 26 aa, Entamoeba histolytica
GETVQEYWECTLKALKFGENQGPQII

SEQ ID NO: 2713109 - protein, 29 aa, Entamoeba histolytica
GETVQPLRSYLILPIQRIPRYNLLLSDFL

SEQ ID NO: 2713110 - protein, 31 aa, Entamoeba histolytica
GETYCGIKIYRLYFKCTRCKTIFTIKTDPKN

SEQ ID NO: 2713111 - protein, 27 aa, Entamoeba histolytica
GEVFPDLDMLPLFLTKKKILSRVQVLN

SEQ ID NO: 2713112 - protein, 18 aa, Entamoeba histolytica
GEVINAFLTCGYVGASSL

SEQ ID NO: 2713113 - protein, 26 aa, Entamoeba histolytica
GEVTLFLNGHFFLGSNQIKILGNEIN

SEQ ID NO: 2713114 - protein, 28 aa, Entamoeba histolytica
GEVWKVRHKLMRFISAAKIIKLNKSSSE

SEQ ID NO: 2713115 - protein, 26 aa, Entamoeba histolytica
GEWHMQAVCAITVWLKERNYNFWMNE

SEQ ID NO: 2713116 - protein, 19 aa, Entamoeba histolytica
GEYGLIHKGIYQTASTIYI

SEQ ID NO: 2713117 - protein, 34 aa, Entamoeba histolytica
GEYPIINIKNYENYLLISSPLRVLLITLEGKIIE

SEQ ID NO: 2713118 - protein, 24 aa, Entamoeba histolytica
GEYSYYITNLYGAISFLLEINGNK

SEQ ID NO: 2713119 - protein, 17 aa, Entamoeba histolytica
GFAIRKSSTKMRIIAAM

SEQ ID NO: 2713120 - protein, 17 aa, Entamoeba histolytica
GFAKINNYWISCSETSF

SEQ ID NO: 2713121 - protein, 26 aa, Entamoeba histolytica
GFAKQFLQFTMFLKSYTTYVNHQSQI

SEQ ID NO: 2713122 - protein, 26 aa, Entamoeba histolytica
GFDAIQNILLINKILQQLFQQQSPFP

SEQ ID NO: 2713123 - protein, 17 aa, Entamoeba histolytica
GFDVGIEEFWRSYDDRE

SEQ ID NO: 2713124 - protein, 27 aa, Entamoeba histolytica
GFEAENFEYILLFYKALNKCSNSNELL

SEQ ID NO: 2713125 - protein, 18 aa, Entamoeba histolytica
GFEDFMLKKLINAERMTM

SEQ ID NO: 2713126 - protein, 25 aa, Entamoeba histolytica
GFELKLGYFPFESLSTLVYGHLKAI

SEQ ID NO: 2713127 - protein, 18 aa, Entamoeba histolytica
GFEPIPVRFILSKENPYN

SEQ ID NO: 2713128 - protein, 21 aa, Entamoeba histolytica
GFFDFKNIKLPPNIKKLILEF

SEQ ID NO: 2713129 - protein, 19 aa, Entamoeba histolytica
GFFDSLVDFLTLPSNLNLN

SEQ ID NO: 2713130 - protein, 17 aa, Entamoeba histolytica
GFFLIPEKGSWNYSLST

SEQ ID NO: 2713131 - protein, 17 aa, Entamoeba histolytica
GFFTAVFIKKGETPAPP

SEQ ID NO: 2713132 - protein, 18 aa, Entamoeba histolytica
GFGFIDFYSINDALSLVQ

SEQ ID NO: 2713133 - protein, 25 aa, Entamoeba histolytica
GFGICWSNLLLGTFTVCEEGNLHIF

SEQ ID NO: 2713134 - protein, 19 aa, Entamoeba histolytica
GFGISKKLLFDKVKSQLGL

SEQ ID NO: 2713135 - protein, 17 aa, Entamoeba histolytica
GFGLSSFGGFNTSSSGG

SEQ ID NO: 2713136 - protein, 33 aa, Entamoeba histolytica; identical to SEQ ID NO: 2525128

SEQ ID NO: 2713137 - protein, 29 aa, Entamoeba histolytica
GFHSNPVIVLDFLSMYPTTAIAYNICYST

SEQ ID NO: 2713138 - protein, 27 aa, Entamoeba histolytica
GFHVCVTKWLTLVQLLMGEIPRRNVFL

SEQ ID NO: 2713139 - protein, 22 aa, Entamoeba histolytica
GFIAISFLKLIPEKFTLPDRAK

SEQ ID NO: 2713140 - protein, 21 aa, Entamoeba histolytica
GFIASRFLTGVPPQEFFFHCM

SEQ ID NO: 2713141 - protein, 17 aa, Entamoeba histolytica
GFICNSPVLNDKREVIP

SEQ ID NO: 2713142 - protein, 28 aa, Entamoeba histolytica
GFIKEVLNNHLFIYKLLENLEPASSTPI

SEQ ID NO: 2713143 - protein, 19 aa, Entamoeba histolytica
GFILSQFYTSLPISKRPET

SEQ ID NO: 2713144 - protein, 17 aa, Entamoeba histolytica
GFINIFSIKTGVIVGSL

SEQ ID NO: 2713145 - protein, 22 aa, Entamoeba histolytica
GFIPTIELFNQKIGMISIGQLL

SEQ ID NO: 2713146 - protein, 32 aa, Entamoeba histolytica; identical to SEQ ID NO: 2525139

SEQ ID NO: 2713147 - protein, 17 aa, Entamoeba histolytica
GFKHADFGNCFISTGFG

SEQ ID NO: 2713148 - protein, 17 aa, Entamoeba histolytica
GFKLHYFLQNTDIPPCI

SEQ ID NO: 2713149 - protein, 25 aa, Entamoeba histolytica
GFLFDCDVILHLYDLNDMALKGLSM

SEQ ID NO: 2713150 - protein, 21 aa, Entamoeba histolytica
GFLGVHLIQALQKKGYHVICL

SEQ ID NO: 2713151 - protein, 25 aa, Entamoeba histolytica
GFLHQKIETLQLDNYDSRLTLMEIE

SEQ ID NO: 2713152 - protein, 19 aa, Entamoeba histolytica
GFLQCLHRLLSTRIGYESF

SEQ ID NO: 2713153 - protein, 18 aa, Entamoeba histolytica
GFLTQYFELLDKNPGDLI

SEQ ID NO: 2713154 - protein, 20 aa, Entamoeba histolytica
GFNRKTLYRKIIGEKNIMFY

SEQ ID NO: 2713155 - protein, 28 aa, Entamoeba histolytica
GFPRAKIFLENLLQKKYKEALIPTLNKL

SEQ ID NO: 2713156 - protein, 18 aa, Entamoeba histolytica
GFPTDMFPVISPICSPLI

SEQ ID NO: 2713157 - protein, 26 aa, Entamoeba histolytica
GFQLERIIHIFYKNKFIMGKEDLTIH

SEQ ID NO: 2713158 - protein, 38 aa, Entamoeba histolytica
GFSDNPILQIYILQKLIQKFPMFIAKCNVIAGVGISAF

SEQ ID NO: 2713159 - protein, 28 aa, Entamoeba histolytica
GFSITTIRKFLFQILRALRTLSHANIVH

SEQ ID NO: 2713160 - protein, 22 aa, Entamoeba histolytica
GFSRTRFIKLFNNYIFCNTTQN

SEQ ID NO: 2713161 - protein, 26 aa, Entamoeba histolytica
GFTEPVAVMLLRTPITAIKEIKEILN

SEQ ID NO: 2713162 - protein, 24 aa, Entamoeba histolytica
GFTKIIVDLLILHGRFIPCIEVMI

SEQ ID NO: 2713163 - protein, 17 aa, Entamoeba histolytica
GFTLERNILGQRVDFIN

SEQ ID NO: 2713164 - protein, 18 aa, Entamoeba histolytica
GFVFIIDRKINANEIKEI

SEQ ID NO: 2713165 - protein, 17 aa, Entamoeba histolytica
GFVFTLLNPLHLEPVIS

SEQ ID NO: 2713166 - protein, 26 aa, Entamoeba histolytica
GFYCSNANYLYKLLNKLDPIISLVNP

SEQ ID NO: 2713167 - protein, 27 aa, Entamoeba histolytica
GFYINKDMDFFMFSLKGNIKTPTKITK

SEQ ID NO: 2713168 - protein, 30 aa, Entamoeba histolytica
GGCDLTIGEYPFISIKLLLEGHIEIIDEIE

SEQ ID NO: 2713169 - protein, 31 aa, Entamoeba histolytica
GGCNHITCRCGFQFCWLCMQPYTKDHWRVNR

SEQ ID NO: 2713170 - protein, 23 aa, Entamoeba histolytica
GGDCNRIRFIPSTSFIIIQQSFL

SEQ ID NO: 2713171 - protein, 33 aa, Entamoeba histolytica; identical to SEQ ID NO: 2525158

SEQ ID NO: 2713172 - protein, 20 aa, Entamoeba histolytica
GGDWFIGLFVRQLSSINQRK

SEQ ID NO: 2713173 - protein, 31 aa, Entamoeba histolytica
GGEELIGIRRWLLVDSLLRAKSRTKEEIHYV

SEQ ID NO: 2713174 - protein, 40 aa, Entamoeba histolytica; identical to SEQ ID NO: 2525162

SEQ ID NO: 2713175 - protein, 33 aa, Entamoeba histolytica; identical to SEQ ID NO: 2525163

SEQ ID NO: 2713176 - protein, 24 aa, Entamoeba histolytica
GGELIFSDLFKLGEWYTNPRIIMY

SEQ ID NO: 2713177 - protein, 28 aa, Entamoeba histolytica
GGERSFSTVCLLLSLWNVVDCPFRAMDE

SEQ ID NO: 2713178 - protein, 30 aa, Entamoeba histolytica; identical to SEQ ID NO: 2525165

SEQ ID NO: 2713179 - protein, 25 aa, Entamoeba histolytica
GGFGWCDGLLLRAMKSGSWVLLDEL

SEQ ID NO: 2713180 - protein, 26 aa, Entamoeba histolytica
GGFIDEVLIYAFRNGIKLNGKNASDF

SEQ ID NO: 2713181 - protein, 25 aa, Entamoeba histolytica
GGFNPCIIFVPLRLGPESPENEFKP

SEQ ID NO: 2713182 - protein, 20 aa, Entamoeba histolytica
GGGIWHTWIDRDLGISGRVI

SEQ ID NO: 2713183 - protein, 24 aa, Entamoeba histolytica
GGGKVIDGGMLLGNRLVGKGMSGI

SEQ ID NO: 2713184 - protein, 22 aa, Entamoeba histolytica
GGHLIWCIVFEKLANTQFRVTY

SEQ ID NO: 2713185 - protein, 18 aa, Entamoeba histolytica
GGIIPLLSNNLSDGIYQK

SEQ ID NO: 2713186 - protein, 23 aa, Entamoeba histolytica
GGIKCIYQCAILQRILDKFPDFF

SEQ ID NO: 2713187 - protein, 18 aa, Entamoeba histolytica
GGILDILFKQKAGTIMKG

SEQ ID NO: 2713188 - protein, 27 aa, Entamoeba histolytica
GGKFALDVFLPENYPYSPPVIKFATKV

SEQ ID NO: 2713189 - protein, 24 aa, Entamoeba histolytica
GGKGFLVCWCGRIEKLFTVGFNKM

SEQ ID NO: 2713190 - protein, 24 aa, Entamoeba histolytica
GGKHSFITLRELFKWADRHANSYE

SEQ ID NO: 2713191 - protein, 37 aa, Entamoeba histolytica
GGKSTYLRMIGLCVIMAQIGMFIPCSEAHISICDKIM

SEQ ID NO: 2713192 - protein, 37 aa, Entamoeba histolytica
GGKSTYLRMIGLCVIMAQIGMFVPCSEAHISICDKIM

SEQ ID NO: 2713193 - protein, 24 aa, Entamoeba histolytica
GGKVFYFHGWRVEGLLGVSRSIGD

SEQ ID NO: 2713194 - protein, 25 aa, Entamoeba histolytica
GGKVSMLGFCKKYKFLEEKQKEEAN

SEQ ID NO: 2713195 - protein, 17 aa, Entamoeba histolytica
GGLYFKLKEKHPEFDDE

SEQ ID NO: 2713196 - protein, 30 aa, Entamoeba histolytica
GGLYLRFAIPILFKRGIFNNLNWIPFSFMT

SEQ ID NO: 2713197 - protein, 28 aa, Entamoeba histolytica
GGMGDRAIFVFGFHALQFLYLDPHIVQP

SEQ ID NO: 2713198 - protein, 18 aa, Entamoeba histolytica
GGNAVIIATLKRLIENNN

SEQ ID NO: 2713199 - protein, 24 aa, Entamoeba histolytica
GGNQTRLLMLTNKTPGKFMDSRGY

SEQ ID NO: 2713200 - protein, 24 aa, Entamoeba histolytica
GGNTPIHILIPFENWTIQGENTML

SEQ ID NO: 2713201 - protein, 23 aa, Entamoeba histolytica
GGNVNVIFIDKDGWRLISRNDCY

SEQ ID NO: 2713202 - protein, 23 aa, Entamoeba histolytica
GGQKQFMDMYLGAQKSQTFKKVE

SEQ ID NO: 2713203 - protein, 33 aa, Entamoeba histolytica
GGQKSLLALSLILAILLYKPSPLYILDEVDAAL

SEQ ID NO: 2713204 - protein, 40 aa, Entamoeba histolytica
GGQKTVVALSLIFAIQRCDPAPFYLFDEIDSNLDTVYREA

SEQ ID NO: 2713205 - protein, 23 aa, Entamoeba histolytica
GGSKGIIFLYPNNIKNDIEIIKK

SEQ ID NO: 2713206 - protein, 24 aa, Entamoeba histolytica
GGSLNRFIELLTSPGLINNDFNRV

SEQ ID NO: 2713207 - protein, 18 aa, Entamoeba histolytica
GGSSIEYLGKRYCLACYK

SEQ ID NO: 2713208 - protein, 24 aa, Entamoeba histolytica
GGSTFIPFVQKIAESYCVNTKLER

SEQ ID NO: 2713209 - protein, 28 aa, Entamoeba histolytica
GGTDIAFHPFLPWIYSTGADGTIQWYSD

SEQ ID NO: 2713210 - protein, 28 aa, Entamoeba histolytica
GGTTKCHQSWFQKYIDKEQERLINKQHT

SEQ ID NO: 2713211 - protein, 28 aa, Entamoeba histolytica
GGVKCIYQCVLLKRIIKEIPDFFDKIDL

SEQ ID NO: 2713212 - protein, 31 aa, Entamoeba histolytica
GGVPSFYSELTKWILSFNPLQQYKSLVTLHR

SEQ ID NO: 2713213 - protein, 26 aa, Entamoeba histolytica
GGVTNNLIYIILSLVLSGFQHVYDVI

SEQ ID NO: 2713214 - protein, 39 aa, Entamoeba histolytica
GHALNLRSYLITPVQRLPRYKLLLEDLIRNTPEGHCDLA

SEQ ID NO: 2713215 - protein, 20 aa, Entamoeba histolytica
GHDDCTIDFFNALGVRIAEL

SEQ ID NO: 2713216 - protein, 22 aa, Entamoeba histolytica
GHDIIFWMGDLNYRIDEEDSII

SEQ ID NO: 2713217 - protein, 25 aa, Entamoeba histolytica
GHELKYRKMPLPSQYLRVGFERDET

SEQ ID NO: 2713218 - protein, 23 aa, Entamoeba histolytica
GHEVVYDIVPIPIGIEVEGGKFE

SEQ ID NO: 2713219 - protein, 34 aa, Entamoeba histolytica
GHEYLRKIIYSSGNIFVICFSLIHPQTFSNVVQY

SEQ ID NO: 2713220 - protein, 21 aa, Entamoeba histolytica
GHGFLIVYSVTDRNSFESIKN

SEQ ID NO: 2713221 - protein, 22 aa, Entamoeba histolytica
GHGPFSHLYERLMKARNIHFNH

SEQ ID NO: 2713222 - protein, 25 aa, Entamoeba histolytica
GHIIPKVVWGTEYWMKSFKFEDEEG

SEQ ID NO: 2713223 - protein, 33 aa, Entamoeba histolytica
GHIIVSFIVAKGYYYIFLDKFDVEKIFQIIEEN

SEQ ID NO: 2713224 - protein, 22 aa, Entamoeba histolytica
GHILNQLKILTLTGGLVFFELK

SEQ ID NO: 2713225 - protein, 25 aa, Entamoeba histolytica
GHISKAFIVYDRLRKLQLFEQNEYK

SEQ ID NO: 2713226 - protein, 28 aa, Entamoeba histolytica
GHLIDSAFTMTWDPALQPILDCSKDATN

SEQ ID NO: 2713227 - protein, 33 aa, Entamoeba histolytica
GHLNIYEFIAIYRYLEICYALFNAYNGSGPEII

SEQ ID NO: 2713228 - protein, 34 aa, Entamoeba histolytica
GHLNIYEFIAIYRYLEICYALFNAYNGSGPEIIK

SEQ ID NO: 2713229 - protein, 30 aa, Entamoeba histolytica
GHMAKVRMLITQIPYFKEVTIMAFSCDTCG

SEQ ID NO: 2713230 - protein, 18 aa, Entamoeba histolytica
GHPFSLKTVLMIVDQCLR

SEQ ID NO: 2713231 - protein, 24 aa, Entamoeba histolytica
GHPRRWKMKKERLGKLILGDNDML

SEQ ID NO: 2713232 - protein, 18 aa, Entamoeba histolytica
GHPSILSNVLWSLGIIIQ

SEQ ID NO: 2713233 - protein, 18 aa, Entamoeba histolytica
GHRLSPTDKIPIAIIGII

SEQ ID NO: 2713234 - protein, 18 aa, Entamoeba histolytica
GHRRMMELYASDPMKYQK

SEQ ID NO: 2713235 - protein, 21 aa, Entamoeba histolytica
GHSKILVIIATSDFDIFGIYN

SEQ ID NO: 2713236 - protein, 35 aa, Entamoeba histolytica
GHTNYLTRLNLPILDVFWLSQYPAVLLSTGEVLVL

SEQ ID NO: 2713237 - protein, 18 aa, Entamoeba histolytica
GHYWVKYTCHGKSAHGCM

SEQ ID NO: 2713238 - protein, 17 aa, Entamoeba histolytica
GHYYSYVKCDDKWYCCN

SEQ ID NO: 2713239 - protein, 18 aa, Entamoeba histolytica
GIAELIPGVLFIDEVHML

SEQ ID NO: 2713240 - protein, 17 aa, Entamoeba histolytica
GIAIRKLLSKHIISEAI

SEQ ID NO: 2713241 - protein, 25 aa, Entamoeba histolytica
GIANITPLLTPIDNSPRLNPPSSAL

SEQ ID NO: 2713242 - protein, 24 aa, Entamoeba histolytica
GIARRGYVIIDDKGKVRYIQMNDD

SEQ ID NO: 2713243 - protein, 24 aa, Entamoeba histolytica
GIAWQLRHKVWKILLGQVPLDQDK

SEQ ID NO: 2713244 - protein, 17 aa, Entamoeba histolytica
GIAYRMIGQYQKSVVDL

SEQ ID NO: 2713245 - protein, 23 aa, Entamoeba histolytica
GICLYFDCTFLKKSYLTTKPDTN

SEQ ID NO: 2713246 - protein, 27 aa, Entamoeba histolytica
GICNTDDFIYKFIRVCVMNNIGLSGPA

SEQ ID NO: 2713247 - protein, 22 aa, Entamoeba histolytica
GICWECWKIYFPDEKWPDLEHD

SEQ ID NO: 2713248 - protein, 25 aa, Entamoeba histolytica
GIDDPSFFMFVTNKKDLYCFIKKSV

SEQ ID NO: 2713249 - protein, 17 aa, Entamoeba histolytica
GIDFRKSLLSNLCNICE

SEQ ID NO: 2713250 - protein, 20 aa, Entamoeba histolytica
GIDLLKFLCNSFVLLNGTFT

SEQ ID NO: 2713251 - protein, 17 aa, Entamoeba histolytica
GIDPLHFTITEPIVFQQ

SEQ ID NO: 2713252 - protein, 28 aa, Entamoeba histolytica
GIEAALRFMNPPFTAVLMLIKVMQYTPE

SEQ ID NO: 2713253 - protein, 24 aa, Entamoeba histolytica
GIEASPKELFLIKSKRNKSTELVS

SEQ ID NO: 2713254 - protein, 32 aa, Entamoeba histolytica
GIEFRKRFAFIDYMMFEYRKNIKDLFEKRGGA

SEQ ID NO: 2713255 - protein, 28 aa, Entamoeba histolytica
GIEKHATYGFYWMLGAAKVSDYKDWCLY

SEQ ID NO: 2713256 - protein, 18 aa, Entamoeba histolytica
GIEKYMYFFKNAFELYEN

SEQ ID NO: 2713257 - protein, 17 aa, Entamoeba histolytica
GIEMINPQNIFGLGLTL

SEQ ID NO: 2713258 - protein, 24 aa, Entamoeba histolytica
GIEQATLNYLYYTNAFKKLNTTVD

SEQ ID NO: 2713259 - protein, 17 aa, Entamoeba histolytica
GIESLFDSFFGYEQNPL

SEQ ID NO: 2713260 - protein, 23 aa, Entamoeba histolytica
GIETLQLAFTRFMSAGNIMLPII

SEQ ID NO: 2713261 - protein, 17 aa, Entamoeba histolytica
GIETPTFSRFYLLIVQY

SEQ ID NO: 2713262 - protein, 23 aa, Entamoeba histolytica
GIEYLFEYYIKQIILRCSSIDKG

SEQ ID NO: 2713263 - protein, 18 aa, Entamoeba histolytica
GIEYRIELKPKKEIFTVP

SEQ ID NO: 2713264 - protein, 25 aa, Entamoeba histolytica
GIEYSQYHFLTPDKAFHQKESQVVF

SEQ ID NO: 2713265 - protein, 25 aa, Entamoeba histolytica
GIEYSQYRFLTPDKAFHQKESQVVF

SEQ ID NO: 2713266 - protein, 26 aa, Entamoeba histolytica
GIFASYPVVLSQIYQFIVFQRSNGLS

SEQ ID NO: 2713267 - protein, 26 aa, Entamoeba histolytica
GIFCHENVYIYLAPGKSAETFNIFCW

SEQ ID NO: 2713268 - protein, 18 aa, Entamoeba histolytica
GIFIGKMTKAFYTKQLSD

SEQ ID NO: 2713269 - protein, 19 aa, Entamoeba histolytica
GIFIGKMTKAFYTKQLSDP

SEQ ID NO: 2713270 - protein, 26 aa, Entamoeba histolytica
GIFLITTENITYLWKGKLTGKKELEF

SEQ ID NO: 2713271 - protein, 24 aa, Entamoeba histolytica
GIFNKYIVMEFIDGYDLFHIVFTN

SEQ ID NO: 2713272 - protein, 26 aa, Entamoeba histolytica
GIFTQSLSLILFYYENNKLSDLEIIG

SEQ ID NO: 2713273 - protein, 26 aa, Entamoeba histolytica
GIGLIPGYGLYQGIRGWGCNIFPTLV

SEQ ID NO: 2713274 - protein, 24 aa, Entamoeba histolytica
GIGSNFVYALLDKNWHSGMEFEEA

SEQ ID NO: 2713275 - protein, 28 aa, Entamoeba histolytica
GIHGIVYPYTWIFNGVNKLVFTDKWEKM

SEQ ID NO: 2713276 - protein, 24 aa, Entamoeba histolytica
GIHKIFMCPIKNLIVRYIIREYVL

SEQ ID NO: 2713277 - protein, 17 aa, Entamoeba histolytica
GIHSLTGVIHDPNTIQT

SEQ ID NO: 2713278 - protein, 48 aa, Entamoeba histolytica
GIIDQPLPFFIFDWHYTWFINAFNFELVLRIFDVIILEGFYALFSVAD

SEQ ID NO: 2713279 - protein, 29 aa, Entamoeba histolytica
GIIEKIPYLKELGITIVWLNPIYSTSDAD

SEQ ID NO: 2713280 - protein, 24 aa, Entamoeba histolytica
GIIGWIISYFLPCKETLYNIYSQL

SEQ ID NO: 2713281 - protein, 36 aa, Entamoeba histolytica
GIINSQLLAYFMGRTFKFLIELGIPAEHIRFRQHLK

SEQ ID NO: 2713282 - protein, 19 aa, Entamoeba histolytica
GIIPPMVELLLSILSEYNP

SEQ ID NO: 2713283 - protein, 20 aa, Entamoeba histolytica
GIIRIKPFSLLTQKEVVLYA

SEQ ID NO: 2713284 - protein, 18 aa, Entamoeba histolytica
GIIVFRQIMKKGCDVNII

SEQ ID NO: 2713285 - protein, 23 aa, Entamoeba histolytica
GIKDELLRSIYSYGFEKPSAIQQ

SEQ ID NO: 2713286 - protein, 22 aa, Entamoeba histolytica
GIKDILHFDYLDAPSPQVMVRA

SEQ ID NO: 2713287 - protein, 19 aa, Entamoeba histolytica
GIKKMKINALIPARMQCVI

SEQ ID NO: 2713288 - protein, 23 aa, Entamoeba histolytica
GIKKRVCFLFSDQVLIYGSPVVG

SEQ ID NO: 2713289 - protein, 17 aa, Entamoeba histolytica
GIKLVNETHLLLGNDIE

SEQ ID NO: 2713290 - protein, 24 aa, Entamoeba histolytica
GIKNGMWLKQAYNLCPQLIVVGYD

SEQ ID NO: 2713291 - protein, 24 aa, Entamoeba histolytica
GIKNNIIMVLLYNEKKIISCNGKK

SEQ ID NO: 2713292 - protein, 17 aa, Entamoeba histolytica
GIKSIRSIFGPKTDLDF

SEQ ID NO: 2713293 - protein, 27 aa, Entamoeba histolytica
GIKSKTLLYIPSYFDYLRIKQYLNTEN

SEQ ID NO: 2713294 - protein, 25 aa, Entamoeba histolytica
GIKSVYTMFYSSEIMFHVATMLPHV

SEQ ID NO: 2713295 - protein, 21 aa, Entamoeba histolytica
GIKYVFKLLPIVYDSSIFKEV

SEQ ID NO: 2713296 - protein, 20 aa, Entamoeba histolytica
GIKYVIDSGLGKWKIYNPKI

SEQ ID NO: 2713297 - protein, 17 aa, Entamoeba histolytica
GILACSFFNVQWDKKVE

SEQ ID NO: 2713298 - protein, 25 aa, Entamoeba histolytica
GILHFNNQPINFTRTLLLINNKICN

SEQ ID NO: 2713299 - protein, 17 aa, Entamoeba histolytica
GILLYPNEIIPCSLLKE

SEQ ID NO: 2713300 - protein, 23 aa, Entamoeba histolytica
GILTFNGVPPHLPLTIKLENVQS

SEQ ID NO: 2713301 - protein, 21 aa, Entamoeba histolytica
GIMENCNGLILGSVLRAVTPN

SEQ ID NO: 2713302 - protein, 21 aa, Entamoeba histolytica
GIMIPNPQYPLYGACIQQLGG

SEQ ID NO: 2713303 - protein, 20 aa, Entamoeba histolytica
GIMQILLKKTKGIDIEKRKK

SEQ ID NO: 2713304 - protein, 23 aa, Entamoeba histolytica
GIMSLLKMRTKPLTIIGPRSMEK

SEQ ID NO: 2713305 - protein, 17 aa, Entamoeba histolytica
GINFPTLKGKQTQFWCV

SEQ ID NO: 2713306 - protein, 25 aa, Entamoeba histolytica
GINGRYGMFPLAKGTIIPLSKEEQD

SEQ ID NO: 2713307 - protein, 21 aa, Entamoeba histolytica
GINIFSLNVISFRLLDNEYNG

SEQ ID NO: 2713308 - protein, 18 aa, Entamoeba histolytica
GINIVPIFDTLVSQSQLE

SEQ ID NO: 2713309 - protein, 18 aa, Entamoeba histolytica
GINIWLQLFTQIINRVKL

SEQ ID NO: 2713310 - protein, 20 aa, Entamoeba histolytica
GINLFNCYKLHKLTLRIGNV

SEQ ID NO: 2713311 - protein, 23 aa, Entamoeba histolytica
GINPELVNYLFDALLSENETRMS

SEQ ID NO: 2713312 - protein, 23 aa, Entamoeba histolytica
GINPPIIPILTLQEIRHKSTCSP

SEQ ID NO: 2713313 - protein, 23 aa, Entamoeba histolytica
GINSELVNYLFDALLSENETRMS

SEQ ID NO: 2713314 - protein, 25 aa, Entamoeba histolytica
GINYIYIPIILRVSIEDYKKAQTKQ

SEQ ID NO: 2713315 - protein, 18 aa, Entamoeba histolytica
GIPNLQVFMLMKGLATKK

SEQ ID NO: 2713316 - protein, 23 aa, Entamoeba histolytica
GIPQPRRLFIFEKLTFSCCDSMK

SEQ ID NO: 2713317 - protein, 24 aa, Entamoeba histolytica
GIPSNLIIPLYHKLVEQTFDAGKV

SEQ ID NO: 2713318 - protein, 24 aa, Entamoeba histolytica
GIQCYLWEIQIKKEYRRQGIGKEM

SEQ ID NO: 2713319 - protein, 22 aa, Entamoeba histolytica
GIQKYNFGPSYIYVCGCEGTWN

SEQ ID NO: 2713320 - protein, 37 aa, Entamoeba histolytica
GIQLQSLDSYLILPVQRLPRYQMLLIQLIQSIQMNSS

SEQ ID NO: 2713321 - protein, 25 aa, Entamoeba histolytica
GIQQPTISILNFTKGGGIFSTNTVL

SEQ ID NO: 2713322 - protein, 20 aa, Entamoeba histolytica
GIQRFKTVYIDRIKKGMINP

SEQ ID NO: 2713323 - protein, 22 aa, Entamoeba histolytica
GIQVEMCLVLMISKQKFIFSFI

SEQ ID NO: 2713324 - protein, 27 aa, Entamoeba histolytica
GIRALPVDIWLHVIPQIIARIQSNVPA

SEQ ID NO: 2713325 - protein, 18 aa, Entamoeba histolytica
GIRCSQECDIAVFTIGRV

SEQ ID NO: 2713326 - protein, 18 aa, Entamoeba histolytica
GIRFHQWMTIINEKTPLH

SEQ ID NO: 2713327 - protein, 17 aa, Entamoeba histolytica
GIRISRCKILVDNSKCK

SEQ ID NO: 2713328 - protein, 24 aa, Entamoeba histolytica
GIRPDKQIVMFSATFPISVEQHAR

SEQ ID NO: 2713329 - protein, 22 aa, Entamoeba histolytica
GISNFWIEVFNEVGLMGNLEVT

SEQ ID NO: 2713330 - protein, 32 aa, Entamoeba histolytica
GISQLPNNLFTFLPYLKILKLGINQLTTIPTS

SEQ ID NO: 2713331 - protein, 20 aa, Entamoeba histolytica
GISSVFRKGFAQSGIIILPC

SEQ ID NO: 2713332 - protein, 41 aa, Entamoeba histolytica
GITALRNMLQLFLRQLPLNSKFQIISFGSTYDFIFKEMTEY

SEQ ID NO: 2713333 - protein, 20 aa, Entamoeba histolytica
GITFSLPLFKPTYPMRFENY

SEQ ID NO: 2713334 - protein, 34 aa, Entamoeba histolytica
GITHYPLHTIAFKSSYCIPLILVRCFKIIDECEY

SEQ ID NO: 2713335 - protein, 28 aa, Entamoeba histolytica
GITIPLDTPLLWLALNLSHSDLFLHVII

SEQ ID NO: 2713336 - protein, 24 aa, Entamoeba histolytica
GITLKFLCHVSEKEIIQPLVNAIL

SEQ ID NO: 2713337 - protein, 32 aa, Entamoeba histolytica
GITNFDLILNHPLILSPLYKLTVVQAETKLYT

SEQ ID NO: 2713338 - protein, 35 aa, Entamoeba histolytica
GITNLPRYLTYIIETCVPFLESITCFPLMEHPKQT

SEQ ID NO: 2713339 - protein, 18 aa, Entamoeba histolytica
GIVILITPQKMHCANCGD

SEQ ID NO: 2713340 - protein, 24 aa, Entamoeba histolytica
GIVSNMLIKYPILKGLFDNGELLD

SEQ ID NO: 2713341 - protein, 24 aa, Entamoeba histolytica
GIVTLHDIGFIKDVFREMVLLPSQ

SEQ ID NO: 2713342 - protein, 19 aa, Entamoeba histolytica
GIVVLPCGAGKTLTAIAAC

SEQ ID NO: 2713343 - protein, 22 aa, Entamoeba histolytica
GIVVRLIVCAMRHLSEEESLKA

SEQ ID NO: 2713344 - protein, 23 aa, Entamoeba histolytica
GIWPSKFSMNLYSFVPSGICPLN

SEQ ID NO: 2713345 - protein, 24 aa, Entamoeba histolytica
GIYHAKFVLITTSRMLRLIIMSTN

SEQ ID NO: 2713346 - protein, 19 aa, Entamoeba histolytica
GIYQFNTWIGGMIGKVEIE

SEQ ID NO: 2713347 - protein, 18 aa, Entamoeba histolytica
GIYSGKSLRFESKSYKDF

SEQ ID NO: 2713348 - protein, 26 aa, Entamoeba histolytica
GIYTNNMVTLWYRPPELLLGETRYKG

SEQ ID NO: 2713349 - protein, 19 aa, Entamoeba histolytica
GIYVTRFPPEPNGYLHIGH

SEQ ID NO: 2713350 - protein, 20 aa, Entamoeba histolytica
GKAFSLINRKQFCIHCGLCV

SEQ ID NO: 2713351 - protein, 27 aa, Entamoeba histolytica
GKAKSIFYYHYFVPELNLNDVKRFSGC

SEQ ID NO: 2713352 - protein, 20 aa, Entamoeba histolytica
GKCYYPTFYGYNAKTKKELY

SEQ ID NO: 2713353 - protein, 27 aa, Entamoeba histolytica
GKDAENIWRLYFLVTELDVENGANGSK

SEQ ID NO: 2713354 - protein, 23 aa, Entamoeba histolytica
GKDCFILVLKMILKNAHLSGGQL

SEQ ID NO: 2713355 - protein, 24 aa, Entamoeba histolytica
GKDIPIYHMYTFEDPYIISHLNIA

SEQ ID NO: 2713356 - protein, 29 aa, Entamoeba histolytica
GKDSRNFHCWGYYLWVLEQGKISQEEDLK

SEQ ID NO: 2713357 - protein, 25 aa, Entamoeba histolytica
GKEFMKQLCLNGIQFSFLSSEIKQK

SEQ ID NO: 2713358 - protein, 23 aa, Entamoeba histolytica
GKEGAPTLIYPDSIVYYINDGIV

SEQ ID NO: 2713359 - protein, 23 aa, Entamoeba histolytica
GKEILEKWYDGRKGIIDMSRLKE

SEQ ID NO: 2713360 - protein, 31 aa, Entamoeba histolytica
GKELLTLTYRKIITIPYISGFLGFREVEVYH

SEQ ID NO: 2713361 - protein, 22 aa, Entamoeba histolytica
GKENIMVIIITKHGYVFGSFNS

SEQ ID NO: 2713362 - protein, 24 aa, Entamoeba histolytica
GKENTLIELAQLKPPIFTNEEKDE

SEQ ID NO: 2713363 - protein, 23 aa, Entamoeba histolytica
GKEVIGYVFMRKLVSALSVLGVT

SEQ ID NO: 2713364 - protein, 17 aa, Entamoeba histolytica
GKEYLVFFNNHLREINT

SEQ ID NO: 2713365 - protein, 22 aa, Entamoeba histolytica
GKGPKLLDVRMMLPMSVRCQAC

SEQ ID NO: 2713366 - protein, 37 aa, Entamoeba histolytica
GKGRFKYVPEFLFKFLLWLRKWLYPRNFLGGLFVDNH

SEQ ID NO: 2713367 - protein, 47 aa, Entamoeba histolytica
GKGRHWVLDPIDGTLGFLRREQYAVCLAFMIDGDIKVGVLGCPNFEG

SEQ ID NO: 2713368 - protein, 28 aa, Entamoeba histolytica
GKHFDEIFSVLSPFIFSSEKFRNYRFNK

SEQ ID NO: 2713369 - protein, 21 aa, Entamoeba histolytica
GKHIKLQIWDTAGQERFATLT

SEQ ID NO: 2713370 - protein, 19 aa, Entamoeba histolytica
GKHLILEDADLTLAHGRRY

SEQ ID NO: 2713371 - protein, 23 aa, Entamoeba histolytica
GKIFKQMIWYKVEYSTYLKEKEQ

SEQ ID NO: 2713372 - protein, 22 aa, Entamoeba histolytica
GKIHLLEFFAIKAEYVQEAMSA

SEQ ID NO: 2713373 - protein, 21 aa, Entamoeba histolytica
GKIKSRWMRKNARRLDIENYT

SEQ ID NO: 2713374 - protein, 42 aa, Entamoeba histolytica
GKIQLNVINTATGSPFVLCYLQKGVVSIKKATSNRCVFKCFE

SEQ ID NO: 2713375 - protein, 24 aa, Entamoeba histolytica
GKIVGCIMSSYLLEKSRVVYQARE

SEQ ID NO: 2713376 - protein, 22 aa, Entamoeba histolytica
GKKGILPFYVLDQLNQMVQIVN

SEQ ID NO: 2713377 - protein, 31 aa, Entamoeba histolytica
GKKHPNEEIIIPMLGIFFNFSQTDSKEVEVH

SEQ ID NO: 2713378 - protein, 19 aa, Entamoeba histolytica
GKKIEILESCRRPTIGFSD

SEQ ID NO: 2713379 - protein, 19 aa, Entamoeba histolytica
GKKIIDDKIDITIKGRHVS

SEQ ID NO: 2713380 - protein, 19 aa, Entamoeba histolytica
GKKILRCQCGMGHHNTVGF

SEQ ID NO: 2713381 - protein, 27 aa, Entamoeba histolytica
GKKISCAVLYCWCVSLLLEKLNNTEKV

SEQ ID NO: 2713382 - protein, 23 aa, Entamoeba histolytica
GKKKLLLYFIDRLCNRDVISREF

SEQ ID NO: 2713383 - protein, 21 aa, Entamoeba histolytica
GKKLFLFEDFNKCISFDTVIQ

SEQ ID NO: 2713384 - protein, 23 aa, Entamoeba histolytica
GKKNPLFDFRFTFDDFKRRTDIC

SEQ ID NO: 2713385 - protein, 26 aa, Entamoeba histolytica
GKKRNIRQTIFVGNLPFKMEEEQLRK

SEQ ID NO: 2713386 - protein, 21 aa, Entamoeba histolytica
GKKYIKLPYVVKGMDISLTGL

SEQ ID NO: 2713387 - protein, 21 aa, Entamoeba histolytica
GKKYQLVAHQLIWNCDTYSTE

SEQ ID NO: 2713388 - protein, 26 aa, Entamoeba histolytica
GKLAEPYLMKYFPGISLTDVRVEHEH

SEQ ID NO: 2713389 - protein, 18 aa, Entamoeba histolytica
GKLASLKAWLKKSLDETA

SEQ ID NO: 2713390 - protein, 22 aa, Entamoeba histolytica
GKLCERCFALAKTIRSAVFEKK

SEQ ID NO: 2713391 - protein, 27 aa, Entamoeba histolytica
GKLGLGIRQYYYIKGKNLMIFNEKKGE

SEQ ID NO: 2713392 - protein, 23 aa, Entamoeba histolytica
GKLLNQYLIYYLNFDYSTQRIVT

SEQ ID NO: 2713393 - protein, 26 aa, Entamoeba histolytica
GKLSNFQIILITHDENFVKKLSNFNE

SEQ ID NO: 2713394 - protein, 29 aa, Entamoeba histolytica
GKLTKLIPTLFITHFLSRSLVEFEKELLV

SEQ ID NO: 2713395 - protein, 26 aa, Entamoeba histolytica
GKLVEQWSQLLRKYWSGYSTISPKEF

SEQ ID NO: 2713396 - protein, 26 aa, Entamoeba histolytica
GKMDHSTLCVLVLNDGLFTKTTLNQL

SEQ ID NO: 2713397 - protein, 20 aa, Entamoeba histolytica
GKMLLLLMETGDAFFYKLEN

SEQ ID NO: 2713398 - protein, 26 aa, Entamoeba histolytica
GKNIEEIFVFIAQQFIQRIKSNTAVE

SEQ ID NO: 2713399 - protein, 25 aa, Entamoeba histolytica
GKNIFLIEPLLKEQFTYWNKNDGKV

SEQ ID NO: 2713400 - protein, 23 aa, Entamoeba histolytica
GKNLDQLIKKWKTISRDLLVDIQ

SEQ ID NO: 2713401 - protein, 26 aa, Entamoeba histolytica
GKNQFYYDYLSLLSIENFCLIILKRS

SEQ ID NO: 2713402 - protein, 28 aa, Entamoeba histolytica
GKNSFERKVLFLPLSVPKYAVIESTEDI

SEQ ID NO: 2713403 - protein, 31 aa, Entamoeba histolytica
GKNSIEVITLLLLYKLKYPQSIFLLRGNHED

SEQ ID NO: 2713404 - protein, 32 aa, Entamoeba histolytica
GKNVIQYCLRLLNPLQVFDILNGWDVLFNFVE

SEQ ID NO: 2713405 - protein, 24 aa, Entamoeba histolytica
GKPDVVFILGFSHSSRFDCAAVMD

SEQ ID NO: 2713406 - protein, 23 aa, Entamoeba histolytica
GKPIMPSQPISPGKPIMPSQPGF

SEQ ID NO: 2713407 - protein, 24 aa, Entamoeba histolytica
GKPLFKVSCYCGHEFCFGCGKERH

SEQ ID NO: 2713408 - protein, 19 aa, Entamoeba histolytica
GKPLLEWLEATVHKFEPKC

SEQ ID NO: 2713409 - protein, 23 aa, Entamoeba histolytica
GKPTVPYIGLILSDLTFTNFGNK

SEQ ID NO: 2713410 - protein, 25 aa, Entamoeba histolytica
GKPYCNFHYYKLFGQVCEKCGKVVH

SEQ ID NO: 2713411 - protein, 27 aa, Entamoeba histolytica
GKQCTKALGYLKYLLTNKKGFKQICLE

SEQ ID NO: 2713412 - protein, 25 aa, Entamoeba histolytica
GKQVTPLLFIIEDMVPIGVGKCELP

SEQ ID NO: 2713413 - protein, 26 aa, Entamoeba histolytica
GKRFHLTEGFLFYPNSEYIPFTNNYF

SEQ ID NO: 2713414 - protein, 27 aa, Entamoeba histolytica
GKRFICTLCLLFHPKFNLGKCELYCDV

SEQ ID NO: 2713415 - protein, 23 aa, Entamoeba histolytica
GKRKKEMLMVARSLAKDMKAICD

SEQ ID NO: 2713416 - protein, 22 aa, Entamoeba histolytica
GKRRIRYFGGLKFVTPGEISKE

SEQ ID NO: 2713417 - protein, 27 aa, Entamoeba histolytica
GKRYFKQCEFKLWRKQPQPIKTSPDAP

SEQ ID NO: 2713418 - protein, 28 aa, Entamoeba histolytica
GKRYFKQCEFKLWRKQPQPIKTSPDAPI

SEQ ID NO: 2713419 - protein, 28 aa, Entamoeba histolytica
GKSESRGFGYLDFFNVNEAQRCIDEMTG

SEQ ID NO: 2713420 - protein, 18 aa, Entamoeba histolytica
GKSFFFTGAAGCGKSYVL

SEQ ID NO: 2713421 - protein, 23 aa, Entamoeba histolytica
GKSNLLLRFTRNEFEPEKKFTIG

SEQ ID NO: 2713422 - protein, 28 aa, Entamoeba histolytica
GKSPQQCKARWYSWLDPSIKKTEWTSTE

SEQ ID NO: 2713423 - protein, 23 aa, Entamoeba histolytica
GKSSLVNFILQKNVFEVSDDTKS

SEQ ID NO: 2713424 - protein, 24 aa, Entamoeba histolytica
GKSVARIKGFPSILAVDVFKEYTQ

SEQ ID NO: 2713425 - protein, 23 aa, Entamoeba histolytica
GKSYQIWLPLGKIQPAKVRPNSF

SEQ ID NO: 2713426 - protein, 27 aa, Entamoeba histolytica
GKTAFLAKLLAFLRKHKEKIVIVSNYT

SEQ ID NO: 2713427 - protein, 24 aa, Entamoeba histolytica
GKTAVFVISILNQGLCLGDYVSAL

SEQ ID NO: 2713428 - protein, 24 aa, Entamoeba histolytica
GKTCLLISYSIRKFPEDYIPTVFD

SEQ ID NO: 2713429 - protein, 24 aa, Entamoeba histolytica
GKTDNIVIGFLKGAGIGLIPGYGL

SEQ ID NO: 2713430 - protein, 28 aa, Entamoeba histolytica
GKTEFAIQEIFLKFNTFMLRGDSLFDAY

SEQ ID NO: 2713431 - protein, 25 aa, Entamoeba histolytica
GKTKHFQTLILNDELMLCDCPGLVF

SEQ ID NO: 2713432 - protein, 20 aa, Entamoeba histolytica
GKTMAFLLSTLQLINRKDPF

SEQ ID NO: 2713433 - protein, 31 aa, Entamoeba histolytica; identical to SEQ ID NO: 2525404

SEQ ID NO: 2713434 - protein, 26 aa, Entamoeba histolytica
GKTSIRYKLLLGKFAMNIPTIGFGVE

SEQ ID NO: 2713435 - protein, 23 aa, Entamoeba histolytica
GKTTLVNLILEYMDFYSHTVIIK

SEQ ID NO: 2713436 - protein, 29 aa, Entamoeba histolytica
GKVGFVRYNWIYPFLTKESFYKFGRNVCE

SEQ ID NO: 2713437 - protein, 17 aa, Entamoeba histolytica
GKVGLLKDHIQVGRIQQ

SEQ ID NO: 2713438 - protein, 29 aa, Entamoeba histolytica
GKVLPQSHILTFFRAIGLNVNNPHFLIMQ

SEQ ID NO: 2713439 - protein, 24 aa, Entamoeba histolytica
GKYDFFTNCFWDIGVTLNIYIDKD

SEQ ID NO: 2713440 - protein, 25 aa, Entamoeba histolytica
GKYGTSPFILCRYGFGDVAQGFSRS

SEQ ID NO: 2713441 - protein, 22 aa, Entamoeba histolytica
GKYHVIGFYCRDFSRVCPREIK

SEQ ID NO: 2713442 - protein, 23 aa, Entamoeba histolytica
GKYPICCECLMKELIDNEQYYRC

SEQ ID NO: 2713443 - protein, 25 aa, Entamoeba histolytica
GLAAASFFARCNFKKIVVFERNAYL

SEQ ID NO: 2713444 - protein, 27 aa, Entamoeba histolytica
GLAILDNFFMPFFLLCVDDPVPNVRIH

SEQ ID NO: 2713445 - protein, 21 aa, Entamoeba histolytica
GLAMLGIGRIGWIEKKIPECG

SEQ ID NO: 2713446 - protein, 17 aa, Entamoeba histolytica
GLAWKEDLVYCEENGRI

SEQ ID NO: 2713447 - protein, 23 aa, Entamoeba histolytica
GLCQFVPEASFDAAKALFKISDI

SEQ ID NO: 2713448 - protein, 24 aa, Entamoeba histolytica
GLDKGLVELKLFSSLKTIQKGCCL

SEQ ID NO: 2713449 - protein, 24 aa, Entamoeba histolytica
GLDKKKILSSWDFPDDYPTESFCG

SEQ ID NO: 2713450 - protein, 18 aa, Entamoeba histolytica
GLDLIYTKQFPYSVSFVS

SEQ ID NO: 2713451 - protein, 28 aa, Entamoeba histolytica
GLDNIDKRYIWFNKKYLSYEDMYSTIFP

SEQ ID NO: 2713452 - protein, 20 aa, Entamoeba histolytica
GLDYILMAAVLKRFFRNLPE

SEQ ID NO: 2713453 - protein, 29 aa, Entamoeba histolytica
GLEDFYSLIEFCSPGCLGTLSSFKRVFAI

SEQ ID NO: 2713454 - protein, 25 aa, Entamoeba histolytica
GLEHLSTIYFVLRYYSGRSQHKENL

SEQ ID NO: 2713455 - protein, 25 aa, Entamoeba histolytica
GLEILRDLPDVDAIIAPIGSGSLLC

SEQ ID NO: 2713456 - protein, 27 aa, Entamoeba histolytica
GLEMKMRVRKLFGDIPIQLIGLEGETA

SEQ ID NO: 2713457 - protein, 23 aa, Entamoeba histolytica
GLERITMLYLGIPNIRKVTLFPR

SEQ ID NO: 2713458 - protein, 21 aa, Entamoeba histolytica
GLFCDLLWSDPIDESIYSKLT

SEQ ID NO: 2713459 - protein, 20 aa, Entamoeba histolytica
GLFEVLKDKIYQIRGFDISN

SEQ ID NO: 2713460 - protein, 19 aa, Entamoeba histolytica
GLFICRAFSNNNSVGGFLS

SEQ ID NO: 2713461 - protein, 26 aa, Entamoeba histolytica
GLFSGFIEIILDPYFRTFNGFIEMIH

SEQ ID NO: 2713462 - protein, 24 aa, Entamoeba histolytica
GLGCFKNCLSLRTITIPSSISEIG

SEQ ID NO: 2713463 - protein, 24 aa, Entamoeba histolytica
GLGCVNTCFGPFRVAFQEKHKLQN

SEQ ID NO: 2713464 - protein, 26 aa, Entamoeba histolytica
GLGDFVDEQLLYEVFLPFGEITDIQL

SEQ ID NO: 2713465 - protein, 30 aa, Entamoeba histolytica; identical to SEQ ID NO: 2525438

SEQ ID NO: 2713466 - protein, 18 aa, Entamoeba histolytica
GLGKTLQALALVSAYPEN

SEQ ID NO: 2713467 - protein, 19 aa, Entamoeba histolytica
GLGLPMFSRLLQLGHEPYR

SEQ ID NO: 2713468 - protein, 24 aa, Entamoeba histolytica
GLGLSERILMPISLCLQRPQTECY

SEQ ID NO: 2713469 - protein, 19 aa, Entamoeba histolytica
GLGNLYLLLDLHTSGIIHY

SEQ ID NO: 2713470 - protein, 17 aa, Entamoeba histolytica
GLGVIIIEMMNGTAPFA

SEQ ID NO: 2713471 - protein, 19 aa, Entamoeba histolytica
GLHQYLHKQPHFNKIESGK

SEQ ID NO: 2713472 - protein, 18 aa, Entamoeba histolytica
GLIDQPKLKVGEMVEFLL

SEQ ID NO: 2713473 - protein, 19 aa, Entamoeba histolytica
GLIELLNSVLKYNPYQRPT

SEQ ID NO: 2713474 - protein, 18 aa, Entamoeba histolytica
GLIKLDVVLFGEQLEKEK

SEQ ID NO: 2713475 - protein, 18 aa, Entamoeba histolytica
GLIPGYGQYQGIRGWGCI

SEQ ID NO: 2713476 - protein, 18 aa, Entamoeba histolytica
GLIRLMEEHLKVVEGAVA

SEQ ID NO: 2713477 - protein, 30 aa, Entamoeba histolytica
GLISDIWSCGVILYVMAFGLMPFDGDTLEE

SEQ ID NO: 2713478 - protein, 25 aa, Entamoeba histolytica
GLIVKEVMIINLYQNIFLGRESVLD

SEQ ID NO: 2713479 - protein, 29 aa, Entamoeba histolytica
GLIVSARIQLPLTHAWGLSIHKSQGLTLP

SEQ ID NO: 2713480 - protein, 22 aa, Entamoeba histolytica
GLKDLIAIFKTKVISFIGLIQG

SEQ ID NO: 2713481 - protein, 51 aa, Entamoeba histolytica
GLKEYYITQFKGYPFTEWFWMIEFQDKYFGFQTIFTMKKAYSLSIRKYVQI

SEQ ID NO: 2713482 - protein, 21 aa, Entamoeba histolytica
GLKVPVLLSDWGYEVMVTCSA

SEQ ID NO: 2713483 - protein, 19 aa, Entamoeba histolytica
GLLILTINSIIYLSTTSFE

SEQ ID NO: 2713484 - protein, 17 aa, Entamoeba histolytica
GLLSIIGVSNRATVIVD

SEQ ID NO: 2713485 - protein, 18 aa, Entamoeba histolytica
GLLSKKLPIEKGSKVAVI

SEQ ID NO: 2713486 - protein, 26 aa, Entamoeba histolytica
GLLSLRPHPFDPYRVYTIPFEEQDFK

SEQ ID NO: 2713487 - protein, 17 aa, Entamoeba histolytica
GLLSVKIGNYKGAAEAL

SEQ ID NO: 2713488 - protein, 20 aa, Entamoeba histolytica
GLLTILLEDSPLEAFSIFIG

SEQ ID NO: 2713489 - protein, 22 aa, Entamoeba histolytica
GLNFPIVSTTWFPTYIRSNIDQ

SEQ ID NO: 2713490 - protein, 29 aa, Entamoeba histolytica
GLNKALRPLAWKIFLKIIKPQASEEWIEV

SEQ ID NO: 2713491 - protein, 20 aa, Entamoeba histolytica
GLNKKNFLIRIAHGFHDLFI

SEQ ID NO: 2713492 - protein, 18 aa, Entamoeba histolytica
GLNKQTLLGVLKKGYRVP

SEQ ID NO: 2713493 - protein, 17 aa, Entamoeba histolytica
GLNQYYTYFVFGVTLCN

SEQ ID NO: 2713494 - protein, 24 aa, Entamoeba histolytica
GLNTFMITLLVYSFLEMYNTGNIT

SEQ ID NO: 2713495 - protein, 24 aa, Entamoeba histolytica
GLNYQRMFFVKYTGIESFIREHPD

SEQ ID NO: 2713496 - protein, 23 aa, Entamoeba histolytica
GLPHNLIIDILVKGTEYLRLTDN

SEQ ID NO: 2713497 - protein, 22 aa, Entamoeba histolytica
GLPLGIMRRTPEPWLKGLGCGD

SEQ ID NO: 2713498 - protein, 19 aa, Entamoeba histolytica
GLQCLLKLLKTQKGSDLIG

SEQ ID NO: 2713499 - protein, 25 aa, Entamoeba histolytica
GLQESIVLGIFYQIANAISFLHSQS

SEQ ID NO: 2713500 - protein, 24 aa, Entamoeba histolytica
GLQQLTPYFIRYISNHTLANLGSL

SEQ ID NO: 2713501 - protein, 22 aa, Entamoeba histolytica
GLQRLPIDLTKLTNLNICDVGD

SEQ ID NO: 2713502 - protein, 26 aa, Entamoeba histolytica
GLRDMIAPFFLRRIKKEVLPSLPTRQ

SEQ ID NO: 2713503 - protein, 23 aa, Entamoeba histolytica
GLRHHTLTSLLITPVQRLPRYKL

SEQ ID NO: 2713504 - protein, 26 aa, Entamoeba histolytica
GLRIRKLVDMAYKRDFRIIKKKMREK

SEQ ID NO: 2713505 - protein, 18 aa, Entamoeba histolytica
GLRPYGVSFLYAGWDRYF

SEQ ID NO: 2713506 - protein, 32 aa, Entamoeba histolytica; identical to SEQ ID NO: 2517986

SEQ ID NO: 2713507 - protein, 23 aa, Entamoeba histolytica
GLRQSIMQYIFRFFTCVNIGEYA

SEQ ID NO: 2713508 - protein, 28 aa, Entamoeba histolytica
GLRSPCRIVVILLFHYFNKMYELNYDIL

SEQ ID NO: 2713509 - protein, 20 aa, Entamoeba histolytica
GLRTMIFVHFNALISDHRKT

SEQ ID NO: 2713510 - protein, 26 aa, Entamoeba histolytica
GLSFVPGGVFVTYKIKNELRGCIGCF

SEQ ID NO: 2713511 - protein, 28 aa, Entamoeba histolytica
GLSKPMNLPLIYSFIIDGKLCFDTYPIV

SEQ ID NO: 2713512 - protein, 29 aa, Entamoeba histolytica
GLSKYETVLKQWIPSIQMKLIYDSSQQFF

SEQ ID NO: 2713513 - protein, 29 aa, Entamoeba histolytica
GLSSFPKYIHLLILLIRTRSRITNLRINK

SEQ ID NO: 2713514 - protein, 27 aa, Entamoeba histolytica
GLTEKPLSSPFSLNGFSFGKSTEKQQD

SEQ ID NO: 2713515 - protein, 18 aa, Entamoeba histolytica
GLTEYMQRLLRSCGYIYT

SEQ ID NO: 2713516 - protein, 17 aa, Entamoeba histolytica
GLTFFDCLSIQKSWNAL

SEQ ID NO: 2713517 - protein, 32 aa, Entamoeba histolytica
GLTGDLFDPFLRPYFAIGYIPVTQGDVIQCHG

SEQ ID NO: 2713518 - protein, 22 aa, Entamoeba histolytica
GLVCGVTCLIRYINGIKVVWMR

SEQ ID NO: 2713519 - protein, 34 aa, Entamoeba histolytica
GLVKPSVLVLFPFKTPAIIFIKTLLTIFGNQFQQ

SEQ ID NO: 2713520 - protein, 20 aa, Entamoeba histolytica
GLVKVWDLEIQQCRQTIVGH

SEQ ID NO: 2713521 - protein, 24 aa, Entamoeba histolytica
GLVPRCLELLFQKKSKTASVSLSM

SEQ ID NO: 2713522 - protein, 21 aa, Entamoeba histolytica
GLYYDDLLFIKDYFPSSVKDH

SEQ ID NO: 2713523 - protein, 17 aa, Entamoeba histolytica
GMAFPCGLSVNSCAAHF

SEQ ID NO: 2713524 - protein, 24 aa, Entamoeba histolytica
GMARTPIMRTNYARPIPTGIRLSQ

SEQ ID NO: 2713525 - protein, 19 aa, Entamoeba histolytica
GMDALNSGALRFGAKEHFV

SEQ ID NO: 2713526 - protein, 29 aa, Entamoeba histolytica
GMDRGEMYFINWNKKYTTWIDPRSFEERQ

SEQ ID NO: 2713527 - protein, 18 aa, Entamoeba histolytica
GMEAVWKIKVEDLLAFVL

SEQ ID NO: 2713528 - protein, 19 aa, Entamoeba histolytica
GMEAVWKIKVEDLLAFVLV

SEQ ID NO: 2713529 - protein, 24 aa, Entamoeba histolytica
GMEDDARMLLIRRAYDIAGCNPGK

SEQ ID NO: 2713530 - protein, 17 aa, Entamoeba histolytica
GMELSELLSFNGSLYGF

SEQ ID NO: 2713531 - protein, 19 aa, Entamoeba histolytica
GMFAFKWCESLTSLSIPSN

SEQ ID NO: 2713532 - protein, 22 aa, Entamoeba histolytica
GMGDVQVMRYLQTLKRFSTTDV

SEQ ID NO: 2713533 - protein, 18 aa, Entamoeba histolytica
GMIYSYRKDPEPTSITTP

SEQ ID NO: 2713534 - protein, 20 aa, Entamoeba histolytica
GMKILEFNSIRNIKILDGMK

SEQ ID NO: 2713535 - protein, 30 aa, Entamoeba histolytica
GMKINSLQQMFFPILYDAHSLQQIPTDTSN

SEQ ID NO: 2713536 - protein, 30 aa, Entamoeba histolytica
GMKNFDDFITKLLNLPRISLEKSREVLKRR

SEQ ID NO: 2713537 - protein, 18 aa, Entamoeba histolytica
GMLMNRLGCGKLLAGCKV

SEQ ID NO: 2713538 - protein, 23 aa, Entamoeba histolytica
GMLNIANMFSMWKNNLIEITDQF

SEQ ID NO: 2713539 - protein, 22 aa, Entamoeba histolytica
GMMFVRNDAKVFWFCRSKCHKS

SEQ ID NO: 2713540 - protein, 17 aa, Entamoeba histolytica
GMMHKKLRMIAIKEYKH

SEQ ID NO: 2713541 - protein, 17 aa, Entamoeba histolytica
GMMVGCAAVPMVRAGVC

SEQ ID NO: 2713542 - protein, 25 aa, Entamoeba histolytica
GMNHPCVLDLKMGCRTWFEDSSPEK

SEQ ID NO: 2713543 - protein, 28 aa, Entamoeba histolytica
GMNQLWASKILQIFKFLNGKDTFEQHYQ

SEQ ID NO: 2713544 - protein, 19 aa, Entamoeba histolytica
GMNQYFRLLSLNNSIRKSK

SEQ ID NO: 2713545 - protein, 18 aa, Entamoeba histolytica
GMNYPILNIGERVMSLLA

SEQ ID NO: 2713546 - protein, 17 aa, Entamoeba histolytica
GMTLFTRSTIQSSGLAI

SEQ ID NO: 2713547 - protein, 20 aa, Entamoeba histolytica
GMTLQRLYEMNLLGEGKRIV

SEQ ID NO: 2713548 - protein, 25 aa, Entamoeba histolytica
GMTQKEKIILNKKLIRLKKEAERIK

SEQ ID NO: 2713549 - protein, 25 aa, Entamoeba histolytica
GMTQQEKIILNKKLIRLKKEAERIK

SEQ ID NO: 2713550 - protein, 25 aa, Entamoeba histolytica
GMTYNRVGTLYYIYADDLRVLCEEH

SEQ ID NO: 2713551 - protein, 27 aa, Entamoeba histolytica
GMVAVAMYHDGVNPTFYFFKDGLKENK

SEQ ID NO: 2713552 - protein, 18 aa, Entamoeba histolytica
GMYLLRGISRKKEWTKKI

SEQ ID NO: 2713553 - protein, 18 aa, Entamoeba histolytica
GMYQCHLKTDFKSIVFLV

SEQ ID NO: 2713554 - protein, 29 aa, Entamoeba histolytica
GNATQAIYSFWLYDFCDVYLEASKGIFRG

SEQ ID NO: 2713555 - protein, 29 aa, Entamoeba histolytica
GNCSYFIEYNYYYPIVIPFSIKVIKEVIV

SEQ ID NO: 2713556 - protein, 28 aa, Entamoeba histolytica
GNDNALYDILRFWGIYSLYSSIDPSSTD

SEQ ID NO: 2713557 - protein, 23 aa, Entamoeba histolytica
GNDVYLWIGTRASSTLRKSAKVV

SEQ ID NO: 2713558 - protein, 29 aa, Entamoeba histolytica
GNDVYQFCRTFVLILSPNPIILNDHLHLF

SEQ ID NO: 2713559 - protein, 29 aa, Entamoeba histolytica
GNEGIIIPIFLIRWNKSPHYIFNEKVPLT

SEQ ID NO: 2713560 - protein, 18 aa, Entamoeba histolytica
GNEIIVHYPVDGSTFTVT

SEQ ID NO: 2713561 - protein, 25 aa, Entamoeba histolytica
GNEKILHFWKTKRDLYKYIHDQTLR

SEQ ID NO: 2713562 - protein, 27 aa, Entamoeba histolytica
GNEKIPLLTFIMHYAQSKLYGDYLKKK

SEQ ID NO: 2713563 - protein, 31 aa, Entamoeba histolytica
GNEKTFLALITGILNRFIGLSSKEVRLIHQW

SEQ ID NO: 2713564 - protein, 24 aa, Entamoeba histolytica
GNENKIIQLLKLLSKWEFESLNEE

SEQ ID NO: 2713565 - protein, 25 aa, Entamoeba histolytica
GNENNLLLSPYKWFSYSITSINNQK

SEQ ID NO: 2713566 - protein, 23 aa, Entamoeba histolytica
GNGFLILYSIISKQSFVECQSTV

SEQ ID NO: 2713567 - protein, 24 aa, Entamoeba histolytica
GNGGLVQWAPVLADLFMLARRDET

SEQ ID NO: 2713568 - protein, 31 aa, Entamoeba histolytica
GNGKYEITLFYMGKERHIVIDDLIPCNNGQP

SEQ ID NO: 2713569 - protein, 25 aa, Entamoeba histolytica
GNGLTIQWIYSLLIKLISSPHQPIR

SEQ ID NO: 2713570 - protein, 21 aa, Entamoeba histolytica
GNGRVIIKRPFMINMENVNIE

SEQ ID NO: 2713571 - protein, 17 aa, Entamoeba histolytica
GNHGKMVVLFKTQLYKD

SEQ ID NO: 2713572 - protein, 20 aa, Entamoeba histolytica
GNIAFWTLNNGTGLYEFLYD

SEQ ID NO: 2713573 - protein, 22 aa, Entamoeba histolytica
GNIEFVDFLLYNGARVEDKTFD

SEQ ID NO: 2713574 - protein, 26 aa, Entamoeba histolytica
GNIENTCLFSHFSIDEVYGWQSFVSK

SEQ ID NO: 2713575 - protein, 26 aa, Entamoeba histolytica
GNIHGMPLACAVGLGPQRLTSIMPHY

SEQ ID NO: 2713576 - protein, 40 aa, Entamoeba histolytica
GNIHKYRMRGANKHLFIAYYTLFVKPVFEIYQKTSKIRDI

SEQ ID NO: 2713577 - protein, 17 aa, Entamoeba histolytica
GNIKSAILLYWNVRARY

SEQ ID NO: 2713578 - protein, 23 aa, Entamoeba histolytica
GNILRLYDIGLKSLLRKAEKRQF

SEQ ID NO: 2713579 - protein, 31 aa, Entamoeba histolytica
GNIPLKEIILIDKSPFIIYGTSKLTQIENLV

SEQ ID NO: 2713580 - protein, 23 aa, Entamoeba histolytica
GNIRYCGLKLLGLMMTKHPKAVI

SEQ ID NO: 2713581 - protein, 26 aa, Entamoeba histolytica
GNKKIYERFMYFICKDFISHRKSYVF

SEQ ID NO: 2713582 - protein, 25 aa, Entamoeba histolytica
GNKKMNILIIGLYDNLLNSTNTPTE

SEQ ID NO: 2713583 - protein, 23 aa, Entamoeba histolytica
GNKSFFNCMRLSKINLVTSLKEI

SEQ ID NO: 2713584 - protein, 17 aa, Entamoeba histolytica
GNKSVFFKKTGHNPALV

SEQ ID NO: 2713585 - protein, 29 aa, Entamoeba histolytica
GNLDDLDSFIILMKKWWCDGQPHIELNVL

SEQ ID NO: 2713586 - protein, 19 aa, Entamoeba histolytica
GNLFQLRYISKATVTIQPL

SEQ ID NO: 2713587 - protein, 34 aa, Entamoeba histolytica
GNLKGNKMMWLPTPVCTLILNNLLGPGNWEIMER

SEQ ID NO: 2713588 - protein, 19 aa, Entamoeba histolytica
GNLLVVERGTELYFKCNTC

SEQ ID NO: 2713589 - protein, 25 aa, Entamoeba histolytica
GNLSQIHIIFYDKVIIRGAQYYEQL

SEQ ID NO: 2713590 - protein, 18 aa, Entamoeba histolytica
GNLWQYIGIERHAQYGYY

SEQ ID NO: 2713591 - protein, 26 aa, Entamoeba histolytica
GNMNITLFSFILFKMELHNMLCVYFD

SEQ ID NO: 2713592 - protein, 22 aa, Entamoeba histolytica
GNMVFTQYKILDFVKGEFEPLK

SEQ ID NO: 2713593 - protein, 18 aa, Entamoeba histolytica
GNNEYLIGFLEFVLNRDP

SEQ ID NO: 2713594 - protein, 17 aa, Entamoeba histolytica
GNNGWEILFDKMKITTN

SEQ ID NO: 2713595 - protein, 22 aa, Entamoeba histolytica
GNNIPVIITGQEGIQGPYERYG

SEQ ID NO: 2713596 - protein, 22 aa, Entamoeba histolytica
GNNMTCDDLEWALSRVGAVETT

SEQ ID NO: 2713597 - protein, 29 aa, Entamoeba histolytica
GNNNLEMTSFLLSFDEIKRIINDKNESGS

SEQ ID NO: 2713598 - protein, 20 aa, Entamoeba histolytica
GNNVTAMFRDGKLNYLQYTK

SEQ ID NO: 2713599 - protein, 27 aa, Entamoeba histolytica
GNPIIQLQQILFWGIPESNSSIIKIAL

SEQ ID NO: 2713600 - protein, 21 aa, Entamoeba histolytica
GNPLDLPRLFQIKGQKRPFVR

SEQ ID NO: 2713601 - protein, 31 aa, Entamoeba histolytica
GNPNWQATQYPFLPNFLKLEEFSTIPPSFSF

SEQ ID NO: 2713602 - protein, 22 aa, Entamoeba histolytica
GNQLFIMDIRQPTKLYNHLQLD

SEQ ID NO: 2713603 - protein, 23 aa, Entamoeba histolytica
GNQPSFHKLTLSKRSIISRRGKT

SEQ ID NO: 2713604 - protein, 22 aa, Entamoeba histolytica
GNQRFLMTILDPAVAPGQNKND

SEQ ID NO: 2713605 - protein, 24 aa, Entamoeba histolytica
GNQRITVSGWFYLKNVYLENDSRF

SEQ ID NO: 2713606 - protein, 35 aa, Entamoeba histolytica
GNQTATCQTLVFNLTWSWVVSLRELRKSTLGVIPT

SEQ ID NO: 2713607 - protein, 17 aa, Entamoeba histolytica
GNQTINFSGGQQNQIGF

SEQ ID NO: 2713608 - protein, 21 aa, Entamoeba histolytica
GNQVLRFYRRIVRDYLTRNYT

SEQ ID NO: 2713609 - protein, 17 aa, Entamoeba histolytica
GNRGRFDGRRGLNHIGR

SEQ ID NO: 2713610 - protein, 26 aa, Entamoeba histolytica
GNRSVKLFLLRWKKNNHYIIDDTVPV

SEQ ID NO: 2713611 - protein, 21 aa, Entamoeba histolytica
GNRVLVIDFGGGTLDVACCKI

SEQ ID NO: 2713612 - protein, 27 aa, Entamoeba histolytica
GNSASVRDWWYYPELTYVTDTSDEQGV

SEQ ID NO: 2713613 - protein, 27 aa, Entamoeba histolytica
GNSEAKKKWLANRKPSLPLPKPGEVEN

SEQ ID NO: 2713614 - protein, 29 aa, Entamoeba histolytica
GNSELFLLDKYVVLYRMVSDLIIAALTDP

SEQ ID NO: 2713615 - protein, 26 aa, Entamoeba histolytica
GNSHLPELHILLSKFVMIRRLKEEVL

SEQ ID NO: 2713616 - protein, 23 aa, Entamoeba histolytica
GNSRVQCFEPLFNPQLCAMNCSG

SEQ ID NO: 2713617 - protein, 25 aa, Entamoeba histolytica
GNTCCIIFYGWKPHLDIDLTELNKK

SEQ ID NO: 2713618 - protein, 28 aa, Entamoeba histolytica
GNTDGCPAFYKFLDLLGTKIELQGFDKY

SEQ ID NO: 2713619 - protein, 28 aa, Entamoeba histolytica
GNTEGCPAFYKFLDLLGNKIELHGFNKY

SEQ ID NO: 2713620 - protein, 34 aa, Entamoeba histolytica
GNTIFDVRLLNSFKQYVLPFVPLKTTIDDLQIKQ

SEQ ID NO: 2713621 - protein, 23 aa, Entamoeba histolytica
GNTLIHELQPKLNFGLTTCGELM

SEQ ID NO: 2713622 - protein, 23 aa, Entamoeba histolytica
GNTPNLLPELTGAYLKVIDVELH

SEQ ID NO: 2713623 - protein, 26 aa, Entamoeba histolytica
GNVDSFCYFSFNKEKYFLVGDHSGRI

SEQ ID NO: 2713624 - protein, 26 aa, Entamoeba histolytica
GNVKKDIPALWFKCSMKSSTSIEPVT

SEQ ID NO: 2713625 - protein, 30 aa, Entamoeba histolytica
GNVKLTLGLVWTLILRFAISELSAEGLSAK

SEQ ID NO: 2713626 - protein, 24 aa, Entamoeba histolytica
GNVKMLMGFFRALMVWETSLKKSL

SEQ ID NO: 2713627 - protein, 24 aa, Entamoeba histolytica
GNVNFGCFGISKISLKRNVCCTLS

SEQ ID NO: 2713628 - protein, 47 aa, Entamoeba histolytica
GNWEISYHMFNVGQGDCALLLIKNYNGNKWIVRKRVLIDAGNQNKLK

SEQ ID NO: 2713629 - protein, 19 aa, Entamoeba histolytica
GNYVLIMGEGVQSPLAIGL

SEQ ID NO: 2713630 - protein, 18 aa, Entamoeba histolytica
GPAGLAAAYFLRLKGHKV

SEQ ID NO: 2713631 - protein, 23 aa, Entamoeba histolytica
GPAGLAAAYFLRLKGHKVVVYEQ

SEQ ID NO: 2713632 - protein, 19 aa, Entamoeba histolytica
GPAHPTNVHACDWDYGLIA

SEQ ID NO: 2713633 - protein, 27 aa, Entamoeba histolytica
GPCLDCIISLFPPQKTFPMCTIASQPR

SEQ ID NO: 2713634 - protein, 22 aa, Entamoeba histolytica
GPCYKCLYPVMPSTTLNATAKT

SEQ ID NO: 2713635 - protein, 20 aa, Entamoeba histolytica
GPELLTMWYGESEANVRDVF

SEQ ID NO: 2713636 - protein, 18 aa, Entamoeba histolytica
GPFLIITNKENLGFYQEN

SEQ ID NO: 2713637 - protein, 18 aa, Entamoeba histolytica
GPIGIVFAPIRELAEQIN

SEQ ID NO: 2713638 - protein, 17 aa, Entamoeba histolytica
GPIIRGYIPERVELWRQ

SEQ ID NO: 2713639 - protein, 28 aa, Entamoeba histolytica
GPIVTQIRALLLPQPMKDLRVKTPYIVQ

SEQ ID NO: 2713640 - protein, 17 aa, Entamoeba histolytica
GPKAKTCQLAFDVYIKQ

SEQ ID NO: 2713641 - protein, 30 aa, Entamoeba histolytica; identical to SEQ ID NO: 2525596

SEQ ID NO: 2713642 - protein, 17 aa, Entamoeba histolytica
GPLVIHPLPGTNAVNTT

SEQ ID NO: 2713643 - protein, 25 aa, Entamoeba histolytica
GPSLKPFTCMIAGSYWANLTVISKS

SEQ ID NO: 2713644 - protein, 38 aa, Entamoeba histolytica
GPSLQIGKTFLVSSYLFDLYELFFPLNDTSKKMQTYAK

SEQ ID NO: 2713645 - protein, 17 aa, Entamoeba histolytica
GPSWFIPMAMHPAAYKH

SEQ ID NO: 2713646 - protein, 25 aa, Entamoeba histolytica
GPVLYKIHLIPEYSLMVALKLSRIV

SEQ ID NO: 2713647 - protein, 22 aa, Entamoeba histolytica
GPVSLVLVLVQGQYIIQVDNKD

SEQ ID NO: 2713648 - protein, 17 aa, Entamoeba histolytica
GPYIFWKEYSMKSISEV

SEQ ID NO: 2713649 - protein, 22 aa, Entamoeba histolytica
GQCDLPFRRISGGSNIFGKTGG

SEQ ID NO: 2713650 - protein, 23 aa, Entamoeba histolytica
GQCDLPFRRISGGTNIFAKTAGV

SEQ ID NO: 2713651 - protein, 23 aa, Entamoeba histolytica
GQDLSDDKIGLKVLYKLMDVDGD

SEQ ID NO: 2713652 - protein, 17 aa, Entamoeba histolytica
GQDVSVFPKWSIVDPCH

SEQ ID NO: 2713653 - protein, 17 aa, Entamoeba histolytica
GQDYYIVKNSWGSFWGM

SEQ ID NO: 2713654 - protein, 28 aa, Entamoeba histolytica
GQEKFRSMIDLYFRKAVGAFIVYDVMLR

SEQ ID NO: 2713655 - protein, 17 aa, Entamoeba histolytica
GQENLRPYWRCYYSGTN

SEQ ID NO: 2713656 - protein, 19 aa, Entamoeba histolytica
GQERYGFVFIIDRKINANE

SEQ ID NO: 2713657 - protein, 30 aa, Entamoeba histolytica
GQFIENLWQFDISNLVWRKLGDLENFKLGR

SEQ ID NO: 2713658 - protein, 24 aa, Entamoeba histolytica
GQFKSIPIVIKEPLYRIATCAPHL

SEQ ID NO: 2713659 - protein, 19 aa, Entamoeba histolytica
GQFLVTCQHKLPKEERIEA

SEQ ID NO: 2713660 - protein, 21 aa, Entamoeba histolytica
GQHDFPIERLALSRDKNILAS

SEQ ID NO: 2713661 - protein, 25 aa, Entamoeba histolytica
GQHKLVTLLCMPLEVGLLNRVEYQT

SEQ ID NO: 2713662 - protein, 26 aa, Entamoeba histolytica
GQIPWRSPDIFYKKNQLFLDVIESVN

SEQ ID NO: 2713663 - protein, 20 aa, Entamoeba histolytica
GQITFKHFIILFNQDKTKKS

SEQ ID NO: 2713664 - protein, 26 aa, Entamoeba histolytica
GQLFTVWFNTWFVKGTTLTLTKLELD

SEQ ID NO: 2713665 - protein, 25 aa, Entamoeba histolytica
GQLFVFCKFFTSKLSLVLLATKNES

SEQ ID NO: 2713666 - protein, 23 aa, Entamoeba histolytica
GQLKKWEIKYYKGLGTSKDSDAK

SEQ ID NO: 2713667 - protein, 35 aa, Entamoeba histolytica
GQLLKITSIKTMDYFNLLLKKKPGCSGKIVLDHSK

SEQ ID NO: 2713668 - protein, 28 aa, Entamoeba histolytica
GQLYDLLRIFLREGYPGEINYLFLGDYV

SEQ ID NO: 2713669 - protein, 18 aa, Entamoeba histolytica
GQMLYNCLVYLMSQNVET

SEQ ID NO: 2713670 - protein, 25 aa, Entamoeba histolytica
GQMPRSVIVILLDQLVDKGKPGDRV

SEQ ID NO: 2713671 - protein, 19 aa, Entamoeba histolytica
GQMQDFFDKLFTAVIRMKS

SEQ ID NO: 2713672 - protein, 23 aa, Entamoeba histolytica
GQMSPLQLLELNVSYQIACLFEE

SEQ ID NO: 2713673 - protein, 29 aa, Entamoeba histolytica
GQNAFNCCILLDKILLPDSVYKIDEEAFS

SEQ ID NO: 2713674 - protein, 23 aa, Entamoeba histolytica
GQPGAYPGYPPQGGYPPQQPGAY

SEQ ID NO: 2713675 - protein, 27 aa, Entamoeba histolytica
GQPLVYRLIWICFVERKLRLVRHRKIK

SEQ ID NO: 2713676 - protein, 28 aa, Entamoeba histolytica
GQQDITLFFYRLLGPDPSFKKGFEDHCK

SEQ ID NO: 2713677 - protein, 17 aa, Entamoeba histolytica
GQSLLQFTPSDLVKFQL

SEQ ID NO: 2713678 - protein, 25 aa, Entamoeba histolytica
GQTKIKLSFIVLSLLLSNYSVIYKL

SEQ ID NO: 2713679 - protein, 22 aa, Entamoeba histolytica
GQTVYGYLNKKGIFSLKESSVG

SEQ ID NO: 2713680 - protein, 25 aa, Entamoeba histolytica
GQVDTFVEFLIKTTLPLLRDPQSML

SEQ ID NO: 2713681 - protein, 28 aa, Entamoeba histolytica
GQWQFGTTKLFIRLPESIFAIEEMLEKM

SEQ ID NO: 2713682 - protein, 17 aa, Entamoeba histolytica
GQYVLTTFGMDSRIKLW

SEQ ID NO: 2713683 - protein, 25 aa, Entamoeba histolytica
GRAMKGFMIPLLKNIIKDFKTTDLV

SEQ ID NO: 2713684 - protein, 17 aa, Entamoeba histolytica
GRATYYTILPSLIGKGC

SEQ ID NO: 2713685 - protein, 18 aa, Entamoeba histolytica
GRCISLICYDRLMWVIPL

SEQ ID NO: 2713686 - protein, 24 aa, Entamoeba histolytica
GRDIIKIGVPIIQLSSIDIETINI

SEQ ID NO: 2713687 - protein, 25 aa, Entamoeba histolytica
GRETSYFPFKGINILCVVFDFSNDS

SEQ ID NO: 2713688 - protein, 27 aa, Entamoeba histolytica
GRFEGTAYMPLLKKLKVMFLNDTNSLT

SEQ ID NO: 2713689 - protein, 26 aa, Entamoeba histolytica
GRFILTQYSFYFIPYVEESIVTKSGV

SEQ ID NO: 2713690 - protein, 18 aa, Entamoeba histolytica
GRGIWGVPKLKPSEMERW

SEQ ID NO: 2713691 - protein, 23 aa, Entamoeba histolytica
GRGRLHEMFYFRGNYESPIYYDK

SEQ ID NO: 2713692 - protein, 24 aa, Entamoeba histolytica
GRHKAALAFLATYTGPITVYYGDE

SEQ ID NO: 2713693 - protein, 25 aa, Entamoeba histolytica
GRHRAAIAFLAAYTGPITIYYGDEV

SEQ ID NO: 2713694 - protein, 24 aa, Entamoeba histolytica
GRIDLPFIQRIYNSYMGFCINLLP

SEQ ID NO: 2713695 - protein, 17 aa, Entamoeba histolytica
GRIGWIEKKIPECGPLD

SEQ ID NO: 2713696 - protein, 18 aa, Entamoeba histolytica
GRILLIRQDTEGLIYIVG

SEQ ID NO: 2713697 - protein, 24 aa, Entamoeba histolytica
GRINKYVIWYKMSYSRYLKEKEEM

SEQ ID NO: 2713698 - protein, 25 aa, Entamoeba histolytica
GRIRETYWHIYPTQHSLYTNKTPII

SEQ ID NO: 2713699 - protein, 24 aa, Entamoeba histolytica
GRITYPLVLIYSSPTGINPQFSMI

SEQ ID NO: 2713700 - protein, 21 aa, Entamoeba histolytica
GRIVPIKPFDKDFQKFVSGSE

SEQ ID NO: 2713701 - protein, 18 aa, Entamoeba histolytica
GRIVSVGVGFWKVDINGK

SEQ ID NO: 2713702 - protein, 17 aa, Entamoeba histolytica
GRKEHLINRLSLQPKHL

SEQ ID NO: 2713703 - protein, 26 aa, Entamoeba histolytica
GRKGSPWEFNLRDILRFCKLYIEYSS

SEQ ID NO: 2713704 - protein, 19 aa, Entamoeba histolytica
GRKMAEFPLEPPLAKMLIV

SEQ ID NO: 2713705 - protein, 23 aa, Entamoeba histolytica
GRLAMTGSIRRYLAEHPKDFDPR

SEQ ID NO: 2713706 - protein, 26 aa, Entamoeba histolytica
GRLKKGLIYNFGSNTCWHLYGIILRT

SEQ ID NO: 2713707 - protein, 24 aa, Entamoeba histolytica
GRLKTDPMRVCRYLKMILEGVRVL

SEQ ID NO: 2713708 - protein, 22 aa, Entamoeba histolytica
GRLMINTFFWENNVKYEYSLKQ

SEQ ID NO: 2713709 - protein, 24 aa, Entamoeba histolytica
GRSNLDEAFIKRINSDLLELRVRM

SEQ ID NO: 2713710 - protein, 26 aa, Entamoeba histolytica
GRSRLFNYQFLESNSLRLGKKSKAFS

SEQ ID NO: 2713711 - protein, 26 aa, Entamoeba histolytica
GRSYRTLSQYPIYPWVICSYDSKDFR

SEQ ID NO: 2713712 - protein, 33 aa, Entamoeba histolytica
GRTIKMLKGISDGKWILSEDWIDAIIKSNNIVE

SEQ ID NO: 2713713 - protein, 17 aa, Entamoeba histolytica
GRTIYYVMTEGVNFRAA

SEQ ID NO: 2713714 - protein, 28 aa, Entamoeba histolytica
GRTPLMNAILNKSLNVALLLLTNGDCCL

SEQ ID NO: 2713715 - protein, 25 aa, Entamoeba histolytica
GRTTIRLFESLIRISQAHAKLMMHQ

SEQ ID NO: 2713716 - protein, 32 aa, Entamoeba histolytica
GRTYKKVMNLWDLKYKLIDWKSYFIITINELQ

SEQ ID NO: 2713717 - protein, 25 aa, Entamoeba histolytica
GRVRDLFDRQFLKLDSIETIVLDEA

SEQ ID NO: 2713718 - protein, 34 aa, Entamoeba histolytica
GRVSLIILEKMKVKPNWRNWKKIPKSERIVDLID

SEQ ID NO: 2713719 - protein, 26 aa, Entamoeba histolytica
GRVVTAIIHSLFPKEFDYNSMTFKEP

SEQ ID NO: 2713720 - protein, 29 aa, Entamoeba histolytica
GSAMDAAKIMWLLYEHPEADFFAMKQKFI

SEQ ID NO: 2713721 - protein, 24 aa, Entamoeba histolytica
GSAYQLSILVLFNQKNEITIDEIF

SEQ ID NO: 2713722 - protein, 25 aa, Entamoeba histolytica
GSDIFFSECFILVHPLVVSSSKLME

SEQ ID NO: 2713723 - protein, 26 aa, Entamoeba histolytica
GSDKALVEFIFWKYVEPESIVEDDII

SEQ ID NO: 2713724 - protein, 24 aa, Entamoeba histolytica
GSDKTVAWLLKKGASPMVENCMGQ

SEQ ID NO: 2713725 - protein, 24 aa, Entamoeba histolytica
GSEAIQIPFILNSPDFQPDAERET

SEQ ID NO: 2713726 - protein, 19 aa, Entamoeba histolytica
GSEFTGIYSPLMLNVGSTK

SEQ ID NO: 2713727 - protein, 27 aa, Entamoeba histolytica
GSEIHPLTHLFLQKFISAYLLTHNKLP

SEQ ID NO: 2713728 - protein, 24 aa, Entamoeba histolytica
GSEMNLFVCTFILNIINLSREDLF

SEQ ID NO: 2713729 - protein, 18 aa, Entamoeba histolytica
GSENVLLLMAMKVTYPQR

SEQ ID NO: 2713730 - protein, 17 aa, Entamoeba histolytica
GSERIYFDPLCEDNFVV

SEQ ID NO: 2713731 - protein, 18 aa, Entamoeba histolytica
GSFGCVFSASYKGNFFAI

SEQ ID NO: 2713732 - protein, 23 aa, Entamoeba histolytica
GSFKNSLDLFKLHSLPSSSVSIN

SEQ ID NO: 2713733 - protein, 27 aa, Entamoeba histolytica
GSGHELHFFCWIVLLVQLKVINEEEYP

SEQ ID NO: 2713734 - protein, 28 aa, Entamoeba histolytica
GSGKTAAFLFPIISDILKNPPMPRQSNF

SEQ ID NO: 2713735 - protein, 24 aa, Entamoeba histolytica
GSGKTASFLLPMVQHLLNVKEKNR

SEQ ID NO: 2713736 - protein, 30 aa, Entamoeba histolytica; identical to SEQ ID NO: 2484158

SEQ ID NO: 2713737 - protein, 25 aa, Entamoeba histolytica
GSGKTLAYLLPTITMILNKHPKLKR

SEQ ID NO: 2713738 - protein, 28 aa, Entamoeba histolytica
GSGKTLAYTIPLIKHVMAQRPLSKGEGP

SEQ ID NO: 2713739 - protein, 41 aa, Entamoeba histolytica
GSGKTLAYTLPLLKLINPLFNHIQVVILIPTLPLALQVSNV

SEQ ID NO: 2713740 - protein, 25 aa, Entamoeba histolytica
GSGKTLAYVIPILNNLLVSQEEQRR

SEQ ID NO: 2713741 - protein, 24 aa, Entamoeba histolytica
GSGKTLSFLIPLFEIIKRERESIE

SEQ ID NO: 2713742 - protein, 24 aa, Entamoeba histolytica
GSGQLQFLSFFNNGRVRLNCKNLH

SEQ ID NO: 2713743 - protein, 24 aa, Entamoeba histolytica
GSGRYTCCMLFLKEIYGSVVLELG

SEQ ID NO: 2713744 - protein, 17 aa, Entamoeba histolytica
GSGYFGTILKWANEIKK

SEQ ID NO: 2713745 - protein, 46 aa, Entamoeba histolytica
GSHFSSGYFLIVPSLFALTCWRRIVWHCVLPLALKERKYLTYEAGL

SEQ ID NO: 2713746 - protein, 24 aa, Entamoeba histolytica
GSHWTLLYIDILSKIGYYYDSVPS

SEQ ID NO: 2713747 - protein, 28 aa, Entamoeba histolytica
GSIFVEFAHFFKVYKLIVGNSEAVLAVL

SEQ ID NO: 2713748 - protein, 27 aa, Entamoeba histolytica
GSIGFYEYLALMKFVKLATAVFTKFDK

SEQ ID NO: 2713749 - protein, 24 aa, Entamoeba histolytica
GSIGRIRYIIKCTIQRFSKIIKEI

SEQ ID NO: 2713750 - protein, 24 aa, Entamoeba histolytica
GSISDIIFNFLDFCYDQGLSQNEI

SEQ ID NO: 2713751 - protein, 26 aa, Entamoeba histolytica
GSKCTLQALIFARLVNKFPTLLEEVN

SEQ ID NO: 2713752 - protein, 22 aa, Entamoeba histolytica
GSKFFKGLPQFPEADFYECYKL

SEQ ID NO: 2713753 - protein, 30 aa, Entamoeba histolytica
GSKKFQEQAIWMLNAMWPKDQGANAEELWN

SEQ ID NO: 2713754 - protein, 30 aa, Entamoeba histolytica; identical to SEQ ID NO: 2525734

SEQ ID NO: 2713755 - protein, 19 aa, Entamoeba histolytica
GSLGLSLVRRFAFQILSAL

SEQ ID NO: 2713756 - protein, 18 aa, Entamoeba histolytica
GSLIGILFEMLKDDSKKN

SEQ ID NO: 2713757 - protein, 25 aa, Entamoeba histolytica
GSLLDDLFVIMSYKNTKDGFMNEYQ

SEQ ID NO: 2713758 - protein, 26 aa, Entamoeba histolytica
GSLNHFIIICFMLDDCFLPLLQTVQS

SEQ ID NO: 2713759 - protein, 36 aa, Entamoeba histolytica
GSLNTQLLDLEYFFFIKVIVASTMKLNGFLESMMKD

SEQ ID NO: 2713760 - protein, 24 aa, Entamoeba histolytica
GSLRQVLEIISLRTETAPIPMQVP

SEQ ID NO: 2713761 - protein, 27 aa, Entamoeba histolytica
GSMDCEGDVMKWVNTTLGSKRMINYTS

SEQ ID NO: 2713762 - protein, 20 aa, Entamoeba histolytica
GSMGLLAVRQSELLIVLSNE

SEQ ID NO: 2713763 - protein, 26 aa, Entamoeba histolytica
GSMITMKIMEYLGGLFYGVRVEKERF

SEQ ID NO: 2713764 - protein, 23 aa, Entamoeba histolytica
GSNLLDLIKYYDYKGIPINDCKE

SEQ ID NO: 2713765 - protein, 25 aa, Entamoeba histolytica
GSNNFQCRYCLKPYQPFLNDCEKGI

SEQ ID NO: 2713766 - protein, 24 aa, Entamoeba histolytica
GSNTWIALCQLVLDLVYKAVDNPN

SEQ ID NO: 2713767 - protein, 33 aa, Entamoeba histolytica
GSNYKSINFMSQFKNKSLIEIRTEDYKANNGNK

SEQ ID NO: 2713768 - protein, 21 aa, Entamoeba histolytica
GSPFVIYGCVTTLKYIVCEPY

SEQ ID NO: 2713769 - protein, 26 aa, Entamoeba histolytica
GSPHQPNCPMALSTPLPLPSNPLTAN

SEQ ID NO: 2713770 - protein, 33 aa, Entamoeba histolytica
GSQFCLPLCIMYPYDYPLSPPLFFTDPTPEMEV

SEQ ID NO: 2713771 - protein, 30 aa, Entamoeba histolytica; identical to SEQ ID NO: 2525753

SEQ ID NO: 2713772 - protein, 31 aa, Entamoeba histolytica
GSQVTFIQLEKIKYIYQPVDDIYVVLITSIN

SEQ ID NO: 2713773 - protein, 24 aa, Entamoeba histolytica
GSRDKNFGLLPRWENSRNRYHSRS

SEQ ID NO: 2713774 - protein, 28 aa, Entamoeba histolytica
GSSYFEHFLNLLGNKIELFGYQGFVGGL

SEQ ID NO: 2713775 - protein, 27 aa, Entamoeba histolytica
GSSYFEHFLTLLGDKVELFGYQGFAGG

SEQ ID NO: 2713776 - protein, 22 aa, Entamoeba histolytica
GSTEIIINEILALKCIDIETRT

SEQ ID NO: 2713777 - protein, 18 aa, Entamoeba histolytica
GSTILTKKQGRLYCTICK

SEQ ID NO: 2713778 - protein, 17 aa, Entamoeba histolytica
GSTKLLKYLLAKGASLQ

SEQ ID NO: 2713779 - protein, 18 aa, Entamoeba histolytica
GSTLFKLQYFNEPAYLTQ

SEQ ID NO: 2713780 - protein, 18 aa, Entamoeba histolytica
GSTLFKRVYNQNNIYIVI

SEQ ID NO: 2713781 - protein, 32 aa, Entamoeba histolytica; identical to SEQ ID NO: 2525763

SEQ ID NO: 2713782 - protein, 25 aa, Entamoeba histolytica
GSVDGAVYVWNLTTSKFACCVYPEV

SEQ ID NO: 2713783 - protein, 30 aa, Entamoeba histolytica; identical to SEQ ID NO: 2525768

SEQ ID NO: 2713784 - protein, 33 aa, Entamoeba histolytica; identical to SEQ ID NO: 2525770

SEQ ID NO: 2713785 - protein, 20 aa, Entamoeba histolytica
GSVRVRLVPAPRGTGIVAAP

SEQ ID NO: 2713786 - protein, 28 aa, Entamoeba histolytica
GSWKSWKRRFFVLKDRKLWYFESENSTT

SEQ ID NO: 2713787 - protein, 28 aa, Entamoeba histolytica
GSYIMKIMGYITVRFKQLRSSPLEIVEA

SEQ ID NO: 2713788 - protein, 29 aa, Entamoeba histolytica
GTAADIIKMCMIEIFKKLHSSWVGVQLLL

SEQ ID NO: 2713789 - protein, 20 aa, Entamoeba histolytica
GTACGRYFSVSVLSIIDGGD

SEQ ID NO: 2713790 - protein, 27 aa, Entamoeba histolytica
GTAFARTFIYILELIKYLEHIGADPTS

SEQ ID NO: 2713791 - protein, 25 aa, Entamoeba histolytica
GTAKSQLLKYSQKLAPRAVFTTGRG

SEQ ID NO: 2713792 - protein, 42 aa, Entamoeba histolytica
GTANPTWASVTYGIFLCIQCAGLHRGLGVHLTFVRSIDMDEW

SEQ ID NO: 2713793 - protein, 25 aa, Entamoeba histolytica
GTDKTGMMLLFPQQNKPIPKTIREI

SEQ ID NO: 2713794 - protein, 19 aa, Entamoeba histolytica
GTDPFRFFEEMFSGFGMFE

SEQ ID NO: 2713795 - protein, 25 aa, Entamoeba histolytica
GTDTLKIKIIVDPYGKWLKGEVHLK

SEQ ID NO: 2713796 - protein, 46 aa, Entamoeba histolytica
GTEDFAPHGIPLDLLDRLLVIVTKQYTLQELLKIINIRAGVENVEL

SEQ ID NO: 2713797 - protein, 24 aa, Entamoeba histolytica
GTEEFFVFSLYNNKGFNPIKIERK

SEQ ID NO: 2713798 - protein, 28 aa, Entamoeba histolytica
GTEGNIIRMFLFRWKNGQHYINNEKIPL

SEQ ID NO: 2713799 - protein, 19 aa, Entamoeba histolytica
GTEIFLRCTSPLSELRTVI

SEQ ID NO: 2713800 - protein, 23 aa, Entamoeba histolytica
GTELFVSRLLKRIANEVNVPLLE

SEQ ID NO: 2713801 - protein, 27 aa, Entamoeba histolytica
GTFCIPFEFFEDVLPLIITTLSKVEKI

SEQ ID NO: 2713802 - protein, 36 aa, Entamoeba histolytica
GTFKYPLGCAVSKSAWRYPIPIYRAIEYLQKNKGAE

SEQ ID NO: 2713803 - protein, 26 aa, Entamoeba histolytica
GTFNSLAVPNAPLKPGKGIDDCEVIT

SEQ ID NO: 2713804 - protein, 17 aa, Entamoeba histolytica
GTFNYYVKDTEIKDIIS

SEQ ID NO: 2713805 - protein, 22 aa, Entamoeba histolytica
GTGVKVCTVIGFPLGATPSEVK

SEQ ID NO: 2713806 - protein, 17 aa, Entamoeba histolytica
GTIFGPYIFWKEYSMKS

SEQ ID NO: 2713807 - protein, 23 aa, Entamoeba histolytica
GTILKECLLLKNQMGQMVITTKK

SEQ ID NO: 2713808 - protein, 26 aa, Entamoeba histolytica
GTKLSFFSWNAWNGWIPNWCVNKATK

SEQ ID NO: 2713809 - protein, 18 aa, Entamoeba histolytica
GTKLVDCVHLLPSHFHQL

SEQ ID NO: 2713810 - protein, 20 aa, Entamoeba histolytica
GTKQFVCNVASDVKTCTSNG

SEQ ID NO: 2713811 - protein, 23 aa, Entamoeba histolytica
GTKRMSEIAGYIRDMAYILGSED

SEQ ID NO: 2713812 - protein, 30 aa, Entamoeba histolytica
GTLEFLHNCAPFIAKLYLLVNSPQSNSLIC

SEQ ID NO: 2713813 - protein, 19 aa, Entamoeba histolytica
GTLIIPTVDGTIMVGPNAD

SEQ ID NO: 2713814 - protein, 26 aa, Entamoeba histolytica
GTLNDYFIQLLNLHLQYERGARSLWI

SEQ ID NO: 2713815 - protein, 24 aa, Entamoeba histolytica
GTLQLIHTLSYYIDKQIIRLQESP

SEQ ID NO: 2713816 - protein, 23 aa, Entamoeba histolytica
GTMDSIIRRLKGKRIQTIVHGPL

SEQ ID NO: 2713817 - protein, 24 aa, Entamoeba histolytica
GTMTKIVFWIPGDTDIDLPKYVEP

SEQ ID NO: 2713818 - protein, 32 aa, Entamoeba histolytica
GTNEPIDIKLPFLLKFLSIKNPLSLQIHPDAS

SEQ ID NO: 2713819 - protein, 18 aa, Entamoeba histolytica
GTNHYFAMKILIKKQMEE

SEQ ID NO: 2713820 - protein, 22 aa, Entamoeba histolytica
GTPEIILMATGTEVDIAINAAE

SEQ ID NO: 2713821 - protein, 24 aa, Entamoeba histolytica
GTPPKFLEPLPKLSRPTLKRTIPG

SEQ ID NO: 2713822 - protein, 22 aa, Entamoeba histolytica
GTPSIYIFDCSCAGRIITWCKK

SEQ ID NO: 2713823 - protein, 17 aa, Entamoeba histolytica
GTQLICICIEKIERSES

SEQ ID NO: 2713824 - protein, 24 aa, Entamoeba histolytica
GTRDGSFIYLNKYTDAKSISHRHA

SEQ ID NO: 2713825 - protein, 25 aa, Entamoeba histolytica
GTRRPLYLQMFNNPKQRTPKCCFAN

SEQ ID NO: 2713826 - protein, 25 aa, Entamoeba histolytica
GTSEGVIFGWIKKQKKFELIFAVYA

SEQ ID NO: 2713827 - protein, 27 aa, Entamoeba histolytica
GTSLRLQTIIKMKYYLKKQISEKEMYY

SEQ ID NO: 2713828 - protein, 23 aa, Entamoeba histolytica
GTSTYLALNWKSTGAGVIGCIPL

SEQ ID NO: 2713829 - protein, 25 aa, Entamoeba histolytica
GTTDKKVMVWVIKPSSQNENSLLEF

SEQ ID NO: 2713830 - protein, 23 aa, Entamoeba histolytica
GTTKTFISEIPKWGTKNYDCSKD

SEQ ID NO: 2713831 - protein, 22 aa, Entamoeba histolytica
GTTKYCSHFLRGKQCINPDCTY

SEQ ID NO: 2713832 - protein, 18 aa, Entamoeba histolytica
GTTLLILDRSFDPITPLL

SEQ ID NO: 2713833 - protein, 19 aa, Entamoeba histolytica
GTTLLILDRSFDPITPLLT

SEQ ID NO: 2713834 - protein, 23 aa, Entamoeba histolytica
GTTRTKAVLWSRQFSSFNVIKFN

SEQ ID NO: 2713835 - protein, 25 aa, Entamoeba histolytica
GTVAKLIMIIKLIKDIIIMADIGID

SEQ ID NO: 2713836 - protein, 27 aa, Entamoeba histolytica
GTVLNSFREIAPLYLKKKNKKFEKKQA

SEQ ID NO: 2713837 - protein, 21 aa, Entamoeba histolytica
GTVYFHTILLNLKFGSYETIL

SEQ ID NO: 2713838 - protein, 17 aa, Entamoeba histolytica
GTYQIKIPIGYDSPNPI

SEQ ID NO: 2713839 - protein, 31 aa, Entamoeba histolytica; identical to SEQ ID NO: 2525834

SEQ ID NO: 2713840 - protein, 20 aa, Entamoeba histolytica
GVCSWYDGPCLVELLDSIKL

SEQ ID NO: 2713841 - protein, 28 aa, Entamoeba histolytica
GVDIIHLPPKFVDFALTPFGCIIIQERG

SEQ ID NO: 2713842 - protein, 22 aa, Entamoeba histolytica
GVDPMDIFEQFFGGSSFGGKKR

SEQ ID NO: 2713843 - protein, 19 aa, Entamoeba histolytica
GVDWIVQYDCPEDTAQYIH

SEQ ID NO: 2713844 - protein, 18 aa, Entamoeba histolytica
GVDWWSLGILIYEMIVGI

SEQ ID NO: 2713845 - protein, 17 aa, Entamoeba histolytica
GVEKIRQLYKKCEMKVP

SEQ ID NO: 2713846 - protein, 25 aa, Entamoeba histolytica
GVEKKIHFGILLVDAIFPITDIPED

SEQ ID NO: 2713847 - protein, 20 aa, Entamoeba histolytica
GVELFRYNSIAIYDVDIKRV

SEQ ID NO: 2713848 - protein, 34 aa, Entamoeba histolytica
GVENFKRVGMLHFLTYYYGMDWHKVANAPQGDNS

SEQ ID NO: 2713849 - protein, 29 aa, Entamoeba histolytica
GVEQVPKKWWKFAFDSLLIEVKKKNYKES

SEQ ID NO: 2713850 - protein, 26 aa, Entamoeba histolytica
GVEVLCLLYALKIKYPDNIHFIRGNH

SEQ ID NO: 2713851 - protein, 24 aa, Entamoeba histolytica
GVFEIVPKKIYQVRAFTLDLANFT

SEQ ID NO: 2713852 - protein, 24 aa, Entamoeba histolytica
GVFEVPIINFSFKAPIIGIDIIDQ

SEQ ID NO: 2713853 - protein, 27 aa, Entamoeba histolytica
GVFKNELILFYMFYVMVGEESQLKAAK

SEQ ID NO: 2713854 - protein, 22 aa, Entamoeba histolytica
GVGARFWPLSRESKPKQFLDIM

SEQ ID NO: 2713855 - protein, 18 aa, Entamoeba histolytica
GVGIAFIRKSRSFEDTHV

SEQ ID NO: 2713856 - protein, 20 aa, Entamoeba histolytica
GVGINEMFETLTKEIVALPK

SEQ ID NO: 2713857 - protein, 18 aa, Entamoeba histolytica
GVGITVKPKFAMDGDEIN

SEQ ID NO: 2713858 - protein, 26 aa, Entamoeba histolytica
GVHVAACIIKLFLRELSDCLIPMQFY

SEQ ID NO: 2713859 - protein, 17 aa, Entamoeba histolytica
GVHWLKGKTLKEILEKK

SEQ ID NO: 2713860 - protein, 29 aa, Entamoeba histolytica
GVIEILIPLLQQEKILYKIFHYQKNQLVK

SEQ ID NO: 2713861 - protein, 25 aa, Entamoeba histolytica
GVIFDKSIRIINIADKSLFVEKEIK

SEQ ID NO: 2713862 - protein, 23 aa, Entamoeba histolytica
GVIKAFGAFYILPSSILNSYEYS

SEQ ID NO: 2713863 - protein, 30 aa, Entamoeba histolytica
GVKKTSNTAILLHKVLFGTSGYADVRKKEI

SEQ ID NO: 2713864 - protein, 20 aa, Entamoeba histolytica
GVKSILTYDCPCAIILTCDK

SEQ ID NO: 2713865 - protein, 18 aa, Entamoeba histolytica
GVKVIFADETVVNYLIDM

SEQ ID NO: 2713866 - protein, 21 aa, Entamoeba histolytica
GVKWMYELFKQHAGGIVGDEM

SEQ ID NO: 2713867 - protein, 20 aa, Entamoeba histolytica
GVLAVWLALLEGEKVIITST

SEQ ID NO: 2713868 - protein, 25 aa, Entamoeba histolytica
GVLGNLKVIIPWSDLLHKPIEVVLS

SEQ ID NO: 2713869 - protein, 20 aa, Entamoeba histolytica
GVLLFGTIDTWIIYNLTGGQ

SEQ ID NO: 2713870 - protein, 25 aa, Entamoeba histolytica
GVLLLEILLRFYGAQHISIFMDLLN

SEQ ID NO: 2713871 - protein, 22 aa, Entamoeba histolytica
GVLLSKMSVIIPYIYTQFKCDG

SEQ ID NO: 2713872 - protein, 28 aa, Entamoeba histolytica
GVLMKEGYLLKRWKERFVVVKNSYLFYF

SEQ ID NO: 2713873 - protein, 23 aa, Entamoeba histolytica
GVLPSCKDYIFYCKKCGERCIQI

SEQ ID NO: 2713874 - protein, 23 aa, Entamoeba histolytica
GVLQFLPYIKQLNKIRIEILLRV

SEQ ID NO: 2713875 - protein, 19 aa, Entamoeba histolytica
GVLSPYHALLAHILFAKKE

SEQ ID NO: 2713876 - protein, 19 aa, Entamoeba histolytica
GVLSYKYSSKFIKILATKI

SEQ ID NO: 2713877 - protein, 17 aa, Entamoeba histolytica
GVMAVIVWRKKGSDQCF

SEQ ID NO: 2713878 - protein, 38 aa, Entamoeba histolytica; identical to SEQ ID NO: 2525863

SEQ ID NO: 2713879 - protein, 32 aa, Entamoeba histolytica
GVNFLLCICNDIRFPAFLRNLKLEYDVILCSI

SEQ ID NO: 2713880 - protein, 29 aa, Entamoeba histolytica
GVNPSVIAPLHFLAKLKIMVVKDIERDDI

SEQ ID NO: 2713881 - protein, 25 aa, Entamoeba histolytica
GVNTKGYVIASPLPPKVTTPSVKSS

SEQ ID NO: 2713882 - protein, 24 aa, Entamoeba histolytica
GVNVGLREMFRRVIYSRNFEELET

SEQ ID NO: 2713883 - protein, 20 aa, Entamoeba histolytica
GVPEKGKYPLGLSFEIVNQS

SEQ ID NO: 2713884 - protein, 17 aa, Entamoeba histolytica
GVPLTILSLLGLYLDLI

SEQ ID NO: 2713885 - protein, 19 aa, Entamoeba histolytica
GVPPMIPGAIPPGIPMYPP

SEQ ID NO: 2713886 - protein, 22 aa, Entamoeba histolytica
GVRSVLFLDNYLVIGGGSGSVS

SEQ ID NO: 2713887 - protein, 27 aa, Entamoeba histolytica
GVRVLHMNFLLHRDLKPANILISEDDV

SEQ ID NO: 2713888 - protein, 17 aa, Entamoeba histolytica
GVRYRLQATLQIVPLKI

SEQ ID NO: 2713889 - protein, 23 aa, Entamoeba histolytica
GVSIKIIIYESPFFMDVVKGEKK

SEQ ID NO: 2713890 - protein, 18 aa, Entamoeba histolytica
GVSINLGKTKFSAKEAKL

SEQ ID NO: 2713891 - protein, 24 aa, Entamoeba histolytica
GVTGFFVSPIYKIEEKVGILESRL

SEQ ID NO: 2713892 - protein, 32 aa, Entamoeba histolytica
GVVIGNSYLLLHLYNHLIKIVPLPREEENLPE

SEQ ID NO: 2713893 - protein, 29 aa, Entamoeba histolytica
GVVPIKKPFRGGFDSCWLCEKGIESINFF

SEQ ID NO: 2713894 - protein, 24 aa, Entamoeba histolytica
GVVQPIIYVLKNRSLFTSDDVLNC

SEQ ID NO: 2713895 - protein, 18 aa, Entamoeba histolytica
GWGVEVYLLTRDNLTIYN

SEQ ID NO: 2713896 - protein, 18 aa, Entamoeba histolytica
GWIDIRINLSTKIKKYYY

SEQ ID NO: 2713897 - protein, 20 aa, Entamoeba histolytica
GWIDIRINLSTKIKKYYYVL

SEQ ID NO: 2713898 - protein, 18 aa, Entamoeba histolytica
GWINVKWESGKVNQYRWG

SEQ ID NO: 2713899 - protein, 18 aa, Entamoeba histolytica
GWITINSTPLFIARLIQM

SEQ ID NO: 2713900 - protein, 27 aa, Entamoeba histolytica
GWKINLAICYDLRFPNWLRNSKEDPYD

SEQ ID NO: 2713901 - protein, 19 aa, Entamoeba histolytica
GWKVIVADWGAEACGDAVR

SEQ ID NO: 2713902 - protein, 18 aa, Entamoeba histolytica
GWRLPLGNSFKFLNEIIS

SEQ ID NO: 2713903 - protein, 29 aa, Entamoeba histolytica
GWVRVQIQLFTLWMDEVLQQRQMGVKDLA

SEQ ID NO: 2713904 - protein, 24 aa, Entamoeba histolytica
GWVSNYFILKDGKLIHYRSSDNFL

SEQ ID NO: 2713905 - protein, 25 aa, Entamoeba histolytica
GYACEFEVFITIKCTTKIKDKIMII

SEQ ID NO: 2713906 - protein, 34 aa, Entamoeba histolytica
GYAGYYDACGELRLWNCQLYLPFPIEDKLNPIDP

SEQ ID NO: 2713907 - protein, 25 aa, Entamoeba histolytica
GYDEFLQFYGVFNLKTYKYVCSRKQ

SEQ ID NO: 2713908 - protein, 19 aa, Entamoeba histolytica
GYDRYLPVIMEIPCKDHPY

SEQ ID NO: 2713909 - protein, 20 aa, Entamoeba histolytica
GYDSFISEFSSCYPNILFSL

SEQ ID NO: 2713910 - protein, 21 aa, Entamoeba histolytica
GYEITILYPNFHGRVNYRIEE

SEQ ID NO: 2713911 - protein, 23 aa, Entamoeba histolytica
GYEKDICMRIMKIWINQKDRTMH

SEQ ID NO: 2713912 - protein, 26 aa, Entamoeba histolytica
GYETFCSIAIMKITKRGVAKKLSSKE

SEQ ID NO: 2713913 - protein, 20 aa, Entamoeba histolytica
GYFGTILKWANEIKKIGVFA

SEQ ID NO: 2713914 - protein, 23 aa, Entamoeba histolytica
GYFICDYIYIITTFITKGTEFIT

SEQ ID NO: 2713915 - protein, 18 aa, Entamoeba histolytica
GYFIKQYIDRLRLTQTRH

SEQ ID NO: 2713916 - protein, 21 aa, Entamoeba histolytica
GYFVNVFNNGQIHIGSMSLFE

SEQ ID NO: 2713917 - protein, 25 aa, Entamoeba histolytica
GYGATNLLLERLMYSSDAFKVCVCK

SEQ ID NO: 2713918 - protein, 17 aa, Entamoeba histolytica
GYGFVTFKTAEQQKKAI

SEQ ID NO: 2713919 - protein, 23 aa, Entamoeba histolytica
GYGHYFSYILNDGKWIEFNDSRV

SEQ ID NO: 2713920 - protein, 25 aa, Entamoeba histolytica
GYGIDILTFLIDEYPMIFKEELEKH

SEQ ID NO: 2713921 - protein, 26 aa, Entamoeba histolytica
GYIDSIRDFIKPFMLRRLKTDVQKEL

SEQ ID NO: 2713922 - protein, 17 aa, Entamoeba histolytica
GYILYYCKAGDGVVDLS

SEQ ID NO: 2713923 - protein, 24 aa, Entamoeba histolytica
GYIMMPLNPLYTKPQLERLLPRVN

SEQ ID NO: 2713924 - protein, 25 aa, Entamoeba histolytica
GYINEECFLLWLFDEVIPFATEQRK

SEQ ID NO: 2713925 - protein, 18 aa, Entamoeba histolytica
GYKKGNVQLVLLIGGTCE

SEQ ID NO: 2713926 - protein, 21 aa, Entamoeba histolytica
GYKKGNVQLVLLIGGTSKMPR

SEQ ID NO: 2713927 - protein, 28 aa, Entamoeba histolytica
GYKNWKKRYFVLKDKKLWYFDNKDSVSA

SEQ ID NO: 2713928 - protein, 18 aa, Entamoeba histolytica
GYKPRIDVTNACGRLGPA

SEQ ID NO: 2713929 - protein, 18 aa, Entamoeba histolytica
GYLFNVSVMAMCCEPYLV

SEQ ID NO: 2713930 - protein, 22 aa, Entamoeba histolytica
GYLKYYLYNWACPKVEPNKLAI

SEQ ID NO: 2713931 - protein, 20 aa, Entamoeba histolytica
GYLSCKILQPYLSLKELKHK

SEQ ID NO: 2713932 - protein, 19 aa, Entamoeba histolytica
GYMLQILQAIQFLHSNNII

SEQ ID NO: 2713933 - protein, 25 aa, Entamoeba histolytica
GYNLEFTYVIPYEDYFLVSTNKGEI

SEQ ID NO: 2713934 - protein, 21 aa, Entamoeba histolytica
GYNTGYLPTKILKKVEYDLTP

SEQ ID NO: 2713935 - protein, 20 aa, Entamoeba histolytica
GYPSVYRNPTYQAPLSQYPQ

SEQ ID NO: 2713936 - protein, 24 aa, Entamoeba histolytica
GYQEKILNVLPKIVSLDLCSDDTI

SEQ ID NO: 2713937 - protein, 17 aa, Entamoeba histolytica
GYRNFCNKLWNAFKFST

SEQ ID NO: 2713938 - protein, 23 aa, Entamoeba histolytica
GYRNFCNKLWNAFKFSTMNFRKD

SEQ ID NO: 2713939 - protein, 18 aa, Entamoeba histolytica
GYRTSRYERRVDRRDYRN

SEQ ID NO: 2713940 - protein, 22 aa, Entamoeba histolytica
GYSLTISNIIISPKAVFTFDEG

SEQ ID NO: 2713941 - protein, 18 aa, Entamoeba histolytica
GYTPLYISKSIYSLFNEV

SEQ ID NO: 2713942 - protein, 22 aa, Entamoeba histolytica
GYVCINCTQVVFLNTICAPQTI

SEQ ID NO: 2713943 - protein, 18 aa, Entamoeba histolytica
GYVFGSFSSIQIPPPPRL

SEQ ID NO: 2713944 - protein, 21 aa, Entamoeba histolytica
GYYQLLFACSIRKFSTIYLFN

SEQ ID NO: 2713945 - protein, 17 aa, Entamoeba histolytica
GYYSKILCCNKIQLTKT

SEQ ID NO: 2713946 - protein, 20 aa, Entamoeba histolytica
HADFGNCFISTGFGNNEKPK

SEQ ID NO: 2713947 - protein, 27 aa, Entamoeba histolytica
HAHGRLEELLIWAFNKQIITKDNKNIL

SEQ ID NO: 2713948 - protein, 21 aa, Entamoeba histolytica
HAIDLLKRIFLIASRPDRQND

SEQ ID NO: 2713949 - protein, 17 aa, Entamoeba histolytica
HAIQYFIDNLQLETLEI

SEQ ID NO: 2713950 - protein, 17 aa, Entamoeba histolytica
HAIQYKIDHLNKLWSTV

SEQ ID NO: 2713951 - protein, 24 aa, Entamoeba histolytica
HAKVPLEYVFPFIKNLFQTHCKDQ

SEQ ID NO: 2713952 - protein, 26 aa, Entamoeba histolytica
HALFVEGLSLYHKDWKRIEGHVKTKT

SEQ ID NO: 2713953 - protein, 19 aa, Entamoeba histolytica
HALGAVMYEILLDGKRIVY

SEQ ID NO: 2713954 - protein, 19 aa, Entamoeba histolytica
HALIWLEEVLKNWDGTLLI

SEQ ID NO: 2713955 - protein, 20 aa, Entamoeba histolytica
HALQFLYLDPHIVQPSFKSF

SEQ ID NO: 2713956 - protein, 28 aa, Entamoeba histolytica
HALRWGVPVLSHQWLFDCIAERRLLSIN

SEQ ID NO: 2713957 - protein, 29 aa, Entamoeba histolytica
HAMNRQGIIPIFLYATLGADALDYIVKKM

SEQ ID NO: 2713958 - protein, 26 aa, Entamoeba histolytica
HANIKVEGFWPIIMAKALTNANIEDL

SEQ ID NO: 2713959 - protein, 21 aa, Entamoeba histolytica
HAREFLKKPIEIICGGRSQVS

SEQ ID NO: 2713960 - protein, 17 aa, Entamoeba histolytica
HARFIVRSFKINEMEFF

SEQ ID NO: 2713961 - protein, 24 aa, Entamoeba histolytica
HARHVILSYFYQFSPLKATYSQDE

SEQ ID NO: 2713962 - protein, 30 aa, Entamoeba histolytica
HARTYLSTDIFRRILEDYFGYQVIQCMNIT

SEQ ID NO: 2713963 - protein, 24 aa, Entamoeba histolytica
HCDELTSCVILLLTKEFMGSKIRR

SEQ ID NO: 2713964 - protein, 24 aa, Entamoeba histolytica
HCDKLQAIYFPRELKILRIYKCPL

SEQ ID NO: 2713965 - protein, 28 aa, Entamoeba histolytica
HCDLLSIAIIPFKFLSKFYELSLQYRKI

SEQ ID NO: 2713966 - protein, 17 aa, Entamoeba histolytica
HCESFPHYLEINGSIPS

SEQ ID NO: 2713967 - protein, 25 aa, Entamoeba histolytica
HCGDSTAFALKKRKLKKLTHDQNTS

SEQ ID NO: 2713968 - protein, 17 aa, Entamoeba histolytica
HCICTIPPPSFMDVIQS

SEQ ID NO: 2713969 - protein, 17 aa, Entamoeba histolytica
HCIFTVTVQIIRDSDFE

SEQ ID NO: 2713970 - protein, 17 aa, Entamoeba histolytica
HCKILPNGNYEIGVHIA

SEQ ID NO: 2713971 - protein, 19 aa, Entamoeba histolytica
HCKKLKRIKISALLFDSFK

SEQ ID NO: 2713972 - protein, 17 aa, Entamoeba histolytica
HCKYENLKYIPIKNIRK

SEQ ID NO: 2713973 - protein, 24 aa, Entamoeba histolytica
HCMIKSLYLLLLDSLDYSVFILFN

SEQ ID NO: 2713974 - protein, 18 aa, Entamoeba histolytica
HCNTTCSVISLLKSKMKV

SEQ ID NO: 2713975 - protein, 27 aa, Entamoeba histolytica
HCRAFEVFMIGIILEKIRLVPSKSTTE

SEQ ID NO: 2713976 - protein, 27 aa, Entamoeba histolytica
HCSHLLAIELPPFLKLIKSHCFSNCSC

SEQ ID NO: 2713977 - protein, 33 aa, Entamoeba histolytica
HDDHIGTAFKNGFWYLLEKSGIIFDKFIDRDSG

SEQ ID NO: 2713978 - protein, 27 aa, Entamoeba histolytica
HDDSMFCFLLKTKRIISVPKKWNIKKS

SEQ ID NO: 2713979 - protein, 25 aa, Entamoeba histolytica
HDELTFLIPEIDFSPLFDPTQISAE

SEQ ID NO: 2713980 - protein, 20 aa, Entamoeba histolytica
HDFVKNKIMLALVFKKWWGD

SEQ ID NO: 2713981 - protein, 23 aa, Entamoeba histolytica
HDGAIWDLQWHPVGHLLASCAHD

SEQ ID NO: 2713982 - protein, 37 aa, Entamoeba histolytica
HDGITRPPFVQLLLKVNPAMYLYPLQTKPIGDCTSII

SEQ ID NO: 2713983 - protein, 25 aa, Entamoeba histolytica
HDGTYDIVFVPPYAGNYLIAVYVND

SEQ ID NO: 2713984 - protein, 28 aa, Entamoeba histolytica
HDIDSIFCFHYPGCALIFNWFSVSSKTR

SEQ ID NO: 2713985 - protein, 17 aa, Entamoeba histolytica
HDILIISCYCYGKLIPK

SEQ ID NO: 2713986 - protein, 18 aa, Entamoeba histolytica
HDIPIQRQALKQATIKEE

SEQ ID NO: 2713987 - protein, 24 aa, Entamoeba histolytica
HDKDKICFYCRQPGHCLKNCPKKA

SEQ ID NO: 2713988 - protein, 27 aa, Entamoeba histolytica
HDKDLRSLLLTDLRFSPDGSYLSVADD

SEQ ID NO: 2713989 - protein, 25 aa, Entamoeba histolytica
HDKKIIWSTIIPFKVRSIIATETHV

SEQ ID NO: 2713990 - protein, 17 aa, Entamoeba histolytica
HDKMYWKESIIFTQTGV

SEQ ID NO: 2713991 - protein, 18 aa, Entamoeba histolytica
HDLIPLVELVFGGRRRRF

SEQ ID NO: 2713992 - protein, 39 aa, Entamoeba histolytica
HDNKYQITTIFKLKDTALLKRLKDFMLIKVIQGSVHVPQ

SEQ ID NO: 2713993 - protein, 17 aa, Entamoeba histolytica
HDPFILLRVIYLCKTAN

SEQ ID NO: 2713994 - protein, 20 aa, Entamoeba histolytica
HDRFFIHRDIKPDNFVMGMR

SEQ ID NO: 2713995 - protein, 24 aa, Entamoeba histolytica
HDSKNIVILEQLKHWFTPMIISDG

SEQ ID NO: 2713996 - protein, 30 aa, Entamoeba histolytica; identical to SEQ ID NO: 2517583

SEQ ID NO: 2713997 - protein, 34 aa, Entamoeba histolytica
HDTSPKQFLIVIPKFFYELIQQIKNELSKLGFVV

SEQ ID NO: 2713998 - protein, 17 aa, Entamoeba histolytica
HDVSFFLRPKHLKQWAD

SEQ ID NO: 2713999 - protein, 22 aa, Entamoeba histolytica
HDYISQLTICDNTIFAAGGDGC

SEQ ID NO: 2714000 - protein, 21 aa, Entamoeba histolytica
HDYITGIEYLKPMLTTCGIIL

SEQ ID NO: 2714001 - protein, 24 aa, Entamoeba histolytica
HEDMLFRIKFDLYNPQREKIETLY

SEQ ID NO: 2714002 - protein, 21 aa, Entamoeba histolytica
HEECLYCCYLYNILSKSKKEY

SEQ ID NO: 2714003 - protein, 24 aa, Entamoeba histolytica
HEEGKLKIYLYPNEPFNHKDENDA

SEQ ID NO: 2714004 - protein, 29 aa, Entamoeba histolytica
HEEKRKILLPFISRYYTLTSKLYQLFDLS

SEQ ID NO: 2714005 - protein, 28 aa, Entamoeba histolytica
HEEQYMRNFIYFLPYVMKHRDVYATIMN

SEQ ID NO: 2714006 - protein, 24 aa, Entamoeba histolytica
HEFVQLYYALFQSRVDELLKMYHQ

SEQ ID NO: 2714007 - protein, 21 aa, Entamoeba histolytica
HEIIPALRILGFFVNQRTAIV

SEQ ID NO: 2714008 - protein, 25 aa, Entamoeba histolytica
HEKEEYFEILLPLLGTLVEDKEVNI

SEQ ID NO: 2714009 - protein, 30 aa, Entamoeba histolytica
HELPKQPLKAPPLPPLPKGAKPKVSPNPNS

SEQ ID NO: 2714010 - protein, 25 aa, Entamoeba histolytica
HENGKLKIYLYPNQEFNQIDESDAI

SEQ ID NO: 2714011 - protein, 26 aa, Entamoeba histolytica
HENIKKGILLLLFGGVHKTTKEGIAL

SEQ ID NO: 2714012 - protein, 19 aa, Entamoeba histolytica
HENIVRFYGVIVKKQFSMV

SEQ ID NO: 2714013 - protein, 33 aa, Entamoeba histolytica
HENLAYHSMNLWLEYLLLCRNSNDFKLSQKIKS

SEQ ID NO: 2714014 - protein, 24 aa, Entamoeba histolytica
HENLDIIVSSPFYRATQTAKFIAE

SEQ ID NO: 2714015 - protein, 23 aa, Entamoeba histolytica
HERYSCVVTTFYRGSDCCVLCFD

SEQ ID NO: 2714016 - protein, 17 aa, Entamoeba histolytica
HESDDVLMLITNQLKKD

SEQ ID NO: 2714017 - protein, 17 aa, Entamoeba histolytica
HESLLLINCKDNKPFGG

SEQ ID NO: 2714018 - protein, 25 aa, Entamoeba histolytica
HETKHILEAIQFNDILISSNGALSL

SEQ ID NO: 2714019 - protein, 29 aa, Entamoeba histolytica
HETSAPWLQILLFRLLSTIDLETTTQKIF

SEQ ID NO: 2714020 - protein, 18 aa, Entamoeba histolytica
HEVKLKRLDKKGISQSDN

SEQ ID NO: 2714021 - protein, 25 aa, Entamoeba histolytica
HEVTYIFVYGYGRVAFMCGGLGCLL

SEQ ID NO: 2714022 - protein, 29 aa, Entamoeba histolytica
HEVYHCIAIIPFDSYIFVLDGRKGSYCVL

SEQ ID NO: 2714023 - protein, 32 aa, Entamoeba histolytica
HEYFIEIISQLYWLRHNLLATLGLSIGFSSFR

SEQ ID NO: 2714024 - protein, 17 aa, Entamoeba histolytica
HFARILKKHLMTENNLG

SEQ ID NO: 2714025 - protein, 31 aa, Entamoeba histolytica
HFARSYHFMFPIEPFKVIAMIKPQEKCFGCG

SEQ ID NO: 2714026 - protein, 23 aa, Entamoeba histolytica
HFCDYVWRDLLGNKTFLWNERFP

SEQ ID NO: 2714027 - protein, 20 aa, Entamoeba histolytica
HFDHEIIYKLFIYSLEFSQH

SEQ ID NO: 2714028 - protein, 24 aa, Entamoeba histolytica
HFDKLYFIHLVVIAEFEQAEEYLL

SEQ ID NO: 2714029 - protein, 25 aa, Entamoeba histolytica
HFEGETFILTRKSYLQQFTVLMEKM

SEQ ID NO: 2714030 - protein, 30 aa, Entamoeba histolytica
HFELEEPMYQPLLLTELLKLLRSICMKCHS

SEQ ID NO: 2714031 - protein, 17 aa, Entamoeba histolytica
HFENACLPRYPISLIEQ

SEQ ID NO: 2714032 - protein, 18 aa, Entamoeba histolytica
HFENACLPRYPISLIEQV

SEQ ID NO: 2714033 - protein, 24 aa, Entamoeba histolytica
HFEVFKLLCKLFTEIINRKPTNKM

SEQ ID NO: 2714034 - protein, 21 aa, Entamoeba histolytica
HFFPKLPKKIKINKEYTLAMV

SEQ ID NO: 2714035 - protein, 25 aa, Entamoeba histolytica
HFGRNDPDFKWEFPKELEIPAELKP

SEQ ID NO: 2714036 - protein, 18 aa, Entamoeba histolytica
HFIFKDNTSPTASVDLVK

SEQ ID NO: 2714037 - protein, 33 aa, Entamoeba histolytica
HFIQKNWINEPISSIFYCIIKRIKNDFEANIYD

SEQ ID NO: 2714038 - protein, 29 aa, Entamoeba histolytica
HFISLSRNFPDLFPSFLSSSLLPDSLDYW

SEQ ID NO: 2714039 - protein, 19 aa, Entamoeba histolytica
HFITQKRTILTLPQRDFSS

SEQ ID NO: 2714040 - protein, 19 aa, Entamoeba histolytica
HFKASQFIVVSLKSGMFDN

SEQ ID NO: 2714041 - protein, 18 aa, Entamoeba histolytica
HFKEILTSSFVQAKKNLT

SEQ ID NO: 2714042 - protein, 26 aa, Entamoeba histolytica
HFKKLKQWIGLSKYKIIFDSYFDDLV

SEQ ID NO: 2714043 - protein, 23 aa, Entamoeba histolytica
HFKKNCRYDYQPEICKDFYETGY

SEQ ID NO: 2714044 - protein, 18 aa, Entamoeba histolytica
HFKLIYQMSYRKPNNLKK

SEQ ID NO: 2714045 - protein, 27 aa, Entamoeba histolytica
HFKQTPIPKPAAPPPPSILLSPKHRAP

SEQ ID NO: 2714046 - protein, 26 aa, Entamoeba histolytica
HFKSTDIIFIYMYKMFTIKHIGETCF

SEQ ID NO: 2714047 - protein, 18 aa, Entamoeba histolytica
HFKTILRKIYHRVAQSRS

SEQ ID NO: 2714048 - protein, 20 aa, Entamoeba histolytica
HFLIDLLENEGYFFNSSYSS

SEQ ID NO: 2714049 - protein, 19 aa, Entamoeba histolytica
HFLQRPFEEAALKQPLKII

SEQ ID NO: 2714050 - protein, 25 aa, Entamoeba histolytica
HFLSEICSGLWYLHFNKHLLHRDLK

SEQ ID NO: 2714051 - protein, 18 aa, Entamoeba histolytica
HFNISWLKITFIEFSIHS

SEQ ID NO: 2714052 - protein, 18 aa, Entamoeba histolytica
HFNKSNHLSLLSYFNDYF

SEQ ID NO: 2714053 - protein, 25 aa, Entamoeba histolytica
HFNTTPLRMLILDEADRILDMGFKK

SEQ ID NO: 2714054 - protein, 24 aa, Entamoeba histolytica
HFPDDFYHLPDCINVIPIQTISST

SEQ ID NO: 2714055 - protein, 25 aa, Entamoeba histolytica
HFRIVAVLLKYWLKIRNLNCPFKGG

SEQ ID NO: 2714056 - protein, 17 aa, Entamoeba histolytica
HFRSFILNIKTKSNITL

SEQ ID NO: 2714057 - protein, 17 aa, Entamoeba histolytica
HFSEMISLKYLSITFTQ

SEQ ID NO: 2714058 - protein, 26 aa, Entamoeba histolytica
HFTLDHLTLCLYPEFIGDTLTYINSI

SEQ ID NO: 2714059 - protein, 27 aa, Entamoeba histolytica
HFTPEVISLWYRAPEILLKMPSYTSAV

SEQ ID NO: 2714060 - protein, 17 aa, Entamoeba histolytica
HFTSKPLLPTKTPRDKA

SEQ ID NO: 2714061 - protein, 17 aa, Entamoeba histolytica
HGDATETLSQPGSASAG

SEQ ID NO: 2714062 - protein, 23 aa, Entamoeba histolytica
HGDLYIHFEVVLPSKEEINKNIS

SEQ ID NO: 2714063 - protein, 25 aa, Entamoeba histolytica
HGEKMRLICIINHYGSLDAGHYNCW

SEQ ID NO: 2714064 - protein, 34 aa, Entamoeba histolytica
HGERIIKIFLIRWENNFHYVPDEKVPLTTYFIHH

SEQ ID NO: 2714065 - protein, 30 aa, Entamoeba histolytica
HGERTIKIFLIRWKNNFHYVPDEKVPLTTY

SEQ ID NO: 2714066 - protein, 19 aa, Entamoeba histolytica
HGFSSIKLIPYQEDVILYL

SEQ ID NO: 2714067 - protein, 34 aa, Entamoeba histolytica; identical to SEQ ID NO: 2526077

SEQ ID NO: 2714068 - protein, 18 aa, Entamoeba histolytica
HGGHYFSNRLINGKWVCF

SEQ ID NO: 2714069 - protein, 38 aa, Entamoeba histolytica
HGGVVIEKGRREYWRIVNNKVRIWDRSGKIEELSGNEI

SEQ ID NO: 2714070 - protein, 19 aa, Entamoeba histolytica
HGILLYGPPGTGKTLLAKA

SEQ ID NO: 2714071 - protein, 28 aa, Entamoeba histolytica
HGIPFSIRYIIWKYLLRYIPVEHKRVEL

SEQ ID NO: 2714072 - protein, 19 aa, Entamoeba histolytica
HGIQRLKTIYCDRIDCGQL

SEQ ID NO: 2714073 - protein, 25 aa, Entamoeba histolytica
HGIYLTYFSDYALFYSNSRNSNQMV

SEQ ID NO: 2714074 - protein, 23 aa, Entamoeba histolytica
HGKAFILDTFNEVFVYYGTGCPK

SEQ ID NO: 2714075 - protein, 21 aa, Entamoeba histolytica
HGKTFWARRSLNIYNGLIALY

SEQ ID NO: 2714076 - protein, 18 aa, Entamoeba histolytica
HGLGYYITTHYGISHGFA

SEQ ID NO: 2714077 - protein, 31 aa, Entamoeba histolytica
HGLIHTYRVVLFSLIIGYYTKNRRFGLLASC

SEQ ID NO: 2714078 - protein, 20 aa, Entamoeba histolytica
HGLYWVTMVLVDNNLIFLTK

SEQ ID NO: 2714079 - protein, 24 aa, Entamoeba histolytica
HGNIQNYAMQLLRKLMGYNNGMDR

SEQ ID NO: 2714080 - protein, 18 aa, Entamoeba histolytica
HGPPGCGKTLLAKAIAGE

SEQ ID NO: 2714081 - protein, 23 aa, Entamoeba histolytica
HGQFFDLLRIFYQNGIPPDKKYL

SEQ ID NO: 2714082 - protein, 23 aa, Entamoeba histolytica
HGQFYDLMKLFSIGGSLPENSYI

SEQ ID NO: 2714083 - protein, 17 aa, Entamoeba histolytica
HGQFYDMLTIFDVRPPE

SEQ ID NO: 2714084 - protein, 36 aa, Entamoeba histolytica; identical to SEQ ID NO: 2526096

SEQ ID NO: 2714085 - protein, 22 aa, Entamoeba histolytica
HGQYSPIFFQFLDCVNILIHQF

SEQ ID NO: 2714086 - protein, 24 aa, Entamoeba histolytica
HGTHRQFILPKTNYLLLCGDFTIR

SEQ ID NO: 2714087 - protein, 30 aa, Entamoeba histolytica
HGVSMPWLVIVLIKLIPLICIEKREIISFQ

SEQ ID NO: 2714088 - protein, 19 aa, Entamoeba histolytica
HGVVENIIQILFMMMILQN

SEQ ID NO: 2714089 - protein, 37 aa, Entamoeba histolytica
HGYLKMVGISYSFMYKWIILLFRRDFPHMACVRLWDA

SEQ ID NO: 2714090 - protein, 18 aa, Entamoeba histolytica
HGYPLLKKYKHLIGHFGT

SEQ ID NO: 2714091 - protein, 27 aa, Entamoeba histolytica
HHCLSYIHHYFPKRLKVIKKLIPLIKT

SEQ ID NO: 2714092 - protein, 20 aa, Entamoeba histolytica
HHDPKIPVLALLLGENIRSD

SEQ ID NO: 2714093 - protein, 18 aa, Entamoeba histolytica
HHIAGVPQIPLVVNSKSI

SEQ ID NO: 2714094 - protein, 18 aa, Entamoeba histolytica
HHILVPQHILLSPEEKQE

SEQ ID NO: 2714095 - protein, 23 aa, Entamoeba histolytica
HHKTIMRMLQPAITKGLIEIKSL

SEQ ID NO: 2714096 - protein, 18 aa, Entamoeba histolytica
HHLPKGLIQCASLQSLDL

SEQ ID NO: 2714097 - protein, 29 aa, Entamoeba histolytica
HHNQLDIQMYMRIAPELYLKELVVGGINR

SEQ ID NO: 2714098 - protein, 24 aa, Entamoeba histolytica
HHNSELAMFLLRRALRNKNRIGHQ

SEQ ID NO: 2714099 - protein, 23 aa, Entamoeba histolytica
HHQYHYYPDYYLINSTLMFDIYN

SEQ ID NO: 2714100 - protein, 24 aa, Entamoeba histolytica
HHRCEGFALDWSPVVEGRLITGTL

SEQ ID NO: 2714101 - protein, 17 aa, Entamoeba histolytica
HHRSVIFSSYNNLQLEK

SEQ ID NO: 2714102 - protein, 17 aa, Entamoeba histolytica
HHTDPFIISSMRADIET

SEQ ID NO: 2714103 - protein, 17 aa, Entamoeba histolytica
HHYNLFHQFNHVSPFDA

SEQ ID NO: 2714104 - protein, 23 aa, Entamoeba histolytica
HHYSHPLIPTTPYTDNQLLSSTS

SEQ ID NO: 2714105 - protein, 17 aa, Entamoeba histolytica
HIARLEYKYGSVDKGRS

SEQ ID NO: 2714106 - protein, 31 aa, Entamoeba histolytica
HIDCTGYLYRMTLWEVPLLAIVSELYQKMTH

SEQ ID NO: 2714107 - protein, 20 aa, Entamoeba histolytica
HIDFGIVFEFGKKLPIPEIV

SEQ ID NO: 2714108 - protein, 22 aa, Entamoeba histolytica
HIDFLTVPHPFYNKRSICLICA

SEQ ID NO: 2714109 - protein, 24 aa, Entamoeba histolytica
HIEGNFIYFISNYKAVMLFRSGIK

SEQ ID NO: 2714110 - protein, 23 aa, Entamoeba histolytica
HIEIITMERLQFSSLFVQSVKGC

SEQ ID NO: 2714111 - protein, 24 aa, Entamoeba histolytica
HIELKILHIFSSKGTFTCITPNGQ

SEQ ID NO: 2714112 - protein, 24 aa, Entamoeba histolytica
HIEQPFFERTIPEVKIRCVGIQRM

SEQ ID NO: 2714113 - protein, 20 aa, Entamoeba histolytica
HIFDIINSYPLKITPCELLD

SEQ ID NO: 2714114 - protein, 18 aa, Entamoeba histolytica
HIFHSLYSRQKVVIFYCL

SEQ ID NO: 2714115 - protein, 19 aa, Entamoeba histolytica
HIHSIFHYKYSAIAYSLSK

SEQ ID NO: 2714116 - protein, 17 aa, Entamoeba histolytica
HIIFHLHLIAQYSQFNL

SEQ ID NO: 2714117 - protein, 17 aa, Entamoeba histolytica
HIIIKPITSFDPIEVIN

SEQ ID NO: 2714118 - protein, 17 aa, Entamoeba histolytica
HIIINQLISIHPLQFRE

SEQ ID NO: 2714119 - protein, 19 aa, Entamoeba histolytica
HIIKGNVLIISDDVKHTNS

SEQ ID NO: 2714120 - protein, 19 aa, Entamoeba histolytica
HIINKFYALKEEARRIGLV

SEQ ID NO: 2714121 - protein, 17 aa, Entamoeba histolytica
HIIQLESLLFQLKPQQL

SEQ ID NO: 2714122 - protein, 17 aa, Entamoeba histolytica
HIIQLKEKHLKEFNDLT

SEQ ID NO: 2714123 - protein, 20 aa, Entamoeba histolytica
HIIRFWDLASMKVAHQLNHH

SEQ ID NO: 2714124 - protein, 18 aa, Entamoeba histolytica
HIKYIVRMLYKFLTCFTL

SEQ ID NO: 2714125 - protein, 18 aa, Entamoeba histolytica
HILKIDVKGYLYIIAKCI

SEQ ID NO: 2714126 - protein, 18 aa, Entamoeba histolytica
HILLFECDSVYLSNELQR

SEQ ID NO: 2714127 - protein, 29 aa, Entamoeba histolytica
HILTLFNSIIPEPMNLHLLLNLVSSIHTR

SEQ ID NO: 2714128 - protein, 18 aa, Entamoeba histolytica
HILVITPNSLVYQWCDQI

SEQ ID NO: 2714129 - protein, 25 aa, Entamoeba histolytica
HINEMVPSILLFSFGDRTVTVYPES

SEQ ID NO: 2714130 - protein, 23 aa, Entamoeba histolytica
HINEPFDRYSIHKNLNSLEVQHS

SEQ ID NO: 2714131 - protein, 17 aa, Entamoeba histolytica
HINLLKENINKEQEEIL

SEQ ID NO: 2714132 - protein, 22 aa, Entamoeba histolytica
HINNLKLEFIRFFKVRQVNINE

SEQ ID NO: 2714133 - protein, 18 aa, Entamoeba histolytica
HINRPYLGILGGAKVADK

SEQ ID NO: 2714134 - protein, 27 aa, Entamoeba histolytica
HINSRRRILALLTLLNEELPDTPLFYA

SEQ ID NO: 2714135 - protein, 17 aa, Entamoeba histolytica
HINSVTPGILLLMEIIK

SEQ ID NO: 2714136 - protein, 17 aa, Entamoeba histolytica
HIPKDCYFYLTGHFQFE

SEQ ID NO: 2714137 - protein, 33 aa, Entamoeba histolytica
HIPSCSCPTLYLIPRIITFTEHQLILDSLALSQ

SEQ ID NO: 2714138 - protein, 19 aa, Entamoeba histolytica
HIQLLRVTPKKRKGEMNSN

SEQ ID NO: 2714139 - protein, 28 aa, Entamoeba histolytica
HIRCHPLCSWVYILLGHLINNYKDDIQS

SEQ ID NO: 2714140 - protein, 31 aa, Entamoeba histolytica
HIRMHSICDGIYLLIGKLLDKYTKAFCTVLQ

SEQ ID NO: 2714141 - protein, 29 aa, Entamoeba histolytica
HIRMLHDYFDILIYTHKYSPYIQLIKQCK

SEQ ID NO: 2714142 - protein, 27 aa, Entamoeba histolytica
HIRRVISQSYFLEYIHSLLGNTCVNCD

SEQ ID NO: 2714143 - protein, 27 aa, Entamoeba histolytica
HISKVDIPYACKLLFQELMSMAVCPRI

SEQ ID NO: 2714144 - protein, 27 aa, Entamoeba histolytica
HISNNTFLWDIFLDNLNLLFFEFQLKH

SEQ ID NO: 2714145 - protein, 27 aa, Entamoeba histolytica
HISTDALIAKLYFYYERAAELCKVTII

SEQ ID NO: 2714146 - protein, 17 aa, Entamoeba histolytica
HISTWLPFMETNDQQLD

SEQ ID NO: 2714147 - protein, 29 aa, Entamoeba histolytica
HISVIDNTLWAFYPDLKKLNVYNDKLQIL

SEQ ID NO: 2714148 - protein, 25 aa, Entamoeba histolytica
HITKPLNGCIFIFNPRTGGVHLKII

SEQ ID NO: 2714149 - protein, 24 aa, Entamoeba histolytica
HITLKQSRFFGIKSIEINRIAIEN

SEQ ID NO: 2714150 - protein, 27 aa, Entamoeba histolytica
HITTKPLIDIIPVFKTINESSTSEKKE

SEQ ID NO: 2714151 - protein, 25 aa, Entamoeba histolytica
HIVHNNLLKFFFIESSIKERTFTFF

SEQ ID NO: 2714152 - protein, 19 aa, Entamoeba histolytica
HIVQRLRKNPRKVEFLIDE

SEQ ID NO: 2714153 - protein, 27 aa, Entamoeba histolytica
HIVRNWLQRWFVLTNDILYYFDEQKLH

SEQ ID NO: 2714154 - protein, 27 aa, Entamoeba histolytica
HIVSIKEPLFRICGLAIHLDTERKYII

SEQ ID NO: 2714155 - protein, 21 aa, Entamoeba histolytica
HIYIYMLEQGYRDAAKVFKKE

SEQ ID NO: 2714156 - protein, 26 aa, Entamoeba histolytica
HIYYSDEKYFYFFNENEFKYDLKEDS

SEQ ID NO: 2714157 - protein, 17 aa, Entamoeba histolytica
HKDDIVALLIGPVADDL

SEQ ID NO: 2714158 - protein, 22 aa, Entamoeba histolytica
HKDLFTEGLLLPNGNPLPILTN

SEQ ID NO: 2714159 - protein, 22 aa, Entamoeba histolytica
HKDRLFHQRISALEGKSILEDV

SEQ ID NO: 2714160 - protein, 41 aa, Entamoeba histolytica
HKDVDIKILILFQSIIRGYLTRRVFGIKLMTKRKAALMEFL

SEQ ID NO: 2714161 - protein, 27 aa, Entamoeba histolytica
HKEDQIYRTIFIQNLSFETSEEELKEK

SEQ ID NO: 2714162 - protein, 26 aa, Entamoeba histolytica
HKEIRLPFCIKILEILIEYLTDNEII

SEQ ID NO: 2714163 - protein, 17 aa, Entamoeba histolytica
HKELILFSYDDCERSIP

SEQ ID NO: 2714164 - protein, 21 aa, Entamoeba histolytica
HKFYEPLKEWTSKQTFKLIYD

SEQ ID NO: 2714165 - protein, 19 aa, Entamoeba histolytica
HKGFMKHVLGYTIEFLLRS

SEQ ID NO: 2714166 - protein, 30 aa, Entamoeba histolytica
HKGQELVKVLLFYQLCSFCLKCFYKELTSA

SEQ ID NO: 2714167 - protein, 24 aa, Entamoeba histolytica
HKHPLDYFFVVSKTCPLLKSEKHL

SEQ ID NO: 2714168 - protein, 17 aa, Entamoeba histolytica
HKHTYKLAKVDSKICRL

SEQ ID NO: 2714169 - protein, 21 aa, Entamoeba histolytica
HKIEPKYDAIPIASDYRQKTN

SEQ ID NO: 2714170 - protein, 36 aa, Entamoeba histolytica
HKIETHLGQIFKLFTPFFKVYFLYISHYDDSNQVLT

SEQ ID NO: 2714171 - protein, 19 aa, Entamoeba histolytica
HKIFKKYIPTMRIEKINEW

SEQ ID NO: 2714172 - protein, 19 aa, Entamoeba histolytica
HKILFQSVLLYSLIKDIIE

SEQ ID NO: 2714173 - protein, 23 aa, Entamoeba histolytica
HKINLMLLNIYYYYIRINQTQTN

SEQ ID NO: 2714174 - protein, 33 aa, Entamoeba histolytica
HKKEIQTFNDFFYALSVILPRSTIGSFKQMIRS

SEQ ID NO: 2714175 - protein, 21 aa, Entamoeba histolytica
HKKGLFDLFSRIKHTTNEEKK

SEQ ID NO: 2714176 - protein, 25 aa, Entamoeba histolytica
HKKLQQIITQQWRSLGVSFKRKYPT

SEQ ID NO: 2714177 - protein, 25 aa, Entamoeba histolytica
HKKTTMVTFFPKTYGFIVMEKDNLG

SEQ ID NO: 2714178 - protein, 27 aa, Entamoeba histolytica
HKLGGMMILCIPPYRLPRDKLDEDIDR

SEQ ID NO: 2714179 - protein, 28 aa, Entamoeba histolytica
HKLGGMMILCIPPYRLPRDKLDEDIDRI

SEQ ID NO: 2714180 - protein, 17 aa, Entamoeba histolytica
HKLVPLYDSEGNEEIII

SEQ ID NO: 2714181 - protein, 23 aa, Entamoeba histolytica
HKMKVTLLRFILENTQYLDEDSI

SEQ ID NO: 2714182 - protein, 29 aa, Entamoeba histolytica
HKNDSVWLKYLVTLPYQFYKEGLEINGNE

SEQ ID NO: 2714183 - protein, 22 aa, Entamoeba histolytica
HKNFISDIQWKPEVFGDSAIFA

SEQ ID NO: 2714184 - protein, 30 aa, Entamoeba histolytica
HKNNHSYRVIPSLHFPLLSSDWGADEELML

SEQ ID NO: 2714185 - protein, 17 aa, Entamoeba histolytica
HKNPGLYYLLGEMHFHL

SEQ ID NO: 2714186 - protein, 25 aa, Entamoeba histolytica
HKQISTINILLPLSPLNVPDNYGQL

SEQ ID NO: 2714187 - protein, 19 aa, Entamoeba histolytica
HKRDCRMIILSNKELYDFG

SEQ ID NO: 2714188 - protein, 30 aa, Entamoeba histolytica
HKSEILNKFSPFFIHLIKIVFKRIDQLVED

SEQ ID NO: 2714189 - protein, 23 aa, Entamoeba histolytica
HKTEINKVRWNKNGKWFLTCSKD

SEQ ID NO: 2714190 - protein, 19 aa, Entamoeba histolytica
HKTFKFNQLFYSDELRFKP

SEQ ID NO: 2714191 - protein, 17 aa, Entamoeba histolytica
HKVLVLPASQRDPFCGS

SEQ ID NO: 2714192 - protein, 27 aa, Entamoeba histolytica
HLADNGVMFLQFAFRWINCCLLREFKL

SEQ ID NO: 2714193 - protein, 24 aa, Entamoeba histolytica
HLAGKWPFWLSPRQVMVCTVSEKY

SEQ ID NO: 2714194 - protein, 18 aa, Entamoeba histolytica
HLAMQFLEKEMLVRNPGC

SEQ ID NO: 2714195 - protein, 23 aa, Entamoeba histolytica
HLARAVLIIGAPYLQSSPIPIKE

SEQ ID NO: 2714196 - protein, 31 aa, Entamoeba histolytica
HLCEIKNLLLSLRWRLFLKCLPENSSLWTSV

SEQ ID NO: 2714197 - protein, 18 aa, Entamoeba histolytica
HLCIVCELLSINLYDALK

SEQ ID NO: 2714198 - protein, 28 aa, Entamoeba histolytica
HLDKLFEIINKYLLHQHPRVRNMAFLLL

SEQ ID NO: 2714199 - protein, 24 aa, Entamoeba histolytica
HLDSPFLKLKPNPDVFKNNLALVS

SEQ ID NO: 2714200 - protein, 17 aa, Entamoeba histolytica
HLDVRTTKEDLIKLFST

SEQ ID NO: 2714201 - protein, 20 aa, Entamoeba histolytica
HLEEWFDIDKIIFNDFTFKG

SEQ ID NO: 2714202 - protein, 26 aa, Entamoeba histolytica
HLEEYNKSLFWKPQFKKTSKRSERSS

SEQ ID NO: 2714203 - protein, 25 aa, Entamoeba histolytica
HLENNMYLLGYLPKENRCFLSDLKG

SEQ ID NO: 2714204 - protein, 18 aa, Entamoeba histolytica
HLFEQASSIFLTASNNIK

SEQ ID NO: 2714205 - protein, 21 aa, Entamoeba histolytica
HLFKILIIGESGVGKTAIMQR

SEQ ID NO: 2714206 - protein, 17 aa, Entamoeba histolytica
HLFLYPELPETDFLPSY

SEQ ID NO: 2714207 - protein, 18 aa, Entamoeba histolytica
HLFVFVNSLIENPAFDSQ

SEQ ID NO: 2714208 - protein, 27 aa, Entamoeba histolytica
HLGEAFSQFIPLLNVYKTYVGNTEAQF

SEQ ID NO: 2714209 - protein, 26 aa, Entamoeba histolytica
HLGTLILTALDDIAWLFNIRGTDIPF

SEQ ID NO: 2714210 - protein, 20 aa, Entamoeba histolytica
HLHETLLFLFNALQSGEESA

SEQ ID NO: 2714211 - protein, 20 aa, Entamoeba histolytica
HLHVYLSFLTTTFNDLRSFS

SEQ ID NO: 2714212 - protein, 20 aa, Entamoeba histolytica
HLIAFMAIRTFFAKKRPILI

SEQ ID NO: 2714213 - protein, 17 aa, Entamoeba histolytica
HLIEYIEEFPPLLSQVG

SEQ ID NO: 2714214 - protein, 18 aa, Entamoeba histolytica
HLIHCHPLFLTDPFEVYK

SEQ ID NO: 2714215 - protein, 19 aa, Entamoeba histolytica
HLIIPDLNKMFKIKEDQMA

SEQ ID NO: 2714216 - protein, 27 aa, Entamoeba histolytica
HLISESSLFSILPRVNKIILGCHSVFA

SEQ ID NO: 2714217 - protein, 17 aa, Entamoeba histolytica
HLKQCSTPSFGNLLIAE

SEQ ID NO: 2714218 - protein, 17 aa, Entamoeba histolytica
HLKWRAFGNQRPMINPM

SEQ ID NO: 2714219 - protein, 20 aa, Entamoeba histolytica
HLLLTALCYSFKNDTFLLKK

SEQ ID NO: 2714220 - protein, 20 aa, Entamoeba histolytica
HLLMDILSEFGYFFNTTKSQ

SEQ ID NO: 2714221 - protein, 17 aa, Entamoeba histolytica
HLLYTDCTFKVIEGMIP

SEQ ID NO: 2714222 - protein, 31 aa, Entamoeba histolytica
HLMNNRIYPSYQLYLNYLFIIHGLNEYIEDI

SEQ ID NO: 2714223 - protein, 21 aa, Entamoeba histolytica
HLNNEIIELIKRTITKAGMTI

SEQ ID NO: 2714224 - protein, 42 aa, Entamoeba histolytica
HLNTPISQPSSKLPKLLFNSTPSLQPIKLPKPPVTSIQQVPS

SEQ ID NO: 2714225 - protein, 19 aa, Entamoeba histolytica
HLNVLKSLIGFLVQITEKS

SEQ ID NO: 2714226 - protein, 17 aa, Entamoeba histolytica
HLNVNYPTTLTDKQKRE

SEQ ID NO: 2714227 - protein, 28 aa, Entamoeba histolytica
HLPHHECLIFDYYELGPLNKIISEREIP

SEQ ID NO: 2714228 - protein, 19 aa, Entamoeba histolytica
HLPLPPVKLPGNSASYHPA

SEQ ID NO: 2714229 - protein, 27 aa, Entamoeba histolytica
HLPMNDFPIFFDIFKHFITIHFKDPSV

SEQ ID NO: 2714230 - protein, 17 aa, Entamoeba histolytica
HLPPYHNEDIFYQNSYH

SEQ ID NO: 2714231 - protein, 23 aa, Entamoeba histolytica
HLQTFLVVVSLFIEILPQLIEDN

SEQ ID NO: 2714232 - protein, 24 aa, Entamoeba histolytica
HLQTLDGYYRKALFVDFVADQVKA

SEQ ID NO: 2714233 - protein, 25 aa, Entamoeba histolytica
HLQVVKMLVLYFNTIDQKSIDLIVR

SEQ ID NO: 2714234 - protein, 38 aa, Entamoeba histolytica
HLRKVGVTSFKKISMINFLIFIYGYDLHEVVNAPQGAN

SEQ ID NO: 2714235 - protein, 25 aa, Entamoeba histolytica
HLSEAWRCWKANIPWKVPGLPEPIE

SEQ ID NO: 2714236 - protein, 20 aa, Entamoeba histolytica
HLSLLFPNDLPTTFWQRCNI

SEQ ID NO: 2714237 - protein, 25 aa, Entamoeba histolytica
HLSMIYLNIEFDLNFSRTAYTSLPD

SEQ ID NO: 2714238 - protein, 29 aa, Entamoeba histolytica
HLSNLYLHSVILILIKPFLSPNDLKTKQT

SEQ ID NO: 2714239 - protein, 36 aa, Entamoeba histolytica; identical to SEQ ID NO: 2526264

SEQ ID NO: 2714240 - protein, 21 aa, Entamoeba histolytica
HLTCFDVFPKNMFKPKRRHQN

SEQ ID NO: 2714241 - protein, 21 aa, Entamoeba histolytica
HLYERYIIFKSKSNKKRKHVW

SEQ ID NO: 2714242 - protein, 17 aa, Entamoeba histolytica
HLYKPTTTPTYKGFEII

SEQ ID NO: 2714243 - protein, 17 aa, Entamoeba histolytica
HLYQMINEPIRSWCFGW

SEQ ID NO: 2714244 - protein, 18 aa, Entamoeba histolytica
HMCLMKNGLNTKGIFRES

SEQ ID NO: 2714245 - protein, 29 aa, Entamoeba histolytica
HMDIPDGSYVKLLNFAYKGNKPSSVVLKV

SEQ ID NO: 2714246 - protein, 30 aa, Entamoeba histolytica
HMEESNSFNWLFPEIYVLDGGFKNFYKRNK

SEQ ID NO: 2714247 - protein, 20 aa, Entamoeba histolytica
HMFCVDIGYPVRYCNKCQKI

SEQ ID NO: 2714248 - protein, 26 aa, Entamoeba histolytica
HMGGVAFLRSPPGKFFFDFFGENMLA

SEQ ID NO: 2714249 - protein, 25 aa, Entamoeba histolytica
HMMLTPLTCRCGKTKIMPPIPCGTQ

SEQ ID NO: 2714250 - protein, 19 aa, Entamoeba histolytica
HMWVGKKTINGPTHLEWYY

SEQ ID NO: 2714251 - protein, 18 aa, Entamoeba histolytica
HMYALALTPSLYTTVLQH

SEQ ID NO: 2714252 - protein, 24 aa, Entamoeba histolytica
HNAFKEHFMYPILIVRVSRIIDNS

SEQ ID NO: 2714253 - protein, 29 aa, Entamoeba histolytica
HNDAYIYDDLKYIYVWIGKKCNDFKKTKA

SEQ ID NO: 2714254 - protein, 24 aa, Entamoeba histolytica
HNDEIINIFKHAHQIYLSIGINET

SEQ ID NO: 2714255 - protein, 17 aa, Entamoeba histolytica
HNDIPIIIKQYKKSEYF

SEQ ID NO: 2714256 - protein, 24 aa, Entamoeba histolytica
HNEKPIYRLVERIGFIRRNIGIKT

SEQ ID NO: 2714257 - protein, 26 aa, Entamoeba histolytica
HNESLKYDIRLFDDANLNDIIWPEFK

SEQ ID NO: 2714258 - protein, 28 aa, Entamoeba histolytica
HNINPHITVIGFDPCYNLLMEAVHNQKS

SEQ ID NO: 2714259 - protein, 17 aa, Entamoeba histolytica
HNIPWKERIQIAISIAK

SEQ ID NO: 2714260 - protein, 17 aa, Entamoeba histolytica
HNIVYPSPILSFDMNKD

SEQ ID NO: 2714261 - protein, 25 aa, Entamoeba histolytica
HNKINFIIIFIITYSNTNILNQMDY

SEQ ID NO: 2714262 - protein, 24 aa, Entamoeba histolytica
HNKTLFAHLIDCLKYIYSVKEQCE

SEQ ID NO: 2714263 - protein, 19 aa, Entamoeba histolytica
HNLNKSVLLYSLYNSIHNS

SEQ ID NO: 2714264 - protein, 22 aa, Entamoeba histolytica
HNNGDELWVMLLEKAYAKVVGS

SEQ ID NO: 2714265 - protein, 31 aa, Entamoeba histolytica
HNNLKFLSLHNIPLLNKILIPQQLHSFVLSN

SEQ ID NO: 2714266 - protein, 17 aa, Entamoeba histolytica
HNNLVGHAKIYGLSKTR

SEQ ID NO: 2714267 - protein, 20 aa, Entamoeba histolytica
HNNVKWFPFPDHHNPSLIVL

SEQ ID NO: 2714268 - protein, 25 aa, Entamoeba histolytica
HNQINFIIIFIITYSNTNILNQMDY

SEQ ID NO: 2714269 - protein, 22 aa, Entamoeba histolytica
HNQSYFYRSFSILLEVFEMTHN

SEQ ID NO: 2714270 - protein, 35 aa, Entamoeba histolytica
HNSTQWVFQQLFFVKFLFPLLENPLFILDGVKQDE

SEQ ID NO: 2714271 - protein, 19 aa, Entamoeba histolytica
HNTKPLPVPPKPSGLSKTD

SEQ ID NO: 2714272 - protein, 19 aa, Entamoeba histolytica
HNVHGVIPYVLNVDSEEDA

SEQ ID NO: 2714273 - protein, 22 aa, Entamoeba histolytica
HPALVMGVLGSIIPFPDHNQSP

SEQ ID NO: 2714274 - protein, 18 aa, Entamoeba histolytica
HPEFEVRILDLILMEGWE

SEQ ID NO: 2714275 - protein, 31 aa, Entamoeba histolytica
HPEFLNDDRLDFLRNYIISLGGKIPEPKKEE

SEQ ID NO: 2714276 - protein, 28 aa, Entamoeba histolytica
HPEVHKKIVVMMYQSLIRDLNMTNEENK

SEQ ID NO: 2714277 - protein, 35 aa, Entamoeba histolytica
HPFESKGMYIFLIKKHFDELIKRYPLKNCFPEYDG

SEQ ID NO: 2714278 - protein, 18 aa, Entamoeba histolytica
HPFLVNLYCSFQTSVNLH

SEQ ID NO: 2714279 - protein, 20 aa, Entamoeba histolytica
HPHIQIPFRKFRQIQREEDK

SEQ ID NO: 2714280 - protein, 26 aa, Entamoeba histolytica
HPHQHVLIVLNRPKSFNARPVINHSD

SEQ ID NO: 2714281 - protein, 22 aa, Entamoeba histolytica
HPIFIKKVKVLFRTKSRYPNYT

SEQ ID NO: 2714282 - protein, 27 aa, Entamoeba histolytica
HPKEPWVLAALHTGTIYILNYQTKSIV

SEQ ID NO: 2714283 - protein, 17 aa, Entamoeba histolytica
HPKNAFHYIPRVYGFKL

SEQ ID NO: 2714284 - protein, 26 aa, Entamoeba histolytica
HPKTKYSRVILIRDQIFKLACDHFCH

SEQ ID NO: 2714285 - protein, 32 aa, Entamoeba histolytica; identical to SEQ ID NO: 2526321

SEQ ID NO: 2714286 - protein, 25 aa, Entamoeba histolytica
HPKVWYLIFINFELKNTLPIIHLII

SEQ ID NO: 2714287 - protein, 25 aa, Entamoeba histolytica
HPKYLIDLTTFPLLTKLTLNIFSQP

SEQ ID NO: 2714288 - protein, 18 aa, Entamoeba histolytica
HPLALISITQSATHKTIN

SEQ ID NO: 2714289 - protein, 17 aa, Entamoeba histolytica
HPLIVDNIWSLITSCCE

SEQ ID NO: 2714290 - protein, 22 aa, Entamoeba histolytica
HPLVQLPSNSLTFYSLGRDLMR

SEQ ID NO: 2714291 - protein, 25 aa, Entamoeba histolytica
HPNTPQWKLITFTDKTINQLINTLH

SEQ ID NO: 2714292 - protein, 17 aa, Entamoeba histolytica
HPQCESNFVLTIASAFW

SEQ ID NO: 2714293 - protein, 26 aa, Entamoeba histolytica
HPQDNFLFEIIPLISNPDPCNDILSY

SEQ ID NO: 2714294 - protein, 21 aa, Entamoeba histolytica
HPQFFISENLTMNCPRVTQNF

SEQ ID NO: 2714295 - protein, 28 aa, Entamoeba histolytica
HPQMLGVLGLKAMALILIRLITSNTQSN

SEQ ID NO: 2714296 - protein, 19 aa, Entamoeba histolytica
HPQNKWMIQFPRIFHVCKG

SEQ ID NO: 2714297 - protein, 26 aa, Entamoeba histolytica
HPRVRNMAFLLLNEMICLFKKKCKSY

SEQ ID NO: 2714298 - protein, 25 aa, Entamoeba histolytica
HPSFWHFHVHFTSINFPTLARNNSI

SEQ ID NO: 2714299 - protein, 28 aa, Entamoeba histolytica
HPSKGLFLRSYLLYVIKNYLPTTLIENN

SEQ ID NO: 2714300 - protein, 25 aa, Entamoeba histolytica
HPTRDLILPQIIITLDIAFREKGGF

SEQ ID NO: 2714301 - protein, 24 aa, Entamoeba histolytica
HPTRSWVLASLHNGKIQLWDMRTR

SEQ ID NO: 2714302 - protein, 29 aa, Entamoeba histolytica
HPVIHKTLPIILPIILRTIDCSIIEQYET

SEQ ID NO: 2714303 - protein, 25 aa, Entamoeba histolytica
HPYCDFCNIPFFDLESLYNHLNTQH

SEQ ID NO: 2714304 - protein, 18 aa, Entamoeba histolytica
HQCIDEFQLIYPTDHIVI

SEQ ID NO: 2714305 - protein, 25 aa, Entamoeba histolytica
HQFDIIECIILIGSIINVFMNKSKL

SEQ ID NO: 2714306 - protein, 20 aa, Entamoeba histolytica
HQHYSYTRYLQPPILCTSNP

SEQ ID NO: 2714307 - protein, 26 aa, Entamoeba histolytica
HQIEELFISLLGYPIDQIRSTCLILL

SEQ ID NO: 2714308 - protein, 17 aa, Entamoeba histolytica
HQIIKYLDTVDIKQMGV

SEQ ID NO: 2714309 - protein, 27 aa, Entamoeba histolytica
HQIRRLTYQLIKFILQICYISDASTIQ

SEQ ID NO: 2714310 - protein, 18 aa, Entamoeba histolytica
HQITFIFDEPQTLAFVRF

SEQ ID NO: 2714311 - protein, 22 aa, Entamoeba histolytica
HQLENILIKYVSQFVQCPECKS

SEQ ID NO: 2714312 - protein, 23 aa, Entamoeba histolytica
HQLPTPVGGFKKPSEIKKATPSK

SEQ ID NO: 2714313 - protein, 24 aa, Entamoeba histolytica
HQLQIYSDQFLPITDEIVPTGEIR

SEQ ID NO: 2714314 - protein, 23 aa, Entamoeba histolytica
HQNRKYLAWAGAALLAGMSTLQD

SEQ ID NO: 2714315 - protein, 20 aa, Entamoeba histolytica
HQNYLIKPISVFIQFGNCVN

SEQ ID NO: 2714316 - protein, 31 aa, Entamoeba histolytica
HQPKEILNNCPLYQLLPLQAFCDLLSVSVNP

SEQ ID NO: 2714317 - protein, 20 aa, Entamoeba histolytica
HQRMEIVNLMSKIMDFTDEE

SEQ ID NO: 2714318 - protein, 17 aa, Entamoeba histolytica
HQSLLELLLKFNTKKKR

SEQ ID NO: 2714319 - protein, 27 aa, Entamoeba histolytica
HQSQIFYEFNDFEDFKWILTETNENTN

SEQ ID NO: 2714320 - protein, 24 aa, Entamoeba histolytica
HQSQKDLPLFPGADPREFWQRAEE

SEQ ID NO: 2714321 - protein, 28 aa, Entamoeba histolytica
HRCYALQTLYSVYLWIGKQTDQISRIQA

SEQ ID NO: 2714322 - protein, 18 aa, Entamoeba histolytica
HRDLALRNLLYIHDDKGG

SEQ ID NO: 2714323 - protein, 19 aa, Entamoeba histolytica
HRDLKPENILLKENKPYPT

SEQ ID NO: 2714324 - protein, 23 aa, Entamoeba histolytica
HRDPLKELILPPLEELRPFPSNR

SEQ ID NO: 2714325 - protein, 21 aa, Entamoeba histolytica
HREDTYLPLFYSESSIKPIFL

SEQ ID NO: 2714326 - protein, 21 aa, Entamoeba histolytica
HRELFLYVCSKIHILRQNHLE

SEQ ID NO: 2714327 - protein, 17 aa, Entamoeba histolytica
HRHLQLDLCSQVNFIVG

SEQ ID NO: 2714328 - protein, 27 aa, Entamoeba histolytica
HRIIKKYVVFYELDLGLNHVIRKVAEP

SEQ ID NO: 2714329 - protein, 23 aa, Entamoeba histolytica
HRKKLYCVKLRTIDIFNIEIGTP

SEQ ID NO: 2714330 - protein, 21 aa, Entamoeba histolytica
HRKRMGINTILFLDEIHSLNR

SEQ ID NO: 2714331 - protein, 18 aa, Entamoeba histolytica
HRLDRMTSGILLLAKTIQ

SEQ ID NO: 2714332 - protein, 26 aa, Entamoeba histolytica
HRLRAVEQMLVLLKTRRLNGNILNDC

SEQ ID NO: 2714333 - protein, 25 aa, Entamoeba histolytica
HRLVLPKTDFIFTVNYKKVCEILSL

SEQ ID NO: 2714334 - protein, 23 aa, Entamoeba histolytica
HRQRAMIQFILDDMKIDFLSHTE

SEQ ID NO: 2714335 - protein, 35 aa, Entamoeba histolytica; identical to SEQ ID NO: 2526378

SEQ ID NO: 2714336 - protein, 24 aa, Entamoeba histolytica
HRSKGRFPVLTWYNKKNGSVIVRS

SEQ ID NO: 2714337 - protein, 17 aa, Entamoeba histolytica
HRSTSLLTLRKQLEALK

SEQ ID NO: 2714338 - protein, 32 aa, Entamoeba histolytica
HSASVDWWTLGVLMYEFLYGCNPFAASSIQET

SEQ ID NO: 2714339 - protein, 17 aa, Entamoeba histolytica
HSDLFLHVIIRKTDELL

SEQ ID NO: 2714340 - protein, 46 aa, Entamoeba histolytica
HSDTSFISFKILTLLYPQPIWNLTPYQYIVLIGLNRLSQISSSPII

SEQ ID NO: 2714341 - protein, 17 aa, Entamoeba histolytica
HSFCLVCVRQIFRKDNI

SEQ ID NO: 2714342 - protein, 29 aa, Entamoeba histolytica
HSFEIPIQPSLTFILRKYNSFIKREMKRY

SEQ ID NO: 2714343 - protein, 19 aa, Entamoeba histolytica
HSFFILGMTKNQIIQHSLF

SEQ ID NO: 2714344 - protein, 17 aa, Entamoeba histolytica
HSFIIKKENPKLQSILF

SEQ ID NO: 2714345 - protein, 17 aa, Entamoeba histolytica
HSFILVYTSLSSLNNYS

SEQ ID NO: 2714346 - protein, 17 aa, Entamoeba histolytica
HSFLFPGMTLFDTAIDV

SEQ ID NO: 2714347 - protein, 17 aa, Entamoeba histolytica
HSGISKKYAYLEMDSIE

SEQ ID NO: 2714348 - protein, 17 aa, Entamoeba histolytica
HSGKYVSYKFSIRFPEI

SEQ ID NO: 2714349 - protein, 24 aa, Entamoeba histolytica
HSIGCGPTLWLANQIQLDKLKKYN

SEQ ID NO: 2714350 - protein, 31 aa, Entamoeba histolytica
HSIKTPQLLVEIIWILSRFSYTKEEVLTSFN

SEQ ID NO: 2714351 - protein, 20 aa, Entamoeba histolytica
HSIPMQIDLMFLISNLCRNE

SEQ ID NO: 2714352 - protein, 24 aa, Entamoeba histolytica
HSKLSNWIIPHLSAIRNTPYYKKI

SEQ ID NO: 2714353 - protein, 18 aa, Entamoeba histolytica
HSKMLLKPRINPKQFFGF

SEQ ID NO: 2714354 - protein, 20 aa, Entamoeba histolytica
HSLCSIRLTPNAEPLIALFQ

SEQ ID NO: 2714355 - protein, 19 aa, Entamoeba histolytica
HSLFYSSSHFVHWVCGSLI

SEQ ID NO: 2714356 - protein, 18 aa, Entamoeba histolytica
HSLPQSLQLLIDDIYFIS

SEQ ID NO: 2714357 - protein, 18 aa, Entamoeba histolytica
HSLTFYPNLMDLPLKMMD

SEQ ID NO: 2714358 - protein, 35 aa, Entamoeba histolytica; identical to SEQ ID NO: 2526408

SEQ ID NO: 2714359 - protein, 20 aa, Entamoeba histolytica
HSMKAWRDDVYTFYINQGVK

SEQ ID NO: 2714360 - protein, 19 aa, Entamoeba histolytica
HSMLNRWKLMQNDQEIGNL

SEQ ID NO: 2714361 - protein, 25 aa, Entamoeba histolytica
HSNFSSFVRQLNIYGFHKVDHPLGQ

SEQ ID NO: 2714362 - protein, 26 aa, Entamoeba histolytica
HSNGSQLIRFPLLKNVYADTVLSSFT

SEQ ID NO: 2714363 - protein, 26 aa, Entamoeba histolytica
HSNNAEWLGVLKPTVSLISCGHGNLY

SEQ ID NO: 2714364 - protein, 24 aa, Entamoeba histolytica
HSNNTRIYLIDRMTGLRKKYDRFS

SEQ ID NO: 2714365 - protein, 31 aa, Entamoeba histolytica
HSNSSLSLFIKILCFFVKEWRYRNKNKSNTL

SEQ ID NO: 2714366 - protein, 30 aa, Entamoeba histolytica
HSPFADKIWNIRFIKGLTWGRIFEDKESKQ

SEQ ID NO: 2714367 - protein, 19 aa, Entamoeba histolytica
HSPIISIKNLSLLKTLNCF

SEQ ID NO: 2714368 - protein, 23 aa, Entamoeba histolytica
HSPKAIHLISLIFSLYSNKTYAT

SEQ ID NO: 2714369 - protein, 23 aa, Entamoeba histolytica
HSPKLFEQLLKLIPTLQSNEYVP

SEQ ID NO: 2714370 - protein, 27 aa, Entamoeba histolytica
HSPYIVKLFYTFQNPTSLFYVLELCPN

SEQ ID NO: 2714371 - protein, 35 aa, Entamoeba histolytica
HSQLNRNIAILFLLQQFYPFFDNFLDAKLLQVGRI

SEQ ID NO: 2714372 - protein, 24 aa, Entamoeba histolytica
HSQNEYFALFWRCIKEYCDDNSEI

SEQ ID NO: 2714373 - protein, 26 aa, Entamoeba histolytica
HSSELFPERWFDLIVVLRTDNTVLYD

SEQ ID NO: 2714374 - protein, 28 aa, Entamoeba histolytica
HSSFFTSYPFPFFPWQMVKFQSTLETHI

SEQ ID NO: 2714375 - protein, 31 aa, Entamoeba histolytica
HSTERLETIYEWLRKMSLLLHSVVVGYEYPG

SEQ ID NO: 2714376 - protein, 25 aa, Entamoeba histolytica
HSTFHEVSQRFLFARFKNIENEEDI

SEQ ID NO: 2714377 - protein, 25 aa, Entamoeba histolytica
HSTLSLKINTLWRNNSKYLEMVNTN

SEQ ID NO: 2714378 - protein, 27 aa, Entamoeba histolytica
HSTMAQILFPLLSQYIKKNSLANLNTI

SEQ ID NO: 2714379 - protein, 27 aa, Entamoeba histolytica
HSVELTPVKLPKVFRILEDYITKNFTN

SEQ ID NO: 2714380 - protein, 25 aa, Entamoeba histolytica
HSVGLFSILAVLEKEEFVNCFPLRV

SEQ ID NO: 2714381 - protein, 29 aa, Entamoeba histolytica
HSWKRRYFVIKNEFIYYFASASPNSTPKG

SEQ ID NO: 2714382 - protein, 22 aa, Entamoeba histolytica
HSWSKLWYQNSFENPLILECFA

SEQ ID NO: 2714383 - protein, 23 aa, Entamoeba histolytica
HSYAEKLYKIFENYYRHCIRELN

SEQ ID NO: 2714384 - protein, 28 aa, Entamoeba histolytica
HSYSDVLFILFHRALCSRLSLFISSIQI

SEQ ID NO: 2714385 - protein, 17 aa, Entamoeba histolytica
HTALAILIILKDIGYEI

SEQ ID NO: 2714386 - protein, 17 aa, Entamoeba histolytica
HTALLEKWNPIFDLTLF

SEQ ID NO: 2714387 - protein, 27 aa, Entamoeba histolytica
HTCNTFNLILLKANIIASLLIELNSEA

SEQ ID NO: 2714388 - protein, 19 aa, Entamoeba histolytica
HTCYSAAMSLMANFDSKVI

SEQ ID NO: 2714389 - protein, 25 aa, Entamoeba histolytica
HTEPPFIPIIVLIKQELMKINDMPT

SEQ ID NO: 2714390 - protein, 24 aa, Entamoeba histolytica
HTEQEILFGYKLLEKLIPEIKTGG

SEQ ID NO: 2714391 - protein, 25 aa, Entamoeba histolytica
HTHNFEIMFHVSPLIPLLQDDGQGL

SEQ ID NO: 2714392 - protein, 17 aa, Entamoeba histolytica
HTIPTKAGSLKVGGFVV

SEQ ID NO: 2714393 - protein, 17 aa, Entamoeba histolytica
HTLPRLYHLEEYKTFDD

SEQ ID NO: 2714394 - protein, 19 aa, Entamoeba histolytica
HTLVSSFFLFLACLDQKHF

SEQ ID NO: 2714395 - protein, 26 aa, Entamoeba histolytica
HTNFKIFMELINEVYPMALSFFDESM

SEQ ID NO: 2714396 - protein, 24 aa, Entamoeba histolytica
HTPINLMDRIKYKLEIPIMWNEDS

SEQ ID NO: 2714397 - protein, 18 aa, Entamoeba histolytica
HTPVGAIPILVIDEPFRW

SEQ ID NO: 2714398 - protein, 24 aa, Entamoeba histolytica
HTRPVSVIPIIQFNPHELTILALQ

SEQ ID NO: 2714399 - protein, 28 aa, Entamoeba histolytica
HTSNVFYNSLTPLYKIAAAVTGSIAAVI

SEQ ID NO: 2714400 - protein, 27 aa, Entamoeba histolytica
HTTQSVFQWKEEFLKWSTIKPDAIKLC

SEQ ID NO: 2714401 - protein, 40 aa, Entamoeba histolytica
HTVLGTLPFKLFEKLSYRSLMLWILYDDIPEFEKETIPRA

SEQ ID NO: 2714402 - protein, 33 aa, Entamoeba histolytica
HVAQPPPDFSKVPPLFRSTPLIRHHNASKPRLI

SEQ ID NO: 2714403 - protein, 19 aa, Entamoeba histolytica
HVDHCASLPYLILERQFKG

SEQ ID NO: 2714404 - protein, 17 aa, Entamoeba histolytica
HVFIIEVKQTSVFKLKK

SEQ ID NO: 2714405 - protein, 18 aa, Entamoeba histolytica
HVFKVWVLVTRQTIKTKG

SEQ ID NO: 2714406 - protein, 20 aa, Entamoeba histolytica
HVFPFCLQFDVMDKFIRGGR

SEQ ID NO: 2714407 - protein, 17 aa, Entamoeba histolytica
HVFSLHPSNIILTVIPE

SEQ ID NO: 2714408 - protein, 18 aa, Entamoeba histolytica
HVGDSPVFLIKRNSEKKI

SEQ ID NO: 2714409 - protein, 24 aa, Entamoeba histolytica
HVGKGFFELELLKKAYLDSIKCSD

SEQ ID NO: 2714410 - protein, 26 aa, Entamoeba histolytica
HVGKLPRVFKLLPSFEEWIPLLQMTN

SEQ ID NO: 2714411 - protein, 18 aa, Entamoeba histolytica
HVICLVRSLTISDGWKRI

SEQ ID NO: 2714412 - protein, 24 aa, Entamoeba histolytica
HVIQKFIEFMPSTYSSLIANEISG

SEQ ID NO: 2714413 - protein, 19 aa, Entamoeba histolytica
HVKFKRGLRGHISKIYAMH

SEQ ID NO: 2714414 - protein, 21 aa, Entamoeba histolytica
HVKGILLYGPPGCGKTLMARQ

SEQ ID NO: 2714415 - protein, 34 aa, Entamoeba histolytica
HVKKPDDFFMYCLVSLHRFIIYTNTVNASLIIPY

SEQ ID NO: 2714416 - protein, 31 aa, Entamoeba histolytica
HVKVTSIPTILVLNPGSWKALPRTTKEYEDF

SEQ ID NO: 2714417 - protein, 19 aa, Entamoeba histolytica
HVLNNFQEFLYSGIGLTDE

SEQ ID NO: 2714418 - protein, 18 aa, Entamoeba histolytica
HVLRTNKFDFKIPEEFPV

SEQ ID NO: 2714419 - protein, 18 aa, Entamoeba histolytica
HVLYQPDGRPRNVYPIDL

SEQ ID NO: 2714420 - protein, 19 aa, Entamoeba histolytica
HVNALLFNGIIEATLPLLN

SEQ ID NO: 2714421 - protein, 19 aa, Entamoeba histolytica
HVNSMLRIKLFNITASHIN

SEQ ID NO: 2714422 - protein, 22 aa, Entamoeba histolytica
HVPTFILYHNGQELKRIVEPGY

SEQ ID NO: 2714423 - protein, 18 aa, Entamoeba histolytica
HVQMICEVLNLFTPEQLE

SEQ ID NO: 2714424 - protein, 18 aa, Entamoeba histolytica
HVQPKMIPKVPLVSLIDS

SEQ ID NO: 2714425 - protein, 27 aa, Entamoeba histolytica
HVRSFIDKLFLYFPNIETLQLHPKQLT

SEQ ID NO: 2714426 - protein, 27 aa, Entamoeba histolytica
HVSFQVIKNLYLLLGSVDFLGNPVGLV

SEQ ID NO: 2714427 - protein, 26 aa, Entamoeba histolytica
HVSHDGYLIFYSFEGKVKSYDCFDRE

SEQ ID NO: 2714428 - protein, 23 aa, Entamoeba histolytica
HVSNGFLHFLIDCAIEAHLEAYT

SEQ ID NO: 2714429 - protein, 23 aa, Entamoeba histolytica
HVTPEQIILAVSPLKDLVNDFED

SEQ ID NO: 2714430 - protein, 18 aa, Entamoeba histolytica
HVTYFWNGNKSGYFDDKL

SEQ ID NO: 2714431 - protein, 31 aa, Entamoeba histolytica; identical to SEQ ID NO: 2526477

SEQ ID NO: 2714432 - protein, 24 aa, Entamoeba histolytica
HVYDTINHWFGINGMITIGSTYWN

SEQ ID NO: 2714433 - protein, 20 aa, Entamoeba histolytica
HVYLNCHYHFVFNLLNSYNC

SEQ ID NO: 2714434 - protein, 30 aa, Entamoeba histolytica
HWDRNRLFDRLICDLLYEDALEYINSATIT

SEQ ID NO: 2714435 - protein, 22 aa, Entamoeba histolytica
HWGIIWASLRMLLEMTPGTLGN

SEQ ID NO: 2714436 - protein, 18 aa, Entamoeba histolytica
HWIGTMILMFPDVEMRAK

SEQ ID NO: 2714437 - protein, 31 aa, Entamoeba histolytica
HWLTFHSGYDFGYLLRLLTCEKLPSSIDDFF

SEQ ID NO: 2714438 - protein, 20 aa, Entamoeba histolytica
HWNSMVWEPPCELLDCGKSY

SEQ ID NO: 2714439 - protein, 18 aa, Entamoeba histolytica
HWSYFYTSKRLLFTSLLS

SEQ ID NO: 2714440 - protein, 25 aa, Entamoeba histolytica
HYDEVLNINKNFFLALKKLQETHKI

SEQ ID NO: 2714441 - protein, 24 aa, Entamoeba histolytica
HYDNIYEILYIFNTPEKVQHDTFI

SEQ ID NO: 2714442 - protein, 24 aa, Entamoeba histolytica
HYEFPEIVLKCLPVLPFEITEDYL

SEQ ID NO: 2714443 - protein, 22 aa, Entamoeba histolytica
HYESALHDFLLAKLINADRLSQ

SEQ ID NO: 2714444 - protein, 17 aa, Entamoeba histolytica
HYFARRLINKTVSIDED

SEQ ID NO: 2714445 - protein, 17 aa, Entamoeba histolytica
HYFSNRLINGKWVCFND

SEQ ID NO: 2714446 - protein, 34 aa, Entamoeba histolytica; identical to SEQ ID NO: 2526490

SEQ ID NO: 2714447 - protein, 20 aa, Entamoeba histolytica
HYIPLLDHLIQNDFIISIFS

SEQ ID NO: 2714448 - protein, 20 aa, Entamoeba histolytica
HYITYFGQDLYVCFNDSECV

SEQ ID NO: 2714449 - protein, 18 aa, Entamoeba histolytica
HYKILHNIRFHDKALPQY

SEQ ID NO: 2714450 - protein, 18 aa, Entamoeba histolytica
HYKYIIHDKWLSLPELTN

SEQ ID NO: 2714451 - protein, 32 aa, Entamoeba histolytica
HYLGFIDFVHKILPIFIKNTSLPSFVSFLSDI

SEQ ID NO: 2714452 - protein, 19 aa, Entamoeba histolytica
HYLICKKLIVIGLNSELPH

SEQ ID NO: 2714453 - protein, 28 aa, Entamoeba histolytica
HYLNLKQLPFNSIILPLNLQILELFSVV

SEQ ID NO: 2714454 - protein, 23 aa, Entamoeba histolytica
HYLQPSCFILPTSLKTITFTNCS

SEQ ID NO: 2714455 - protein, 18 aa, Entamoeba histolytica
HYMELYKKSLGYTFLPII

SEQ ID NO: 2714456 - protein, 28 aa, Entamoeba histolytica
HYNKIKHTGYLRNLLIRKAKKTNEIMYC

SEQ ID NO: 2714457 - protein, 17 aa, Entamoeba histolytica
HYNLIPSVAIVDPEFTY

SEQ ID NO: 2714458 - protein, 24 aa, Entamoeba histolytica
HYNRPYYEFPNLLQQPFALMNQVS

SEQ ID NO: 2714459 - protein, 26 aa, Entamoeba histolytica
HYNSHEIIKLFFPNKLYYPCKGRNCK

SEQ ID NO: 2714460 - protein, 17 aa, Entamoeba histolytica
HYPVLNLSHAVGIALNY

SEQ ID NO: 2714461 - protein, 48 aa, Entamoeba histolytica
HYQECREIMDFLYKRLCEDGKNWREIYKSLLVLDNILKNGSEEAVNIA

SEQ ID NO: 2714462 - protein, 27 aa, Entamoeba histolytica
HYQLPTQRPLPPTPTQRPLPPTPTPQQ

SEQ ID NO: 2714463 - protein, 28 aa, Entamoeba histolytica
HYQTYEADLLFVLRFMVDSGLVGCSWVK

SEQ ID NO: 2714464 - protein, 24 aa, Entamoeba histolytica
HYQYDRSIFYPTTLTFLSCDFNEY

SEQ ID NO: 2714465 - protein, 28 aa, Entamoeba histolytica
HYRSSDNFLIYDLVICTVRLAKNGHEIC

SEQ ID NO: 2714466 - protein, 21 aa, Entamoeba histolytica
HYSLTLLVKEKLFFLVLILNT

SEQ ID NO: 2714467 - protein, 34 aa, Entamoeba histolytica
HYSNIYHTIPSFFPLPIPLLRSNAGYIASTNIID

SEQ ID NO: 2714468 - protein, 26 aa, Entamoeba histolytica
HYTITERRFILKLASEPKEIELKYTN

SEQ ID NO: 2714469 - protein, 26 aa, Entamoeba histolytica
HYVENIETLIYYLDELRAQGKFKILG

SEQ ID NO: 2714470 - protein, 18 aa, Entamoeba histolytica
HYVFCKKKEELPSKLILF

SEQ ID NO: 2714471 - protein, 19 aa, Entamoeba histolytica
HYYNLIISSSPLNLKFLQI

SEQ ID NO: 2714472 - protein, 20 aa, Entamoeba histolytica
IAAEITFYIKCQIAAFCELL

SEQ ID NO: 2714473 - protein, 23 aa, Entamoeba histolytica
IAAELVLGIPLFPGSSEFNQLFK

SEQ ID NO: 2714474 - protein, 19 aa, Entamoeba histolytica
IAAIHRIFSGKAGADNLKS

SEQ ID NO: 2714475 - protein, 25 aa, Entamoeba histolytica
IACCCGNSYIIPLLIKKYPSCINIQ

SEQ ID NO: 2714476 - protein, 22 aa, Entamoeba histolytica
IACIFTSLIDWAFSPSCIFPKA

SEQ ID NO: 2714477 - protein, 17 aa, Entamoeba histolytica
IACLAGCIKNAWCKDMK

SEQ ID NO: 2714478 - protein, 24 aa, Entamoeba histolytica
IADINRRYTFRLKALNVALNTTFR

SEQ ID NO: 2714479 - protein, 31 aa, Entamoeba histolytica
IADIWSLGVVFYVMIFGLMPFPGETDEEFVE

SEQ ID NO: 2714480 - protein, 23 aa, Entamoeba histolytica
IADRYFKLVKRTNKYRLKESFEF

SEQ ID NO: 2714481 - protein, 18 aa, Entamoeba histolytica
IAEFSLLANLITKNYKMK

SEQ ID NO: 2714482 - protein, 20 aa, Entamoeba histolytica
IAEGIKWTPIKYFNNKVVCD

SEQ ID NO: 2714483 - protein, 33 aa, Entamoeba histolytica
IAEGNDTWDLLYVALLMCGYDDLAERCKEENRD

SEQ ID NO: 2714484 - protein, 22 aa, Entamoeba histolytica
IAELTLIHRMAAWGVSLNDCND

SEQ ID NO: 2714485 - protein, 24 aa, Entamoeba histolytica
IAEQFFVYDIKLIKKLTMGEIILQ

SEQ ID NO: 2714486 - protein, 19 aa, Entamoeba histolytica
IAFKKAIKYFGYTTARGIN

SEQ ID NO: 2714487 - protein, 24 aa, Entamoeba histolytica
IAFQSIHIVLLSDFLQFLQQENLP

SEQ ID NO: 2714488 - protein, 26 aa, Entamoeba histolytica
IAFSLYSLLNLFTKIHYQYLQTQLQK

SEQ ID NO: 2714489 - protein, 19 aa, Entamoeba histolytica
IAGIRSINPDKPVEIEFFK

SEQ ID NO: 2714490 - protein, 24 aa, Entamoeba histolytica
IAHIINLLARYFDVSLKYPLHPNA

SEQ ID NO: 2714491 - protein, 20 aa, Entamoeba histolytica
IAIDPWKLALKRKEQKRRNE

SEQ ID NO: 2714492 - protein, 19 aa, Entamoeba histolytica
IAIDTLLSILLRLDFDVKY

SEQ ID NO: 2714493 - protein, 22 aa, Entamoeba histolytica
IAIVFSPNLLFYEDSQDGLILS

SEQ ID NO: 2714494 - protein, 28 aa, Entamoeba histolytica
IAIYSNSCLIFQRPYLCGLYNESTTLWV

SEQ ID NO: 2714495 - protein, 25 aa, Entamoeba histolytica
IAKDETILIMPLKTDPETGYFSLMR

SEQ ID NO: 2714496 - protein, 26 aa, Entamoeba histolytica
IAKKYQKYPRLYYTWIDKLVQTQERC

SEQ ID NO: 2714497 - protein, 25 aa, Entamoeba histolytica
IAKQNQLVQIIWKNKEKVDCVDETT

SEQ ID NO: 2714498 - protein, 20 aa, Entamoeba histolytica
IALAKIPIPSLITTIDSIHD

SEQ ID NO: 2714499 - protein, 25 aa, Entamoeba histolytica
IALEEGNFLMWDILKEGSKTIEDIN

SEQ ID NO: 2714500 - protein, 17 aa, Entamoeba histolytica
IALLRMDDIFVDSFEIE

SEQ ID NO: 2714501 - protein, 17 aa, Entamoeba histolytica
IALNILDYYKIVKHPMD

SEQ ID NO: 2714502 - protein, 27 aa, Entamoeba histolytica
IALQSFKHFFFFCREFNFLSKDDIAPL

SEQ ID NO: 2714503 - protein, 33 aa, Entamoeba histolytica
IALTNKRIIIMDYFHLHFIDEIELRYIKDISTG

SEQ ID NO: 2714504 - protein, 19 aa, Entamoeba histolytica
IAMLQELYGELPPNLINAI

SEQ ID NO: 2714505 - protein, 18 aa, Entamoeba histolytica
IAMMRIGGITYKLTKGTK

SEQ ID NO: 2714506 - protein, 26 aa, Entamoeba histolytica
IANETGAFFFLINGPEIMSKMAGESE

SEQ ID NO: 2714507 - protein, 19 aa, Entamoeba histolytica
IANLLKILQVALKYIGDLN

SEQ ID NO: 2714508 - protein, 27 aa, Entamoeba histolytica
IANQNKKYLTQLLKEFGDDVNELRMKA

SEQ ID NO: 2714509 - protein, 18 aa, Entamoeba histolytica
IAQELFQIIKSRMTSIII

SEQ ID NO: 2714510 - protein, 22 aa, Entamoeba histolytica
IAQITQNFTWVRAGCICMAVAN

SEQ ID NO: 2714511 - protein, 20 aa, Entamoeba histolytica
IAQLYYHYYLRTSETQFLNE

SEQ ID NO: 2714512 - protein, 18 aa, Entamoeba histolytica
IAQWRSIFVLYGITCFGI

SEQ ID NO: 2714513 - protein, 24 aa, Entamoeba histolytica
IARKQLVEILWKLGDSYFADVVDE

SEQ ID NO: 2714514 - protein, 17 aa, Entamoeba histolytica
IARRGYVIIDDKGKVRY

SEQ ID NO: 2714515 - protein, 24 aa, Entamoeba histolytica
IARYCNMYQFFCYECKEDKVIVTN

SEQ ID NO: 2714516 - protein, 24 aa, Entamoeba histolytica
IASCIRYLFFFIGSSIVDFTQTIS

SEQ ID NO: 2714517 - protein, 25 aa, Entamoeba histolytica
IASESRFVIKLLDSIILQQQHQIAI

SEQ ID NO: 2714518 - protein, 17 aa, Entamoeba histolytica
IASILHKVSIPSKHSAV

SEQ ID NO: 2714519 - protein, 25 aa, Entamoeba histolytica
IASLFTLKYISVTFFSTLKHLLTLN

SEQ ID NO: 2714520 - protein, 20 aa, Entamoeba histolytica
IASQFAINFPDLEKIYLRDI

SEQ ID NO: 2714521 - protein, 29 aa, Entamoeba histolytica
IASSILKRTILSDVFWLKSTSYPGRIWVH

SEQ ID NO: 2714522 - protein, 17 aa, Entamoeba histolytica
IASTVLHYFIELAVKIA

SEQ ID NO: 2714523 - protein, 34 aa, Entamoeba histolytica
IATHPEYRLKLTTLLPAFDFGMDIFIDKLPLTND

SEQ ID NO: 2714524 - protein, 18 aa, Entamoeba histolytica
IATIISPLIQLPLSNDFI

SEQ ID NO: 2714525 - protein, 21 aa, Entamoeba histolytica
IATKYMTTCECLELGLTTCLT

SEQ ID NO: 2714526 - protein, 29 aa, Entamoeba histolytica
IAVYCLKDTYLPIKLLEKLMSLVNGFEMC

SEQ ID NO: 2714527 - protein, 18 aa, Entamoeba histolytica
IAWCPYRWCSHYGQKRFT

SEQ ID NO: 2714528 - protein, 17 aa, Entamoeba histolytica
IAYLMKKNQWTYEYSYK

SEQ ID NO: 2714529 - protein, 26 aa, Entamoeba histolytica
IAYVCKRVLQGLVYLHKMGIIHRDIK

SEQ ID NO: 2714530 - protein, 19 aa, Entamoeba histolytica
ICALLPETTSRLLRILKDE

SEQ ID NO: 2714531 - protein, 26 aa, Entamoeba histolytica
ICASAIAVLPKKPSLWLEAIELEKNI

SEQ ID NO: 2714532 - protein, 18 aa, Entamoeba histolytica
ICCCSHLFPFYIKTGEHD

SEQ ID NO: 2714533 - protein, 21 aa, Entamoeba histolytica
ICCKVFDNIKMFLHLKDTPKS

SEQ ID NO: 2714534 - protein, 18 aa, Entamoeba histolytica
ICCPVIPDVKKYVQEKGG

SEQ ID NO: 2714535 - protein, 19 aa, Entamoeba histolytica
ICDNSIQRAWNKVLNKVTE

SEQ ID NO: 2714536 - protein, 27 aa, Entamoeba histolytica
ICDPEFHKEWDPYLISWTVIDTKNEQT

SEQ ID NO: 2714537 - protein, 40 aa, Entamoeba histolytica
ICEIKKCRILFSRKYNYLQAHKLQIVLYKINKKLEKIHSE

SEQ ID NO: 2714538 - protein, 17 aa, Entamoeba histolytica
ICELYFELHPIFNKSCA

SEQ ID NO: 2714539 - protein, 17 aa, Entamoeba histolytica
ICFEILYFFTKAVKIDC

SEQ ID NO: 2714540 - protein, 17 aa, Entamoeba histolytica
ICFGIISTEIYEIIPRC

SEQ ID NO: 2714541 - protein, 27 aa, Entamoeba histolytica
ICGEEYPMITFILIAFKMVQCNIERKS

SEQ ID NO: 2714542 - protein, 28 aa, Entamoeba histolytica
ICGTIIYTKLFIPHLFSLSANGFSYYVY

SEQ ID NO: 2714543 - protein, 38 aa, Entamoeba histolytica
ICHEESTLFWMFKYVMDFLQPFYFCKGDIIMKALRKNG

SEQ ID NO: 2714544 - protein, 18 aa, Entamoeba histolytica
ICHLLVTSISLKFKLTFS

SEQ ID NO: 2714545 - protein, 25 aa, Entamoeba histolytica
ICIARDNMNILDVIEFLKTFQHHKI

SEQ ID NO: 2714546 - protein, 25 aa, Entamoeba histolytica
ICIDFISFCISNYPLIFPNDVDEKL

SEQ ID NO: 2714547 - protein, 24 aa, Entamoeba histolytica
ICIHSIIQIHILNIIVIIQSINGQ

SEQ ID NO: 2714548 - protein, 17 aa, Entamoeba histolytica
ICIIQVFGDQEMVVGYK

SEQ ID NO: 2714549 - protein, 17 aa, Entamoeba histolytica
ICIPRIYSRWKEEGYIN

SEQ ID NO: 2714550 - protein, 37 aa, Entamoeba histolytica
ICISHKWDFVSFYPKYTKLIFTLFCNIGMVSCDDFFG

SEQ ID NO: 2714551 - protein, 26 aa, Entamoeba histolytica
ICKDIYKHWGLIWYTYHRTLKIKMKE

SEQ ID NO: 2714552 - protein, 48 aa, Entamoeba histolytica
ICKDKCEYWYWINKLSYFTHNIGVLGFPLLVAIRKSGWRVPNPIYRCI

SEQ ID NO: 2714553 - protein, 19 aa, Entamoeba histolytica
ICKKVQIEITPEAIIDKLE

SEQ ID NO: 2714554 - protein, 28 aa, Entamoeba histolytica
ICLKKHVMVLVFTTDGNVFGCYNSKRLP

SEQ ID NO: 2714555 - protein, 21 aa, Entamoeba histolytica
ICMICFQTVRQGMNTLRCCKG

SEQ ID NO: 2714556 - protein, 28 aa, Entamoeba histolytica
ICNEFIDKNLYLLPIKQIIQKYGKNEQN

SEQ ID NO: 2714557 - protein, 30 aa, Entamoeba histolytica
ICNVPLMNNGIIYNAFYNEGYLVVLECNGI

SEQ ID NO: 2714558 - protein, 18 aa, Entamoeba histolytica
ICQGPDSFYFIHKGKIGK

SEQ ID NO: 2714559 - protein, 17 aa, Entamoeba histolytica
ICQHIKDWIYGTKPGIM

SEQ ID NO: 2714560 - protein, 24 aa, Entamoeba histolytica
ICQKLLSEVLIQLLLPDTHDEMKS

SEQ ID NO: 2714561 - protein, 17 aa, Entamoeba histolytica
ICRLFTSISSEGLNRMS

SEQ ID NO: 2714562 - protein, 24 aa, Entamoeba histolytica
ICSAEYLCTILMALSSKSISTNER

SEQ ID NO: 2714563 - protein, 25 aa, Entamoeba histolytica
ICSINSYIIPLKRIIIGAFKDTTND

SEQ ID NO: 2714564 - protein, 19 aa, Entamoeba histolytica
ICSQPKLLYQLKFKNKDNE

SEQ ID NO: 2714565 - protein, 26 aa, Entamoeba histolytica
ICSVIQSMFPQQYTFQPIITQNSQQL

SEQ ID NO: 2714566 - protein, 22 aa, Entamoeba histolytica
ICVKFAFIEFIGDKSPRLQKAG

SEQ ID NO: 2714567 - protein, 37 aa, Entamoeba histolytica
ICVKPFCSCYIDCSVFIFLNLTQWKSYDFKFTSEPSL

SEQ ID NO: 2714568 - protein, 20 aa, Entamoeba histolytica
ICWLKLKIYNTFVLPIDAGD

SEQ ID NO: 2714569 - protein, 20 aa, Entamoeba histolytica
ICYFHNLGYDGRFLAQYGII

SEQ ID NO: 2714570 - protein, 19 aa, Entamoeba histolytica
ICYTDLYENDILAKQLGNS

SEQ ID NO: 2714571 - protein, 23 aa, Entamoeba histolytica
IDACGNLVDIGDYLIYEKTKEQL

SEQ ID NO: 2714572 - protein, 30 aa, Entamoeba histolytica; identical to SEQ ID NO: 2526616

SEQ ID NO: 2714573 - protein, 24 aa, Entamoeba histolytica
IDAHTIPLLKVIAPKIISLSIHTE

SEQ ID NO: 2714574 - protein, 31 aa, Entamoeba histolytica
IDCEEWAREVFYFALRDTLVCENLTIAREVA

SEQ ID NO: 2714575 - protein, 27 aa, Entamoeba histolytica
IDCKADLFTFALLVTKIWTGKLPYSPN

SEQ ID NO: 2714576 - protein, 31 aa, Entamoeba histolytica
IDDDFTFFKQFFYLQRLPSGLRRFILPKNDD

SEQ ID NO: 2714577 - protein, 26 aa, Entamoeba histolytica
IDDDKLIPALVYRLTHKDTYLTEDPE

SEQ ID NO: 2714578 - protein, 25 aa, Entamoeba histolytica
IDDFFTKLCIFFPNIIDLKHVTNQI

SEQ ID NO: 2714579 - protein, 18 aa, Entamoeba histolytica
IDDLFTFDDISKPKEETK

SEQ ID NO: 2714580 - protein, 23 aa, Entamoeba histolytica
IDDYQFLPFIFGSAQLIKHPYLK

SEQ ID NO: 2714581 - protein, 19 aa, Entamoeba histolytica
IDEADKLLEMDFANEIDYL

SEQ ID NO: 2714582 - protein, 18 aa, Entamoeba histolytica
IDEIRRSFRGKWPISYIK

SEQ ID NO: 2714583 - protein, 29 aa, Entamoeba histolytica
IDENPPYEYYLYYLYANITVLNGFRKEKK

SEQ ID NO: 2714584 - protein, 30 aa, Entamoeba histolytica
IDEQPLFVIHVLWLRVLYNISLPDDDNCFI

SEQ ID NO: 2714585 - protein, 28 aa, Entamoeba histolytica
IDESYIIFDLLLFKEIIEKGYGMYESYF

SEQ ID NO: 2714586 - protein, 25 aa, Entamoeba histolytica
IDFDYYIENQLKKPLTRIFKPILGE

SEQ ID NO: 2714587 - protein, 18 aa, Entamoeba histolytica
IDFESVLFYGFENVDLFI

SEQ ID NO: 2714588 - protein, 24 aa, Entamoeba histolytica
IDFNGFQIPKVYDGKFERKPMELE

SEQ ID NO: 2714589 - protein, 23 aa, Entamoeba histolytica
IDFNTFIVRRILTIPSTPLPNNQ

SEQ ID NO: 2714590 - protein, 26 aa, Entamoeba histolytica
IDFNTNRFFLITKELTYLVACESMED

SEQ ID NO: 2714591 - protein, 17 aa, Entamoeba histolytica
IDFPPFLKELHTSCFSQ

SEQ ID NO: 2714592 - protein, 32 aa, Entamoeba histolytica
IDFTLFSNILFVQYLLGIVPNWRVLNSTFSRM

SEQ ID NO: 2714593 - protein, 26 aa, Entamoeba histolytica
IDGCDYPFVYENPYLSDKQLDNKIHE

SEQ ID NO: 2714594 - protein, 29 aa, Entamoeba histolytica
IDGIKGLIILYHYIKVDPLPLLRERIIKL

SEQ ID NO: 2714595 - protein, 30 aa, Entamoeba histolytica
IDGIKYLSTFFPINAIFKSALQTQSKKIAQ

SEQ ID NO: 2714596 - protein, 26 aa, Entamoeba histolytica
IDGLQYLLIIRHHAVFYYVKEKRSKK

SEQ ID NO: 2714597 - protein, 21 aa, Entamoeba histolytica
IDGVDIFQLLRSPSFITRSPP

SEQ ID NO: 2714598 - protein, 23 aa, Entamoeba histolytica
IDGYDLFHIVFTNNLLKEEFIKK

SEQ ID NO: 2714599 - protein, 18 aa, Entamoeba histolytica
IDHLYGSYIIDQSTYRVG

SEQ ID NO: 2714600 - protein, 27 aa, Entamoeba histolytica
IDHMYFIMMDLMKGSIWDLLHQRPMEF

SEQ ID NO: 2714601 - protein, 22 aa, Entamoeba histolytica
IDHSFLIPLITSIEIIARGCNV

SEQ ID NO: 2714602 - protein, 17 aa, Entamoeba histolytica
IDHTCGISLLVESFYND

SEQ ID NO: 2714603 - protein, 26 aa, Entamoeba histolytica
IDIDFNLLPMDRGINSWFFLKEPEGS

SEQ ID NO: 2714604 - protein, 23 aa, Entamoeba histolytica
IDIDHIVICAPFLKNQYVSYSLK

SEQ ID NO: 2714605 - protein, 19 aa, Entamoeba histolytica
IDIILTKEFIMNIAHFAIL

SEQ ID NO: 2714606 - protein, 25 aa, Entamoeba histolytica
IDIKSHFGFVTFTNAEDGKKIIDDK

SEQ ID NO: 2714607 - protein, 21 aa, Entamoeba histolytica
IDIKSLKNYFIDLDTLEDICD

SEQ ID NO: 2714608 - protein, 36 aa, Entamoeba histolytica
IDINEDFWLRQTFIEFLSWYVIVLLDEQNPLHIENL

SEQ ID NO: 2714609 - protein, 18 aa, Entamoeba histolytica
IDIPTLQGLIEQYLQFYY

SEQ ID NO: 2714610 - protein, 18 aa, Entamoeba histolytica
IDIQGMLCFYKKNTFNGK

SEQ ID NO: 2714611 - protein, 25 aa, Entamoeba histolytica
IDISTIQFILQQFSFAISRSKVLCP

SEQ ID NO: 2714612 - protein, 23 aa, Entamoeba histolytica
IDIVLCKYCDFIYIAVTEDIVFS

SEQ ID NO: 2714613 - protein, 25 aa, Entamoeba histolytica
IDIWSLGCCIYWMATGHPIYPIDDV

SEQ ID NO: 2714614 - protein, 24 aa, Entamoeba histolytica
IDKDFASVFFSLENPQFFCGTQRG

SEQ ID NO: 2714615 - protein, 30 aa, Entamoeba histolytica
IDKIISIEEMVMKNKLFRKPKETDTITAEF

SEQ ID NO: 2714616 - protein, 17 aa, Entamoeba histolytica
IDKKHIIQLKEKHLKEF

SEQ ID NO: 2714617 - protein, 24 aa, Entamoeba histolytica
IDKKHNYYPSWKKDRIGISIDEYK

SEQ ID NO: 2714618 - protein, 17 aa, Entamoeba histolytica
IDKLDYCIHSDTMFVFV

SEQ ID NO: 2714619 - protein, 20 aa, Entamoeba histolytica
IDKLSEEQIELAKQALEDGN

SEQ ID NO: 2714620 - protein, 25 aa, Entamoeba histolytica
IDKNFFRFFFPIAPSYLHSSFLCID

SEQ ID NO: 2714621 - protein, 24 aa, Entamoeba histolytica
IDKNGHLLLTDFGLSVVGLCNEQH

SEQ ID NO: 2714622 - protein, 23 aa, Entamoeba histolytica
IDKPTLMKILPQLSFGYDEDEEF

SEQ ID NO: 2714623 - protein, 25 aa, Entamoeba histolytica
IDKVKSLPIFKWIISGGTMPEKGYP

SEQ ID NO: 2714624 - protein, 25 aa, Entamoeba histolytica
IDLCKPALSLLLTFLSKKVISNDIR

SEQ ID NO: 2714625 - protein, 18 aa, Entamoeba histolytica
IDLKKLAQDDVLGDAVAR

SEQ ID NO: 2714626 - protein, 21 aa, Entamoeba histolytica
IDLLLRAVPWTDYKAREEMAD

SEQ ID NO: 2714627 - protein, 23 aa, Entamoeba histolytica
IDLMKDIIGILKKLYKKIEQADE

SEQ ID NO: 2714628 - protein, 29 aa, Entamoeba histolytica
IDLNKSSKLILLYKPLREWGKELYEYGNS

SEQ ID NO: 2714629 - protein, 20 aa, Entamoeba histolytica
IDLPTTFNIEYLLSKGLDQL

SEQ ID NO: 2714630 - protein, 17 aa, Entamoeba histolytica
IDLSLPVQFCLPKVFKL

SEQ ID NO: 2714631 - protein, 24 aa, Entamoeba histolytica
IDLSQTTPFMFRDKKINIELSKQN

SEQ ID NO: 2714632 - protein, 17 aa, Entamoeba histolytica
IDLSRCFISKLIIRRCK

SEQ ID NO: 2714633 - protein, 25 aa, Entamoeba histolytica
IDLSTISLFPNLKVQKLYAWNDTQI

SEQ ID NO: 2714634 - protein, 18 aa, Entamoeba histolytica
IDLVWSNDGFFKDQQFLV

SEQ ID NO: 2714635 - protein, 23 aa, Entamoeba histolytica
IDLVYITFISINRIIKKVRICRS

SEQ ID NO: 2714636 - protein, 19 aa, Entamoeba histolytica
IDLYFYDVYEKPTLTSDIA

SEQ ID NO: 2714637 - protein, 19 aa, Entamoeba histolytica
IDMLGPIPDYLLRKGTKTE

SEQ ID NO: 2714638 - protein, 19 aa, Entamoeba histolytica
IDMMIYCPQLLFKTRIKTS

SEQ ID NO: 2714639 - protein, 28 aa, Entamoeba histolytica
IDMWSVGCIIAELFLGVPLFPADSEFDL

SEQ ID NO: 2714640 - protein, 31 aa, Entamoeba histolytica
IDNDCLFLYLGEYWYHLMNWKIPEEHIVYYA

SEQ ID NO: 2714641 - protein, 18 aa, Entamoeba histolytica
IDNKPLFYQTINYLIHYN

SEQ ID NO: 2714642 - protein, 22 aa, Entamoeba histolytica
IDNLCIVVAPTFFWKKGEMQRQ

SEQ ID NO: 2714643 - protein, 18 aa, Entamoeba histolytica
IDNLILNFAIYDQSKKEK

SEQ ID NO: 2714644 - protein, 26 aa, Entamoeba histolytica
IDNLSLDSLILLHRLMYHKKGEDSER

SEQ ID NO: 2714645 - protein, 24 aa, Entamoeba histolytica
IDNNFNILFTLGGDGTLRGANAIN

SEQ ID NO: 2714646 - protein, 24 aa, Entamoeba histolytica
IDNRPWHINVEYRTQKWNELVSFL

SEQ ID NO: 2714647 - protein, 25 aa, Entamoeba histolytica
IDPQNVGLILFKIKREIRKQNFINA

SEQ ID NO: 2714648 - protein, 23 aa, Entamoeba histolytica
IDPTLSMMLSQISKLSIGDDDDK

SEQ ID NO: 2714649 - protein, 24 aa, Entamoeba histolytica
IDQKQLINLTDWHDIHKKRESDTK

SEQ ID NO: 2714650 - protein, 22 aa, Entamoeba histolytica
IDQLLKGYFGISVLNVANENGV

SEQ ID NO: 2714651 - protein, 31 aa, Entamoeba histolytica
IDQLLQENLIEPFPLILRDSTQREYLVRQSL

SEQ ID NO: 2714652 - protein, 25 aa, Entamoeba histolytica
IDQTLYIPYLQLLTSQTFKTILLIK

SEQ ID NO: 2714653 - protein, 24 aa, Entamoeba histolytica
IDRDHYMCIICFKRMSRGYACCHC

SEQ ID NO: 2714654 - protein, 21 aa, Entamoeba histolytica
IDRFKLQYRFAKVCFVSSLTG

SEQ ID NO: 2714655 - protein, 22 aa, Entamoeba histolytica
IDRRLREVLIYLFSQEYSEADK

SEQ ID NO: 2714656 - protein, 26 aa, Entamoeba histolytica
IDSFAVELYSFYNSLPIVKTQTLCYY

SEQ ID NO: 2714657 - protein, 17 aa, Entamoeba histolytica
IDSFIDAFAKRASQLYD

SEQ ID NO: 2714658 - protein, 25 aa, Entamoeba histolytica
IDSFKMYLNNIFYNAGISQVNAMDL

SEQ ID NO: 2714659 - protein, 27 aa, Entamoeba histolytica
IDSIPTFYKNFIYLQIPKQTSSKPDIN

SEQ ID NO: 2714660 - protein, 26 aa, Entamoeba histolytica
IDSLHKYFPLRFIPTLWTEDCDLLTQ

SEQ ID NO: 2714661 - protein, 17 aa, Entamoeba histolytica
IDSLIRYLSDENAITVE

SEQ ID NO: 2714662 - protein, 31 aa, Entamoeba histolytica
IDSLPTIIALGKYFHYLLSSNNFFQIEQMLP

SEQ ID NO: 2714663 - protein, 23 aa, Entamoeba histolytica
IDSNIMAILCYLLNNVHITEIRE

SEQ ID NO: 2714664 - protein, 18 aa, Entamoeba histolytica
IDSSLFSWKHPTTDRNDE

SEQ ID NO: 2714665 - protein, 18 aa, Entamoeba histolytica
IDSVLSVYSYPQGLIELL

SEQ ID NO: 2714666 - protein, 28 aa, Entamoeba histolytica
IDSYQVLDMLWMIWNYDEEYSLFCKEKE

SEQ ID NO: 2714667 - protein, 18 aa, Entamoeba histolytica
IDTELLKRWTGMRNFRII

SEQ ID NO: 2714668 - protein, 18 aa, Entamoeba histolytica
IDTEVEVQIIQRICLYWL

SEQ ID NO: 2714669 - protein, 24 aa, Entamoeba histolytica
IDTLRIGRIMKLSRITEVLKSSES

SEQ ID NO: 2714670 - protein, 29 aa, Entamoeba histolytica
IDTMEDELYIFLWRFERDGKFDVWRCFYE

SEQ ID NO: 2714671 - protein, 19 aa, Entamoeba histolytica
IDTMLAVCQGAAYKAFGTD

SEQ ID NO: 2714672 - protein, 29 aa, Entamoeba histolytica
IDTRVFTSEFKLFRKKEAKVFSLIKSSME

SEQ ID NO: 2714673 - protein, 17 aa, Entamoeba histolytica
IDTWIIYNLTGGQSHST

SEQ ID NO: 2714674 - protein, 23 aa, Entamoeba histolytica
IDVDGLVIIRGKLVWKITVCVHI

SEQ ID NO: 2714675 - protein, 25 aa, Entamoeba histolytica
IDVGIGLERIPWLINGTPTSYLEAF

SEQ ID NO: 2714676 - protein, 40 aa, Entamoeba histolytica
IDVIASFIKKLLIKSLYSSPSFICSVLGIVSNMLIKYPIL

SEQ ID NO: 2714677 - protein, 25 aa, Entamoeba histolytica
IDVIVPWTHLYSKPIILRLGEVIVD

SEQ ID NO: 2714678 - protein, 25 aa, Entamoeba histolytica
IDVKARNFLVFQGDVIQVASKSGKE

SEQ ID NO: 2714679 - protein, 21 aa, Entamoeba histolytica
IDVNITCLRSIYWNLNTSLIP

SEQ ID NO: 2714680 - protein, 36 aa, Entamoeba histolytica
IDVPEPYYLFNRFVLFNRELIGIKLPKSLKEINHTH

SEQ ID NO: 2714681 - protein, 19 aa, Entamoeba histolytica
IDVQFTRRNLLLAAGIYNS

SEQ ID NO: 2714682 - protein, 29 aa, Entamoeba histolytica
IDVQLQELLPFLYQRYPTVFPNDYIYYVI

SEQ ID NO: 2714683 - protein, 17 aa, Entamoeba histolytica
IDVQNYIRMRCNELVLL

SEQ ID NO: 2714684 - protein, 24 aa, Entamoeba histolytica
IDVSKFFIVKQLGTTFLFNINSIQ

SEQ ID NO: 2714685 - protein, 20 aa, Entamoeba histolytica
IDVSLFNRLPVDKKKKSDVF

SEQ ID NO: 2714686 - protein, 19 aa, Entamoeba histolytica
IDYKTPFFSVVAKNADPSK

SEQ ID NO: 2714687 - protein, 18 aa, Entamoeba histolytica
IDYLIRMKGIPKDVIIGV

SEQ ID NO: 2714688 - protein, 25 aa, Entamoeba histolytica
IDYLNDAMCLPLIELTNRLGTASQK

SEQ ID NO: 2714689 - protein, 17 aa, Entamoeba histolytica
IDYMSLYGNPQQFQQQP

SEQ ID NO: 2714690 - protein, 17 aa, Entamoeba histolytica
IDYMVPQMLFSLLEIAS

SEQ ID NO: 2714691 - protein, 27 aa, Entamoeba histolytica
IDYNLLKIYFSGIIEFNFNPVTKICIE

SEQ ID NO: 2714692 - protein, 25 aa, Entamoeba histolytica
IDYQIIFCDTGFTQQNWKSNDSSID

SEQ ID NO: 2714693 - protein, 22 aa, Entamoeba histolytica
IDYRSMVFVFTFDPITHQAQFL

SEQ ID NO: 2714694 - protein, 19 aa, Entamoeba histolytica
IDYVPIYYEILHSLDTHSS

SEQ ID NO: 2714695 - protein, 19 aa, Entamoeba histolytica
IEAFLPHTDIIYFVYDMTD

SEQ ID NO: 2714696 - protein, 18 aa, Entamoeba histolytica
IEAIYYFYREWYDAMKWD

SEQ ID NO: 2714697 - protein, 24 aa, Entamoeba histolytica
IEALLHSLLQISVVRPIVLKLADV

SEQ ID NO: 2714698 - protein, 19 aa, Entamoeba histolytica
IEALTILLKDVWKNLKDEN

SEQ ID NO: 2714699 - protein, 42 aa, Entamoeba histolytica
IEAPKGYPIIPLKPSCLPYPPQFLIPPQKSYLPRKVRLHSLH

SEQ ID NO: 2714700 - protein, 32 aa, Entamoeba histolytica
IEARNTFLTLFFLRYCFRPFSKVPSVLKILHE

SEQ ID NO: 2714701 - protein, 17 aa, Entamoeba histolytica
IEAYLNDSSLKASFRDF

SEQ ID NO: 2714702 - protein, 25 aa, Entamoeba histolytica
IECATYVLLIYMMKNIYCECKTIAG

SEQ ID NO: 2714703 - protein, 24 aa, Entamoeba histolytica
IECDPFNHIYYSNRSACYCYLNND

SEQ ID NO: 2714704 - protein, 25 aa, Entamoeba histolytica
IECRDLQCFFSLSKDISRFEIFNRE

SEQ ID NO: 2714705 - protein, 24 aa, Entamoeba histolytica
IECYGEFPLYYTKTSVPLCIDLKK

SEQ ID NO: 2714706 - protein, 18 aa, Entamoeba histolytica
IEDFIYPGLLKEGEKVIL

SEQ ID NO: 2714707 - protein, 27 aa, Entamoeba histolytica
IEDFVPKAIMHFLINQTCKDLQKALVE

SEQ ID NO: 2714708 - protein, 33 aa, Entamoeba histolytica
IEDGIRTLQYSYVKVFFLPKEDLSPDLFVFRQN

SEQ ID NO: 2714709 - protein, 17 aa, Entamoeba histolytica
IEDLPPSPLPTQSPSII

SEQ ID NO: 2714710 - protein, 22 aa, Entamoeba histolytica
IEDLSLLIESLLILIKMDESKT

SEQ ID NO: 2714711 - protein, 29 aa, Entamoeba histolytica
IEDRKVLMWNCFLALVLNIKGKIGRVTLE

SEQ ID NO: 2714712 - protein, 23 aa, Entamoeba histolytica
IEDYYHYLSTQIPILRWVELEYC

SEQ ID NO: 2714713 - protein, 24 aa, Entamoeba histolytica
IEDYYMFFIHPCGTSSSLLPIIEF

SEQ ID NO: 2714714 - protein, 26 aa, Entamoeba histolytica
IEEEKSLVFFDWPNTSLNFMLPCGST

SEQ ID NO: 2714715 - protein, 25 aa, Entamoeba histolytica
IEEIEFQVNQLYQSEIEDLYSNEKY

SEQ ID NO: 2714716 - protein, 33 aa, Entamoeba histolytica
IEEIHFYQSLLQSFGYKFVFNKSPNKKKIHYLN

SEQ ID NO: 2714717 - protein, 26 aa, Entamoeba histolytica
IEELEFEYFNLEKRISLLNRRKDIIK

SEQ ID NO: 2714718 - protein, 19 aa, Entamoeba histolytica
IEEMITNLWIRYSSVLKSI

SEQ ID NO: 2714719 - protein, 26 aa, Entamoeba histolytica
IEEQAFFRCRYLTSITLSTSIKILSK

SEQ ID NO: 2714720 - protein, 27 aa, Entamoeba histolytica
IEEQTTLLSVLPFGEDRIKGINGLREM

SEQ ID NO: 2714721 - protein, 26 aa, Entamoeba histolytica
IEERGNLINELLIKRLESIPKSSDLS

SEQ ID NO: 2714722 - protein, 32 aa, Entamoeba histolytica
IEESAIGTILFNGKYYIASPTKLYLLENKQLK

SEQ ID NO: 2714723 - protein, 17 aa, Entamoeba histolytica
IEEVTIYMDWVIEMLKV

SEQ ID NO: 2714724 - protein, 25 aa, Entamoeba histolytica
IEEYSHLIILFKFHLNKNHAYHPLV

SEQ ID NO: 2714725 - protein, 28 aa, Entamoeba histolytica
IEEYVHMLQPFLLDNLRYNIKSPNPTSN

SEQ ID NO: 2714726 - protein, 30 aa, Entamoeba histolytica; identical to SEQ ID NO: 2526763

SEQ ID NO: 2714727 - protein, 20 aa, Entamoeba histolytica
IEFLELLFVDLLFGDKEISF

SEQ ID NO: 2714728 - protein, 18 aa, Entamoeba histolytica
IEFPLHCNKVLLLNNSNA

SEQ ID NO: 2714729 - protein, 28 aa, Entamoeba histolytica
IEFTPISYQPLKALAPFITDFSGESIAG

SEQ ID NO: 2714730 - protein, 19 aa, Entamoeba histolytica
IEFTYFYEQIIERLKRQEF

SEQ ID NO: 2714731 - protein, 26 aa, Entamoeba histolytica
IEGGYAYEFELFITIKCITKINDKIM

SEQ ID NO: 2714732 - protein, 25 aa, Entamoeba histolytica
IEGKIQYVILGYAKAFEGIPRQLAD

SEQ ID NO: 2714733 - protein, 26 aa, Entamoeba histolytica
IEGKIQYVILGYAKAFEGIPRQLADN

SEQ ID NO: 2714734 - protein, 25 aa, Entamoeba histolytica
IEGKKVNMFWSLRDFKQRTQNETNL

SEQ ID NO: 2714735 - protein, 32 aa, Entamoeba histolytica
IEGKTLKLVIMTLYKVFLLENSNIQEEIKTIK

SEQ ID NO: 2714736 - protein, 18 aa, Entamoeba histolytica
IEGNLYTFTKYKSFNDLL

SEQ ID NO: 2714737 - protein, 18 aa, Entamoeba histolytica
IEGVKQAFLFKQYVLYFT

SEQ ID NO: 2714738 - protein, 21 aa, Entamoeba histolytica
IEGVLYNKFVIDQLLSNLNEP

SEQ ID NO: 2714739 - protein, 25 aa, Entamoeba histolytica
IEGVQQFGIGHWKLILNNFKFDDRS

SEQ ID NO: 2714740 - protein, 17 aa, Entamoeba histolytica
IEGYSTKLLIDPESDEM

SEQ ID NO: 2714741 - protein, 19 aa, Entamoeba histolytica
IEHILFYHQLSPAKLISIF

SEQ ID NO: 2714742 - protein, 23 aa, Entamoeba histolytica
IEIESIPIIIKLISNKMSNIGKQ

SEQ ID NO: 2714743 - protein, 31 aa, Entamoeba histolytica
IEIIGQFNKGFIIGKLGYDLYIIDQHAADEI

SEQ ID NO: 2714744 - protein, 17 aa, Entamoeba histolytica
IEIKPIKPKLIESKPIE

SEQ ID NO: 2714745 - protein, 18 aa, Entamoeba histolytica
IEIKSPLSQLIIAESKEV

SEQ ID NO: 2714746 - protein, 17 aa, Entamoeba histolytica
IEILKNKMSRIIEECNN

SEQ ID NO: 2714747 - protein, 30 aa, Entamoeba histolytica
IEIPDGHCELLYFGFLKPVDIEKFKVHDDI

SEQ ID NO: 2714748 - protein, 20 aa, Entamoeba histolytica
IEIRHDGKISRRSVSGPKGR

SEQ ID NO: 2714749 - protein, 20 aa, Entamoeba histolytica
IEIRTICNCLWENCLKYFKN

SEQ ID NO: 2714750 - protein, 25 aa, Entamoeba histolytica
IEIRTLYFTALGMLLYSLPSKFHLQ

SEQ ID NO: 2714751 - protein, 26 aa, Entamoeba histolytica
IEISRIQYYLTLYSKTRLRKIHQMAR

SEQ ID NO: 2714752 - protein, 22 aa, Entamoeba histolytica
IEKAKPLISIASDFIPGGEIIK

SEQ ID NO: 2714753 - protein, 17 aa, Entamoeba histolytica
IEKEITMGYFSQYSTFK

SEQ ID NO: 2714754 - protein, 23 aa, Entamoeba histolytica
IEKFKYIISYWIEHFSSDFTTQM

SEQ ID NO: 2714755 - protein, 17 aa, Entamoeba histolytica
IEKGCFNRCYSLRSIEI

SEQ ID NO: 2714756 - protein, 23 aa, Entamoeba histolytica
IEKGCFNRCYSLRSIEIPTSVSK

SEQ ID NO: 2714757 - protein, 23 aa, Entamoeba histolytica
IEKGLPYDILLFNDLNTVETYIE

SEQ ID NO: 2714758 - protein, 26 aa, Entamoeba histolytica
IEKGVIQYLIRYIYRQNIQFARNAVW

SEQ ID NO: 2714759 - protein, 21 aa, Entamoeba histolytica
IEKHLPSFFFPKDSEFNVYFF

SEQ ID NO: 2714760 - protein, 45 aa, Entamoeba histolytica
IEKIEYFGTVRLIGKLYIQGAVVFKLPLLCCKELLQVGNDLTIEA

SEQ ID NO: 2714761 - protein, 25 aa, Entamoeba histolytica
IEKKERTLFIISNRNYDLSQGLMHG

SEQ ID NO: 2714762 - protein, 25 aa, Entamoeba histolytica
IEKKFKVFMVILDSMTDRELDGSAK

SEQ ID NO: 2714763 - protein, 24 aa, Entamoeba histolytica
IEKKPVEIKPIKPKSIEIKPSNEL

SEQ ID NO: 2714764 - protein, 26 aa, Entamoeba histolytica
IEKLYDPNYIYSIILPNTPEAMEKGK

SEQ ID NO: 2714765 - protein, 31 aa, Entamoeba histolytica
IEKNGIFTIHGKLVLWLANGTHYETDGYTTK

SEQ ID NO: 2714766 - protein, 25 aa, Entamoeba histolytica
IEKPSALKGFLIPVTKTGSPINEEL

SEQ ID NO: 2714767 - protein, 29 aa, Entamoeba histolytica
IEKPTYNGLPLFPYMCRSAALTYSGRIKL

SEQ ID NO: 2714768 - protein, 22 aa, Entamoeba histolytica
IEKQLIIPPKNRIHFAAFGGSI

SEQ ID NO: 2714769 - protein, 18 aa, Entamoeba histolytica
IEKSFFHKFYEPLKEWTS

SEQ ID NO: 2714770 - protein, 22 aa, Entamoeba histolytica
IEKSLLQLVTIKAAKRISHLDI

SEQ ID NO: 2714771 - protein, 22 aa, Entamoeba histolytica
IEKYEWAEYIQSIFSKESLKDE

SEQ ID NO: 2714772 - protein, 18 aa, Entamoeba histolytica
IEKYYYFGDIKEKEYLSI

SEQ ID NO: 2714773 - protein, 24 aa, Entamoeba histolytica
IELAKWIIQEFPNAFIGIAGVITF

SEQ ID NO: 2714774 - protein, 18 aa, Entamoeba histolytica
IELCIFYNGILRKDIKTS

SEQ ID NO: 2714775 - protein, 19 aa, Entamoeba histolytica
IELENFPQLIDLNEDNFFR

SEQ ID NO: 2714776 - protein, 26 aa, Entamoeba histolytica
IELINKNILNPPPIDKIHNFVKCIGY

SEQ ID NO: 2714777 - protein, 32 aa, Entamoeba histolytica; identical to SEQ ID NO: 2526821

SEQ ID NO: 2714778 - protein, 20 aa, Entamoeba histolytica
IELLQPPVAFPKKDDKIKIG

SEQ ID NO: 2714779 - protein, 26 aa, Entamoeba histolytica
IELNQIWETLPFYLDEDKPLHGTNVP

SEQ ID NO: 2714780 - protein, 28 aa, Entamoeba histolytica
IELPKHFLCFRFIKTPDLIELHWSKKHY

SEQ ID NO: 2714781 - protein, 24 aa, Entamoeba histolytica
IELSDFKQWVLYIARYVKELYLKK

SEQ ID NO: 2714782 - protein, 29 aa, Entamoeba histolytica
IELSKKKKILQQLILKKITNDFLNTITVD

SEQ ID NO: 2714783 - protein, 18 aa, Entamoeba histolytica
IELYKILPSFKNVKKLDL

SEQ ID NO: 2714784 - protein, 27 aa, Entamoeba histolytica
IEMKYNPIIIWVDADIKLLYQRADKRV

SEQ ID NO: 2714785 - protein, 20 aa, Entamoeba histolytica
IEMLLTWACSLLPINVERVV

SEQ ID NO: 2714786 - protein, 20 aa, Entamoeba histolytica
IEMNDIHIFFVTSKFGTLNE

SEQ ID NO: 2714787 - protein, 26 aa, Entamoeba histolytica
IEMTSPIGVLLKSIKFTENTTAIIVG

SEQ ID NO: 2714788 - protein, 23 aa, Entamoeba histolytica
IENCNEKIIKGHKLYLQHANSQP

SEQ ID NO: 2714789 - protein, 33 aa, Entamoeba histolytica
IENDKLVNCAKGLQLKFFFSIMEAEMSDIKKLS

SEQ ID NO: 2714790 - protein, 24 aa, Entamoeba histolytica
IENDYLLHVIARLNNQTIKKAYNA

SEQ ID NO: 2714791 - protein, 24 aa, Entamoeba histolytica
IENEPVDGLFKNGNPVDMLDLNQE

SEQ ID NO: 2714792 - protein, 26 aa, Entamoeba histolytica
IENIDIVSLKIYFIELDTLEDFCDYL

SEQ ID NO: 2714793 - protein, 18 aa, Entamoeba histolytica
IENINIRILKDYFIDMDC

SEQ ID NO: 2714794 - protein, 23 aa, Entamoeba histolytica
IENLFAPFVNVLIRLIEIATSAS

SEQ ID NO: 2714795 - protein, 24 aa, Entamoeba histolytica
IENLKSLLFPFEWCNICIDSLPYS

SEQ ID NO: 2714796 - protein, 25 aa, Entamoeba histolytica
IENNRPLLFIALMESDIELSQKYID

SEQ ID NO: 2714797 - protein, 22 aa, Entamoeba histolytica
IENPKRWVMDYVNAGASLVTFH

SEQ ID NO: 2714798 - protein, 26 aa, Entamoeba histolytica
IENPTKLLVFDFGGGTLDITCIEMKL

SEQ ID NO: 2714799 - protein, 24 aa, Entamoeba histolytica
IENRGIAFITFYDIRDAIKAHEEL

SEQ ID NO: 2714800 - protein, 26 aa, Entamoeba histolytica
IENSVGIIFYLLKRYGNLSSTLNEYI

SEQ ID NO: 2714801 - protein, 28 aa, Entamoeba histolytica
IENWTLMEMYWEQAIFKYLRCDPQDHYF

SEQ ID NO: 2714802 - protein, 17 aa, Entamoeba histolytica
IENYWGCIEKILSALQG

SEQ ID NO: 2714803 - protein, 29 aa, Entamoeba histolytica
IEPHYIEKMLCTIPTIVKCIILGENEKFL

SEQ ID NO: 2714804 - protein, 20 aa, Entamoeba histolytica
IEPKFIPFQHEMFSGSFNLV

SEQ ID NO: 2714805 - protein, 23 aa, Entamoeba histolytica
IEPLRKMLFAPSDKDKLAALKAI

SEQ ID NO: 2714806 - protein, 28 aa, Entamoeba histolytica
IEPNDQSAWIYYRWLLGTGMKCYNELNK

SEQ ID NO: 2714807 - protein, 30 aa, Entamoeba histolytica
IEPNRKVSTLRLGFVPLSPIEESFNKACQE

SEQ ID NO: 2714808 - protein, 26 aa, Entamoeba histolytica
IEPVELFMIHVFLLNNNMPPSGPQFA

SEQ ID NO: 2714809 - protein, 19 aa, Entamoeba histolytica
IEPVSQIVYNYQLVASCYL

SEQ ID NO: 2714810 - protein, 23 aa, Entamoeba histolytica
IEQIPPQLMFLHQGQKGIKEAHW

SEQ ID NO: 2714811 - protein, 23 aa, Entamoeba histolytica
IEQKYICIQLLSAVTKKYRTIEI

SEQ ID NO: 2714812 - protein, 27 aa, Entamoeba histolytica
IEQMKEERLSLINGIKGALGIEKECNM

SEQ ID NO: 2714813 - protein, 30 aa, Entamoeba histolytica; identical to SEQ ID NO: 2526869

SEQ ID NO: 2714814 - protein, 28 aa, Entamoeba histolytica
IEQMQQTKLIYEKFKPITPTPHSNQIEI

SEQ ID NO: 2714815 - protein, 25 aa, Entamoeba histolytica
IEQVRYFGYELAKRNIPVFLPPGGH

SEQ ID NO: 2714816 - protein, 17 aa, Entamoeba histolytica
IEQYQKPFADAYLKLKV

SEQ ID NO: 2714817 - protein, 19 aa, Entamoeba histolytica
IERFFDICINIIKDSPKDP

SEQ ID NO: 2714818 - protein, 35 aa, Entamoeba histolytica
IERIPELCNKFKIPFLFFKSQHPLYKIKEIYSFSK

SEQ ID NO: 2714819 - protein, 30 aa, Entamoeba histolytica
IERISDALKLLFPFSFTSIMPLFEGKNGIC

SEQ ID NO: 2714820 - protein, 27 aa, Entamoeba histolytica
IERIYDEYLPKVNYFVYLSINVNKERI

SEQ ID NO: 2714821 - protein, 26 aa, Entamoeba histolytica
IERKILMKIMLEQCPLCWIDSVEKDK

SEQ ID NO: 2714822 - protein, 19 aa, Entamoeba histolytica
IERKKLYMLQTRNGKMNAT

SEQ ID NO: 2714823 - protein, 18 aa, Entamoeba histolytica
IERLIEWGRGITPINIDT

SEQ ID NO: 2714824 - protein, 25 aa, Entamoeba histolytica
IERLIPADIVICAFGFGPDASFVEG

SEQ ID NO: 2714825 - protein, 19 aa, Entamoeba histolytica
IERLWLINEEKRLLAEKDK

SEQ ID NO: 2714826 - protein, 23 aa, Entamoeba histolytica
IERNKRITPFPSKIIIVGTKLDI

SEQ ID NO: 2714827 - protein, 34 aa, Entamoeba histolytica
IERRIRLLNPVQTDMLLFLKLVDYFQDDNDKELK

SEQ ID NO: 2714828 - protein, 23 aa, Entamoeba histolytica
IESIIFLHRLYLTSPFNHFSLLQ

SEQ ID NO: 2714829 - protein, 21 aa, Entamoeba histolytica
IESITTLFDKPFVIGNQSVSK

SEQ ID NO: 2714830 - protein, 24 aa, Entamoeba histolytica
IESKLSDQPVIKTTLNKSQESNSQ

SEQ ID NO: 2714831 - protein, 20 aa, Entamoeba histolytica
IESLLNNDILYWIKAELIST

SEQ ID NO: 2714832 - protein, 18 aa, Entamoeba histolytica
IESLSDSTIYMAYYTIAH

SEQ ID NO: 2714833 - protein, 27 aa, Entamoeba histolytica
IESLSKFVFVPLLYQEVFIFSCCEEYL

SEQ ID NO: 2714834 - protein, 25 aa, Entamoeba histolytica
IESMERQLMILSNKARFIKMVIEGE

SEQ ID NO: 2714835 - protein, 27 aa, Entamoeba histolytica
IESMNIFIELFLPYINRLLTSDSLFAK

SEQ ID NO: 2714836 - protein, 24 aa, Entamoeba histolytica
IESNTPLSIPPPPPSLSISQPSSS

SEQ ID NO: 2714837 - protein, 25 aa, Entamoeba histolytica
IETASLMVALKVRYPNRVHLLRGNH

SEQ ID NO: 2714838 - protein, 19 aa, Entamoeba histolytica
IETGLLCEETRFSRGFSGE

SEQ ID NO: 2714839 - protein, 20 aa, Entamoeba histolytica
IETLLCCNLIRKIDARETNV

SEQ ID NO: 2714840 - protein, 24 aa, Entamoeba histolytica
IETNTFIYVTFSFVTEIIIQNESS

SEQ ID NO: 2714841 - protein, 27 aa, Entamoeba histolytica
IETRAKRMTLPQLPNYLKQAIKKKKTE

SEQ ID NO: 2714842 - protein, 30 aa, Entamoeba histolytica
IETSQSIKLKKIYSIPCVIANKTFTFQQTG

SEQ ID NO: 2714843 - protein, 25 aa, Entamoeba histolytica
IETTLNHIPPMTKKFFISSQKVNFK

SEQ ID NO: 2714844 - protein, 17 aa, Entamoeba histolytica
IETWKIAVSLENITLTA

SEQ ID NO: 2714845 - protein, 19 aa, Entamoeba histolytica
IETYLLTVATFDDFISRKT

SEQ ID NO: 2714846 - protein, 23 aa, Entamoeba histolytica
IEVKCPPTFRLFASQNPLGEGSG

SEQ ID NO: 2714847 - protein, 25 aa, Entamoeba histolytica
IEVLCLLYALKVKYPRFIFICRGDH

SEQ ID NO: 2714848 - protein, 20 aa, Entamoeba histolytica
IEVMRAWITSKIIDILEVDD

SEQ ID NO: 2714849 - protein, 29 aa, Entamoeba histolytica
IEVMSCEGGWWYGRSGCSMGYFPGEYVEV

SEQ ID NO: 2714850 - protein, 21 aa, Entamoeba histolytica
IEVNDIIRLHLLKNVQRIIIY

SEQ ID NO: 2714851 - protein, 24 aa, Entamoeba histolytica
IEVNIFDLHPPAVPAWELSEQRLP

SEQ ID NO: 2714852 - protein, 17 aa, Entamoeba histolytica
IEVSAMVLRTLYNILVK

SEQ ID NO: 2714853 - protein, 20 aa, Entamoeba histolytica
IEWDYLDYAFMRLNKYYELK

SEQ ID NO: 2714854 - protein, 19 aa, Entamoeba histolytica
IEWIKLMQCFIQRKEIDEA

SEQ ID NO: 2714855 - protein, 29 aa, Entamoeba histolytica
IEWSKTEMYVFIRTIKLYFEMFIDNTSQL

SEQ ID NO: 2714856 - protein, 25 aa, Entamoeba histolytica
IEYDAFCSDVLPFIEILNSNGMIQS

SEQ ID NO: 2714857 - protein, 25 aa, Entamoeba histolytica
IEYGKKLLGLITYVNTPSFGKEDSK

SEQ ID NO: 2714858 - protein, 21 aa, Entamoeba histolytica
IEYKLFFTPVTEHKKFDGSFQ

SEQ ID NO: 2714859 - protein, 23 aa, Entamoeba histolytica
IEYSDYSYPIHKYLKGIAKEKIA

SEQ ID NO: 2714860 - protein, 19 aa, Entamoeba histolytica
IEYTIYDRNIFGNTIPIEV

SEQ ID NO: 2714861 - protein, 19 aa, Entamoeba histolytica
IFCNMRKKVDWLTENMMKA

SEQ ID NO: 2714862 - protein, 19 aa, Entamoeba histolytica
IFCNSKNRVEWIQRRLQAH

SEQ ID NO: 2714863 - protein, 18 aa, Entamoeba histolytica
IFDILQLNSIELIRHFNI

SEQ ID NO: 2714864 - protein, 19 aa, Entamoeba histolytica
IFDLHPPAVPAWELSEQRL

SEQ ID NO: 2714865 - protein, 17 aa, Entamoeba histolytica
IFDLLLHFNHDLQAVEK

SEQ ID NO: 2714866 - protein, 18 aa, Entamoeba histolytica
IFDQFSVNFYTLENLQQF

SEQ ID NO: 2714867 - protein, 17 aa, Entamoeba histolytica
IFDTDPYLVIDKSFRCL

SEQ ID NO: 2714868 - protein, 17 aa, Entamoeba histolytica
IFDTVYDGWERKSFNKH

SEQ ID NO: 2714869 - protein, 28 aa, Entamoeba histolytica
IFEDGRIFKYVIWYDVSYSRYLKEKEEM

SEQ ID NO: 2714870 - protein, 19 aa, Entamoeba histolytica
IFEIQRFIEFSALKNSLNE

SEQ ID NO: 2714871 - protein, 17 aa, Entamoeba histolytica
IFEKAMIFNFKKDVPIP

SEQ ID NO: 2714872 - protein, 23 aa, Entamoeba histolytica
IFENNPCVCAFPYVFGDKGFKAD

SEQ ID NO: 2714873 - protein, 19 aa, Entamoeba histolytica
IFEWNIWMEGPTQTPYEGG

SEQ ID NO: 2714874 - protein, 24 aa, Entamoeba histolytica
IFEYNMFSYFIRYVDVYLNIHQIQ

SEQ ID NO: 2714875 - protein, 26 aa, Entamoeba histolytica
IFEYNYIFLPFHQNSHFSLIIICFDK

SEQ ID NO: 2714876 - protein, 24 aa, Entamoeba histolytica
IFFGEVIIHYNIWDFPNWEINKDI

SEQ ID NO: 2714877 - protein, 19 aa, Entamoeba histolytica
IFGPMNGTTLLILDRSFDP

SEQ ID NO: 2714878 - protein, 18 aa, Entamoeba histolytica
IFGTWTERYVIIKDNVLV

SEQ ID NO: 2714879 - protein, 24 aa, Entamoeba histolytica
IFHIESNYWPKYVEYYLFCCEKHL

SEQ ID NO: 2714880 - protein, 17 aa, Entamoeba histolytica
IFHLFDKDTLTSDDHLG

SEQ ID NO: 2714881 - protein, 17 aa, Entamoeba histolytica
IFHLIRNPINNDICIQL

SEQ ID NO: 2714882 - protein, 17 aa, Entamoeba histolytica
IFIDIICITISIIELHR

SEQ ID NO: 2714883 - protein, 19 aa, Entamoeba histolytica
IFIEHYFINNFKNTLVQQI

SEQ ID NO: 2714884 - protein, 18 aa, Entamoeba histolytica
IFIPSDYIIPKPIKKVST

SEQ ID NO: 2714885 - protein, 23 aa, Entamoeba histolytica
IFIQCLLGYFPKEISLIDFICVS

SEQ ID NO: 2714886 - protein, 29 aa, Entamoeba histolytica
IFKDRPWKKDPYYFKKCYVSSVALLKMVM

SEQ ID NO: 2714887 - protein, 26 aa, Entamoeba histolytica
IFKLSKPPLVLFPNKQLTSIQFNFED

SEQ ID NO: 2714888 - protein, 30 aa, Entamoeba histolytica
IFKNDEKMMLAFFTIIAQKYLKLKRTDMEE

SEQ ID NO: 2714889 - protein, 19 aa, Entamoeba histolytica
IFKQVIWYEVNYQDYLKEK

SEQ ID NO: 2714890 - protein, 18 aa, Entamoeba histolytica
IFKVFKKDIIPHLLTLIS

SEQ ID NO: 2714891 - protein, 25 aa, Entamoeba histolytica
IFLGRYISQYLYKIYGEYALVISVG

SEQ ID NO: 2714892 - protein, 27 aa, Entamoeba histolytica
IFLGSTQGLIWKKLKTLKCIKCKVNVI

SEQ ID NO: 2714893 - protein, 23 aa, Entamoeba histolytica
IFLNIYSHLKYLLILNLKDFLNS

SEQ ID NO: 2714894 - protein, 19 aa, Entamoeba histolytica
IFLNKCAFELYLNKLYELM

SEQ ID NO: 2714895 - protein, 22 aa, Entamoeba histolytica
IFLSIKPMYIYFKRIEIEIQAI

SEQ ID NO: 2714896 - protein, 18 aa, Entamoeba histolytica
IFMNEAVLISIEIPKNLK

SEQ ID NO: 2714897 - protein, 18 aa, Entamoeba histolytica
IFMNEPALLSIQTPRDIQ

SEQ ID NO: 2714898 - protein, 19 aa, Entamoeba histolytica
IFMNEPVLISIKIPKKLEM

SEQ ID NO: 2714899 - protein, 19 aa, Entamoeba histolytica
IFNEGQYNSFLKRCNEEGD

SEQ ID NO: 2714900 - protein, 33 aa, Entamoeba histolytica
IFNGLSGLYLRTIAWRVWLGVLPTPISINWVEV

SEQ ID NO: 2714901 - protein, 25 aa, Entamoeba histolytica
IFNIQQIISRLILNSSLRAEHFMNL

SEQ ID NO: 2714902 - protein, 24 aa, Entamoeba histolytica
IFNKEINIIPPKKPILLCLEETNN

SEQ ID NO: 2714903 - protein, 17 aa, Entamoeba histolytica
IFNLLDKDKSGYLSPDE

SEQ ID NO: 2714904 - protein, 20 aa, Entamoeba histolytica
IFNLSMPILLPMIQNGLVPQ

SEQ ID NO: 2714905 - protein, 18 aa, Entamoeba histolytica
IFNPYQKVIDIIGRTLDP

SEQ ID NO: 2714906 - protein, 19 aa, Entamoeba histolytica
IFNSKIPFDCIIGPIVKTL

SEQ ID NO: 2714907 - protein, 20 aa, Entamoeba histolytica
IFNYFLKIEDIYSSSLLYVY

SEQ ID NO: 2714908 - protein, 18 aa, Entamoeba histolytica
IFNYLRLDGKTSQKQRDI

SEQ ID NO: 2714909 - protein, 18 aa, Entamoeba histolytica
IFQRWIEIIDTQTDSKLI

SEQ ID NO: 2714910 - protein, 19 aa, Entamoeba histolytica
IFQTNTNFIFRLVNPKDVN

SEQ ID NO: 2714911 - protein, 30 aa, Entamoeba histolytica
IFRLLPGMCQSLLLRIIFLTERISINEMYN

SEQ ID NO: 2714912 - protein, 19 aa, Entamoeba histolytica
IFSEISYGFPLLSKIDISN

SEQ ID NO: 2714913 - protein, 17 aa, Entamoeba histolytica
IFSFMPNEAPCAGVAEV

SEQ ID NO: 2714914 - protein, 19 aa, Entamoeba histolytica
IFSGSTLIYLIKGDGKTMD

SEQ ID NO: 2714915 - protein, 17 aa, Entamoeba histolytica
IFSLFKIKRFGKKPIEV

SEQ ID NO: 2714916 - protein, 22 aa, Entamoeba histolytica
IFSLIELPWIENTLLCIIRTRY

SEQ ID NO: 2714917 - protein, 24 aa, Entamoeba histolytica
IFSNHLFFNFYNLCSLELPNSIVK

SEQ ID NO: 2714918 - protein, 22 aa, Entamoeba histolytica
IFSQLFGGFGGFGGFSGFSGFG

SEQ ID NO: 2714919 - protein, 30 aa, Entamoeba histolytica
IFSTSHRIWLWIVNMPQIIHAMNALAPPTF

SEQ ID NO: 2714920 - protein, 29 aa, Entamoeba histolytica
IFTDLRSGLALIKLMEKLTGKTLDKKYDK

SEQ ID NO: 2714921 - protein, 27 aa, Entamoeba histolytica
IFTDNGKYFGYAQLLNSDKLPDWVDRS

SEQ ID NO: 2714922 - protein, 20 aa, Entamoeba histolytica
IFTEEVILTPILSCMDDIEK

SEQ ID NO: 2714923 - protein, 21 aa, Entamoeba histolytica
IFTFQNKNLYFYVMVAIYEDM

SEQ ID NO: 2714924 - protein, 18 aa, Entamoeba histolytica
IFTLILFYSSRGKITQLL

SEQ ID NO: 2714925 - protein, 19 aa, Entamoeba histolytica
IFTQFLLDILPHLDEFSLI

SEQ ID NO: 2714926 - protein, 23 aa, Entamoeba histolytica
IFTYFGYRKFSKGNYKGFPCFEL

SEQ ID NO: 2714927 - protein, 23 aa, Entamoeba histolytica
IFVFGCQGTTLFFLDPHYVQNAG

SEQ ID NO: 2714928 - protein, 27 aa, Entamoeba histolytica
IFVKAICMFLTTITTPDKFFLKLMERL

SEQ ID NO: 2714929 - protein, 17 aa, Entamoeba histolytica
IFVLIKMQQKQTAAYLQ

SEQ ID NO: 2714930 - protein, 27 aa, Entamoeba histolytica
IFVQENIGLFPQFGFEVTFREDKEATQ

SEQ ID NO: 2714931 - protein, 28 aa, Entamoeba histolytica
IFVSQSLTLWWNVMQNMPLLWNITDKEF

SEQ ID NO: 2714932 - protein, 18 aa, Entamoeba histolytica
IFWLHRAGGICVCSDPVF

SEQ ID NO: 2714933 - protein, 19 aa, Entamoeba histolytica
IFYCKKCGERCIQITQGKP

SEQ ID NO: 2714934 - protein, 21 aa, Entamoeba histolytica
IFYIIQCLYLIQNGLCQFCLD

SEQ ID NO: 2714935 - protein, 17 aa, Entamoeba histolytica
IFYKPPNIKLENILSLV

SEQ ID NO: 2714936 - protein, 30 aa, Entamoeba histolytica; identical to SEQ ID NO: 2527012

SEQ ID NO: 2714937 - protein, 27 aa, Entamoeba histolytica
IGANSYISRIIFIIRDSLETKNKPSVT

SEQ ID NO: 2714938 - protein, 18 aa, Entamoeba histolytica
IGCIIFECFIKRPPFQAA

SEQ ID NO: 2714939 - protein, 22 aa, Entamoeba histolytica
IGCILAKIYFYQKNQIIIISSI

SEQ ID NO: 2714940 - protein, 26 aa, Entamoeba histolytica
IGCSGLQLYRFGQTVSVCFWSEHWRP

SEQ ID NO: 2714941 - protein, 23 aa, Entamoeba histolytica
IGDCTLVMYLTTKSDVSNPPYDT

SEQ ID NO: 2714942 - protein, 23 aa, Entamoeba histolytica
IGDDIYEYVWIPQHLIQKENMTI

SEQ ID NO: 2714943 - protein, 23 aa, Entamoeba histolytica
IGDGCFYQCYSLTTINIPTSVSK

SEQ ID NO: 2714944 - protein, 24 aa, Entamoeba histolytica
IGDLHFQYIVFYENIKYQNKREFN

SEQ ID NO: 2714945 - protein, 17 aa, Entamoeba histolytica
IGDPRYRKVSVGFVVYK

SEQ ID NO: 2714946 - protein, 26 aa, Entamoeba histolytica
IGDSIKLQYFLRIQINTKYPPRPYFE

SEQ ID NO: 2714947 - protein, 22 aa, Entamoeba histolytica
IGDWIYLTDTLPFTGRDRRLYL

SEQ ID NO: 2714948 - protein, 23 aa, Entamoeba histolytica
IGECTLVMYLTTKSDVSNPPYDT

SEQ ID NO: 2714949 - protein, 17 aa, Entamoeba histolytica
IGEEIIFHLFDRDTFTS

SEQ ID NO: 2714950 - protein, 22 aa, Entamoeba histolytica
IGEEYTLVCAVYFVLKYCGKKG

SEQ ID NO: 2714951 - protein, 29 aa, Entamoeba histolytica
IGEGEDYYLIWFKRELFSSKGRLFNVPFM

SEQ ID NO: 2714952 - protein, 25 aa, Entamoeba histolytica
IGEGWKYIFTLLSRIEQVLLTEQVA

SEQ ID NO: 2714953 - protein, 26 aa, Entamoeba histolytica
IGEIFNLYMRVILDEKNKMVFASIPG

SEQ ID NO: 2714954 - protein, 32 aa, Entamoeba histolytica
IGEISTTFLLALYKQTKIPTLIPRLINFMLEH

SEQ ID NO: 2714955 - protein, 25 aa, Entamoeba histolytica
IGENKFIKLWEGKRQRFSFNSLTSE

SEQ ID NO: 2714956 - protein, 25 aa, Entamoeba histolytica
IGENSVIFPPFRCSKGRFITIGNNT

SEQ ID NO: 2714957 - protein, 26 aa, Entamoeba histolytica
IGESLTLMMNIFLTTSKNLKCIEEIT

SEQ ID NO: 2714958 - protein, 26 aa, Entamoeba histolytica
IGETFQRFIPYLKVYYQFIGNSGVSL

SEQ ID NO: 2714959 - protein, 30 aa, Entamoeba histolytica
IGETIRVLEKKYLWIKTEKKQFNKKGGIFD

SEQ ID NO: 2714960 - protein, 35 aa, Entamoeba histolytica
IGEWKEMELVLTNDLMIITYQKQIEYISLYVDYNI

SEQ ID NO: 2714961 - protein, 18 aa, Entamoeba histolytica
IGFDYILIEMMIGIQILN

SEQ ID NO: 2714962 - protein, 20 aa, Entamoeba histolytica
IGFHLLSLFDGHSGIYSSCF

SEQ ID NO: 2714963 - protein, 29 aa, Entamoeba histolytica
IGFITEDIPFIPFAPFIEQVENLCISSLT

SEQ ID NO: 2714964 - protein, 22 aa, Entamoeba histolytica
IGFYEYLALMKFVDLVDKTFTH

SEQ ID NO: 2714965 - protein, 18 aa, Entamoeba histolytica
IGGVFRTEFPPTPKSKFT

SEQ ID NO: 2714966 - protein, 20 aa, Entamoeba histolytica
IGHQSMIPRVTFYDNFVISV

SEQ ID NO: 2714967 - protein, 26 aa, Entamoeba histolytica
IGHSENILFILFDNGKIRVYRTNELD

SEQ ID NO: 2714968 - protein, 25 aa, Entamoeba histolytica
IGIEHKICYGPYKTGIRNSGNTCYA

SEQ ID NO: 2714969 - protein, 22 aa, Entamoeba histolytica
IGIFFYHFQLPQQQLALFLTTY

SEQ ID NO: 2714970 - protein, 28 aa, Entamoeba histolytica
IGINTSIFGYLNFGLLSFAKVQGKKCFD

SEQ ID NO: 2714971 - protein, 29 aa, Entamoeba histolytica
IGIPLEHETKWFLMVKTSFSLEVMNCVIR

SEQ ID NO: 2714972 - protein, 22 aa, Entamoeba histolytica
IGIQLPDFFLNAELPHLTLEQQ

SEQ ID NO: 2714973 - protein, 26 aa, Entamoeba histolytica
IGIYLPNCIQFIISSASIETCGFIMI

SEQ ID NO: 2714974 - protein, 23 aa, Entamoeba histolytica
IGKGCFNRCYSLRSIEIPSTITS

SEQ ID NO: 2714975 - protein, 30 aa, Entamoeba histolytica; identical to SEQ ID NO: 2527055

SEQ ID NO: 2714976 - protein, 24 aa, Entamoeba histolytica
IGKLPLIHPSIISYNIMLYRDFHH

SEQ ID NO: 2714977 - protein, 23 aa, Entamoeba histolytica
IGKMLNYNNYYSKIILLNNIEYN

SEQ ID NO: 2714978 - protein, 36 aa, Entamoeba histolytica
IGKQHLPILAMIFSPTPVLPFYNKNYTKLRSILFAH

SEQ ID NO: 2714979 - protein, 28 aa, Entamoeba histolytica
IGKQTVDDLIWPLLEKKLKISGETLDGK

SEQ ID NO: 2714980 - protein, 17 aa, Entamoeba histolytica
IGKSLWGWKFETYKKLT

SEQ ID NO: 2714981 - protein, 19 aa, Entamoeba histolytica
IGLAVSFKTYIKCFDIRNM

SEQ ID NO: 2714982 - protein, 17 aa, Entamoeba histolytica
IGLFPVTEGFYKLVEIV

SEQ ID NO: 2714983 - protein, 17 aa, Entamoeba histolytica
IGLHALNERLEEMYHSM

SEQ ID NO: 2714984 - protein, 17 aa, Entamoeba histolytica
IGLLQPPLPIQTTGPTQ

SEQ ID NO: 2714985 - protein, 19 aa, Entamoeba histolytica
IGLLVKRFNPQRPEGMNWD

SEQ ID NO: 2714986 - protein, 27 aa, Entamoeba histolytica
IGLNVNNPHFLIMQGKVVKVLNMKPME

SEQ ID NO: 2714987 - protein, 26 aa, Entamoeba histolytica
IGMDSNLRVVFLALKEFDSMPLEFNQ

SEQ ID NO: 2714988 - protein, 24 aa, Entamoeba histolytica
IGNFGGILDLYKSPRLIVNKSLHL

SEQ ID NO: 2714989 - protein, 19 aa, Entamoeba histolytica
IGNIKGIVLASRDLYCIYN

SEQ ID NO: 2714990 - protein, 18 aa, Entamoeba histolytica
IGNKCFYGCLSLTTINIP

SEQ ID NO: 2714991 - protein, 25 aa, Entamoeba histolytica
IGNNPPLLRIIDKSGYGLFGANTNL

SEQ ID NO: 2714992 - protein, 19 aa, Entamoeba histolytica
IGNPPPPPPIAPPKQAGNP

SEQ ID NO: 2714993 - protein, 25 aa, Entamoeba histolytica
IGNRREKGLRYLCGYYGEIMEVTLL

SEQ ID NO: 2714994 - protein, 24 aa, Entamoeba histolytica
IGNSCFYGCTRLRTINIPTNVNEL

SEQ ID NO: 2714995 - protein, 24 aa, Entamoeba histolytica
IGPLQPIFPELFTYKQINIDDSVK

SEQ ID NO: 2714996 - protein, 21 aa, Entamoeba histolytica
IGPRYCMRCIKILSGCFSGSV

SEQ ID NO: 2714997 - protein, 21 aa, Entamoeba histolytica
IGQALEKMIVYGKAGEGFLQC

SEQ ID NO: 2714998 - protein, 17 aa, Entamoeba histolytica
IGQGNVCYVEFGGPVPP

SEQ ID NO: 2714999 - protein, 18 aa, Entamoeba histolytica
IGQIMDGLLILITTNNQP

SEQ ID NO: 2715000 - protein, 24 aa, Entamoeba histolytica
IGQRWIPEIKHFCPDVPFIIVATK

SEQ ID NO: 2715001 - protein, 24 aa, Entamoeba histolytica
IGQSRLCMFYLQKAHIGEIQASVW

SEQ ID NO: 2715002 - protein, 23 aa, Entamoeba histolytica
IGRAPTLVAIALIELGMENTEAM

SEQ ID NO: 2715003 - protein, 28 aa, Entamoeba histolytica
IGRDEEIKRVIRILSKKTKNNPVLIGEP

SEQ ID NO: 2715004 - protein, 21 aa, Entamoeba histolytica
IGRDEEIKRVIRILSRRTKNN

SEQ ID NO: 2715005 - protein, 23 aa, Entamoeba histolytica
IGREKFLEEVWKWKDEYGKGICN

SEQ ID NO: 2715006 - protein, 33 aa, Entamoeba histolytica
IGRFCYIFQRCFLDYHFLIFFIDNNGLSLLKDS

SEQ ID NO: 2715007 - protein, 17 aa, Entamoeba histolytica
IGRLWSHFSQEFYPKHT

SEQ ID NO: 2715008 - protein, 21 aa, Entamoeba histolytica
IGRQRGFVPLIIVCKQGKPIL

SEQ ID NO: 2715009 - protein, 24 aa, Entamoeba histolytica
IGSGSLLCGLALAVKTLDPRVKVY

SEQ ID NO: 2715010 - protein, 18 aa, Entamoeba histolytica
IGSLIQQFKIKDIIDYIL

SEQ ID NO: 2715011 - protein, 21 aa, Entamoeba histolytica
IGSSCFYLCSSLKSINIPTSV

SEQ ID NO: 2715012 - protein, 23 aa, Entamoeba histolytica
IGTEPFIHPLPQNPTQSQLQLHL

SEQ ID NO: 2715013 - protein, 21 aa, Entamoeba histolytica
IGTFFHCISLTSLQLPKAITS

SEQ ID NO: 2715014 - protein, 23 aa, Entamoeba histolytica
IGTKPFYFLMDQTTTFEEVEKKN

SEQ ID NO: 2715015 - protein, 32 aa, Entamoeba histolytica; identical to SEQ ID NO: 2397836

SEQ ID NO: 2715016 - protein, 23 aa, Entamoeba histolytica
IGVFSFLMKLYCNNISFKISDLY

SEQ ID NO: 2715017 - protein, 20 aa, Entamoeba histolytica
IGWKFTTRNDLLKPKVFYGL

SEQ ID NO: 2715018 - protein, 17 aa, Entamoeba histolytica
IGYELIKKLPYGGMICN

SEQ ID NO: 2715019 - protein, 33 aa, Entamoeba histolytica
IGYNQFKRVDTLLYLLYYPQIPMVKTKTIDMIN

SEQ ID NO: 2715020 - protein, 36 aa, Entamoeba histolytica
IHCDEFFQCELEPNEWLNIPLIILNNIETHCSTLKI

SEQ ID NO: 2715021 - protein, 20 aa, Entamoeba histolytica
IHCIDILDRIKLSLSIDPTN

SEQ ID NO: 2715022 - protein, 18 aa, Entamoeba histolytica
IHCIIKRSELPNLTVTTI

SEQ ID NO: 2715023 - protein, 19 aa, Entamoeba histolytica
IHCVNMVNEIILLKKKWIN

SEQ ID NO: 2715024 - protein, 18 aa, Entamoeba histolytica
IHDFIILTKARNLILSSG

SEQ ID NO: 2715025 - protein, 19 aa, Entamoeba histolytica
IHDSYLLMYNECYDFNNNL

SEQ ID NO: 2715026 - protein, 24 aa, Entamoeba histolytica
IHEEKSFLFSMMNNFVPIAKTILR

SEQ ID NO: 2715027 - protein, 25 aa, Entamoeba histolytica
IHESVDEILLGRIFSIVGHVVSCKI

SEQ ID NO: 2715028 - protein, 19 aa, Entamoeba histolytica
IHFQFIRPNNQEKALTIGF

SEQ ID NO: 2715029 - protein, 19 aa, Entamoeba histolytica
IHFSLKDIDFRSLVPIFKA

SEQ ID NO: 2715030 - protein, 18 aa, Entamoeba histolytica
IHGKPTTVPLLYNNIELP

SEQ ID NO: 2715031 - protein, 25 aa, Entamoeba histolytica
IHGQFWDLLQLFEVAGKPPSTKYIF

SEQ ID NO: 2715032 - protein, 31 aa, Entamoeba histolytica
IHGRTPLMSCLLHQSLDVIVLLLSIGDCRLD

SEQ ID NO: 2715033 - protein, 18 aa, Entamoeba histolytica
IHGTIQHILITNPPEFNK

SEQ ID NO: 2715034 - protein, 28 aa, Entamoeba histolytica
IHGVKLILGLLYTLYRKYRLSVLVDKKK

SEQ ID NO: 2715035 - protein, 17 aa, Entamoeba histolytica
IHHGRVAGILLPHIIRY

SEQ ID NO: 2715036 - protein, 20 aa, Entamoeba histolytica
IHHPAILGMAGIVLSSSTIL

SEQ ID NO: 2715037 - protein, 21 aa, Entamoeba histolytica
IHHPAILGMAGIVLSSSTILL

SEQ ID NO: 2715038 - protein, 26 aa, Entamoeba histolytica
IHHSFDEIIPLFPNLQTFYVRRCPSR

SEQ ID NO: 2715039 - protein, 24 aa, Entamoeba histolytica
IHHSFDEIIPLFPNLQTFYVRRCS

SEQ ID NO: 2715040 - protein, 26 aa, Entamoeba histolytica
IHIENSFIELFIKKIGGLFIESSSGR

SEQ ID NO: 2715041 - protein, 17 aa, Entamoeba histolytica
IHIFFVTSKFGTLNEIR

SEQ ID NO: 2715042 - protein, 17 aa, Entamoeba histolytica
IHKNSMFQLINSSGSYQ

SEQ ID NO: 2715043 - protein, 25 aa, Entamoeba histolytica
IHKTFPTLLELGLSTPLVSLINQSC

SEQ ID NO: 2715044 - protein, 17 aa, Entamoeba histolytica
IHKVGPFLIGNKLLGEG

SEQ ID NO: 2715045 - protein, 23 aa, Entamoeba histolytica
IHLIRDRRKFDRGAYILCQEIKT

SEQ ID NO: 2715046 - protein, 17 aa, Entamoeba histolytica
IHLKRIKLISINVKLNL

SEQ ID NO: 2715047 - protein, 30 aa, Entamoeba histolytica
IHLLSSLMQYLIFHKFTPTKYQPLPDIQII

SEQ ID NO: 2715048 - protein, 17 aa, Entamoeba histolytica
IHLMTLYSNFNIKFYSC

SEQ ID NO: 2715049 - protein, 24 aa, Entamoeba histolytica
IHLTNVCIFIKGKIETPTRTNVFV

SEQ ID NO: 2715050 - protein, 19 aa, Entamoeba histolytica
IHLVSRSDLFGLLTSLSIL

SEQ ID NO: 2715051 - protein, 22 aa, Entamoeba histolytica
IHNDFFIMQFLERNNLEDFIPI

SEQ ID NO: 2715052 - protein, 17 aa, Entamoeba histolytica
IHNELKPYLLRRMKKDV

SEQ ID NO: 2715053 - protein, 18 aa, Entamoeba histolytica
IHNFVKCIGYILSNTVGV

SEQ ID NO: 2715054 - protein, 18 aa, Entamoeba histolytica
IHNILNDLYANCISFIEP

SEQ ID NO: 2715055 - protein, 26 aa, Entamoeba histolytica
IHNKEFVVTPPILIIQILRFEQHSNN

SEQ ID NO: 2715056 - protein, 18 aa, Entamoeba histolytica
IHNNTIWNKYYVPVGYKK

SEQ ID NO: 2715057 - protein, 32 aa, Entamoeba histolytica
IHPCEVIFKNRYLLKIPLEQPMFFIINELSGG

SEQ ID NO: 2715058 - protein, 25 aa, Entamoeba histolytica
IHPIEQLIAVLPPKSIHLIPKQLQE

SEQ ID NO: 2715059 - protein, 17 aa, Entamoeba histolytica
IHSFPLPLREKFLSNLV

SEQ ID NO: 2715060 - protein, 23 aa, Entamoeba histolytica
IHSIGLTTFLGCVILKIKGDDDK

SEQ ID NO: 2715061 - protein, 26 aa, Entamoeba histolytica
IHSNIYYLNTFNELLYFKKPSQLEMI

SEQ ID NO: 2715062 - protein, 33 aa, Entamoeba histolytica; identical to SEQ ID NO: 2527130

SEQ ID NO: 2715063 - protein, 18 aa, Entamoeba histolytica
IHSYHSFFGSIKHLIKTP

SEQ ID NO: 2715064 - protein, 19 aa, Entamoeba histolytica
IHTIASLFKLYFRELPDSL

SEQ ID NO: 2715065 - protein, 26 aa, Entamoeba histolytica
IHTMEYVYRFLISSLHRIIISPNDKN

SEQ ID NO: 2715066 - protein, 17 aa, Entamoeba histolytica
IHYAWEMFGLEDNLKSK

SEQ ID NO: 2715067 - protein, 27 aa, Entamoeba histolytica
IHYKDIKHLYKFINIRKLIVIELDSLN

SEQ ID NO: 2715068 - protein, 18 aa, Entamoeba histolytica
IHYWHPNLIIHCNNAYND

SEQ ID NO: 2715069 - protein, 23 aa, Entamoeba histolytica
IHYYTPEHLLQLKHNFHSVSSVT

SEQ ID NO: 2715070 - protein, 17 aa, Entamoeba histolytica
IIAPIGSGSLLCGLALA

SEQ ID NO: 2715071 - protein, 19 aa, Entamoeba histolytica
IIATQVLSFPTVYGLASRR

SEQ ID NO: 2715072 - protein, 18 aa, Entamoeba histolytica
IICGGMAYTFLAASKNMK

SEQ ID NO: 2715073 - protein, 18 aa, Entamoeba histolytica
IICKCGQKFCFKCGREMH

SEQ ID NO: 2715074 - protein, 18 aa, Entamoeba histolytica
IICKDLRVLSFRIVGPIQ

SEQ ID NO: 2715075 - protein, 17 aa, Entamoeba histolytica
IICRCGDSPIYVLTTDD

SEQ ID NO: 2715076 - protein, 20 aa, Entamoeba histolytica
IICSNLLIYDIIEICRKREC

SEQ ID NO: 2715077 - protein, 18 aa, Entamoeba histolytica
IICTLPDEHLLSKLESSS

SEQ ID NO: 2715078 - protein, 17 aa, Entamoeba histolytica
IICWLKKTENTENQQFL

SEQ ID NO: 2715079 - protein, 41 aa, Entamoeba histolytica; identical to SEQ ID NO: 2527144

SEQ ID NO: 2715080 - protein, 27 aa, Entamoeba histolytica
IIDEPTPLILVLKLLLSLKLTEECSDT

SEQ ID NO: 2715081 - protein, 17 aa, Entamoeba histolytica
IIDIIACPFNDNLIFSS

SEQ ID NO: 2715082 - protein, 18 aa, Entamoeba histolytica
IIDILKSLKPSDNTNEED

SEQ ID NO: 2715083 - protein, 18 aa, Entamoeba histolytica
IIDILRKYLRKTNEFLNL

SEQ ID NO: 2715084 - protein, 26 aa, Entamoeba histolytica
IIDLSQTTPFMFRDKKINIELSKQNN

SEQ ID NO: 2715085 - protein, 23 aa, Entamoeba histolytica
IIDNYNILELKWGESNTLIPEDS

SEQ ID NO: 2715086 - protein, 34 aa, Entamoeba histolytica
IIDPALTRPGRLDQLIYIPLPDLEARVGVLQANL

SEQ ID NO: 2715087 - protein, 25 aa, Entamoeba histolytica
IIDSTGRVLIWEATQNRMFLTNAII

SEQ ID NO: 2715088 - protein, 28 aa, Entamoeba histolytica
IIDSTISFLNNYLLPLLDKRDVPTLCSS

SEQ ID NO: 2715089 - protein, 31 aa, Entamoeba histolytica
IIDTDIFKIINKYLMVLQQWTDMENFNIIYN

SEQ ID NO: 2715090 - protein, 22 aa, Entamoeba histolytica
IIEAWECISLPNLINIPLQDLQ

SEQ ID NO: 2715091 - protein, 20 aa, Entamoeba histolytica
IIEDFFLLGEELGRGAFAVV

SEQ ID NO: 2715092 - protein, 26 aa, Entamoeba histolytica
IIEDNNHFVFCLYPSNDERTTMRWIP

SEQ ID NO: 2715093 - protein, 25 aa, Entamoeba histolytica
IIEEEVSIPMGYFSRVFLDNDTDFE

SEQ ID NO: 2715094 - protein, 27 aa, Entamoeba histolytica
IIEELYDYFIFLLDSPLHHGEEIIMLQ

SEQ ID NO: 2715095 - protein, 17 aa, Entamoeba histolytica
IIEFLNDLGKKSFDELL

SEQ ID NO: 2715096 - protein, 28 aa, Entamoeba histolytica
IIEGRKVNMFWSLRDYKLRTQSETNLYV

SEQ ID NO: 2715097 - protein, 23 aa, Entamoeba histolytica
IIEHELRRKIEIMVLEWVEKNCK

SEQ ID NO: 2715098 - protein, 17 aa, Entamoeba histolytica
IIEILKYEFTFILAIIH

SEQ ID NO: 2715099 - protein, 26 aa, Entamoeba histolytica
IIEKKQFHFIMPQQHSPKTTALGFGY

SEQ ID NO: 2715100 - protein, 29 aa, Entamoeba histolytica
IIELNTYVGFFYRVSFYGQAFTNIFEQQS

SEQ ID NO: 2715101 - protein, 22 aa, Entamoeba histolytica
IIEPDFIKVVGEKYYNMIKNVN

SEQ ID NO: 2715102 - protein, 26 aa, Entamoeba histolytica
IIESTKMMLLLIDINKQKTLRIVESL

SEQ ID NO: 2715103 - protein, 17 aa, Entamoeba histolytica
IIEWAKSSQIKESDLDK

SEQ ID NO: 2715104 - protein, 20 aa, Entamoeba histolytica
IIFCNELKPAGFYKEKLKLQ

SEQ ID NO: 2715105 - protein, 20 aa, Entamoeba histolytica
IIFGQLLTEKKYIRKLYSLI

SEQ ID NO: 2715106 - protein, 18 aa, Entamoeba histolytica
IIFKQTSPFTFVNFTQYY

SEQ ID NO: 2715107 - protein, 18 aa, Entamoeba histolytica
IIFPDLKTPRLLCNNIHG

SEQ ID NO: 2715108 - protein, 18 aa, Entamoeba histolytica
IIFRLNWLRDEDIPTIQQ

SEQ ID NO: 2715109 - protein, 21 aa, Entamoeba histolytica
IIFRNTQKLLILQNEKDNKNI

SEQ ID NO: 2715110 - protein, 17 aa, Entamoeba histolytica
IIFSKSEQLINIIPLLL

SEQ ID NO: 2715111 - protein, 17 aa, Entamoeba histolytica
IIFSPFQGELIEGRVLR

SEQ ID NO: 2715112 - protein, 26 aa, Entamoeba histolytica
IIGDKKPFFISLPCKRNIPMEQFADY

SEQ ID NO: 2715113 - protein, 17 aa, Entamoeba histolytica
IIGLKQGLGHYYQMYKT

SEQ ID NO: 2715114 - protein, 30 aa, Entamoeba histolytica; identical to SEQ ID NO: 2527174

SEQ ID NO: 2715115 - protein, 19 aa, Entamoeba histolytica
IIHAMNALAPPTFIDVMKY

SEQ ID NO: 2715116 - protein, 18 aa, Entamoeba histolytica
IIHDRIIKQLNTLNWRRL

SEQ ID NO: 2715117 - protein, 18 aa, Entamoeba histolytica
IIHFFILAIQTSAIHLID

SEQ ID NO: 2715118 - protein, 17 aa, Entamoeba histolytica
IIHFIKFIQLNPSEKDK

SEQ ID NO: 2715119 - protein, 19 aa, Entamoeba histolytica
IIHIYSVLELFFNSNIPSY

SEQ ID NO: 2715120 - protein, 23 aa, Entamoeba histolytica
IIHTLFCFSPFDCAKQLSLKQME

SEQ ID NO: 2715121 - protein, 17 aa, Entamoeba histolytica
IIICDWMGINLYYDSLL

SEQ ID NO: 2715122 - protein, 19 aa, Entamoeba histolytica
IIIERGYCDVYPDGIQKPR

SEQ ID NO: 2715123 - protein, 18 aa, Entamoeba histolytica
IIINEHLHLFKGDIPFVV

SEQ ID NO: 2715124 - protein, 17 aa, Entamoeba histolytica
IIINPVNYTLIITSTFS

SEQ ID NO: 2715125 - protein, 18 aa, Entamoeba histolytica
IIIQFIRYHMDIEVWMNL

SEQ ID NO: 2715126 - protein, 24 aa, Entamoeba histolytica
IIISELIILVINDLKLYLNEHTTK

SEQ ID NO: 2715127 - protein, 26 aa, Entamoeba histolytica
IIISKKYFMLIVNVMKNIRKIGNKKE

SEQ ID NO: 2715128 - protein, 17 aa, Entamoeba histolytica
IIISNPNLIGFCVDYLC

SEQ ID NO: 2715129 - protein, 19 aa, Entamoeba histolytica
IIISVIREILYRNGLKIAL

SEQ ID NO: 2715130 - protein, 21 aa, Entamoeba histolytica
IIKEDIYLVSLLISHLHQFYS

SEQ ID NO: 2715131 - protein, 21 aa, Entamoeba histolytica
IIKEYMYCVNRIYNLLKRSHG

SEQ ID NO: 2715132 - protein, 25 aa, Entamoeba histolytica
IIKIGENYCKIIVYLRNRGESSLNH

SEQ ID NO: 2715133 - protein, 18 aa, Entamoeba histolytica
IIKIHRDYIINYVDHIVT

SEQ ID NO: 2715134 - protein, 26 aa, Entamoeba histolytica
IIKIYNCFFCYFNGSLQFWIVMEKCT

SEQ ID NO: 2715135 - protein, 19 aa, Entamoeba histolytica
IIKLRKICNIKIGYENKEI

SEQ ID NO: 2715136 - protein, 17 aa, Entamoeba histolytica
IIKLWKIITSISSNELF

SEQ ID NO: 2715137 - protein, 26 aa, Entamoeba histolytica
IIKNKDFYYLIMKLSRHVTAAYGSKH

SEQ ID NO: 2715138 - protein, 18 aa, Entamoeba histolytica
IIKPTYIDQPIQPQFKFI

SEQ ID NO: 2715139 - protein, 27 aa, Entamoeba histolytica
IIKSRMTSIIIGKIKTFLVYPIEEQLL

SEQ ID NO: 2715140 - protein, 24 aa, Entamoeba histolytica
IIKTFPLYHFFVKNTRLYPIECYP

SEQ ID NO: 2715141 - protein, 29 aa, Entamoeba histolytica
IIKYSLDDYIWYNFVLYQHNIQKIKEFED

SEQ ID NO: 2715142 - protein, 20 aa, Entamoeba histolytica
IILAIHHPHLVKKLSLHHKG

SEQ ID NO: 2715143 - protein, 17 aa, Entamoeba histolytica
IILARILEKHPQFLKNI

SEQ ID NO: 2715144 - protein, 30 aa, Entamoeba histolytica
IILDGLNCFYYFATTMFFTLSPTTEFLHRL

SEQ ID NO: 2715145 - protein, 27 aa, Entamoeba histolytica
IILDISFPSILYKKLLDIPLTFDDYNI

SEQ ID NO: 2715146 - protein, 19 aa, Entamoeba histolytica
IILEEKTMYPFSFSGIDKK

SEQ ID NO: 2715147 - protein, 19 aa, Entamoeba histolytica
IILFNQDKTKKSAISHVCY

SEQ ID NO: 2715148 - protein, 19 aa, Entamoeba histolytica
IILIYERESPIKQEKEIDI

SEQ ID NO: 2715149 - protein, 19 aa, Entamoeba histolytica
IILLPDTVHYVFLSATIPN

SEQ ID NO: 2715150 - protein, 20 aa, Entamoeba histolytica
IILQSLFVDSIMKFSEKLFS

SEQ ID NO: 2715151 - protein, 30 aa, Entamoeba histolytica
IILRSNAMIPKYYLLIKNILERIERITELL

SEQ ID NO: 2715152 - protein, 18 aa, Entamoeba histolytica
IILTIDINKERFSANLKF

SEQ ID NO: 2715153 - protein, 34 aa, Entamoeba histolytica
IIMDKSMTFYGFKNKLGLLPKLWRNEEMKEIPKL

SEQ ID NO: 2715154 - protein, 23 aa, Entamoeba histolytica
IIMKKKQLLNHLDIITIGSGQLQ

SEQ ID NO: 2715155 - protein, 34 aa, Entamoeba histolytica
IIMKLESCLHPYTFIRGYLTISLIGIICTYTEAN

SEQ ID NO: 2715156 - protein, 27 aa, Entamoeba histolytica
IIMTIKYYHLILHYSFLNDFVTTKIYK

SEQ ID NO: 2715157 - protein, 33 aa, Entamoeba histolytica
IINDIFTIKDIWKHVCIVWTKCYSLIQQKQLEK

SEQ ID NO: 2715158 - protein, 34 aa, Entamoeba histolytica
IINDIFTIKDIWKHVCIVWTKCYSLIQQKQLEKG

SEQ ID NO: 2715159 - protein, 24 aa, Entamoeba histolytica
IINEHHWIIEWAKSTQIRDSDLDK

SEQ ID NO: 2715160 - protein, 20 aa, Entamoeba histolytica
IINFIDVPINLTLSIHQVIC

SEQ ID NO: 2715161 - protein, 22 aa, Entamoeba histolytica
IINGIERYLRMIVYAKPNHPLA

SEQ ID NO: 2715162 - protein, 29 aa, Entamoeba histolytica
IINGKVLISGGLTLPLLSSSYLVSKNGEI

SEQ ID NO: 2715163 - protein, 17 aa, Entamoeba histolytica
IINIWDTAGQEKYQALT

SEQ ID NO: 2715164 - protein, 19 aa, Entamoeba histolytica
IINLEYQSPLLFCQIRSLE

SEQ ID NO: 2715165 - protein, 25 aa, Entamoeba histolytica
IINNFQSISLFFFVACCHPTAEIRQ

SEQ ID NO: 2715166 - protein, 26 aa, Entamoeba histolytica
IINNPPEPIFFSSKYQIPQFPFKCFP

SEQ ID NO: 2715167 - protein, 27 aa, Entamoeba histolytica
IINNQYLPILFNIYDKLLTYAQTTHGV

SEQ ID NO: 2715168 - protein, 18 aa, Entamoeba histolytica
IINQVPEHISLKPKGRTG

SEQ ID NO: 2715169 - protein, 18 aa, Entamoeba histolytica
IINRLWNYEMLEEYIICQ

SEQ ID NO: 2715170 - protein, 20 aa, Entamoeba histolytica
IINSLMLLLQDPNPRVRVAL

SEQ ID NO: 2715171 - protein, 22 aa, Entamoeba histolytica
IINTILCSFMIKYEVHCYWRNG

SEQ ID NO: 2715172 - protein, 20 aa, Entamoeba histolytica
IIPDGSYYRLVTPKGPLPKV

SEQ ID NO: 2715173 - protein, 17 aa, Entamoeba histolytica
IIPDTLGALRTTAPYTL

SEQ ID NO: 2715174 - protein, 26 aa, Entamoeba histolytica
IIPEIDSPWYLKFNNSAIYDDNTEDE

SEQ ID NO: 2715175 - protein, 26 aa, Entamoeba histolytica
IIPEIDSPWYLKFNNSAIYDDNTEDK

SEQ ID NO: 2715176 - protein, 19 aa, Entamoeba histolytica
IIPFFNPFLTIENYYITLS

SEQ ID NO: 2715177 - protein, 18 aa, Entamoeba histolytica
IIPINKKTPSIPSPKPTS

SEQ ID NO: 2715178 - protein, 21 aa, Entamoeba histolytica
IIPKFYGVELHEFGFGELEFI

SEQ ID NO: 2715179 - protein, 26 aa, Entamoeba histolytica
IIPKKYYIEVPLSLQQFIDKCKLLYP

SEQ ID NO: 2715180 - protein, 18 aa, Entamoeba histolytica
IIPLFSALRNNHLSVVNY

SEQ ID NO: 2715181 - protein, 18 aa, Entamoeba histolytica
IIPLVKRTEYIVGSSKKP

SEQ ID NO: 2715182 - protein, 22 aa, Entamoeba histolytica
IIPNKPLFLQELPIIHINEGME

SEQ ID NO: 2715183 - protein, 18 aa, Entamoeba histolytica
IIPRSRIPRVGNKRRRIM

SEQ ID NO: 2715184 - protein, 17 aa, Entamoeba histolytica
IIPSLFTENFRLFKESK

SEQ ID NO: 2715185 - protein, 24 aa, Entamoeba histolytica
IIPTRTRILALVKMLIQVFPNDFK

SEQ ID NO: 2715186 - protein, 26 aa, Entamoeba histolytica
IIQFDTLFIFSLFELITLTYNNHFIQ

SEQ ID NO: 2715187 - protein, 22 aa, Entamoeba histolytica
IIQKLLEEKSLLIDQLKQTHQE

SEQ ID NO: 2715188 - protein, 21 aa, Entamoeba histolytica
IIQLFNTLSFPNEAALIITLH

SEQ ID NO: 2715189 - protein, 25 aa, Entamoeba histolytica
IIQNVYLFICLLTKKTIGLWKTNNE

SEQ ID NO: 2715190 - protein, 17 aa, Entamoeba histolytica
IIQQWKKDGNKYINYVY

SEQ ID NO: 2715191 - protein, 18 aa, Entamoeba histolytica
IIQTQIFEKLLKVLSETT

SEQ ID NO: 2715192 - protein, 24 aa, Entamoeba histolytica
IIQTRIFMSAFYMMRQLKFSKIDL

SEQ ID NO: 2715193 - protein, 18 aa, Entamoeba histolytica
IIQVCLKACKFIAQHDLM

SEQ ID NO: 2715194 - protein, 26 aa, Entamoeba histolytica
IIQVSSKFYGIPWKSNGDGLMYVGIM

SEQ ID NO: 2715195 - protein, 20 aa, Entamoeba histolytica
IIQYYGYTQLTDSMLLFSEY

SEQ ID NO: 2715196 - protein, 21 aa, Entamoeba histolytica
IIREYTIWLRMNELNIESDKL

SEQ ID NO: 2715197 - protein, 17 aa, Entamoeba histolytica
IIRLFSCSPNDKVKVFK

SEQ ID NO: 2715198 - protein, 17 aa, Entamoeba histolytica
IIRNTLTKFFIKENYKG

SEQ ID NO: 2715199 - protein, 18 aa, Entamoeba histolytica
IIRQEGMQGPYKGYGMPI

SEQ ID NO: 2715200 - protein, 28 aa, Entamoeba histolytica
IIRSKFLRRRFCTFVIMKLGGLCSVEDM

SEQ ID NO: 2715201 - protein, 31 aa, Entamoeba histolytica
IIRSQTMIPPELTLLYKIPETYIKDLLRLGA

SEQ ID NO: 2715202 - protein, 20 aa, Entamoeba histolytica
IIRVVQINPHKLLGCVGQHD

SEQ ID NO: 2715203 - protein, 30 aa, Entamoeba histolytica
IISADTILKTMFWYLMESKIDPKYKIEIPS

SEQ ID NO: 2715204 - protein, 20 aa, Entamoeba histolytica
IISFESFCSYFADKNFKKIS

SEQ ID NO: 2715205 - protein, 19 aa, Entamoeba histolytica
IISGLKFIPSKNINSLLPF

SEQ ID NO: 2715206 - protein, 18 aa, Entamoeba histolytica
IISHLRKFIEGNIPPITG

SEQ ID NO: 2715207 - protein, 18 aa, Entamoeba histolytica
IISITRRNPKTNKIIVMY

SEQ ID NO: 2715208 - protein, 28 aa, Entamoeba histolytica
IISKYTFHKYIIYWYKQQAKSSDFTSAD

SEQ ID NO: 2715209 - protein, 24 aa, Entamoeba histolytica
IISLLQIYYCPISMSLSPQMKHEL

SEQ ID NO: 2715210 - protein, 24 aa, Entamoeba histolytica
IISNTLKMNLLIKLWNEENNEMCI

SEQ ID NO: 2715211 - protein, 18 aa, Entamoeba histolytica
IISVPKKWNIKKSINCAI

SEQ ID NO: 2715212 - protein, 19 aa, Entamoeba histolytica
IISYALSLIGPFCYLELPD

SEQ ID NO: 2715213 - protein, 24 aa, Entamoeba histolytica
IITDILIDHIIVLLLEMGISEKKD

SEQ ID NO: 2715214 - protein, 20 aa, Entamoeba histolytica
IITEMIFVLLYLVENEQDYS

SEQ ID NO: 2715215 - protein, 28 aa, Entamoeba histolytica
IITGLQNLIHILLLYHDPILSIHLDTNR

SEQ ID NO: 2715216 - protein, 22 aa, Entamoeba histolytica
IITIDQIKLFEKYQFKVQLKNI

SEQ ID NO: 2715217 - protein, 20 aa, Entamoeba histolytica
IITIKTLYYCFRFINHIMGG

SEQ ID NO: 2715218 - protein, 25 aa, Entamoeba histolytica
IITKIYAMDILKRKLEYGWNSIGEE

SEQ ID NO: 2715219 - protein, 19 aa, Entamoeba histolytica
IITLFSLNNKTRILHHLPN

SEQ ID NO: 2715220 - protein, 34 aa, Entamoeba histolytica
IITSIRFEGVYGLNLLWKMLMITGEWSIEQLLEV

SEQ ID NO: 2715221 - protein, 30 aa, Entamoeba histolytica
IITVDKDLWMKYPLMKFLALYVINISEVND

SEQ ID NO: 2715222 - protein, 18 aa, Entamoeba histolytica
IIVIIDTLFPIEYQKKII

SEQ ID NO: 2715223 - protein, 31 aa, Entamoeba histolytica; identical to SEQ ID NO: 2527291

SEQ ID NO: 2715224 - protein, 18 aa, Entamoeba histolytica
IIVNLHIWKALNASFKTQ

SEQ ID NO: 2715225 - protein, 22 aa, Entamoeba histolytica
IIYDHILVLILVSNSKIINMFQ

SEQ ID NO: 2715226 - protein, 24 aa, Entamoeba histolytica
IIYKEPQLLKYEEPLLIGVLDNVA

SEQ ID NO: 2715227 - protein, 33 aa, Entamoeba histolytica
IIYKLTELFITFNFSNTFLYFMSRALVELHART

SEQ ID NO: 2715228 - protein, 19 aa, Entamoeba histolytica
IIYPQKPKTFIVKTNDLTL

SEQ ID NO: 2715229 - protein, 17 aa, Entamoeba histolytica
IIYQDKIFVLKSTQIKV

SEQ ID NO: 2715230 - protein, 24 aa, Entamoeba histolytica
IIYQRQYLPYNLADRVRTAPFFTL

SEQ ID NO: 2715231 - protein, 19 aa, Entamoeba histolytica
IIYRKTYCGFALSNAFDSF

SEQ ID NO: 2715232 - protein, 18 aa, Entamoeba histolytica
IIYTPNDVPYIPYLEQIS

SEQ ID NO: 2715233 - protein, 18 aa, Entamoeba histolytica
IIYVPMQQVIDPYTGQVI

SEQ ID NO: 2715234 - protein, 27 aa, Entamoeba histolytica
IKAFKKRNILFINALKELKKRKEREDR

SEQ ID NO: 2715235 - protein, 31 aa, Entamoeba histolytica
IKAHGVTCFVSRQLIYPIPEQFFNANGIVSI

SEQ ID NO: 2715236 - protein, 22 aa, Entamoeba histolytica
IKAIYPIRDVIYFNRKSLKSRE

SEQ ID NO: 2715237 - protein, 31 aa, Entamoeba histolytica
IKAKYNTDFYILDKFPAAIRPFYTMPDIDDP

SEQ ID NO: 2715238 - protein, 25 aa, Entamoeba histolytica
IKAQYQFYLGWYDGNPAHLNELTPT

SEQ ID NO: 2715239 - protein, 19 aa, Entamoeba histolytica
IKCEYCSLMFPANQIQQHK

SEQ ID NO: 2715240 - protein, 18 aa, Entamoeba histolytica
IKCLYYNCPLLSVDQLNT

SEQ ID NO: 2715241 - protein, 19 aa, Entamoeba histolytica
IKCSFPTLSLILNVISIEK

SEQ ID NO: 2715242 - protein, 24 aa, Entamoeba histolytica
IKDELIRDIWFSSIIKSICKIQMK

SEQ ID NO: 2715243 - protein, 18 aa, Entamoeba histolytica
IKDFFSEFFKHFEKWFSE

SEQ ID NO: 2715244 - protein, 24 aa, Entamoeba histolytica
IKDGAWIGCGAIILPGVTIGENAI

SEQ ID NO: 2715245 - protein, 24 aa, Entamoeba histolytica
IKDGTKFLFKSEGYALCITVYLQD

SEQ ID NO: 2715246 - protein, 19 aa, Entamoeba histolytica
IKDMYIFDCGHKFCLDCCY

SEQ ID NO: 2715247 - protein, 25 aa, Entamoeba histolytica
IKDSNYMLIIKIYGLLKCTNFTPNN

SEQ ID NO: 2715248 - protein, 26 aa, Entamoeba histolytica
IKDYDLLFNLIIRDSWQFLFSHSPID

SEQ ID NO: 2715249 - protein, 18 aa, Entamoeba histolytica
IKEEVQLLCYPKGISQSE

SEQ ID NO: 2715250 - protein, 27 aa, Entamoeba histolytica
IKEFITNHWPILSKLKQFKTPNWRKAL

SEQ ID NO: 2715251 - protein, 26 aa, Entamoeba histolytica
IKEFSLILDHLITVGFFTIKCITLDG

SEQ ID NO: 2715252 - protein, 20 aa, Entamoeba histolytica
IKEIDLNISLPLYTVNACCS

SEQ ID NO: 2715253 - protein, 24 aa, Entamoeba histolytica
IKEIPDFFDKIDLITGLSASSLVS

SEQ ID NO: 2715254 - protein, 18 aa, Entamoeba histolytica
IKEIPLSSWKEYLINQYF

SEQ ID NO: 2715255 - protein, 17 aa, Entamoeba histolytica
IKEIRDELIKIIDCGDN

SEQ ID NO: 2715256 - protein, 21 aa, Entamoeba histolytica
IKELKLKRIIGNKSGQLQIDE

SEQ ID NO: 2715257 - protein, 23 aa, Entamoeba histolytica
IKELQSLIFFLNNLVLHANEQFK

SEQ ID NO: 2715258 - protein, 19 aa, Entamoeba histolytica
IKENVVFIQESLAETEQKI

SEQ ID NO: 2715259 - protein, 22 aa, Entamoeba histolytica
IKESLESFVPIPLHSYEKIKRS

SEQ ID NO: 2715260 - protein, 19 aa, Entamoeba histolytica
IKESPLFHKKKVIKKTISL

SEQ ID NO: 2715261 - protein, 24 aa, Entamoeba histolytica
IKEVQLFPRLLAIKISKFSSFLLH

SEQ ID NO: 2715262 - protein, 24 aa, Entamoeba histolytica
IKEYCEGILLLVQSLHINAFAKVK

SEQ ID NO: 2715263 - protein, 18 aa, Entamoeba histolytica
IKFAYIFTGAKGGVVPYQ

SEQ ID NO: 2715264 - protein, 19 aa, Entamoeba histolytica
IKFEFKPMSLFNSLTKKLV

SEQ ID NO: 2715265 - protein, 33 aa, Entamoeba histolytica
IKFEQFKCFIPSIHDIYILNKINELYIFADEKI

SEQ ID NO: 2715266 - protein, 21 aa, Entamoeba histolytica
IKFPKLPKVYIYKTQEHIIKE

SEQ ID NO: 2715267 - protein, 21 aa, Entamoeba histolytica
IKGIQERWLTILPQGTEQVQG

SEQ ID NO: 2715268 - protein, 35 aa, Entamoeba histolytica
IKGNENVMIFFFLKRNIIVGIYFNTPLQPDKQIKE

SEQ ID NO: 2715269 - protein, 24 aa, Entamoeba histolytica
IKGTYKTLILPNSPIIFEIIGLFD

SEQ ID NO: 2715270 - protein, 20 aa, Entamoeba histolytica
IKGVLLIYKYAELDPNASKE

SEQ ID NO: 2715271 - protein, 18 aa, Entamoeba histolytica
IKGYAYYTALEYSNTISK

SEQ ID NO: 2715272 - protein, 37 aa, Entamoeba histolytica; identical to SEQ ID NO: 2527366

SEQ ID NO: 2715273 - protein, 30 aa, Entamoeba histolytica
IKHGKYGRNALLFNLCFVFDEGTTDGAISC

SEQ ID NO: 2715274 - protein, 19 aa, Entamoeba histolytica
IKHPIKRFGSGDFWEKMSV

SEQ ID NO: 2715275 - protein, 19 aa, Entamoeba histolytica
IKHQNKVSTILPITKDEAL

SEQ ID NO: 2715276 - protein, 28 aa, Entamoeba histolytica
IKHTLGKYLILIATLDQKMIQCLPSQIA

SEQ ID NO: 2715277 - protein, 29 aa, Entamoeba histolytica
IKHVLDIVILTDKWSIKISLDYIDQIYKS

SEQ ID NO: 2715278 - protein, 18 aa, Entamoeba histolytica
IKIEELQQFLPLEEKQER

SEQ ID NO: 2715279 - protein, 26 aa, Entamoeba histolytica
IKIIGDIMYWEAALPYELVVLNCYDN

SEQ ID NO: 2715280 - protein, 19 aa, Entamoeba histolytica
IKIKYIPTTLTFKGTIEVL

SEQ ID NO: 2715281 - protein, 21 aa, Entamoeba histolytica
IKIMKIIHYFLSNGVSNELLG

SEQ ID NO: 2715282 - protein, 18 aa, Entamoeba histolytica
IKIPDILDYCSQYMMTTN

SEQ ID NO: 2715283 - protein, 29 aa, Entamoeba histolytica
IKIQNETLFYLYNDSWYKTFFQIKRDEII

SEQ ID NO: 2715284 - protein, 26 aa, Entamoeba histolytica
IKITKLFSLHQILYYLHNELANKKIN

SEQ ID NO: 2715285 - protein, 26 aa, Entamoeba histolytica
IKIVNQKHFLLPTSLTYLSLCDCEDV

SEQ ID NO: 2715286 - protein, 21 aa, Entamoeba histolytica
IKKAFETKVFDLNAICFVASS

SEQ ID NO: 2715287 - protein, 22 aa, Entamoeba histolytica
IKKAFETKVFDLNAICFVASSS

SEQ ID NO: 2715288 - protein, 31 aa, Entamoeba histolytica
IKKCPLTSRRPLLNHIILAGGSTLFPGLPER

SEQ ID NO: 2715289 - protein, 26 aa, Entamoeba histolytica
IKKDLQKLMELIFNKSLMSCDELINF

SEQ ID NO: 2715290 - protein, 26 aa, Entamoeba histolytica
IKKEFPLKGILIIDPLGFVLLSLGDE

SEQ ID NO: 2715291 - protein, 24 aa, Entamoeba histolytica
IKKEPSIGIMQPLFRNGNDSTMFH

SEQ ID NO: 2715292 - protein, 21 aa, Entamoeba histolytica
IKKFKVAVIFSYVGRGYFGLM

SEQ ID NO: 2715293 - protein, 26 aa, Entamoeba histolytica
IKKFSQETYILASRLPLVVDVNHMMT

SEQ ID NO: 2715294 - protein, 19 aa, Entamoeba histolytica
IKKIFRSDAPYGFISKFIE

SEQ ID NO: 2715295 - protein, 21 aa, Entamoeba histolytica
IKKILKLLRLRQINNAVFIKA

SEQ ID NO: 2715296 - protein, 21 aa, Entamoeba histolytica
IKKIVIIKDLKGINKGYAFVE

SEQ ID NO: 2715297 - protein, 22 aa, Entamoeba histolytica
IKKKFYEEIINVGRVDFTVIRE

SEQ ID NO: 2715298 - protein, 25 aa, Entamoeba histolytica
IKKKYDGYAIFRSKYRRFELYEDDD

SEQ ID NO: 2715299 - protein, 22 aa, Entamoeba histolytica
IKKLQQHYLFHDCILPNQVTLT

SEQ ID NO: 2715300 - protein, 27 aa, Entamoeba histolytica
IKKLTQFIQNLIQLTPIPLQTDMLKEC

SEQ ID NO: 2715301 - protein, 38 aa, Entamoeba histolytica
IKKLYNEFPVFDFWKHVCIVWTKCFYYTSEKKLEKQME

SEQ ID NO: 2715302 - protein, 17 aa, Entamoeba histolytica
IKKMFVGQFGTTLIAET

SEQ ID NO: 2715303 - protein, 26 aa, Entamoeba histolytica
IKKNEPVICLGQEKLKEQQLFNDNGE

SEQ ID NO: 2715304 - protein, 22 aa, Entamoeba histolytica
IKKPIMHNGIKLVLQGIFECQS

SEQ ID NO: 2715305 - protein, 19 aa, Entamoeba histolytica
IKKPIYIVSLPRSGSTFTH

SEQ ID NO: 2715306 - protein, 24 aa, Entamoeba histolytica
IKKRILKRVGYLSELIGDIVVFSE

SEQ ID NO: 2715307 - protein, 17 aa, Entamoeba histolytica
IKKSLSKIKLTPGTIGK

SEQ ID NO: 2715308 - protein, 25 aa, Entamoeba histolytica
IKKSQWRVPLPIFRAMQYLEEHKGD

SEQ ID NO: 2715309 - protein, 31 aa, Entamoeba histolytica
IKKVEKKYILTYKLIENYLQRNIYQPKNQGE

SEQ ID NO: 2715310 - protein, 27 aa, Entamoeba histolytica
IKKVHRQIFFYYNSFNIIIGKQGAGKT

SEQ ID NO: 2715311 - protein, 29 aa, Entamoeba histolytica
IKKVHRQIFFYYNSFNIIIGKQGAGKTTF

SEQ ID NO: 2715312 - protein, 23 aa, Entamoeba histolytica
IKLIRYNIVIEENPELIKQICFF

SEQ ID NO: 2715313 - protein, 28 aa, Entamoeba histolytica
IKLKQNKLNYFFVSAKTGLNIKKAFISL

SEQ ID NO: 2715314 - protein, 19 aa, Entamoeba histolytica
IKLLSIFINQLGFEKDRII

SEQ ID NO: 2715315 - protein, 30 aa, Entamoeba histolytica
IKLNNFIVPIELQEFYLKSEWKFADDLRLM

SEQ ID NO: 2715316 - protein, 25 aa, Entamoeba histolytica
IKLPDSLLIIDSYAFSLCYSLISID

SEQ ID NO: 2715317 - protein, 19 aa, Entamoeba histolytica
IKLWAKLFCSPLEDPKKET

SEQ ID NO: 2715318 - protein, 17 aa, Entamoeba histolytica
IKLYKRAEGTRIKKQLT

SEQ ID NO: 2715319 - protein, 18 aa, Entamoeba histolytica
IKLYKRAIKKNNSKLIIA

SEQ ID NO: 2715320 - protein, 19 aa, Entamoeba histolytica
IKMGKELSFFFDKNPYFTN

SEQ ID NO: 2715321 - protein, 18 aa, Entamoeba histolytica
IKMKLYFNYFEEGKLNKV

SEQ ID NO: 2715322 - protein, 19 aa, Entamoeba histolytica
IKMKVLIDVLKGIQFLHRN

SEQ ID NO: 2715323 - protein, 20 aa, Entamoeba histolytica
IKMPSLKVQVIMKYKAPNGS

SEQ ID NO: 2715324 - protein, 24 aa, Entamoeba histolytica
IKMVKIPVFAIYGQQDRFAGGMKK

SEQ ID NO: 2715325 - protein, 34 aa, Entamoeba histolytica; identical to SEQ ID NO: 2527420

SEQ ID NO: 2715326 - protein, 26 aa, Entamoeba histolytica
IKNDKDFFVFSLHSKKLKQPVMIQRK

SEQ ID NO: 2715327 - protein, 26 aa, Entamoeba histolytica
IKNDTIKFILRLLEKNGFLIQITKDI

SEQ ID NO: 2715328 - protein, 29 aa, Entamoeba histolytica
IKNDVWAYGITLWELFTKGKLPYSALKKE

SEQ ID NO: 2715329 - protein, 25 aa, Entamoeba histolytica
IKNGKLWGVLTIYKLFDGESMEEIF

SEQ ID NO: 2715330 - protein, 30 aa, Entamoeba histolytica
IKNIQFISGNRIFLNEPILLSIRIPENIKE

SEQ ID NO: 2715331 - protein, 29 aa, Entamoeba histolytica
IKNIQFISGNRIFLNEPILLSIRTPENIK

SEQ ID NO: 2715332 - protein, 23 aa, Entamoeba histolytica
IKNNFVILKLFDWNLCHFIQRER

SEQ ID NO: 2715333 - protein, 23 aa, Entamoeba histolytica
IKNNKEFYLIRNMNIDGKITQIR

SEQ ID NO: 2715334 - protein, 25 aa, Entamoeba histolytica
IKNQLIQHRSLLFEYFAITITENGE

SEQ ID NO: 2715335 - protein, 24 aa, Entamoeba histolytica
IKNVVLLYLYCSIDLFKDDEESFV

SEQ ID NO: 2715336 - protein, 24 aa, Entamoeba histolytica
IKNYLMKGYHMLGLFDGHGGDTVS

SEQ ID NO: 2715337 - protein, 25 aa, Entamoeba histolytica
IKPDLMITISLFVGNLLKLQEFIKD

SEQ ID NO: 2715338 - protein, 24 aa, Entamoeba histolytica
IKPESYLISGIFVFGIEYAQLKKI

SEQ ID NO: 2715339 - protein, 19 aa, Entamoeba histolytica
IKPKKYIVQLSKSFRSKKN

SEQ ID NO: 2715340 - protein, 18 aa, Entamoeba histolytica
IKPNTLRRQPPTPVIQMI

SEQ ID NO: 2715341 - protein, 17 aa, Entamoeba histolytica
IKPPFFGFGSLEPKFAI

SEQ ID NO: 2715342 - protein, 31 aa, Entamoeba histolytica; identical to SEQ ID NO: 2527441

SEQ ID NO: 2715343 - protein, 21 aa, Entamoeba histolytica
IKQESQCPPMQGFPQQPPMQG

SEQ ID NO: 2715344 - protein, 23 aa, Entamoeba histolytica
IKQFGFLIELLKDVSRSATYFTN

SEQ ID NO: 2715345 - protein, 21 aa, Entamoeba histolytica
IKQFGFYVDGVRQAVLNGSSS

SEQ ID NO: 2715346 - protein, 18 aa, Entamoeba histolytica
IKQKHFYLSPTNKLKKID

SEQ ID NO: 2715347 - protein, 24 aa, Entamoeba histolytica
IKQKNILMGISFLEGIEKLCGKFF

SEQ ID NO: 2715348 - protein, 25 aa, Entamoeba histolytica
IKQKVLLGKCRVAVEYFKTGRDQAL

SEQ ID NO: 2715349 - protein, 26 aa, Entamoeba histolytica
IKQLFLDNNFQLLKENNLWNLEKGKK

SEQ ID NO: 2715350 - protein, 27 aa, Entamoeba histolytica
IKQLREIYYLLHPLQYTSKGIPIQTII

SEQ ID NO: 2715351 - protein, 31 aa, Entamoeba histolytica
IKQSQTLLHLFLQNFPFPFLELMQPFIETDA

SEQ ID NO: 2715352 - protein, 24 aa, Entamoeba histolytica
IKQTPENLLTISLLTELISTVESF

SEQ ID NO: 2715353 - protein, 24 aa, Entamoeba histolytica
IKQVHLEYGCWYIKPTLLADNSFK

SEQ ID NO: 2715354 - protein, 22 aa, Entamoeba histolytica
IKQVRFYNRKLNKPSQPPFYQN

SEQ ID NO: 2715355 - protein, 18 aa, Entamoeba histolytica
IKRIELCKLPPISKNINL

SEQ ID NO: 2715356 - protein, 27 aa, Entamoeba histolytica
IKRIKIYRTLYSLAKFKDGNWLIKRNV

SEQ ID NO: 2715357 - protein, 21 aa, Entamoeba histolytica
IKRLVLIYLESIDKMDKGELR

SEQ ID NO: 2715358 - protein, 33 aa, Entamoeba histolytica
IKRQCLVINTLKYIYFRIERLLTVSFGELGEEI

SEQ ID NO: 2715359 - protein, 17 aa, Entamoeba histolytica
IKRRRDLNRAALTFNWL

SEQ ID NO: 2715360 - protein, 17 aa, Entamoeba histolytica
IKRWPHRKLQRIEGEIK

SEQ ID NO: 2715361 - protein, 22 aa, Entamoeba histolytica
IKSFLDNFTHSFYSLSSFHSSF

SEQ ID NO: 2715362 - protein, 31 aa, Entamoeba histolytica
IKSHCWFKGFDWEGLFKKKLTPPFVPVLKDK

SEQ ID NO: 2715363 - protein, 21 aa, Entamoeba histolytica
IKSHKFFRSVKFQLIRNIPPP

SEQ ID NO: 2715364 - protein, 27 aa, Entamoeba histolytica
IKSHPWFHDLHWDNLFAKKVLPDYLPQ

SEQ ID NO: 2715365 - protein, 28 aa, Entamoeba histolytica
IKSHQSFPCIPFFGVYLQDLTFIHEGNE

SEQ ID NO: 2715366 - protein, 20 aa, Entamoeba histolytica
IKSIFNSFYPRHIQPLALNT

SEQ ID NO: 2715367 - protein, 24 aa, Entamoeba histolytica
IKSITFLLHLFKVINSISSISLPH

SEQ ID NO: 2715368 - protein, 22 aa, Entamoeba histolytica
IKSQVLSFFSSILKIYSGSGNS

SEQ ID NO: 2715369 - protein, 18 aa, Entamoeba histolytica
IKSRLPKEPVLNSAIKEL

SEQ ID NO: 2715370 - protein, 26 aa, Entamoeba histolytica
IKSSGKMVLLDKLLPKLNADGHKVLI

SEQ ID NO: 2715371 - protein, 31 aa, Entamoeba histolytica
IKSTDGIYPKKEIEWLMGISWNKGNQSRYKQ

SEQ ID NO: 2715372 - protein, 28 aa, Entamoeba histolytica
IKSWNDMELLWNYTFNEKLHVETTGKSI

SEQ ID NO: 2715373 - protein, 24 aa, Entamoeba histolytica
IKTCDFLANELFKYLQKNCYLSFF

SEQ ID NO: 2715374 - protein, 17 aa, Entamoeba histolytica
IKTIFPNIFMSKKMKKW

SEQ ID NO: 2715375 - protein, 19 aa, Entamoeba histolytica
IKTIQRIIAPTFYVRSIDL

SEQ ID NO: 2715376 - protein, 25 aa, Entamoeba histolytica
IKTKNFPFLLSRLKHPKTYKVITSL

SEQ ID NO: 2715377 - protein, 22 aa, Entamoeba histolytica
IKTLEQYTLLKRITIIKSYWRN

SEQ ID NO: 2715378 - protein, 27 aa, Entamoeba histolytica
IKTLFTQFVLYQQFIQFLMKTKYFNDS

SEQ ID NO: 2715379 - protein, 36 aa, Entamoeba histolytica
IKTMIKMICKIFPISDFWEHVCIVWTKCFCYTPKKK

SEQ ID NO: 2715380 - protein, 30 aa, Entamoeba histolytica
IKTMIKMICKIFPRSNFWEHVCIVWTKCSC

SEQ ID NO: 2715381 - protein, 28 aa, Entamoeba histolytica
IKTPTKLLHLGFHKLPFIPKESAELYYF

SEQ ID NO: 2715382 - protein, 22 aa, Entamoeba histolytica
IKTTRLCVLILSSLRCLKPLNE

SEQ ID NO: 2715383 - protein, 22 aa, Entamoeba histolytica
IKTWEYYLYVKKISNEQNAPIF

SEQ ID NO: 2715384 - protein, 20 aa, Entamoeba histolytica
IKVDYIDLFIKEMMKKFKEQ

SEQ ID NO: 2715385 - protein, 25 aa, Entamoeba histolytica
IKVIEPIIAYMLFKKIIIREKRIYS

SEQ ID NO: 2715386 - protein, 32 aa, Entamoeba histolytica; identical to SEQ ID NO: 2527502

SEQ ID NO: 2715387 - protein, 23 aa, Entamoeba histolytica
IKVLMEVILLQRLSAEFPDMFVN

SEQ ID NO: 2715388 - protein, 30 aa, Entamoeba histolytica
IKVNTKWVGIPWTGIGKVAVWPLEKSGKMI

SEQ ID NO: 2715389 - protein, 18 aa, Entamoeba histolytica
IKVQLEGLRISLNSRFAK

SEQ ID NO: 2715390 - protein, 22 aa, Entamoeba histolytica
IKVQMGMLRVIDIILKSDFGEM

SEQ ID NO: 2715391 - protein, 25 aa, Entamoeba histolytica
IKVTEIDLLLLHKIDAIIDFKNDFK

SEQ ID NO: 2715392 - protein, 17 aa, Entamoeba histolytica
IKWKKMLEQWKCDGKIP

SEQ ID NO: 2715393 - protein, 25 aa, Entamoeba histolytica
IKYASYRQYRIPIVFGKSINKEIVD

SEQ ID NO: 2715394 - protein, 18 aa, Entamoeba histolytica
IKYLFTSLLGINEKSYNR

SEQ ID NO: 2715395 - protein, 26 aa, Entamoeba histolytica
IKYLKHIELMIENYRIELSKKKKILQ

SEQ ID NO: 2715396 - protein, 18 aa, Entamoeba histolytica
IKYNYLAILIDSSGSWKK

SEQ ID NO: 2715397 - protein, 38 aa, Entamoeba histolytica
IKYPTPLKRKAITPLLESKRRFLVPHKSILKTTSVEVK

SEQ ID NO: 2715398 - protein, 27 aa, Entamoeba histolytica
IKYQSIVCTFLIKYYPLIFRDTCNTEG

SEQ ID NO: 2715399 - protein, 26 aa, Entamoeba histolytica
IKYTIEQFVDYFRHCGIAKKKTPTQY

SEQ ID NO: 2715400 - protein, 23 aa, Entamoeba histolytica
ILAKIIPRMTFYASRPLPIVTNE

SEQ ID NO: 2715401 - protein, 18 aa, Entamoeba histolytica
ILALISFNRLIVIRGHEQ

SEQ ID NO: 2715402 - protein, 24 aa, Entamoeba histolytica
ILAPLVRSKLLYAHLMIIAGQKQM

SEQ ID NO: 2715403 - protein, 17 aa, Entamoeba histolytica
ILASGIKHWCKNTHVFS

SEQ ID NO: 2715404 - protein, 18 aa, Entamoeba histolytica
ILASIRRIAFIIAKTEYN

SEQ ID NO: 2715405 - protein, 19 aa, Entamoeba histolytica
ILCLLTQTNTYFTKIGLQL

SEQ ID NO: 2715406 - protein, 18 aa, Entamoeba histolytica
ILDAMIHCNLFESGKSTV

SEQ ID NO: 2715407 - protein, 26 aa, Entamoeba histolytica
ILDCLKPVYIPLLSETMFDVNFLINS

SEQ ID NO: 2715408 - protein, 26 aa, Entamoeba histolytica
ILDDMLPPFIGKYTRGLLLGETELGL

SEQ ID NO: 2715409 - protein, 17 aa, Entamoeba histolytica
ILDHFNIPIDNPCILLM

SEQ ID NO: 2715410 - protein, 18 aa, Entamoeba histolytica
ILDKIDISQFPWSTDEAI

SEQ ID NO: 2715411 - protein, 26 aa, Entamoeba histolytica
ILDNDTFYKYDLLTQSILCSYIPHNK

SEQ ID NO: 2715412 - protein, 35 aa, Entamoeba histolytica
ILDRLIEIVAFPRLYYKTIPLPFDYPTYFSHCKII

SEQ ID NO: 2715413 - protein, 17 aa, Entamoeba histolytica
ILDSKLLYNIPILVIQR

SEQ ID NO: 2715414 - protein, 28 aa, Entamoeba histolytica
ILDVNFVINLELPLIYPSQNIDITTYIH

SEQ ID NO: 2715415 - protein, 27 aa, Entamoeba histolytica
ILEDQSKLYHAYWQQTKTDFSDFKKES

SEQ ID NO: 2715416 - protein, 18 aa, Entamoeba histolytica
ILEIDYLPTSLDGLNISC

SEQ ID NO: 2715417 - protein, 24 aa, Entamoeba histolytica
ILEIPPTISRLTSLKQLIICGNKI

SEQ ID NO: 2715418 - protein, 23 aa, Entamoeba histolytica
ILEKDEGWWKGELNGQEGWIPNN

SEQ ID NO: 2715419 - protein, 35 aa, Entamoeba histolytica
ILEKMRSKGFDLLNNRFLILQGEVERIALMPTKSK

SEQ ID NO: 2715420 - protein, 31 aa, Entamoeba histolytica
ILEKYKGKWFMYVYGVIDKLLTKIQSEPKEY

SEQ ID NO: 2715421 - protein, 18 aa, Entamoeba histolytica
ILELIKKHPPPTFKNKEE

SEQ ID NO: 2715422 - protein, 25 aa, Entamoeba histolytica
ILENEKKRFYADKIAFENEKNAALE

SEQ ID NO: 2715423 - protein, 21 aa, Entamoeba histolytica
ILEPKFEGCILPRIPQVYYKP

SEQ ID NO: 2715424 - protein, 31 aa, Entamoeba histolytica; identical to SEQ ID NO: 2527534

SEQ ID NO: 2715425 - protein, 25 aa, Entamoeba histolytica
ILEVLSIDLLPILPIEQWKSTSSFV

SEQ ID NO: 2715426 - protein, 19 aa, Entamoeba histolytica
ILEWFDKELASLINEKERR

SEQ ID NO: 2715427 - protein, 17 aa, Entamoeba histolytica
ILFEYCDMGTFDQFIPS

SEQ ID NO: 2715428 - protein, 17 aa, Entamoeba histolytica
ILFFAKVKDDNLLLIKK

SEQ ID NO: 2715429 - protein, 20 aa, Entamoeba histolytica
ILFKNLNFALNMESRIALVG

SEQ ID NO: 2715430 - protein, 18 aa, Entamoeba histolytica
ILFNLLKEQDSMKCCIKG

SEQ ID NO: 2715431 - protein, 17 aa, Entamoeba histolytica
ILFPLNEKEIITNNIFT

SEQ ID NO: 2715432 - protein, 29 aa, Entamoeba histolytica
ILFSSIIKLMKLLLLPFKTVVYSSKPSDS

SEQ ID NO: 2715433 - protein, 18 aa, Entamoeba histolytica
ILFTLMADGLPWDKAHRY

SEQ ID NO: 2715434 - protein, 19 aa, Entamoeba histolytica
ILGLPYSCSIDMWSFGCVI

SEQ ID NO: 2715435 - protein, 18 aa, Entamoeba histolytica
ILGSYKWMSPERFLKKKY

SEQ ID NO: 2715436 - protein, 19 aa, Entamoeba histolytica
ILGTFVYKCECCQAILCGD

SEQ ID NO: 2715437 - protein, 24 aa, Entamoeba histolytica
ILHAQKFLVKLYDLQQKEISEEKK

SEQ ID NO: 2715438 - protein, 18 aa, Entamoeba histolytica
ILHCPIIEDLIRKIQTID

SEQ ID NO: 2715439 - protein, 27 aa, Entamoeba histolytica
ILHGDDAYFFIPNPTQFKLKRIIAFEY

SEQ ID NO: 2715440 - protein, 17 aa, Entamoeba histolytica
ILHLLQEESPRSQLYYL

SEQ ID NO: 2715441 - protein, 19 aa, Entamoeba histolytica
ILHQSQCLHFIKLTFTNES

SEQ ID NO: 2715442 - protein, 18 aa, Entamoeba histolytica
ILHVYLHQVHLKELLEIL

SEQ ID NO: 2715443 - protein, 18 aa, Entamoeba histolytica
ILHYIYDTKMLKSTLMKE

SEQ ID NO: 2715444 - protein, 29 aa, Entamoeba histolytica
ILIDIYKVLNMSTLVRRKLIRSNLYTSFN

SEQ ID NO: 2715445 - protein, 18 aa, Entamoeba histolytica
ILIELNYLNEISGILTFG

SEQ ID NO: 2715446 - protein, 26 aa, Entamoeba histolytica
ILIFTANIIYHLFDQFTEHMKKLEEQ

SEQ ID NO: 2715447 - protein, 18 aa, Entamoeba histolytica
ILIIYFTRDGHSEKIAND

SEQ ID NO: 2715448 - protein, 18 aa, Entamoeba histolytica
ILIPKNPDAPLPSLKIEE

SEQ ID NO: 2715449 - protein, 20 aa, Entamoeba histolytica
ILITLLCMKVNNPNGVILLR

SEQ ID NO: 2715450 - protein, 17 aa, Entamoeba histolytica
ILITTKNSVLVIEITES

SEQ ID NO: 2715451 - protein, 19 aa, Entamoeba histolytica
ILIVLKQWMQSYPNDFSLL

SEQ ID NO: 2715452 - protein, 17 aa, Entamoeba histolytica
ILIYERESPIKQEKEID

SEQ ID NO: 2715453 - protein, 18 aa, Entamoeba histolytica
ILKCNIALFVLRERIRKA

SEQ ID NO: 2715454 - protein, 24 aa, Entamoeba histolytica
ILKDGRKLLYYGPLKIIEEKNEWN

SEQ ID NO: 2715455 - protein, 18 aa, Entamoeba histolytica
ILKGVERKIKAQESLRKC

SEQ ID NO: 2715456 - protein, 18 aa, Entamoeba histolytica
ILKLFVNFAPRTTFKTEY

SEQ ID NO: 2715457 - protein, 18 aa, Entamoeba histolytica
ILKLLKKHHCGDLIRVSI

SEQ ID NO: 2715458 - protein, 19 aa, Entamoeba histolytica
ILKLPIGNDSSVYQHYHHQ

SEQ ID NO: 2715459 - protein, 18 aa, Entamoeba histolytica
ILKNPVIISPRPLDWIYD

SEQ ID NO: 2715460 - protein, 17 aa, Entamoeba histolytica
ILKPLKIGELCGKVLHK

SEQ ID NO: 2715461 - protein, 18 aa, Entamoeba histolytica
ILKRTMERINKHAWEGAM

SEQ ID NO: 2715462 - protein, 21 aa, Entamoeba histolytica
ILKYLQDMQMKIRDSILLIVS

SEQ ID NO: 2715463 - protein, 17 aa, Entamoeba histolytica
ILKYPELVIFIVKGTQI

SEQ ID NO: 2715464 - protein, 19 aa, Entamoeba histolytica
ILLAPIFRELQCIVNVILL

SEQ ID NO: 2715465 - protein, 21 aa, Entamoeba histolytica
ILLEWINTKVWIILKSQREFV

SEQ ID NO: 2715466 - protein, 22 aa, Entamoeba histolytica
ILLGLLNVYCTIPSSLQELIEE

SEQ ID NO: 2715467 - protein, 20 aa, Entamoeba histolytica
ILLHKKIIEILGMYLQYFNQ

SEQ ID NO: 2715468 - protein, 17 aa, Entamoeba histolytica
ILLHSDYSMQCSVYSYI

SEQ ID NO: 2715469 - protein, 17 aa, Entamoeba histolytica
ILLKQFFVSVKKAIRYL

SEQ ID NO: 2715470 - protein, 27 aa, Entamoeba histolytica
ILLNEKKPLVMSTAKALRVANEIKEKL

SEQ ID NO: 2715471 - protein, 26 aa, Entamoeba histolytica
ILLNGITFSIPLQRLNQIPTIITLIC

SEQ ID NO: 2715472 - protein, 17 aa, Entamoeba histolytica
ILLPQSFQYISLEQLIG

SEQ ID NO: 2715473 - protein, 28 aa, Entamoeba histolytica
ILLRRMTDTIKPLKYSPLFIQKQNELLQ

SEQ ID NO: 2715474 - protein, 19 aa, Entamoeba histolytica
ILLSFNLLEEKIAKDVLLK

SEQ ID NO: 2715475 - protein, 19 aa, Entamoeba histolytica
ILLTKSFIMRNVNLMGVIK

SEQ ID NO: 2715476 - protein, 30 aa, Entamoeba histolytica
ILLTKSPIYQHGCSWAWKLMDGNAPLSFNE

SEQ ID NO: 2715477 - protein, 17 aa, Entamoeba histolytica
ILLVKVIARYCEFIETD

SEQ ID NO: 2715478 - protein, 17 aa, Entamoeba histolytica
ILMIHHPPYNEKADINP

SEQ ID NO: 2715479 - protein, 35 aa, Entamoeba histolytica
ILMSLNTFIPLYTYKYLRPWKIVHYKNIVVTLYND

SEQ ID NO: 2715480 - protein, 17 aa, Entamoeba histolytica
ILNGFSSTLRIFGNQTF

SEQ ID NO: 2715481 - protein, 19 aa, Entamoeba histolytica
ILNGKFLATKPLNSQDKLK

SEQ ID NO: 2715482 - protein, 17 aa, Entamoeba histolytica
ILNKIYGNLFFSLIQQY

SEQ ID NO: 2715483 - protein, 18 aa, Entamoeba histolytica
ILNKKGDWWQGECQGNIG

SEQ ID NO: 2715484 - protein, 27 aa, Entamoeba histolytica
ILNKYRLGNCPVKMAHFAKWIKSSLKI

SEQ ID NO: 2715485 - protein, 18 aa, Entamoeba histolytica
ILNLSFASTLRKIKAIQT

SEQ ID NO: 2715486 - protein, 17 aa, Entamoeba histolytica
ILNPRMVYANALRQRLK

SEQ ID NO: 2715487 - protein, 26 aa, Entamoeba histolytica
ILNQFFSLWNSFIPKKLPSLSDKKIT

SEQ ID NO: 2715488 - protein, 31 aa, Entamoeba histolytica; identical to SEQ ID NO: 2527592

SEQ ID NO: 2715489 - protein, 24 aa, Entamoeba histolytica
ILNQYFIDLPPIHSLPLEQLFEWV

SEQ ID NO: 2715490 - protein, 26 aa, Entamoeba histolytica
ILNTLNFQIIRPTPLDFLRRFSRAAD

SEQ ID NO: 2715491 - protein, 20 aa, Entamoeba histolytica
ILNVVPDEASEKLPKLPTSQ

SEQ ID NO: 2715492 - protein, 17 aa, Entamoeba histolytica
ILNYFKKHHIPIALATS

SEQ ID NO: 2715493 - protein, 20 aa, Entamoeba histolytica
ILPCWESFESSRLQVICISL

SEQ ID NO: 2715494 - protein, 28 aa, Entamoeba histolytica
ILPEDFPQIQLLLPTVLLSLSIESPSVE

SEQ ID NO: 2715495 - protein, 20 aa, Entamoeba histolytica
ILQDAFIQNLFLNTNVSYID

SEQ ID NO: 2715496 - protein, 25 aa, Entamoeba histolytica
ILQISLYSLFIYVTSLLLNLQIPTI

SEQ ID NO: 2715497 - protein, 18 aa, Entamoeba histolytica
ILQKTLYILKIKTTFYSF

SEQ ID NO: 2715498 - protein, 26 aa, Entamoeba histolytica
ILQKVKHPFLVNLYYSFQSATHLHYV

SEQ ID NO: 2715499 - protein, 18 aa, Entamoeba histolytica
ILQLFLHCKVIDKQVAIT

SEQ ID NO: 2715500 - protein, 32 aa, Entamoeba histolytica
ILQPKQDIVFCYPPPPLFIAERGQFSNYLDMV

SEQ ID NO: 2715501 - protein, 21 aa, Entamoeba histolytica
ILQYFDPCLIELELLKKEIGS

SEQ ID NO: 2715502 - protein, 34 aa, Entamoeba histolytica
ILQYIKQKKLECPLLFLWGNLYGNLQFVKEQNEN

SEQ ID NO: 2715503 - protein, 18 aa, Entamoeba histolytica
ILRDFQLTKAEFIIYVLS

SEQ ID NO: 2715504 - protein, 18 aa, Entamoeba histolytica
ILRFIVSLVEHILKTNFF

SEQ ID NO: 2715505 - protein, 18 aa, Entamoeba histolytica
ILRGKVEFPLSLPSLFIK

SEQ ID NO: 2715506 - protein, 25 aa, Entamoeba histolytica
ILRGNFLVSKLFLVLSHITIPTIEC

SEQ ID NO: 2715507 - protein, 19 aa, Entamoeba histolytica
ILRHIFDIRWWPNDSLRVE

SEQ ID NO: 2715508 - protein, 25 aa, Entamoeba histolytica
ILRIGGIIPFCSLLHFGFSYEKFNT

SEQ ID NO: 2715509 - protein, 18 aa, Entamoeba histolytica
ILRLYQTRADYYSLIGDI

SEQ ID NO: 2715510 - protein, 21 aa, Entamoeba histolytica
ILRRGYWMLSNISVSKFPETT

SEQ ID NO: 2715511 - protein, 19 aa, Entamoeba histolytica
ILRSLILQNGGKYLMKYSS

SEQ ID NO: 2715512 - protein, 32 aa, Entamoeba histolytica
ILRSRLNQLAIKYKYLYLTNTEILLGITMSRC

SEQ ID NO: 2715513 - protein, 17 aa, Entamoeba histolytica
ILRYTDLLMRIGSSEFA

SEQ ID NO: 2715514 - protein, 25 aa, Entamoeba histolytica
ILSDLRMIKPFLTYFHNAAVKAIKF

SEQ ID NO: 2715515 - protein, 19 aa, Entamoeba histolytica
ILSDYCFYLEELYGTADVN

SEQ ID NO: 2715516 - protein, 20 aa, Entamoeba histolytica
ILSFIELPWMRTSETKSLLL

SEQ ID NO: 2715517 - protein, 18 aa, Entamoeba histolytica
ILSFLKSDYPITAQFYAL

SEQ ID NO: 2715518 - protein, 18 aa, Entamoeba histolytica
ILSFPFTYNGIFHIKEHP

SEQ ID NO: 2715519 - protein, 19 aa, Entamoeba histolytica
ILSIDKIRLFSEQKRTAKK

SEQ ID NO: 2715520 - protein, 20 aa, Entamoeba histolytica
ILSIIIPSKIISSTILCIFD

SEQ ID NO: 2715521 - protein, 17 aa, Entamoeba histolytica
ILSIVDILIHYSDDEAL

SEQ ID NO: 2715522 - protein, 26 aa, Entamoeba histolytica
ILSLTHALILKFRFIKDSTKIRIITA

SEQ ID NO: 2715523 - protein, 20 aa, Entamoeba histolytica
ILSNYIVKLINKLKSYLRLS

SEQ ID NO: 2715524 - protein, 22 aa, Entamoeba histolytica
ILSPNYWEVIDLITGNIIQSTK

SEQ ID NO: 2715525 - protein, 21 aa, Entamoeba histolytica
ILSPYKYAGYGLLVPALDDEE

SEQ ID NO: 2715526 - protein, 24 aa, Entamoeba histolytica
ILSQSGLCRILLKTLGITSFENKY

SEQ ID NO: 2715527 - protein, 27 aa, Entamoeba histolytica
ILSVGDCEAFIYKSAIGRTFSINKKWC

SEQ ID NO: 2715528 - protein, 29 aa, Entamoeba histolytica
ILTDLKDGLILIRFLTNLSGKEILKTIET

SEQ ID NO: 2715529 - protein, 20 aa, Entamoeba histolytica
ILTEFHWDRNRLFDRLICDL

SEQ ID NO: 2715530 - protein, 18 aa, Entamoeba histolytica
ILTEILLQYQNEINYLEQ

SEQ ID NO: 2715531 - protein, 21 aa, Entamoeba histolytica
ILTFYHYNPIAITQGMEKFFP

SEQ ID NO: 2715532 - protein, 20 aa, Entamoeba histolytica
ILTGFGYIIQTLDNELYNVI

SEQ ID NO: 2715533 - protein, 17 aa, Entamoeba histolytica
ILTLLKDNLCSIYSLIN

SEQ ID NO: 2715534 - protein, 24 aa, Entamoeba histolytica
ILTPKFPDFFTDEMKEFLPVIINC

SEQ ID NO: 2715535 - protein, 31 aa, Entamoeba histolytica
ILTSQYLHWSLFINILLHLIQLPSPQRVLFL

SEQ ID NO: 2715536 - protein, 19 aa, Entamoeba histolytica
ILVGNNFFGDASSLFGIFD

SEQ ID NO: 2715537 - protein, 19 aa, Entamoeba histolytica
ILVIDEPFRWEGCSWEWCW

SEQ ID NO: 2715538 - protein, 24 aa, Entamoeba histolytica
ILVLTHIFLITNDEIRTLIFNWII

SEQ ID NO: 2715539 - protein, 21 aa, Entamoeba histolytica
ILVNLPLLQSISLPKSLKNIV

SEQ ID NO: 2715540 - protein, 20 aa, Entamoeba histolytica
ILVSGGVDTIILFRSINDMN

SEQ ID NO: 2715541 - protein, 24 aa, Entamoeba histolytica
ILVVTSVILYYLRPKTYPQEFNGR

SEQ ID NO: 2715542 - protein, 30 aa, Entamoeba histolytica; identical to SEQ ID NO: 2527644

SEQ ID NO: 2715543 - protein, 27 aa, Entamoeba histolytica
ILYGTKAMFMNPFIPSSLLKESGIEYH

SEQ ID NO: 2715544 - protein, 19 aa, Entamoeba histolytica
ILYNFSVVHDKFPPNPKFV

SEQ ID NO: 2715545 - protein, 26 aa, Entamoeba histolytica
ILYNKTNVMFYFMTEQNLYGAYFSKF

SEQ ID NO: 2715546 - protein, 20 aa, Entamoeba histolytica
ILYQNPTYVIPTGPQNQRIV

SEQ ID NO: 2715547 - protein, 17 aa, Entamoeba histolytica
ILYVIMSFDLKTHTIHF

SEQ ID NO: 2715548 - protein, 19 aa, Entamoeba histolytica
IMADALWGFSFIVSNPQNI

SEQ ID NO: 2715549 - protein, 19 aa, Entamoeba histolytica
IMELWELITNMMKCIATAL

SEQ ID NO: 2715550 - protein, 26 aa, Entamoeba histolytica
IMETPYLAIHFNVGPIYLFNLNNPQE

SEQ ID NO: 2715551 - protein, 18 aa, Entamoeba histolytica
IMGILKKYEEILAQIVYF

SEQ ID NO: 2715552 - protein, 25 aa, Entamoeba histolytica
IMGRLIFPKVENKEPIFNCIWIGNG

SEQ ID NO: 2715553 - protein, 17 aa, Entamoeba histolytica
IMIDTINTIPIIVHTIS

SEQ ID NO: 2715554 - protein, 25 aa, Entamoeba histolytica
IMKDPYVIYAILDLIHSHYQILKDE

SEQ ID NO: 2715555 - protein, 20 aa, Entamoeba histolytica
IMKDPYVIYAILDSIHSHYQ

SEQ ID NO: 2715556 - protein, 19 aa, Entamoeba histolytica
IMKDTGLYSKCECTMESDV

SEQ ID NO: 2715557 - protein, 17 aa, Entamoeba histolytica
IMKSCSLPFLFKPYGNC

SEQ ID NO: 2715558 - protein, 27 aa, Entamoeba histolytica
IMKTSFTLINWRSVIPTAPAHGLFLDQ

SEQ ID NO: 2715559 - protein, 17 aa, Entamoeba histolytica
IMLLDVQGRRYEFYPTF

SEQ ID NO: 2715560 - protein, 19 aa, Entamoeba histolytica
IMMTFNILISTLPKETRLT

SEQ ID NO: 2715561 - protein, 86 aa, Entamoeba histolytica
IMNGEPKPIITLMFYLMYRFRLNDTPVRIIDFSKWIKCILKINNPLFDLKTEFSDGILFARILNYYKPNIIAYNTLTRDKIKTVST

SEQ ID NO: 2715562 - protein, 24 aa, Entamoeba histolytica
IMNKTFTFFVLQDGTFRYYNSNGT

SEQ ID NO: 2715563 - protein, 20 aa, Entamoeba histolytica
IMPPPLCHISIPIQSTQYIY

SEQ ID NO: 2715564 - protein, 24 aa, Entamoeba histolytica
IMPVQRLMRYPILLKELIKNTSSF

SEQ ID NO: 2715565 - protein, 30 aa, Entamoeba histolytica
IMPVQRVPRYRLLLQDLLKNTPDGTLGKSA

SEQ ID NO: 2715566 - protein, 30 aa, Entamoeba histolytica
IMQELYNHHIGIKEWNKYVKALFDSITKTY

SEQ ID NO: 2715567 - protein, 42 aa, Entamoeba histolytica
IMQHHTIYILSELWMCGLIQYETPILCFWNNDKTLAIHLFSS

SEQ ID NO: 2715568 - protein, 23 aa, Entamoeba histolytica
IMQLWNCYLKEYVPIIPVLQEEI

SEQ ID NO: 2715569 - protein, 26 aa, Entamoeba histolytica
IMQRHQYLAFHLLNCNLNSFNVNNGN

SEQ ID NO: 2715570 - protein, 24 aa, Entamoeba histolytica
IMQRVVRLIIQYPVSYSNIASITK

SEQ ID NO: 2715571 - protein, 19 aa, Entamoeba histolytica
IMREGLFTQIVLKVGNDVV

SEQ ID NO: 2715572 - protein, 26 aa, Entamoeba histolytica
IMSSSTMIFMYSYFSRIEFTPISYQP

SEQ ID NO: 2715573 - protein, 28 aa, Entamoeba histolytica
IMTELDAHLYFLIPISIYLGNLTSDISS

SEQ ID NO: 2715574 - protein, 28 aa, Entamoeba histolytica
IMTLGLNEHRFQQIVDSLDLFDEYNELN

SEQ ID NO: 2715575 - protein, 26 aa, Entamoeba histolytica
IMTVDPIVFVCNVPIRAFKAKTMFLS

SEQ ID NO: 2715576 - protein, 18 aa, Entamoeba histolytica
IMVLKILHQTSLGITYQS

SEQ ID NO: 2715577 - protein, 20 aa, Entamoeba histolytica
INAMVLLLIEIGKKQPELLK

SEQ ID NO: 2715578 - protein, 17 aa, Entamoeba histolytica
INCFIACSFHPYSKVSY

SEQ ID NO: 2715579 - protein, 25 aa, Entamoeba histolytica
INCIETIFTCSLFESLWPPSYEDNP

SEQ ID NO: 2715580 - protein, 22 aa, Entamoeba histolytica
INCKVYNVTPFWAELITRELPS

SEQ ID NO: 2715581 - protein, 25 aa, Entamoeba histolytica
INCQRNCNVVLRWALLHGTYPIKKL

SEQ ID NO: 2715582 - protein, 19 aa, Entamoeba histolytica
INCYQHCLQLLANQINMNQ

SEQ ID NO: 2715583 - protein, 24 aa, Entamoeba histolytica
INDADWCRYVHLFCIYCGKRYTSL

SEQ ID NO: 2715584 - protein, 20 aa, Entamoeba histolytica
INDCQMVFTGVWHGLTHIYL

SEQ ID NO: 2715585 - protein, 26 aa, Entamoeba histolytica
INDEGYHRLFYPIIDRIMEVFQPSVV

SEQ ID NO: 2715586 - protein, 19 aa, Entamoeba histolytica
INDFKSFFDELLKDYVDII

SEQ ID NO: 2715587 - protein, 28 aa, Entamoeba histolytica
INDIKVMYLCMFFVLKNISYSTMKSWLE

SEQ ID NO: 2715588 - protein, 17 aa, Entamoeba histolytica
INDKIMMLLGINGINKI

SEQ ID NO: 2715589 - protein, 17 aa, Entamoeba histolytica
INDKSFVLKYKYSEKLK

SEQ ID NO: 2715590 - protein, 30 aa, Entamoeba histolytica
INDKTLLSLFHLHTLYLRLLSQEYSSFTGE

SEQ ID NO: 2715591 - protein, 18 aa, Entamoeba histolytica
INDLLLNDLKETEQLFIE

SEQ ID NO: 2715592 - protein, 25 aa, Entamoeba histolytica
INDNEFLYISLFNMQLKLVQTFSHS

SEQ ID NO: 2715593 - protein, 24 aa, Entamoeba histolytica
INDPKAFVFSLYKNKRYQKLKFPF

SEQ ID NO: 2715594 - protein, 22 aa, Entamoeba histolytica
INDPTLCSQLFIKEIDNALIDS

SEQ ID NO: 2715595 - protein, 30 aa, Entamoeba histolytica
INDQIVMAIGKIIPPEQLTLDRLVDYLDTF

SEQ ID NO: 2715596 - protein, 23 aa, Entamoeba histolytica
INDRYEFPRELDLYPYCIEHINH

SEQ ID NO: 2715597 - protein, 25 aa, Entamoeba histolytica
INDSKWYCFPLLIEIAMNWKLKIYD

SEQ ID NO: 2715598 - protein, 35 aa, Entamoeba histolytica
INDVFKIKDIWKHVCIVWTRCYNYIPPKKIDEGKK

SEQ ID NO: 2715599 - protein, 26 aa, Entamoeba histolytica
INEDSKHFIFTLRNPHLVPPTMIQPR

SEQ ID NO: 2715600 - protein, 17 aa, Entamoeba histolytica
INEFYQFAVLLETEFPK

SEQ ID NO: 2715601 - protein, 17 aa, Entamoeba histolytica
INEGIWRSMRRVVIYLE

SEQ ID NO: 2715602 - protein, 24 aa, Entamoeba histolytica
INEHLWYCTPLERIFRNITNDIIL

SEQ ID NO: 2715603 - protein, 26 aa, Entamoeba histolytica
INEKITYVTVPTMIKHQPKHCSSFKK

SEQ ID NO: 2715604 - protein, 24 aa, Entamoeba histolytica
INELIFKSKYFYLKRYEYLDQIYK

SEQ ID NO: 2715605 - protein, 25 aa, Entamoeba histolytica
INELKNELIIIEQKLKDIPNLDELE

SEQ ID NO: 2715606 - protein, 17 aa, Entamoeba histolytica
INELPIEIWLHVVPQII

SEQ ID NO: 2715607 - protein, 20 aa, Entamoeba histolytica
INELRNLVLTKRGINQYTEV

SEQ ID NO: 2715608 - protein, 24 aa, Entamoeba histolytica
INELVLWTLKCCGLYYQRLEGGDE

SEQ ID NO: 2715609 - protein, 19 aa, Entamoeba histolytica
INELYIFADEKITFVKKIN

SEQ ID NO: 2715610 - protein, 22 aa, Entamoeba histolytica
INEMEFFIQLMKDQISFLKRRY

SEQ ID NO: 2715611 - protein, 21 aa, Entamoeba histolytica
INEMEFLGIVIPPSDFQQYNQ

SEQ ID NO: 2715612 - protein, 18 aa, Entamoeba histolytica
INEMFDPNDLKYLDDKRQ

SEQ ID NO: 2715613 - protein, 19 aa, Entamoeba histolytica
INEMYLFNPISISSLNLFP

SEQ ID NO: 2715614 - protein, 27 aa, Entamoeba histolytica
INENKLIEFFGIVPIIHIEGRTFPVSV

SEQ ID NO: 2715615 - protein, 25 aa, Entamoeba histolytica
INENLDVFSFLLKDFRLIIYEVSPI

SEQ ID NO: 2715616 - protein, 24 aa, Entamoeba histolytica
INENTKLPLFLGREGKEFKEDGTF

SEQ ID NO: 2715617 - protein, 25 aa, Entamoeba histolytica
INEPILICGDSCIDSYIISFSVAIG

SEQ ID NO: 2715618 - protein, 17 aa, Entamoeba histolytica
INEPSATILLYQNEFHI

SEQ ID NO: 2715619 - protein, 18 aa, Entamoeba histolytica
INFCVIKTLYLYETYIKD

SEQ ID NO: 2715620 - protein, 36 aa, Entamoeba histolytica
INFETFLHKVLIPIRLKVMGLLRMWIQNRKFDFQNE

SEQ ID NO: 2715621 - protein, 19 aa, Entamoeba histolytica
INFIIFHINLERVRTCLLG

SEQ ID NO: 2715622 - protein, 18 aa, Entamoeba histolytica
INFISLKFNIKKGESLII

SEQ ID NO: 2715623 - protein, 18 aa, Entamoeba histolytica
INFLFVKGCNDYFDSPLK

SEQ ID NO: 2715624 - protein, 19 aa, Entamoeba histolytica
INFLTKPDFEIIKPKTQIV

SEQ ID NO: 2715625 - protein, 27 aa, Entamoeba histolytica
INFNELPLLSKVNILLSYSIPKNLKNV

SEQ ID NO: 2715626 - protein, 20 aa, Entamoeba histolytica
INFYNIILQFLLSNVNKGDI

SEQ ID NO: 2715627 - protein, 21 aa, Entamoeba histolytica
INGCVDFIVPEGFMPRIIDGN

SEQ ID NO: 2715628 - protein, 39 aa, Entamoeba histolytica
INGFGFRNIREWIKKIKTPYYSYAFSVIQYILVKTNHYD

SEQ ID NO: 2715629 - protein, 25 aa, Entamoeba histolytica
INGIKQLNLELLKYALKELDIAAKQ

SEQ ID NO: 2715630 - protein, 28 aa, Entamoeba histolytica
INGILVERAAFIILGALIAPVLESSIVV

SEQ ID NO: 2715631 - protein, 23 aa, Entamoeba histolytica
INGKVAFPLQLNISKYGMDGLYD

SEQ ID NO: 2715632 - protein, 21 aa, Entamoeba histolytica
INGLNKMSLISDWKKLCLIKD

SEQ ID NO: 2715633 - protein, 23 aa, Entamoeba histolytica
INGLPLFLHHFRIKFGECAKFMD

SEQ ID NO: 2715634 - protein, 28 aa, Entamoeba histolytica
INGVEVFMLLIALKVKYPRRVTLLRGNH

SEQ ID NO: 2715635 - protein, 29 aa, Entamoeba histolytica
INGVLLLPPLILLFHELNPHRFFMSYIIN

SEQ ID NO: 2715636 - protein, 28 aa, Entamoeba histolytica
INHFNSSLIKILWNYNIKYKTIILSDEK

SEQ ID NO: 2715637 - protein, 18 aa, Entamoeba histolytica
INHFVPSVKIKYLTLINI

SEQ ID NO: 2715638 - protein, 42 aa, Entamoeba histolytica; identical to SEQ ID NO: 2527749

SEQ ID NO: 2715639 - protein, 20 aa, Entamoeba histolytica
INHLILIKNWTEALESELVA

SEQ ID NO: 2715640 - protein, 28 aa, Entamoeba histolytica
INHLVEMGFLRDDAIKALRKSQNNTAIA

SEQ ID NO: 2715641 - protein, 28 aa, Entamoeba histolytica
INHNEKMLLSFFISIATKFVPLGRVHMK

SEQ ID NO: 2715642 - protein, 17 aa, Entamoeba histolytica
INHSQVPLYLLTDNIYA

SEQ ID NO: 2715643 - protein, 17 aa, Entamoeba histolytica
INIDPFIAQLSKRKYDK

SEQ ID NO: 2715644 - protein, 17 aa, Entamoeba histolytica
INIIMRGKMIYKMVVEY

SEQ ID NO: 2715645 - protein, 34 aa, Entamoeba histolytica
INIIQLHDVFLTQQYFYLVFELVEGGDLFKLTLN

SEQ ID NO: 2715646 - protein, 26 aa, Entamoeba histolytica
INIKNTYLFMPIFTKKEISNSLGKVT

SEQ ID NO: 2715647 - protein, 24 aa, Entamoeba histolytica
INILDENWIFSRKADMEKPLFSNA

SEQ ID NO: 2715648 - protein, 18 aa, Entamoeba histolytica
INIPEYIIHLKKGEFNEA

SEQ ID NO: 2715649 - protein, 24 aa, Entamoeba histolytica
INISLEMMILCASKLKLGVERYLK

SEQ ID NO: 2715650 - protein, 18 aa, Entamoeba histolytica
INITFFIESLHILALLFQ

SEQ ID NO: 2715651 - protein, 22 aa, Entamoeba histolytica
INKCSLLLPKNIISFGMINTDS

SEQ ID NO: 2715652 - protein, 30 aa, Entamoeba histolytica
INKEYLELKIVLQRLLLKTKVLIKEICIDL

SEQ ID NO: 2715653 - protein, 24 aa, Entamoeba histolytica
INKFYNQYNIDVKYGKAGLISKNA

SEQ ID NO: 2715654 - protein, 25 aa, Entamoeba histolytica
INKGSIDIILFKRNCRKAKPIGTSC

SEQ ID NO: 2715655 - protein, 19 aa, Entamoeba histolytica
INKKVIWYKQTYSDAIEEI

SEQ ID NO: 2715656 - protein, 30 aa, Entamoeba histolytica; identical to SEQ ID NO: 2527780

SEQ ID NO: 2715657 - protein, 27 aa, Entamoeba histolytica
INKNREYLTPFLKFPPFEEAKKMITQE

SEQ ID NO: 2715658 - protein, 25 aa, Entamoeba histolytica
INKSSFELSKYFARPKLIEKVNNFK

SEQ ID NO: 2715659 - protein, 25 aa, Entamoeba histolytica
INKYNIPEVLITLSLDKVKIDNLRE

SEQ ID NO: 2715660 - protein, 28 aa, Entamoeba histolytica
INLELPVFHIGFFRPIIQVLQCVCKNCN

SEQ ID NO: 2715661 - protein, 19 aa, Entamoeba histolytica
INLIPSLYVLKIQAKLQSN

SEQ ID NO: 2715662 - protein, 29 aa, Entamoeba histolytica
INLKLMQFPQPFLALGIIQIKILDGSSLY

SEQ ID NO: 2715663 - protein, 26 aa, Entamoeba histolytica
INLLELQVRSTGDEFVYISQSQYLEN

SEQ ID NO: 2715664 - protein, 20 aa, Entamoeba histolytica
INLSHFYTIFQSEIAVLAIC

SEQ ID NO: 2715665 - protein, 18 aa, Entamoeba histolytica
INMMIFNATLIIFRNISI

SEQ ID NO: 2715666 - protein, 20 aa, Entamoeba histolytica
INMVKYLLPLGADPFIKCVT

SEQ ID NO: 2715667 - protein, 31 aa, Entamoeba histolytica
INNDNFLIYHSNGRIIWYSYRKRTSTRIKFE

SEQ ID NO: 2715668 - protein, 26 aa, Entamoeba histolytica
INNDPHYFIFSLINKSQYGAFSMSLV

SEQ ID NO: 2715669 - protein, 25 aa, Entamoeba histolytica
INNEPYIIIIDLFNTIHILKYIDNQ

SEQ ID NO: 2715670 - protein, 23 aa, Entamoeba histolytica
INNHALLLAYLQSIPVDIFCQTT

SEQ ID NO: 2715671 - protein, 26 aa, Entamoeba histolytica
INNHKNIDGTSCIFVILSIIITFTFF

SEQ ID NO: 2715672 - protein, 27 aa, Entamoeba histolytica
INNIPFYLNYPIIIIPHKITLSPVLPK

SEQ ID NO: 2715673 - protein, 30 aa, Entamoeba histolytica
INNIPIVSEQWLIDTIKSTTIKDPYAYLVP

SEQ ID NO: 2715674 - protein, 20 aa, Entamoeba histolytica
INNIPLMQILPSITPLMKSD

SEQ ID NO: 2715675 - protein, 23 aa, Entamoeba histolytica
INNKFNVLWVSGKMKGIDPVNPA

SEQ ID NO: 2715676 - protein, 22 aa, Entamoeba histolytica
INNKRIILRLFDLKRNKECNEI

SEQ ID NO: 2715677 - protein, 33 aa, Entamoeba histolytica
INNMNRLLINKLFKYLWPPMIALKEGQCIQQID

SEQ ID NO: 2715678 - protein, 18 aa, Entamoeba histolytica
INNRVTFFIVKYDQVFYE

SEQ ID NO: 2715679 - protein, 26 aa, Entamoeba histolytica
INNSFEQFIFLYLRHPYDIEEIDKIF

SEQ ID NO: 2715680 - protein, 26 aa, Entamoeba histolytica
INNSLGYYLLPLNYFCSRHTKLSDDL

SEQ ID NO: 2715681 - protein, 17 aa, Entamoeba histolytica
INNYKISYLLGVTHQFN

SEQ ID NO: 2715682 - protein, 22 aa, Entamoeba histolytica
INNYVIWHKVKYRVIYKGTIPP

SEQ ID NO: 2715683 - protein, 19 aa, Entamoeba histolytica
INPIAPIHILVIPKQHIAS

SEQ ID NO: 2715684 - protein, 20 aa, Entamoeba histolytica
INPKILKQYSLMPSMMIFYE

SEQ ID NO: 2715685 - protein, 25 aa, Entamoeba histolytica
INPVRLMVDLVQDLRLINSSTIHSV

SEQ ID NO: 2715686 - protein, 29 aa, Entamoeba histolytica
INQCVKPIIQYLVLCLIEKAKGAITEITK

SEQ ID NO: 2715687 - protein, 18 aa, Entamoeba histolytica
INQIDILLKENESILKCI

SEQ ID NO: 2715688 - protein, 29 aa, Entamoeba histolytica
INQKGKKIKHFYLFNDRLISGKPGNEVIV

SEQ ID NO: 2715689 - protein, 34 aa, Entamoeba histolytica; identical to SEQ ID NO: 2527824

SEQ ID NO: 2715690 - protein, 24 aa, Entamoeba histolytica
INQPRIVFVVPPQFFTHHQITPEI

SEQ ID NO: 2715691 - protein, 27 aa, Entamoeba histolytica
INQRKKIINVLLFFIPTTKNCLIAKEL

SEQ ID NO: 2715692 - protein, 25 aa, Entamoeba histolytica
INQRYLYQLFVFYSTLTLTKAHVHG

SEQ ID NO: 2715693 - protein, 17 aa, Entamoeba histolytica
INQVILCLLTQTNTYFT

SEQ ID NO: 2715694 - protein, 19 aa, Entamoeba histolytica
INQVPEHISLKPKTKSKPL

SEQ ID NO: 2715695 - protein, 27 aa, Entamoeba histolytica
INRFNNEVILPQFIDFIFNSQDDFIVS

SEQ ID NO: 2715696 - protein, 22 aa, Entamoeba histolytica
INRINYDLTPFKALTSLTLTAQ

SEQ ID NO: 2715697 - protein, 19 aa, Entamoeba histolytica
INRIRLEDDLKRLNIENHR

SEQ ID NO: 2715698 - protein, 23 aa, Entamoeba histolytica
INRKDPFCQVIIIVNTRELARQT

SEQ ID NO: 2715699 - protein, 24 aa, Entamoeba histolytica
INRRNALTSIPKNAFMKFVKDLVL

SEQ ID NO: 2715700 - protein, 26 aa, Entamoeba histolytica
INSEDQLLIRLKKRFYFRDRNVNDTD

SEQ ID NO: 2715701 - protein, 18 aa, Entamoeba histolytica
INSFDKITYWLHELGNEK

SEQ ID NO: 2715702 - protein, 18 aa, Entamoeba histolytica
INSFNTWNKKFAKKVARA

SEQ ID NO: 2715703 - protein, 30 aa, Entamoeba histolytica
INSIDQIYRNLICKILIRNVGKNELPNEYT

SEQ ID NO: 2715704 - protein, 27 aa, Entamoeba histolytica
INSITEYIYNIFLYNDIRLTSNPVLRS

SEQ ID NO: 2715705 - protein, 33 aa, Entamoeba histolytica
INSLLSFPRDNTVTYYFAYGGWIVQMEEKNDQI

SEQ ID NO: 2715706 - protein, 25 aa, Entamoeba histolytica
INSNYIKVFYIPYGILDNSDPINSL

SEQ ID NO: 2715707 - protein, 25 aa, Entamoeba histolytica
INSSRPLPSIPQPKIIPIKEDELNQ

SEQ ID NO: 2715708 - protein, 26 aa, Entamoeba histolytica
INSSYCQIIFVLNQIDKFLDKELSHK

SEQ ID NO: 2715709 - protein, 22 aa, Entamoeba histolytica
INSTEIFFTTLWSELDINDKQY

SEQ ID NO: 2715710 - protein, 27 aa, Entamoeba histolytica
INSTLDFLRFYITNYKLYLISCQKISH

SEQ ID NO: 2715711 - protein, 23 aa, Entamoeba histolytica
INSVACLLDYIIDSFPKHCIDSL

SEQ ID NO: 2715712 - protein, 22 aa, Entamoeba histolytica
INTPLQIETFLPILNDEIFKSG

SEQ ID NO: 2715713 - protein, 22 aa, Entamoeba histolytica
INTRLLYKFRSIEQLQNYLNGM

SEQ ID NO: 2715714 - protein, 24 aa, Entamoeba histolytica
INTVEDKWRLIPAFVKARGLVRQH

SEQ ID NO: 2715715 - protein, 18 aa, Entamoeba histolytica
INTVLKEFKFPISDCGKL

SEQ ID NO: 2715716 - protein, 24 aa, Entamoeba histolytica
INVGMYGFKFKLAFSEAYKIKVRS

SEQ ID NO: 2715717 - protein, 18 aa, Entamoeba histolytica
INVIYIEDAVYPIIPINI

SEQ ID NO: 2715718 - protein, 25 aa, Entamoeba histolytica
INVNTVDLLLQKKKYRLAYDCLSFI

SEQ ID NO: 2715719 - protein, 18 aa, Entamoeba histolytica
INVRPLYRKLITQAPTTT

SEQ ID NO: 2715720 - protein, 21 aa, Entamoeba histolytica
INVSKKLLLSSKLKKKEFLSA

SEQ ID NO: 2715721 - protein, 19 aa, Entamoeba histolytica
INVVAIETFFRVKNTNEMI

SEQ ID NO: 2715722 - protein, 18 aa, Entamoeba histolytica
INYIETGLLCEETRFSRG

SEQ ID NO: 2715723 - protein, 19 aa, Entamoeba histolytica
INYSIISPLYYKIRACIGL

SEQ ID NO: 2715724 - protein, 17 aa, Entamoeba histolytica
IPAFRSTEIPAIGLEIV

SEQ ID NO: 2715725 - protein, 18 aa, Entamoeba histolytica
IPAIAINVYYKKFVQPRK

SEQ ID NO: 2715726 - protein, 18 aa, Entamoeba histolytica
IPATTIYYLCQQIRTILL

SEQ ID NO: 2715727 - protein, 22 aa, Entamoeba histolytica
IPCARRCCFACVLTGAPSLLEP

SEQ ID NO: 2715728 - protein, 25 aa, Entamoeba histolytica
IPDDEAIYRILPAPSVSPGTAYADN

SEQ ID NO: 2715729 - protein, 31 aa, Entamoeba histolytica
IPDEYNHLFVYLITFLKKLICLGENELLLIS

SEQ ID NO: 2715730 - protein, 25 aa, Entamoeba histolytica
IPDQARGIFIDWKGPKCKGIAKVRV

SEQ ID NO: 2715731 - protein, 27 aa, Entamoeba histolytica
IPDVNKNTLWYLCYFCQEVVKNVEKTQ

SEQ ID NO: 2715732 - protein, 22 aa, Entamoeba histolytica
IPEIDEPWYLKFNNSAIYSDNT

SEQ ID NO: 2715733 - protein, 24 aa, Entamoeba histolytica
IPEIDNPWYLKFNNSAIYDDNTED

SEQ ID NO: 2715734 - protein, 20 aa, Entamoeba histolytica
IPELKEVIPLLKTLGEGQQG

SEQ ID NO: 2715735 - protein, 32 aa, Entamoeba histolytica
IPENLALHLFRFRHYYLHHYFNTIGFFVLKST

SEQ ID NO: 2715736 - protein, 29 aa, Entamoeba histolytica
IPENQNGRFFPFIMYGAKATLPTGAGDIT

SEQ ID NO: 2715737 - protein, 25 aa, Entamoeba histolytica
IPERGLLFDILWSDPFIPQTSTTDN

SEQ ID NO: 2715738 - protein, 19 aa, Entamoeba histolytica
IPERYDADLILKHFKRTFN

SEQ ID NO: 2715739 - protein, 29 aa, Entamoeba histolytica
IPETLFMKLNYLIDAPLISLLSTLLLHHI

SEQ ID NO: 2715740 - protein, 23 aa, Entamoeba histolytica
IPETLRLEIWKLFLQPKKEIVEE

SEQ ID NO: 2715741 - protein, 18 aa, Entamoeba histolytica
IPETYIKDLLRLGAEMLP

SEQ ID NO: 2715742 - protein, 30 aa, Entamoeba histolytica
IPEVRQFFDIPFVVQLYYAATPMQLPVVEI

SEQ ID NO: 2715743 - protein, 18 aa, Entamoeba histolytica
IPFAKSDAIWKIVTEVIN

SEQ ID NO: 2715744 - protein, 20 aa, Entamoeba histolytica
IPFGWFDFESSFSTSTLGLP

SEQ ID NO: 2715745 - protein, 20 aa, Entamoeba histolytica
IPFLTRCCINLVTALQYLSS

SEQ ID NO: 2715746 - protein, 24 aa, Entamoeba histolytica
IPFQPQAILPQLLNFLPIISDHEE

SEQ ID NO: 2715747 - protein, 33 aa, Entamoeba histolytica
IPGAIPPGIPMYPPMGMIPPIGPPPQMNPIIPQ

SEQ ID NO: 2715748 - protein, 19 aa, Entamoeba histolytica
IPGILFNGKRGYYILNPTH

SEQ ID NO: 2715749 - protein, 22 aa, Entamoeba histolytica
IPHLQNLLKDFLLHQNEDYLQN

SEQ ID NO: 2715750 - protein, 19 aa, Entamoeba histolytica
IPHYTSILNLLKMPQTIFN

SEQ ID NO: 2715751 - protein, 29 aa, Entamoeba histolytica
IPIDDIIPLFYIFYQNITGILPWDTISNP

SEQ ID NO: 2715752 - protein, 27 aa, Entamoeba histolytica
IPIDPLTFKELYLINLSLPKRGSLFLR

SEQ ID NO: 2715753 - protein, 20 aa, Entamoeba histolytica
IPIDVFLEDTNNYQPKGNAY

SEQ ID NO: 2715754 - protein, 20 aa, Entamoeba histolytica
IPIERACYYLKRVNPEGPML

SEQ ID NO: 2715755 - protein, 23 aa, Entamoeba histolytica
IPIGKWPALLNQVLQWTQSQNEI

SEQ ID NO: 2715756 - protein, 18 aa, Entamoeba histolytica
IPIHVFGTNKGSTNYKRF

SEQ ID NO: 2715757 - protein, 36 aa, Entamoeba histolytica
IPIKFVKREINSYSTWLFPDDSENILCFAGAFLISG

SEQ ID NO: 2715758 - protein, 29 aa, Entamoeba histolytica
IPINNPHLLCVFPVPIILEKDEYYVIYHN

SEQ ID NO: 2715759 - protein, 17 aa, Entamoeba histolytica
IPISISVIPINCFCGCT

SEQ ID NO: 2715760 - protein, 18 aa, Entamoeba histolytica
IPITDENIYIVILLHLLN

SEQ ID NO: 2715761 - protein, 24 aa, Entamoeba histolytica
IPITPGYFMFELTSGVGMIQLRFR

SEQ ID NO: 2715762 - protein, 19 aa, Entamoeba histolytica
IPIYNMIYDWVLQGTFNDP

SEQ ID NO: 2715763 - protein, 18 aa, Entamoeba histolytica
IPKDFVFEDLEGFKIPID

SEQ ID NO: 2715764 - protein, 21 aa, Entamoeba histolytica
IPKELTIKDQQKYWNNFKHND

SEQ ID NO: 2715765 - protein, 17 aa, Entamoeba histolytica
IPKILPLVTNIVPIIHS

SEQ ID NO: 2715766 - protein, 17 aa, Entamoeba histolytica
IPKIVEYVIEFMELGCG

SEQ ID NO: 2715767 - protein, 23 aa, Entamoeba histolytica
IPKVLIIQLVRIYSKKYPIQQVL

SEQ ID NO: 2715768 - protein, 24 aa, Entamoeba histolytica
IPKYQDYSLLAKQLSQPTFEEDTK

SEQ ID NO: 2715769 - protein, 17 aa, Entamoeba histolytica
IPLFALTRDNTNYFAAG

SEQ ID NO: 2715770 - protein, 23 aa, Entamoeba histolytica
IPLKINQQPILLKRIEFVRNLHE

SEQ ID NO: 2715771 - protein, 18 aa, Entamoeba histolytica
IPLLPTSFDFIQLYNQII

SEQ ID NO: 2715772 - protein, 25 aa, Entamoeba histolytica
IPMDLRVPYPFPKLQEFYNSIDIPT

SEQ ID NO: 2715773 - protein, 39 aa, Entamoeba histolytica
IPMEMRGRCSMGQKALASVIIRIALAKTFCSKCSVLALD

SEQ ID NO: 2715774 - protein, 17 aa, Entamoeba histolytica
IPMFFVDSCPCKGMDNS

SEQ ID NO: 2715775 - protein, 28 aa, Entamoeba histolytica
IPMLVDGSFFFWMAYCPIKPKSEKLSQI

SEQ ID NO: 2715776 - protein, 17 aa, Entamoeba histolytica
IPNCLGNIWVYVRDWSE

SEQ ID NO: 2715777 - protein, 30 aa, Entamoeba histolytica
IPNEIINEKLILKVLIKGEESEKWVECGID

SEQ ID NO: 2715778 - protein, 25 aa, Entamoeba histolytica
IPNLSDITLYPIYIKSLDDQDQEFM

SEQ ID NO: 2715779 - protein, 22 aa, Entamoeba histolytica
IPPHMFIDINALTAAFYFSAIA

SEQ ID NO: 2715780 - protein, 36 aa, Entamoeba histolytica
IPPMNSSIYTFIRSLVLQPIVLYFSCSLQPSHLVLI

SEQ ID NO: 2715781 - protein, 23 aa, Entamoeba histolytica
IPPNKRWGALLPVGLIPPEITTP

SEQ ID NO: 2715782 - protein, 17 aa, Entamoeba histolytica
IPPPPPPARGTGCGAPP

SEQ ID NO: 2715783 - protein, 27 aa, Entamoeba histolytica
IPPSILNPPIITKPFQNFLPSNVPVQP

SEQ ID NO: 2715784 - protein, 27 aa, Entamoeba histolytica
IPPSKPSNLLLLINKLLFAPTIGKCVA

SEQ ID NO: 2715785 - protein, 19 aa, Entamoeba histolytica
IPQHSVPFAWTNPDGRRLL

SEQ ID NO: 2715786 - protein, 36 aa, Entamoeba histolytica; identical to SEQ ID NO: 2527942

SEQ ID NO: 2715787 - protein, 17 aa, Entamoeba histolytica
IPRARAYFISNGILDVF

SEQ ID NO: 2715788 - protein, 26 aa, Entamoeba histolytica
IPREQKYYIFIAPLTQLNIDEYNFIG

SEQ ID NO: 2715789 - protein, 29 aa, Entamoeba histolytica
IPRETNHHLLFFPKEKDSLFYILGCWDIK

SEQ ID NO: 2715790 - protein, 17 aa, Entamoeba histolytica
IPRLIPTSAIDSSKLLV

SEQ ID NO: 2715791 - protein, 17 aa, Entamoeba histolytica
IPRSSFLKLKNLFENGG

SEQ ID NO: 2715792 - protein, 32 aa, Entamoeba histolytica
IPSESKFFIKIERILLVKLFTKEIKLNKLIEG

SEQ ID NO: 2715793 - protein, 23 aa, Entamoeba histolytica
IPSIDFMLNGYKPIIEINNKEIT

SEQ ID NO: 2715794 - protein, 23 aa, Entamoeba histolytica
IPSIFGLMILFDTNGFPLCLLDG

SEQ ID NO: 2715795 - protein, 30 aa, Entamoeba histolytica
IPSIGIYAYELFNFYGVKRIIRIGSAGAIS

SEQ ID NO: 2715796 - protein, 23 aa, Entamoeba histolytica
IPSIQISLFLQPECPWKQLKKLA

SEQ ID NO: 2715797 - protein, 30 aa, Entamoeba histolytica
IPSNIAVKALWITIGFFRLGKDYQSCISED

SEQ ID NO: 2715798 - protein, 24 aa, Entamoeba histolytica
IPSNIDFGFRPKFGKIHLVNGKIV

SEQ ID NO: 2715799 - protein, 22 aa, Entamoeba histolytica
IPSQKPYTVGFPEIDEIKKNKK

SEQ ID NO: 2715800 - protein, 17 aa, Entamoeba histolytica
IPTFEEVFLSLEPDILS

SEQ ID NO: 2715801 - protein, 20 aa, Entamoeba histolytica
IPTFYLMDYSSTYNSYLLFI

SEQ ID NO: 2715802 - protein, 17 aa, Entamoeba histolytica
IPTIPTSTPILPKTTVN

SEQ ID NO: 2715803 - protein, 23 aa, Entamoeba histolytica
IPTNPLLRYSSQLPFRTPLTLQK

SEQ ID NO: 2715804 - protein, 27 aa, Entamoeba histolytica
IPTTGDLHWFKVPPKVFFEPFSIRYLA

SEQ ID NO: 2715805 - protein, 17 aa, Entamoeba histolytica
IPVFGFGDSKTGDRSVF

SEQ ID NO: 2715806 - protein, 34 aa, Entamoeba histolytica
IPVLTRPVSFTLVRQYRSFITNSKIIHIVWRKRR

SEQ ID NO: 2715807 - protein, 18 aa, Entamoeba histolytica
IPVYSFWINDMNGFEISS

SEQ ID NO: 2715808 - protein, 27 aa, Entamoeba histolytica
IPYGQLRAFPWNSLALMTTTGAKGSKV

SEQ ID NO: 2715809 - protein, 25 aa, Entamoeba histolytica
IPYLAEAMNIPLINYQFESNSSICI

SEQ ID NO: 2715810 - protein, 24 aa, Entamoeba histolytica
IPYPKSFPETFFIKLQISTAVRDF

SEQ ID NO: 2715811 - protein, 24 aa, Entamoeba histolytica
IPYRYTNYIQPISSALLFTKMIVE

SEQ ID NO: 2715812 - protein, 20 aa, Entamoeba histolytica
IQAIQLCLKKDFDGALIEIK

SEQ ID NO: 2715813 - protein, 24 aa, Entamoeba histolytica
IQAKLAMVPVRRGYWGATIGEVHT

SEQ ID NO: 2715814 - protein, 18 aa, Entamoeba histolytica
IQARKLLLKSPATTESQM

SEQ ID NO: 2715815 - protein, 24 aa, Entamoeba histolytica
IQDEDLLRKIRRKVQNKWSSKEYR

SEQ ID NO: 2715816 - protein, 23 aa, Entamoeba histolytica
IQDIIHPNTYFLRAKRLVNEQNR

SEQ ID NO: 2715817 - protein, 20 aa, Entamoeba histolytica
IQDRTFWIARLKDLIHSALL

SEQ ID NO: 2715818 - protein, 23 aa, Entamoeba histolytica
IQDTPLIINVLSQFGVIVNVIEW

SEQ ID NO: 2715819 - protein, 29 aa, Entamoeba histolytica
IQEGAIDILIKIYLKFLPENGYITENGTI

SEQ ID NO: 2715820 - protein, 24 aa, Entamoeba histolytica
IQEMFEFRIQNFLDIYLHESSQST

SEQ ID NO: 2715821 - protein, 25 aa, Entamoeba histolytica
IQFFNGIIVIAFKKEIYRISLTDFM

SEQ ID NO: 2715822 - protein, 19 aa, Entamoeba histolytica
IQFPSLLRSIGIDAFSYCS

SEQ ID NO: 2715823 - protein, 27 aa, Entamoeba histolytica
IQFQTNFIWYPERFSSYGLFPNTENLI

SEQ ID NO: 2715824 - protein, 20 aa, Entamoeba histolytica
IQFSNLYSFLRNEPKTPRLT

SEQ ID NO: 2715825 - protein, 19 aa, Entamoeba histolytica
IQGALFIPGFVVSVGDDGL

SEQ ID NO: 2715826 - protein, 24 aa, Entamoeba histolytica
IQGDMGDYLPFRPGSFDGCISISA

SEQ ID NO: 2715827 - protein, 19 aa, Entamoeba histolytica
IQGYNKYRNSWSKIANLLK

SEQ ID NO: 2715828 - protein, 23 aa, Entamoeba histolytica
IQHIQKPFLITQPLIRTSTPSES

SEQ ID NO: 2715829 - protein, 31 aa, Entamoeba histolytica
IQHQRANALKWIIQLLLHECPITEKIKIVDF

SEQ ID NO: 2715830 - protein, 30 aa, Entamoeba histolytica
IQHQRANALKWVVDLIIHSPSLLRVNKHQY

SEQ ID NO: 2715831 - protein, 19 aa, Entamoeba histolytica
IQIEDDILFIIPDHKLKSN

SEQ ID NO: 2715832 - protein, 28 aa, Entamoeba histolytica
IQINLNSMIYLSLNKYFTQLFKSINNAI

SEQ ID NO: 2715833 - protein, 19 aa, Entamoeba histolytica
IQIWDYRTKILLHTYPHAH

SEQ ID NO: 2715834 - protein, 23 aa, Entamoeba histolytica
IQKCIDIGYTKLRVPKLVKAENI

SEQ ID NO: 2715835 - protein, 29 aa, Entamoeba histolytica
IQKCLEIKPDFTKGIIRLATIYEELKQPQ

SEQ ID NO: 2715836 - protein, 22 aa, Entamoeba histolytica
IQKETLKLATPFGLRVCCCIGG

SEQ ID NO: 2715837 - protein, 26 aa, Entamoeba histolytica
IQKGLFCLMHILLQYHDPQLCHCLDS

SEQ ID NO: 2715838 - protein, 28 aa, Entamoeba histolytica
IQKHQLRALLYFIPIEQREILYSLFEFL

SEQ ID NO: 2715839 - protein, 33 aa, Entamoeba histolytica
IQKNYLLHYNTLPIIPITPPLISEYPFGTLFIK

SEQ ID NO: 2715840 - protein, 21 aa, Entamoeba histolytica
IQKQILITALPIFDFLSKHGK

SEQ ID NO: 2715841 - protein, 34 aa, Entamoeba histolytica; identical to SEQ ID NO: 2528020

SEQ ID NO: 2715842 - protein, 19 aa, Entamoeba histolytica
IQKVISLAPGLFKIYDEIL

SEQ ID NO: 2715843 - protein, 18 aa, Entamoeba histolytica
IQKVYPSINLLLNQKRFI

SEQ ID NO: 2715844 - protein, 34 aa, Entamoeba histolytica; identical to SEQ ID NO: 2528021

SEQ ID NO: 2715845 - protein, 17 aa, Entamoeba histolytica
IQKYFEKCGNINLMEFN

SEQ ID NO: 2715846 - protein, 23 aa, Entamoeba histolytica
IQKYNEIFKFLWKIKCMSISIDK

SEQ ID NO: 2715847 - protein, 18 aa, Entamoeba histolytica
IQLIGYYVKDKDCLHCDS

SEQ ID NO: 2715848 - protein, 17 aa, Entamoeba histolytica
IQLLFHRIDESTGKYQN

SEQ ID NO: 2715849 - protein, 20 aa, Entamoeba histolytica
IQLLFSPKRYFDYTEPMVQI

SEQ ID NO: 2715850 - protein, 27 aa, Entamoeba histolytica
IQLLRIMTGCILLYDTVVPTGAFSTKG

SEQ ID NO: 2715851 - protein, 17 aa, Entamoeba histolytica
IQLLYSKKQYHLQLQFI

SEQ ID NO: 2715852 - protein, 22 aa, Entamoeba histolytica
IQLREMERGIWTAAEQLVHKAM

SEQ ID NO: 2715853 - protein, 21 aa, Entamoeba histolytica
IQLRKVCNHPFLIPGVEEKEI

SEQ ID NO: 2715854 - protein, 21 aa, Entamoeba histolytica
IQLSFSLPINILRYVQPLNQS

SEQ ID NO: 2715855 - protein, 20 aa, Entamoeba histolytica
IQLTFHSIFSHRFYEFNHSQ

SEQ ID NO: 2715856 - protein, 33 aa, Entamoeba histolytica
IQLTLKQIQIPPLKWINPITGTGKITIKYTSFT

SEQ ID NO: 2715857 - protein, 18 aa, Entamoeba histolytica
IQMALPHLISLTHFLAQC

SEQ ID NO: 2715858 - protein, 18 aa, Entamoeba histolytica
IQMFSFINSVLITPKYTE

SEQ ID NO: 2715859 - protein, 21 aa, Entamoeba histolytica
IQMKIELVHLDKFPTPFTMDG

SEQ ID NO: 2715860 - protein, 28 aa, Entamoeba histolytica
IQNENDLIRLFYIYLLNSNESNVLQKVL

SEQ ID NO: 2715861 - protein, 36 aa, Entamoeba histolytica
IQNEYPLFRDITIPILFGLYLLKTGIRIELFKKILK

SEQ ID NO: 2715862 - protein, 18 aa, Entamoeba histolytica
IQNIIIIKQFYGIEDIQE

SEQ ID NO: 2715863 - protein, 25 aa, Entamoeba histolytica
IQNNQIIFLYTLLDGACPKSYGMKV

SEQ ID NO: 2715864 - protein, 24 aa, Entamoeba histolytica
IQNTESFVYLFNFYKTNINHIGYD

SEQ ID NO: 2715865 - protein, 17 aa, Entamoeba histolytica
IQNTLIAVKPKIMENID

SEQ ID NO: 2715866 - protein, 25 aa, Entamoeba histolytica
IQPERAFVFKFLMNEINFHLNDKQG

SEQ ID NO: 2715867 - protein, 19 aa, Entamoeba histolytica
IQPFQWEGVVLPYIPSHLY

SEQ ID NO: 2715868 - protein, 28 aa, Entamoeba histolytica
IQPIQRIPRYVLLLESLLKCLPEYLDET

SEQ ID NO: 2715869 - protein, 33 aa, Entamoeba histolytica
IQPKQSQICIPENPIPVIEVKPVPTTTYNVIAD

SEQ ID NO: 2715870 - protein, 28 aa, Entamoeba histolytica
IQPPKKKTLQILPLTPIKPLKDTQRRNK

SEQ ID NO: 2715871 - protein, 22 aa, Entamoeba histolytica
IQPSAFYYLIHLEKINLNSVRK

SEQ ID NO: 2715872 - protein, 24 aa, Entamoeba histolytica
IQQAEIILRLFLLDSVDSEHPSET

SEQ ID NO: 2715873 - protein, 17 aa, Entamoeba histolytica
IQQEELPWPNYIQTLFS

SEQ ID NO: 2715874 - protein, 26 aa, Entamoeba histolytica
IQQEGKIKARWLRKNARRIDMENYTK

SEQ ID NO: 2715875 - protein, 26 aa, Entamoeba histolytica
IQQEGKIKARWLRKNARRLDIEHYTR

SEQ ID NO: 2715876 - protein, 27 aa, Entamoeba histolytica
IQQFLSSPKYHLLLENSYETHFIDIYL

SEQ ID NO: 2715877 - protein, 17 aa, Entamoeba histolytica
IQQKIVPQPIKKPYSKS

SEQ ID NO: 2715878 - protein, 25 aa, Entamoeba histolytica
IQQKSMKYLLLPQQLHTLKLEDASD

SEQ ID NO: 2715879 - protein, 23 aa, Entamoeba histolytica
IQQQPNVFFDYLEDFFLYPDDPT

SEQ ID NO: 2715880 - protein, 28 aa, Entamoeba histolytica
IQQRYGIDFDLVFKIVKEFRVNKKKVGR

SEQ ID NO: 2715881 - protein, 34 aa, Entamoeba histolytica
IQQYLITPIQRIPRYVLLISDLLRNISMVFGDAP

SEQ ID NO: 2715882 - protein, 27 aa, Entamoeba histolytica
IQRAEFHSFDWPLVPPEFLKTLGNIFT

SEQ ID NO: 2715883 - protein, 17 aa, Entamoeba histolytica
IQRMKESLYEDGKKPRL

SEQ ID NO: 2715884 - protein, 32 aa, Entamoeba histolytica
IQRNLISPYILTFVGLTEFPYAAITELAPYGD

SEQ ID NO: 2715885 - protein, 26 aa, Entamoeba histolytica
IQRQINEFLPKKLKFIKTETINPTAK

SEQ ID NO: 2715886 - protein, 22 aa, Entamoeba histolytica
IQRQNYFMTYASKKLFIPQFVP

SEQ ID NO: 2715887 - protein, 24 aa, Entamoeba histolytica
IQSCGKMILLDKLLVKLKETGHRV

SEQ ID NO: 2715888 - protein, 23 aa, Entamoeba histolytica
IQSDIGLQYIPEPLPRTTQSNTQ

SEQ ID NO: 2715889 - protein, 27 aa, Entamoeba histolytica
IQSEIQIMTLLIGLYPLICSGFEESKN

SEQ ID NO: 2715890 - protein, 28 aa, Entamoeba histolytica
IQSKEYGPLIIFLLSDVLLVHRAKQEVK

SEQ ID NO: 2715891 - protein, 34 aa, Entamoeba histolytica
IQSNHLLYRIKYYVPYYYYLENKKNWIQCDNVMY

SEQ ID NO: 2715892 - protein, 21 aa, Entamoeba histolytica
IQSQSFIFVKGVPLNFERYSQ

SEQ ID NO: 2715893 - protein, 41 aa, Entamoeba histolytica
IQSQVFKKYISLKKYMKCLDPLLEFCRLLTMPMSLEIVQMK

SEQ ID NO: 2715894 - protein, 26 aa, Entamoeba histolytica
IQSSTTMFLIHIPTIIQDLVYQQVIY

SEQ ID NO: 2715895 - protein, 28 aa, Entamoeba histolytica
IQSTLHSPYPIFYSHIVQSILCALKVTP

SEQ ID NO: 2715896 - protein, 20 aa, Entamoeba histolytica
IQTFFVIEVLQEKFSENKVE

SEQ ID NO: 2715897 - protein, 17 aa, Entamoeba histolytica
IQTFIPPIQLNALSRLS

SEQ ID NO: 2715898 - protein, 21 aa, Entamoeba histolytica
IQTRLFRPLITIPSSKKNSFV

SEQ ID NO: 2715899 - protein, 27 aa, Entamoeba histolytica
IQTTKKYMFILDRFRINPIRITSFVKN

SEQ ID NO: 2715900 - protein, 17 aa, Entamoeba histolytica
IQVIKSSSPPTIVFVNQ

SEQ ID NO: 2715901 - protein, 17 aa, Entamoeba histolytica
IQVINNINKIYPIVKGI

SEQ ID NO: 2715902 - protein, 28 aa, Entamoeba histolytica
IQWNEGLIDVMLLRLDMFPDEKDTIIAT

SEQ ID NO: 2715903 - protein, 20 aa, Entamoeba histolytica
IQYKLYMYLYEQYSPSYKVQ

SEQ ID NO: 2715904 - protein, 17 aa, Entamoeba histolytica
IQYMALDIAKPPPPEEF

SEQ ID NO: 2715905 - protein, 24 aa, Entamoeba histolytica
IQYMTDGMLLRGFLNQPDLSDYSC

SEQ ID NO: 2715906 - protein, 19 aa, Entamoeba histolytica
IRARVISAVKYWIENIWGV

SEQ ID NO: 2715907 - protein, 24 aa, Entamoeba histolytica
IRASIVFSEYQKICKLQLVNERSD

SEQ ID NO: 2715908 - protein, 18 aa, Entamoeba histolytica
IRCLGWCGVPDDFNSRFS

SEQ ID NO: 2715909 - protein, 18 aa, Entamoeba histolytica
IRCYCNILMRALYSEVKE

SEQ ID NO: 2715910 - protein, 18 aa, Entamoeba histolytica
IRDIFRKPLLIEVINENK

SEQ ID NO: 2715911 - protein, 18 aa, Entamoeba histolytica
IRDIIVHPTLPYILTCSD

SEQ ID NO: 2715912 - protein, 22 aa, Entamoeba histolytica
IRDLEFMIGPMLYEASWQELAK

SEQ ID NO: 2715913 - protein, 24 aa, Entamoeba histolytica
IRDLVKVIPLERILVETDGPFMAP

SEQ ID NO: 2715914 - protein, 25 aa, Entamoeba histolytica
IRDSYFLIYLYYDQGCKNLQYILNK

SEQ ID NO: 2715915 - protein, 18 aa, Entamoeba histolytica
IRDYIPVLIISYEQVRSH

SEQ ID NO: 2715916 - protein, 25 aa, Entamoeba histolytica
IREDDVIFCYIGDSPIYIKSNEQVK

SEQ ID NO: 2715917 - protein, 23 aa, Entamoeba histolytica
IREFAWLLCIGYYNYRSTTKERN

SEQ ID NO: 2715918 - protein, 24 aa, Entamoeba histolytica
IREFGGNVYLFTKSIERAHTPAKL

SEQ ID NO: 2715919 - protein, 26 aa, Entamoeba histolytica
IREKDGIWAALCWVSILAAESERAQR

SEQ ID NO: 2715920 - protein, 27 aa, Entamoeba histolytica
IREKNPDAFVPWIPNNMQLAVCDIPPK

SEQ ID NO: 2715921 - protein, 24 aa, Entamoeba histolytica
IREKRVLYRTLIEPKFKDIKNASL

SEQ ID NO: 2715922 - protein, 19 aa, Entamoeba histolytica
IREMLRMSKPIRLMLVLEA

SEQ ID NO: 2715923 - protein, 17 aa, Entamoeba histolytica
IRFIWDLADPMALPIKG

SEQ ID NO: 2715924 - protein, 21 aa, Entamoeba histolytica
IRFPKTYPVIYKTLRVDGELT

SEQ ID NO: 2715925 - protein, 21 aa, Entamoeba histolytica
IRFSAIIRFIGHLNLRGFVPS

SEQ ID NO: 2715926 - protein, 17 aa, Entamoeba histolytica
IRGEICATLPVLCEGGI

SEQ ID NO: 2715927 - protein, 29 aa, Entamoeba histolytica
IRGQMQRKVWINVNDVILVSLREYEDGKA

SEQ ID NO: 2715928 - protein, 20 aa, Entamoeba histolytica
IRGWYDEIFKAEPDVVCMLV

SEQ ID NO: 2715929 - protein, 26 aa, Entamoeba histolytica
IRHNIVPAVFGLRWIRMLYAREFHID

SEQ ID NO: 2715930 - protein, 29 aa, Entamoeba histolytica
IRHRNVAKLIYIQLLGYPTQYGQMECLAL

SEQ ID NO: 2715931 - protein, 33 aa, Entamoeba histolytica
IRIAHGFHDLFIRTIKKLKITPISGGFIFMYDV

SEQ ID NO: 2715932 - protein, 18 aa, Entamoeba histolytica
IRIKKYGKHTLPLIEFHG

SEQ ID NO: 2715933 - protein, 18 aa, Entamoeba histolytica
IRILKLEYDGFVFTKELL

SEQ ID NO: 2715934 - protein, 18 aa, Entamoeba histolytica
IRILTYNMYLRPMLISAA

SEQ ID NO: 2715935 - protein, 19 aa, Entamoeba histolytica
IRILTYNMYLRPMLISAAG

SEQ ID NO: 2715936 - protein, 17 aa, Entamoeba histolytica
IRIMAIKALTDISDLKL

SEQ ID NO: 2715937 - protein, 20 aa, Entamoeba histolytica
IRIMASLCLLELIQKFDIGV

SEQ ID NO: 2715938 - protein, 20 aa, Entamoeba histolytica
IRIMREREDLIYITDVAPTS

SEQ ID NO: 2715939 - protein, 17 aa, Entamoeba histolytica
IRIPTRKASLNMSQKYS

SEQ ID NO: 2715940 - protein, 18 aa, Entamoeba histolytica
IRIRLEKNLYEKLIAIKE

SEQ ID NO: 2715941 - protein, 27 aa, Entamoeba histolytica
IRISPFNFSKLKLFNPFIPDFLVDIYQ

SEQ ID NO: 2715942 - protein, 17 aa, Entamoeba histolytica
IRISRCKILVDNRKYKT

SEQ ID NO: 2715943 - protein, 28 aa, Entamoeba histolytica
IRKFFNTLNFPIWPKELLPSLLNCTKEN

SEQ ID NO: 2715944 - protein, 25 aa, Entamoeba histolytica
IRKSPDLLIWAVYNLVRGVDYLHTK

SEQ ID NO: 2715945 - protein, 18 aa, Entamoeba histolytica
IRLIKKGIKIALSLKDEE

SEQ ID NO: 2715946 - protein, 20 aa, Entamoeba histolytica
IRLKIPICVSPKKSFDLGSI

SEQ ID NO: 2715947 - protein, 19 aa, Entamoeba histolytica
IRLKLNCIVFRPVINTYLI

SEQ ID NO: 2715948 - protein, 28 aa, Entamoeba histolytica
IRLREKLTYSHTFGIYVDLQLIKSRPTT

SEQ ID NO: 2715949 - protein, 19 aa, Entamoeba histolytica
IRLRLCPHIPLDDIKTFLY

SEQ ID NO: 2715950 - protein, 27 aa, Entamoeba histolytica
IRMETLTYLPILLPELEIQTVKEIIVN

SEQ ID NO: 2715951 - protein, 26 aa, Entamoeba histolytica
IRMMKQTPIFYPKDRFGLIFYGSQNS

SEQ ID NO: 2715952 - protein, 26 aa, Entamoeba histolytica
IRMNGQTRYFIPISALNDLGTNTITP

SEQ ID NO: 2715953 - protein, 31 aa, Entamoeba histolytica
IRMSSNQVMLLIPKLLRAQKINKILFNNLSS

SEQ ID NO: 2715954 - protein, 25 aa, Entamoeba histolytica
IRNDYAITLHYLFTATEPFIQNPQM

SEQ ID NO: 2715955 - protein, 28 aa, Entamoeba histolytica
IRNIAMLYSYLFYSNAIPWELFSIIKLT

SEQ ID NO: 2715956 - protein, 24 aa, Entamoeba histolytica
IRNSGSIEWVVYHVNFKNGDLIED

SEQ ID NO: 2715957 - protein, 19 aa, Entamoeba histolytica
IRNWILEGLLGHYSSHEKY

SEQ ID NO: 2715958 - protein, 27 aa, Entamoeba histolytica
IRPNLDKFILLLLNRIELPIIKQEGDQ

SEQ ID NO: 2715959 - protein, 18 aa, Entamoeba histolytica
IRPNRKTGRQAPTKNLLE

SEQ ID NO: 2715960 - protein, 24 aa, Entamoeba histolytica
IRPSNVIITKLFLNKDREAYLAKK

SEQ ID NO: 2715961 - protein, 17 aa, Entamoeba histolytica
IRQLKLTDFKKEKLYYI

SEQ ID NO: 2715962 - protein, 26 aa, Entamoeba histolytica
IRQTNSFLIVYSIVDEKTFETAKKYV

SEQ ID NO: 2715963 - protein, 18 aa, Entamoeba histolytica
IRRCERISLFLDESGIGL

SEQ ID NO: 2715964 - protein, 21 aa, Entamoeba histolytica
IRRDVFDLPLKRKEPILNAED

SEQ ID NO: 2715965 - protein, 24 aa, Entamoeba histolytica
IRRERMYEQSLYGNRGRFDGRRGL

SEQ ID NO: 2715966 - protein, 24 aa, Entamoeba histolytica
IRRKKKIHVSDELEYLLMENQIYS

SEQ ID NO: 2715967 - protein, 22 aa, Entamoeba histolytica
IRRNINEFIIPTSVTKLTDECF

SEQ ID NO: 2715968 - protein, 21 aa, Entamoeba histolytica
IRRNINEFIIPTTITKLTDEC

SEQ ID NO: 2715969 - protein, 22 aa, Entamoeba histolytica
IRRNINEFIIPTTITKLTDECF

SEQ ID NO: 2715970 - protein, 27 aa, Entamoeba histolytica
IRRSFRGKWPISYIKKILVFSTDEECA

SEQ ID NO: 2715971 - protein, 20 aa, Entamoeba histolytica
IRSHAQKYFLKLQKMQQQNP

SEQ ID NO: 2715972 - protein, 23 aa, Entamoeba histolytica
IRSKNLFIPVFCGKYSIKREIEK

SEQ ID NO: 2715973 - protein, 22 aa, Entamoeba histolytica
IRSLTEIHILYGTKAMFMNPFI

SEQ ID NO: 2715974 - protein, 17 aa, Entamoeba histolytica
IRSLTYIHSLGICHRDI

SEQ ID NO: 2715975 - protein, 17 aa, Entamoeba histolytica
IRSVLFPDHTRPVSVIP

SEQ ID NO: 2715976 - protein, 24 aa, Entamoeba histolytica
IRTAALVDDSLWIGTFAGLHIYDP

SEQ ID NO: 2715977 - protein, 19 aa, Entamoeba histolytica
IRTEATMLLCLISNKKKGS

SEQ ID NO: 2715978 - protein, 27 aa, Entamoeba histolytica
IRTVGLINLSILFIPALNESSIEIYLN

SEQ ID NO: 2715979 - protein, 17 aa, Entamoeba histolytica
IRTVRPVLMLFDAIIVD

SEQ ID NO: 2715980 - protein, 19 aa, Entamoeba histolytica
IRVCEDLVFPTIIPFYDYF

SEQ ID NO: 2715981 - protein, 29 aa, Entamoeba histolytica
IRVGSTFDLKRLCRVTGATPFISLTTECD

SEQ ID NO: 2715982 - protein, 17 aa, Entamoeba histolytica
IRVIAQEPSLLQLKAPI

SEQ ID NO: 2715983 - protein, 22 aa, Entamoeba histolytica
IRVINFFELLSGKTLKEKYDLR

SEQ ID NO: 2715984 - protein, 17 aa, Entamoeba histolytica
IRYQSNLVFIIITNNEQ

SEQ ID NO: 2715985 - protein, 27 aa, Entamoeba histolytica
ISADEQYWIFQLVAAILHLGNVYFTEN

SEQ ID NO: 2715986 - protein, 25 aa, Entamoeba histolytica
ISADGRFFVCYLSKSFELQVYYLRD

SEQ ID NO: 2715987 - protein, 27 aa, Entamoeba histolytica
ISAEVPLGFDNYVLWVKGEDADLKVLL

SEQ ID NO: 2715988 - protein, 29 aa, Entamoeba histolytica
ISAFTICNNNIWLAMPMFNQIGIVSFNYQ

SEQ ID NO: 2715989 - protein, 21 aa, Entamoeba histolytica
ISALQFIIKILPLNDIEILYN

SEQ ID NO: 2715990 - protein, 32 aa, Entamoeba histolytica
ISATCYPLEIDLWLAYSEYATMGLKLQVAEGV

SEQ ID NO: 2715991 - protein, 17 aa, Entamoeba histolytica
ISCDYLTPLQLLPDEYT

SEQ ID NO: 2715992 - protein, 20 aa, Entamoeba histolytica
ISCHFKVFNTFFSAKIHSIC

SEQ ID NO: 2715993 - protein, 19 aa, Entamoeba histolytica
ISCYCYGKLIPKYSKSLSL

SEQ ID NO: 2715994 - protein, 24 aa, Entamoeba histolytica
ISDAKYLEMLSFPPNLTSLILHGC

SEQ ID NO: 2715995 - protein, 17 aa, Entamoeba histolytica
ISDKKYWLDVESRMSWI

SEQ ID NO: 2715996 - protein, 21 aa, Entamoeba histolytica
ISDLIDYFRGIDDLKYLCSDF

SEQ ID NO: 2715997 - protein, 32 aa, Entamoeba histolytica
ISDLLITPVQRLPRYQLLLKDLLKHTQQSHID

SEQ ID NO: 2715998 - protein, 39 aa, Entamoeba histolytica
ISDLLLSSGYYRVRLTNLLPFDKILGGLAWGISATCYPL

SEQ ID NO: 2715999 - protein, 22 aa, Entamoeba histolytica
ISDYEIIQPIPWLQSNDINESL

SEQ ID NO: 2716000 - protein, 17 aa, Entamoeba histolytica
ISDYIHVFSLHPSNIIL

SEQ ID NO: 2716001 - protein, 26 aa, Entamoeba histolytica
ISDYKPILVDGFKLSLQLLVKEVSNL

SEQ ID NO: 2716002 - protein, 24 aa, Entamoeba histolytica
ISEERIFMNEPLLNSIKTPENLKI

SEQ ID NO: 2716003 - protein, 17 aa, Entamoeba histolytica
ISEERIFMNEPVLISIE

SEQ ID NO: 2716004 - protein, 27 aa, Entamoeba histolytica
ISEFSSCYPNILFSLLSGLQCLVYTTQ

SEQ ID NO: 2716005 - protein, 24 aa, Entamoeba histolytica
ISEHYIIMPDFVKMFVKQVAEKGK

SEQ ID NO: 2716006 - protein, 24 aa, Entamoeba histolytica
ISEKGIIELLLQLLSNGKQAPNEL

SEQ ID NO: 2716007 - protein, 23 aa, Entamoeba histolytica
ISEKIVNNLLDALKPKEVQPENQ

SEQ ID NO: 2716008 - protein, 23 aa, Entamoeba histolytica
ISELIKYGMSLLFSYQLDNRSLE

SEQ ID NO: 2716009 - protein, 23 aa, Entamoeba histolytica
ISENIFYFPHLINSLFKEISQSE

SEQ ID NO: 2716010 - protein, 35 aa, Entamoeba histolytica
ISERRYIPELIGWIRKGYLIVKDSKRKKGIKVEEA

SEQ ID NO: 2716011 - protein, 25 aa, Entamoeba histolytica
ISFEQFVAQLYKLGKNEIMCDWLRN

SEQ ID NO: 2716012 - protein, 18 aa, Entamoeba histolytica
ISFFCNILNTPNEVLLEY

SEQ ID NO: 2716013 - protein, 19 aa, Entamoeba histolytica
ISFFFNFEIPAEIITKLFN

SEQ ID NO: 2716014 - protein, 25 aa, Entamoeba histolytica
ISFNQDFSCFALGTTKGFCVYGIEQ

SEQ ID NO: 2716015 - protein, 25 aa, Entamoeba histolytica
ISFNQDFSCFALGTTKGFFVYGIEQ

SEQ ID NO: 2716016 - protein, 18 aa, Entamoeba histolytica
ISFSVAIGGYLWVPINHT

SEQ ID NO: 2716017 - protein, 21 aa, Entamoeba histolytica
ISFTELLLSLLTRQFSQWTNS

SEQ ID NO: 2716018 - protein, 23 aa, Entamoeba histolytica
ISGFKLVFNSRLLTIFSPHELEL

SEQ ID NO: 2716019 - protein, 25 aa, Entamoeba histolytica
ISGKKPFPSLLRNYLRELRSLWVSL

SEQ ID NO: 2716020 - protein, 32 aa, Entamoeba histolytica
ISGSKKITPFILQNPFDLIPVRFDPKVEMNFN

SEQ ID NO: 2716021 - protein, 32 aa, Entamoeba histolytica
ISHDIIPSVFGIRWIKMLFAREFHIEDVVEIW

SEQ ID NO: 2716022 - protein, 17 aa, Entamoeba histolytica
ISHFFVFDVFDKALCFL

SEQ ID NO: 2716023 - protein, 21 aa, Entamoeba histolytica
ISHLIAIDLYKYITSQYSMLI

SEQ ID NO: 2716024 - protein, 23 aa, Entamoeba histolytica
ISHLTKQFIKIKKIVFSDQNDSI

SEQ ID NO: 2716025 - protein, 26 aa, Entamoeba histolytica
ISHNPEIPIFPILKKFGPADFVELVG

SEQ ID NO: 2716026 - protein, 25 aa, Entamoeba histolytica
ISHTLLTQFLIPKRFDCLVALNISA

SEQ ID NO: 2716027 - protein, 21 aa, Entamoeba histolytica
ISIEEMIMKDKLFRKPKETDT

SEQ ID NO: 2716028 - protein, 19 aa, Entamoeba histolytica
ISIFALSLNRSILVPLTTL

SEQ ID NO: 2716029 - protein, 21 aa, Entamoeba histolytica
ISIGYPYKPIHFNKSNHLSLL

SEQ ID NO: 2716030 - protein, 29 aa, Entamoeba histolytica
ISIIQMIEWYYQGLLNTITPFAKKISIVS

SEQ ID NO: 2716031 - protein, 21 aa, Entamoeba histolytica
ISIMCHRAKILPWRTLRFNEC

SEQ ID NO: 2716032 - protein, 26 aa, Entamoeba histolytica
ISINQLKYFPYLHTLHFYKSITIHEV

SEQ ID NO: 2716033 - protein, 27 aa, Entamoeba histolytica
ISIQKVHAILRGLLKLKIIDANMRITE

SEQ ID NO: 2716034 - protein, 21 aa, Entamoeba histolytica
ISIRYYLSNGILKRTIFAVKK

SEQ ID NO: 2716035 - protein, 30 aa, Entamoeba histolytica
ISISEVDCIYYIKWQIPALCKHQVFVDWNL

SEQ ID NO: 2716036 - protein, 22 aa, Entamoeba histolytica
ISISYLSKIIKKMGLGKRANHS

SEQ ID NO: 2716037 - protein, 26 aa, Entamoeba histolytica
ISITSFRAYFVLSLHYGIRCLEKEKY

SEQ ID NO: 2716038 - protein, 18 aa, Entamoeba histolytica
ISIYKPKTVFGHSIVSVL

SEQ ID NO: 2716039 - protein, 22 aa, Entamoeba histolytica
ISKDFLGLRVLKGINLITPTTM

SEQ ID NO: 2716040 - protein, 22 aa, Entamoeba histolytica
ISKDFMYRLYDPRVSSEAITSY

SEQ ID NO: 2716041 - protein, 18 aa, Entamoeba histolytica
ISKERIFMNEPALLSIQT

SEQ ID NO: 2716042 - protein, 19 aa, Entamoeba histolytica
ISKIFGRPDSIRTIALLLQ

SEQ ID NO: 2716043 - protein, 17 aa, Entamoeba histolytica
ISKIIEYITKRGKGMFK

SEQ ID NO: 2716044 - protein, 27 aa, Entamoeba histolytica
ISKKTLQFLTIKLILFPKQDEIDFSSL

SEQ ID NO: 2716045 - protein, 28 aa, Entamoeba histolytica
ISKLIRFYPQLFNLFYSSFRDLCIQPYI

SEQ ID NO: 2716046 - protein, 24 aa, Entamoeba histolytica
ISKNSCIISIQLLFHRIDESTGKY

SEQ ID NO: 2716047 - protein, 24 aa, Entamoeba histolytica
ISKSLSWPTILYVIGSIVKGWLQK

SEQ ID NO: 2716048 - protein, 24 aa, Entamoeba histolytica
ISKYFTKLLPCILMVIQKIIQQQQ

SEQ ID NO: 2716049 - protein, 19 aa, Entamoeba histolytica
ISKYTNAVGVGKYTYKCQV

SEQ ID NO: 2716050 - protein, 17 aa, Entamoeba histolytica
ISLAMLKAKKRGAEEVD

SEQ ID NO: 2716051 - protein, 18 aa, Entamoeba histolytica
ISLDISCNRLTSIKFPYT

SEQ ID NO: 2716052 - protein, 19 aa, Entamoeba histolytica
ISLEIHIARLEYKYGSVDK

SEQ ID NO: 2716053 - protein, 37 aa, Entamoeba histolytica
ISLFSILIEIVIDPYYRTIDGFLFLFQKELLSVNFFE

SEQ ID NO: 2716054 - protein, 29 aa, Entamoeba histolytica
ISLGKVFIELLNIIKWNGIQKHIILVLNK

SEQ ID NO: 2716055 - protein, 19 aa, Entamoeba histolytica
ISLIQKYIKIPSYQDLSFL

SEQ ID NO: 2716056 - protein, 23 aa, Entamoeba histolytica
ISLLRMMYALEFNYQLMAPEQLN

SEQ ID NO: 2716057 - protein, 18 aa, Entamoeba histolytica
ISLNCTLEDLYNGKTFKR

SEQ ID NO: 2716058 - protein, 25 aa, Entamoeba histolytica
ISLNDYVLMLRFIQILGKEAFEVLI

SEQ ID NO: 2716059 - protein, 22 aa, Entamoeba histolytica
ISLPIVLCGGDWFIGLFVRQLS

SEQ ID NO: 2716060 - protein, 24 aa, Entamoeba histolytica
ISLRHYICIITYNTSITLYQIGDT

SEQ ID NO: 2716061 - protein, 26 aa, Entamoeba histolytica
ISLRMFYDMYLFTYVVILKSTRNGKI

SEQ ID NO: 2716062 - protein, 30 aa, Entamoeba histolytica
ISLTIKQLYHFLAYYVLDTLFTQPEKICCS

SEQ ID NO: 2716063 - protein, 27 aa, Entamoeba histolytica
ISMEDWIDCVWLIKTLETFKVIKFGFE

SEQ ID NO: 2716064 - protein, 17 aa, Entamoeba histolytica
ISMEQFFIEGRYNRVLE

SEQ ID NO: 2716065 - protein, 17 aa, Entamoeba histolytica
ISMIMKYGISDKKEIHN

SEQ ID NO: 2716066 - protein, 18 aa, Entamoeba histolytica
ISMNFRFTEPLWKKYENK

SEQ ID NO: 2716067 - protein, 30 aa, Entamoeba histolytica; identical to SEQ ID NO: 2528282

SEQ ID NO: 2716068 - protein, 22 aa, Entamoeba histolytica
ISNFEYLMLLNRYSSRSYHDLT

SEQ ID NO: 2716069 - protein, 26 aa, Entamoeba histolytica
ISNIDSYNYALELLKKFSAVSSKTKI

SEQ ID NO: 2716070 - protein, 24 aa, Entamoeba histolytica
ISNKKWIIEPLIEPFDIKGKCILP

SEQ ID NO: 2716071 - protein, 30 aa, Entamoeba histolytica
ISNKPNIILPFQFCNFVHLKQLIIENLHCQ

SEQ ID NO: 2716072 - protein, 24 aa, Entamoeba histolytica
ISNSMPFQFLSLHLSKSVIYIPSV

SEQ ID NO: 2716073 - protein, 26 aa, Entamoeba histolytica
ISNTCIVGYLPYFKQTQVLDIVVEKC

SEQ ID NO: 2716074 - protein, 20 aa, Entamoeba histolytica
ISNYLWEIILENVDLIKEGK

SEQ ID NO: 2716075 - protein, 19 aa, Entamoeba histolytica
ISPDLKNTKALLKQTQKEL

SEQ ID NO: 2716076 - protein, 21 aa, Entamoeba histolytica
ISPFQPYYKLAFAAPELLWDL

SEQ ID NO: 2716077 - protein, 18 aa, Entamoeba histolytica
ISPHAGFRYSGQTAGYDF

SEQ ID NO: 2716078 - protein, 21 aa, Entamoeba histolytica
ISPLLLTPIPCRGTIKTYSHE

SEQ ID NO: 2716079 - protein, 26 aa, Entamoeba histolytica
ISPLQLPTVIAPPFSLTNCIIIKVSG

SEQ ID NO: 2716080 - protein, 27 aa, Entamoeba histolytica
ISPNDYSLFLYYSKRRVNPFIRPKSIL

SEQ ID NO: 2716081 - protein, 37 aa, Entamoeba histolytica; identical to SEQ ID NO: 2528303

SEQ ID NO: 2716082 - protein, 21 aa, Entamoeba histolytica
ISPPFTKLRLFFTCFDHIIEG

SEQ ID NO: 2716083 - protein, 24 aa, Entamoeba histolytica
ISPSNKTLPYPFWKEWIATKCIDL

SEQ ID NO: 2716084 - protein, 18 aa, Entamoeba histolytica
ISPVHPLPSRPWKGTRLR

SEQ ID NO: 2716085 - protein, 21 aa, Entamoeba histolytica
ISQLLPLYKYRLKNGYLLIPS

SEQ ID NO: 2716086 - protein, 34 aa, Entamoeba histolytica
ISRIEEAFDILILARCWLKFSYVYSFYSSEEGKI

SEQ ID NO: 2716087 - protein, 25 aa, Entamoeba histolytica
ISRKEMYFMLCLIDHIISNYEPFRK

SEQ ID NO: 2716088 - protein, 18 aa, Entamoeba histolytica
ISRLIIKCKNIEYTVSDR

SEQ ID NO: 2716089 - protein, 34 aa, Entamoeba histolytica
ISRLQQFLDYYLKEVIELLPNDKLLKKCSEDIKV

SEQ ID NO: 2716090 - protein, 21 aa, Entamoeba histolytica
ISRLQVMDSIPSKYAKLYHQL

SEQ ID NO: 2716091 - protein, 22 aa, Entamoeba histolytica
ISRSATLVIAYLIYHEKISLKD

SEQ ID NO: 2716092 - protein, 23 aa, Entamoeba histolytica
ISSALSLIQQIYEKLSKTINTII

SEQ ID NO: 2716093 - protein, 22 aa, Entamoeba histolytica
ISSIPNSKFFYYYPSGTDEFRK

SEQ ID NO: 2716094 - protein, 24 aa, Entamoeba histolytica
ISSLLKLRHPFIIKLISVENKVDS

SEQ ID NO: 2716095 - protein, 24 aa, Entamoeba histolytica
ISSNTFLWDVFLDNLNKLFFDFQL

SEQ ID NO: 2716096 - protein, 17 aa, Entamoeba histolytica
ISSPQIAVIKFIHEFRS

SEQ ID NO: 2716097 - protein, 17 aa, Entamoeba histolytica
ISSSKHNELFISPATKR

SEQ ID NO: 2716098 - protein, 19 aa, Entamoeba histolytica
ISSSWDHTLRLWDLNKMES

SEQ ID NO: 2716099 - protein, 24 aa, Entamoeba histolytica
ISSTLDFVFVLFKGLNSPSFNQYF

SEQ ID NO: 2716100 - protein, 17 aa, Entamoeba histolytica
ISTPPLNIPQDRRSYIP

SEQ ID NO: 2716101 - protein, 26 aa, Entamoeba histolytica
ISTSEPYLYFYNTDRMKLYKKVPIEN

SEQ ID NO: 2716102 - protein, 27 aa, Entamoeba histolytica
ISTSEPYLYFYNTDRMKLYKKVPIENM

SEQ ID NO: 2716103 - protein, 18 aa, Entamoeba histolytica
ISTTFPLVPLTPQQIRET

SEQ ID NO: 2716104 - protein, 25 aa, Entamoeba histolytica
ISTTPIYFKILVRLIKEGGIEILKE

SEQ ID NO: 2716105 - protein, 22 aa, Entamoeba histolytica
ISTTTFPLIEPQYLCKLPESRI

SEQ ID NO: 2716106 - protein, 24 aa, Entamoeba histolytica
ISVAAYYVPLLKTLGLTTILSTEL

SEQ ID NO: 2716107 - protein, 21 aa, Entamoeba histolytica
ISVATLKFNPIRKTELFNGLQ

SEQ ID NO: 2716108 - protein, 18 aa, Entamoeba histolytica
ISVIQALVKSGLIKIFCR

SEQ ID NO: 2716109 - protein, 17 aa, Entamoeba histolytica
ISVLKKWKESGKGDIID

SEQ ID NO: 2716110 - protein, 23 aa, Entamoeba histolytica
ISVSKEILLFVRNILLNSNNTNN

SEQ ID NO: 2716111 - protein, 24 aa, Entamoeba histolytica
ISVTKRHIYYLDKNLFKHQRVVDE

SEQ ID NO: 2716112 - protein, 20 aa, Entamoeba histolytica
ISWDELFVHPFITQKLQCVF

SEQ ID NO: 2716113 - protein, 18 aa, Entamoeba histolytica
ISYDLVTLYWSKISRDKK

SEQ ID NO: 2716114 - protein, 29 aa, Entamoeba histolytica
ISYFLGEICSGLWYLHFNKRLIHRDLKPA

SEQ ID NO: 2716115 - protein, 18 aa, Entamoeba histolytica
ISYITKPHQRMEIVNLMS

SEQ ID NO: 2716116 - protein, 24 aa, Entamoeba histolytica
ISYKLLHSLLVFQSAVLRKDESKI

SEQ ID NO: 2716117 - protein, 23 aa, Entamoeba histolytica
ISYTFFISFFLTPDNEIYKKYLF

SEQ ID NO: 2716118 - protein, 21 aa, Entamoeba histolytica
ITADYLIDFFTYGIPAEIRCS

SEQ ID NO: 2716119 - protein, 25 aa, Entamoeba histolytica
ITALPYLAQYCSCKIWVKPEAETSF

SEQ ID NO: 2716120 - protein, 17 aa, Entamoeba histolytica
ITALRNILSDRRKDMNM

SEQ ID NO: 2716121 - protein, 19 aa, Entamoeba histolytica
ITALVRIQIKPTEQFWTQI

SEQ ID NO: 2716122 - protein, 17 aa, Entamoeba histolytica
ITCSLRFPGQLNQDLKK

SEQ ID NO: 2716123 - protein, 24 aa, Entamoeba histolytica
ITDFWKIQHFFDKRLPALRDSARN

SEQ ID NO: 2716124 - protein, 31 aa, Entamoeba histolytica
ITDVHFVSTLFYYMRLCVLSYGKWVYIQGDK

SEQ ID NO: 2716125 - protein, 22 aa, Entamoeba histolytica
ITEEFVNYGHLFRPIVFEGKKV

SEQ ID NO: 2716126 - protein, 26 aa, Entamoeba histolytica
ITEELIHKYFDPFGPIIGVDIVYKPQ

SEQ ID NO: 2716127 - protein, 26 aa, Entamoeba histolytica
ITEGKYLNFIGIGGIIPLLSNNLSDG

SEQ ID NO: 2716128 - protein, 26 aa, Entamoeba histolytica
ITEMNNKYSVLLAAARAAEERNKKEK

SEQ ID NO: 2716129 - protein, 29 aa, Entamoeba histolytica
ITEQRFYHRLPIFLREEALRKIPGMKKYT

SEQ ID NO: 2716130 - protein, 33 aa, Entamoeba histolytica
ITEQVPIFMKLTNCLLWYFEKILYQKDTTDQRL

SEQ ID NO: 2716131 - protein, 26 aa, Entamoeba histolytica
ITETEAYQGAYLKKKQEKKEISNEEK

SEQ ID NO: 2716132 - protein, 17 aa, Entamoeba histolytica
ITEWFKNQPIYEDILMY

SEQ ID NO: 2716133 - protein, 32 aa, Entamoeba histolytica
ITFKTTSTAAALLWVFYIRQSFIKQHSFDKTS

SEQ ID NO: 2716134 - protein, 24 aa, Entamoeba histolytica
ITGRGFNRCLAILSLIQCQGNEEK

SEQ ID NO: 2716135 - protein, 25 aa, Entamoeba histolytica
ITGTEIFNIFYKTGYKLYQEKKYSE

SEQ ID NO: 2716136 - protein, 22 aa, Entamoeba histolytica
ITGTLKICSFSIFFASNEQSFP

SEQ ID NO: 2716137 - protein, 17 aa, Entamoeba histolytica
ITGTQFYDKTPLLMTSG

SEQ ID NO: 2716138 - protein, 25 aa, Entamoeba histolytica
ITHCELLRCFIKILKKIKDVNENNI

SEQ ID NO: 2716139 - protein, 18 aa, Entamoeba histolytica
ITHLMRLLQLSLTSFGVK

SEQ ID NO: 2716140 - protein, 29 aa, Entamoeba histolytica
ITHNRIPEFTIIPFSYCFYKPLPLNKFGN

SEQ ID NO: 2716141 - protein, 20 aa, Entamoeba histolytica
ITHPLVMTLFTSPNYCDVYD

SEQ ID NO: 2716142 - protein, 19 aa, Entamoeba histolytica
ITHQFIKIKSISFSYKDSI

SEQ ID NO: 2716143 - protein, 20 aa, Entamoeba histolytica
ITHTSLCYIFIHALTEERPT

SEQ ID NO: 2716144 - protein, 19 aa, Entamoeba histolytica
ITHWIQEYQIEQEIAFIII

SEQ ID NO: 2716145 - protein, 17 aa, Entamoeba histolytica
ITIGPTTHYGRRIFNGC

SEQ ID NO: 2716146 - protein, 21 aa, Entamoeba histolytica
ITIHKGCTFLLKLPSGLEKLK

SEQ ID NO: 2716147 - protein, 24 aa, Entamoeba histolytica
ITIIKSIYYSKTPQKLLLLTSSEL

SEQ ID NO: 2716148 - protein, 20 aa, Entamoeba histolytica
ITINFPTEFPEEPAVFVFHL

SEQ ID NO: 2716149 - protein, 23 aa, Entamoeba histolytica
ITIQRILTLLYSYADLFSSRTRQ

SEQ ID NO: 2716150 - protein, 22 aa, Entamoeba histolytica
ITIWDVLSNKLLFSLPVPYEQH

SEQ ID NO: 2716151 - protein, 26 aa, Entamoeba histolytica
ITKAINDFFAPLLNKFIIPNSLVEVE

SEQ ID NO: 2716152 - protein, 21 aa, Entamoeba histolytica
ITKFPVMWMNQIHALHSSYEE

SEQ ID NO: 2716153 - protein, 27 aa, Entamoeba histolytica
ITKHQRLILIFQCVIRRVYLRFETEEE

SEQ ID NO: 2716154 - protein, 18 aa, Entamoeba histolytica
ITKIYLPSPKEEGSYVVL

SEQ ID NO: 2716155 - protein, 24 aa, Entamoeba histolytica
ITKKALNEWILKSLIKNIQKKREN

SEQ ID NO: 2716156 - protein, 27 aa, Entamoeba histolytica
ITKKSKGFGFVLFVVPQDAVKACNEMD

SEQ ID NO: 2716157 - protein, 19 aa, Entamoeba histolytica
ITKLFGSAPVKILMISPKV

SEQ ID NO: 2716158 - protein, 18 aa, Entamoeba histolytica
ITKLINTLNIMFDGNDII

SEQ ID NO: 2716159 - protein, 25 aa, Entamoeba histolytica
ITKNTYLCVKRLPRSARQMVIKKIR

SEQ ID NO: 2716160 - protein, 31 aa, Entamoeba histolytica
ITKPGQLPRFILIKIIPYLKNISNVLHFGAV

SEQ ID NO: 2716161 - protein, 24 aa, Entamoeba histolytica
ITKQVLEKLLNRIKFLLQSSTIDF

SEQ ID NO: 2716162 - protein, 20 aa, Entamoeba histolytica
ITKRTLISSYRRERDRFWNI

SEQ ID NO: 2716163 - protein, 24 aa, Entamoeba histolytica
ITKWHPEVIHFAPKVPIILVGTKL

SEQ ID NO: 2716164 - protein, 29 aa, Entamoeba histolytica
ITKYLLVKPSTIFDLWRQCHQPYSKMYEA

SEQ ID NO: 2716165 - protein, 22 aa, Entamoeba histolytica
ITLENFPKLTNLIFSNISRLEL

SEQ ID NO: 2716166 - protein, 19 aa, Entamoeba histolytica
ITLFNLYKERKCLGYRWIS

SEQ ID NO: 2716167 - protein, 25 aa, Entamoeba histolytica
ITLHLPDRWFISRKVVLQINNISIC

SEQ ID NO: 2716168 - protein, 20 aa, Entamoeba histolytica
ITLHSFLNQFRILSRRDCEL

SEQ ID NO: 2716169 - protein, 26 aa, Entamoeba histolytica
ITLIEWEMFKAIKPPELYAWNKKDKE

SEQ ID NO: 2716170 - protein, 20 aa, Entamoeba histolytica
ITLINPFQNLDILLIQTINV

SEQ ID NO: 2716171 - protein, 22 aa, Entamoeba histolytica
ITLKIFPLFNLVSTVFNNCIRC

SEQ ID NO: 2716172 - protein, 18 aa, Entamoeba histolytica
ITLKLLRAGSTVIGTTRY

SEQ ID NO: 2716173 - protein, 17 aa, Entamoeba histolytica
ITLLESLILLPHIKEII

SEQ ID NO: 2716174 - protein, 19 aa, Entamoeba histolytica
ITLLKVKRISSEDLRIVIC

SEQ ID NO: 2716175 - protein, 31 aa, Entamoeba histolytica; identical to SEQ ID NO: 2528424

SEQ ID NO: 2716176 - protein, 18 aa, Entamoeba histolytica
ITLPFHIIDIGNYVFFNC

SEQ ID NO: 2716177 - protein, 18 aa, Entamoeba histolytica
ITLPLLKRKDEIFSIPDF

SEQ ID NO: 2716178 - protein, 18 aa, Entamoeba histolytica
ITLPWRISAVHSINKKVI

SEQ ID NO: 2716179 - protein, 27 aa, Entamoeba histolytica
ITLRFQNYYFFKEKVSFRVIRCLEPFV

SEQ ID NO: 2716180 - protein, 19 aa, Entamoeba histolytica
ITLTFYINTTRYRNSLFIG

SEQ ID NO: 2716181 - protein, 20 aa, Entamoeba histolytica
ITLVRPRTLKWSYSLLCGEI

SEQ ID NO: 2716182 - protein, 23 aa, Entamoeba histolytica
ITNDRSYIIPSFNKYYNDTTQIG

SEQ ID NO: 2716183 - protein, 19 aa, Entamoeba histolytica
ITNEKITPPSFKTNTIPPQ

SEQ ID NO: 2716184 - protein, 28 aa, Entamoeba histolytica
ITNITLNDLLRLCWGLMTVADFTVRRSL

SEQ ID NO: 2716185 - protein, 24 aa, Entamoeba histolytica
ITNKKKLRHMSGKQFRQLRTFHFD

SEQ ID NO: 2716186 - protein, 30 aa, Entamoeba histolytica
ITNLPRYLTYIIETCVPFLESITCFPLMEH

SEQ ID NO: 2716187 - protein, 31 aa, Entamoeba histolytica
ITNLTFLETITLPHFPILLNLKELGISGGLN

SEQ ID NO: 2716188 - protein, 18 aa, Entamoeba histolytica
ITNLWIRYSSVLKSIKTD

SEQ ID NO: 2716189 - protein, 32 aa, Entamoeba histolytica
ITNPIVFSCGILKITMLLIKKSQVKFYTPMID

SEQ ID NO: 2716190 - protein, 23 aa, Entamoeba histolytica
ITNRYYIQIPFSQLDKYKEKFLH

SEQ ID NO: 2716191 - protein, 25 aa, Entamoeba histolytica
ITNSSNLIPLPRTPSARKVIQDFLK

SEQ ID NO: 2716192 - protein, 26 aa, Entamoeba histolytica
ITNTVLCILIKQLGAIVSFRRTKKTK

SEQ ID NO: 2716193 - protein, 25 aa, Entamoeba histolytica
ITNTVRQWMRLFLPNQEVNVENTQK

SEQ ID NO: 2716194 - protein, 18 aa, Entamoeba histolytica
ITNWLNYTLKSCYKKKIT

SEQ ID NO: 2716195 - protein, 21 aa, Entamoeba histolytica
ITPALLLCHFNVEIKAIYPIR

SEQ ID NO: 2716196 - protein, 19 aa, Entamoeba histolytica
ITPIFVFDGARLPSKITTE

SEQ ID NO: 2716197 - protein, 22 aa, Entamoeba histolytica
ITPLLGCPLLQTLVLAHNNIES

SEQ ID NO: 2716198 - protein, 17 aa, Entamoeba histolytica
ITPLLTQWTYQAMIHEF

SEQ ID NO: 2716199 - protein, 19 aa, Entamoeba histolytica
ITQFDKMFYYKLYCSLSKC

SEQ ID NO: 2716200 - protein, 25 aa, Entamoeba histolytica
ITQKHLVITYFIRELLNIYTREGPV

SEQ ID NO: 2716201 - protein, 17 aa, Entamoeba histolytica
ITQLKRHKFLTQVEDNQ

SEQ ID NO: 2716202 - protein, 26 aa, Entamoeba histolytica
ITQPEATYLLWMNFSKYGISSDKIDD

SEQ ID NO: 2716203 - protein, 22 aa, Entamoeba histolytica
ITQTFKTLIPLIQNFHTKIENL

SEQ ID NO: 2716204 - protein, 23 aa, Entamoeba histolytica
ITQYKKYLNTAIGKEWTSLLTHN

SEQ ID NO: 2716205 - protein, 23 aa, Entamoeba histolytica
ITRDDLVVCWYSRITRSIGFIVN

SEQ ID NO: 2716206 - protein, 22 aa, Entamoeba histolytica
ITRFNLFVVIGLADGKAKFFTW

SEQ ID NO: 2716207 - protein, 19 aa, Entamoeba histolytica
ITRIIAEKKMIFNKSFELI

SEQ ID NO: 2716208 - protein, 26 aa, Entamoeba histolytica
ITRIKNALIYYIQYNQPISSTFLKEH

SEQ ID NO: 2716209 - protein, 37 aa, Entamoeba histolytica; identical to SEQ ID NO: 2528457

SEQ ID NO: 2716210 - protein, 35 aa, Entamoeba histolytica; identical to SEQ ID NO: 2528458

SEQ ID NO: 2716211 - protein, 27 aa, Entamoeba histolytica
ITSFKKNSFTPFCFPRLNLLDLSNNEI

SEQ ID NO: 2716212 - protein, 23 aa, Entamoeba histolytica
ITSIIKALKLLFPPSFNKDQTDK

SEQ ID NO: 2716213 - protein, 27 aa, Entamoeba histolytica
ITSIIRKPIYGIGWFRTHQNQSKVVIG

SEQ ID NO: 2716214 - protein, 24 aa, Entamoeba histolytica
ITSIPIKLSFTMGFAETHHYSHPL

SEQ ID NO: 2716215 - protein, 29 aa, Entamoeba histolytica
ITSKVWNMLIHQFYLRDALFELKEHDFVQ

SEQ ID NO: 2716216 - protein, 22 aa, Entamoeba histolytica
ITSLKLLQQVLFLFDNLSSITI

SEQ ID NO: 2716217 - protein, 22 aa, Entamoeba histolytica
ITSMNFVRDYGKILTVMRHCSH

SEQ ID NO: 2716218 - protein, 27 aa, Entamoeba histolytica
ITSRQSVMYLLYYFCSALKERFSDFIG

SEQ ID NO: 2716219 - protein, 25 aa, Entamoeba histolytica
ITSSHLKICGIYWGITTLHLLNKVT

SEQ ID NO: 2716220 - protein, 24 aa, Entamoeba histolytica
ITSSLRIIIKPHFIFQNLTNEIFT

SEQ ID NO: 2716221 - protein, 31 aa, Entamoeba histolytica
ITTDHNPYFDSFIRWQFLKLKEMGKIQFGKR

SEQ ID NO: 2716222 - protein, 23 aa, Entamoeba histolytica
ITTEVLMTCTFRTLDKSCSASLD

SEQ ID NO: 2716223 - protein, 29 aa, Entamoeba histolytica
ITTFSDWKLILYFINLLGKFGGETNYEID

SEQ ID NO: 2716224 - protein, 23 aa, Entamoeba histolytica
ITTIIIPIVLKLLTDKVPNVRFN

SEQ ID NO: 2716225 - protein, 20 aa, Entamoeba histolytica
ITTISFLPTTLTTLNMRGLC

SEQ ID NO: 2716226 - protein, 26 aa, Entamoeba histolytica
ITTKESSLFWLFQSVMTMLQGFYCSN

SEQ ID NO: 2716227 - protein, 24 aa, Entamoeba histolytica
ITTKIGIVPIINLFIDSINTEFSN

SEQ ID NO: 2716228 - protein, 18 aa, Entamoeba histolytica
ITTKLIPISKGIASFLPG

SEQ ID NO: 2716229 - protein, 19 aa, Entamoeba histolytica
ITTLKIGCLFAFENNKFSV

SEQ ID NO: 2716230 - protein, 36 aa, Entamoeba histolytica
ITTLPDILPGYLPTASAFPFFISLFSEIKWDDEISC

SEQ ID NO: 2716231 - protein, 25 aa, Entamoeba histolytica
ITTLSSLSYYFPLLSEYALLQSNNI

SEQ ID NO: 2716232 - protein, 24 aa, Entamoeba histolytica
ITTMIPKFILRCSIEVIQELFNFI

SEQ ID NO: 2716233 - protein, 27 aa, Entamoeba histolytica
ITTQREMFFYMSLLSQQLPIESQFIGS

SEQ ID NO: 2716234 - protein, 27 aa, Entamoeba histolytica
ITTSAEKLIRIPKEVFLILHDCSGEKS

SEQ ID NO: 2716235 - protein, 47 aa, Entamoeba histolytica
ITTTTKLLKLLIILFSPNKPIDMLWNDFIQNIIIPTRTRILALVKML

SEQ ID NO: 2716236 - protein, 25 aa, Entamoeba histolytica
ITVDKLLRCLFMKELSFESEKKYDI

SEQ ID NO: 2716237 - protein, 18 aa, Entamoeba histolytica
ITVIKPWKGGDMIGLVSG

SEQ ID NO: 2716238 - protein, 18 aa, Entamoeba histolytica
ITVISTDGEWWEGESKGK

SEQ ID NO: 2716239 - protein, 26 aa, Entamoeba histolytica
ITVKYPRWFEFYDMIQIVETLHKKVE

SEQ ID NO: 2716240 - protein, 19 aa, Entamoeba histolytica
ITVTIIRQEGMQGPYKGYG

SEQ ID NO: 2716241 - protein, 30 aa, Entamoeba histolytica
ITYKNLLVQGSFLPIYLYGMSKHEFFNNKQ

SEQ ID NO: 2716242 - protein, 25 aa, Entamoeba histolytica
IVACDGFWNVFKYEDAINLARNYLF

SEQ ID NO: 2716243 - protein, 23 aa, Entamoeba histolytica
IVAKTLHLISRLLSKLSGKLANS

SEQ ID NO: 2716244 - protein, 41 aa, Entamoeba histolytica
IVCADLRGWIVGYVVTKFLYQQVEPFILLKYQLEKDEREAE

SEQ ID NO: 2716245 - protein, 18 aa, Entamoeba histolytica
IVCALCTQIGILYKSINT

SEQ ID NO: 2716246 - protein, 23 aa, Entamoeba histolytica
IVCPSRVLDIKFSPTNDVVAVGD

SEQ ID NO: 2716247 - protein, 28 aa, Entamoeba histolytica
IVCVGTLFIERKFIWNGGLVGHIEDIGV

SEQ ID NO: 2716248 - protein, 23 aa, Entamoeba histolytica
IVDCMGPIYLQYATWMKMKKLDK

SEQ ID NO: 2716249 - protein, 18 aa, Entamoeba histolytica
IVDECCNYPIQLGCRLAK

SEQ ID NO: 2716250 - protein, 34 aa, Entamoeba histolytica
IVDFDACSLYPSAIARLYLPLSSPNRMVQPIEWY

SEQ ID NO: 2716251 - protein, 31 aa, Entamoeba histolytica; identical to SEQ ID NO: 2528494

SEQ ID NO: 2716252 - protein, 25 aa, Entamoeba histolytica
IVDIKIEFGWFYLNVLSTSPIHQIA

SEQ ID NO: 2716253 - protein, 37 aa, Entamoeba histolytica
IVDKKVTTEPIKQEETFGGQTIPKEKPTTQETERVKE

SEQ ID NO: 2716254 - protein, 18 aa, Entamoeba histolytica
IVDLIHPKGVVFVLCETE

SEQ ID NO: 2716255 - protein, 22 aa, Entamoeba histolytica
IVDLLPCFAKYSQVIALNDSDE

SEQ ID NO: 2716256 - protein, 25 aa, Entamoeba histolytica
IVDMYLQPLQMLVNQGVIPVVHGDV

SEQ ID NO: 2716257 - protein, 33 aa, Entamoeba histolytica; identical to SEQ ID NO: 2528497

SEQ ID NO: 2716258 - protein, 19 aa, Entamoeba histolytica
IVDWNKIIGWCEEWNKIDI

SEQ ID NO: 2716259 - protein, 18 aa, Entamoeba histolytica
IVDYRKNVFYLSAANGWF

SEQ ID NO: 2716260 - protein, 20 aa, Entamoeba histolytica
IVEFCNLIVGTWKLNERTFN

SEQ ID NO: 2716261 - protein, 26 aa, Entamoeba histolytica
IVELTWTCSSLFLPQQYLSYLTTQQP

SEQ ID NO: 2716262 - protein, 26 aa, Entamoeba histolytica
IVEWTNMRNYRILYRSSKDGLSARSL

SEQ ID NO: 2716263 - protein, 25 aa, Entamoeba histolytica
IVEYSMRLLCRIIKGDGVLITNIVD

SEQ ID NO: 2716264 - protein, 17 aa, Entamoeba histolytica
IVFAFAYGIEQMRNMGM

SEQ ID NO: 2716265 - protein, 27 aa, Entamoeba histolytica
IVFEVKYDLVLQIVQQFYKEGRSIEIC

SEQ ID NO: 2716266 - protein, 19 aa, Entamoeba histolytica
IVFHALFRMRLIDMRHRVL

SEQ ID NO: 2716267 - protein, 28 aa, Entamoeba histolytica
IVFYKIHQVFGGKLKYILNGGAPLTEEL

SEQ ID NO: 2716268 - protein, 24 aa, Entamoeba histolytica
IVGCIEVITFILVDYPHIYPNDVD

SEQ ID NO: 2716269 - protein, 28 aa, Entamoeba histolytica
IVGDIHGQFFDLIHLFEINGLPSEDNVY

SEQ ID NO: 2716270 - protein, 25 aa, Entamoeba histolytica
IVGIIKRNWKPLPGYIKQESSGSYS

SEQ ID NO: 2716271 - protein, 18 aa, Entamoeba histolytica
IVGIIVPEKIEFIKFLQT

SEQ ID NO: 2716272 - protein, 25 aa, Entamoeba histolytica
IVGIIVPELNIIKPWLKTKGIEYTS

SEQ ID NO: 2716273 - protein, 21 aa, Entamoeba histolytica
IVGKDTPFRFITDKELQNQLD

SEQ ID NO: 2716274 - protein, 20 aa, Entamoeba histolytica
IVGLTYWSPIEKSFTFISPY

SEQ ID NO: 2716275 - protein, 24 aa, Entamoeba histolytica
IVGMFLSHSLLLGSAPYFGNGEDF

SEQ ID NO: 2716276 - protein, 26 aa, Entamoeba histolytica
IVGNMTKIFYLTYKYHSTNIKYLEEC

SEQ ID NO: 2716277 - protein, 17 aa, Entamoeba histolytica
IVGWYHSHPGFGCWLSS

SEQ ID NO: 2716278 - protein, 43 aa, Entamoeba histolytica
IVHSYFEGMNWVLGYYYKGCQSWDWYYPYLYAPFAEDMGEYVD

SEQ ID NO: 2716279 - protein, 44 aa, Entamoeba histolytica; identical to SEQ ID NO: 2518109

SEQ ID NO: 2716280 - protein, 17 aa, Entamoeba histolytica
IVIADECHYLKNSQSKR

SEQ ID NO: 2716281 - protein, 17 aa, Entamoeba histolytica
IVICLDINNPRLLNSTK

SEQ ID NO: 2716282 - protein, 28 aa, Entamoeba histolytica
IVIFVSSKSIRFIPLPGSALTLGTYIDE

SEQ ID NO: 2716283 - protein, 25 aa, Entamoeba histolytica
IVINIAPLISFNFFNEKFGEYENVF

SEQ ID NO: 2716284 - protein, 19 aa, Entamoeba histolytica
IVIQLLSLHFSFSKDILPQ

SEQ ID NO: 2716285 - protein, 18 aa, Entamoeba histolytica
IVIVLNYNNKKLSSAVKT

SEQ ID NO: 2716286 - protein, 24 aa, Entamoeba histolytica
IVKAIGLPVLGWGCPDPYACVWDS

SEQ ID NO: 2716287 - protein, 22 aa, Entamoeba histolytica
IVKALHITIIFEQQLYKRLYHK

SEQ ID NO: 2716288 - protein, 17 aa, Entamoeba histolytica
IVKDKWYILEDIKLNTS

SEQ ID NO: 2716289 - protein, 20 aa, Entamoeba histolytica
IVKIDRLKWVPIRRKMAADN

SEQ ID NO: 2716290 - protein, 25 aa, Entamoeba histolytica
IVKKIQIPYVFRYLAAELSAMNVRL

SEQ ID NO: 2716291 - protein, 18 aa, Entamoeba histolytica
IVKLKSMRFIKCSSLKSV

SEQ ID NO: 2716292 - protein, 24 aa, Entamoeba histolytica
IVKMYDHFMYCDHLCISFELLNQN

SEQ ID NO: 2716293 - protein, 20 aa, Entamoeba histolytica
IVKNGGVVMNLFGTKRVNGQ

SEQ ID NO: 2716294 - protein, 19 aa, Entamoeba histolytica
IVKNIDYIILFDEQGNRNE

SEQ ID NO: 2716295 - protein, 26 aa, Entamoeba histolytica
IVKNIPISSILGVLFVQIKILAHMIN

SEQ ID NO: 2716296 - protein, 19 aa, Entamoeba histolytica
IVKNIRRDLQGIQRTSVKM

SEQ ID NO: 2716297 - protein, 24 aa, Entamoeba histolytica
IVKNKFYIELYFDKLINDTSQTSE

SEQ ID NO: 2716298 - protein, 23 aa, Entamoeba histolytica
IVKSIMGLFRKTIISGKLSLIER

SEQ ID NO: 2716299 - protein, 26 aa, Entamoeba histolytica
IVLAAPPPKFFALQNRGILKNEQNLI

SEQ ID NO: 2716300 - protein, 17 aa, Entamoeba histolytica
IVLAKEFLMKMSYSFDT

SEQ ID NO: 2716301 - protein, 24 aa, Entamoeba histolytica
IVLDVFPDLKYFVTTLQKVICSCY

SEQ ID NO: 2716302 - protein, 17 aa, Entamoeba histolytica
IVLGCDGLWDTLNGNQI

SEQ ID NO: 2716303 - protein, 25 aa, Entamoeba histolytica
IVLKFRNIHFASFRSPLRKVHDMCV

SEQ ID NO: 2716304 - protein, 18 aa, Entamoeba histolytica
IVLLMLDHCPQTFNLLFD

SEQ ID NO: 2716305 - protein, 19 aa, Entamoeba histolytica
IVLNILDPNPFSLPTLAVF

SEQ ID NO: 2716306 - protein, 30 aa, Entamoeba histolytica; identical to SEQ ID NO: 2528548

SEQ ID NO: 2716307 - protein, 18 aa, Entamoeba histolytica
IVLSLNQFGNYVIQHLLE

SEQ ID NO: 2716308 - protein, 17 aa, Entamoeba histolytica
IVMERLHPLIKKDFIDF

SEQ ID NO: 2716309 - protein, 17 aa, Entamoeba histolytica
IVMFILELFNELSIDSF

SEQ ID NO: 2716310 - protein, 23 aa, Entamoeba histolytica
IVMKDLFRKYPQKYLPVIAKLCD

SEQ ID NO: 2716311 - protein, 24 aa, Entamoeba histolytica
IVNDKILIHYPKNGEKFYVSDSTE

SEQ ID NO: 2716312 - protein, 36 aa, Entamoeba histolytica
IVNGMLEYLKFFNTHKIIPIFVFDGATLPSKKGVEE

SEQ ID NO: 2716313 - protein, 19 aa, Entamoeba histolytica
IVNGTFSIPHDFLELLQVN

SEQ ID NO: 2716314 - protein, 22 aa, Entamoeba histolytica
IVNIIIPKLYCNGALDGDEVSI

SEQ ID NO: 2716315 - protein, 26 aa, Entamoeba histolytica
IVNKVKPFLRQCGFSDIYSIPISGFS

SEQ ID NO: 2716316 - protein, 25 aa, Entamoeba histolytica
IVNNHYHHSFFDQFLIPYESLNEEE

SEQ ID NO: 2716317 - protein, 20 aa, Entamoeba histolytica
IVNSFYIQALMNPEKYGLCS

SEQ ID NO: 2716318 - protein, 17 aa, Entamoeba histolytica
IVNVTHHILVPQHILLS

SEQ ID NO: 2716319 - protein, 19 aa, Entamoeba histolytica
IVNWHPIQEDFFVSGGANG

SEQ ID NO: 2716320 - protein, 27 aa, Entamoeba histolytica
IVPIYIKYTWSTIYKLLYKTNPDIVMK

SEQ ID NO: 2716321 - protein, 20 aa, Entamoeba histolytica
IVPKYYTLCFTSTEDNDKLI

SEQ ID NO: 2716322 - protein, 28 aa, Entamoeba histolytica
IVPSQRPMILFEYYETFIVKSSVYKAFV

SEQ ID NO: 2716323 - protein, 20 aa, Entamoeba histolytica
IVQCIRLLPCLIFGRGDEEC

SEQ ID NO: 2716324 - protein, 29 aa, Entamoeba histolytica
IVQFGDDPLLFRFLQIFKEIRELSGMRPN

SEQ ID NO: 2716325 - protein, 18 aa, Entamoeba histolytica
IVQINLCLLFGESFTEQR

SEQ ID NO: 2716326 - protein, 18 aa, Entamoeba histolytica
IVQNIPESAYFYTPDDDR

SEQ ID NO: 2716327 - protein, 22 aa, Entamoeba histolytica
IVQTFPSTIRWFISKQIYSVGV

SEQ ID NO: 2716328 - protein, 25 aa, Entamoeba histolytica
IVRIQEGPLILLKLNTNPYSMVIKG

SEQ ID NO: 2716329 - protein, 27 aa, Entamoeba histolytica
IVRKTTRLMLQKKPSIIVSIPSIPSIP

SEQ ID NO: 2716330 - protein, 18 aa, Entamoeba histolytica
IVRMLVELLCRLPEDMKR

SEQ ID NO: 2716331 - protein, 18 aa, Entamoeba histolytica
IVRNEFVTILLNGEKWSL

SEQ ID NO: 2716332 - protein, 19 aa, Entamoeba histolytica
IVRRCHLTMPLCCSGGMLT

SEQ ID NO: 2716333 - protein, 28 aa, Entamoeba histolytica
IVRTTPRVISIHQRLLNEKKPRISSIVK

SEQ ID NO: 2716334 - protein, 18 aa, Entamoeba histolytica
IVRVIALGIKEKKLLECF

SEQ ID NO: 2716335 - protein, 18 aa, Entamoeba histolytica
IVRYIFDIGYWIGKNKGN

SEQ ID NO: 2716336 - protein, 24 aa, Entamoeba histolytica
IVSKNAYVLYYIRKDIDQQTNINT

SEQ ID NO: 2716337 - protein, 17 aa, Entamoeba histolytica
IVSTPFESSPKFIPLMN

SEQ ID NO: 2716338 - protein, 27 aa, Entamoeba histolytica
IVTEELYLHPSIFQKYLVTPANKYVAA

SEQ ID NO: 2716339 - protein, 25 aa, Entamoeba histolytica
IVTKTLAYILLKENIQFIPTNICFI

SEQ ID NO: 2716340 - protein, 18 aa, Entamoeba histolytica
IVTLFTPKENKYSTALEI

SEQ ID NO: 2716341 - protein, 17 aa, Entamoeba histolytica
IVTPLFLDNVNQKYFSK

SEQ ID NO: 2716342 - protein, 20 aa, Entamoeba histolytica
IVTVFRQFHPSTMWASFSYL

SEQ ID NO: 2716343 - protein, 20 aa, Entamoeba histolytica
IVTVKKFRYTKPLIFELENK

SEQ ID NO: 2716344 - protein, 18 aa, Entamoeba histolytica
IVVKRLISAIGYLHSMNI

SEQ ID NO: 2716345 - protein, 17 aa, Entamoeba histolytica
IVVNGMEFSIKNENKIS

SEQ ID NO: 2716346 - protein, 24 aa, Entamoeba histolytica
IVVSQYFCTLLKDLKKENKLYTNI

SEQ ID NO: 2716347 - protein, 23 aa, Entamoeba histolytica
IVVTQQWLSILQSLPEPFRFYNK

SEQ ID NO: 2716348 - protein, 18 aa, Entamoeba histolytica
IVVVVLSGLIRLIPTFNK

SEQ ID NO: 2716349 - protein, 18 aa, Entamoeba histolytica
IVYYVGDFACRYPNLLEG

SEQ ID NO: 2716350 - protein, 27 aa, Entamoeba histolytica
IWCCGVMLFYMSIGMFPFNQEGVNSSL

SEQ ID NO: 2716351 - protein, 19 aa, Entamoeba histolytica
IWKSAIQVLFIINKNKFPL

SEQ ID NO: 2716352 - protein, 29 aa, Entamoeba histolytica
IWQNRFNILIQFPDSIDLLLRAVPWTDYK

SEQ ID NO: 2716353 - protein, 17 aa, Entamoeba histolytica
IWSGNYRFVTSLAIKDI

SEQ ID NO: 2716354 - protein, 17 aa, Entamoeba histolytica
IWSIGVIFFMLVHGHHP

SEQ ID NO: 2716355 - protein, 22 aa, Entamoeba histolytica
IWSIGVILVRMLTGKYPFYSKD

SEQ ID NO: 2716356 - protein, 23 aa, Entamoeba histolytica
IWSIGVITYLVLSGNLPFYDENE

SEQ ID NO: 2716357 - protein, 21 aa, Entamoeba histolytica
IWTNEIWFRNRYEALVQHYCE

SEQ ID NO: 2716358 - protein, 19 aa, Entamoeba histolytica
IWVDGCFDMFHWGHANVIR

SEQ ID NO: 2716359 - protein, 19 aa, Entamoeba histolytica
IYCGITAVIPTMMYAQAIG

SEQ ID NO: 2716360 - protein, 18 aa, Entamoeba histolytica
IYCPIEPHFIPVKKAEDL

SEQ ID NO: 2716361 - protein, 18 aa, Entamoeba histolytica
IYDAFPHCAMLRRHPPPD

SEQ ID NO: 2716362 - protein, 19 aa, Entamoeba histolytica
IYDEHHFAFSFAHKGELSS

SEQ ID NO: 2716363 - protein, 21 aa, Entamoeba histolytica
IYDFDQRIITSIRFEGVYGLN

SEQ ID NO: 2716364 - protein, 25 aa, Entamoeba histolytica
IYDIFNTISFMIKYLHSVIMEHSDM

SEQ ID NO: 2716365 - protein, 19 aa, Entamoeba histolytica
IYDKATLISVKRYEKTKKD

SEQ ID NO: 2716366 - protein, 29 aa, Entamoeba histolytica
IYDMLCSYCLPFLFYKQTILFNRDLIIKH

SEQ ID NO: 2716367 - protein, 26 aa, Entamoeba histolytica
IYDNSGDWWMAELNGKRGLVPANFID

SEQ ID NO: 2716368 - protein, 18 aa, Entamoeba histolytica
IYELFNYLDYPFNEQTTQ

SEQ ID NO: 2716369 - protein, 19 aa, Entamoeba histolytica
IYENGIKLLYEIFCLFIRA

SEQ ID NO: 2716370 - protein, 23 aa, Entamoeba histolytica
IYEPQIISEIIIFSMSLTMLPES

SEQ ID NO: 2716371 - protein, 18 aa, Entamoeba histolytica
IYERLLSIEKKQVNIPKA

SEQ ID NO: 2716372 - protein, 24 aa, Entamoeba histolytica
IYESTFVRAVKLISARIEGILDYL

SEQ ID NO: 2716373 - protein, 24 aa, Entamoeba histolytica
IYFNVLNIPYKRVMLFKSKSIIVA

SEQ ID NO: 2716374 - protein, 31 aa, Entamoeba histolytica
IYFSSFVVHYLGALKPLLDFTPRTTISNSIK

SEQ ID NO: 2716375 - protein, 19 aa, Entamoeba histolytica
IYGCSNARFGGCGSVMTVI

SEQ ID NO: 2716376 - protein, 19 aa, Entamoeba histolytica
IYGDKKLLEVIDSKMVGIL

SEQ ID NO: 2716377 - protein, 21 aa, Entamoeba histolytica
IYGGLIAYGSTFFVFSDYCRP

SEQ ID NO: 2716378 - protein, 22 aa, Entamoeba histolytica
IYGIVKIHIPKTQNAILRKSLC

SEQ ID NO: 2716379 - protein, 23 aa, Entamoeba histolytica
IYGQCHFSLPLGSQLHKIVFDGI

SEQ ID NO: 2716380 - protein, 24 aa, Entamoeba histolytica
IYGQPINIPINCSVIFVTKRDYNE

SEQ ID NO: 2716381 - protein, 20 aa, Entamoeba histolytica
IYGYITIKFHYNKFIQMVCI

SEQ ID NO: 2716382 - protein, 26 aa, Entamoeba histolytica
IYGYSLYPLFVTIEYFNGGSLYSLIN

SEQ ID NO: 2716383 - protein, 19 aa, Entamoeba histolytica
IYHHLKSSLLLKYSNSPDL

SEQ ID NO: 2716384 - protein, 26 aa, Entamoeba histolytica
IYIEFLKLVILTKQWSMLKNIILSCV

SEQ ID NO: 2716385 - protein, 18 aa, Entamoeba histolytica
IYIELTPFSEANGLLTPS

SEQ ID NO: 2716386 - protein, 19 aa, Entamoeba histolytica
IYIKYIPECLNPYKEQLMT

SEQ ID NO: 2716387 - protein, 28 aa, Entamoeba histolytica
IYIPSVGIMFDLIPTALTLLESYNIDLI

SEQ ID NO: 2716388 - protein, 18 aa, Entamoeba histolytica
IYIYLPRVTTASQLYKLI

SEQ ID NO: 2716389 - protein, 24 aa, Entamoeba histolytica
IYKDKFRPIIPKAPFQYFGKKYES

SEQ ID NO: 2716390 - protein, 20 aa, Entamoeba histolytica
IYKEFIWGYRLFVSTQEVLF

SEQ ID NO: 2716391 - protein, 17 aa, Entamoeba histolytica
IYKIRYNIIFLNEELNE

SEQ ID NO: 2716392 - protein, 24 aa, Entamoeba histolytica
IYKNIFIGINYLLPSNKLSPVFIK

SEQ ID NO: 2716393 - protein, 23 aa, Entamoeba histolytica
IYKRLIQMFKEINIPYIIAPGEA

SEQ ID NO: 2716394 - protein, 21 aa, Entamoeba histolytica
IYLIGNCEGCFPVMLLVESCR

SEQ ID NO: 2716395 - protein, 18 aa, Entamoeba histolytica
IYLYCFKLDSFICSFATY

SEQ ID NO: 2716396 - protein, 17 aa, Entamoeba histolytica
IYNFKWKEHEINSVACL

SEQ ID NO: 2716397 - protein, 18 aa, Entamoeba histolytica
IYNFLIQDTLIDFSPSAK

SEQ ID NO: 2716398 - protein, 27 aa, Entamoeba histolytica
IYPLGVCFYRILTNKLPFGQTADEVKA

SEQ ID NO: 2716399 - protein, 26 aa, Entamoeba histolytica
IYPQSILQASWILSTAIPYFPDNTVF

SEQ ID NO: 2716400 - protein, 19 aa, Entamoeba histolytica
IYPQYFFTTFGIYNQQFSD

SEQ ID NO: 2716401 - protein, 21 aa, Entamoeba histolytica
IYPVLMMFRSELTLPSMSMIH

SEQ ID NO: 2716402 - protein, 24 aa, Entamoeba histolytica
IYQKLREGILEHLIPYLTQNMKKN

SEQ ID NO: 2716403 - protein, 17 aa, Entamoeba histolytica
IYQQISDFHLLVFCLDY

SEQ ID NO: 2716404 - protein, 21 aa, Entamoeba histolytica
IYRIFSDILYQTIIYKDHRLF

SEQ ID NO: 2716405 - protein, 19 aa, Entamoeba histolytica
IYRILIKTNSFPTLSAFED

SEQ ID NO: 2716406 - protein, 17 aa, Entamoeba histolytica
IYRNDCYIFDTGKQLIV

SEQ ID NO: 2716407 - protein, 25 aa, Entamoeba histolytica
IYRPDILHYTLLTLLDSPLNKAGML

SEQ ID NO: 2716408 - protein, 21 aa, Entamoeba histolytica
IYRVGMYLLSTESFCLPFYWN

SEQ ID NO: 2716409 - protein, 23 aa, Entamoeba histolytica
IYSGYFFHVEFVGEALKSLSTPF

SEQ ID NO: 2716410 - protein, 23 aa, Entamoeba histolytica
IYSHLEQLNKWTKTKGADLIFDS

SEQ ID NO: 2716411 - protein, 19 aa, Entamoeba histolytica
IYSSKSKDLIVGSHNFFIL

SEQ ID NO: 2716412 - protein, 17 aa, Entamoeba histolytica
IYSSYPLNSTTSYNLHP

SEQ ID NO: 2716413 - protein, 26 aa, Entamoeba histolytica
IYSTHKVSFLPLFEPKMFSSKYQIVM

SEQ ID NO: 2716414 - protein, 18 aa, Entamoeba histolytica
IYSTMYLYANGELPSFVS

SEQ ID NO: 2716415 - protein, 24 aa, Entamoeba histolytica
IYTMVEMLIAEYPSIFEMIDKTLE

SEQ ID NO: 2716416 - protein, 25 aa, Entamoeba histolytica
IYTQNAKLFMRIGNAYFKQDKYTEA

SEQ ID NO: 2716417 - protein, 18 aa, Entamoeba histolytica
IYVDGCYDMFHWGHANVI

SEQ ID NO: 2716418 - protein, 18 aa, Entamoeba histolytica
IYVFEVLVSLFKTMKQYK

SEQ ID NO: 2716419 - protein, 20 aa, Entamoeba histolytica
IYVNLFIPHITSIFIETYNS

SEQ ID NO: 2716420 - protein, 21 aa, Entamoeba histolytica
IYVPNFANHQERPQRQPRAEG

SEQ ID NO: 2716421 - protein, 21 aa, Entamoeba histolytica
IYVSTLPVNICRFSPDGTILA

SEQ ID NO: 2716422 - protein, 18 aa, Entamoeba histolytica
IYWDGTCCTLVRSHFQKS

SEQ ID NO: 2716423 - protein, 26 aa, Entamoeba histolytica
IYWNVLSLLNQVNIFFLINAELLNRY

SEQ ID NO: 2716424 - protein, 25 aa, Entamoeba histolytica
IYYNNQLNKYYISMLPHVICEDFET

SEQ ID NO: 2716425 - protein, 20 aa, Entamoeba histolytica
KACLEPMIKAFRLACYKFPG

SEQ ID NO: 2716426 - protein, 19 aa, Entamoeba histolytica
KADQHVFLALSFAGKSNPG

SEQ ID NO: 2716427 - protein, 20 aa, Entamoeba histolytica
KADQLLIWQPPNTHIMKINL

SEQ ID NO: 2716428 - protein, 24 aa, Entamoeba histolytica
KADRKYVVMIFNDSIIIIKEQQEE

SEQ ID NO: 2716429 - protein, 25 aa, Entamoeba histolytica
KAECLMNFKWRQGLILTNDIFSIKN

SEQ ID NO: 2716430 - protein, 25 aa, Entamoeba histolytica
KAEGLKICLILKTDLAKTYDLTEVK

SEQ ID NO: 2716431 - protein, 50 aa, Entamoeba histolytica
KAEKLFKPYEEIKIQLFIESVRRKVYFTTTTLLMNKLNGKDFTKKEAKML

SEQ ID NO: 2716432 - protein, 25 aa, Entamoeba histolytica
KAELKPKIFVIPLGTGNDLSHCTGW

SEQ ID NO: 2716433 - protein, 30 aa, Entamoeba histolytica; identical to SEQ ID NO: 2528676

SEQ ID NO: 2716434 - protein, 18 aa, Entamoeba histolytica
KAFIFQLDCFEDMHFWLN

SEQ ID NO: 2716435 - protein, 24 aa, Entamoeba histolytica
KAFRYRIVLSTLLGQTIRITSIRE

SEQ ID NO: 2716436 - protein, 19 aa, Entamoeba histolytica
KAFWEERYDYFILLDKIQK

SEQ ID NO: 2716437 - protein, 37 aa, Entamoeba histolytica
KAGFKYRIQTEKPLFPLFLCDAGLIIISRFPIVENQF

SEQ ID NO: 2716438 - protein, 35 aa, Entamoeba histolytica; identical to SEQ ID NO: 2528683

SEQ ID NO: 2716439 - protein, 26 aa, Entamoeba histolytica
KAGKRAGNFLDFLRATEGMVHDYEQR

SEQ ID NO: 2716440 - protein, 20 aa, Entamoeba histolytica
KAGKWDVPLPKVKPIAESEV

SEQ ID NO: 2716441 - protein, 24 aa, Entamoeba histolytica
KAGRIVMELFNDIVPKTAENFRCL

SEQ ID NO: 2716442 - protein, 36 aa, Entamoeba histolytica
KAHASKCRGFCGYTCIDCHKSFKTEPEFDAHKQCIT

SEQ ID NO: 2716443 - protein, 18 aa, Entamoeba histolytica
KAHLSNYPIIPNFEQLYN

SEQ ID NO: 2716444 - protein, 25 aa, Entamoeba histolytica
KAISLTVYLVYIPEKNSQLIVHLQN

SEQ ID NO: 2716445 - protein, 19 aa, Entamoeba histolytica
KAIYCPTTSVLDPYEFTIA

SEQ ID NO: 2716446 - protein, 25 aa, Entamoeba histolytica
KAKACLQMDWTKKGNLTPLINRADG

SEQ ID NO: 2716447 - protein, 25 aa, Entamoeba histolytica
KAKAFAIAVEWYRALRSICWSSIQS

SEQ ID NO: 2716448 - protein, 24 aa, Entamoeba histolytica
KAKELLLLAKAMKELKMEYRSILK

SEQ ID NO: 2716449 - protein, 25 aa, Entamoeba histolytica
KAKKEYEVIYFELVQKLISHRRIVR

SEQ ID NO: 2716450 - protein, 24 aa, Entamoeba histolytica
KAKKQVLIDLKKLTPELRGVLKAA

SEQ ID NO: 2716451 - protein, 24 aa, Entamoeba histolytica
KAKLPIVLTPQHHLLFVIQEVLLT

SEQ ID NO: 2716452 - protein, 35 aa, Entamoeba histolytica
KAKSGLFVFIISFEPQELINFKKAIYKHELFGITT

SEQ ID NO: 2716453 - protein, 26 aa, Entamoeba histolytica
KAKTCQLAFDVYIKQLAKTIGGLMVE

SEQ ID NO: 2716454 - protein, 22 aa, Entamoeba histolytica
KALDRTQVFGQYIRIDWDYGFV

SEQ ID NO: 2716455 - protein, 23 aa, Entamoeba histolytica
KALEIIHRIMLDGPQQACTTRTF

SEQ ID NO: 2716456 - protein, 27 aa, Entamoeba histolytica
KALELWYNFYYLFEGIFNHSLNESYEH

SEQ ID NO: 2716457 - protein, 19 aa, Entamoeba histolytica
KALHLINGNIRIVVSPTLM

SEQ ID NO: 2716458 - protein, 18 aa, Entamoeba histolytica
KALIIIDLDGKRLYSKFY

SEQ ID NO: 2716459 - protein, 27 aa, Entamoeba histolytica
KALLVLKQMFKFFPSLINLEPQFIKKV

SEQ ID NO: 2716460 - protein, 20 aa, Entamoeba histolytica
KALPLITELLKNAKRTDDKV

SEQ ID NO: 2716461 - protein, 22 aa, Entamoeba histolytica
KALQRIVFTYLYPRLDINVSMK

SEQ ID NO: 2716462 - protein, 23 aa, Entamoeba histolytica
KALQRIVFTYLYPRLDINVSMKR

SEQ ID NO: 2716463 - protein, 20 aa, Entamoeba histolytica
KAMELSILCDCKVSLMVFKD

SEQ ID NO: 2716464 - protein, 18 aa, Entamoeba histolytica
KAMYSLYFSRRSLEGVFR

SEQ ID NO: 2716465 - protein, 18 aa, Entamoeba histolytica
KAMYWSKLASINGHARAF

SEQ ID NO: 2716466 - protein, 45 aa, Entamoeba histolytica
KANIKDLNIAGLLIPPINFYIPDEPIFPTEFFISCEPKEIARQLT

SEQ ID NO: 2716467 - protein, 29 aa, Entamoeba histolytica
KAPPELVDFLKKCFFFNPEERWSATQLLE

SEQ ID NO: 2716468 - protein, 24 aa, Entamoeba histolytica
KAPSEIIIFCPKKHKFTIRSLKQK

SEQ ID NO: 2716469 - protein, 24 aa, Entamoeba histolytica
KAQKSLYLLLDYYENDNFDQYLNK

SEQ ID NO: 2716470 - protein, 37 aa, Entamoeba histolytica
KAQSIAIPFELWYIEATYTCIIFIKEKMKRIKFVLQL

SEQ ID NO: 2716471 - protein, 28 aa, Entamoeba histolytica
KARKMIAEWGFKFPYELNEYMKIYEKNK

SEQ ID NO: 2716472 - protein, 32 aa, Entamoeba histolytica
KARLLLFKDLLIDKWFMKLFNHWNNTVRQIFH

SEQ ID NO: 2716473 - protein, 20 aa, Entamoeba histolytica
KARLLNLESEIHKRVIGQDE

SEQ ID NO: 2716474 - protein, 35 aa, Entamoeba histolytica
KASGLMDYYYQRLKSWIGLEKYKIILNEKVTSLTN

SEQ ID NO: 2716475 - protein, 36 aa, Entamoeba histolytica
KATDIHSLFDFPKPRQLDFLPYHFLLSVNCVETKPK

SEQ ID NO: 2716476 - protein, 27 aa, Entamoeba histolytica
KATIHFIQIGDYLMKLNNFQSLYGIVQ

SEQ ID NO: 2716477 - protein, 28 aa, Entamoeba histolytica
KATLIKRRVVIALKYFCSDALDECNQGL

SEQ ID NO: 2716478 - protein, 19 aa, Entamoeba histolytica
KATLKFLRPCEIEALKYTC

SEQ ID NO: 2716479 - protein, 24 aa, Entamoeba histolytica
KATMHHICLLRGKLVKYQKMLAPT

SEQ ID NO: 2716480 - protein, 23 aa, Entamoeba histolytica
KATTLFLSRNRTFTRLITFNSHN

SEQ ID NO: 2716481 - protein, 18 aa, Entamoeba histolytica
KATVTKPFLCIEFIEFEE

SEQ ID NO: 2716482 - protein, 37 aa, Entamoeba histolytica; identical to SEQ ID NO: 2528726

SEQ ID NO: 2716483 - protein, 26 aa, Entamoeba histolytica
KAVHFTSRYMYLTLWGDEISNQTQFK

SEQ ID NO: 2716484 - protein, 17 aa, Entamoeba histolytica
KAVLLQQLPLISGDVDK

SEQ ID NO: 2716485 - protein, 25 aa, Entamoeba histolytica
KAVPSLICQFNLRCLEFLKSYISRK

SEQ ID NO: 2716486 - protein, 21 aa, Entamoeba histolytica
KAVRDTYIYCNVDCIKITLRN

SEQ ID NO: 2716487 - protein, 22 aa, Entamoeba histolytica
KAVRDTYIYCNVDCIKITLRNN

SEQ ID NO: 2716488 - protein, 17 aa, Entamoeba histolytica
KAWTFELSMVLVGELNA

SEQ ID NO: 2716489 - protein, 24 aa, Entamoeba histolytica
KAYSDIVYLIAFFDEKRQIQQGLA

SEQ ID NO: 2716490 - protein, 20 aa, Entamoeba histolytica
KCAFELYLNKLYELMKKYSN

SEQ ID NO: 2716491 - protein, 19 aa, Entamoeba histolytica
KCCCFYVSLNHQQLPMKIW

SEQ ID NO: 2716492 - protein, 21 aa, Entamoeba histolytica
KCCPICKFEIIMTSSLKSTKK

SEQ ID NO: 2716493 - protein, 25 aa, Entamoeba histolytica
KCDLWSLGGLLYFLRTHTYPLSANN

SEQ ID NO: 2716494 - protein, 24 aa, Entamoeba histolytica
KCDNIFISLIMKLLYSIVHDVFPI

SEQ ID NO: 2716495 - protein, 27 aa, Entamoeba histolytica
KCELLVRTLIPSLLYRVLCSPTPDIMA

SEQ ID NO: 2716496 - protein, 19 aa, Entamoeba histolytica
KCENFLIEPLPGVSLETVN

SEQ ID NO: 2716497 - protein, 17 aa, Entamoeba histolytica
KCFLQQLALKLLCNVVY

SEQ ID NO: 2716498 - protein, 37 aa, Entamoeba histolytica; identical to SEQ ID NO: 2528743

SEQ ID NO: 2716499 - protein, 17 aa, Entamoeba histolytica
KCGIHYHYIKIKDNEII

SEQ ID NO: 2716500 - protein, 25 aa, Entamoeba histolytica
KCGITHQIFPLFQSNPLFNDNEFHP

SEQ ID NO: 2716501 - protein, 20 aa, Entamoeba histolytica
KCGMIHKNFLKKLGICKIED

SEQ ID NO: 2716502 - protein, 22 aa, Entamoeba histolytica
KCGRCYKFCPYGAIISKSVPCV

SEQ ID NO: 2716503 - protein, 19 aa, Entamoeba histolytica
KCHCFFCWVCMQITNDHQH

SEQ ID NO: 2716504 - protein, 24 aa, Entamoeba histolytica
KCIDALMYVMLIHTYSFNQFKEFI

SEQ ID NO: 2716505 - protein, 18 aa, Entamoeba histolytica
KCIDKQYLSFIFKFFDGL

SEQ ID NO: 2716506 - protein, 33 aa, Entamoeba histolytica
KCIKGYSYILIFLKFNYGNILGIFFQKSLSEFD

SEQ ID NO: 2716507 - protein, 23 aa, Entamoeba histolytica
KCILQAIIFSRLVEKFPTLLEEV

SEQ ID NO: 2716508 - protein, 23 aa, Entamoeba histolytica
KCISRYFQYPRTITIDRFEIPEM

SEQ ID NO: 2716509 - protein, 25 aa, Entamoeba histolytica
KCKAILSYHPTLFKSFKKLVPETRS

SEQ ID NO: 2716510 - protein, 29 aa, Entamoeba histolytica
KCKEFAYQWRIYPEMELFAHWSKDHLPIN

SEQ ID NO: 2716511 - protein, 25 aa, Entamoeba histolytica
KCKEFFEILIRFYESFGLIEDKLTP

SEQ ID NO: 2716512 - protein, 25 aa, Entamoeba histolytica
KCKINKIILYCFQIDSIILNKLTLP

SEQ ID NO: 2716513 - protein, 35 aa, Entamoeba histolytica
KCKQYLIKTMIRYVFKIPFNSLITLLAKESPEHFQ

SEQ ID NO: 2716514 - protein, 18 aa, Entamoeba histolytica
KCKSYCEVVNRLLNIYDS

SEQ ID NO: 2716515 - protein, 20 aa, Entamoeba histolytica
KCLKAIIISNPNLIGFCVDY

SEQ ID NO: 2716516 - protein, 20 aa, Entamoeba histolytica
KCLWERRYSLLKTNPHALAR

SEQ ID NO: 2716517 - protein, 18 aa, Entamoeba histolytica
KCMKYINLALFTPNSNEK

SEQ ID NO: 2716518 - protein, 24 aa, Entamoeba histolytica
KCNEYCIMIDNLCQFLPQDRVSAF

SEQ ID NO: 2716519 - protein, 18 aa, Entamoeba histolytica
KCRHFLTKVRKICQYYFC

SEQ ID NO: 2716520 - protein, 28 aa, Entamoeba histolytica
KCSMTPKYLLLFYMKFMHLIGNICNIQK

SEQ ID NO: 2716521 - protein, 23 aa, Entamoeba histolytica
KCSRKEWELLKMLANKVIMKMVD

SEQ ID NO: 2716522 - protein, 21 aa, Entamoeba histolytica
KCSYRVYVYPFEQSIFDQQTY

SEQ ID NO: 2716523 - protein, 23 aa, Entamoeba histolytica
KCTIKFVFVTPERITQSKSFKEA

SEQ ID NO: 2716524 - protein, 27 aa, Entamoeba histolytica
KCVDLYKDLLNHLIQYGYTNLYIVGAG

SEQ ID NO: 2716525 - protein, 29 aa, Entamoeba histolytica
KCYLHTGPATAIDFFYDCKMNGAISAADF

SEQ ID NO: 2716526 - protein, 24 aa, Entamoeba histolytica
KDALHWGVLRPFDSSYPGIDLYGS

SEQ ID NO: 2716527 - protein, 23 aa, Entamoeba histolytica
KDALNLLRGSYGTIFENFKKVYD

SEQ ID NO: 2716528 - protein, 20 aa, Entamoeba histolytica
KDALSTSQLFYPCMQCADIF

SEQ ID NO: 2716529 - protein, 23 aa, Entamoeba histolytica
KDANEQYWWYKANDEWLIQNEKE

SEQ ID NO: 2716530 - protein, 17 aa, Entamoeba histolytica
KDAWIGVCVAEKIYNES

SEQ ID NO: 2716531 - protein, 18 aa, Entamoeba histolytica
KDCKKLELITLHEGIEYE

SEQ ID NO: 2716532 - protein, 27 aa, Entamoeba histolytica
KDCVQPFPPFLIPSHTQPILPVLAHGP

SEQ ID NO: 2716533 - protein, 38 aa, Entamoeba histolytica
KDDEHIFAYIKTLNQLKWIVILNFFETPIEFILPIDIQ

SEQ ID NO: 2716534 - protein, 17 aa, Entamoeba histolytica
KDDENGVCYWKIPSMYS

SEQ ID NO: 2716535 - protein, 33 aa, Entamoeba histolytica
KDDEPPIVYGFRPYMKEFIRKIDQMESQMFTII

SEQ ID NO: 2716536 - protein, 22 aa, Entamoeba histolytica
KDDFFSKIIAQQQKERKEIQAH

SEQ ID NO: 2716537 - protein, 26 aa, Entamoeba histolytica
KDDFMGKVSWTVPQLFLGQTNFYVLH

SEQ ID NO: 2716538 - protein, 25 aa, Entamoeba histolytica
KDDIIHDMELFGLGSLDKDKINDTL

SEQ ID NO: 2716539 - protein, 23 aa, Entamoeba histolytica
KDDIVLVYRKDGDWWEGEVNGLY

SEQ ID NO: 2716540 - protein, 26 aa, Entamoeba histolytica
KDDQSHLNWLNKFISSTQLQNKQQEE

SEQ ID NO: 2716541 - protein, 25 aa, Entamoeba histolytica
KDDRIRKLVLLIKSILCCYDFHQPA

SEQ ID NO: 2716542 - protein, 25 aa, Entamoeba histolytica
KDEDTSFFILNLSNPLKKGKSVYEC

SEQ ID NO: 2716543 - protein, 22 aa, Entamoeba histolytica
KDEFFLSFMKSLGQYRIFDNSP

SEQ ID NO: 2716544 - protein, 30 aa, Entamoeba histolytica
KDEIYNCVFKWIHFFVMKNVKVVRRKEKED

SEQ ID NO: 2716545 - protein, 20 aa, Entamoeba histolytica
KDFIELNIEWSNGIIVCPLK

SEQ ID NO: 2716546 - protein, 17 aa, Entamoeba histolytica
KDFIISPGYRMLSTEHV

SEQ ID NO: 2716547 - protein, 22 aa, Entamoeba histolytica
KDFIRSFLVIDPNKRLKAVDCL

SEQ ID NO: 2716548 - protein, 27 aa, Entamoeba histolytica
KDFKIILHDIRMFNKPLMIFEKHMKDV

SEQ ID NO: 2716549 - protein, 29 aa, Entamoeba histolytica
KDFLEKQKSYFEDLDTFILEEDIDTGDKD

SEQ ID NO: 2716550 - protein, 25 aa, Entamoeba histolytica
KDGDRILVIDFGGGTLDVACCKIIN

SEQ ID NO: 2716551 - protein, 25 aa, Entamoeba histolytica
KDGFILDKWLIEQRKLRGNVFGKEI

SEQ ID NO: 2716552 - protein, 26 aa, Entamoeba histolytica
KDGIRVINFFELLSGKTLKEKYDLRP

SEQ ID NO: 2716553 - protein, 26 aa, Entamoeba histolytica
KDGKIFKQIIWYDVSYSRYLEEKEEM

SEQ ID NO: 2716554 - protein, 27 aa, Entamoeba histolytica
KDGKIFKQIIWYKVNYSRYLLEKEEMN

SEQ ID NO: 2716555 - protein, 26 aa, Entamoeba histolytica
KDGKIFKQIIWYKVSYSRYLKEKEEM

SEQ ID NO: 2716556 - protein, 26 aa, Entamoeba histolytica
KDGKIFKYVIWYKVNYSRYLKEKNEM

SEQ ID NO: 2716557 - protein, 26 aa, Entamoeba histolytica
KDGKIIKYVIWYKVEYSRYLKEKEEM

SEQ ID NO: 2716558 - protein, 23 aa, Entamoeba histolytica
KDGKKVIILFDKSPININKQTKE

SEQ ID NO: 2716559 - protein, 26 aa, Entamoeba histolytica
KDGQYKITNWKSPKIMCTNEGGVFFV

SEQ ID NO: 2716560 - protein, 26 aa, Entamoeba histolytica
KDGRIIKYVIWYKVEYSKYLEEKEEG

SEQ ID NO: 2716561 - protein, 25 aa, Entamoeba histolytica
KDGTKYEYIILKKTLHPKDEQTEHL

SEQ ID NO: 2716562 - protein, 17 aa, Entamoeba histolytica
KDHIQVGRIQQPTPREF

SEQ ID NO: 2716563 - protein, 28 aa, Entamoeba histolytica
KDHTIIFDCPFYIKNSTLLPLVINDFGT

SEQ ID NO: 2716564 - protein, 24 aa, Entamoeba histolytica
KDIANEMLIILNYSLEWLNKEEGS

SEQ ID NO: 2716565 - protein, 27 aa, Entamoeba histolytica
KDIEDDKLFEIALEKGLQMINGININE

SEQ ID NO: 2716566 - protein, 24 aa, Entamoeba histolytica
KDIHFLVSVVYTLPRLDLDSIKSK

SEQ ID NO: 2716567 - protein, 23 aa, Entamoeba histolytica
KDIIIPCFSFVRDIIHAPIIKHF

SEQ ID NO: 2716568 - protein, 23 aa, Entamoeba histolytica
KDIKGHFIKFPIGFGKDEKASLG

SEQ ID NO: 2716569 - protein, 28 aa, Entamoeba histolytica
KDIKRITSILISLFLDKPSSAARLDPGE

SEQ ID NO: 2716570 - protein, 21 aa, Entamoeba histolytica
KDIKSVFTAVFRLLDIKDQGK

SEQ ID NO: 2716571 - protein, 26 aa, Entamoeba histolytica
KDIKYHPLIVLLFQLLLEDINSTKVK

SEQ ID NO: 2716572 - protein, 21 aa, Entamoeba histolytica
KDILFLIKMLLLKCKICVNNK

SEQ ID NO: 2716573 - protein, 29 aa, Entamoeba histolytica
KDILKSLVETLIPLALKTLKIAFEEYKTV

SEQ ID NO: 2716574 - protein, 18 aa, Entamoeba histolytica
KDILLRISILIKTIQPMA

SEQ ID NO: 2716575 - protein, 18 aa, Entamoeba histolytica
KDILYILAQSKSLWERRI

SEQ ID NO: 2716576 - protein, 21 aa, Entamoeba histolytica
KDINEFIIPSTITKLGNGCFE

SEQ ID NO: 2716577 - protein, 33 aa, Entamoeba histolytica
KDINEMKRLLNEWQYKCMYLSYKNGSVIFTKDI

SEQ ID NO: 2716578 - protein, 18 aa, Entamoeba histolytica
KDIQFIIYQILKAIQYLQ

SEQ ID NO: 2716579 - protein, 19 aa, Entamoeba histolytica
KDIQNWVEPINLYEPKDDI

SEQ ID NO: 2716580 - protein, 22 aa, Entamoeba histolytica
KDKDCIFLEDDPSHFIFSLSNS

SEQ ID NO: 2716581 - protein, 26 aa, Entamoeba histolytica
KDKDMKFYIYFVRAKNIIANDLGGTS

SEQ ID NO: 2716582 - protein, 19 aa, Entamoeba histolytica
KDKIKFILSSKTKVYEANS

SEQ ID NO: 2716583 - protein, 36 aa, Entamoeba histolytica
KDKILKVFQLIKYKEPLIPIIFKAFTQPTNMFNFIC

SEQ ID NO: 2716584 - protein, 25 aa, Entamoeba histolytica
KDKKIKCFFRLEQTLKKKNGFITYI

SEQ ID NO: 2716585 - protein, 23 aa, Entamoeba histolytica
KDKKIWDKLKPKHKKKNGMFGKI

SEQ ID NO: 2716586 - protein, 23 aa, Entamoeba histolytica
KDKLARITGRRNSLEKLSPFLYA

SEQ ID NO: 2716587 - protein, 25 aa, Entamoeba histolytica
KDKNYPFAIGELIYFLKEVISWQFG

SEQ ID NO: 2716588 - protein, 25 aa, Entamoeba histolytica
KDKNYYYFIVVTKPFSIKLVRISCF

SEQ ID NO: 2716589 - protein, 33 aa, Entamoeba histolytica; identical to SEQ ID NO: 2528842

SEQ ID NO: 2716590 - protein, 23 aa, Entamoeba histolytica
KDKRNIMFVITSTSGNVFGSFHS

SEQ ID NO: 2716591 - protein, 24 aa, Entamoeba histolytica
KDKTKIMFDLLFSYVSSIDQQSIP

SEQ ID NO: 2716592 - protein, 20 aa, Entamoeba histolytica
KDKTLLVLSLEIEKVEFKRG

SEQ ID NO: 2716593 - protein, 21 aa, Entamoeba histolytica
KDLFNCITSSLFWNIIKKGLS

SEQ ID NO: 2716594 - protein, 25 aa, Entamoeba histolytica
KDLIDWKGLIPYFFNSFIFNNDTFI

SEQ ID NO: 2716595 - protein, 18 aa, Entamoeba histolytica
KDLILHLITHHEYQRLSW

SEQ ID NO: 2716596 - protein, 24 aa, Entamoeba histolytica
KDLIQLYFNEYGSNLLFFIVEGPV

SEQ ID NO: 2716597 - protein, 23 aa, Entamoeba histolytica
KDLKGQFECYWTYLLNALDFVLH

SEQ ID NO: 2716598 - protein, 25 aa, Entamoeba histolytica
KDLKTIREYLLYCLDLNNDSVNEAL

SEQ ID NO: 2716599 - protein, 17 aa, Entamoeba histolytica
KDLLALSAKIKKAQEKF

SEQ ID NO: 2716600 - protein, 34 aa, Entamoeba histolytica
KDLLTLLSIKDFYLMFMLFFDDDNTKFITQLLSC

SEQ ID NO: 2716601 - protein, 21 aa, Entamoeba histolytica
KDLLVLISGLLRYDTTLRWTC

SEQ ID NO: 2716602 - protein, 25 aa, Entamoeba histolytica
KDLMVINEYLFAPKILCVELAHLDV

SEQ ID NO: 2716603 - protein, 18 aa, Entamoeba histolytica
KDLNKGMTLQRLYEMNLL

SEQ ID NO: 2716604 - protein, 24 aa, Entamoeba histolytica
KDLQDGIILSRYLQIETGKVISNI

SEQ ID NO: 2716605 - protein, 23 aa, Entamoeba histolytica
KDMFKKLVICILVTIKDGVCEQK

SEQ ID NO: 2716606 - protein, 20 aa, Entamoeba histolytica
KDMHYYISLYANPLQKHIKT

SEQ ID NO: 2716607 - protein, 42 aa, Entamoeba histolytica
KDNDFRFELQMKKYIRSDLREVLKINPKIYPSSYPSDPSVFG

SEQ ID NO: 2716608 - protein, 23 aa, Entamoeba histolytica
KDNKIIGLLPNASLLYHTLDYKS

SEQ ID NO: 2716609 - protein, 22 aa, Entamoeba histolytica
KDNLLEYWIINNNGIRICQING

SEQ ID NO: 2716610 - protein, 17 aa, Entamoeba histolytica
KDNLWLNLIDGSVYCGR

SEQ ID NO: 2716611 - protein, 25 aa, Entamoeba histolytica
KDNNTVVLCPSLVHYYEVSIKGKSE

SEQ ID NO: 2716612 - protein, 24 aa, Entamoeba histolytica
KDNQLIVWNVYEKTIKKLKLPNTV

SEQ ID NO: 2716613 - protein, 23 aa, Entamoeba histolytica
KDNTIWMVDPFMMRVVQKYFNDD

SEQ ID NO: 2716614 - protein, 27 aa, Entamoeba histolytica
KDNVKYLMTWVEMNKMRILYDSVIDGS

SEQ ID NO: 2716615 - protein, 17 aa, Entamoeba histolytica
KDPLMKKVLPYLNDLEH

SEQ ID NO: 2716616 - protein, 20 aa, Entamoeba histolytica
KDQETFFKNTVSKMIKRVIE

SEQ ID NO: 2716617 - protein, 22 aa, Entamoeba histolytica
KDQKELWIQLAIELNYEERDDI

SEQ ID NO: 2716618 - protein, 20 aa, Entamoeba histolytica
KDQLILLKIITFLYCSCHNN

SEQ ID NO: 2716619 - protein, 42 aa, Entamoeba histolytica
KDQLSSWMTIIKATVDLVWRVWGAMMSAQPFDPSLFGSVNES

SEQ ID NO: 2716620 - protein, 21 aa, Entamoeba histolytica
KDQWLKQFYLKTVPLIPTFKY

SEQ ID NO: 2716621 - protein, 24 aa, Entamoeba histolytica
KDSDGIILFFDTTIGPSFADLEEY

SEQ ID NO: 2716622 - protein, 27 aa, Entamoeba histolytica
KDSEFNVYFFLNVIIENGFTIVPKDGQ

SEQ ID NO: 2716623 - protein, 34 aa, Entamoeba histolytica
KDSELALTTLQHYLPLFKLADHLKRCYEDGTNTS

SEQ ID NO: 2716624 - protein, 18 aa, Entamoeba histolytica
KDSFRKLINQVRKSKGLP

SEQ ID NO: 2716625 - protein, 32 aa, Entamoeba histolytica
KDSGVLLWQNPYGTIPILSYQGNVKTYPLLLR

SEQ ID NO: 2716626 - protein, 23 aa, Entamoeba histolytica
KDSHIPYRNSKLTELLQNCLGSD

SEQ ID NO: 2716627 - protein, 18 aa, Entamoeba histolytica
KDSKKLTSALILPQERSL

SEQ ID NO: 2716628 - protein, 19 aa, Entamoeba histolytica
KDSLLRDWSLFYLRCIHHM

SEQ ID NO: 2716629 - protein, 24 aa, Entamoeba histolytica
KDSQNLICQLLITKTPNAGMLRLC

SEQ ID NO: 2716630 - protein, 30 aa, Entamoeba histolytica
KDTDTYLPLPFMPKLQILTIRFTQKVIQSL

SEQ ID NO: 2716631 - protein, 25 aa, Entamoeba histolytica
KDTDWDGLLAIIQNIYENELDGCDP

SEQ ID NO: 2716632 - protein, 23 aa, Entamoeba histolytica
KDTLGRMEIFCKEGLKQEKENKE

SEQ ID NO: 2716633 - protein, 24 aa, Entamoeba histolytica
KDTTPVRLVALKGLTDYYLLSGIN

SEQ ID NO: 2716634 - protein, 20 aa, Entamoeba histolytica
KDVFLNNSFNCIVERVINVC

SEQ ID NO: 2716635 - protein, 17 aa, Entamoeba histolytica
KDVFREMVLLPSQIEVT

SEQ ID NO: 2716636 - protein, 20 aa, Entamoeba histolytica
KDVILVGGSTFIPFVQKIAE

SEQ ID NO: 2716637 - protein, 24 aa, Entamoeba histolytica
KDVPIPHFDFKYSSIYYKQLLIDL

SEQ ID NO: 2716638 - protein, 22 aa, Entamoeba histolytica
KDVQIHFACHNWPLYGNEKIVK

SEQ ID NO: 2716639 - protein, 24 aa, Entamoeba histolytica
KDVSLITGLLVQVGNPPSAIFQFW

SEQ ID NO: 2716640 - protein, 24 aa, Entamoeba histolytica
KDYKDILELLFNFEPKKVSCLDID

SEQ ID NO: 2716641 - protein, 25 aa, Entamoeba histolytica
KDYKGCTVYKKIKALPNEGLCQKCH

SEQ ID NO: 2716642 - protein, 24 aa, Entamoeba histolytica
KDYSLLLIHIIKQLKINNNLIVCT

SEQ ID NO: 2716643 - protein, 22 aa, Entamoeba histolytica
KDYYGLLYCNLIANIDISGKYH

SEQ ID NO: 2716644 - protein, 18 aa, Entamoeba histolytica
KEAFVFLHPFNSHFIDQN

SEQ ID NO: 2716645 - protein, 23 aa, Entamoeba histolytica
KEAKTPMRLSLAKIPGIITVSPP

SEQ ID NO: 2716646 - protein, 31 aa, Entamoeba histolytica
KEALQEAVILPIKFPQLFTDKRKPWTGILLF

SEQ ID NO: 2716647 - protein, 24 aa, Entamoeba histolytica
KEASPYFEQFLKLLGERVDMKTYP

SEQ ID NO: 2716648 - protein, 24 aa, Entamoeba histolytica
KEATQRVFLTKVYHRGKNFFGANE

SEQ ID NO: 2716649 - protein, 33 aa, Entamoeba histolytica
KECIFSEIIRYVEKPWYLKFNNSAIYDDNTEDE

SEQ ID NO: 2716650 - protein, 18 aa, Entamoeba histolytica
KECLRKLIVGKKFEAKEC

SEQ ID NO: 2716651 - protein, 21 aa, Entamoeba histolytica
KECPLLVVFDLDDTLIHTHIN

SEQ ID NO: 2716652 - protein, 20 aa, Entamoeba histolytica
KECRIVIKQIFYGLKYLHQN

SEQ ID NO: 2716653 - protein, 36 aa, Entamoeba histolytica
KECYLILLSDFYRSVVLLLFKPYDYTVIPLGKDARN

SEQ ID NO: 2716654 - protein, 24 aa, Entamoeba histolytica
KEDDGLWTVRHGHDFRRRQPKKDR

SEQ ID NO: 2716655 - protein, 21 aa, Entamoeba histolytica
KEDEEFWKALGGKNDNIAKAE

SEQ ID NO: 2716656 - protein, 27 aa, Entamoeba histolytica
KEDHLKLLHFLLVKKKLTTKPENAEVI

SEQ ID NO: 2716657 - protein, 18 aa, Entamoeba histolytica
KEDIGVGLISNPKDKNEH

SEQ ID NO: 2716658 - protein, 22 aa, Entamoeba histolytica
KEDIILIFIEITILLMQNESNF

SEQ ID NO: 2716659 - protein, 29 aa, Entamoeba histolytica
KEDKAIGFIINGVLLKPAFVGITQTELYP

SEQ ID NO: 2716660 - protein, 33 aa, Entamoeba histolytica; identical to SEQ ID NO: 2528931

SEQ ID NO: 2716661 - protein, 23 aa, Entamoeba histolytica
KEDKLFIDGIPEFPVIKATDEIP

SEQ ID NO: 2716662 - protein, 26 aa, Entamoeba histolytica
KEDLEIDPALLLKHAQRVMVDEPEET

SEQ ID NO: 2716663 - protein, 17 aa, Entamoeba histolytica
KEDLVGVEKIRQLYKKC

SEQ ID NO: 2716664 - protein, 20 aa, Entamoeba histolytica
KEDSIALRPSFDNFLKFISG

SEQ ID NO: 2716665 - protein, 25 aa, Entamoeba histolytica
KEDVITPITMNWILYGYRASKNIDG

SEQ ID NO: 2716666 - protein, 26 aa, Entamoeba histolytica
KEDWFDWFRQIAMVFLKESPSQSLCY

SEQ ID NO: 2716667 - protein, 22 aa, Entamoeba histolytica
KEDYLIVSTSNRQLYFERGGIA

SEQ ID NO: 2716668 - protein, 32 aa, Entamoeba histolytica
KEECYNLMHYLFQFPFALLDLNIYKHHTEISS

SEQ ID NO: 2716669 - protein, 18 aa, Entamoeba histolytica
KEEDIRLLFPDELQHWIS

SEQ ID NO: 2716670 - protein, 26 aa, Entamoeba histolytica
KEEDKVYIYVKYTIEIPKLNQNISKR

SEQ ID NO: 2716671 - protein, 24 aa, Entamoeba histolytica
KEEEPIVLLIDPKKRRSLRFYEAM

SEQ ID NO: 2716672 - protein, 24 aa, Entamoeba histolytica
KEEERLQIMKGMNTIEEMLQLEEW

SEQ ID NO: 2716673 - protein, 25 aa, Entamoeba histolytica
KEEEYFHFMNFLSYYELAVLRLCNF

SEQ ID NO: 2716674 - protein, 20 aa, Entamoeba histolytica
KEEFIILMTPIGKCMKNKVI

SEQ ID NO: 2716675 - protein, 31 aa, Entamoeba histolytica
KEEFMDIGCTCTLIYIWEEDNKVYIRSGNVG

SEQ ID NO: 2716676 - protein, 25 aa, Entamoeba histolytica
KEEGNDFFYALSDGVIVKHIINKFY

SEQ ID NO: 2716677 - protein, 20 aa, Entamoeba histolytica
KEEIIPIKKDDIWKVCHVKK

SEQ ID NO: 2716678 - protein, 27 aa, Entamoeba histolytica
KEEIYINIHYTFLFKENQFLSNSIFEF

SEQ ID NO: 2716679 - protein, 26 aa, Entamoeba histolytica
KEEIYNLYPLFDILLGAPEINIREKA

SEQ ID NO: 2716680 - protein, 26 aa, Entamoeba histolytica
KEEKGYQYSLFYNPSLIESPLNTRWN

SEQ ID NO: 2716681 - protein, 25 aa, Entamoeba histolytica
KEEKIVFEKLLAFQQEMLKKDRSKE

SEQ ID NO: 2716682 - protein, 18 aa, Entamoeba histolytica
KEEKLYDYLKQYVAKIQC

SEQ ID NO: 2716683 - protein, 19 aa, Entamoeba histolytica
KEELIGLLVKRFNPQRPEG

SEQ ID NO: 2716684 - protein, 20 aa, Entamoeba histolytica
KEELLAKAQQFKTKMNKFKK

SEQ ID NO: 2716685 - protein, 18 aa, Entamoeba histolytica
KEELLCPLGYIEKNDLLD

SEQ ID NO: 2716686 - protein, 26 aa, Entamoeba histolytica
KEELLEKWKQFQSWLKGKNIFEYNYI

SEQ ID NO: 2716687 - protein, 27 aa, Entamoeba histolytica
KEELSMNIYLVYLYEKRKEIEALNKEM

SEQ ID NO: 2716688 - protein, 28 aa, Entamoeba histolytica
KEENNLYRLLCWTGKDIWACTKPTNNKS

SEQ ID NO: 2716689 - protein, 32 aa, Entamoeba histolytica
KEESFIIGCAIKVGIHLLLERKTKKSESLQKF

SEQ ID NO: 2716690 - protein, 25 aa, Entamoeba histolytica
KEESILGLLMKWVDIELQVFKRFNE

SEQ ID NO: 2716691 - protein, 19 aa, Entamoeba histolytica
KEEWEKQYSDYFSRKKREE

SEQ ID NO: 2716692 - protein, 31 aa, Entamoeba histolytica
KEEWSDWVEKISLVFLKSNPSRILSRCEDIA

SEQ ID NO: 2716693 - protein, 23 aa, Entamoeba histolytica
KEEYLLDTLNLKKTFMVKKRGKT

SEQ ID NO: 2716694 - protein, 23 aa, Entamoeba histolytica
KEFDRFGNIAEIHLPIDKITKKS

SEQ ID NO: 2716695 - protein, 17 aa, Entamoeba histolytica
KEFDYLHLIIYDIYRVE

SEQ ID NO: 2716696 - protein, 27 aa, Entamoeba histolytica
KEFIMNIAHFAILPNPSSLAKAKQFAA

SEQ ID NO: 2716697 - protein, 25 aa, Entamoeba histolytica
KEFKELFEPILMLTKKIVDELDRVY

SEQ ID NO: 2716698 - protein, 24 aa, Entamoeba histolytica
KEFMKPYVMVFVSGLLTISSNESI

SEQ ID NO: 2716699 - protein, 24 aa, Entamoeba histolytica
KEFNKLIELGYFNDTTDLSQNKEV

SEQ ID NO: 2716700 - protein, 33 aa, Entamoeba histolytica
KEFQQNPHFFNAPSIPYLPTTAEKHLKVLNIIK

SEQ ID NO: 2716701 - protein, 24 aa, Entamoeba histolytica
KEFSATACLLDRLPEFYEQKYIEK

SEQ ID NO: 2716702 - protein, 30 aa, Entamoeba histolytica
KEFTDILRRAFMSRMFPSETIKKLGIKHVK

SEQ ID NO: 2716703 - protein, 18 aa, Entamoeba histolytica
KEFVALEFVWEITRKHER

SEQ ID NO: 2716704 - protein, 21 aa, Entamoeba histolytica
KEFVYCIFGRKPQRSIKSMKA

SEQ ID NO: 2716705 - protein, 34 aa, Entamoeba histolytica
KEGDIITVLKKEGDWWLGELKGQQGYFPYNYVSP

SEQ ID NO: 2716706 - protein, 25 aa, Entamoeba histolytica
KEGDLRKVYSACTLAIHLAIQDNSP

SEQ ID NO: 2716707 - protein, 24 aa, Entamoeba histolytica
KEGHKALIFCQTRQMLNIIEQMML

SEQ ID NO: 2716708 - protein, 27 aa, Entamoeba histolytica
KEGIMCKYFFTIFFNDLTIYGTRDIES

SEQ ID NO: 2716709 - protein, 19 aa, Entamoeba histolytica
KEGIVRKSSLLQDTKKPVI

SEQ ID NO: 2716710 - protein, 25 aa, Entamoeba histolytica
KEGLMKAVFVSCSLIKFGVSIENAL

SEQ ID NO: 2716711 - protein, 19 aa, Entamoeba histolytica
KEGLPLPVYDSLKYFKENP

SEQ ID NO: 2716712 - protein, 25 aa, Entamoeba histolytica
KEGNEMIWYFMKYIRESNKINQIKE

SEQ ID NO: 2716713 - protein, 38 aa, Entamoeba histolytica
KEGYILKRWVARYVLVKRNYLIYFVSDKEFSKLTLPTI

SEQ ID NO: 2716714 - protein, 25 aa, Entamoeba histolytica
KEHDNYPYLIILQDPREAKVKLNTV

SEQ ID NO: 2716715 - protein, 26 aa, Entamoeba histolytica
KEHGLIPLVELVFGGRRRRFIINLEN

SEQ ID NO: 2716716 - protein, 25 aa, Entamoeba histolytica
KEHKYSFFVIKRIPILLDDKEKIKK

SEQ ID NO: 2716717 - protein, 17 aa, Entamoeba histolytica
KEHLINRLSLQPKHLEK

SEQ ID NO: 2716718 - protein, 17 aa, Entamoeba histolytica
KEHWNYFSKDTILFAKY

SEQ ID NO: 2716719 - protein, 24 aa, Entamoeba histolytica
KEIAIQNALLLLENFKGKSYDSKE

SEQ ID NO: 2716720 - protein, 25 aa, Entamoeba histolytica
KEIASYHKLLYPGKFKNVFARTQMI

SEQ ID NO: 2716721 - protein, 22 aa, Entamoeba histolytica
KEIEFPPLIRSLNKSTFFDCSS

SEQ ID NO: 2716722 - protein, 32 aa, Entamoeba histolytica
KEIEIITKHIYFFFIKSPLPFISHKLFLVNEM

SEQ ID NO: 2716723 - protein, 21 aa, Entamoeba histolytica
KEIFAKWKTMNSMTPVDAKYK

SEQ ID NO: 2716724 - protein, 18 aa, Entamoeba histolytica
KEIFFTKNRIKLPSIPFK

SEQ ID NO: 2716725 - protein, 34 aa, Entamoeba histolytica
KEIHQTLPHLSGSIIYALLSRFKPDNLNNEIIDK

SEQ ID NO: 2716726 - protein, 24 aa, Entamoeba histolytica
KEIIEIDILYLLISQINRLNHEEI

SEQ ID NO: 2716727 - protein, 24 aa, Entamoeba histolytica
KEIIEYFYRLCSALLRSSCSELNI

SEQ ID NO: 2716728 - protein, 17 aa, Entamoeba histolytica
KEIIKKRYDNRSLLVGF

SEQ ID NO: 2716729 - protein, 19 aa, Entamoeba histolytica
KEIINYFLETIIAYPNFIT

SEQ ID NO: 2716730 - protein, 26 aa, Entamoeba histolytica
KEIKEHPLFVFNIYINSYTPQTVKEK

SEQ ID NO: 2716731 - protein, 23 aa, Entamoeba histolytica
KEIKETMLISSHFIKTLSIEEIN

SEQ ID NO: 2716732 - protein, 24 aa, Entamoeba histolytica
KEIKIKPLDPYFYCSKNYKTVMKG

SEQ ID NO: 2716733 - protein, 22 aa, Entamoeba histolytica
KEILESILSLVINPVTWRDSTT

SEQ ID NO: 2716734 - protein, 21 aa, Entamoeba histolytica
KEILIKINNEKIALKEKMERS

SEQ ID NO: 2716735 - protein, 19 aa, Entamoeba histolytica
KEILILGDKTYKIISELMC

SEQ ID NO: 2716736 - protein, 17 aa, Entamoeba histolytica
KEILPLGKAIGSMQKQY

SEQ ID NO: 2716737 - protein, 25 aa, Entamoeba histolytica
KEINDIINDLWSGVYAAQDIQTVKI

SEQ ID NO: 2716738 - protein, 17 aa, Entamoeba histolytica
KEINFYHTLIKPSHYNT

SEQ ID NO: 2716739 - protein, 26 aa, Entamoeba histolytica
KEINYSIVPFYIPKELYRLTNYIIDH

SEQ ID NO: 2716740 - protein, 23 aa, Entamoeba histolytica
KEIPAIVNVLKPSSEKLSIMDSM

SEQ ID NO: 2716741 - protein, 19 aa, Entamoeba histolytica
KEIPEEFLTLLYQGSEIHP

SEQ ID NO: 2716742 - protein, 26 aa, Entamoeba histolytica
KEIPLSWYHRIIMFTFSNLALTNDKY

SEQ ID NO: 2716743 - protein, 25 aa, Entamoeba histolytica
KEIPNCCFFRCYSLSQINIPNQCTS

SEQ ID NO: 2716744 - protein, 17 aa, Entamoeba histolytica
KEISYEDKFILFKELAI

SEQ ID NO: 2716745 - protein, 19 aa, Entamoeba histolytica
KEIVVNYLTLLIQIDRRFE

SEQ ID NO: 2716746 - protein, 19 aa, Entamoeba histolytica
KEIYEFIHKNYKACGVLSE

SEQ ID NO: 2716747 - protein, 18 aa, Entamoeba histolytica
KEIYFIAQIIEKFEVPKY

SEQ ID NO: 2716748 - protein, 24 aa, Entamoeba histolytica
KEIYRLIDYIIQHYEPNCFVKKDP

SEQ ID NO: 2716749 - protein, 22 aa, Entamoeba histolytica
KEKCLWYLLDNVGISIIYSKTP

SEQ ID NO: 2716750 - protein, 23 aa, Entamoeba histolytica
KEKDNFICFLISFGMTSSPPIWL

SEQ ID NO: 2716751 - protein, 19 aa, Entamoeba histolytica
KEKEEIIQKLNLNKKDEKK

SEQ ID NO: 2716752 - protein, 23 aa, Entamoeba histolytica
KEKEKFIKLYKEAEAATAAVEKA

SEQ ID NO: 2716753 - protein, 33 aa, Entamoeba histolytica
KEKELIINGISYLEIIKIYSSFNVSTVPVIDVN

SEQ ID NO: 2716754 - protein, 18 aa, Entamoeba histolytica
KEKKLSLILDLDGTIVFT

SEQ ID NO: 2716755 - protein, 24 aa, Entamoeba histolytica
KEKKPIMINNLSHVLLIVTNHQYF

SEQ ID NO: 2716756 - protein, 19 aa, Entamoeba histolytica
KEKLAWWLCERQTVTGGLN

SEQ ID NO: 2716757 - protein, 20 aa, Entamoeba histolytica
KEKLFKYLDKFIEVSIEGKN

SEQ ID NO: 2716758 - protein, 17 aa, Entamoeba histolytica
KEKLHPLGLFKNIESLS

SEQ ID NO: 2716759 - protein, 26 aa, Entamoeba histolytica
KEKLKEKKILLQKTKKGQPIMNNIMN

SEQ ID NO: 2716760 - protein, 22 aa, Entamoeba histolytica
KEKLPLLVKVQGHLVLASLIFG

SEQ ID NO: 2716761 - protein, 24 aa, Entamoeba histolytica
KEKQKFRHWFTKKELYTLFDSSQV

SEQ ID NO: 2716762 - protein, 23 aa, Entamoeba histolytica
KEKSFFLFKLNEKSYERLISKTN

SEQ ID NO: 2716763 - protein, 23 aa, Entamoeba histolytica
KEKSSLLGPIGFVSGIVAGVTGV

SEQ ID NO: 2716764 - protein, 27 aa, Entamoeba histolytica
KEKWTRYIEFWVLYARYEEKLQHYENA

SEQ ID NO: 2716765 - protein, 18 aa, Entamoeba histolytica
KEKYDVIKYTRICQFIDA

SEQ ID NO: 2716766 - protein, 25 aa, Entamoeba histolytica
KELADFLFAPKLLKRDFKLSCIETM

SEQ ID NO: 2716767 - protein, 20 aa, Entamoeba histolytica
KELCELLQKSEMKKITEEWS

SEQ ID NO: 2716768 - protein, 23 aa, Entamoeba histolytica
KELDSFVKKHYPYVTSYTRDDST

SEQ ID NO: 2716769 - protein, 27 aa, Entamoeba histolytica
KELELIKANISYLDIIHLYSSCHKTQE

SEQ ID NO: 2716770 - protein, 30 aa, Entamoeba histolytica
KELESFPINILLLDFIQINDPFIQLCIERS

SEQ ID NO: 2716771 - protein, 19 aa, Entamoeba histolytica
KELFLHTMFSFFYEGDSSK

SEQ ID NO: 2716772 - protein, 23 aa, Entamoeba histolytica
KELFVQFLIDNDFICFLCIAIEN

SEQ ID NO: 2716773 - protein, 20 aa, Entamoeba histolytica
KELHIVLSSRIIPELINNIF

SEQ ID NO: 2716774 - protein, 27 aa, Entamoeba histolytica
KELIKKLYNEALLQDLLAENPAIVNER

SEQ ID NO: 2716775 - protein, 19 aa, Entamoeba histolytica
KELILTPGLVMFMNGMAHP

SEQ ID NO: 2716776 - protein, 26 aa, Entamoeba histolytica
KELKELYNILTIPKIPIRDDIKMEKA

SEQ ID NO: 2716777 - protein, 27 aa, Entamoeba histolytica
KELKKDDLWILLPQEYPYSFNSKIYIV

SEQ ID NO: 2716778 - protein, 27 aa, Entamoeba histolytica
KELLLFIRIQWIFIHLCNCKNPYEPNK

SEQ ID NO: 2716779 - protein, 19 aa, Entamoeba histolytica
KELMTETLPLILTTKLTQL

SEQ ID NO: 2716780 - protein, 28 aa, Entamoeba histolytica
KELNSNFKLLPKLILVDVINSFNNFEES

SEQ ID NO: 2716781 - protein, 18 aa, Entamoeba histolytica
KELPQLQLIESRIKIHFQ

SEQ ID NO: 2716782 - protein, 23 aa, Entamoeba histolytica
KELQIILFRIFGGKDSYLPPKVV

SEQ ID NO: 2716783 - protein, 25 aa, Entamoeba histolytica
KELQTSKVIFLPEIHSIPKPTTEEE

SEQ ID NO: 2716784 - protein, 25 aa, Entamoeba histolytica
KELSAYMEVLFNQQVQIEKEADKKK

SEQ ID NO: 2716785 - protein, 26 aa, Entamoeba histolytica
KELSEGVLLAKLLNYLQKDIIDLKSL

SEQ ID NO: 2716786 - protein, 20 aa, Entamoeba histolytica
KELTIQDQQKFWNNFKHNDE

SEQ ID NO: 2716787 - protein, 20 aa, Entamoeba histolytica
KELTIQDQQKYWNNFKHNDE

SEQ ID NO: 2716788 - protein, 19 aa, Entamoeba histolytica
KELTKEYPLLLMSDGWYTI

SEQ ID NO: 2716789 - protein, 18 aa, Entamoeba histolytica
KELTPLMEKYINPIIHSC

SEQ ID NO: 2716790 - protein, 24 aa, Entamoeba histolytica
KELVRGCVGIKRKPNEPILETKRK

SEQ ID NO: 2716791 - protein, 30 aa, Entamoeba histolytica
KELYKLFPTLFTYWISFYEFRKVFIQFILV

SEQ ID NO: 2716792 - protein, 25 aa, Entamoeba histolytica
KELYNGMFLKLVFIIKKCFACDEEE

SEQ ID NO: 2716793 - protein, 17 aa, Entamoeba histolytica
KEMAILCYELYSRGYKR

SEQ ID NO: 2716794 - protein, 26 aa, Entamoeba histolytica
KEMCELFRIDLFGSIVYSILIEKTRK

SEQ ID NO: 2716795 - protein, 18 aa, Entamoeba histolytica
KEMERILSPPSYIEDLNR

SEQ ID NO: 2716796 - protein, 57 aa, Entamoeba histolytica
KEMEVNGIKVKLQIWDTAGQERFATLSSNYFRNAMGGVIMFDVSNRQSFENVSNWID

SEQ ID NO: 2716797 - protein, 29 aa, Entamoeba histolytica
KEMGFNEPIGYHQILYPKTTDVTNILNFL

SEQ ID NO: 2716798 - protein, 24 aa, Entamoeba histolytica
KEMGINYIIRLIYDEYPNTRYAAF

SEQ ID NO: 2716799 - protein, 23 aa, Entamoeba histolytica
KEMKRRIWYARHSEPYFEDENEG

SEQ ID NO: 2716800 - protein, 26 aa, Entamoeba histolytica
KEMRQTFPQCFWCDPTAFFTDGPLMN

SEQ ID NO: 2716801 - protein, 23 aa, Entamoeba histolytica
KEMTMPVPCFNVINGGAHAGNAL

SEQ ID NO: 2716802 - protein, 40 aa, Entamoeba histolytica
KEMTQLPIQNFKTDWRDGYAMKFIFADDHPFELFSQFGIT

SEQ ID NO: 2716803 - protein, 26 aa, Entamoeba histolytica
KEMVVYIKQYHTTGLTWNPKGGVASA

SEQ ID NO: 2716804 - protein, 19 aa, Entamoeba histolytica
KEMYLSYLIGIIHGSLNSR

SEQ ID NO: 2716805 - protein, 19 aa, Entamoeba histolytica
KEMYYSITGTKPSIRVGEK

SEQ ID NO: 2716806 - protein, 32 aa, Entamoeba histolytica; identical to SEQ ID NO: 2529067

SEQ ID NO: 2716807 - protein, 23 aa, Entamoeba histolytica
KENCFFINFDKKGNVFGAFMKEN

SEQ ID NO: 2716808 - protein, 17 aa, Entamoeba histolytica
KENGHYLCHIIKKYHLK

SEQ ID NO: 2716809 - protein, 24 aa, Entamoeba histolytica
KENGIIVLKYILSDKFLNFFQPGE

SEQ ID NO: 2716810 - protein, 37 aa, Entamoeba histolytica
KENIETRIYYQVIKKYLDFLFKMKRINMITAQNIIDN

SEQ ID NO: 2716811 - protein, 19 aa, Entamoeba histolytica
KENIFDEKQFFNGPQLDKD

SEQ ID NO: 2716812 - protein, 23 aa, Entamoeba histolytica
KENIMLLVITESGDIFGCYDQTL

SEQ ID NO: 2716813 - protein, 19 aa, Entamoeba histolytica
KENISEDIFLVSISPIEGN

SEQ ID NO: 2716814 - protein, 21 aa, Entamoeba histolytica
KENKALFSLIPYASKVCIKRT

SEQ ID NO: 2716815 - protein, 24 aa, Entamoeba histolytica
KENKDLHELIIPKHIKRLGKFSFK

SEQ ID NO: 2716816 - protein, 26 aa, Entamoeba histolytica
KENKTIRILEYYGYDDNVWKESSSEE

SEQ ID NO: 2716817 - protein, 23 aa, Entamoeba histolytica
KENKYGLPLLPKENFEAIFTELG

SEQ ID NO: 2716818 - protein, 23 aa, Entamoeba histolytica
KENNVYAQFYIRDEYFVERKIDL

SEQ ID NO: 2716819 - protein, 24 aa, Entamoeba histolytica
KENPRFWHNILPEIRGCSEETTTG

SEQ ID NO: 2716820 - protein, 24 aa, Entamoeba histolytica
KENSPIFIQFLEIVVMLIKKYPNA

SEQ ID NO: 2716821 - protein, 17 aa, Entamoeba histolytica
KENYRCVIPLGVDPAKY

SEQ ID NO: 2716822 - protein, 20 aa, Entamoeba histolytica
KEPFADLLRGSLQNFLNAIT

SEQ ID NO: 2716823 - protein, 31 aa, Entamoeba histolytica
KEPICKDLIRLIELFKLRYNYLKKSSNEDKI

SEQ ID NO: 2716824 - protein, 22 aa, Entamoeba histolytica
KEPKFILVTSLRNIIDSLNESD

SEQ ID NO: 2716825 - protein, 18 aa, Entamoeba histolytica
KEPLLEVDYLFNEWPLEC

SEQ ID NO: 2716826 - protein, 32 aa, Entamoeba histolytica
KEQAIYCIGTIIKKFISILPFDSLKESFDELI

SEQ ID NO: 2716827 - protein, 19 aa, Entamoeba histolytica
KEQGILRHVFWDCYDIQLI

SEQ ID NO: 2716828 - protein, 22 aa, Entamoeba histolytica
KEQHIPFRDCKLTSILKNSMLQ

SEQ ID NO: 2716829 - protein, 19 aa, Entamoeba histolytica
KEQLLLHRQRLKEMIESAE

SEQ ID NO: 2716830 - protein, 20 aa, Entamoeba histolytica
KEQLQMCFELVKENMFSLDS

SEQ ID NO: 2716831 - protein, 23 aa, Entamoeba histolytica
KEQPVEMNLIDFIGKESTTEEDE

SEQ ID NO: 2716832 - protein, 30 aa, Entamoeba histolytica
KEQYKVFSKVWPCNLLPPSLPTPNIEYEEI

SEQ ID NO: 2716833 - protein, 23 aa, Entamoeba histolytica
KEQYSLALNYLKKAMTLAEQDGL

SEQ ID NO: 2716834 - protein, 17 aa, Entamoeba histolytica
KERAYQAIFNLTKYLRK

SEQ ID NO: 2716835 - protein, 24 aa, Entamoeba histolytica
KERDKMILFLFLEKKTDEINVNET

SEQ ID NO: 2716836 - protein, 30 aa, Entamoeba histolytica
KEREEEKKPILPKYLIKKIERQEEIKKERA

SEQ ID NO: 2716837 - protein, 20 aa, Entamoeba histolytica
KERFVVVKNSYLFYFVSEKS

SEQ ID NO: 2716838 - protein, 21 aa, Entamoeba histolytica
KERIFIKEYIDFKPSTGKKML

SEQ ID NO: 2716839 - protein, 20 aa, Entamoeba histolytica
KERLDILNKFKLKDINCIGM

SEQ ID NO: 2716840 - protein, 25 aa, Entamoeba histolytica
KERLKQLALERIDLSKDPYFYKTHV

SEQ ID NO: 2716841 - protein, 26 aa, Entamoeba histolytica
KERNEELIKELLTMKQAAVEMQDAVN

SEQ ID NO: 2716842 - protein, 38 aa, Entamoeba histolytica
KERNLGKEQYNFLNKILFKLNLNKQSKTFDAIIISHWD

SEQ ID NO: 2716843 - protein, 23 aa, Entamoeba histolytica
KERNYVFIQSLHSLPFPVQREFV

SEQ ID NO: 2716844 - protein, 18 aa, Entamoeba histolytica
KESFLLFDGDGDGYLTLN

SEQ ID NO: 2716845 - protein, 21 aa, Entamoeba histolytica
KESFNYLIYTQLKKSNIHFTK

SEQ ID NO: 2716846 - protein, 24 aa, Entamoeba histolytica
KESKLSLIRPIYIYLGCCVKKDFH

SEQ ID NO: 2716847 - protein, 21 aa, Entamoeba histolytica
KESPDLLYIYLRNGRICVHIN

SEQ ID NO: 2716848 - protein, 24 aa, Entamoeba histolytica
KESQLPRLLTSDPISKYYGFQRGD

SEQ ID NO: 2716849 - protein, 27 aa, Entamoeba histolytica
KESSNTLIPILPFISKTFSKTLSINES

SEQ ID NO: 2716850 - protein, 17 aa, Entamoeba histolytica
KESVLLPFLVDGRLVHI

SEQ ID NO: 2716851 - protein, 25 aa, Entamoeba histolytica
KESWKAIPTMKLMPVLETALNYEVI

SEQ ID NO: 2716852 - protein, 19 aa, Entamoeba histolytica
KESWLQCIGYDGKIFYVNC

SEQ ID NO: 2716853 - protein, 19 aa, Entamoeba histolytica
KETAFLYFSETNFFAQTGG

SEQ ID NO: 2716854 - protein, 30 aa, Entamoeba histolytica
KETDKIPITFFVLRNELFVPCSYHIASVDV

SEQ ID NO: 2716855 - protein, 29 aa, Entamoeba histolytica
KETEQYIERLPPGTYFTPSSVINKVKSRY

SEQ ID NO: 2716856 - protein, 33 aa, Entamoeba histolytica
KETGYAIKMYPIGNSSWILGAHCCFYIGSKDNS

SEQ ID NO: 2716857 - protein, 26 aa, Entamoeba histolytica
KETHKKRLSFLGRKSFSKRNSTENTG

SEQ ID NO: 2716858 - protein, 18 aa, Entamoeba histolytica
KETIDILKGFYPETIFNE

SEQ ID NO: 2716859 - protein, 32 aa, Entamoeba histolytica
KETMYTELILKFITFYLNLFFSRIELVDEEGW

SEQ ID NO: 2716860 - protein, 26 aa, Entamoeba histolytica
KETNPQLILPTIKRPLTFPSIPTHNN

SEQ ID NO: 2716861 - protein, 24 aa, Entamoeba histolytica
KETRKYLEKMKAFVNLGFDEDMLK

SEQ ID NO: 2716862 - protein, 34 aa, Entamoeba histolytica
KEVDVKMGFLLLKNYLLNLPVPLLSSNVLNKLDM

SEQ ID NO: 2716863 - protein, 34 aa, Entamoeba histolytica
KEVFEKWMTFKPGEYPWLAYIKFEIRIGEIKVAK

SEQ ID NO: 2716864 - protein, 25 aa, Entamoeba histolytica
KEVGELTEFKWKIPYQLIESLGFDG

SEQ ID NO: 2716865 - protein, 24 aa, Entamoeba histolytica
KEVGQFMLATSKSVFLWLCDLNDE

SEQ ID NO: 2716866 - protein, 23 aa, Entamoeba histolytica
KEVGRIVFDKLWHGSYESIDKIE

SEQ ID NO: 2716867 - protein, 25 aa, Entamoeba histolytica
KEVIRRQHEVLLKLKKEREIMENEI

SEQ ID NO: 2716868 - protein, 19 aa, Entamoeba histolytica
KEVMPYTLGFGLVNNGFSV

SEQ ID NO: 2716869 - protein, 26 aa, Entamoeba histolytica
KEVPLPSDIIYFDIPKEILGQSSLSD

SEQ ID NO: 2716870 - protein, 24 aa, Entamoeba histolytica
KEVQQIMFSILTLAKEDLKMACSQ

SEQ ID NO: 2716871 - protein, 25 aa, Entamoeba histolytica
KEVRLIHQWIATLVGQPIRSMREWA

SEQ ID NO: 2716872 - protein, 17 aa, Entamoeba histolytica
KEVVKLDRFVKPESIGF

SEQ ID NO: 2716873 - protein, 18 aa, Entamoeba histolytica
KEVVLIHLKVTKTLLLFD

SEQ ID NO: 2716874 - protein, 26 aa, Entamoeba histolytica
KEVVQYPVEFPDKFRKFGMEPSKGVL

SEQ ID NO: 2716875 - protein, 22 aa, Entamoeba histolytica
KEWGKWRNEKRERKTLLEMYGI

SEQ ID NO: 2716876 - protein, 19 aa, Entamoeba histolytica
KEYFVFTGTTVVKVERVIA

SEQ ID NO: 2716877 - protein, 24 aa, Entamoeba histolytica
KEYKPIEVFLQYLKTYQINYEIIG

SEQ ID NO: 2716878 - protein, 21 aa, Entamoeba histolytica
KEYLIPMIYSFDGMVFDDTLS

SEQ ID NO: 2716879 - protein, 24 aa, Entamoeba histolytica
KEYNARFIWIHREPIEQIKSMVIL

SEQ ID NO: 2716880 - protein, 25 aa, Entamoeba histolytica
KEYSYDEIAIKFRPSWYYNEVSKQL

SEQ ID NO: 2716881 - protein, 27 aa, Entamoeba histolytica
KFCEEGIMLYLMSLIEFPFKDGVDGEC

SEQ ID NO: 2716882 - protein, 18 aa, Entamoeba histolytica
KFDCWEGLFYFLSQIVNT

SEQ ID NO: 2716883 - protein, 25 aa, Entamoeba histolytica
KFDDCDMLLIIGTALVVYPFANLVD

SEQ ID NO: 2716884 - protein, 19 aa, Entamoeba histolytica
KFDFSFNYKQTFDVQVGEV

SEQ ID NO: 2716885 - protein, 19 aa, Entamoeba histolytica
KFDIVVFGLPQHEINSIVH

SEQ ID NO: 2716886 - protein, 26 aa, Entamoeba histolytica
KFDMDLTHTLPILVDLILGLFKNDNI

SEQ ID NO: 2716887 - protein, 21 aa, Entamoeba histolytica
KFDQYVKSGRYSSSGIFTCVG

SEQ ID NO: 2716888 - protein, 17 aa, Entamoeba histolytica
KFDTLIGEGLNESFYLV

SEQ ID NO: 2716889 - protein, 24 aa, Entamoeba histolytica
KFEEYAYFINLYKRIMNDYEEIMK

SEQ ID NO: 2716890 - protein, 19 aa, Entamoeba histolytica
KFEFKKPNLMSKPLKDRMK

SEQ ID NO: 2716891 - protein, 20 aa, Entamoeba histolytica
KFEKVLLRYHGLYWVTMVLV

SEQ ID NO: 2716892 - protein, 19 aa, Entamoeba histolytica
KFELIFAVYATDRLREVKY

SEQ ID NO: 2716893 - protein, 22 aa, Entamoeba histolytica
KFFDELTVVFYKKDWDCFNSVD

SEQ ID NO: 2716894 - protein, 18 aa, Entamoeba histolytica
KFFDIFEILFIQLEPNEV

SEQ ID NO: 2716895 - protein, 22 aa, Entamoeba histolytica
KFFDIPMKVLSFSKLNTLKMAN

SEQ ID NO: 2716896 - protein, 25 aa, Entamoeba histolytica
KFFEDLEILFIDYSEAFPKYVEVLN

SEQ ID NO: 2716897 - protein, 20 aa, Entamoeba histolytica
KFFEIQRIIPDFKPLTHLHV

SEQ ID NO: 2716898 - protein, 19 aa, Entamoeba histolytica
KFFQSIIHLLYDQQQLIDK

SEQ ID NO: 2716899 - protein, 26 aa, Entamoeba histolytica
KFFSNIKRWYYLHPIEHQRTESMGRI

SEQ ID NO: 2716900 - protein, 17 aa, Entamoeba histolytica
KFFVFTCKNSFGIPMTR

SEQ ID NO: 2716901 - protein, 24 aa, Entamoeba histolytica
KFGCSRELFLFSRNILEGSSLKKL

SEQ ID NO: 2716902 - protein, 18 aa, Entamoeba histolytica
KFGIEKIIQGINPLTAVV

SEQ ID NO: 2716903 - protein, 18 aa, Entamoeba histolytica
KFGNQKYDIKKQNYLTLL

SEQ ID NO: 2716904 - protein, 23 aa, Entamoeba histolytica
KFGNVYLVKYKKYDYVCALKVIF

SEQ ID NO: 2716905 - protein, 21 aa, Entamoeba histolytica
KFGSHFDGWFDLKGSPFGNEY

SEQ ID NO: 2716906 - protein, 25 aa, Entamoeba histolytica
KFHAKWNPTCQCVFQTLADIRINDE

SEQ ID NO: 2716907 - protein, 18 aa, Entamoeba histolytica
KFHLEYTLRILPHQQNTG

SEQ ID NO: 2716908 - protein, 22 aa, Entamoeba histolytica
KFIADLYQFFKSLHFKIKEIQK

SEQ ID NO: 2716909 - protein, 18 aa, Entamoeba histolytica
KFICLFPNDFFVSENSGT

SEQ ID NO: 2716910 - protein, 19 aa, Entamoeba histolytica
KFIDWKCIVGKLTVKQRNI

SEQ ID NO: 2716911 - protein, 18 aa, Entamoeba histolytica
KFIFSFVLAISKMVAKLE

SEQ ID NO: 2716912 - protein, 19 aa, Entamoeba histolytica
KFIGLVPLSSRIFPQIFTK

SEQ ID NO: 2716913 - protein, 26 aa, Entamoeba histolytica
KFIHQKIIKQGPIEDLPPSPLPTQSP

SEQ ID NO: 2716914 - protein, 17 aa, Entamoeba histolytica
KFIICDISPVFAKQIRA

SEQ ID NO: 2716915 - protein, 17 aa, Entamoeba histolytica
KFILFTPSKEEALEWQE

SEQ ID NO: 2716916 - protein, 17 aa, Entamoeba histolytica
KFILSSKTKVYEANSLK

SEQ ID NO: 2716917 - protein, 28 aa, Entamoeba histolytica
KFIPKYVELKILPANPFEILDRPGVGEV

SEQ ID NO: 2716918 - protein, 25 aa, Entamoeba histolytica
KFIRGVEIIMFYSQPPPIYHAYNLV

SEQ ID NO: 2716919 - protein, 32 aa, Entamoeba histolytica
KFISDPNHFIFSLKKSIFKPMKWNPIGDNSSN

SEQ ID NO: 2716920 - protein, 21 aa, Entamoeba histolytica
KFITPITFLLPNANGWVAEEI

SEQ ID NO: 2716921 - protein, 35 aa, Entamoeba histolytica
KFITPITIQILPPFTFINKLPLTLSIFITHQSTFL

SEQ ID NO: 2716922 - protein, 18 aa, Entamoeba histolytica
KFIYLSNGSFMQKSGKTE

SEQ ID NO: 2716923 - protein, 23 aa, Entamoeba histolytica
KFKKELPLLLKQYSQPRTSLSKL

SEQ ID NO: 2716924 - protein, 21 aa, Entamoeba histolytica
KFKKLWDYCSMYLSKDVETIK

SEQ ID NO: 2716925 - protein, 18 aa, Entamoeba histolytica
KFKLITRNVLTEYKELLN

SEQ ID NO: 2716926 - protein, 23 aa, Entamoeba histolytica
KFKLYEFNELCLQIAFVEQKVGI

SEQ ID NO: 2716927 - protein, 21 aa, Entamoeba histolytica
KFKNQLGGVMFLCATELTVTE

SEQ ID NO: 2716928 - protein, 25 aa, Entamoeba histolytica
KFKRNLPHVLKQYTPFKLFAKPEKV

SEQ ID NO: 2716929 - protein, 23 aa, Entamoeba histolytica
KFKTQTIPPPIKELIQYLYVNGS

SEQ ID NO: 2716930 - protein, 21 aa, Entamoeba histolytica
KFKVGYNSSLFRKGNYVCIAE

SEQ ID NO: 2716931 - protein, 17 aa, Entamoeba histolytica
KFLCMFFGEIKQIQNSI

SEQ ID NO: 2716932 - protein, 18 aa, Entamoeba histolytica
KFLEKLGFMNVLEQVAKS

SEQ ID NO: 2716933 - protein, 25 aa, Entamoeba histolytica
KFLGFYKVYCGLKEPLRILVDKQFL

SEQ ID NO: 2716934 - protein, 17 aa, Entamoeba histolytica
KFLLQGSNRDTIGIYNE

SEQ ID NO: 2716935 - protein, 21 aa, Entamoeba histolytica
KFLNYQVIYCVRHIPLISEFL

SEQ ID NO: 2716936 - protein, 20 aa, Entamoeba histolytica
KFLRALLTNCHIAQEAAIKA

SEQ ID NO: 2716937 - protein, 17 aa, Entamoeba histolytica
KFLSCFSSAMKVTEESS

SEQ ID NO: 2716938 - protein, 18 aa, Entamoeba histolytica
KFMFTLSVFGACFYDGIR

SEQ ID NO: 2716939 - protein, 17 aa, Entamoeba histolytica
KFMNCMEQFIDSLLIDP

SEQ ID NO: 2716940 - protein, 20 aa, Entamoeba histolytica
KFMNIIRKDWRDSIFFFGSN

SEQ ID NO: 2716941 - protein, 26 aa, Entamoeba histolytica
KFNEYAQFPFFLFREDSVSITMTQCI

SEQ ID NO: 2716942 - protein, 27 aa, Entamoeba histolytica
KFNKSKYHSWRTLFDSCYVSSNNITYS

SEQ ID NO: 2716943 - protein, 30 aa, Entamoeba histolytica
KFNLNECLINKLWFNKLLDIDIKNTLFDDK

SEQ ID NO: 2716944 - protein, 18 aa, Entamoeba histolytica
KFNPIRKTELFNGLQVQR

SEQ ID NO: 2716945 - protein, 17 aa, Entamoeba histolytica
KFNYADGIFMLSPNPKQ

SEQ ID NO: 2716946 - protein, 17 aa, Entamoeba histolytica
KFPFEFINDRTAFKEVC

SEQ ID NO: 2716947 - protein, 17 aa, Entamoeba histolytica
KFPIFAKIRESQILQMQ

SEQ ID NO: 2716948 - protein, 20 aa, Entamoeba histolytica
KFPVVNISQMYIRPGTPAAK

SEQ ID NO: 2716949 - protein, 28 aa, Entamoeba histolytica
KFQEIIQSCIFLPSLQLFTKMSSNNYNK

SEQ ID NO: 2716950 - protein, 23 aa, Entamoeba histolytica
KFQTEIFPLIREGHSITLLCTEE

SEQ ID NO: 2716951 - protein, 21 aa, Entamoeba histolytica
KFRGLWKSYYTNVIAVAYVID

SEQ ID NO: 2716952 - protein, 17 aa, Entamoeba histolytica
KFRKNMYWTIDPAQQFI

SEQ ID NO: 2716953 - protein, 17 aa, Entamoeba histolytica
KFRPSWYYNEVSKQLEW

SEQ ID NO: 2716954 - protein, 20 aa, Entamoeba histolytica
KFSDVYYVYNCIDLIFIHLQ

SEQ ID NO: 2716955 - protein, 21 aa, Entamoeba histolytica
KFSGHYISYCKTPSGGWFRFD

SEQ ID NO: 2716956 - protein, 33 aa, Entamoeba histolytica
KFTDTYQRMVFLWMIWLIMNQHPQVFGFNYNLV

SEQ ID NO: 2716957 - protein, 17 aa, Entamoeba histolytica
KFTEIPACVFKLKNLEI

SEQ ID NO: 2716958 - protein, 18 aa, Entamoeba histolytica
KFTIFHQDYIMREKRFND

SEQ ID NO: 2716959 - protein, 27 aa, Entamoeba histolytica
KFTKWRNYQALQEAFFIGLLNQFATIT

SEQ ID NO: 2716960 - protein, 19 aa, Entamoeba histolytica
KFTLLSCVLFSLIVQKNND

SEQ ID NO: 2716961 - protein, 18 aa, Entamoeba histolytica
KFVFELFNRIQLVDEVTY

SEQ ID NO: 2716962 - protein, 21 aa, Entamoeba histolytica
KFYQIGQCKFGDNCKFLHIKT

SEQ ID NO: 2716963 - protein, 33 aa, Entamoeba histolytica; identical to SEQ ID NO: 2529255

SEQ ID NO: 2716964 - protein, 21 aa, Entamoeba histolytica
KGANFPPYAFVKFTDEKSAGL

SEQ ID NO: 2716965 - protein, 25 aa, Entamoeba histolytica
KGASYTPYFNVLGVILCFDYQKSDT

SEQ ID NO: 2716966 - protein, 32 aa, Entamoeba histolytica
KGATRAFAPLNPVIPDAYKPIGQPAIIGGSMG

SEQ ID NO: 2716967 - protein, 23 aa, Entamoeba histolytica
KGCEKAIGQLLYQLATKLNKGKE

SEQ ID NO: 2716968 - protein, 20 aa, Entamoeba histolytica
KGCFNRCYSLRSIEIPTSVS

SEQ ID NO: 2716969 - protein, 24 aa, Entamoeba histolytica
KGCQKFMMIYQLNSGELFGTYHSV

SEQ ID NO: 2716970 - protein, 25 aa, Entamoeba histolytica
KGDENYLERILLIPMEEERIQVVKI

SEQ ID NO: 2716971 - protein, 24 aa, Entamoeba histolytica
KGDGKSIIWEILKQLRPGMSLERI

SEQ ID NO: 2716972 - protein, 25 aa, Entamoeba histolytica
KGDHIYNIVIPRYTLHPTSFTVGDV

SEQ ID NO: 2716973 - protein, 26 aa, Entamoeba histolytica
KGDKYYQFLKVVYRWLVILINEANKG

SEQ ID NO: 2716974 - protein, 25 aa, Entamoeba histolytica
KGDNGFISCSILVKGIRRVLFVEPK

SEQ ID NO: 2716975 - protein, 23 aa, Entamoeba histolytica
KGDPIQYGIYLHAWRYVIDDEIF

SEQ ID NO: 2716976 - protein, 26 aa, Entamoeba histolytica
KGECWINVYNLKTFKLIHKTPVEDIC

SEQ ID NO: 2716977 - protein, 26 aa, Entamoeba histolytica
KGEGIDSYFKLKANFLAVALKTRTAE

SEQ ID NO: 2716978 - protein, 25 aa, Entamoeba histolytica
KGEHKTEPLLFVLSSPKDQQHKTKS

SEQ ID NO: 2716979 - protein, 25 aa, Entamoeba histolytica
KGEIKHKIAFWKLPVVACEYVNNHL

SEQ ID NO: 2716980 - protein, 19 aa, Entamoeba histolytica
KGEKFRPFLDACFGLEIVG

SEQ ID NO: 2716981 - protein, 23 aa, Entamoeba histolytica
KGEKIPIRIPLRGVPLTPSYNNI

SEQ ID NO: 2716982 - protein, 22 aa, Entamoeba histolytica
KGELPPIDLPHPKRKDMKTTRF

SEQ ID NO: 2716983 - protein, 20 aa, Entamoeba histolytica
KGERRKFLLQGSNRDTIGIY

SEQ ID NO: 2716984 - protein, 20 aa, Entamoeba histolytica
KGETFINGKLSKLVKKNDCC

SEQ ID NO: 2716985 - protein, 25 aa, Entamoeba histolytica
KGFDSFIIDMYFPSKIILTGITQSC

SEQ ID NO: 2716986 - protein, 20 aa, Entamoeba histolytica
KGFFYLVRAVKCFCGKTPDI

SEQ ID NO: 2716987 - protein, 17 aa, Entamoeba histolytica
KGFIELPPGTETKDVSQ

SEQ ID NO: 2716988 - protein, 22 aa, Entamoeba histolytica
KGFNFASMGVTFNGAFKALLEI

SEQ ID NO: 2716989 - protein, 17 aa, Entamoeba histolytica
KGFPKKLEILKKTVIPI

SEQ ID NO: 2716990 - protein, 22 aa, Entamoeba histolytica
KGGATFVVSNFNIFVCPTCSGI

SEQ ID NO: 2716991 - protein, 27 aa, Entamoeba histolytica
KGGELNQYFMKLLKTTQFVVITKDNTE

SEQ ID NO: 2716992 - protein, 20 aa, Entamoeba histolytica
KGGFAVPGFNFNNLEQMQAI

SEQ ID NO: 2716993 - protein, 25 aa, Entamoeba histolytica
KGGIFNIWFNTWFIHDNRLEFSKME

SEQ ID NO: 2716994 - protein, 31 aa, Entamoeba histolytica
KGGKSSVDDDFMAAYLGMQHNRIGGEGVIDL

SEQ ID NO: 2716995 - protein, 24 aa, Entamoeba histolytica
KGGWTFNFLKDSLSFYGFEIHEKK

SEQ ID NO: 2716996 - protein, 23 aa, Entamoeba histolytica
KGHKFYSELLPFCRDNSVIKTVT

SEQ ID NO: 2716997 - protein, 23 aa, Entamoeba histolytica
KGHYVPSFLIQPIQRIPRYVLLL

SEQ ID NO: 2716998 - protein, 18 aa, Entamoeba histolytica
KGIETIVDKKVTTEPIKQ

SEQ ID NO: 2716999 - protein, 24 aa, Entamoeba histolytica
KGIETQLSVLIFLSSKDKKTISRE

SEQ ID NO: 2717000 - protein, 25 aa, Entamoeba histolytica
KGIEYLFYNHLIEVGYKLIIPLCYF

SEQ ID NO: 2717001 - protein, 17 aa, Entamoeba histolytica
KGIFLRNYILDCVKSIL

SEQ ID NO: 2717002 - protein, 17 aa, Entamoeba histolytica
KGIFYVPPQFFNGQISL

SEQ ID NO: 2717003 - protein, 17 aa, Entamoeba histolytica
KGIIPLFSALRNNHLSV

SEQ ID NO: 2717004 - protein, 19 aa, Entamoeba histolytica
KGIKSWLSIALSSAPESTP

SEQ ID NO: 2717005 - protein, 20 aa, Entamoeba histolytica
KGILKEMKYSLHSFYYPVQH

SEQ ID NO: 2717006 - protein, 20 aa, Entamoeba histolytica
KGIQMIFRHGKIGIQQVREM

SEQ ID NO: 2717007 - protein, 36 aa, Entamoeba histolytica
KGISEKSWKLVWVVIKYTFIFVFKSRDDTTLIEIFM

SEQ ID NO: 2717008 - protein, 39 aa, Entamoeba histolytica
KGISFLDVKYSLLFEYNMYLAYYCWIKSSGSNVERHKAI

SEQ ID NO: 2717009 - protein, 30 aa, Entamoeba histolytica; identical to SEQ ID NO: 2529302

SEQ ID NO: 2717010 - protein, 22 aa, Entamoeba histolytica
KGIVFYGFKEAPIHFIPTFKII

SEQ ID NO: 2717011 - protein, 35 aa, Entamoeba histolytica
KGIYKFLPEFLVGLHYNFHTLLYPSNTVLITPVFR

SEQ ID NO: 2717012 - protein, 18 aa, Entamoeba histolytica
KGIYMYRTYKEAIEKNCD

SEQ ID NO: 2717013 - protein, 24 aa, Entamoeba histolytica
KGKALSLLCRMLFVHIVQKAVEKS

SEQ ID NO: 2717014 - protein, 23 aa, Entamoeba histolytica
KGKEIKTIYVKFADKKLRDEKET

SEQ ID NO: 2717015 - protein, 26 aa, Entamoeba histolytica
KGKENILLMAFTKKGYVFGSFHSIIP

SEQ ID NO: 2717016 - protein, 22 aa, Entamoeba histolytica
KGKGAFFEDMAIVVLADGCGLG

SEQ ID NO: 2717017 - protein, 19 aa, Entamoeba histolytica
KGKGFQKSKTKLKRTDFKG

SEQ ID NO: 2717018 - protein, 21 aa, Entamoeba histolytica
KGKPSWSIKSIFLGKKSYLDV

SEQ ID NO: 2717019 - protein, 20 aa, Entamoeba histolytica
KGKRRLINEGKLSLINYDKI

SEQ ID NO: 2717020 - protein, 28 aa, Entamoeba histolytica
KGKVCKSLFMKYLRQQPNWNIKVETKVL

SEQ ID NO: 2717021 - protein, 24 aa, Entamoeba histolytica
KGKYHVIGFYCRDFSRVCPREIKE

SEQ ID NO: 2717022 - protein, 20 aa, Entamoeba histolytica
KGLCASTLYYWIKSSEHKTS

SEQ ID NO: 2717023 - protein, 24 aa, Entamoeba histolytica
KGLCGIIFMNIPFYQSTKFIDQLD

SEQ ID NO: 2717024 - protein, 22 aa, Entamoeba histolytica
KGLEILKEVYLFPITKSTNSES

SEQ ID NO: 2717025 - protein, 18 aa, Entamoeba histolytica
KGLEKRLPDIKKYFPENC

SEQ ID NO: 2717026 - protein, 19 aa, Entamoeba histolytica
KGLFDLFSRIKHTTSEEKK

SEQ ID NO: 2717027 - protein, 20 aa, Entamoeba histolytica
KGLFNITCATTSMPPLYQAR

SEQ ID NO: 2717028 - protein, 25 aa, Entamoeba histolytica
KGLKALVMCTNLFLTKLLQTDTPRV

SEQ ID NO: 2717029 - protein, 22 aa, Entamoeba histolytica
KGLKNVLCIKVTQIGSVFGYFH

SEQ ID NO: 2717030 - protein, 40 aa, Entamoeba histolytica; identical to SEQ ID NO: 2529322

SEQ ID NO: 2717031 - protein, 27 aa, Entamoeba histolytica
KGLNCAFGRWPVKSAQFILKLLKNAVD

SEQ ID NO: 2717032 - protein, 23 aa, Entamoeba histolytica
KGLNEFIQITLKMFCGAIGKGKG

SEQ ID NO: 2717033 - protein, 19 aa, Entamoeba histolytica
KGLNFGVVLIPEGLVEFIP

SEQ ID NO: 2717034 - protein, 17 aa, Entamoeba histolytica
KGLNKIICWLKKTENTE

SEQ ID NO: 2717035 - protein, 24 aa, Entamoeba histolytica
KGLNLCLFETIFNWRQVNGLKHDD

SEQ ID NO: 2717036 - protein, 25 aa, Entamoeba histolytica
KGLVKPSMYFVLENTIENLSQLSLY

SEQ ID NO: 2717037 - protein, 28 aa, Entamoeba histolytica
KGLYNDIDHFLFVLRKKGVSDVRKFTRK

SEQ ID NO: 2717038 - protein, 26 aa, Entamoeba histolytica
KGLYSTSFLNSFLNKEKENNLKKSVI

SEQ ID NO: 2717039 - protein, 29 aa, Entamoeba histolytica
KGMKKFDIEQPERAFWLGNQTVNYSFEYN

SEQ ID NO: 2717040 - protein, 26 aa, Entamoeba histolytica
KGMNNFDRIILYFHDKRVDGSLTFSQ

SEQ ID NO: 2717041 - protein, 18 aa, Entamoeba histolytica
KGMSTLSSMWKQLPEEDK

SEQ ID NO: 2717042 - protein, 31 aa, Entamoeba histolytica
KGNEGLLMPYLCCILQRIYVLSSSYLEDVVT

SEQ ID NO: 2717043 - protein, 24 aa, Entamoeba histolytica
KGNIDLFHFIITSSNPILKEYLTH

SEQ ID NO: 2717044 - protein, 31 aa, Entamoeba histolytica
KGNKIMWLHTPVCTLILNNLLRPGSWEVIER

SEQ ID NO: 2717045 - protein, 18 aa, Entamoeba histolytica
KGNNIKPMKDRWITIKNV

SEQ ID NO: 2717046 - protein, 24 aa, Entamoeba histolytica
KGNTPFIRLYQSYVLNWCNRYLDE

SEQ ID NO: 2717047 - protein, 17 aa, Entamoeba histolytica
KGNVSGLTEYMSRLLRA

SEQ ID NO: 2717048 - protein, 21 aa, Entamoeba histolytica
KGPELLTMWFGESEANVRNIF

SEQ ID NO: 2717049 - protein, 38 aa, Entamoeba histolytica
KGQEKYTHFYPVTYEQPKLNIIKKRKLSIGRVESEVNV

SEQ ID NO: 2717050 - protein, 26 aa, Entamoeba histolytica
KGQKFNRIHSFLYSGYWGNIIARLDN

SEQ ID NO: 2717051 - protein, 17 aa, Entamoeba histolytica
KGQLHVLYQPDGRPRNV

SEQ ID NO: 2717052 - protein, 26 aa, Entamoeba histolytica
KGQLTSWDYSFFDLDQQKLFELIIAA

SEQ ID NO: 2717053 - protein, 17 aa, Entamoeba histolytica
KGQYEIILSGSFFLDEN

SEQ ID NO: 2717054 - protein, 32 aa, Entamoeba histolytica; identical to SEQ ID NO: 2529347

SEQ ID NO: 2717055 - protein, 20 aa, Entamoeba histolytica
KGRELLIEKKWPIGNIKFET

SEQ ID NO: 2717056 - protein, 21 aa, Entamoeba histolytica
KGRIITTLQLLELLLDFFAQN

SEQ ID NO: 2717057 - protein, 18 aa, Entamoeba histolytica
KGSIWDLLHQRPMEFFEI

SEQ ID NO: 2717058 - protein, 24 aa, Entamoeba histolytica
KGSIYQFQLFIIDCYREQLEKAKD

SEQ ID NO: 2717059 - protein, 23 aa, Entamoeba histolytica
KGSKSWVFGIEKGFWIHSKQNKS

SEQ ID NO: 2717060 - protein, 25 aa, Entamoeba histolytica
KGSKYYRELIPRPLFEEYFNNIKKL

SEQ ID NO: 2717061 - protein, 22 aa, Entamoeba histolytica
KGSLFHLINLQRKFINNIFDHI

SEQ ID NO: 2717062 - protein, 22 aa, Entamoeba histolytica
KGSPFTPEILPGITAGNCVVSG

SEQ ID NO: 2717063 - protein, 23 aa, Entamoeba histolytica
KGSQWYSSLTFLKRLSCFSDKEI

SEQ ID NO: 2717064 - protein, 26 aa, Entamoeba histolytica
KGSSILILPHFFKKIIQDQTLFSLFN

SEQ ID NO: 2717065 - protein, 23 aa, Entamoeba histolytica
KGTKYLFVQVSDGTTFCSCYLDC

SEQ ID NO: 2717066 - protein, 21 aa, Entamoeba histolytica
KGTWELMMDCYKENTITAKEE

SEQ ID NO: 2717067 - protein, 18 aa, Entamoeba histolytica
KGVAYQSGWFKPVGGILE

SEQ ID NO: 2717068 - protein, 24 aa, Entamoeba histolytica
KGVFFSSRWTPYRRAENKLLEEHY

SEQ ID NO: 2717069 - protein, 18 aa, Entamoeba histolytica
KGVQAIVIVLNYNNKKLS

SEQ ID NO: 2717070 - protein, 26 aa, Entamoeba histolytica
KGVSRTIVLIGYKPKRFSDKVLGEVE

SEQ ID NO: 2717071 - protein, 21 aa, Entamoeba histolytica
KGVTVAYEFKRFIGKSFDDKV

SEQ ID NO: 2717072 - protein, 33 aa, Entamoeba histolytica; identical to SEQ ID NO: 2529364

SEQ ID NO: 2717073 - protein, 31 aa, Entamoeba histolytica
KGYDFHTWKKRYFIIKNEFIYYFSSANPTST

SEQ ID NO: 2717074 - protein, 27 aa, Entamoeba histolytica
KGYDPIFMDLIDHLLQLNPKSRFTADE

SEQ ID NO: 2717075 - protein, 25 aa, Entamoeba histolytica
KGYGDFVIIRGWRSIGSFDSEAANS

SEQ ID NO: 2717076 - protein, 21 aa, Entamoeba histolytica
KGYIIFHLDNGKYVQDITSDS

SEQ ID NO: 2717077 - protein, 22 aa, Entamoeba histolytica
KGYIPFIGVIIQDLTFIDEGNP

SEQ ID NO: 2717078 - protein, 17 aa, Entamoeba histolytica
KGYKSFFQKRYFQFLLS

SEQ ID NO: 2717079 - protein, 19 aa, Entamoeba histolytica
KGYLITLQASSYLPLLKYC

SEQ ID NO: 2717080 - protein, 21 aa, Entamoeba histolytica
KGYMKQLLIGIQYLHSIGIVH

SEQ ID NO: 2717081 - protein, 20 aa, Entamoeba histolytica
KGYYHLLKEKVEGISPHFIF

SEQ ID NO: 2717082 - protein, 18 aa, Entamoeba histolytica
KHAIAYGLVMTQLKHMKK

SEQ ID NO: 2717083 - protein, 20 aa, Entamoeba histolytica
KHCVALFEFMATAATLDNEI

SEQ ID NO: 2717084 - protein, 18 aa, Entamoeba histolytica
KHDELFKWWREMKREQRM

SEQ ID NO: 2717085 - protein, 30 aa, Entamoeba histolytica; identical to SEQ ID NO: 2529373

SEQ ID NO: 2717086 - protein, 26 aa, Entamoeba histolytica
KHEIMEVWHFIRLTGTTAFISDDFNE

SEQ ID NO: 2717087 - protein, 26 aa, Entamoeba histolytica
KHEPKQYISLAPILYEIIKEPINQNN

SEQ ID NO: 2717088 - protein, 31 aa, Entamoeba histolytica
KHFDIALEINPIYQRLWFALGICCMQISDIA

SEQ ID NO: 2717089 - protein, 25 aa, Entamoeba histolytica
KHFEILKAILPLRNQKDPKVKKFVY

SEQ ID NO: 2717090 - protein, 18 aa, Entamoeba histolytica
KHFENKVALYLINQLPFV

SEQ ID NO: 2717091 - protein, 25 aa, Entamoeba histolytica
KHFNNLCLRFHFFQSILNKVIVNSD

SEQ ID NO: 2717092 - protein, 18 aa, Entamoeba histolytica
KHFPGIPTPLKKCEIDVL

SEQ ID NO: 2717093 - protein, 33 aa, Entamoeba histolytica; identical to SEQ ID NO: 2529378

SEQ ID NO: 2717094 - protein, 18 aa, Entamoeba histolytica
KHGKKKLKKIPTPSSIEE

SEQ ID NO: 2717095 - protein, 17 aa, Entamoeba histolytica
KHGMEVFGVKRPVSWIL

SEQ ID NO: 2717096 - protein, 20 aa, Entamoeba histolytica
KHHLLIELTSLRIQVKQQEE

SEQ ID NO: 2717097 - protein, 27 aa, Entamoeba histolytica
KHHRELMAELYFLFAQTLLKCYVDNKC

SEQ ID NO: 2717098 - protein, 23 aa, Entamoeba histolytica
KHHRFIEFFDLRSAEKALKTMNK

SEQ ID NO: 2717099 - protein, 41 aa, Entamoeba histolytica
KHIKEIIYCQVIEPMKIFIEEWKVYYKRINIMKNRKIDMDR

SEQ ID NO: 2717100 - protein, 17 aa, Entamoeba histolytica
KHIKPIVEFGGIEPNPS

SEQ ID NO: 2717101 - protein, 25 aa, Entamoeba histolytica
KHIQPNYILMNLPATAIEFLDCIPE

SEQ ID NO: 2717102 - protein, 18 aa, Entamoeba histolytica
KHIWRCTGPCRNKPPFYG

SEQ ID NO: 2717103 - protein, 27 aa, Entamoeba histolytica
KHKFHPKLIFRLYKGVPCNKRKDLWKV

SEQ ID NO: 2717104 - protein, 34 aa, Entamoeba histolytica
KHKTISEIVRFAPPLSIIIIKPGTYEETEPIVVD

SEQ ID NO: 2717105 - protein, 18 aa, Entamoeba histolytica
KHLLLPYCESFIKNVLNQ

SEQ ID NO: 2717106 - protein, 26 aa, Entamoeba histolytica
KHLNKKYLIQMIILEKEIIVVIQYKN

SEQ ID NO: 2717107 - protein, 19 aa, Entamoeba histolytica
KHLYLIFEYCNTDLHKFLK

SEQ ID NO: 2717108 - protein, 35 aa, Entamoeba histolytica; identical to SEQ ID NO: 2529388

SEQ ID NO: 2717109 - protein, 27 aa, Entamoeba histolytica
KHNQINFIIIFIITYSNTNILNQMDYN

SEQ ID NO: 2717110 - protein, 24 aa, Entamoeba histolytica
KHNQLRELALWNGTFREDRVYEVE

SEQ ID NO: 2717111 - protein, 22 aa, Entamoeba histolytica
KHPDYVYFNYKTSFYVSVIFDG

SEQ ID NO: 2717112 - protein, 17 aa, Entamoeba histolytica
KHPFESFTFMTSLIGEI

SEQ ID NO: 2717113 - protein, 34 aa, Entamoeba histolytica
KHPFIVHLEWDFETPFYYIFVMTYCAGGDFWRLL

SEQ ID NO: 2717114 - protein, 23 aa, Entamoeba histolytica
KHPLDYFFVVSKTCPLLKCEKQL

SEQ ID NO: 2717115 - protein, 23 aa, Entamoeba histolytica
KHPMMNKALFKGKVFISCDDRGL

SEQ ID NO: 2717116 - protein, 23 aa, Entamoeba histolytica
KHQILIPIIGNFGVGKTSLLFTF

SEQ ID NO: 2717117 - protein, 17 aa, Entamoeba histolytica
KHQNICMLFKEESQRKE

SEQ ID NO: 2717118 - protein, 29 aa, Entamoeba histolytica
KHQSSHGDLYIYFTVKMPRLQEISMHIDK

SEQ ID NO: 2717119 - protein, 38 aa, Entamoeba histolytica
KHQVLSVFGIKWLKMMFAREFLLADSVIIWDAIFAYGN

SEQ ID NO: 2717120 - protein, 21 aa, Entamoeba histolytica
KHRPLTGWKWIGDCVITLTQM

SEQ ID NO: 2717121 - protein, 25 aa, Entamoeba histolytica
KHSENFFYNYALKKYAQRDKEEMEL

SEQ ID NO: 2717122 - protein, 25 aa, Entamoeba histolytica
KHSLTIYITYSLIGQTYLHSFCFHL

SEQ ID NO: 2717123 - protein, 25 aa, Entamoeba histolytica
KHVKTTSLLYSPLRSFTISHFPSSG

SEQ ID NO: 2717124 - protein, 31 aa, Entamoeba histolytica
KHYFETEFGFIPLVYPIPKEYRKQEYKFFVF

SEQ ID NO: 2717125 - protein, 17 aa, Entamoeba histolytica
KHYLEKRILVKIHGKRS

SEQ ID NO: 2717126 - protein, 22 aa, Entamoeba histolytica
KHYRDSFILGLFDALSGHVSST

SEQ ID NO: 2717127 - protein, 25 aa, Entamoeba histolytica
KHYTKLYISLISLLFEIGTKEQTDI

SEQ ID NO: 2717128 - protein, 25 aa, Entamoeba histolytica
KIAPSDLAFVIIVPSLNGIMSDVNV

SEQ ID NO: 2717129 - protein, 27 aa, Entamoeba histolytica
KIARYAVGKNVFILDLGNHSTNYITLI

SEQ ID NO: 2717130 - protein, 17 aa, Entamoeba histolytica
KIASLIDRYENNDKKKQ

SEQ ID NO: 2717131 - protein, 28 aa, Entamoeba histolytica
KIATTTTNILFHHLMIEDIFENTQTLSH

SEQ ID NO: 2717132 - protein, 19 aa, Entamoeba histolytica
KIAWILQRKGLGDFVIYVT

SEQ ID NO: 2717133 - protein, 20 aa, Entamoeba histolytica
KICILKGVSPRLPSKGLNTL

SEQ ID NO: 2717134 - protein, 19 aa, Entamoeba histolytica
KICSAFSVLFNIDLTRQCI

SEQ ID NO: 2717135 - protein, 26 aa, Entamoeba histolytica
KIDDSLLSIPLPLRVPTKRTIPITIQ

SEQ ID NO: 2717136 - protein, 24 aa, Entamoeba histolytica
KIDEALLLCLNKLKELTPNPGNDK

SEQ ID NO: 2717137 - protein, 25 aa, Entamoeba histolytica
KIDEYKMTVYLSKILPRFVTDINNE

SEQ ID NO: 2717138 - protein, 20 aa, Entamoeba histolytica
KIDFYLDEFKVKLPLNLNDQ

SEQ ID NO: 2717139 - protein, 24 aa, Entamoeba histolytica
KIDGRTIILITLSLMKKSLCQKEL

SEQ ID NO: 2717140 - protein, 17 aa, Entamoeba histolytica
KIDHLNKLWSTVKPLPG

SEQ ID NO: 2717141 - protein, 21 aa, Entamoeba histolytica
KIDIRSHYPVLNLSHAVGIAL

SEQ ID NO: 2717142 - protein, 26 aa, Entamoeba histolytica
KIDISPNRFLILNITPEFILTLNQLF

SEQ ID NO: 2717143 - protein, 29 aa, Entamoeba histolytica
KIDIWSAGVIIYIILTGRHPFCSNDYKIK

SEQ ID NO: 2717144 - protein, 21 aa, Entamoeba histolytica
KIDLKLCLAPFLDKLPNVSSE

SEQ ID NO: 2717145 - protein, 24 aa, Entamoeba histolytica
KIDLPSCLTYLDVYSFFNCISLHS

SEQ ID NO: 2717146 - protein, 20 aa, Entamoeba histolytica
KIDQIRIKKLLKMRDTIVCQ

SEQ ID NO: 2717147 - protein, 24 aa, Entamoeba histolytica
KIDRTYCVLAYLQRIQILNCFYNG

SEQ ID NO: 2717148 - protein, 21 aa, Entamoeba histolytica
KIEDKLILPSTLKQYAMLITD

SEQ ID NO: 2717149 - protein, 18 aa, Entamoeba histolytica
KIEELQQFLPLEEKEERE

SEQ ID NO: 2717150 - protein, 35 aa, Entamoeba histolytica
KIEFDSLMTPFIPILRFRILKDIKQLPGLYILMLL

SEQ ID NO: 2717151 - protein, 22 aa, Entamoeba histolytica
KIEFLKYIICRYLDVLSSEVYY

SEQ ID NO: 2717152 - protein, 18 aa, Entamoeba histolytica
KIEFYKPTQLSYSYQEKS

SEQ ID NO: 2717153 - protein, 25 aa, Entamoeba histolytica
KIEGKKRITLLPLLSELDIWNQMDV

SEQ ID NO: 2717154 - protein, 23 aa, Entamoeba histolytica
KIEIAQAIYIRWKTKKLINERLL

SEQ ID NO: 2717155 - protein, 18 aa, Entamoeba histolytica
KIEIKDEYGDVIATHYQN

SEQ ID NO: 2717156 - protein, 24 aa, Entamoeba histolytica
KIEIKNPMFIVSLPRSGSTYLHNL

SEQ ID NO: 2717157 - protein, 26 aa, Entamoeba histolytica
KIEKFENYFIIKDYKFGVLYATEGQT

SEQ ID NO: 2717158 - protein, 25 aa, Entamoeba histolytica
KIEKGTILKIIVPYGTYPYEIEVET

SEQ ID NO: 2717159 - protein, 19 aa, Entamoeba histolytica
KIELAKMQGVIYKLEGEKS

SEQ ID NO: 2717160 - protein, 22 aa, Entamoeba histolytica
KIENINIVSLKDYFIALDELED

SEQ ID NO: 2717161 - protein, 24 aa, Entamoeba histolytica
KIENTAIMILPINTTKTILLKELC

SEQ ID NO: 2717162 - protein, 30 aa, Entamoeba histolytica
KIEPLDLLLVQPVQRIMRYPMLIKEVIKQT

SEQ ID NO: 2717163 - protein, 21 aa, Entamoeba histolytica
KIETNPFLDPSLTQQPITTHE

SEQ ID NO: 2717164 - protein, 19 aa, Entamoeba histolytica
KIEVTKDGFKFDFGTNETA

SEQ ID NO: 2717165 - protein, 20 aa, Entamoeba histolytica
KIFDNIVVFVIGTKIIYGVN

SEQ ID NO: 2717166 - protein, 29 aa, Entamoeba histolytica
KIFEDGKIFKYVIWYDVSYSRYLEEKKEK

SEQ ID NO: 2717167 - protein, 17 aa, Entamoeba histolytica
KIFEIEPTLFVFKATSH

SEQ ID NO: 2717168 - protein, 20 aa, Entamoeba histolytica
KIFHIDFGYVFGKLVPRKEN

SEQ ID NO: 2717169 - protein, 22 aa, Entamoeba histolytica
KIFLEFTPFLKMYSDYCRIYNN

SEQ ID NO: 2717170 - protein, 17 aa, Entamoeba histolytica
KIFPHNEGFILDIPLED

SEQ ID NO: 2717171 - protein, 20 aa, Entamoeba histolytica
KIFRKTVTIGYMPIMLQSKH

SEQ ID NO: 2717172 - protein, 22 aa, Entamoeba histolytica
KIFSIYNTLYHSIPIFNYNEWI

SEQ ID NO: 2717173 - protein, 17 aa, Entamoeba histolytica
KIFSLQLEYGPYSTNFT

SEQ ID NO: 2717174 - protein, 17 aa, Entamoeba histolytica
KIFSQHSLLLTKKEIIQ

SEQ ID NO: 2717175 - protein, 18 aa, Entamoeba histolytica
KIFSVFENNFRPTIDSQD

SEQ ID NO: 2717176 - protein, 33 aa, Entamoeba histolytica
KIGDIILKLMRVDLFYLIIAELLTKQFSPSSSV

SEQ ID NO: 2717177 - protein, 26 aa, Entamoeba histolytica
KIGLTVCGWKNGFYKDCLFSPDESNF

SEQ ID NO: 2717178 - protein, 17 aa, Entamoeba histolytica
KIGRPESILNFMIKYDL

SEQ ID NO: 2717179 - protein, 22 aa, Entamoeba histolytica
KIGVIINKWDVFEQKRKLVIES

SEQ ID NO: 2717180 - protein, 25 aa, Entamoeba histolytica
KIGYDCFYYNLFKSIDLSHVLQIDV

SEQ ID NO: 2717181 - protein, 19 aa, Entamoeba histolytica
KIGYELIKKLPYGGMICNT

SEQ ID NO: 2717182 - protein, 24 aa, Entamoeba histolytica
KIHECGGLYKIYIADWFAQLNHKM

SEQ ID NO: 2717183 - protein, 20 aa, Entamoeba histolytica
KIHIMYPVSSVYFIGDIKTP

SEQ ID NO: 2717184 - protein, 21 aa, Entamoeba histolytica
KIHIWKTLIGTKYLLQQRNLD

SEQ ID NO: 2717185 - protein, 22 aa, Entamoeba histolytica
KIHKNEFIWFLNNERSFIYNLN

SEQ ID NO: 2717186 - protein, 24 aa, Entamoeba histolytica
KIHTDLMVALAHFGEKWPGYEFEV

SEQ ID NO: 2717187 - protein, 35 aa, Entamoeba histolytica; identical to SEQ ID NO: 2529484

SEQ ID NO: 2717188 - protein, 17 aa, Entamoeba histolytica
KIIEILGMYLQYFNQNE

SEQ ID NO: 2717189 - protein, 22 aa, Entamoeba histolytica
KIIEMGLDVPYMVLIERKHIDL

SEQ ID NO: 2717190 - protein, 24 aa, Entamoeba histolytica
KIIEVLYSQLRLFGGIGTSVKLLK

SEQ ID NO: 2717191 - protein, 23 aa, Entamoeba histolytica
KIIIHFDISYFQLLNYQKQFQRK

SEQ ID NO: 2717192 - protein, 18 aa, Entamoeba histolytica
KIIKFLNINCGQALDFRL

SEQ ID NO: 2717193 - protein, 24 aa, Entamoeba histolytica
KIIKFSIPLFTKPLFESTGIKTPF

SEQ ID NO: 2717194 - protein, 17 aa, Entamoeba histolytica
KIININDIIIYVDPLDG

SEQ ID NO: 2717195 - protein, 21 aa, Entamoeba histolytica
KIINQLPDHISLKPKGRTGVS

SEQ ID NO: 2717196 - protein, 24 aa, Entamoeba histolytica
KIISRLVGLNKPWHCPHGRQTIRH

SEQ ID NO: 2717197 - protein, 20 aa, Entamoeba histolytica
KIITIPDIPLELKYLKSIDV

SEQ ID NO: 2717198 - protein, 20 aa, Entamoeba histolytica
KIIVNEELYYFLKKNNLTHL

SEQ ID NO: 2717199 - protein, 20 aa, Entamoeba histolytica
KIIYEFRQKLIALGVTEEEI

SEQ ID NO: 2717200 - protein, 27 aa, Entamoeba histolytica
KIKDLDYLIGPILYQESWKELIKEKYI

SEQ ID NO: 2717201 - protein, 27 aa, Entamoeba histolytica
KIKEAKLMIFRGYSRGFAFVEYETEED

SEQ ID NO: 2717202 - protein, 17 aa, Entamoeba histolytica
KIKEQFGGKLKFIFNGG

SEQ ID NO: 2717203 - protein, 23 aa, Entamoeba histolytica
KIKHVVRIILQHFYSPLLLENTD

SEQ ID NO: 2717204 - protein, 27 aa, Entamoeba histolytica
KIKIEKLIRIVLLIIHNLLNVDWYVRL

SEQ ID NO: 2717205 - protein, 17 aa, Entamoeba histolytica
KIKIRKLPKKTITELPK

SEQ ID NO: 2717206 - protein, 27 aa, Entamoeba histolytica
KIKKFITTYYFMIEIKPSPQFVIEGDI

SEQ ID NO: 2717207 - protein, 24 aa, Entamoeba histolytica
KIKKIEPPLPSIPPPRRKTPFIQN

SEQ ID NO: 2717208 - protein, 19 aa, Entamoeba histolytica
KIKLVENLDILRKKYKDCK

SEQ ID NO: 2717209 - protein, 19 aa, Entamoeba histolytica
KIKNITLNPLFIRPDEEPE

SEQ ID NO: 2717210 - protein, 27 aa, Entamoeba histolytica
KIKNWAYKIILFFPNIQTFRIKDLNVF

SEQ ID NO: 2717211 - protein, 21 aa, Entamoeba histolytica
KIKQTIIAIPYINFVLNEHYQ

SEQ ID NO: 2717212 - protein, 24 aa, Entamoeba histolytica
KIKRLPTFTITFGQLELLLNPEQN

SEQ ID NO: 2717213 - protein, 23 aa, Entamoeba histolytica
KIKSEACWLLANTIFKINDSMYS

SEQ ID NO: 2717214 - protein, 35 aa, Entamoeba histolytica; identical to SEQ ID NO: 2529514

SEQ ID NO: 2717215 - protein, 19 aa, Entamoeba histolytica
KIKTLPITARALDSLIRLA

SEQ ID NO: 2717216 - protein, 25 aa, Entamoeba histolytica
KIKTTKLCILILRSLKKLHPMTDYF

SEQ ID NO: 2717217 - protein, 18 aa, Entamoeba histolytica
KIKTTQFVILILTSLKIL

SEQ ID NO: 2717218 - protein, 21 aa, Entamoeba histolytica
KIKTTRLCVLILQSLKEIKPL

SEQ ID NO: 2717219 - protein, 29 aa, Entamoeba histolytica
KILAQRYCYYPYFYSIIIEDELVTKEVFN

SEQ ID NO: 2717220 - protein, 18 aa, Entamoeba histolytica
KILDGSIDLKKLAQDDVL

SEQ ID NO: 2717221 - protein, 20 aa, Entamoeba histolytica
KILDLKGKLILPSLCTFGNL

SEQ ID NO: 2717222 - protein, 24 aa, Entamoeba histolytica
KILEEYICYFIIDKNLNENEIILN

SEQ ID NO: 2717223 - protein, 21 aa, Entamoeba histolytica
KILIDIFQIDKVIVPSLVMLL

SEQ ID NO: 2717224 - protein, 24 aa, Entamoeba histolytica
KILNKIIYQIALKYPQQTLWHILM

SEQ ID NO: 2717225 - protein, 18 aa, Entamoeba histolytica
KILPFAQTLLQISHKMIT

SEQ ID NO: 2717226 - protein, 21 aa, Entamoeba histolytica
KILPIIKELKWNGVFNQIPKE

SEQ ID NO: 2717227 - protein, 21 aa, Entamoeba histolytica
KILYLNHCWAGNQYLLGVVDS

SEQ ID NO: 2717228 - protein, 22 aa, Entamoeba histolytica
KILYLNHCWAGNQYLLGVVDSE

SEQ ID NO: 2717229 - protein, 23 aa, Entamoeba histolytica
KILYPLCLQTKKQYAKLLFQSSS

SEQ ID NO: 2717230 - protein, 19 aa, Entamoeba histolytica
KIMNETYYVDKRIVNKLLI

SEQ ID NO: 2717231 - protein, 27 aa, Entamoeba histolytica
KIMNNNYYILVLLIISNINGSYCDLKE

SEQ ID NO: 2717232 - protein, 22 aa, Entamoeba histolytica
KIMPLELRALISGLPFCVVSTD

SEQ ID NO: 2717233 - protein, 19 aa, Entamoeba histolytica
KIMYLGDSTIITFQFLDGR

SEQ ID NO: 2717234 - protein, 21 aa, Entamoeba histolytica
KINALIPARMQCVIDALLVPE

SEQ ID NO: 2717235 - protein, 28 aa, Entamoeba histolytica
KINEDLRIKIFLWKTIQCDKALGTVRGG

SEQ ID NO: 2717236 - protein, 18 aa, Entamoeba histolytica
KINELNFELLRNATMLRK

SEQ ID NO: 2717237 - protein, 29 aa, Entamoeba histolytica
KINEYGHHWTLISQFIPGRAPNSIKNRFY

SEQ ID NO: 2717238 - protein, 25 aa, Entamoeba histolytica
KINFLDERFVLHYLHSILLSVTGCY

SEQ ID NO: 2717239 - protein, 24 aa, Entamoeba histolytica
KINFYYCNRIRSFKIPTKITSLRL

SEQ ID NO: 2717240 - protein, 19 aa, Entamoeba histolytica
KINILKKNPKVSFTIVGKT

SEQ ID NO: 2717241 - protein, 19 aa, Entamoeba histolytica
KINKLPQTTLITSPAPNTT

SEQ ID NO: 2717242 - protein, 25 aa, Entamoeba histolytica
KINLVQCRLFLTKLIAVFNRGDTFT

SEQ ID NO: 2717243 - protein, 27 aa, Entamoeba histolytica
KINSIFKGELPEIPKIFFTATTFKELV

SEQ ID NO: 2717244 - protein, 23 aa, Entamoeba histolytica
KINSPFQHATLKPKFNFFERAEE

SEQ ID NO: 2717245 - protein, 24 aa, Entamoeba histolytica
KINTPLLSPKCDLLSFIQISEIPS

SEQ ID NO: 2717246 - protein, 23 aa, Entamoeba histolytica
KINTVLEHIYNLKFVLKVIESKA

SEQ ID NO: 2717247 - protein, 21 aa, Entamoeba histolytica
KINVLFSFIRTHTNSKMIVFF

SEQ ID NO: 2717248 - protein, 19 aa, Entamoeba histolytica
KINVQLFYKMLTQHQIDQV

SEQ ID NO: 2717249 - protein, 19 aa, Entamoeba histolytica
KIPECGPLDALVRPLALAP

SEQ ID NO: 2717250 - protein, 29 aa, Entamoeba histolytica
KIPEDRQIDLWPNFQIFLNEQAKEKYGDA

SEQ ID NO: 2717251 - protein, 24 aa, Entamoeba histolytica
KIPESLFSMTKLVELFLNCNQIPE

SEQ ID NO: 2717252 - protein, 33 aa, Entamoeba histolytica
KIPGKYFIKYMRNIPMYFQWFTQQKQIDLFFEI

SEQ ID NO: 2717253 - protein, 24 aa, Entamoeba histolytica
KIPQYLPFEMKLGNLKKLSLSSKV

SEQ ID NO: 2717254 - protein, 30 aa, Entamoeba histolytica
KIPSLLSHYIQLYFLPAVRSLVIDEIRRSF

SEQ ID NO: 2717255 - protein, 17 aa, Entamoeba histolytica
KIPYQLIESLGFDGNNI

SEQ ID NO: 2717256 - protein, 19 aa, Entamoeba histolytica
KIPYQYFLPGNVMPFAQTL

SEQ ID NO: 2717257 - protein, 25 aa, Entamoeba histolytica
KIQAFQEILLLRSQLCSILGKENKV

SEQ ID NO: 2717258 - protein, 25 aa, Entamoeba histolytica
KIQEKLYLDFLFSRDKTDNLLLNNI

SEQ ID NO: 2717259 - protein, 26 aa, Entamoeba histolytica
KIQFIQGLILFMKTIQQLKDIHFLVA

SEQ ID NO: 2717260 - protein, 34 aa, Entamoeba histolytica
KIQHCLLNIFSLTRFNLITGLLSIELFLETLDSI

SEQ ID NO: 2717261 - protein, 19 aa, Entamoeba histolytica
KIQIVNIKRFNITTKIGIV

SEQ ID NO: 2717262 - protein, 28 aa, Entamoeba histolytica
KIQKKYQPIPFFIPKEIYRLIDYIIQHY

SEQ ID NO: 2717263 - protein, 20 aa, Entamoeba histolytica
KIQLAAPPRKRAMSASAQAL

SEQ ID NO: 2717264 - protein, 21 aa, Entamoeba histolytica
KIQLLLPKLPDLLMSKDLSLR

SEQ ID NO: 2717265 - protein, 22 aa, Entamoeba histolytica
KIRAKICFDVAKALFYMHENGG

SEQ ID NO: 2717266 - protein, 17 aa, Entamoeba histolytica
KIRIITALMKLLKKFNS

SEQ ID NO: 2717267 - protein, 19 aa, Entamoeba histolytica
KIRIKFMIDGAKGISCLHL

SEQ ID NO: 2717268 - protein, 20 aa, Entamoeba histolytica
KIRLLNLFNLEKENEHFKCG

SEQ ID NO: 2717269 - protein, 17 aa, Entamoeba histolytica
KIRNYIKLFMKSSSNLN

SEQ ID NO: 2717270 - protein, 17 aa, Entamoeba histolytica
KIRNYIKLFMKSSSNLS

SEQ ID NO: 2717271 - protein, 17 aa, Entamoeba histolytica
KIRQKYAILLGEDEVGE

SEQ ID NO: 2717272 - protein, 26 aa, Entamoeba histolytica
KIRSATTFMLLLLDPDWYNSESFKKL

SEQ ID NO: 2717273 - protein, 28 aa, Entamoeba histolytica
KIRSTFFQMYFSTLYICGFDEMLKIIKI

SEQ ID NO: 2717274 - protein, 23 aa, Entamoeba histolytica
KISEAHHFLMDTLQLQGYEYESF

SEQ ID NO: 2717275 - protein, 32 aa, Entamoeba histolytica; identical to SEQ ID NO: 2529586

SEQ ID NO: 2717276 - protein, 24 aa, Entamoeba histolytica
KISELLPFIQEKSNLWPQLSAAIE

SEQ ID NO: 2717277 - protein, 17 aa, Entamoeba histolytica
KISGSFSSLLFSAPEVN

SEQ ID NO: 2717278 - protein, 21 aa, Entamoeba histolytica
KISIDPYTIEKFPLPSKHPIV

SEQ ID NO: 2717279 - protein, 27 aa, Entamoeba histolytica
KISILPSHLFKITSLKKLILSQNILYE

SEQ ID NO: 2717280 - protein, 17 aa, Entamoeba histolytica
KISINHFVPSVKIKYLT

SEQ ID NO: 2717281 - protein, 24 aa, Entamoeba histolytica
KISKTIICYLLRFGMKIDEENMII

SEQ ID NO: 2717282 - protein, 20 aa, Entamoeba histolytica
KISLQLLNALQYLHSNKIVH

SEQ ID NO: 2717283 - protein, 17 aa, Entamoeba histolytica
KITAVIIHLMTLYSNFN

SEQ ID NO: 2717284 - protein, 30 aa, Entamoeba histolytica
KITKKENCQFILFRLTKSDGLFIYEMEIEK

SEQ ID NO: 2717285 - protein, 28 aa, Entamoeba histolytica
KITKKENCQFILFTLTNSDGLFIYEMEI

SEQ ID NO: 2717286 - protein, 25 aa, Entamoeba histolytica
KITLKSLLLESLLNTIIFITCDYCL

SEQ ID NO: 2717287 - protein, 25 aa, Entamoeba histolytica
KITLNKKLVILKKEAERIKIELSGK

SEQ ID NO: 2717288 - protein, 18 aa, Entamoeba histolytica
KITPPSFKTNTIPPQINS

SEQ ID NO: 2717289 - protein, 18 aa, Entamoeba histolytica
KITQSNIKFIPLGDGILT

SEQ ID NO: 2717290 - protein, 21 aa, Entamoeba histolytica
KITRLGCLVVIFQMSIQLELE

SEQ ID NO: 2717291 - protein, 24 aa, Entamoeba histolytica
KITRSSLFLAYLIENPFNREICLL

SEQ ID NO: 2717292 - protein, 27 aa, Entamoeba histolytica
KITSFKLPHFFIFTNILTNDVDKFKTF

SEQ ID NO: 2717293 - protein, 28 aa, Entamoeba histolytica
KITSTWSRTFFFLLDGISQYRRHFGCDE

SEQ ID NO: 2717294 - protein, 25 aa, Entamoeba histolytica
KITYDVQPLAIIKKIDCDSPAEKAG

SEQ ID NO: 2717295 - protein, 24 aa, Entamoeba histolytica
KITYSFYSSLLQKIYKLLPSLMPN

SEQ ID NO: 2717296 - protein, 23 aa, Entamoeba histolytica
KIVCGNLFFKDSQPMFWEVACIL

SEQ ID NO: 2717297 - protein, 17 aa, Entamoeba histolytica
KIVFKYLPIKEIKCVVI

SEQ ID NO: 2717298 - protein, 18 aa, Entamoeba histolytica
KIVHFIKRQMNDNAIELM

SEQ ID NO: 2717299 - protein, 19 aa, Entamoeba histolytica
KIVKFPPINRLDVAGVDLS

SEQ ID NO: 2717300 - protein, 26 aa, Entamoeba histolytica
KIVLTFVMSLIPFFFQKYISKHTLVS

SEQ ID NO: 2717301 - protein, 18 aa, Entamoeba histolytica
KIVLVNLEPFFIAEQIAL

SEQ ID NO: 2717302 - protein, 18 aa, Entamoeba histolytica
KIVPAAVTVELLLNAIRN

SEQ ID NO: 2717303 - protein, 25 aa, Entamoeba histolytica
KIVPSHITVKLLLKAIQEHPHKVFL

SEQ ID NO: 2717304 - protein, 44 aa, Entamoeba histolytica; identical to SEQ ID NO: 2529628

SEQ ID NO: 2717305 - protein, 20 aa, Entamoeba histolytica
KIVSLSSVRYLIFDEADRML

SEQ ID NO: 2717306 - protein, 20 aa, Entamoeba histolytica
KIVVFERNAYLGGILRKEIQ

SEQ ID NO: 2717307 - protein, 24 aa, Entamoeba histolytica
KIVWKIMMSLPSFSGIMKKVNSCF

SEQ ID NO: 2717308 - protein, 24 aa, Entamoeba histolytica
KIVYKWRFNSWPEGKYSHVEITLT

SEQ ID NO: 2717309 - protein, 22 aa, Entamoeba histolytica
KIVYLDEMPSIISSALSLIQQI

SEQ ID NO: 2717310 - protein, 17 aa, Entamoeba histolytica
KIWCFNAGHILGAAMFC

SEQ ID NO: 2717311 - protein, 18 aa, Entamoeba histolytica
KIWKFICQVLSTHKMKVT

SEQ ID NO: 2717312 - protein, 33 aa, Entamoeba histolytica
KIWSKNEFIISIGNFYRGWIDIASIGENCSYNH

SEQ ID NO: 2717313 - protein, 24 aa, Entamoeba histolytica
KIYDMINLFMWNFVQKHISTQGKG

SEQ ID NO: 2717314 - protein, 18 aa, Entamoeba histolytica
KIYLARVVGYFPDSIEVN

SEQ ID NO: 2717315 - protein, 18 aa, Entamoeba histolytica
KIYLARVVGYFPDTIEVN

SEQ ID NO: 2717316 - protein, 19 aa, Entamoeba histolytica
KIYLRNLPEPLLPYDSIPE

SEQ ID NO: 2717317 - protein, 18 aa, Entamoeba histolytica
KIYTNFWKMNEREKIVAP

SEQ ID NO: 2717318 - protein, 21 aa, Entamoeba histolytica
KKACGFVKFKRVEDAIRCVCD

SEQ ID NO: 2717319 - protein, 31 aa, Entamoeba histolytica
KKAFSVMHLRWFNMHLLRVEYYPESKVPIVH

SEQ ID NO: 2717320 - protein, 27 aa, Entamoeba histolytica
KKAIQSFEFLLRNFKYAFSDVKKRNIA

SEQ ID NO: 2717321 - protein, 19 aa, Entamoeba histolytica
KKAIYRPQAFFKGLIFPLC

SEQ ID NO: 2717322 - protein, 27 aa, Entamoeba histolytica
KKANITWLLEMIVYIALAPNINKETHD

SEQ ID NO: 2717323 - protein, 53 aa, Entamoeba histolytica
KKARKALEKVGLVEVPNVIEFSLKRAGSKFVINQPAVYKLPSSEHYVVYGEPR

SEQ ID NO: 2717324 - protein, 26 aa, Entamoeba histolytica
KKASDIAHLIHKVLFGTPGSVEERKK

SEQ ID NO: 2717325 - protein, 26 aa, Entamoeba histolytica
KKATVIFVPLRMMRICRASFEKVIEA

SEQ ID NO: 2717326 - protein, 22 aa, Entamoeba histolytica
KKAVNRFLAANDLFCIVRAHQV

SEQ ID NO: 2717327 - protein, 18 aa, Entamoeba histolytica
KKAYRKLAIKYHPDKNPG

SEQ ID NO: 2717328 - protein, 27 aa, Entamoeba histolytica
KKCGDVQFLVISLKDTLYERADALVGV

SEQ ID NO: 2717329 - protein, 23 aa, Entamoeba histolytica
KKCKAFSIILRYNLNTHSVERVY

SEQ ID NO: 2717330 - protein, 21 aa, Entamoeba histolytica
KKCLYQWWDIQRMMTCPFCRG

SEQ ID NO: 2717331 - protein, 30 aa, Entamoeba histolytica; identical to SEQ ID NO: 2529657

SEQ ID NO: 2717332 - protein, 24 aa, Entamoeba histolytica
KKCYFCSLIIDHSLMKIIKEAPKD

SEQ ID NO: 2717333 - protein, 25 aa, Entamoeba histolytica
KKDCYKTMMFWNQPNELDAVISAIL

SEQ ID NO: 2717334 - protein, 27 aa, Entamoeba histolytica
KKDEFKYGFQKFNLFKGKKVFATELFT

SEQ ID NO: 2717335 - protein, 24 aa, Entamoeba histolytica
KKDFVDCQFLYNCILYLVQHNYHS

SEQ ID NO: 2717336 - protein, 25 aa, Entamoeba histolytica
KKDGLNIMFSFVKHRYPRFQFIGLG

SEQ ID NO: 2717337 - protein, 27 aa, Entamoeba histolytica
KKDIDYLLKTYYSIRIHHKKETKAILK

SEQ ID NO: 2717338 - protein, 40 aa, Entamoeba histolytica
KKDKKIIFPIEKTCYILLSSYLFITLIKKISTKKEEKIAE

SEQ ID NO: 2717339 - protein, 24 aa, Entamoeba histolytica
KKDKYTLCIILNLAEAIIQYKDVN

SEQ ID NO: 2717340 - protein, 22 aa, Entamoeba histolytica
KKDNEMLLKLMKDPYANYVIQT

SEQ ID NO: 2717341 - protein, 23 aa, Entamoeba histolytica
KKDNLLYKVGITASAAGFFACQG

SEQ ID NO: 2717342 - protein, 26 aa, Entamoeba histolytica
KKDNYDVVIFFAKGKFYELYENDADI

SEQ ID NO: 2717343 - protein, 24 aa, Entamoeba histolytica
KKEAKMLIREVAKKVVKKAKRHDA

SEQ ID NO: 2717344 - protein, 22 aa, Entamoeba histolytica
KKECKNLFIPVLLKLQDDSSII

SEQ ID NO: 2717345 - protein, 25 aa, Entamoeba histolytica
KKEDIIHPIMPKPLLDDIRSSSGHI

SEQ ID NO: 2717346 - protein, 37 aa, Entamoeba histolytica
KKEDIKMFIRVLGKIVSYYPKWIKGDENYLERILLIP

SEQ ID NO: 2717347 - protein, 26 aa, Entamoeba histolytica
KKEEEKRIIGWLNNIYVIEKNKEGIK

SEQ ID NO: 2717348 - protein, 22 aa, Entamoeba histolytica
KKEEELLLMIAIGYGDEDYLST

SEQ ID NO: 2717349 - protein, 23 aa, Entamoeba histolytica
KKEEKLMKIRFIIELSKCSIVEP

SEQ ID NO: 2717350 - protein, 18 aa, Entamoeba histolytica
KKEELKLPFDGDKYVQLG

SEQ ID NO: 2717351 - protein, 26 aa, Entamoeba histolytica
KKEELPSKLILFKKGENTFLLNNYTE

SEQ ID NO: 2717352 - protein, 24 aa, Entamoeba histolytica
KKEGLVYLLWGAFAQKKASGVDST

SEQ ID NO: 2717353 - protein, 25 aa, Entamoeba histolytica
KKEHIYIPELIFGHLLTSSNYKDDD

SEQ ID NO: 2717354 - protein, 23 aa, Entamoeba histolytica
KKEIDEYFQGTRYDYAIGETSIG

SEQ ID NO: 2717355 - protein, 19 aa, Entamoeba histolytica
KKEIINRDVFWTGIDTNEI

SEQ ID NO: 2717356 - protein, 26 aa, Entamoeba histolytica
KKEIKDFFDDLIENIILTISDKEGGV

SEQ ID NO: 2717357 - protein, 27 aa, Entamoeba histolytica
KKEISIPRLMSCVEITFSLVPPKDTNV

SEQ ID NO: 2717358 - protein, 19 aa, Entamoeba histolytica
KKEIYPWGTRMRYLYIALE

SEQ ID NO: 2717359 - protein, 24 aa, Entamoeba histolytica
KKEKSPIHLLTRKYAQYNALLHYA

SEQ ID NO: 2717360 - protein, 20 aa, Entamoeba histolytica
KKELLLSLPIEYFQSIVNEK

SEQ ID NO: 2717361 - protein, 24 aa, Entamoeba histolytica
KKELLPEIINSRRLIIVYNLMEEI

SEQ ID NO: 2717362 - protein, 24 aa, Entamoeba histolytica
KKELPYIPVKIPTYNYKSIDGVNE

SEQ ID NO: 2717363 - protein, 27 aa, Entamoeba histolytica
KKELSEGILFAKLINYLQNDLINLTSF

SEQ ID NO: 2717364 - protein, 25 aa, Entamoeba histolytica
KKEMNKFIGKEFILKVKGKINPMKH

SEQ ID NO: 2717365 - protein, 21 aa, Entamoeba histolytica
KKENLEKLRQIIEKKNNEEMN

SEQ ID NO: 2717366 - protein, 23 aa, Entamoeba histolytica
KKEPAILIDPYIGKFLRPHQIEG

SEQ ID NO: 2717367 - protein, 24 aa, Entamoeba histolytica
KKEPIIYDYKWDIDGYKLKIQSMM

SEQ ID NO: 2717368 - protein, 33 aa, Entamoeba histolytica
KKEQLTQQKPIQKPLPVIPQKRTQQTAIDNEIS

SEQ ID NO: 2717369 - protein, 30 aa, Entamoeba histolytica
KKERARCMSPIYDFFVPSEPKSPLILLAEL

SEQ ID NO: 2717370 - protein, 28 aa, Entamoeba histolytica
KKESYREIFNDIFLLADGKGLFNSKDNK

SEQ ID NO: 2717371 - protein, 26 aa, Entamoeba histolytica
KKETLEFAFKYFITPYVVEQLKIELR

SEQ ID NO: 2717372 - protein, 25 aa, Entamoeba histolytica
KKEYESLFYLQSYIFIQCLDEFTLS

SEQ ID NO: 2717373 - protein, 19 aa, Entamoeba histolytica
KKFCTDILHLLQEESPRSQ

SEQ ID NO: 2717374 - protein, 24 aa, Entamoeba histolytica
KKFDGSFQAIIKYLKNQNKKHGSE

SEQ ID NO: 2717375 - protein, 18 aa, Entamoeba histolytica
KKFIYSTLDFEKANVMYN

SEQ ID NO: 2717376 - protein, 32 aa, Entamoeba histolytica
KKFKPTLVFGVPRFYEKLLFRAKEIRGNSMII

SEQ ID NO: 2717377 - protein, 21 aa, Entamoeba histolytica
KKFQHLLEYFKSNPIPLNDET

SEQ ID NO: 2717378 - protein, 25 aa, Entamoeba histolytica
KKGDYDPLPYIKPLSGTTLTQKVME

SEQ ID NO: 2717379 - protein, 25 aa, Entamoeba histolytica
KKGEKYYPLALKLLIQNVSLHSFRM

SEQ ID NO: 2717380 - protein, 25 aa, Entamoeba histolytica
KKGEMPFFQFVLNVKSFGQTVENIF

SEQ ID NO: 2717381 - protein, 28 aa, Entamoeba histolytica
KKGENEFYLNNKLFPVVDFGKGVIVTIT

SEQ ID NO: 2717382 - protein, 29 aa, Entamoeba histolytica
KKGEPRTMFKFILEFLKLSLQNEDTDEGI

SEQ ID NO: 2717383 - protein, 18 aa, Entamoeba histolytica
KKGFLYVSLHCKKGVTSS

SEQ ID NO: 2717384 - protein, 25 aa, Entamoeba histolytica
KKGGKFFVRYYAPWCGFCKMMSYDY

SEQ ID NO: 2717385 - protein, 25 aa, Entamoeba histolytica
KKGKQYQMMFEWGRIGGTLHNTFRN

SEQ ID NO: 2717386 - protein, 23 aa, Entamoeba histolytica
KKGMLFISSIFNTINIIKGKEDE

SEQ ID NO: 2717387 - protein, 18 aa, Entamoeba histolytica
KKGNVQLVLFVGGTSKMP

SEQ ID NO: 2717388 - protein, 23 aa, Entamoeba histolytica
KKGSPQFMLKYKTNVDPSKPLAH

SEQ ID NO: 2717389 - protein, 18 aa, Entamoeba histolytica
KKGSYFIRIFVKQPNMLL

SEQ ID NO: 2717390 - protein, 23 aa, Entamoeba histolytica
KKGTIKFNVLLTSFELVIKDQDV

SEQ ID NO: 2717391 - protein, 24 aa, Entamoeba histolytica
KKGVILCFKEFVGALLELKNKETP

SEQ ID NO: 2717392 - protein, 31 aa, Entamoeba histolytica; identical to SEQ ID NO: 2529733

SEQ ID NO: 2717393 - protein, 19 aa, Entamoeba histolytica
KKHIGNDIVVLIFKEYRGK

SEQ ID NO: 2717394 - protein, 20 aa, Entamoeba histolytica
KKIDILLRNVAMIGNECFSE

SEQ ID NO: 2717395 - protein, 39 aa, Entamoeba histolytica
KKIDNLPTILPETAAQGPLPTTFNLPLTGKKKSRLRQDV

SEQ ID NO: 2717396 - protein, 20 aa, Entamoeba histolytica
KKIENLIGKFAKRIIMEDKY

SEQ ID NO: 2717397 - protein, 27 aa, Entamoeba histolytica
KKIFYSSFNFIIEKIPQITFLSNLREL

SEQ ID NO: 2717398 - protein, 21 aa, Entamoeba histolytica
KKIGAFFFETSAFDGKNVETA

SEQ ID NO: 2717399 - protein, 20 aa, Entamoeba histolytica
KKIGELLFDLKKEEEQRKIL

SEQ ID NO: 2717400 - protein, 20 aa, Entamoeba histolytica
KKIIVPISLKEYYLGITKEI

SEQ ID NO: 2717401 - protein, 22 aa, Entamoeba histolytica
KKIKHPFIISYYNDYNINNNKF

SEQ ID NO: 2717402 - protein, 24 aa, Entamoeba histolytica
KKILDFCTIFSRELPHHYCFVIAQ

SEQ ID NO: 2717403 - protein, 35 aa, Entamoeba histolytica
KKIMKDFVRYYPEYLWYPFLTLIISKLEEPNFSKT

SEQ ID NO: 2717404 - protein, 24 aa, Entamoeba histolytica
KKINFDIQIYVYNIKFGNQKYDIK

SEQ ID NO: 2717405 - protein, 27 aa, Entamoeba histolytica
KKINKEEIIRMVKSGEYKLVPIEQYDK

SEQ ID NO: 2717406 - protein, 24 aa, Entamoeba histolytica
KKIPITLDSLLIKSFHVYMEYLLG

SEQ ID NO: 2717407 - protein, 21 aa, Entamoeba histolytica
KKIQTILFGNISAMHLHFKEY

SEQ ID NO: 2717408 - protein, 22 aa, Entamoeba histolytica
KKISLPGLLFKFITIKPCDRKI

SEQ ID NO: 2717409 - protein, 38 aa, Entamoeba histolytica
KKITKSCIVALLRGIWIMPIEWLFSKGDYFENEELYVS

SEQ ID NO: 2717410 - protein, 33 aa, Entamoeba histolytica
KKITVEPITNKELYPKLWEKALNQARKEIMTIV

SEQ ID NO: 2717411 - protein, 20 aa, Entamoeba histolytica
KKIVSLIQVYPPFVTMKWEE

SEQ ID NO: 2717412 - protein, 18 aa, Entamoeba histolytica
KKIVWDRSLAFTNILLNN

SEQ ID NO: 2717413 - protein, 18 aa, Entamoeba histolytica
KKIYSTALAQLVFLLLEP

SEQ ID NO: 2717414 - protein, 22 aa, Entamoeba histolytica
KKKAIVMTAKDLENEEISSEEK

SEQ ID NO: 2717415 - protein, 26 aa, Entamoeba histolytica
KKKATKALPFLQIRSINFGNGDVFNF

SEQ ID NO: 2717416 - protein, 31 aa, Entamoeba histolytica
KKKEKKMMMNIEKQFKLLEQQKTLHKKNLAK

SEQ ID NO: 2717417 - protein, 22 aa, Entamoeba histolytica
KKKENLLKWNNYKKSKHPLAEL

SEQ ID NO: 2717418 - protein, 35 aa, Entamoeba histolytica; identical to SEQ ID NO: 2529756

SEQ ID NO: 2717419 - protein, 18 aa, Entamoeba histolytica
KKKKKWIHLEYLIKNMIG

SEQ ID NO: 2717420 - protein, 34 aa, Entamoeba histolytica
KKKKMCLYNKCTVIKILVGWMKDATEKGESIEPI

SEQ ID NO: 2717421 - protein, 23 aa, Entamoeba histolytica
KKKKTITCLWNKLFKQINKMVIE

SEQ ID NO: 2717422 - protein, 30 aa, Entamoeba histolytica
KKKKTYTLNIWKSTYLINFSKFIQTNTNQK

SEQ ID NO: 2717423 - protein, 37 aa, Entamoeba histolytica; identical to SEQ ID NO: 2529768

SEQ ID NO: 2717424 - protein, 22 aa, Entamoeba histolytica
KKKPLFFNKQTPIEYNKQENDI

SEQ ID NO: 2717425 - protein, 25 aa, Entamoeba histolytica
KKKPVGLNYFSEKKGLLTDEDLMED

SEQ ID NO: 2717426 - protein, 25 aa, Entamoeba histolytica
KKKRVNTDIVFPKLENFKCPVEYNE

SEQ ID NO: 2717427 - protein, 26 aa, Entamoeba histolytica
KKKRVNTDIVFPKLENFKCPVEYNEK

SEQ ID NO: 2717428 - protein, 26 aa, Entamoeba histolytica
KKKSGWRFPLPIYRSIEYLKKHGGVE

SEQ ID NO: 2717429 - protein, 17 aa, Entamoeba histolytica
KKKVDFMALFDQAMQQP

SEQ ID NO: 2717430 - protein, 27 aa, Entamoeba histolytica
KKKVPTIYIRLFSYELIRGLAYLHSLN

SEQ ID NO: 2717431 - protein, 25 aa, Entamoeba histolytica
KKKWDGIVNMTVPLDFPSCFDFLQF

SEQ ID NO: 2717432 - protein, 24 aa, Entamoeba histolytica
KKKWKLRFVIVNGSTLYYYKTELD

SEQ ID NO: 2717433 - protein, 22 aa, Entamoeba histolytica
KKLDEILLQPKDDFLLTTDENE

SEQ ID NO: 2717434 - protein, 24 aa, Entamoeba histolytica
KKLEKVLLGIVYYICKIENNGLTI

SEQ ID NO: 2717435 - protein, 21 aa, Entamoeba histolytica
KKLENWFVLCEMRVYLARIET

SEQ ID NO: 2717436 - protein, 21 aa, Entamoeba histolytica
KKLEPFACELLALTAHRAEQL

SEQ ID NO: 2717437 - protein, 22 aa, Entamoeba histolytica
KKLFDFITNTFLASIYKDSTFQ

SEQ ID NO: 2717438 - protein, 26 aa, Entamoeba histolytica
KKLHFQEYLALKKAIYRPQAFFKGLI

SEQ ID NO: 2717439 - protein, 19 aa, Entamoeba histolytica
KKLIDSIGTEYCKYLKYAD

SEQ ID NO: 2717440 - protein, 20 aa, Entamoeba histolytica
KKLIQQVLDDKIPIVTSTFV

SEQ ID NO: 2717441 - protein, 24 aa, Entamoeba histolytica
KKLLEGCLSYLKKNKLFASFISAV

SEQ ID NO: 2717442 - protein, 21 aa, Entamoeba histolytica
KKLMGHLNVLRGFSQLLKEEA

SEQ ID NO: 2717443 - protein, 20 aa, Entamoeba histolytica
KKLMKLSWHGIPFSIRYIIW

SEQ ID NO: 2717444 - protein, 20 aa, Entamoeba histolytica
KKLNYLPMITDFKFFVETFV

SEQ ID NO: 2717445 - protein, 20 aa, Entamoeba histolytica
KKLPPIFHLIRNPINNDICI

SEQ ID NO: 2717446 - protein, 30 aa, Entamoeba histolytica
KKLPTYNFNTFYYILSFLRELLVHAEKNGL

SEQ ID NO: 2717447 - protein, 34 aa, Entamoeba histolytica
KKLSKRIRLLLMNIIQMMESGWTISPFGSMPPTP

SEQ ID NO: 2717448 - protein, 28 aa, Entamoeba histolytica
KKLSVIDLIYRTMFPFNLDAQKVIEQIF

SEQ ID NO: 2717449 - protein, 20 aa, Entamoeba histolytica
KKLTDPNWIPTFTVVSDDKL

SEQ ID NO: 2717450 - protein, 20 aa, Entamoeba histolytica
KKLVSMYETCNEKQLIKIKE

SEQ ID NO: 2717451 - protein, 18 aa, Entamoeba histolytica
KKLYTIKAVILSNSTRKG

SEQ ID NO: 2717452 - protein, 19 aa, Entamoeba histolytica
KKMIINLSIRRCGIIVLNE

SEQ ID NO: 2717453 - protein, 23 aa, Entamoeba histolytica
KKMVLDFTAPFKRISYVHALEEK

SEQ ID NO: 2717454 - protein, 24 aa, Entamoeba histolytica
KKMVYMYLCTYSEKYPELSILCVN

SEQ ID NO: 2717455 - protein, 21 aa, Entamoeba histolytica
KKNCLMIFRNMGEGQTLMVLP

SEQ ID NO: 2717456 - protein, 29 aa, Entamoeba histolytica
KKNDWIKNTLKGFKLLRLASQIDSVGVVS

SEQ ID NO: 2717457 - protein, 23 aa, Entamoeba histolytica
KKNELYKDLIKFGFDQIRDPKKA

SEQ ID NO: 2717458 - protein, 20 aa, Entamoeba histolytica
KKNFIAMLTFCDGKKPQVIN

SEQ ID NO: 2717459 - protein, 20 aa, Entamoeba histolytica
KKNFIAMLTFCDGKTPQVIN

SEQ ID NO: 2717460 - protein, 24 aa, Entamoeba histolytica
KKNFRKSFKLPFSRNSLGINLDLC

SEQ ID NO: 2717461 - protein, 26 aa, Entamoeba histolytica
KKNHKTYYMFTLKDFFLKLKINVHTD

SEQ ID NO: 2717462 - protein, 29 aa, Entamoeba histolytica
KKNIEVTVEIGFLLQTYNKTFKVASQMKV

SEQ ID NO: 2717463 - protein, 17 aa, Entamoeba histolytica
KKNIRIIYDDIPEKVIS

SEQ ID NO: 2717464 - protein, 30 aa, Entamoeba histolytica; identical to SEQ ID NO: 2529820

SEQ ID NO: 2717465 - protein, 19 aa, Entamoeba histolytica
KKNKSLKQITSINQQILSI

SEQ ID NO: 2717466 - protein, 25 aa, Entamoeba histolytica
KKNLTFLKTQPLLINLEKFSSLYNN

SEQ ID NO: 2717467 - protein, 17 aa, Entamoeba histolytica
KKNMIYHMLFNKLSKIN

SEQ ID NO: 2717468 - protein, 21 aa, Entamoeba histolytica
KKNQIKAFDLFKAAAFKKHPD

SEQ ID NO: 2717469 - protein, 23 aa, Entamoeba histolytica
KKNQTFVIYSIYRGMSSYIENDE

SEQ ID NO: 2717470 - protein, 24 aa, Entamoeba histolytica
KKPGKIYTVFYQTIQLKIEYDETG

SEQ ID NO: 2717471 - protein, 19 aa, Entamoeba histolytica
KKPIPVFVEKPGKNWGPAC

SEQ ID NO: 2717472 - protein, 26 aa, Entamoeba histolytica
KKPIRGANVSGRPWKEAYKKRSIKDN

SEQ ID NO: 2717473 - protein, 25 aa, Entamoeba histolytica
KKPISKPTYISLKPLSFEPKEKNKV

SEQ ID NO: 2717474 - protein, 20 aa, Entamoeba histolytica
KKPLLLILQNYDPAGDDIRV

SEQ ID NO: 2717475 - protein, 31 aa, Entamoeba histolytica
KKPMKYIRSIYNRLLLESPIIRAAGITTLSK

SEQ ID NO: 2717476 - protein, 18 aa, Entamoeba histolytica
KKPMLFKELTKSSPAFQF

SEQ ID NO: 2717477 - protein, 28 aa, Entamoeba histolytica
KKPNGNDWICILLLYIGKGTISQTTKDI

SEQ ID NO: 2717478 - protein, 23 aa, Entamoeba histolytica
KKPNNQFWKAMKAYGLAYTGQLE

SEQ ID NO: 2717479 - protein, 27 aa, Entamoeba histolytica
KKPPKKDYLTLFDLEDIKPCTSQQLPL

SEQ ID NO: 2717480 - protein, 24 aa, Entamoeba histolytica
KKPTKFIVLIMKLLMLRPDKSIIY

SEQ ID NO: 2717481 - protein, 19 aa, Entamoeba histolytica
KKQCMIFTPAGKPVFSRYG

SEQ ID NO: 2717482 - protein, 28 aa, Entamoeba histolytica
KKQDDWRWSDLLQFKIIILIEGKMYEKA

SEQ ID NO: 2717483 - protein, 26 aa, Entamoeba histolytica
KKQFILYLDDLWYETSLKVGDFIHLI

SEQ ID NO: 2717484 - protein, 27 aa, Entamoeba histolytica
KKQKIFLPIQYLLIYSFDPLFGKSLDT

SEQ ID NO: 2717485 - protein, 21 aa, Entamoeba histolytica
KKQRRYLLRKEVEKAKIELSS

SEQ ID NO: 2717486 - protein, 27 aa, Entamoeba histolytica
KKQVIRLLPEQVSALILLKIKDIILKV

SEQ ID NO: 2717487 - protein, 21 aa, Entamoeba histolytica
KKQYSILLNGFIRIIECLSIE

SEQ ID NO: 2717488 - protein, 21 aa, Entamoeba histolytica
KKRALITLRQLYKFQPNVLSI

SEQ ID NO: 2717489 - protein, 17 aa, Entamoeba histolytica
KKREFVLDRCFYKEKMA

SEQ ID NO: 2717490 - protein, 18 aa, Entamoeba histolytica
KKREIYANYLKTVITICP

SEQ ID NO: 2717491 - protein, 29 aa, Entamoeba histolytica
KKREYAILYFQVLVHLLQVFDQKSLPNNQ

SEQ ID NO: 2717492 - protein, 28 aa, Entamoeba histolytica
KKREYAILYFQVLVRLLQVFDQKSLPNN

SEQ ID NO: 2717493 - protein, 19 aa, Entamoeba histolytica
KKRGNYYLNYIPIQFVNKE

SEQ ID NO: 2717494 - protein, 21 aa, Entamoeba histolytica
KKRIFGCSKYLSNQYLWVNYS

SEQ ID NO: 2717495 - protein, 23 aa, Entamoeba histolytica
KKRIYLKDYIPVLKNFTGKTDFS

SEQ ID NO: 2717496 - protein, 17 aa, Entamoeba histolytica
KKRKKIIVPISLKEYYL

SEQ ID NO: 2717497 - protein, 24 aa, Entamoeba histolytica
KKRKPVVGCFFELLVLKTQGVIDL

SEQ ID NO: 2717498 - protein, 23 aa, Entamoeba histolytica
KKRKTIIKPLLTTTPRSSMIKTE

SEQ ID NO: 2717499 - protein, 27 aa, Entamoeba histolytica
KKRLFKKWEVILFRKQDRKKKSSQKSH

SEQ ID NO: 2717500 - protein, 23 aa, Entamoeba histolytica
KKRNYFVRFPLDGDVKNGRPTDL

SEQ ID NO: 2717501 - protein, 21 aa, Entamoeba histolytica
KKRNYHQIRTRKGDIHKIGKK

SEQ ID NO: 2717502 - protein, 25 aa, Entamoeba histolytica
KKRRVVLMKILLRIHQIYKLDELKH

SEQ ID NO: 2717503 - protein, 22 aa, Entamoeba histolytica
KKSCQFQILTALKKVSNHPWLI

SEQ ID NO: 2717504 - protein, 20 aa, Entamoeba histolytica
KKSFFALNHEVSAVGYGVVD

SEQ ID NO: 2717505 - protein, 18 aa, Entamoeba histolytica
KKSFFLMSAMKEAVKYTD

SEQ ID NO: 2717506 - protein, 19 aa, Entamoeba histolytica
KKSFSPINFTPTLSQQSST

SEQ ID NO: 2717507 - protein, 21 aa, Entamoeba histolytica
KKSIKKYFSKVIFIANEHLKE

SEQ ID NO: 2717508 - protein, 23 aa, Entamoeba histolytica
KKSLCFEVVYDKQFVFFCKDDDM

SEQ ID NO: 2717509 - protein, 34 aa, Entamoeba histolytica
KKSLSGLHMFYITTGWNSFLWCGLKTSKNAREAC

SEQ ID NO: 2717510 - protein, 17 aa, Entamoeba histolytica
KKSMEGYYREKIELRST

SEQ ID NO: 2717511 - protein, 24 aa, Entamoeba histolytica
KKSNPLLFNKIKKISYSLYSKLEI

SEQ ID NO: 2717512 - protein, 24 aa, Entamoeba histolytica
KKSQIWDLNLAPRALVKPSFLLSK

SEQ ID NO: 2717513 - protein, 25 aa, Entamoeba histolytica
KKSTPLYYSQFLKKNYPVLVEYYEK

SEQ ID NO: 2717514 - protein, 20 aa, Entamoeba histolytica
KKSYVKILLGMIRSILSSNR

SEQ ID NO: 2717515 - protein, 19 aa, Entamoeba histolytica
KKTFIFTDYTYMERMYPVV

SEQ ID NO: 2717516 - protein, 31 aa, Entamoeba histolytica
KKTINGPTHLEWYYLVKVHNKIQRIEEVHGL

SEQ ID NO: 2717517 - protein, 26 aa, Entamoeba histolytica
KKTINNLPSKYIVELLNIVCDIFNNK

SEQ ID NO: 2717518 - protein, 22 aa, Entamoeba histolytica
KKTIYILRRLLETETIFNNVIC

SEQ ID NO: 2717519 - protein, 26 aa, Entamoeba histolytica
KKTKELCEGFIDLAKYADLNGASKDL

SEQ ID NO: 2717520 - protein, 25 aa, Entamoeba histolytica
KKTKNILHRLFVIKTIRNNVFCIYL

SEQ ID NO: 2717521 - protein, 22 aa, Entamoeba histolytica
KKTLYYFNLLSIYVDNDIINEF

SEQ ID NO: 2717522 - protein, 23 aa, Entamoeba histolytica
KKTNCEILNLFSFGLNKPEEDSD

SEQ ID NO: 2717523 - protein, 23 aa, Entamoeba histolytica
KKTPEDFIDLLLEKKVEEKEKKP

SEQ ID NO: 2717524 - protein, 24 aa, Entamoeba histolytica
KKTPKYGLIFHAALIGQAPAKAKG

SEQ ID NO: 2717525 - protein, 29 aa, Entamoeba histolytica
KKTPLLQHLRLNFLLDYFPNIETIESSID

SEQ ID NO: 2717526 - protein, 27 aa, Entamoeba histolytica
KKVAPPIPHRSLPPKPLRSSVITSPLT

SEQ ID NO: 2717527 - protein, 20 aa, Entamoeba histolytica
KKVDILAYWVSQSLYESVQN

SEQ ID NO: 2717528 - protein, 28 aa, Entamoeba histolytica
KKVDTPLLWHQGLLVFVQRYSKDFKPQQ

SEQ ID NO: 2717529 - protein, 17 aa, Entamoeba histolytica
KKVIILMNSNKMLYIEC

SEQ ID NO: 2717530 - protein, 21 aa, Entamoeba histolytica
KKVIKPFTLLLSVGDCRAFYV

SEQ ID NO: 2717531 - protein, 20 aa, Entamoeba histolytica
KKVIVKLVPRFNIAHFQEIA

SEQ ID NO: 2717532 - protein, 25 aa, Entamoeba histolytica
KKVKGDITLYKYIWKCITNSRLNEG

SEQ ID NO: 2717533 - protein, 24 aa, Entamoeba histolytica
KKVKTYFIWNESTKNKWFINLCLT

SEQ ID NO: 2717534 - protein, 26 aa, Entamoeba histolytica
KKVMKPLKMYLEAVTVLEKRVKILDE

SEQ ID NO: 2717535 - protein, 41 aa, Entamoeba histolytica
KKVNDLILELPSKIKLPATIQLYCYLYKDGQLKIEWNQSQE

SEQ ID NO: 2717536 - protein, 23 aa, Entamoeba histolytica
KKVNDVALILKISSRFPTKSIQQ

SEQ ID NO: 2717537 - protein, 19 aa, Entamoeba histolytica
KKVPHYKFTDFWNGYGSCI

SEQ ID NO: 2717538 - protein, 26 aa, Entamoeba histolytica
KKVTHWIWYVFPVIQGLWGGRNNDLY

SEQ ID NO: 2717539 - protein, 21 aa, Entamoeba histolytica
KKVTTLKIPKILYNSKTDKLC

SEQ ID NO: 2717540 - protein, 22 aa, Entamoeba histolytica
KKVWSNLKILKLQKCQLTELEE

SEQ ID NO: 2717541 - protein, 27 aa, Entamoeba histolytica
KKWESKLKYMNRFLKLIGPEKQIPELH

SEQ ID NO: 2717542 - protein, 25 aa, Entamoeba histolytica
KKWGKKWVVMKKNCLMIFRNMGEGQ

SEQ ID NO: 2717543 - protein, 21 aa, Entamoeba histolytica
KKWIHLEYLIKNMIGVYNENL

SEQ ID NO: 2717544 - protein, 20 aa, Entamoeba histolytica
KKWMEIIQKCKKTEKQIRVT

SEQ ID NO: 2717545 - protein, 21 aa, Entamoeba histolytica
KKYAVILYDYEGDTRFHLKGE

SEQ ID NO: 2717546 - protein, 31 aa, Entamoeba histolytica
KKYDDIIKILQTTHLLLNLFEKFSSSEPTIS

SEQ ID NO: 2717547 - protein, 24 aa, Entamoeba histolytica
KKYFIIRDDATIFAFAIGGKYEVG

SEQ ID NO: 2717548 - protein, 27 aa, Entamoeba histolytica
KKYHDIVDLYHFNPFPLLSQNDRAMFI

SEQ ID NO: 2717549 - protein, 28 aa, Entamoeba histolytica
KKYHDIVDLYHFNPFPLLSQNDRAMFIS

SEQ ID NO: 2717550 - protein, 28 aa, Entamoeba histolytica
KKYIEPSDWILFYLFNCVDREQHVMNNW

SEQ ID NO: 2717551 - protein, 26 aa, Entamoeba histolytica
KKYKTYKAMLACLFPILKQVIYEEEC

SEQ ID NO: 2717552 - protein, 26 aa, Entamoeba histolytica
KKYLNELMPLQKQDFIGLLKTMNGLP

SEQ ID NO: 2717553 - protein, 22 aa, Entamoeba histolytica
KKYLSFMKFQDYCKYLDQSPAD

SEQ ID NO: 2717554 - protein, 24 aa, Entamoeba histolytica
KKYNPQIMKLFKQIKERTLININE

SEQ ID NO: 2717555 - protein, 23 aa, Entamoeba histolytica
KKYPFQVIIKIFPKLQTIYFNQP

SEQ ID NO: 2717556 - protein, 17 aa, Entamoeba histolytica
KLAACVVLPLVISSLVQ

SEQ ID NO: 2717557 - protein, 21 aa, Entamoeba histolytica
KLAASYFLYNQYFVNGKWPED

SEQ ID NO: 2717558 - protein, 36 aa, Entamoeba histolytica
KLAFEIIKMYLKRLAEPILGIYYFDMKKGLATEDLV

SEQ ID NO: 2717559 - protein, 17 aa, Entamoeba histolytica
KLAHYINFIGNTLIEDS

SEQ ID NO: 2717560 - protein, 31 aa, Entamoeba histolytica
KLAIEKVRLKGLMLLFMSIGGVIEVNDVMDF

SEQ ID NO: 2717561 - protein, 39 aa, Entamoeba histolytica
KLAKVDSKICRLQDTFISLYTKKLNLQGKINTLLEQENS

SEQ ID NO: 2717562 - protein, 28 aa, Entamoeba histolytica
KLARKTYLDFLQRTLCWDPDLRLTPTQA

SEQ ID NO: 2717563 - protein, 24 aa, Entamoeba histolytica
KLASAQVMALFNKAIRKVVTFLEE

SEQ ID NO: 2717564 - protein, 26 aa, Entamoeba histolytica
KLATNIATTILLVDQIVMQKPAGGPK

SEQ ID NO: 2717565 - protein, 27 aa, Entamoeba histolytica
KLATNIATTILLVDQIVMQKPAGGPKI

SEQ ID NO: 2717566 - protein, 29 aa, Entamoeba histolytica
KLDDQVLRLLWHEYWINTLAATAIISSRD

SEQ ID NO: 2717567 - protein, 17 aa, Entamoeba histolytica
KLDTLFITPTKKGKYKS

SEQ ID NO: 2717568 - protein, 23 aa, Entamoeba histolytica
KLDVDIVYFSIQILLIMSKEDDG

SEQ ID NO: 2717569 - protein, 21 aa, Entamoeba histolytica
KLEDFILMRQFIQVENIALGF

SEQ ID NO: 2717570 - protein, 22 aa, Entamoeba histolytica
KLEEKWKYRKIPLPTEDKMVML

SEQ ID NO: 2717571 - protein, 26 aa, Entamoeba histolytica
KLEEPLEYLYLLYNKSIGVFSFLMKL

SEQ ID NO: 2717572 - protein, 28 aa, Entamoeba histolytica
KLEFITFSDILLKYFTPSMLDLYCQYAN

SEQ ID NO: 2717573 - protein, 21 aa, Entamoeba histolytica
KLEHDVILTYILKVLAALLKE

SEQ ID NO: 2717574 - protein, 25 aa, Entamoeba histolytica
KLEIEEVLVYFQQLIFAVEHFHSRH

SEQ ID NO: 2717575 - protein, 24 aa, Entamoeba histolytica
KLEKKGIELLFLMSDGITDGVTEK

SEQ ID NO: 2717576 - protein, 24 aa, Entamoeba histolytica
KLELKKLVYLYLMNYSRSQPERAI

SEQ ID NO: 2717577 - protein, 20 aa, Entamoeba histolytica
KLEMRVAFLDFLKRALQWDP

SEQ ID NO: 2717578 - protein, 27 aa, Entamoeba histolytica
KLENLNPLKNFFVIRDPDLGAPQGKCY

SEQ ID NO: 2717579 - protein, 25 aa, Entamoeba histolytica
KLEVHQLFFDILSQKLKTIDSINEI

SEQ ID NO: 2717580 - protein, 21 aa, Entamoeba histolytica
KLFDLSYVLPNLIAMAFPATG

SEQ ID NO: 2717581 - protein, 17 aa, Entamoeba histolytica
KLFEKYQFKVQLKNIGK

SEQ ID NO: 2717582 - protein, 19 aa, Entamoeba histolytica
KLFGVHRLDRLTSGVLLIA

SEQ ID NO: 2717583 - protein, 19 aa, Entamoeba histolytica
KLFNPEIGFIIISKAYCYE

SEQ ID NO: 2717584 - protein, 21 aa, Entamoeba histolytica
KLFQRFGEIYSIWGSSNGKIF

SEQ ID NO: 2717585 - protein, 17 aa, Entamoeba histolytica
KLFQRQIKLYNNLHPTI

SEQ ID NO: 2717586 - protein, 24 aa, Entamoeba histolytica
KLGHDFCLKHLLNLPGNFTATKLA

SEQ ID NO: 2717587 - protein, 20 aa, Entamoeba histolytica
KLGNEKLLIKKILSTGRNST

SEQ ID NO: 2717588 - protein, 31 aa, Entamoeba histolytica; identical to SEQ ID NO: 2529941

SEQ ID NO: 2717589 - protein, 26 aa, Entamoeba histolytica
KLGTNPLVFAFPSDEGFPFCLDCATS

SEQ ID NO: 2717590 - protein, 18 aa, Entamoeba histolytica
KLHSSWVGVQLLLNIHDE

SEQ ID NO: 2717591 - protein, 19 aa, Entamoeba histolytica
KLIDLVGSWREKLLDVELQ

SEQ ID NO: 2717592 - protein, 17 aa, Entamoeba histolytica
KLIFYGLANIQATNHAL

SEQ ID NO: 2717593 - protein, 17 aa, Entamoeba histolytica
KLIGKYFVAMIALLKDC

SEQ ID NO: 2717594 - protein, 19 aa, Entamoeba histolytica
KLIIEYGYLFPNIELIHIT

SEQ ID NO: 2717595 - protein, 18 aa, Entamoeba histolytica
KLIIHLFIQNNKIQECSS

SEQ ID NO: 2717596 - protein, 20 aa, Entamoeba histolytica
KLIILACDGIWDVLTNEQCV

SEQ ID NO: 2717597 - protein, 17 aa, Entamoeba histolytica
KLIIPSAIHFNPHVLEV

SEQ ID NO: 2717598 - protein, 20 aa, Entamoeba histolytica
KLIIQALEKLLTIGKPGEGF

SEQ ID NO: 2717599 - protein, 29 aa, Entamoeba histolytica
KLIKNTGTFLNLLPLLKSLIQRLITEKDT

SEQ ID NO: 2717600 - protein, 25 aa, Entamoeba histolytica
KLIKTNVIVFCDIPLTWQTQGDVLN

SEQ ID NO: 2717601 - protein, 25 aa, Entamoeba histolytica
KLILSPHMLTIPSGLCWGCVMLTEV

SEQ ID NO: 2717602 - protein, 21 aa, Entamoeba histolytica
KLINRGVNVDMIEWSKSGLVV

SEQ ID NO: 2717603 - protein, 18 aa, Entamoeba histolytica
KLIPLINAFQATHKIFQA

SEQ ID NO: 2717604 - protein, 20 aa, Entamoeba histolytica
KLIPLINSPLQFFNVLKSTD

SEQ ID NO: 2717605 - protein, 21 aa, Entamoeba histolytica
KLIPTLAIPPRHAFLPLYQAH

SEQ ID NO: 2717606 - protein, 19 aa, Entamoeba histolytica
KLIPYQEDVILYLKTFENE

SEQ ID NO: 2717607 - protein, 24 aa, Entamoeba histolytica
KLISILFDIIPILCSFRPDTFSLI

SEQ ID NO: 2717608 - protein, 19 aa, Entamoeba histolytica
KLISLHHLILYISGKLYKN

SEQ ID NO: 2717609 - protein, 34 aa, Entamoeba histolytica; identical to SEQ ID NO: 2529960

SEQ ID NO: 2717610 - protein, 28 aa, Entamoeba histolytica
KLITINVDIFCRCIRLIETIQKASCRLC

SEQ ID NO: 2717611 - protein, 19 aa, Entamoeba histolytica
KLIVNLLRKHLTVIAQKCG

SEQ ID NO: 2717612 - protein, 29 aa, Entamoeba histolytica
KLKEEVFPTVKYNLLLKILQEFKPGNSNP

SEQ ID NO: 2717613 - protein, 25 aa, Entamoeba histolytica
KLKELEGIPLLIYINKDDLLQDKNV

SEQ ID NO: 2717614 - protein, 30 aa, Entamoeba histolytica
KLKELMKYFIKKLLLIDFPSSFISFISEIA

SEQ ID NO: 2717615 - protein, 22 aa, Entamoeba histolytica
KLKFLQSSFPSLELKVIEETWK

SEQ ID NO: 2717616 - protein, 21 aa, Entamoeba histolytica
KLKGLVLIPTFVEEKEKQRKK

SEQ ID NO: 2717617 - protein, 23 aa, Entamoeba histolytica
KLKIKDIIPLFGIGIYSEGDNTF

SEQ ID NO: 2717618 - protein, 17 aa, Entamoeba histolytica
KLKKRLFDLSLSSRQTV

SEQ ID NO: 2717619 - protein, 20 aa, Entamoeba histolytica
KLKLIASSIQRVLSSALHDI

SEQ ID NO: 2717620 - protein, 18 aa, Entamoeba histolytica
KLKNAPQYLLLQLNRFSI

SEQ ID NO: 2717621 - protein, 19 aa, Entamoeba histolytica
KLKNQLLLRNNEKSKKLRS

SEQ ID NO: 2717622 - protein, 24 aa, Entamoeba histolytica
KLKQEINYLKKPLEPEVVFCNVPI

SEQ ID NO: 2717623 - protein, 17 aa, Entamoeba histolytica
KLKQEIQALKDTIAKND

SEQ ID NO: 2717624 - protein, 22 aa, Entamoeba histolytica
KLKQKHLPLKKLFQESYKSLNE

SEQ ID NO: 2717625 - protein, 21 aa, Entamoeba histolytica
KLKQLQQKLGFKTLTQLIDYL

SEQ ID NO: 2717626 - protein, 19 aa, Entamoeba histolytica
KLKVGEMVEFLLNSNKLIS

SEQ ID NO: 2717627 - protein, 18 aa, Entamoeba histolytica
KLKYKSKAWIFRKKERQR

SEQ ID NO: 2717628 - protein, 19 aa, Entamoeba histolytica
KLLEEVATPLFSLAKEIDT

SEQ ID NO: 2717629 - protein, 20 aa, Entamoeba histolytica
KLLEMDFANEIDYLIEKLPK

SEQ ID NO: 2717630 - protein, 19 aa, Entamoeba histolytica
KLLHYKGEYFGGAVTAICS

SEQ ID NO: 2717631 - protein, 24 aa, Entamoeba histolytica
KLLIKLCEAVHLKEKIEAEFTGVK

SEQ ID NO: 2717632 - protein, 23 aa, Entamoeba histolytica
KLLKHQSGSYYFVHKKKLIIQIL

SEQ ID NO: 2717633 - protein, 18 aa, Entamoeba histolytica
KLLKTLFIFISSNDSSLF

SEQ ID NO: 2717634 - protein, 18 aa, Entamoeba histolytica
KLLKYDEEYTWAFPPTKA

SEQ ID NO: 2717635 - protein, 18 aa, Entamoeba histolytica
KLLLHQILCHSNLKQPHY

SEQ ID NO: 2717636 - protein, 31 aa, Entamoeba histolytica
KLLLKDDIKLDLHADLYFLIHAMYQDNNKTI

SEQ ID NO: 2717637 - protein, 26 aa, Entamoeba histolytica
KLLPDIHYFVFCYELPYSTAIRLKEK

SEQ ID NO: 2717638 - protein, 24 aa, Entamoeba histolytica
KLLQFLADELFTFKYGTFAFNCEK

SEQ ID NO: 2717639 - protein, 30 aa, Entamoeba histolytica
KLLTEDGVYIIWFSHIQFNEIISICTKLQF

SEQ ID NO: 2717640 - protein, 20 aa, Entamoeba histolytica
KLLTITAYHQFFIDTLNSNV

SEQ ID NO: 2717641 - protein, 25 aa, Entamoeba histolytica
KLLTKENFLFLQNDWNTKINQVILC

SEQ ID NO: 2717642 - protein, 18 aa, Entamoeba histolytica
KLLVQPKPLTIQGVVLRM

SEQ ID NO: 2717643 - protein, 19 aa, Entamoeba histolytica
KLLYEIFCLFIRAETKVYQ

SEQ ID NO: 2717644 - protein, 17 aa, Entamoeba histolytica
KLLYYLKMEHSIISSFL

SEQ ID NO: 2717645 - protein, 29 aa, Entamoeba histolytica
KLMIDPTRYVIIPRPITIQFHKLKSYFQK

SEQ ID NO: 2717646 - protein, 27 aa, Entamoeba histolytica
KLMLKYITIDQFIYTLLVIFNVIELEP

SEQ ID NO: 2717647 - protein, 19 aa, Entamoeba histolytica
KLMYSILEKSDKYLTQKSK

SEQ ID NO: 2717648 - protein, 19 aa, Entamoeba histolytica
KLMYSLNHVQSIVAIPQAK

SEQ ID NO: 2717649 - protein, 26 aa, Entamoeba histolytica
KLNELFNRDSLWMDKVLSINPHFKHQ

SEQ ID NO: 2717650 - protein, 34 aa, Entamoeba histolytica; identical to SEQ ID NO: 2530001

SEQ ID NO: 2717651 - protein, 20 aa, Entamoeba histolytica
KLNGPVFIIGKRVVAHTKKV

SEQ ID NO: 2717652 - protein, 22 aa, Entamoeba histolytica
KLNIRLSVKILKQLYSMIKSCS

SEQ ID NO: 2717653 - protein, 19 aa, Entamoeba histolytica
KLNIVSLVRIIPYLSHYRE

SEQ ID NO: 2717654 - protein, 27 aa, Entamoeba histolytica
KLNKPATITYFGGLNEMGDKELDSFVK

SEQ ID NO: 2717655 - protein, 26 aa, Entamoeba histolytica
KLNKTLTEIPSYHKILLTGTPIQNNI

SEQ ID NO: 2717656 - protein, 25 aa, Entamoeba histolytica
KLNKWLGLESNYLLYRNHLSSLKDR

SEQ ID NO: 2717657 - protein, 26 aa, Entamoeba histolytica
KLNPRVANFFACRAQYYNKAKKPNAA

SEQ ID NO: 2717658 - protein, 19 aa, Entamoeba histolytica
KLNQVQFICATSYLAQCRT

SEQ ID NO: 2717659 - protein, 28 aa, Entamoeba histolytica
KLNRNPPPIPPPPENPFPFSKTQHSLVL

SEQ ID NO: 2717660 - protein, 26 aa, Entamoeba histolytica
KLNRRDAIQIIPWKNITSITISTTSK

SEQ ID NO: 2717661 - protein, 27 aa, Entamoeba histolytica
KLNSGLHFLVLYRYYLRHVPKNIAKLC

SEQ ID NO: 2717662 - protein, 26 aa, Entamoeba histolytica
KLNSTWYAKLGMWHKALNKLEEESKK

SEQ ID NO: 2717663 - protein, 18 aa, Entamoeba histolytica
KLNVLKPKKIPSGEYKSY

SEQ ID NO: 2717664 - protein, 27 aa, Entamoeba histolytica
KLPEIHHPIIMSLVDQLPVMFKETLLS

SEQ ID NO: 2717665 - protein, 40 aa, Entamoeba histolytica
KLPERPQGEFILWQPTRHTLFLPNQILAAAGYDSTETLDI

SEQ ID NO: 2717666 - protein, 17 aa, Entamoeba histolytica
KLPFDGDKYVQLGERKY

SEQ ID NO: 2717667 - protein, 17 aa, Entamoeba histolytica
KLPFIPKESAELYYFRD

SEQ ID NO: 2717668 - protein, 33 aa, Entamoeba histolytica
KLPKEIKILFTCKWYNPIFQYFIYNNDYNNERI

SEQ ID NO: 2717669 - protein, 23 aa, Entamoeba histolytica
KLPKEVILAIRRIPTKVQQVVLS

SEQ ID NO: 2717670 - protein, 23 aa, Entamoeba histolytica
KLPNPYISFRKPFQLYHNQNVQQ

SEQ ID NO: 2717671 - protein, 22 aa, Entamoeba histolytica
KLPSLNLWNITINPIPLKIMGF

SEQ ID NO: 2717672 - protein, 23 aa, Entamoeba histolytica
KLQDIRILHYLKNYMFDITNYQI

SEQ ID NO: 2717673 - protein, 20 aa, Entamoeba histolytica
KLQDRYFYNPKSSKTELELS

SEQ ID NO: 2717674 - protein, 23 aa, Entamoeba histolytica
KLQEYWGQILKFIGGYLKVNTET

SEQ ID NO: 2717675 - protein, 18 aa, Entamoeba histolytica
KLQKLLQQYLAVETRIQV

SEQ ID NO: 2717676 - protein, 26 aa, Entamoeba histolytica
KLQKNYLFVVVDKKIYVYNFKDLRPL

SEQ ID NO: 2717677 - protein, 29 aa, Entamoeba histolytica
KLQKRALRCYLRALDYLDNDYRIPEDQKE

SEQ ID NO: 2717678 - protein, 28 aa, Entamoeba histolytica
KLQNKEKFYIIFRSLLKCLVKNVLCQLN

SEQ ID NO: 2717679 - protein, 21 aa, Entamoeba histolytica
KLQQYYAFINKEAQRVIQESD

SEQ ID NO: 2717680 - protein, 20 aa, Entamoeba histolytica
KLQRISFTANFLKSLPKGLA

SEQ ID NO: 2717681 - protein, 18 aa, Entamoeba histolytica
KLQTIWMSSKDQLEPCLI

SEQ ID NO: 2717682 - protein, 27 aa, Entamoeba histolytica
KLRDLFSLFFNVEFFERVWSKTDPKDE

SEQ ID NO: 2717683 - protein, 18 aa, Entamoeba histolytica
KLRFNPISIITKKLFPLI

SEQ ID NO: 2717684 - protein, 19 aa, Entamoeba histolytica
KLRGLIVQFLIDNGANINV

SEQ ID NO: 2717685 - protein, 31 aa, Entamoeba histolytica
KLRKEHSLLFILLIINYWLNLERKGYISKYR

SEQ ID NO: 2717686 - protein, 24 aa, Entamoeba histolytica
KLRNLREWTGLSNYFILYDSDEMP

SEQ ID NO: 2717687 - protein, 23 aa, Entamoeba histolytica
KLRTIFRQLPKERVLFYCGLNGP

SEQ ID NO: 2717688 - protein, 21 aa, Entamoeba histolytica
KLSERFYLRQDGTRIYFFSEE

SEQ ID NO: 2717689 - protein, 17 aa, Entamoeba histolytica
KLSFISFLCEKFDFEEI

SEQ ID NO: 2717690 - protein, 27 aa, Entamoeba histolytica
KLSLEDLLITPIQRLMRYHTLLTELLK

SEQ ID NO: 2717691 - protein, 20 aa, Entamoeba histolytica
KLSLIKLHKRDIPFVSSIIN

SEQ ID NO: 2717692 - protein, 17 aa, Entamoeba histolytica
KLSLQLLVKEVSNLWDD

SEQ ID NO: 2717693 - protein, 17 aa, Entamoeba histolytica
KLSNDFINLLKLKIELQ

SEQ ID NO: 2717694 - protein, 37 aa, Entamoeba histolytica
KLSNDFINLLKLKIELQREWLFDEIDINEYLGIIVTE

SEQ ID NO: 2717695 - protein, 35 aa, Entamoeba histolytica
KLSPRSSSIIFPKNKMPFLSTQPIKPLANSDITPQ

SEQ ID NO: 2717696 - protein, 19 aa, Entamoeba histolytica
KLSSFDMDLNKFSSLTFLD

SEQ ID NO: 2717697 - protein, 17 aa, Entamoeba histolytica
KLSSKWEYILTEGIFRV

SEQ ID NO: 2717698 - protein, 22 aa, Entamoeba histolytica
KLSSLEIKLIMTLRVDFSKQKI

SEQ ID NO: 2717699 - protein, 43 aa, Entamoeba histolytica
KLSVLLQIKSILLTVPSKWIKAMLMFVLLIKSLEEKEKQNENN

SEQ ID NO: 2717700 - protein, 24 aa, Entamoeba histolytica
KLTEFPLNILKLTSLTNLYLTHNY

SEQ ID NO: 2717701 - protein, 19 aa, Entamoeba histolytica
KLTIFWISQPKNLIQICNG

SEQ ID NO: 2717702 - protein, 26 aa, Entamoeba histolytica
KLTKPYVEPLLNILLPKLEEAINKSH

SEQ ID NO: 2717703 - protein, 18 aa, Entamoeba histolytica
KLTKQHELLLTFIQTHEE

SEQ ID NO: 2717704 - protein, 20 aa, Entamoeba histolytica
KLTLLTLLNLDNCPNIIELP

SEQ ID NO: 2717705 - protein, 25 aa, Entamoeba histolytica
KLTPLTLVPYCSCLIDYDLLTIEEK

SEQ ID NO: 2717706 - protein, 25 aa, Entamoeba histolytica
KLTQLIIVDIPITQPFLIDDFSFVE

SEQ ID NO: 2717707 - protein, 24 aa, Entamoeba histolytica
KLTTLPAEQLDYLKAHKATFIITT

SEQ ID NO: 2717708 - protein, 24 aa, Entamoeba histolytica
KLVECYQLILDVAAWINEKKLYEE

SEQ ID NO: 2717709 - protein, 20 aa, Entamoeba histolytica
KLVHQIIVTLVSHLTQDYTI

SEQ ID NO: 2717710 - protein, 17 aa, Entamoeba histolytica
KLVKTLPINASFHGICL

SEQ ID NO: 2717711 - protein, 18 aa, Entamoeba histolytica
KLVSKPFRVVSYPTSIYD

SEQ ID NO: 2717712 - protein, 27 aa, Entamoeba histolytica
KLVSNELWEWILLPKEKFQKRKKTIIS

SEQ ID NO: 2717713 - protein, 21 aa, Entamoeba histolytica
KLVVTIKRFLPNIRSFNKEVK

SEQ ID NO: 2717714 - protein, 19 aa, Entamoeba histolytica
KLYDDVLVLYLHSSQKRPE

SEQ ID NO: 2717715 - protein, 30 aa, Entamoeba histolytica
KLYEDVIKRFDYLLQPPPLKKKKAIIPPDQ

SEQ ID NO: 2717716 - protein, 23 aa, Entamoeba histolytica
KLYFKYLHLERWFNMDQIILYDN

SEQ ID NO: 2717717 - protein, 21 aa, Entamoeba histolytica
KLYHCIVALGHLHIVKFLVST

SEQ ID NO: 2717718 - protein, 19 aa, Entamoeba histolytica
KLYILSTTCLAPDVLRNLD

SEQ ID NO: 2717719 - protein, 19 aa, Entamoeba histolytica
KLYYEWNIFESIYSKNPTD

SEQ ID NO: 2717720 - protein, 18 aa, Entamoeba histolytica
KLYYKQMIYKVESIIDIL

SEQ ID NO: 2717721 - protein, 18 aa, Entamoeba histolytica
KMAKIRGTKYQRKQMTIK

SEQ ID NO: 2717722 - protein, 25 aa, Entamoeba histolytica
KMAVNSGYWSLYRYDPRLVEQGKPG

SEQ ID NO: 2717723 - protein, 27 aa, Entamoeba histolytica
KMDCQLMLLRHWTLYDSLFHTREIASK

SEQ ID NO: 2717724 - protein, 17 aa, Entamoeba histolytica
KMDELIITRIYAALPSD

SEQ ID NO: 2717725 - protein, 17 aa, Entamoeba histolytica
KMDYEIPKLYYKMVFED

SEQ ID NO: 2717726 - protein, 26 aa, Entamoeba histolytica
KMERLRGYQTLYHGLMIFMDKYGRSP

SEQ ID NO: 2717727 - protein, 27 aa, Entamoeba histolytica
KMERSKVLLQLAFKRNQMLQNEKKRLK

SEQ ID NO: 2717728 - protein, 17 aa, Entamoeba histolytica
KMFKFVYAKVGITYPIW

SEQ ID NO: 2717729 - protein, 17 aa, Entamoeba histolytica
KMFKWTLAKVSPRILFQ

SEQ ID NO: 2717730 - protein, 28 aa, Entamoeba histolytica
KMFTDMLDNYYKYFGMGITFIEESDKFK

SEQ ID NO: 2717731 - protein, 17 aa, Entamoeba histolytica
KMFVGQFGTTLIAETTE

SEQ ID NO: 2717732 - protein, 17 aa, Entamoeba histolytica
KMGILFFEYNKVFFELM

SEQ ID NO: 2717733 - protein, 23 aa, Entamoeba histolytica
KMGITHILTIGPLQPIFPELFTY

SEQ ID NO: 2717734 - protein, 21 aa, Entamoeba histolytica
KMGIYSLVAFLQRLDLDAKLQ

SEQ ID NO: 2717735 - protein, 23 aa, Entamoeba histolytica
KMGNIIEMFYKKKLDYKQFVDSY

SEQ ID NO: 2717736 - protein, 22 aa, Entamoeba histolytica
KMIDWMCFYGCDKLTQITFKSS

SEQ ID NO: 2717737 - protein, 25 aa, Entamoeba histolytica
KMIEKSLFIYLDAAKLLYQYDKIQN

SEQ ID NO: 2717738 - protein, 20 aa, Entamoeba histolytica
KMIETYLIKDELKPSFTLKQ

SEQ ID NO: 2717739 - protein, 18 aa, Entamoeba histolytica
KMILEIAKGLKYLHELKI

SEQ ID NO: 2717740 - protein, 18 aa, Entamoeba histolytica
KMIPKVPLVSLIDSTPDY

SEQ ID NO: 2717741 - protein, 20 aa, Entamoeba histolytica
KMIPQPPGNPAKKDKDCIFL

SEQ ID NO: 2717742 - protein, 18 aa, Entamoeba histolytica
KMISWKKSFFDVSKPEEF

SEQ ID NO: 2717743 - protein, 17 aa, Entamoeba histolytica
KMIVFFQTTKEVRFFFE

SEQ ID NO: 2717744 - protein, 29 aa, Entamoeba histolytica
KMKELLEGIFLRLFSFKMIPDSFKSFMTY

SEQ ID NO: 2717745 - protein, 18 aa, Entamoeba histolytica
KMKEYPFFRIISIATEND

SEQ ID NO: 2717746 - protein, 19 aa, Entamoeba histolytica
KMKNLFDKLIPKVKFIDID

SEQ ID NO: 2717747 - protein, 22 aa, Entamoeba histolytica
KMKVYYFYAHFLETVNQIDIND

SEQ ID NO: 2717748 - protein, 20 aa, Entamoeba histolytica
KMKYHFFSSSLLFVYDIESY

SEQ ID NO: 2717749 - protein, 21 aa, Entamoeba histolytica
KMLFAIADVGEFYFRVLKSEE

SEQ ID NO: 2717750 - protein, 21 aa, Entamoeba histolytica
KMLHLKLFYETISQNYEIIFV

SEQ ID NO: 2717751 - protein, 20 aa, Entamoeba histolytica
KMLHVGTIGGVFRTEFPPTP

SEQ ID NO: 2717752 - protein, 18 aa, Entamoeba histolytica
KMLIVEEIKYRPTGKVLN

SEQ ID NO: 2717753 - protein, 29 aa, Entamoeba histolytica
KMLKKVHHLYIISYLGDYFVNSQRYLIIE

SEQ ID NO: 2717754 - protein, 21 aa, Entamoeba histolytica
KMLPLLIFIPDYICNVNYSLN

SEQ ID NO: 2717755 - protein, 18 aa, Entamoeba histolytica
KMMELTKPTIIIGRKGRE

SEQ ID NO: 2717756 - protein, 17 aa, Entamoeba histolytica
KMMKQQSFKAVFEFIMY

SEQ ID NO: 2717757 - protein, 23 aa, Entamoeba histolytica
KMNELIFTGIYLSAKRKKKEGVE

SEQ ID NO: 2717758 - protein, 19 aa, Entamoeba histolytica
KMPCISIFSASFYQGKFMN

SEQ ID NO: 2717759 - protein, 25 aa, Entamoeba histolytica
KMQKSQVFFQKLFNLPVHMPNNNEA

SEQ ID NO: 2717760 - protein, 17 aa, Entamoeba histolytica
KMREVLQILPKRERFRL

SEQ ID NO: 2717761 - protein, 24 aa, Entamoeba histolytica
KMRLWEIRQALRREGLKTQGTIEV

SEQ ID NO: 2717762 - protein, 23 aa, Entamoeba histolytica
KMRNNGQYYWKFGKYAVKSIRDL

SEQ ID NO: 2717763 - protein, 25 aa, Entamoeba histolytica
KMRVTFRVQHQPVLGLRILNTVSKL

SEQ ID NO: 2717764 - protein, 23 aa, Entamoeba histolytica
KMSKIQVLFAGAEHLLHDEIGTI

SEQ ID NO: 2717765 - protein, 20 aa, Entamoeba histolytica
KMSQLLCCICGDGSSFPLYC

SEQ ID NO: 2717766 - protein, 26 aa, Entamoeba histolytica
KMSSERINLLFNVLGIFKEPGRVVEI

SEQ ID NO: 2717767 - protein, 27 aa, Entamoeba histolytica
KMSVLPVKNILMLYKRENIVTRGQVPL

SEQ ID NO: 2717768 - protein, 34 aa, Entamoeba histolytica
KMTEDWKNFEHKYDSLKLNMKKVPFIDNDNTKTM

SEQ ID NO: 2717769 - protein, 25 aa, Entamoeba histolytica
KMTSYESWRIMRKGSIIVLKEQRIF

SEQ ID NO: 2717770 - protein, 19 aa, Entamoeba histolytica
KMVFCVRNDLKMGKGKIAA

SEQ ID NO: 2717771 - protein, 22 aa, Entamoeba histolytica
KMVLILKLLKDEWNKSLKQYGE

SEQ ID NO: 2717772 - protein, 28 aa, Entamoeba histolytica
KMVRELYCGLIQLFCNLFEKEKNALQQI

SEQ ID NO: 2717773 - protein, 23 aa, Entamoeba histolytica
KMWDEFITFPDTTLYIYCVVGYL

SEQ ID NO: 2717774 - protein, 20 aa, Entamoeba histolytica
KMYHNHLEGFKKQRVREVFN

SEQ ID NO: 2717775 - protein, 20 aa, Entamoeba histolytica
KMYLLTFIVRFFIDNFKRID

SEQ ID NO: 2717776 - protein, 20 aa, Entamoeba histolytica
KMYVITRRSLIQYSERFELG

SEQ ID NO: 2717777 - protein, 20 aa, Entamoeba histolytica
KMYYYLVMEYCNFGTLAQYI

SEQ ID NO: 2717778 - protein, 25 aa, Entamoeba histolytica
KNAEYFFVPLIKRKCIVKQDYLVPI

SEQ ID NO: 2717779 - protein, 21 aa, Entamoeba histolytica
KNAKHLACRIFYQSKTQTIAD

SEQ ID NO: 2717780 - protein, 26 aa, Entamoeba histolytica
KNAKPMALILFNDLLMVCEYIEKGVF

SEQ ID NO: 2717781 - protein, 25 aa, Entamoeba histolytica
KNALDLVYIMVKYNFIFSQNISRSM

SEQ ID NO: 2717782 - protein, 24 aa, Entamoeba histolytica
KNASNIFISLFGNGTIIFYDSITG

SEQ ID NO: 2717783 - protein, 24 aa, Entamoeba histolytica
KNCGSYFVKNLGRRCSKYIRKMKE

SEQ ID NO: 2717784 - protein, 17 aa, Entamoeba histolytica
KNCVIITNKIRENVYGK

SEQ ID NO: 2717785 - protein, 33 aa, Entamoeba histolytica
KNDELLVELISYYSFFFGGFSNSILSYCVKSID

SEQ ID NO: 2717786 - protein, 32 aa, Entamoeba histolytica
KNDICYQQAFLILLLNQYLAITLKKQSKKCTI

SEQ ID NO: 2717787 - protein, 28 aa, Entamoeba histolytica
KNDKIVLDFFVWWKCPIQTINTIKQLAS

SEQ ID NO: 2717788 - protein, 35 aa, Entamoeba histolytica
KNDPGHFVFTLQNPFNIAPTPFYPIKKKCKSCAIH

SEQ ID NO: 2717789 - protein, 19 aa, Entamoeba histolytica
KNDRLFKRALEFDKFNESK

SEQ ID NO: 2717790 - protein, 25 aa, Entamoeba histolytica
KNDVDMIVILIKQLSLMNSDVFNSI

SEQ ID NO: 2717791 - protein, 17 aa, Entamoeba histolytica
KNDVGIFIGKMTKAFYT

SEQ ID NO: 2717792 - protein, 19 aa, Entamoeba histolytica
KNDVGIFIGKMTKAFYTKQ

SEQ ID NO: 2717793 - protein, 23 aa, Entamoeba histolytica
KNDVLGYLRRLEEIGLLHGGRKG

SEQ ID NO: 2717794 - protein, 20 aa, Entamoeba histolytica
KNDVLSLWKKKYETLQLQWN

SEQ ID NO: 2717795 - protein, 30 aa, Entamoeba histolytica
KNEEKLLPREVILWVLLPADEESYNYPIKI

SEQ ID NO: 2717796 - protein, 21 aa, Entamoeba histolytica
KNEGLYTYDELLDRIFAQCNI

SEQ ID NO: 2717797 - protein, 17 aa, Entamoeba histolytica
KNEIILQSLFVDSIMKF

SEQ ID NO: 2717798 - protein, 21 aa, Entamoeba histolytica
KNEINKWLPSIKVALMGGTRE

SEQ ID NO: 2717799 - protein, 32 aa, Entamoeba histolytica
KNEIRLPIETYSFYYFLTYKEALNQMKNFNKC

SEQ ID NO: 2717800 - protein, 24 aa, Entamoeba histolytica
KNEIVSSILFNGKLILTSEQINIH

SEQ ID NO: 2717801 - protein, 23 aa, Entamoeba histolytica
KNEKILPRYIVDKLLEKIGRPES

SEQ ID NO: 2717802 - protein, 27 aa, Entamoeba histolytica
KNEKKPVFQLLLYFLVLDIDNENEESI

SEQ ID NO: 2717803 - protein, 18 aa, Entamoeba histolytica
KNEKLLKFIFVHPPKHEK

SEQ ID NO: 2717804 - protein, 25 aa, Entamoeba histolytica
KNELARLLIKYLKNGKIQSLHKSFE

SEQ ID NO: 2717805 - protein, 26 aa, Entamoeba histolytica
KNELLSFLKFHSQDILNLIIKCPHEE

SEQ ID NO: 2717806 - protein, 28 aa, Entamoeba histolytica
KNELRGCIGCFSPSRPLYELVQQYAIAS

SEQ ID NO: 2717807 - protein, 31 aa, Entamoeba histolytica
KNELRLRLCVLFLRTLYEELLKHKASDLNLD

SEQ ID NO: 2717808 - protein, 23 aa, Entamoeba histolytica
KNENWEFIPFDLSTTPLIGRNYF

SEQ ID NO: 2717809 - protein, 19 aa, Entamoeba histolytica
KNERIFVTLKPPRSNKIVP

SEQ ID NO: 2717810 - protein, 24 aa, Entamoeba histolytica
KNESPFYFVLRHIELLRKNTIHSL

SEQ ID NO: 2717811 - protein, 22 aa, Entamoeba histolytica
KNEWKIDLFIQIITKYIEKLQT

SEQ ID NO: 2717812 - protein, 19 aa, Entamoeba histolytica
KNEWLFTFGYSVHWPEKSD

SEQ ID NO: 2717813 - protein, 26 aa, Entamoeba histolytica
KNFDDFISKLVKLPRISLKQSREVLK

SEQ ID NO: 2717814 - protein, 28 aa, Entamoeba histolytica
KNFGMSENWFFAGRFDISLIRQLSEDGN

SEQ ID NO: 2717815 - protein, 17 aa, Entamoeba histolytica
KNFLKKVKPSLYTDCLL

SEQ ID NO: 2717816 - protein, 20 aa, Entamoeba histolytica
KNFPFILGVIVKKGEEDKES

SEQ ID NO: 2717817 - protein, 24 aa, Entamoeba histolytica
KNFYKSPFIVCTYNYILDPKEENV

SEQ ID NO: 2717818 - protein, 23 aa, Entamoeba histolytica
KNGDKWISVPWKLTELKKNIEKW

SEQ ID NO: 2717819 - protein, 31 aa, Entamoeba histolytica; identical to SEQ ID NO: 2530182

SEQ ID NO: 2717820 - protein, 26 aa, Entamoeba histolytica
KNGGVYFVPAFQGLGTPYWDDDVRGI

SEQ ID NO: 2717821 - protein, 19 aa, Entamoeba histolytica
KNGIHGVLFNLLNSADSQV

SEQ ID NO: 2717822 - protein, 26 aa, Entamoeba histolytica
KNGKYYGVWWGCKLVFDCMKYIDPIL

SEQ ID NO: 2717823 - protein, 23 aa, Entamoeba histolytica
KNGRLPAIEFMFGLPLETPRNKQ

SEQ ID NO: 2717824 - protein, 26 aa, Entamoeba histolytica
KNHFKILSIFNPFSIISSLLITKNEV

SEQ ID NO: 2717825 - protein, 19 aa, Entamoeba histolytica
KNHLLFEETLKIAKKLFIH

SEQ ID NO: 2717826 - protein, 21 aa, Entamoeba histolytica
KNHLLPIAKFFDEKYKSIICE

SEQ ID NO: 2717827 - protein, 24 aa, Entamoeba histolytica
KNHLPNLPLFRQHLIRQGKLTQEA

SEQ ID NO: 2717828 - protein, 24 aa, Entamoeba histolytica
KNHLTFFHKAFYEEKFTTLTTQAN

SEQ ID NO: 2717829 - protein, 18 aa, Entamoeba histolytica
KNHLVILAHAKKLGGQLK

SEQ ID NO: 2717830 - protein, 26 aa, Entamoeba histolytica
KNHSLAFRVYVYCGVMLSNPFVYEID

SEQ ID NO: 2717831 - protein, 21 aa, Entamoeba histolytica
KNIEVTVEIGFLLQTYNKTFK

SEQ ID NO: 2717832 - protein, 19 aa, Entamoeba histolytica
KNIFLMNGIYYTVTDIIDG

SEQ ID NO: 2717833 - protein, 23 aa, Entamoeba histolytica
KNIISTSMLFYNETMIGLIGSDI

SEQ ID NO: 2717834 - protein, 23 aa, Entamoeba histolytica
KNIIYEAKRFIGRRVKPNEIEND

SEQ ID NO: 2717835 - protein, 24 aa, Entamoeba histolytica
KNIKNYFIEYFDKKIQVIDDMLNL

SEQ ID NO: 2717836 - protein, 22 aa, Entamoeba histolytica
KNILEKEILPNFKFSYQKYNEC

SEQ ID NO: 2717837 - protein, 24 aa, Entamoeba histolytica
KNILFGIQTFLVNCLFTAGCNKEF

SEQ ID NO: 2717838 - protein, 23 aa, Entamoeba histolytica
KNINLWMKESIIPWINFIKKRDN

SEQ ID NO: 2717839 - protein, 20 aa, Entamoeba histolytica
KNIPVVLVGNKLDLITDENN

SEQ ID NO: 2717840 - protein, 28 aa, Entamoeba histolytica
KNIQFISGNRIFLNEPILLSIRTPENIK

SEQ ID NO: 2717841 - protein, 35 aa, Entamoeba histolytica
KNIQKGNNPIIVHTPFRMTGTFDGVISFDHNRFLF

SEQ ID NO: 2717842 - protein, 25 aa, Entamoeba histolytica
KNIRKLCPLLIPYNSNPIFETPSSY

SEQ ID NO: 2717843 - protein, 19 aa, Entamoeba histolytica
KNISAYNLLLNKIAVQLKV

SEQ ID NO: 2717844 - protein, 18 aa, Entamoeba histolytica
KNISLLSKSWNKLNCIKK

SEQ ID NO: 2717845 - protein, 27 aa, Entamoeba histolytica
KNITTKPIQYLFFTSKIPSLIELVIPW

SEQ ID NO: 2717846 - protein, 22 aa, Entamoeba histolytica
KNITYTFPLSTLMSWGTDSSKT

SEQ ID NO: 2717847 - protein, 37 aa, Entamoeba histolytica
KNKDQYPLIWYPDVFVLNGGYRYFYHLFPECCGGYIR

SEQ ID NO: 2717848 - protein, 25 aa, Entamoeba histolytica
KNKEYCKIFRIIFRFISKVITERID

SEQ ID NO: 2717849 - protein, 27 aa, Entamoeba histolytica
KNKFEDKWYMLELDKKWIKEINKAEIR

SEQ ID NO: 2717850 - protein, 18 aa, Entamoeba histolytica
KNKFTSLYCVFPLVGSEA

SEQ ID NO: 2717851 - protein, 25 aa, Entamoeba histolytica
KNKIFEQIHLLIDLSFVMGYSFRSS

SEQ ID NO: 2717852 - protein, 21 aa, Entamoeba histolytica
KNKIRFEWLVNLFDTENNELK

SEQ ID NO: 2717853 - protein, 29 aa, Entamoeba histolytica
KNKITELNLLLIDILNMLGYTFTTTTSEG

SEQ ID NO: 2717854 - protein, 27 aa, Entamoeba histolytica
KNKKGMFKIYMRGVVLALKNIDEPTIL

SEQ ID NO: 2717855 - protein, 25 aa, Entamoeba histolytica
KNKKVFVQNLLIDLLDEFGFQFHTT

SEQ ID NO: 2717856 - protein, 24 aa, Entamoeba histolytica
KNKNIMERLISVPKLLDDASLQPT

SEQ ID NO: 2717857 - protein, 24 aa, Entamoeba histolytica
KNKNPYIIFCNMKREEVKAANPDL

SEQ ID NO: 2717858 - protein, 17 aa, Entamoeba histolytica
KNKSLILSLLKENDTPL

SEQ ID NO: 2717859 - protein, 24 aa, Entamoeba histolytica
KNKTPVYCMRWTPDGRRIVTGNEK

SEQ ID NO: 2717860 - protein, 22 aa, Entamoeba histolytica
KNKYEVSILFILKSLFKLYQFT

SEQ ID NO: 2717861 - protein, 26 aa, Entamoeba histolytica
KNLDHQLIYIHLTVLPKQKSSSLLSP

SEQ ID NO: 2717862 - protein, 21 aa, Entamoeba histolytica
KNLEHLLLRKNNIEQIPALSI

SEQ ID NO: 2717863 - protein, 18 aa, Entamoeba histolytica
KNLFFQKRILDEVVNDPD

SEQ ID NO: 2717864 - protein, 27 aa, Entamoeba histolytica
KNLGVLDFLIKPIQRITKYPLFVKNLK

SEQ ID NO: 2717865 - protein, 17 aa, Entamoeba histolytica
KNLIIVMEYARGGDLSR

SEQ ID NO: 2717866 - protein, 21 aa, Entamoeba histolytica
KNLIKNAFFEKGIESRKVNYL

SEQ ID NO: 2717867 - protein, 17 aa, Entamoeba histolytica
KNLKILEDQSKLYHAYW

SEQ ID NO: 2717868 - protein, 37 aa, Entamoeba histolytica
KNLKRYLTVLSTPHYQFLTFLKICNYLLTSPLYSQAN

SEQ ID NO: 2717869 - protein, 27 aa, Entamoeba histolytica
KNLMTTSGLLYYIEWSQKGNLFRIELF

SEQ ID NO: 2717870 - protein, 19 aa, Entamoeba histolytica
KNLTIRGALTLNGSCIFVC

SEQ ID NO: 2717871 - protein, 25 aa, Entamoeba histolytica
KNLVEYAFALTYFRDIVVARFSDES

SEQ ID NO: 2717872 - protein, 31 aa, Entamoeba histolytica
KNMKDALSFLPFLNYITLKHIIFHLHLIAQY

SEQ ID NO: 2717873 - protein, 23 aa, Entamoeba histolytica
KNNGLILQKPFDNVFLTLEDLII

SEQ ID NO: 2717874 - protein, 19 aa, Entamoeba histolytica
KNNGYEIVLFFLSQTLITN

SEQ ID NO: 2717875 - protein, 20 aa, Entamoeba histolytica
KNNLLIQKHQLRALLYFIPI

SEQ ID NO: 2717876 - protein, 31 aa, Entamoeba histolytica
KNNLSKFEIPTLKLPIMFNSTDNRLECLKRI

SEQ ID NO: 2717877 - protein, 26 aa, Entamoeba histolytica
KNNPNWLIEFLIGSSLRKGSQERAIE

SEQ ID NO: 2717878 - protein, 26 aa, Entamoeba histolytica
KNPHKHNIIAYKRLGFKVVLCGHLDT

SEQ ID NO: 2717879 - protein, 19 aa, Entamoeba histolytica
KNPIFITSLPRSGSTYLHN

SEQ ID NO: 2717880 - protein, 19 aa, Entamoeba histolytica
KNPSLVTLGIMRPSVSDSS

SEQ ID NO: 2717881 - protein, 20 aa, Entamoeba histolytica
KNQFIFVLSNLEHLNEKLNS

SEQ ID NO: 2717882 - protein, 27 aa, Entamoeba histolytica
KNQGEFLFILFIRRFVELLKNNGCKLS

SEQ ID NO: 2717883 - protein, 36 aa, Entamoeba histolytica
KNQKNEPVFFLLPDQSICYLLLQKIGVVEHLLNTQL

SEQ ID NO: 2717884 - protein, 22 aa, Entamoeba histolytica
KNQLSALAFNLQENEKRIEEQK

SEQ ID NO: 2717885 - protein, 24 aa, Entamoeba histolytica
KNQNYFCINTPLLFSKMSLSKEIT

SEQ ID NO: 2717886 - protein, 22 aa, Entamoeba histolytica
KNQPMALLLPAIVSATSKIISQ

SEQ ID NO: 2717887 - protein, 24 aa, Entamoeba histolytica
KNQPQAIMFLVDQLKDIANQRILI

SEQ ID NO: 2717888 - protein, 23 aa, Entamoeba histolytica
KNQPTLVLFPVSTIAQMRPQLQY

SEQ ID NO: 2717889 - protein, 17 aa, Entamoeba histolytica
KNQQIQFLKRRLAALYN

SEQ ID NO: 2717890 - protein, 25 aa, Entamoeba histolytica
KNRCDRFYAIYYQSSSPLLVDLSLF

SEQ ID NO: 2717891 - protein, 29 aa, Entamoeba histolytica
KNRDLIKEPLLLHIILSLHSYEVIDLCHA

SEQ ID NO: 2717892 - protein, 28 aa, Entamoeba histolytica
KNRDWVNMRSWWFNEDKSLFIIINHSVE

SEQ ID NO: 2717893 - protein, 26 aa, Entamoeba histolytica
KNRGDMGQLFYWLLVGENEKTKISLR

SEQ ID NO: 2717894 - protein, 24 aa, Entamoeba histolytica
KNRLHEWPTYCYLLKELKSIETQD

SEQ ID NO: 2717895 - protein, 30 aa, Entamoeba histolytica; identical to SEQ ID NO: 2530255

SEQ ID NO: 2717896 - protein, 20 aa, Entamoeba histolytica
KNRVEWIQRRLQAHNYPVSI

SEQ ID NO: 2717897 - protein, 27 aa, Entamoeba histolytica
KNSELLQCIYIICKKLIINNSAGIIEP

SEQ ID NO: 2717898 - protein, 27 aa, Entamoeba histolytica
KNSEQMKIFQLFRQLERLSYDDICSKT

SEQ ID NO: 2717899 - protein, 24 aa, Entamoeba histolytica
KNSKDYLIFVTNNQQLIIAQLNDN

SEQ ID NO: 2717900 - protein, 27 aa, Entamoeba histolytica
KNSMLRPLVILIRYLLHQAGFTSVMSG

SEQ ID NO: 2717901 - protein, 22 aa, Entamoeba histolytica
KNSRGFSLFLIDGRKREMYLSG

SEQ ID NO: 2717902 - protein, 18 aa, Entamoeba histolytica
KNSRIWLNSALSGKSKRI

SEQ ID NO: 2717903 - protein, 25 aa, Entamoeba histolytica
KNSYYMWSINFSQINAILLSETAKS

SEQ ID NO: 2717904 - protein, 19 aa, Entamoeba histolytica
KNTIIILNKVIICLEQMKV

SEQ ID NO: 2717905 - protein, 24 aa, Entamoeba histolytica
KNTKNLTPIFLLTGEIAGYDAYSS

SEQ ID NO: 2717906 - protein, 25 aa, Entamoeba histolytica
KNTMDVSLANYLSLIESYGVLQESP

SEQ ID NO: 2717907 - protein, 26 aa, Entamoeba histolytica
KNTTNEQPLFLRRFNQTFNSPYRRNG

SEQ ID NO: 2717908 - protein, 30 aa, Entamoeba histolytica; identical to SEQ ID NO: 2530274

SEQ ID NO: 2717909 - protein, 38 aa, Entamoeba histolytica
KNVDLWNCKGAISYIDKLRLYIKTMVEYLKANSGRKII

SEQ ID NO: 2717910 - protein, 21 aa, Entamoeba histolytica
KNVKKDKRPDHLKPSYLQNNN

SEQ ID NO: 2717911 - protein, 30 aa, Entamoeba histolytica
KNVLMQLHHPFIVKLYYAFQTTDKLYMVMD

SEQ ID NO: 2717912 - protein, 22 aa, Entamoeba histolytica
KNVNLSRYIIMKAFEKFDQNKT

SEQ ID NO: 2717913 - protein, 18 aa, Entamoeba histolytica
KNVRLRYYLRVSVNKKYS

SEQ ID NO: 2717914 - protein, 21 aa, Entamoeba histolytica
KNVSLIDLCRCAFLSMYNNQD

SEQ ID NO: 2717915 - protein, 17 aa, Entamoeba histolytica
KNWKPLRQQIPKAVPDF

SEQ ID NO: 2717916 - protein, 18 aa, Entamoeba histolytica
KNWKPLRQQIPKAVPDFF

SEQ ID NO: 2717917 - protein, 17 aa, Entamoeba histolytica
KNYDVLYPAPYGSTYNS

SEQ ID NO: 2717918 - protein, 25 aa, Entamoeba histolytica
KNYGFAQSYKRLLQYYLPMDSVDFA

SEQ ID NO: 2717919 - protein, 35 aa, Entamoeba histolytica
KNYHDVTLPIRYYQNFIKPFPHCHYCILKTDIHTG

SEQ ID NO: 2717920 - protein, 24 aa, Entamoeba histolytica
KNYKDQAIFFLNAFWAEAGKDAEN

SEQ ID NO: 2717921 - protein, 24 aa, Entamoeba histolytica
KNYLLDTFEPIIDGLILGGDYSEE

SEQ ID NO: 2717922 - protein, 30 aa, Entamoeba histolytica; identical to SEQ ID NO: 2530290

SEQ ID NO: 2717923 - protein, 26 aa, Entamoeba histolytica
KNYYEQHPFYAFFYSEEKEQPEEEVE

SEQ ID NO: 2717924 - protein, 24 aa, Entamoeba histolytica
KPAEKLRPLYWNRIVIDMNNDKSI

SEQ ID NO: 2717925 - protein, 28 aa, Entamoeba histolytica
KPAKLKKHYLINGYYYAMAKYLFQKTKT

SEQ ID NO: 2717926 - protein, 21 aa, Entamoeba histolytica
KPAWNLEKLRKSIVPGAVLII

SEQ ID NO: 2717927 - protein, 17 aa, Entamoeba histolytica
KPCVVFATLASFSVGSI

SEQ ID NO: 2717928 - protein, 24 aa, Entamoeba histolytica
KPDMSTFVFVRILTNVDNFKIHPD

SEQ ID NO: 2717929 - protein, 17 aa, Entamoeba histolytica
KPDSRFKKDARFKNFSK

SEQ ID NO: 2717930 - protein, 30 aa, Entamoeba histolytica
KPEEIPLPNRPILSMKALYDYEASDSTELS

SEQ ID NO: 2717931 - protein, 26 aa, Entamoeba histolytica
KPEEYFRFLWELRMVFNRDLTQLESL

SEQ ID NO: 2717932 - protein, 22 aa, Entamoeba histolytica
KPEGMLLTDCYLEYLKIATSDR

SEQ ID NO: 2717933 - protein, 19 aa, Entamoeba histolytica
KPEQPFLSSLRDLFIKLMR

SEQ ID NO: 2717934 - protein, 25 aa, Entamoeba histolytica
KPESSQTLLFTRMYQNPKKRIDDGE

SEQ ID NO: 2717935 - protein, 22 aa, Entamoeba histolytica
KPFEQFIDPNLFEKAMSLNTAL

SEQ ID NO: 2717936 - protein, 20 aa, Entamoeba histolytica
KPFFQTLLTCKVEEGIQSGV

SEQ ID NO: 2717937 - protein, 23 aa, Entamoeba histolytica
KPFLAESIAKFLSLGPIHTRKGI

SEQ ID NO: 2717938 - protein, 18 aa, Entamoeba histolytica
KPFRAVPVQPKPVKIDVP

SEQ ID NO: 2717939 - protein, 23 aa, Entamoeba histolytica
KPFSYGCLKNFPEQWRGLRNKEL

SEQ ID NO: 2717940 - protein, 26 aa, Entamoeba histolytica
KPGCQKIFHFCSFDVILKVKPSERWS

SEQ ID NO: 2717941 - protein, 18 aa, Entamoeba histolytica
KPGIELILDLFQFDQIIE

SEQ ID NO: 2717942 - protein, 22 aa, Entamoeba histolytica
KPGVINWSMFARPKNGRSLNIF

SEQ ID NO: 2717943 - protein, 25 aa, Entamoeba histolytica
KPGWDNMTLLVVKFKSFNPQPDITT

SEQ ID NO: 2717944 - protein, 24 aa, Entamoeba histolytica
KPHQHLLIVTKRPRSYNARPIIIH

SEQ ID NO: 2717945 - protein, 18 aa, Entamoeba histolytica
KPIEPYLTTLIVKVDRDN

SEQ ID NO: 2717946 - protein, 28 aa, Entamoeba histolytica
KPIKIPLQGILCDLLWSDPHDLPVDGWM

SEQ ID NO: 2717947 - protein, 24 aa, Entamoeba histolytica
KPIKQLFIHFLNKLTSNLNCAISS

SEQ ID NO: 2717948 - protein, 22 aa, Entamoeba histolytica
KPIMPITITEPIIQQPVATIPP

SEQ ID NO: 2717949 - protein, 22 aa, Entamoeba histolytica
KPIRIQNQIYLLITFNNYCSET

SEQ ID NO: 2717950 - protein, 18 aa, Entamoeba histolytica
KPISLKKDKLFSDHTSQQ

SEQ ID NO: 2717951 - protein, 24 aa, Entamoeba histolytica
KPKKRYFYLFNDILVYGRMQLQLF

SEQ ID NO: 2717952 - protein, 25 aa, Entamoeba histolytica
KPKTVFVYSSLPTQFQGRRIQQLGK

SEQ ID NO: 2717953 - protein, 35 aa, Entamoeba histolytica
KPLFDCDQLQCYILYVKMHFFPEMTEEAELVIQKY

SEQ ID NO: 2717954 - protein, 23 aa, Entamoeba histolytica
KPLHNLPHPLQLLEKRKPGVDQR

SEQ ID NO: 2717955 - protein, 18 aa, Entamoeba histolytica
KPLISIASDFIPGGEIIK

SEQ ID NO: 2717956 - protein, 39 aa, Entamoeba histolytica; identical to SEQ ID NO: 2530327

SEQ ID NO: 2717957 - protein, 25 aa, Entamoeba histolytica
KPLVCIGSCYALCKPSQFPVGGCCY

SEQ ID NO: 2717958 - protein, 18 aa, Entamoeba histolytica
KPMKLNYKHLPKTTQKKM

SEQ ID NO: 2717959 - protein, 26 aa, Entamoeba histolytica
KPNEPLNYRINFIGTFYVSKDNVKEK

SEQ ID NO: 2717960 - protein, 17 aa, Entamoeba histolytica
KPNQTEIAILPTTNKNQ

SEQ ID NO: 2717961 - protein, 21 aa, Entamoeba histolytica
KPPKGVILYGPPGTGKTLLAK

SEQ ID NO: 2717962 - protein, 24 aa, Entamoeba histolytica
KPPKKFIDIITKIYKRMFRVYAHM

SEQ ID NO: 2717963 - protein, 24 aa, Entamoeba histolytica
KPPKYERFIRPAAMRFTKAHVTHP

SEQ ID NO: 2717964 - protein, 23 aa, Entamoeba histolytica
KPQLDLGSLLIMPVQRTPRYVLL

SEQ ID NO: 2717965 - protein, 21 aa, Entamoeba histolytica
KPQQFSQIIAWFNQVDKDHSG

SEQ ID NO: 2717966 - protein, 23 aa, Entamoeba histolytica
KPQQFSQIIAWFNQVDKDHSGTL

SEQ ID NO: 2717967 - protein, 26 aa, Entamoeba histolytica
KPRPPFFDGFIDLLKRFKEQGGIVAV

SEQ ID NO: 2717968 - protein, 19 aa, Entamoeba histolytica
KPSFLPPKPQSNAPRFKVR

SEQ ID NO: 2717969 - protein, 18 aa, Entamoeba histolytica
KPSIGFLSDIRRMNVALT

SEQ ID NO: 2717970 - protein, 23 aa, Entamoeba histolytica
KPSKPFIHSGLQLLFIGTNHERG

SEQ ID NO: 2717971 - protein, 23 aa, Entamoeba histolytica
KPSKPLVKKPSKPLIKKPSKPSK

SEQ ID NO: 2717972 - protein, 31 aa, Entamoeba histolytica; identical to SEQ ID NO: 2530342

SEQ ID NO: 2717973 - protein, 23 aa, Entamoeba histolytica
KPSLIMSKFFPALQGSMGKMSAS

SEQ ID NO: 2717974 - protein, 23 aa, Entamoeba histolytica
KPSNELLECPVCSKKFPMSQIES

SEQ ID NO: 2717975 - protein, 27 aa, Entamoeba histolytica
KPSPVDTMLTLFTPLPPILQQYNTLSQ

SEQ ID NO: 2717976 - protein, 33 aa, Entamoeba histolytica
KPSQPPFYQNQSNILIVFKIDTSVFGLYINDKT

SEQ ID NO: 2717977 - protein, 18 aa, Entamoeba histolytica
KPSYYKPHPLRCLRKSLF

SEQ ID NO: 2717978 - protein, 19 aa, Entamoeba histolytica
KPTIIVGTPGRLASLNNSG

SEQ ID NO: 2717979 - protein, 20 aa, Entamoeba histolytica
KPTIPVVVTPPLEEKEKLSK

SEQ ID NO: 2717980 - protein, 22 aa, Entamoeba histolytica
KPTIVFIPFTIPDKFDQRLITI

SEQ ID NO: 2717981 - protein, 18 aa, Entamoeba histolytica
KPTLAELIAMQKAGNLPK

SEQ ID NO: 2717982 - protein, 26 aa, Entamoeba histolytica
KPTWNTILKVIFYSLKKMFPMKEYFS

SEQ ID NO: 2717983 - protein, 17 aa, Entamoeba histolytica
KPTYRPPQQTIPEPVQE

SEQ ID NO: 2717984 - protein, 18 aa, Entamoeba histolytica
KPVLIVRLGDKLYPTNKH

SEQ ID NO: 2717985 - protein, 17 aa, Entamoeba histolytica
KPWILSCSDDRTIRIWN

SEQ ID NO: 2717986 - protein, 23 aa, Entamoeba histolytica
KPYDQLLNEILGIRIKRSANLNS

SEQ ID NO: 2717987 - protein, 22 aa, Entamoeba histolytica
KPYNITLSPFKEYSFHPIITTI

SEQ ID NO: 2717988 - protein, 17 aa, Entamoeba histolytica
KQAILALRESLTTTNDK

SEQ ID NO: 2717989 - protein, 20 aa, Entamoeba histolytica
KQAIYNLIGRNKTIKCPVAG

SEQ ID NO: 2717990 - protein, 21 aa, Entamoeba histolytica
KQASYLSPLPTRPSHQKTESC

SEQ ID NO: 2717991 - protein, 21 aa, Entamoeba histolytica
KQCIEFLKPIMNTIIQFIHLI

SEQ ID NO: 2717992 - protein, 23 aa, Entamoeba histolytica
KQECFLIGLLQLKYNIICERPYK

SEQ ID NO: 2717993 - protein, 37 aa, Entamoeba histolytica
KQEDMEKYFAVFGRFKSCILMVHRGRSKGFGFVEYET

SEQ ID NO: 2717994 - protein, 25 aa, Entamoeba histolytica
KQEETKIKFIIKEVTSETPSSSEEE

SEQ ID NO: 2717995 - protein, 25 aa, Entamoeba histolytica
KQEIGVIINKWDLFEQKRKLVIESM

SEQ ID NO: 2717996 - protein, 17 aa, Entamoeba histolytica
KQEIKWIQVYQDELYVL

SEQ ID NO: 2717997 - protein, 26 aa, Entamoeba histolytica
KQELYQNLITLYLEPSLVQLCQNVYD

SEQ ID NO: 2717998 - protein, 25 aa, Entamoeba histolytica
KQEQEVGYVLYPLKRKNDIIGTIAK

SEQ ID NO: 2717999 - protein, 33 aa, Entamoeba histolytica
KQEQTKRASFMNYLWRGYSVDGLPQNVSQDLST

SEQ ID NO: 2718000 - protein, 25 aa, Entamoeba histolytica
KQFGYLFQLLVLKCTSLGLSTVWLG

SEQ ID NO: 2718001 - protein, 23 aa, Entamoeba histolytica
KQFLPHSIEIYSEPTFLIPVNEC

SEQ ID NO: 2718002 - protein, 18 aa, Entamoeba histolytica
KQFVALKVLRNRLAYFRQ

SEQ ID NO: 2718003 - protein, 27 aa, Entamoeba histolytica
KQGDKLLINWFKIRSIGNLVKEIMVKQ

SEQ ID NO: 2718004 - protein, 27 aa, Entamoeba histolytica
KQHDFFSNIKFALIRNMTPPIIPRLNG

SEQ ID NO: 2718005 - protein, 30 aa, Entamoeba histolytica; identical to SEQ ID NO: 2530379

SEQ ID NO: 2718006 - protein, 21 aa, Entamoeba histolytica
KQHEFYINWKAQQAMNYLTMN

SEQ ID NO: 2718007 - protein, 20 aa, Entamoeba histolytica
KQHFHNILLMFQLMNHLLNS

SEQ ID NO: 2718008 - protein, 23 aa, Entamoeba histolytica
KQHFHNILLMFQLMNHLLNSNYT

SEQ ID NO: 2718009 - protein, 19 aa, Entamoeba histolytica
KQIAFLCHVAYLALNGDYS

SEQ ID NO: 2718010 - protein, 24 aa, Entamoeba histolytica
KQIDLFFEILKFGIDLKEAIAYTK

SEQ ID NO: 2718011 - protein, 17 aa, Entamoeba histolytica
KQIEIPSLLFKYTPSKY

SEQ ID NO: 2718012 - protein, 24 aa, Entamoeba histolytica
KQIISLMIIKFKQLGVTCREPKIV

SEQ ID NO: 2718013 - protein, 25 aa, Entamoeba histolytica
KQIKIIFMLKHVVIPFNYTPWFDYS

SEQ ID NO: 2718014 - protein, 30 aa, Entamoeba histolytica; identical to SEQ ID NO: 2530384

SEQ ID NO: 2718015 - protein, 25 aa, Entamoeba histolytica
KQINSLPSLPLNNTPLGIALKAIKP

SEQ ID NO: 2718016 - protein, 17 aa, Entamoeba histolytica
KQIQFVELYNMTCTAKL

SEQ ID NO: 2718017 - protein, 28 aa, Entamoeba histolytica
KQIQMDTFAYLPFFLTSFKDINSLKMSQ

SEQ ID NO: 2718018 - protein, 29 aa, Entamoeba histolytica
KQIQNSIKYNILYPLKKELIINKHQEHEE

SEQ ID NO: 2718019 - protein, 18 aa, Entamoeba histolytica
KQISVYYHYIIEKTIEVI

SEQ ID NO: 2718020 - protein, 19 aa, Entamoeba histolytica
KQITLKITLIRSPGERPII

SEQ ID NO: 2718021 - protein, 20 aa, Entamoeba histolytica
KQIVELLTDNDYLKQARITA

SEQ ID NO: 2718022 - protein, 39 aa, Entamoeba histolytica
KQIYSAFNVFIKYLSYYTTYMNIYFPLKTFYESDNNTIK

SEQ ID NO: 2718023 - protein, 24 aa, Entamoeba histolytica
KQKEPLLDAYADNIQRKLVPAIND

SEQ ID NO: 2718024 - protein, 26 aa, Entamoeba histolytica
KQKGDGCFLWALIQNFFSEICQKISN

SEQ ID NO: 2718025 - protein, 23 aa, Entamoeba histolytica
KQKLTLYHYYNGGMSFYVPIGDE

SEQ ID NO: 2718026 - protein, 26 aa, Entamoeba histolytica
KQKNFSHHLLPLPYFFHLVSQFNNGM

SEQ ID NO: 2718027 - protein, 38 aa, Entamoeba histolytica
KQKRIPIDQFLIQPIQRLLRYVLLLKELIKATPEIIID

SEQ ID NO: 2718028 - protein, 19 aa, Entamoeba histolytica
KQKTMDWWSCVIIGDEEID

SEQ ID NO: 2718029 - protein, 20 aa, Entamoeba histolytica
KQKVNIIRIGNYAGINSKVN

SEQ ID NO: 2718030 - protein, 26 aa, Entamoeba histolytica
KQKYERSLDLYNYLRSELVEDMKNII

SEQ ID NO: 2718031 - protein, 19 aa, Entamoeba histolytica
KQLEFIKKYANISDENVSE

SEQ ID NO: 2718032 - protein, 19 aa, Entamoeba histolytica
KQLHIIQYKIINGSILKLN

SEQ ID NO: 2718033 - protein, 17 aa, Entamoeba histolytica
KQLIYLSIQTSVTLVDT

SEQ ID NO: 2718034 - protein, 25 aa, Entamoeba histolytica
KQLMKLPNYFLRGCRSIELIDTKNV

SEQ ID NO: 2718035 - protein, 20 aa, Entamoeba histolytica
KQLNITWRYSMKKILTKEAR

SEQ ID NO: 2718036 - protein, 24 aa, Entamoeba histolytica
KQLNLSLLILRRVLVKRSDDGLSI

SEQ ID NO: 2718037 - protein, 24 aa, Entamoeba histolytica
KQLPFVPEQLKFVKYKKYRFMTIE

SEQ ID NO: 2718038 - protein, 27 aa, Entamoeba histolytica
KQLPKMIEIMILLILENGMDFKGIFRF

SEQ ID NO: 2718039 - protein, 18 aa, Entamoeba histolytica
KQMFPQSTIIIVKDACHP

SEQ ID NO: 2718040 - protein, 28 aa, Entamoeba histolytica
KQMKKRLEMMFGKIKIGILGLEEMKEEG

SEQ ID NO: 2718041 - protein, 21 aa, Entamoeba histolytica
KQMKNLFERYFYHERARRMVE

SEQ ID NO: 2718042 - protein, 23 aa, Entamoeba histolytica
KQMKYVIMERKLMTFILHMVFQD

SEQ ID NO: 2718043 - protein, 25 aa, Entamoeba histolytica
KQMYEQIIITKLLPETMIDLRVQVM

SEQ ID NO: 2718044 - protein, 31 aa, Entamoeba histolytica
KQNISDLYQIETPLLHLIYKGKNLKNDKSTL

SEQ ID NO: 2718045 - protein, 24 aa, Entamoeba histolytica
KQNKYNIDWSFIGSAPLCGINSVE

SEQ ID NO: 2718046 - protein, 25 aa, Entamoeba histolytica
KQNNQFISFIQLISKLEQILSELFN

SEQ ID NO: 2718047 - protein, 37 aa, Entamoeba histolytica
KQNTIIFFNTNFIPYPQLLINTPIYSFQELGIRTNNR

SEQ ID NO: 2718048 - protein, 21 aa, Entamoeba histolytica
KQNVDIIIPPHLKSLIIKNCK

SEQ ID NO: 2718049 - protein, 19 aa, Entamoeba histolytica
KQPSLLKIKKMSSALQIGN

SEQ ID NO: 2718050 - protein, 21 aa, Entamoeba histolytica
KQQEIKKIIPFGLIGKTEKQM

SEQ ID NO: 2718051 - protein, 26 aa, Entamoeba histolytica
KQQKYCPPNLFSIVFKGFDDVYRINS

SEQ ID NO: 2718052 - protein, 20 aa, Entamoeba histolytica
KQQPNTMDLFAGLSAPSQPS

SEQ ID NO: 2718053 - protein, 26 aa, Entamoeba histolytica
KQQTWRWFVCLFSREFPVEKVIVIWD

SEQ ID NO: 2718054 - protein, 23 aa, Entamoeba histolytica
KQREELYFLIDYIKCLKDKTELK

SEQ ID NO: 2718055 - protein, 17 aa, Entamoeba histolytica
KQRIKFIKQPGFTTVEI

SEQ ID NO: 2718056 - protein, 22 aa, Entamoeba histolytica
KQRKMVKQVILFHMGKKAKKFI

SEQ ID NO: 2718057 - protein, 24 aa, Entamoeba histolytica
KQRKPLHTFNLFETKVLIQCNELG

SEQ ID NO: 2718058 - protein, 25 aa, Entamoeba histolytica
KQRKWKYHKGYQKWFKKLNDPIYTS

SEQ ID NO: 2718059 - protein, 25 aa, Entamoeba histolytica
KQRTQLFITSGKHKVLIASFIPGIC

SEQ ID NO: 2718060 - protein, 20 aa, Entamoeba histolytica
KQSMFQLTVKPGQILFVERF

SEQ ID NO: 2718061 - protein, 26 aa, Entamoeba histolytica
KQSMNIFNIIFPFYLDESPRNRILAV

SEQ ID NO: 2718062 - protein, 19 aa, Entamoeba histolytica
KQSPSKGGFWFWASKASDE

SEQ ID NO: 2718063 - protein, 30 aa, Entamoeba histolytica; identical to SEQ ID NO: 2530440

SEQ ID NO: 2718064 - protein, 29 aa, Entamoeba histolytica
KQTFVNLIEICRLFCLAAASKEKTKEKYV

SEQ ID NO: 2718065 - protein, 25 aa, Entamoeba histolytica
KQTGSLPVPLHIRNAPTSLMEKMGY

SEQ ID NO: 2718066 - protein, 29 aa, Entamoeba histolytica
KQTLQDTLRLLTILFKFGKYYEVEHAISS

SEQ ID NO: 2718067 - protein, 25 aa, Entamoeba histolytica
KQTVPLQLMQDMQAIPPLPQQKMNK

SEQ ID NO: 2718068 - protein, 33 aa, Entamoeba histolytica
KQTYECVICMVPIRRYHKIWSCPRCFTVVHSTC

SEQ ID NO: 2718069 - protein, 24 aa, Entamoeba histolytica
KQVFRYILGFTDFAFFQPTIFGIE

SEQ ID NO: 2718070 - protein, 17 aa, Entamoeba histolytica
KQVIVVNHLIYSIDKEN

SEQ ID NO: 2718071 - protein, 17 aa, Entamoeba histolytica
KQVKFLIDYFFEVKEKL

SEQ ID NO: 2718072 - protein, 27 aa, Entamoeba histolytica
KQVSLQELYLWLMEPINVIVTNELEYF

SEQ ID NO: 2718073 - protein, 25 aa, Entamoeba histolytica
KQVSSWLINTLFSSNFYKKEDDRKN

SEQ ID NO: 2718074 - protein, 31 aa, Entamoeba histolytica
KQYKEWPPLPQQKLKMIIDIKLSTISLLLRK

SEQ ID NO: 2718075 - protein, 19 aa, Entamoeba histolytica
KRAFKFPTMGKKARLICIP

SEQ ID NO: 2718076 - protein, 20 aa, Entamoeba histolytica
KRALKIIPIKNKVQMIKNER

SEQ ID NO: 2718077 - protein, 27 aa, Entamoeba histolytica
KRAPKAIKIIRFLAIKTMKTHNVKFDM

SEQ ID NO: 2718078 - protein, 26 aa, Entamoeba histolytica
KRCVLLHYPFILDYMIIKIIHNTNVY

SEQ ID NO: 2718079 - protein, 32 aa, Entamoeba histolytica
KRDDESFFLTTYPLDLLTFKLEVKIIRYFDNQ

SEQ ID NO: 2718080 - protein, 20 aa, Entamoeba histolytica
KRDFERGIKIEELQQFLPLE

SEQ ID NO: 2718081 - protein, 21 aa, Entamoeba histolytica
KRDFERGIKIEELQQFLPLEE

SEQ ID NO: 2718082 - protein, 19 aa, Entamoeba histolytica
KRDITTMMSLLFQPTFNNK

SEQ ID NO: 2718083 - protein, 24 aa, Entamoeba histolytica
KRDKNVFVASFRSPLRKPKDVFVI

SEQ ID NO: 2718084 - protein, 21 aa, Entamoeba histolytica
KRDLLLFASSFDDPQRWSKMK

SEQ ID NO: 2718085 - protein, 25 aa, Entamoeba histolytica
KRDWECIEALRLGLLNDHLCGLMQG

SEQ ID NO: 2718086 - protein, 24 aa, Entamoeba histolytica
KREDLRHELLITQKLWSAFPNADE

SEQ ID NO: 2718087 - protein, 27 aa, Entamoeba histolytica
KREELIDFIHACSERIQASKKKIVELQ

SEQ ID NO: 2718088 - protein, 27 aa, Entamoeba histolytica
KREEWLYYRGIYQKRLKDRELFKRRCK

SEQ ID NO: 2718089 - protein, 24 aa, Entamoeba histolytica
KREHHLYFLGYRDTSVYLSDLLYN

SEQ ID NO: 2718090 - protein, 18 aa, Entamoeba histolytica
KREIAKLNYLNGLKKKYK

SEQ ID NO: 2718091 - protein, 25 aa, Entamoeba histolytica
KREIGKSISFVWKLILEDGEYELQY

SEQ ID NO: 2718092 - protein, 26 aa, Entamoeba histolytica
KRELYKKIIFTLPDANITLLMNLCYL

SEQ ID NO: 2718093 - protein, 25 aa, Entamoeba histolytica
KREMPVLFQFHQISSLMFPDISGKI

SEQ ID NO: 2718094 - protein, 25 aa, Entamoeba histolytica
KRENVHLLNLPFYQTGKTGKKPVGQ

SEQ ID NO: 2718095 - protein, 20 aa, Entamoeba histolytica
KRFGALIIRITNPKTTALVF

SEQ ID NO: 2718096 - protein, 31 aa, Entamoeba histolytica
KRGDTIIVSEKHLSGWWYASNKETAKAGFVP

SEQ ID NO: 2718097 - protein, 22 aa, Entamoeba histolytica
KRGTICWSPKGNLLAIGTTADT

SEQ ID NO: 2718098 - protein, 18 aa, Entamoeba histolytica
KRGTTRNGYRRTLSTEKS

SEQ ID NO: 2718099 - protein, 24 aa, Entamoeba histolytica
KRGVECKCFFFIENEWKEVTVDEV

SEQ ID NO: 2718100 - protein, 22 aa, Entamoeba histolytica
KRHEDLIPFYQKHENFTKTLQS

SEQ ID NO: 2718101 - protein, 18 aa, Entamoeba histolytica
KRHIGNDIVVIVFKEMVD

SEQ ID NO: 2718102 - protein, 18 aa, Entamoeba histolytica
KRHIGNDVVVLIFKEYAG

SEQ ID NO: 2718103 - protein, 25 aa, Entamoeba histolytica
KRHVALLIRRNKWTVQLLTAHLNEV

SEQ ID NO: 2718104 - protein, 18 aa, Entamoeba histolytica
KRHVGNDVVVLIFKEQSS

SEQ ID NO: 2718105 - protein, 25 aa, Entamoeba histolytica
KRIDIELFPLKLYSFIHIKGELEIP

SEQ ID NO: 2718106 - protein, 18 aa, Entamoeba histolytica
KRIIIKCSYCSTPFFVGT

SEQ ID NO: 2718107 - protein, 18 aa, Entamoeba histolytica
KRIITGFNSNNIATSVGS

SEQ ID NO: 2718108 - protein, 21 aa, Entamoeba histolytica
KRIKQLRRDGVPKKVIEAMLQ

SEQ ID NO: 2718109 - protein, 25 aa, Entamoeba histolytica
KRIMKESFILFKKYSEGPFDVTFKI

SEQ ID NO: 2718110 - protein, 26 aa, Entamoeba histolytica
KRINVDELFIALGRKLLQINHKGEDA

SEQ ID NO: 2718111 - protein, 24 aa, Entamoeba histolytica
KRIRRKMMSLNIPTRPFLLTENTG

SEQ ID NO: 2718112 - protein, 27 aa, Entamoeba histolytica
KRIVMFDSWEILVLKYSLDEISQWCSS

SEQ ID NO: 2718113 - protein, 19 aa, Entamoeba histolytica
KRKEEWHPYLLFCKEHREE

SEQ ID NO: 2718114 - protein, 22 aa, Entamoeba histolytica
KRKEQLLLHRQRLKEMIESAED

SEQ ID NO: 2718115 - protein, 25 aa, Entamoeba histolytica
KRKFDPLMFYIYNRALNKDPKEVYL

SEQ ID NO: 2718116 - protein, 20 aa, Entamoeba histolytica
KRKIILEAIRKMPLENVTLL

SEQ ID NO: 2718117 - protein, 35 aa, Entamoeba histolytica
KRKLLNKLWEELPKSWKILIVDKYALKVISSFCGM

SEQ ID NO: 2718118 - protein, 22 aa, Entamoeba histolytica
KRKLRLFKIDEVYKNLTRVEQV

SEQ ID NO: 2718119 - protein, 20 aa, Entamoeba histolytica
KRKMLSYWKRNLEDIITGEQ

SEQ ID NO: 2718120 - protein, 18 aa, Entamoeba histolytica
KRKNKYGQLLKITSIKTM

SEQ ID NO: 2718121 - protein, 34 aa, Entamoeba histolytica
KRKYTELLKVTATKTMLLFNQYLEKKPGCKGKIK

SEQ ID NO: 2718122 - protein, 26 aa, Entamoeba histolytica
KRLAWTTLCRLAFLSIYQRTPVDFIN

SEQ ID NO: 2718123 - protein, 20 aa, Entamoeba histolytica
KRLFEITRYTIGIYGVMGIK

SEQ ID NO: 2718124 - protein, 20 aa, Entamoeba histolytica
KRLIFQVLTSKMNLSKEIDL

SEQ ID NO: 2718125 - protein, 17 aa, Entamoeba histolytica
KRLIGRRFSDPAIQNDM

SEQ ID NO: 2718126 - protein, 30 aa, Entamoeba histolytica
KRLNQLAIKYKHLYLTNTQILLGIRISRCQ

SEQ ID NO: 2718127 - protein, 19 aa, Entamoeba histolytica
KRLPDIKKYFPENCKKKVT

SEQ ID NO: 2718128 - protein, 25 aa, Entamoeba histolytica
KRLRKKRSLKKKREILKQLKKDKQQ

SEQ ID NO: 2718129 - protein, 17 aa, Entamoeba histolytica
KRMQDVKFMLSEKLKKL

SEQ ID NO: 2718130 - protein, 26 aa, Entamoeba histolytica
KRMRDFTCTYATRFLGFKPSAAPMGM

SEQ ID NO: 2718131 - protein, 18 aa, Entamoeba histolytica
KRMTIMQQAELRKQMRIR

SEQ ID NO: 2718132 - protein, 32 aa, Entamoeba histolytica
KRNAELMIILISFLPRFSMFDFKLLASSCVYF

SEQ ID NO: 2718133 - protein, 17 aa, Entamoeba histolytica
KRNEFIPELLRRTEILT

SEQ ID NO: 2718134 - protein, 24 aa, Entamoeba histolytica
KRNFKVKMQIFVKTLTGKTITLEV

SEQ ID NO: 2718135 - protein, 26 aa, Entamoeba histolytica
KRNHPSTPLFYKLSKSVPSQDIISHN

SEQ ID NO: 2718136 - protein, 20 aa, Entamoeba histolytica
KRNIPNLYSPEIPVVVQPPE

SEQ ID NO: 2718137 - protein, 24 aa, Entamoeba histolytica
KRNPHLFLMGFNQPGDLFRFEKVI

SEQ ID NO: 2718138 - protein, 23 aa, Entamoeba histolytica
KRNRIEILIKAKSFFREAINANN

SEQ ID NO: 2718139 - protein, 23 aa, Entamoeba histolytica
KRNSIVGTPYWMAPEVIRNKLYD

SEQ ID NO: 2718140 - protein, 21 aa, Entamoeba histolytica
KRPIGSFMFLGPSGVGKTELA

SEQ ID NO: 2718141 - protein, 19 aa, Entamoeba histolytica
KRQLLLKEIELEKSKIERL

SEQ ID NO: 2718142 - protein, 26 aa, Entamoeba histolytica
KRQQIKLLILIFWSLNTQKTEDIAEL

SEQ ID NO: 2718143 - protein, 24 aa, Entamoeba histolytica
KRQTLMFSATFPKQIQRLAADFLD

SEQ ID NO: 2718144 - protein, 22 aa, Entamoeba histolytica
KRRKYFPIIVKTTDIDLSEYTQ

SEQ ID NO: 2718145 - protein, 17 aa, Entamoeba histolytica
KRRLMRKDEIQFLIDFL

SEQ ID NO: 2718146 - protein, 23 aa, Entamoeba histolytica
KRRNKLYEMFLGDNVSNSIEVEQ

SEQ ID NO: 2718147 - protein, 24 aa, Entamoeba histolytica
KRRPKNCIIGLKKLIQVDNNELKI

SEQ ID NO: 2718148 - protein, 28 aa, Entamoeba histolytica
KRRVKLSLEYFLKLQYEPIPFSSFSMEI

SEQ ID NO: 2718149 - protein, 28 aa, Entamoeba histolytica
KRSCRKLLTIPFLQIQRLYFSDDNVIDL

SEQ ID NO: 2718150 - protein, 19 aa, Entamoeba histolytica
KRSILFNQFLTYQKGNCYQ

SEQ ID NO: 2718151 - protein, 24 aa, Entamoeba histolytica
KRSKGILFFGPPGTGKTMLAKAVA

SEQ ID NO: 2718152 - protein, 30 aa, Entamoeba histolytica; identical to SEQ ID NO: 2530552

SEQ ID NO: 2718153 - protein, 28 aa, Entamoeba histolytica
KRSSQRMLAYFPIKKILDENGRTIFDEG

SEQ ID NO: 2718154 - protein, 42 aa, Entamoeba histolytica
KRSTKFVKILSHLAIPDYPDKLLPTLIVYRNTNHVKQFIGLA

SEQ ID NO: 2718155 - protein, 19 aa, Entamoeba histolytica
KRSYVDILLPKIRDIKMQN

SEQ ID NO: 2718156 - protein, 24 aa, Entamoeba histolytica
KRTDGLFCLILTPTRELTQQVYDV

SEQ ID NO: 2718157 - protein, 22 aa, Entamoeba histolytica
KRTMLKTQYRMHPAISEFSNKM

SEQ ID NO: 2718158 - protein, 23 aa, Entamoeba histolytica
KRTMLKTQYRMHPAISEFSNKMF

SEQ ID NO: 2718159 - protein, 22 aa, Entamoeba histolytica
KRVISIYQNLYKLIRSSPIENT

SEQ ID NO: 2718160 - protein, 24 aa, Entamoeba histolytica
KRVKKMKGLDLFFTVKPRNGESAL

SEQ ID NO: 2718161 - protein, 28 aa, Entamoeba histolytica
KRVKQLNLLLCKYSCFPNLKSQFMYLKE

SEQ ID NO: 2718162 - protein, 25 aa, Entamoeba histolytica
KRVPTYFETYSSRNWGRCILQHFFQ

SEQ ID NO: 2718163 - protein, 26 aa, Entamoeba histolytica
KRVPWTIICKYILKALAFINEKQYYS

SEQ ID NO: 2718164 - protein, 24 aa, Entamoeba histolytica
KRVSLSFAPLYTTTGHIIVSFIVA

SEQ ID NO: 2718165 - protein, 26 aa, Entamoeba histolytica
KRVYKQFVSMLRKKAFIYLYTEEGME

SEQ ID NO: 2718166 - protein, 21 aa, Entamoeba histolytica
KRVYLGALKFLPHAVYKLLEN

SEQ ID NO: 2718167 - protein, 20 aa, Entamoeba histolytica
KRVYPFASIIVLGNKLDLAY

SEQ ID NO: 2718168 - protein, 27 aa, Entamoeba histolytica
KRWGVPVLNHQWLFDCIVERRFVSINN

SEQ ID NO: 2718169 - protein, 29 aa, Entamoeba histolytica
KRYECITMFFQLLIKLIQKKNFNSFVSVM

SEQ ID NO: 2718170 - protein, 18 aa, Entamoeba histolytica
KRYFTIEGLNLINKTEFE

SEQ ID NO: 2718171 - protein, 19 aa, Entamoeba histolytica
KRYIKKASKKILKIKRQTK

SEQ ID NO: 2718172 - protein, 26 aa, Entamoeba histolytica
KRYINGRFLPDKAIDLVDEACATLFT

SEQ ID NO: 2718173 - protein, 22 aa, Entamoeba histolytica
KSAEHYINCFKPILFDEIRATI

SEQ ID NO: 2718174 - protein, 21 aa, Entamoeba histolytica
KSAGYIPSVPKKRSLFDDTSD

SEQ ID NO: 2718175 - protein, 26 aa, Entamoeba histolytica
KSALDFLNLPISITRGVLGNLKVIIP

SEQ ID NO: 2718176 - protein, 27 aa, Entamoeba histolytica
KSATKSYKQLRMLLGKKSTNNLESFIS

SEQ ID NO: 2718177 - protein, 22 aa, Entamoeba histolytica
KSATLNLRPTIPASTPLSLTNL

SEQ ID NO: 2718178 - protein, 20 aa, Entamoeba histolytica
KSCLSLKFANNGKLEPRFIY

SEQ ID NO: 2718179 - protein, 22 aa, Entamoeba histolytica
KSCMMLHFLIRDNCSFKLYNNP

SEQ ID NO: 2718180 - protein, 23 aa, Entamoeba histolytica
KSDEWVVELSLLEGLRSLCDHSL

SEQ ID NO: 2718181 - protein, 19 aa, Entamoeba histolytica
KSDFMTKLKQIIVAIPNSE

SEQ ID NO: 2718182 - protein, 24 aa, Entamoeba histolytica
KSDGKHIIFIAGNKIDLENRVVSK

SEQ ID NO: 2718183 - protein, 25 aa, Entamoeba histolytica
KSDIIFIKNLYIKNSFYEIRIFKER

SEQ ID NO: 2718184 - protein, 30 aa, Entamoeba histolytica
KSDINELIFQFLIQLSIYRSMIAFKLDATE

SEQ ID NO: 2718185 - protein, 28 aa, Entamoeba histolytica
KSDINIVITHYLELIWKIPDAHIIINSL

SEQ ID NO: 2718186 - protein, 28 aa, Entamoeba histolytica
KSDIYSFGIILWQLVYKCIYNVYSKPFE

SEQ ID NO: 2718187 - protein, 26 aa, Entamoeba histolytica
KSDNPLMDYLPLLPLSLMEVHENTSS

SEQ ID NO: 2718188 - protein, 24 aa, Entamoeba histolytica
KSDVFSFGIVFWEVIHVVYCKHYN

SEQ ID NO: 2718189 - protein, 24 aa, Entamoeba histolytica
KSDVFSYAIILWELKNKQPPYKSF

SEQ ID NO: 2718190 - protein, 25 aa, Entamoeba histolytica
KSDVWAFGCLIYKCLTLHTPFEDSP

SEQ ID NO: 2718191 - protein, 29 aa, Entamoeba histolytica
KSDVWSFGMLIFKLLVGRLPFELMQMDSF

SEQ ID NO: 2718192 - protein, 27 aa, Entamoeba histolytica
KSDVWSFGVLIFKLLTGFCPFELIQID

SEQ ID NO: 2718193 - protein, 23 aa, Entamoeba histolytica
KSDYIAQIYGYCINPLFVTMEYF

SEQ ID NO: 2718194 - protein, 18 aa, Entamoeba histolytica
KSDYYYLLHNRTGDIEFV

SEQ ID NO: 2718195 - protein, 27 aa, Entamoeba histolytica
KSEKALYPLNPPLPLLNKRYVSSEKEY

SEQ ID NO: 2718196 - protein, 20 aa, Entamoeba histolytica
KSEKRKPWWIIRTYSNNNEG

SEQ ID NO: 2718197 - protein, 20 aa, Entamoeba histolytica
KSEQLINIIPLLLNEKIFAI

SEQ ID NO: 2718198 - protein, 23 aa, Entamoeba histolytica
KSERMHYQLIQKGILKGNEKIEK

SEQ ID NO: 2718199 - protein, 20 aa, Entamoeba histolytica
KSEWIKYIQILLQSTQTVSN

SEQ ID NO: 2718200 - protein, 21 aa, Entamoeba histolytica
KSFFDELLKDYVDIIFCNEEE

SEQ ID NO: 2718201 - protein, 20 aa, Entamoeba histolytica
KSFIHLALRIRGGKPVILLY

SEQ ID NO: 2718202 - protein, 30 aa, Entamoeba histolytica
KSFIPFHLQPFLTHKLLILLGKKIVNYSKF

SEQ ID NO: 2718203 - protein, 38 aa, Entamoeba histolytica
KSFIQKLKIGLLKLKNYKYLFEWYWKGIWNEEKEQTLQ

SEQ ID NO: 2718204 - protein, 24 aa, Entamoeba histolytica
KSFKSFYLPIYLDLNGVQIRYTID

SEQ ID NO: 2718205 - protein, 19 aa, Entamoeba histolytica
KSFLDNFTHSFYSLSSFHS

SEQ ID NO: 2718206 - protein, 21 aa, Entamoeba histolytica
KSFRMFIELGKKILPPPQLRT

SEQ ID NO: 2718207 - protein, 23 aa, Entamoeba histolytica
KSFSYTVQSPYLTYYQLDSQMNL

SEQ ID NO: 2718208 - protein, 19 aa, Entamoeba histolytica
KSFTYSLQKLSLVVEELIT

SEQ ID NO: 2718209 - protein, 17 aa, Entamoeba histolytica
KSFVRGSLAFVYCTIFE

SEQ ID NO: 2718210 - protein, 24 aa, Entamoeba histolytica
KSGDVQYIAMMPYYLVIDGDEGQD

SEQ ID NO: 2718211 - protein, 22 aa, Entamoeba histolytica
KSGDWWSGELNGVKGIFPSNYV

SEQ ID NO: 2718212 - protein, 24 aa, Entamoeba histolytica
KSGFLPQVLICLLNWLTTVNDDDV

SEQ ID NO: 2718213 - protein, 24 aa, Entamoeba histolytica
KSGHWYLFIVCCQMYKKGEEKSKK

SEQ ID NO: 2718214 - protein, 24 aa, Entamoeba histolytica
KSGIIIWMTEGETTFLHVLKYENE

SEQ ID NO: 2718215 - protein, 18 aa, Entamoeba histolytica
KSGKYKLAMKTLDRLAGI

SEQ ID NO: 2718216 - protein, 21 aa, Entamoeba histolytica
KSGLIPYMIKPLQDLNSSLLL

SEQ ID NO: 2718217 - protein, 21 aa, Entamoeba histolytica
KSGMIIRCPFISMEVIKKVVN

SEQ ID NO: 2718218 - protein, 27 aa, Entamoeba histolytica
KSGWRYPVPFFRSIQYLRYNGGITTEG

SEQ ID NO: 2718219 - protein, 17 aa, Entamoeba histolytica
KSHCWFKGFDWEGLFQK

SEQ ID NO: 2718220 - protein, 26 aa, Entamoeba histolytica
KSHEEGMLKIYLYPNEPFNQKDESDA

SEQ ID NO: 2718221 - protein, 27 aa, Entamoeba histolytica
KSHLLSVLCILLASLNYKVLVCASTNV

SEQ ID NO: 2718222 - protein, 28 aa, Entamoeba histolytica
KSHQTNCLCFLLPSYSHPSPSQIICNIY

SEQ ID NO: 2718223 - protein, 28 aa, Entamoeba histolytica
KSHQTNCLCFLLPSYSHPSPSQIKFCMK

SEQ ID NO: 2718224 - protein, 21 aa, Entamoeba histolytica
KSHYFTSWQTLCPGFSMITEK

SEQ ID NO: 2718225 - protein, 19 aa, Entamoeba histolytica
KSHYYVKSPMLNPMLGRMI

SEQ ID NO: 2718226 - protein, 19 aa, Entamoeba histolytica
KSIAFCMFEIVWKQITQIK

SEQ ID NO: 2718227 - protein, 21 aa, Entamoeba histolytica
KSICLLKIYSGMKTSILLPQS

SEQ ID NO: 2718228 - protein, 23 aa, Entamoeba histolytica
KSIDQIFEFGIKIKEYQIVDHLL

SEQ ID NO: 2718229 - protein, 29 aa, Entamoeba histolytica
KSIELPPYLKKLSSSLFYYCISLKSIEIP

SEQ ID NO: 2718230 - protein, 31 aa, Entamoeba histolytica
KSIERAHTPAKLWNKLLLDKDYMKALQQVTD

SEQ ID NO: 2718231 - protein, 24 aa, Entamoeba histolytica
KSIFGFCALYQEGSYTKGWFISLQ

SEQ ID NO: 2718232 - protein, 21 aa, Entamoeba histolytica
KSIHHIVWAILYESSVQLPAA

SEQ ID NO: 2718233 - protein, 22 aa, Entamoeba histolytica
KSIKFNCQWYITVHFDRYICTP

SEQ ID NO: 2718234 - protein, 21 aa, Entamoeba histolytica
KSIKFNCQWYITVHFDRYIIT

SEQ ID NO: 2718235 - protein, 18 aa, Entamoeba histolytica
KSIKTPKPIKIPKTKRNK

SEQ ID NO: 2718236 - protein, 18 aa, Entamoeba histolytica
KSILLKDNLNIVNLMNFC

SEQ ID NO: 2718237 - protein, 25 aa, Entamoeba histolytica
KSIMKHRVLFKGLLNEVFHVIYIPL

SEQ ID NO: 2718238 - protein, 25 aa, Entamoeba histolytica
KSIPAIFLINAPPHIFHHFKLYSEG

SEQ ID NO: 2718239 - protein, 26 aa, Entamoeba histolytica
KSITKIQMIPLKFRKQKSSVTRQKTI

SEQ ID NO: 2718240 - protein, 24 aa, Entamoeba histolytica
KSKAIYQCVLMSDAFFVLTQSKKN

SEQ ID NO: 2718241 - protein, 31 aa, Entamoeba histolytica; identical to SEQ ID NO: 2530655

SEQ ID NO: 2718242 - protein, 21 aa, Entamoeba histolytica
KSKFCKHSLKIIPKVMIDPNI

SEQ ID NO: 2718243 - protein, 23 aa, Entamoeba histolytica
KSKNIPIKDWYSWLLETLSQKIM

SEQ ID NO: 2718244 - protein, 23 aa, Entamoeba histolytica
KSKPFLKRNLCVCLGRIALRKPE

SEQ ID NO: 2718245 - protein, 21 aa, Entamoeba histolytica
KSKSILFPKIIFNININNVEM

SEQ ID NO: 2718246 - protein, 17 aa, Entamoeba histolytica
KSKTFLRIVDESLYTEL

SEQ ID NO: 2718247 - protein, 23 aa, Entamoeba histolytica
KSKVSLDNFFKVKAKPIEQKTKK

SEQ ID NO: 2718248 - protein, 21 aa, Entamoeba histolytica
KSKWELIAFSQNAIISGNGLI

SEQ ID NO: 2718249 - protein, 23 aa, Entamoeba histolytica
KSKWLEVIYLRHTKITDKSIETL

SEQ ID NO: 2718250 - protein, 20 aa, Entamoeba histolytica
KSLAKKCQVLVLWLDCDREG

SEQ ID NO: 2718251 - protein, 34 aa, Entamoeba histolytica
KSLKRRRDLNRAALSFNWLVEYLEQLGYTVERRP

SEQ ID NO: 2718252 - protein, 19 aa, Entamoeba histolytica
KSLLKKQKFVYLILDEAHS

SEQ ID NO: 2718253 - protein, 36 aa, Entamoeba histolytica
KSLNHPFLVHLVWDFETPFYYIFVMTYCAGGDFWRL

SEQ ID NO: 2718254 - protein, 21 aa, Entamoeba histolytica
KSLRSAKTISFSKRDKKKDKK

SEQ ID NO: 2718255 - protein, 25 aa, Entamoeba histolytica
KSLSTLLYCLNINPVIRYINKPNEE

SEQ ID NO: 2718256 - protein, 19 aa, Entamoeba histolytica
KSLVFQNRKLKLVLPDTCG

SEQ ID NO: 2718257 - protein, 20 aa, Entamoeba histolytica
KSLYLPFNELVELCLPLPST

SEQ ID NO: 2718258 - protein, 19 aa, Entamoeba histolytica
KSMTFPENFYQKVDFKKVN

SEQ ID NO: 2718259 - protein, 23 aa, Entamoeba histolytica
KSNDAMKIIEKLGGIKALAKNTN

SEQ ID NO: 2718260 - protein, 25 aa, Entamoeba histolytica
KSNDKKILDFFFVTGGKSLLVKKNS

SEQ ID NO: 2718261 - protein, 21 aa, Entamoeba histolytica
KSNEWRERRISCLLLGEMAKQ

SEQ ID NO: 2718262 - protein, 18 aa, Entamoeba histolytica
KSNFLFTINKAEWKSCQA

SEQ ID NO: 2718263 - protein, 25 aa, Entamoeba histolytica
KSNGTIHLIMLMSILDRISDEEIYA

SEQ ID NO: 2718264 - protein, 19 aa, Entamoeba histolytica
KSNHPLLHAPFNALQSIPL

SEQ ID NO: 2718265 - protein, 21 aa, Entamoeba histolytica
KSNIKIIYNPTVSPANEKLFK

SEQ ID NO: 2718266 - protein, 20 aa, Entamoeba histolytica
KSNKEIKRPLFKLSLETKQS

SEQ ID NO: 2718267 - protein, 31 aa, Entamoeba histolytica; identical to SEQ ID NO: 2530686

SEQ ID NO: 2718268 - protein, 18 aa, Entamoeba histolytica
KSNKIQILITTATLAWGV

SEQ ID NO: 2718269 - protein, 26 aa, Entamoeba histolytica
KSNKPRYFYLFDDVMVYGIGNQRITV

SEQ ID NO: 2718270 - protein, 31 aa, Entamoeba histolytica
KSNNLLNMKLIHVNILPLSKYPTTLTSLLLN

SEQ ID NO: 2718271 - protein, 27 aa, Entamoeba histolytica
KSNQLFLERFLLCLIPISFNKKPQVIQ

SEQ ID NO: 2718272 - protein, 27 aa, Entamoeba histolytica
KSNYPKLPILFVWMGDLFHTNELPVMF

SEQ ID NO: 2718273 - protein, 22 aa, Entamoeba histolytica
KSPAEYLLRKAVMLLQNSDKQL

SEQ ID NO: 2718274 - protein, 23 aa, Entamoeba histolytica
KSPFRSLNYPKLEFLNKILVKPW

SEQ ID NO: 2718275 - protein, 26 aa, Entamoeba histolytica
KSPILEPLSSIYYLSTSYIVGGTISG

SEQ ID NO: 2718276 - protein, 18 aa, Entamoeba histolytica
KSPKDLLTLLSIKDFYLM

SEQ ID NO: 2718277 - protein, 37 aa, Entamoeba histolytica
KSPMENLYFPESLLSRFDLIFIILDSSTEELDRRLSQ

SEQ ID NO: 2718278 - protein, 17 aa, Entamoeba histolytica
KSPMLNPMLGRMINKVS

SEQ ID NO: 2718279 - protein, 17 aa, Entamoeba histolytica
KSQFFFESFQPVYSLVT

SEQ ID NO: 2718280 - protein, 17 aa, Entamoeba histolytica
KSRALLQFYLEIKPLPD

SEQ ID NO: 2718281 - protein, 24 aa, Entamoeba histolytica
KSRCSEFKRKLSLVGKKIGEETEC

SEQ ID NO: 2718282 - protein, 26 aa, Entamoeba histolytica
KSRINDFPIIPLQYLFSSASKNYLRP

SEQ ID NO: 2718283 - protein, 40 aa, Entamoeba histolytica
KSRINEVDLSYYIPPSYLQENSWIGIYDRFEMNMKNYINS

SEQ ID NO: 2718284 - protein, 32 aa, Entamoeba histolytica; identical to SEQ ID NO: 2530708

SEQ ID NO: 2718285 - protein, 33 aa, Entamoeba histolytica
KSRNGFVLHFNALLYLLLKKGWTIQLTKTKTAK

SEQ ID NO: 2718286 - protein, 21 aa, Entamoeba histolytica
KSRWRVPNIIYRCIGFLKTHD

SEQ ID NO: 2718287 - protein, 18 aa, Entamoeba histolytica
KSRYVILNKLHSARFSKV

SEQ ID NO: 2718288 - protein, 19 aa, Entamoeba histolytica
KSRYVILNKLHSARFSKVY

SEQ ID NO: 2718289 - protein, 25 aa, Entamoeba histolytica
KSSDLLVMQRTQALKKEIRSFRDEI

SEQ ID NO: 2718290 - protein, 26 aa, Entamoeba histolytica
KSSEELFIIVFPLQNKFFLDADIPFE

SEQ ID NO: 2718291 - protein, 20 aa, Entamoeba histolytica
KSSFRWTPPQQFFQSDYNKL

SEQ ID NO: 2718292 - protein, 27 aa, Entamoeba histolytica
KSSHFQPKLVGTKRKHPQFARRKQKKT

SEQ ID NO: 2718293 - protein, 22 aa, Entamoeba histolytica
KSSILSVFIQWTKSFFSDFEKK

SEQ ID NO: 2718294 - protein, 23 aa, Entamoeba histolytica
KSSKFNDILDLLRSHLPGDNQLD

SEQ ID NO: 2718295 - protein, 30 aa, Entamoeba histolytica
KSSKIQLFFVQLYMQILKTLRYNTSSTNHM

SEQ ID NO: 2718296 - protein, 25 aa, Entamoeba histolytica
KSSLGNFILQKYVFKVGDSPNPETR

SEQ ID NO: 2718297 - protein, 25 aa, Entamoeba histolytica
KSSLQLLCDKGIHPSLIITNDWFTG

SEQ ID NO: 2718298 - protein, 21 aa, Entamoeba histolytica
KSSLYQIIPFSNKLNGYIITI

SEQ ID NO: 2718299 - protein, 23 aa, Entamoeba histolytica
KSSNPWFKWKLTTSFENHRIQLK

SEQ ID NO: 2718300 - protein, 33 aa, Entamoeba histolytica
KSSSVRWQMARNYILWVPLTAIANNYSTSTTGL

SEQ ID NO: 2718301 - protein, 18 aa, Entamoeba histolytica
KSSYFLAYSPINDVFYFN

SEQ ID NO: 2718302 - protein, 33 aa, Entamoeba histolytica
KSTENLFDLIKNSSLLFVFPMSGFIPICVEYLQ

SEQ ID NO: 2718303 - protein, 27 aa, Entamoeba histolytica
KSTILEIGYFYTITLEEICSLNMSFNS

SEQ ID NO: 2718304 - protein, 25 aa, Entamoeba histolytica
KSTKKYYLIRTWADTTLENELKTPK

SEQ ID NO: 2718305 - protein, 23 aa, Entamoeba histolytica
KSTKYYMDPISLNLLIVDTSTKY

SEQ ID NO: 2718306 - protein, 28 aa, Entamoeba histolytica
KSTLNYLYGIIVPQFIFLRKEIIGTPLE

SEQ ID NO: 2718307 - protein, 22 aa, Entamoeba histolytica
KSTNEHILLTLLKDPRIDVNVK

SEQ ID NO: 2718308 - protein, 23 aa, Entamoeba histolytica
KSTNFLYFLLSQNTIETILSFPI

SEQ ID NO: 2718309 - protein, 27 aa, Entamoeba histolytica
KSTPDYSSWPLLLQNFDQLEIKTGHYT

SEQ ID NO: 2718310 - protein, 19 aa, Entamoeba histolytica
KSTPLSTMKGWEKLRWEDI

SEQ ID NO: 2718311 - protein, 30 aa, Entamoeba histolytica
KSTPQNTFNLLFFIRTVFPVFHAPQHVMDT

SEQ ID NO: 2718312 - protein, 33 aa, Entamoeba histolytica
KSTVIHIVLAGIYLFLYKSTLDFVKQRKPLHTF

SEQ ID NO: 2718313 - protein, 19 aa, Entamoeba histolytica
KSVFFKKTGHNPALVQNFT

SEQ ID NO: 2718314 - protein, 20 aa, Entamoeba histolytica
KSVFLIAGTLRPETMYGQTN

SEQ ID NO: 2718315 - protein, 23 aa, Entamoeba histolytica
KSVGAPLYIVHLSSKGAISIIEK

SEQ ID NO: 2718316 - protein, 37 aa, Entamoeba histolytica
KSVIYTNFPIVIQENRFWYFKDSQGVGWNIKFKTDMD

SEQ ID NO: 2718317 - protein, 23 aa, Entamoeba histolytica
KSVKEYILLYDGIDFNCISKGCK

SEQ ID NO: 2718318 - protein, 19 aa, Entamoeba histolytica
KSVLSILGYEVYLPSVIKE

SEQ ID NO: 2718319 - protein, 28 aa, Entamoeba histolytica
KSVNPSYFIYMYYLYANIVSLNIYRMSR

SEQ ID NO: 2718320 - protein, 22 aa, Entamoeba histolytica
KSVSYIGSFLQPKKKREKKRNS

SEQ ID NO: 2718321 - protein, 32 aa, Entamoeba histolytica; identical to SEQ ID NO: 2518185

SEQ ID NO: 2718322 - protein, 27 aa, Entamoeba histolytica
KSVYSVPTLLRLLYKGYLGDFIVSQTI

SEQ ID NO: 2718323 - protein, 23 aa, Entamoeba histolytica
KSWIKRLNIVISFLRDMRLIQRD

SEQ ID NO: 2718324 - protein, 26 aa, Entamoeba histolytica
KSWKKRWCVLTPTGMIFYFKDKKDVN

SEQ ID NO: 2718325 - protein, 18 aa, Entamoeba histolytica
KSWKRRFFVFEQTTLSYY

SEQ ID NO: 2718326 - protein, 30 aa, Entamoeba histolytica
KSYKCTVFNEFFLQRLLSTLLNFNHLTNSP

SEQ ID NO: 2718327 - protein, 21 aa, Entamoeba histolytica
KSYLHLGVFLSVMNYLIHTSS

SEQ ID NO: 2718328 - protein, 23 aa, Entamoeba histolytica
KSYPLLEEILPNTLELSKDQYGN

SEQ ID NO: 2718329 - protein, 25 aa, Entamoeba histolytica
KSYTPYFNTLISIIVFRYDDKESFK

SEQ ID NO: 2718330 - protein, 30 aa, Entamoeba histolytica
KTAIRLFELITKYVFIRRIGGGVYGPLYTS

SEQ ID NO: 2718331 - protein, 26 aa, Entamoeba histolytica
KTAITIWDVLSNKLLFSLPVPYEQHG

SEQ ID NO: 2718332 - protein, 17 aa, Entamoeba histolytica
KTAKVLPVITNKKSYFI

SEQ ID NO: 2718333 - protein, 25 aa, Entamoeba histolytica
KTAMKGVVQLFNAIAEHQHKLKIAE

SEQ ID NO: 2718334 - protein, 33 aa, Entamoeba histolytica; identical to SEQ ID NO: 2530761

SEQ ID NO: 2718335 - protein, 30 aa, Entamoeba histolytica
KTCDFLANELFKYLQKNCYLSFFDDNMDVK

SEQ ID NO: 2718336 - protein, 20 aa, Entamoeba histolytica
KTCIVLPEYCVQHLIHFLGY

SEQ ID NO: 2718337 - protein, 26 aa, Entamoeba histolytica
KTDDRLYYLCRGAIRVFEFAGKKDSG

SEQ ID NO: 2718338 - protein, 17 aa, Entamoeba histolytica
KTDIIEWLKKQLKEIKE

SEQ ID NO: 2718339 - protein, 31 aa, Entamoeba histolytica
KTDNILTRKYSTLFFALLPESLYDVDAISNY

SEQ ID NO: 2718340 - protein, 23 aa, Entamoeba histolytica
KTDRSLYRFIITNTLEATKAVLR

SEQ ID NO: 2718341 - protein, 25 aa, Entamoeba histolytica
KTDRVNYFGILSNLFLIAGNIISGR

SEQ ID NO: 2718342 - protein, 18 aa, Entamoeba histolytica
KTDVYSIIFLTKNNNKIL

SEQ ID NO: 2718343 - protein, 27 aa, Entamoeba histolytica
KTEFAIQEIFLKYNTFMLRGDSLFDAY

SEQ ID NO: 2718344 - protein, 29 aa, Entamoeba histolytica
KTEFAIQEIFMKYPTFMLRGDSLFDTYDE

SEQ ID NO: 2718345 - protein, 20 aa, Entamoeba histolytica
KTEFNKRLALWFTQQDIWNR

SEQ ID NO: 2718346 - protein, 35 aa, Entamoeba histolytica
KTEIKIIARHLAVIKTRPIIWRSNHSYLVADRVED

SEQ ID NO: 2718347 - protein, 30 aa, Entamoeba histolytica
KTEIVLFIKPSYLQIKLYKIMLKELEKKKL

SEQ ID NO: 2718348 - protein, 25 aa, Entamoeba histolytica
KTEKAIIPLSPPITMLNKRDITSPE

SEQ ID NO: 2718349 - protein, 19 aa, Entamoeba histolytica
KTEKVFWVCRECGYIFEST

SEQ ID NO: 2718350 - protein, 20 aa, Entamoeba histolytica
KTEPFKKLFSKKATTKEVRL

SEQ ID NO: 2718351 - protein, 19 aa, Entamoeba histolytica
KTEPVYKLYISIEEAMNGC

SEQ ID NO: 2718352 - protein, 24 aa, Entamoeba histolytica
KTEQKKLLTIYEFSLREFPKNWTK

SEQ ID NO: 2718353 - protein, 41 aa, Entamoeba histolytica
KTETIWKYNTFIYDLFCEFFNTIPLAALFKCSLGSFLLCHG

SEQ ID NO: 2718354 - protein, 20 aa, Entamoeba histolytica
KTEVLLSLLTFLVSNLSTEL

SEQ ID NO: 2718355 - protein, 23 aa, Entamoeba histolytica
KTFDCLPICALLHSELGKFFCVH

SEQ ID NO: 2718356 - protein, 18 aa, Entamoeba histolytica
KTFDKIMADALWGFSFIV

SEQ ID NO: 2718357 - protein, 20 aa, Entamoeba histolytica
KTFSYSSWLYSFINAIYPQS

SEQ ID NO: 2718358 - protein, 36 aa, Entamoeba histolytica
KTGEHEPFWINVYHIMLLHGLLYWRHRPNIEFKDML

SEQ ID NO: 2718359 - protein, 23 aa, Entamoeba histolytica
KTGFNFISFETLFVSCPIEHISC

SEQ ID NO: 2718360 - protein, 19 aa, Entamoeba histolytica
KTGIFKRYITGKYTGTEKA

SEQ ID NO: 2718361 - protein, 22 aa, Entamoeba histolytica
KTGIRIELFKKILKHLRNDNAE

SEQ ID NO: 2718362 - protein, 27 aa, Entamoeba histolytica
KTGLVLNPYFSASKIMWIFNNVEGAKA

SEQ ID NO: 2718363 - protein, 26 aa, Entamoeba histolytica
KTHEKYHKEFLLPPKLKIKSNEYNTI

SEQ ID NO: 2718364 - protein, 17 aa, Entamoeba histolytica
KTHIIIKPITSFDPIEV

SEQ ID NO: 2718365 - protein, 23 aa, Entamoeba histolytica
KTHPWFNGFNFDDLYKKKLTPPY

SEQ ID NO: 2718366 - protein, 28 aa, Entamoeba histolytica
KTHPWWNSFDWDALYQKKIPAPFKPDMS

SEQ ID NO: 2718367 - protein, 24 aa, Entamoeba histolytica
KTIDNMLKIVFIPNYSVSLAEVII

SEQ ID NO: 2718368 - protein, 25 aa, Entamoeba histolytica
KTIDNMLKIVFIPNYSVSLAEVIIP

SEQ ID NO: 2718369 - protein, 24 aa, Entamoeba histolytica
KTIDPKMVIVWKPNLLYMTEDGVL

SEQ ID NO: 2718370 - protein, 19 aa, Entamoeba histolytica
KTIIAWLDKFIKKQKKEHA

SEQ ID NO: 2718371 - protein, 18 aa, Entamoeba histolytica
KTIKLARMNTSLSRNGTI

SEQ ID NO: 2718372 - protein, 26 aa, Entamoeba histolytica
KTIKQIHQLLSQYSLLHIQRSNTFLD

SEQ ID NO: 2718373 - protein, 21 aa, Entamoeba histolytica
KTIKQPYNILLRTKAKEKKER

SEQ ID NO: 2718374 - protein, 20 aa, Entamoeba histolytica
KTILKFIRMAYEKQKIEEPP

SEQ ID NO: 2718375 - protein, 25 aa, Entamoeba histolytica
KTINDFFKVTKPIPKGLLTFANEVD

SEQ ID NO: 2718376 - protein, 32 aa, Entamoeba histolytica
KTIPNVIQFTYYTMYYLFTLKCKQYLIKTMIR

SEQ ID NO: 2718377 - protein, 23 aa, Entamoeba histolytica
KTIQTKEIFALPKSNRNDVEPEF

SEQ ID NO: 2718378 - protein, 26 aa, Entamoeba histolytica
KTIRDTYLPKLIGLIKEYWDGNILGE

SEQ ID NO: 2718379 - protein, 18 aa, Entamoeba histolytica
KTIRKWIKCASGNKYRMG

SEQ ID NO: 2718380 - protein, 20 aa, Entamoeba histolytica
KTISDPIYLQLLKIQQMCDE

SEQ ID NO: 2718381 - protein, 17 aa, Entamoeba histolytica
KTIVFKPQCINKDIAAA

SEQ ID NO: 2718382 - protein, 24 aa, Entamoeba histolytica
KTIVKRICYLFNDSILFVRENGKK

SEQ ID NO: 2718383 - protein, 17 aa, Entamoeba histolytica
KTKFSGHYISYCKTPSG

SEQ ID NO: 2718384 - protein, 24 aa, Entamoeba histolytica
KTKKCVILIISDAILFIVNKSLTD

SEQ ID NO: 2718385 - protein, 22 aa, Entamoeba histolytica
KTKKDFFFYVSKNDTIKYYNTV

SEQ ID NO: 2718386 - protein, 22 aa, Entamoeba histolytica
KTKKYRKSILSPNTIWTGKDIN

SEQ ID NO: 2718387 - protein, 22 aa, Entamoeba histolytica
KTKLIQWKKYYCEICGIILNGE

SEQ ID NO: 2718388 - protein, 23 aa, Entamoeba histolytica
KTKPLVLEYFSTTTTIQLKKEHS

SEQ ID NO: 2718389 - protein, 27 aa, Entamoeba histolytica
KTKQIFRNLLTEQPLLFTLTEYFNQQK

SEQ ID NO: 2718390 - protein, 22 aa, Entamoeba histolytica
KTKSLYLHAYQSYVWNQVVSKR

SEQ ID NO: 2718391 - protein, 25 aa, Entamoeba histolytica
KTLDQFAILVTRRFFDGMDSRILAL

SEQ ID NO: 2718392 - protein, 23 aa, Entamoeba histolytica
KTLGNWFCQCDMNDFVWNNDGRL

SEQ ID NO: 2718393 - protein, 28 aa, Entamoeba histolytica
KTLKSLFVPYYAFVLKNILSILNQLPLS

SEQ ID NO: 2718394 - protein, 17 aa, Entamoeba histolytica
KTLLKKYLAMSIEKKLV

SEQ ID NO: 2718395 - protein, 28 aa, Entamoeba histolytica
KTLLNTRMHLWLEYYTINQAMSSNHDSD

SEQ ID NO: 2718396 - protein, 26 aa, Entamoeba histolytica
KTLNEILMQHIMKTLPSLRITITEML

SEQ ID NO: 2718397 - protein, 17 aa, Entamoeba histolytica
KTLPIHECLILLERFIE

SEQ ID NO: 2718398 - protein, 20 aa, Entamoeba histolytica
KTLPMRMKVHMENGLKVAKF

SEQ ID NO: 2718399 - protein, 18 aa, Entamoeba histolytica
KTLPTQISFLTYLTKLDV

SEQ ID NO: 2718400 - protein, 17 aa, Entamoeba histolytica
KTLQFENWTREKVLQII

SEQ ID NO: 2718401 - protein, 28 aa, Entamoeba histolytica
KTLQKFSEKLPILINKERPKYQIKDREV

SEQ ID NO: 2718402 - protein, 20 aa, Entamoeba histolytica
KTLRSIIWMICEYCSHYDEV

SEQ ID NO: 2718403 - protein, 24 aa, Entamoeba histolytica
KTLSSSILPFYSQVIELPNELKSI

SEQ ID NO: 2718404 - protein, 20 aa, Entamoeba histolytica
KTLYILKIKTTFYSFCQRSF

SEQ ID NO: 2718405 - protein, 37 aa, Entamoeba histolytica
KTMIEIICNIFPIYDFWKHVCVVWTMCYNYTPLKKLK

SEQ ID NO: 2718406 - protein, 18 aa, Entamoeba histolytica
KTMIRNHQIGWDKRTIGI

SEQ ID NO: 2718407 - protein, 18 aa, Entamoeba histolytica
KTMRSAALCNPFFQLSST

SEQ ID NO: 2718408 - protein, 20 aa, Entamoeba histolytica
KTNFYVFVKVIIKEPNSIEH

SEQ ID NO: 2718409 - protein, 32 aa, Entamoeba histolytica
KTNKTDIFLTLQFIKQFSFRLLEIITSVSMCR

SEQ ID NO: 2718410 - protein, 17 aa, Entamoeba histolytica
KTNLLPSLIYVLNSLNT

SEQ ID NO: 2718411 - protein, 23 aa, Entamoeba histolytica
KTNLRICYLAKKPLKNHLLTFEK

SEQ ID NO: 2718412 - protein, 18 aa, Entamoeba histolytica
KTNLTRISNLLSQESDRF

SEQ ID NO: 2718413 - protein, 23 aa, Entamoeba histolytica
KTNPLVLKWLQTSSAFVNILLID

SEQ ID NO: 2718414 - protein, 30 aa, Entamoeba histolytica
KTNREQLLDGLLREMMRTELETKLRQANYE

SEQ ID NO: 2718415 - protein, 32 aa, Entamoeba histolytica
KTNTSLPLCLPFKPLFFFNRENYLVILNEKEI

SEQ ID NO: 2718416 - protein, 24 aa, Entamoeba histolytica
KTNVICMFIQLLSKFILVWCSIYG

SEQ ID NO: 2718417 - protein, 23 aa, Entamoeba histolytica
KTPCSHLIFSYQNNALYGKTSGI

SEQ ID NO: 2718418 - protein, 22 aa, Entamoeba histolytica
KTPEEFISLHRLALESPYVSSH

SEQ ID NO: 2718419 - protein, 24 aa, Entamoeba histolytica
KTPEEYFIHYSKYYANVCFSTYPV

SEQ ID NO: 2718420 - protein, 25 aa, Entamoeba histolytica
KTPISIICCDTFILTQYNNQIQVVY

SEQ ID NO: 2718421 - protein, 17 aa, Entamoeba histolytica
KTPIYGMNYEKFIPALL

SEQ ID NO: 2718422 - protein, 24 aa, Entamoeba histolytica
KTPLQIAFKTIIPKKLDGAKDEMG

SEQ ID NO: 2718423 - protein, 37 aa, Entamoeba histolytica; identical to SEQ ID NO: 2530858

SEQ ID NO: 2718424 - protein, 23 aa, Entamoeba histolytica
KTPRIIPKQCRLLMRSFEELHDS

SEQ ID NO: 2718425 - protein, 18 aa, Entamoeba histolytica
KTPRLLCNNIHGLKIIEL

SEQ ID NO: 2718426 - protein, 34 aa, Entamoeba histolytica
KTPTPKKYLYANKTPFYMSFTPIEGIEASPKELF

SEQ ID NO: 2718427 - protein, 17 aa, Entamoeba histolytica
KTPVNVRFIIDSSGLFT

SEQ ID NO: 2718428 - protein, 26 aa, Entamoeba histolytica
KTQFDTFKKLYLLRDKIARIEDESPE

SEQ ID NO: 2718429 - protein, 25 aa, Entamoeba histolytica
KTQIIDCTLDPIWNKKFDVKYNIGE

SEQ ID NO: 2718430 - protein, 30 aa, Entamoeba histolytica
KTQIYYQLLTKHNFKYGYTGKLKPINETYL

SEQ ID NO: 2718431 - protein, 18 aa, Entamoeba histolytica
KTQKFLCMFFGEIKQIQN

SEQ ID NO: 2718432 - protein, 27 aa, Entamoeba histolytica
KTQNPQTLLFILTLIEKQPKDKIKEIV

SEQ ID NO: 2718433 - protein, 22 aa, Entamoeba histolytica
KTQRIEIFSLFYNDSVKPELKK

SEQ ID NO: 2718434 - protein, 17 aa, Entamoeba histolytica
KTQVRLPAVFLAPIRGD

SEQ ID NO: 2718435 - protein, 29 aa, Entamoeba histolytica
KTQVRLPAVFLAPIRGDVVHFVYRNQSKN

SEQ ID NO: 2718436 - protein, 21 aa, Entamoeba histolytica
KTQYFWEHLLGRSGAAPFTCP

SEQ ID NO: 2718437 - protein, 20 aa, Entamoeba histolytica
KTREEWLYAMKMQSYRAALE

SEQ ID NO: 2718438 - protein, 25 aa, Entamoeba histolytica
KTREFMCHHLTFMTRYVPVHCVIET

SEQ ID NO: 2718439 - protein, 20 aa, Entamoeba histolytica
KTRNPIVFSFHPSALKCSIM

SEQ ID NO: 2718440 - protein, 33 aa, Entamoeba histolytica
KTRVYEPAPPRRLLIRIFGEGDAAWVVLVKCEK

SEQ ID NO: 2718441 - protein, 23 aa, Entamoeba histolytica
KTSFYEKYLKPKGYGWINMDTLG

SEQ ID NO: 2718442 - protein, 23 aa, Entamoeba histolytica
KTSHIFFEKWYIKQHQRRKLQWL

SEQ ID NO: 2718443 - protein, 33 aa, Entamoeba histolytica
KTSLPSLFCRYKLLPFYIDLFRSNMPEASCAVE

SEQ ID NO: 2718444 - protein, 25 aa, Entamoeba histolytica
KTSNQPIISMAFSNAVIILVTCCNE

SEQ ID NO: 2718445 - protein, 29 aa, Entamoeba histolytica
KTSPFDEFFKLIFLQYPPRIVQSLKRHFA

SEQ ID NO: 2718446 - protein, 28 aa, Entamoeba histolytica
KTSPISLYLTQCLSVIFEPPTSFSIINY

SEQ ID NO: 2718447 - protein, 31 aa, Entamoeba histolytica
KTSVNPYFELFSRLLMIKDYLIKEIIQKQCD

SEQ ID NO: 2718448 - protein, 23 aa, Entamoeba histolytica
KTSYLQWLCECQTKCIKGVIIME

SEQ ID NO: 2718449 - protein, 18 aa, Entamoeba histolytica
KTTDVIQWKLKRVICSHK

SEQ ID NO: 2718450 - protein, 24 aa, Entamoeba histolytica
KTTDVIQWKLKRVICSHKGWVSSI

SEQ ID NO: 2718451 - protein, 27 aa, Entamoeba histolytica
KTTELLYRFICKLINRSYVRFNNEIYN

SEQ ID NO: 2718452 - protein, 17 aa, Entamoeba histolytica
KTTFLRGTAMILKSVPC

SEQ ID NO: 2718453 - protein, 26 aa, Entamoeba histolytica
KTTIIVNLHIWKALNASFKTQIATII

SEQ ID NO: 2718454 - protein, 27 aa, Entamoeba histolytica
KTTIKKGFKFSFSFDPENLKQPTSEGK

SEQ ID NO: 2718455 - protein, 18 aa, Entamoeba histolytica
KTTPLICSLISDHFGKRF

SEQ ID NO: 2718456 - protein, 29 aa, Entamoeba histolytica
KTTRHLNLIIADRMFDLITPLMTEFTYQA

SEQ ID NO: 2718457 - protein, 30 aa, Entamoeba histolytica; identical to SEQ ID NO: 2530895

SEQ ID NO: 2718458 - protein, 33 aa, Entamoeba histolytica
KTVKYYQIYYSLRPIFKRLYLNYTQMKDFHKEE

SEQ ID NO: 2718459 - protein, 17 aa, Entamoeba histolytica
KTVSTCLQLAKSQLNIP

SEQ ID NO: 2718460 - protein, 23 aa, Entamoeba histolytica
KTVSYIFNEPIYYPKISNSGVTF

SEQ ID NO: 2718461 - protein, 27 aa, Entamoeba histolytica
KTYFIHFTGDFVIPKYSFSSSPNTSIE

SEQ ID NO: 2718462 - protein, 31 aa, Entamoeba histolytica
KTYFKTIKIKEKMYWLLGHSFTKYGEIYYCK

SEQ ID NO: 2718463 - protein, 21 aa, Entamoeba histolytica
KTYIGIDEIFGTSSKLKPVSV

SEQ ID NO: 2718464 - protein, 19 aa, Entamoeba histolytica
KTYKQMIFNLMHLSLEQIN

SEQ ID NO: 2718465 - protein, 30 aa, Entamoeba histolytica
KVARGEIVQIKPICALALLDGGETDWKVIG

SEQ ID NO: 2718466 - protein, 20 aa, Entamoeba histolytica
KVCDHPYLMPGAEPEPYVNG

SEQ ID NO: 2718467 - protein, 27 aa, Entamoeba histolytica
KVCGEKNVMFIIITKTGYAFGCFCHKK

SEQ ID NO: 2718468 - protein, 18 aa, Entamoeba histolytica
KVCISSMRISICLRKVLD

SEQ ID NO: 2718469 - protein, 18 aa, Entamoeba histolytica
KVDCFSPFLFTKKENWNR

SEQ ID NO: 2718470 - protein, 32 aa, Entamoeba histolytica
KVDEAEIPLLFIISSVLPPKRKLFNKFVFKIV

SEQ ID NO: 2718471 - protein, 24 aa, Entamoeba histolytica
KVDELFMLFDKKVPSIGLFKEQHI

SEQ ID NO: 2718472 - protein, 24 aa, Entamoeba histolytica
KVDEQLLYELMIQAGPVVNISIPR

SEQ ID NO: 2718473 - protein, 20 aa, Entamoeba histolytica
KVDFMALFDQAMQQPAPSQQ

SEQ ID NO: 2718474 - protein, 25 aa, Entamoeba histolytica
KVDGFLTLLNLLLPSNERKIARLVV

SEQ ID NO: 2718475 - protein, 24 aa, Entamoeba histolytica
KVDGTYLIRMSFTDAKKNPFTLTR

SEQ ID NO: 2718476 - protein, 31 aa, Entamoeba histolytica
KVDIEKEMVCHVLTFKYPFNSEITKFDCPPS

SEQ ID NO: 2718477 - protein, 18 aa, Entamoeba histolytica
KVDILAYWVSQSLYESVQ

SEQ ID NO: 2718478 - protein, 26 aa, Entamoeba histolytica
KVDSQFIYNFFVYTSSKKATYKTGVI

SEQ ID NO: 2718479 - protein, 26 aa, Entamoeba histolytica
KVDTPLLWHQGLLVFVQRYSKDFKPQ

SEQ ID NO: 2718480 - protein, 28 aa, Entamoeba histolytica
KVEDISDIAFLFPDIYSLIKQFKIEDII

SEQ ID NO: 2718481 - protein, 35 aa, Entamoeba histolytica
KVEITPQVTQPLKPTKFIPPPKTLSPSEGETKTQV

SEQ ID NO: 2718482 - protein, 25 aa, Entamoeba histolytica
KVEKSFKILLFFKNEYGGISSRQSY

SEQ ID NO: 2718483 - protein, 25 aa, Entamoeba histolytica
KVENEYLYVIPLNTPTYFEGSNNDG

SEQ ID NO: 2718484 - protein, 29 aa, Entamoeba histolytica
KVEPDKFIPNLYKLTPPLSLPIDTLLSQD

SEQ ID NO: 2718485 - protein, 28 aa, Entamoeba histolytica
KVFHGCDFDMIWLSYNFGLYVVNCIDSG

SEQ ID NO: 2718486 - protein, 19 aa, Entamoeba histolytica
KVFLCLIQKLPEIKMYLVD

SEQ ID NO: 2718487 - protein, 18 aa, Entamoeba histolytica
KVFLTQFVLEFQGKFDEV

SEQ ID NO: 2718488 - protein, 17 aa, Entamoeba histolytica
KVFNTFFSAKIHSICNV

SEQ ID NO: 2718489 - protein, 32 aa, Entamoeba histolytica
KVFPNRFELYYKGYIFNILFDVPQELALLRMG

SEQ ID NO: 2718490 - protein, 17 aa, Entamoeba histolytica
KVFQFDFADPFINSNYD

SEQ ID NO: 2718491 - protein, 30 aa, Entamoeba histolytica
KVFRPEQIIAMLLIQIKQFTEEYTKDIFTD

SEQ ID NO: 2718492 - protein, 25 aa, Entamoeba histolytica
KVGDKKYIMPYCYIKILEDYDQKTA

SEQ ID NO: 2718493 - protein, 23 aa, Entamoeba histolytica
KVGEVFGPLNDYYFSVVPVEGVK

SEQ ID NO: 2718494 - protein, 25 aa, Entamoeba histolytica
KVGGFVVIGTFPCKITEFNKTKDGK

SEQ ID NO: 2718495 - protein, 17 aa, Entamoeba histolytica
KVGINIFSLNVISFRLL

SEQ ID NO: 2718496 - protein, 26 aa, Entamoeba histolytica
KVGKTSMILRYTQNFFTPEEGPRTTQ

SEQ ID NO: 2718497 - protein, 55 aa, Entamoeba histolytica
KVGLKKKYLPVYIVVSPPLLLIFQSQNDYKNIKPFAILNLLNITVKLSDHHENTI

SEQ ID NO: 2718498 - protein, 33 aa, Entamoeba histolytica
KVHDDIIRVCFLFNTMFIITKIKTFQGKVLDKK

SEQ ID NO: 2718499 - protein, 21 aa, Entamoeba histolytica
KVHMENGLKVAKFLEQHPKIK

SEQ ID NO: 2718500 - protein, 23 aa, Entamoeba histolytica
KVHSIKFFYISRLIEKGEFQING

SEQ ID NO: 2718501 - protein, 21 aa, Entamoeba histolytica
KVIDGYNCTFFAYGQTGTGKT

SEQ ID NO: 2718502 - protein, 19 aa, Entamoeba histolytica
KVIFLNDCVGEEVIKACAN

SEQ ID NO: 2718503 - protein, 20 aa, Entamoeba histolytica
KVIHFYVWDSIITPGGHEIS

SEQ ID NO: 2718504 - protein, 26 aa, Entamoeba histolytica
KVIIIVTKEYNTFFLDLLRAMLNTKE

SEQ ID NO: 2718505 - protein, 18 aa, Entamoeba histolytica
KVILESGVFFTDTPQRGT

SEQ ID NO: 2718506 - protein, 20 aa, Entamoeba histolytica
KVINNLFTKLYTMKPKIFDK

SEQ ID NO: 2718507 - protein, 17 aa, Entamoeba histolytica
KVIPNCLGNIWVCVKDW

SEQ ID NO: 2718508 - protein, 19 aa, Entamoeba histolytica
KVIPNCLGNIWVYVRDWSE

SEQ ID NO: 2718509 - protein, 23 aa, Entamoeba histolytica
KVIPNCLGNIWVYVRDWSEEDGR

SEQ ID NO: 2718510 - protein, 30 aa, Entamoeba histolytica
KVISGRIGKMSLRFPWNKLDSQPVVVEIND

SEQ ID NO: 2718511 - protein, 28 aa, Entamoeba histolytica
KVKAPMILKCFLTFAERLNIDDSLYIII

SEQ ID NO: 2718512 - protein, 30 aa, Entamoeba histolytica
KVKDDNLLLIKKIVILTGIIRQISLQVTKN

SEQ ID NO: 2718513 - protein, 20 aa, Entamoeba histolytica
KVKDVLNLCLVFSTSNSFNR

SEQ ID NO: 2718514 - protein, 24 aa, Entamoeba histolytica
KVKEMLMTFKLYYSYDLDITLTLQ

SEQ ID NO: 2718515 - protein, 34 aa, Entamoeba histolytica
KVKEWIRVGKAEILPGVLFIDEVHMLDLECFSFL

SEQ ID NO: 2718516 - protein, 27 aa, Entamoeba histolytica
KVKNVLRPIFHFINDLNPEAINDQTYC

SEQ ID NO: 2718517 - protein, 17 aa, Entamoeba histolytica
KVKPQPRRQTKIKIMTT

SEQ ID NO: 2718518 - protein, 27 aa, Entamoeba histolytica
KVKSQLRLVVPWKRQLGLKVDQTKMSC

SEQ ID NO: 2718519 - protein, 32 aa, Entamoeba histolytica
KVKTIGNENARRIWLGRWTTADYPLPESGNER

SEQ ID NO: 2718520 - protein, 28 aa, Entamoeba histolytica
KVKTIKRRWFVLTTNKLFYFTSQNATEA

SEQ ID NO: 2718521 - protein, 18 aa, Entamoeba histolytica
KVKVFIAPLSNKLCLNDD

SEQ ID NO: 2718522 - protein, 30 aa, Entamoeba histolytica
KVLDSFQFVFLFLHLSFTFHHHISHPSYLP

SEQ ID NO: 2718523 - protein, 17 aa, Entamoeba histolytica
KVLFFETSAKAKINITE

SEQ ID NO: 2718524 - protein, 17 aa, Entamoeba histolytica
KVLFRTKSRYPNYTNSG

SEQ ID NO: 2718525 - protein, 27 aa, Entamoeba histolytica
KVLITHYVVLDLLIQSLNYYQDERVLP

SEQ ID NO: 2718526 - protein, 31 aa, Entamoeba histolytica; identical to SEQ ID NO: 2530970

SEQ ID NO: 2718527 - protein, 30 aa, Entamoeba histolytica
KVLKLLHEYGILYSFRKSPFRSLNYPKLEF

SEQ ID NO: 2718528 - protein, 33 aa, Entamoeba histolytica
KVLKSYVDKFNDKKWLCLMKEEEQIELLATIVV

SEQ ID NO: 2718529 - protein, 20 aa, Entamoeba histolytica
KVLLDLLMIIHSFIETYYKS

SEQ ID NO: 2718530 - protein, 17 aa, Entamoeba histolytica
KVLLLQPSSPLLSAYIN

SEQ ID NO: 2718531 - protein, 28 aa, Entamoeba histolytica
KVLLSTLNRVIIKLVIDLNTFKSNSEIL

SEQ ID NO: 2718532 - protein, 28 aa, Entamoeba histolytica
KVLVENIFYFDNLVLMPFSSHELHIYNN

SEQ ID NO: 2718533 - protein, 18 aa, Entamoeba histolytica
KVLYKVQALFKFSSDDIE

SEQ ID NO: 2718534 - protein, 22 aa, Entamoeba histolytica
KVMELLMVLIKLQGIQKNIKVN

SEQ ID NO: 2718535 - protein, 18 aa, Entamoeba histolytica
KVMGLRRAKRRNMERLTL

SEQ ID NO: 2718536 - protein, 32 aa, Entamoeba histolytica
KVNHLISSIPSMWKCLYKQKFEKIRLDCYFDD

SEQ ID NO: 2718537 - protein, 23 aa, Entamoeba histolytica
KVNKTNLIMGALLHDITKTRSLV

SEQ ID NO: 2718538 - protein, 19 aa, Entamoeba histolytica
KVNLLLERDKYLLQNLFSQ

SEQ ID NO: 2718539 - protein, 22 aa, Entamoeba histolytica
KVNMCALNIKMGYDNLYEFVLG

SEQ ID NO: 2718540 - protein, 19 aa, Entamoeba histolytica
KVNTLVRLDGLKKAFVRLA

SEQ ID NO: 2718541 - protein, 24 aa, Entamoeba histolytica
KVNTPVDEKWGFAKPFFSNDEEFN

SEQ ID NO: 2718542 - protein, 20 aa, Entamoeba histolytica
KVNVFDNSEVLAWYGAACTG

SEQ ID NO: 2718543 - protein, 28 aa, Entamoeba histolytica
KVNYSHCYGWLPLLYKITQEDFFASLIH

SEQ ID NO: 2718544 - protein, 17 aa, Entamoeba histolytica
KVPIRYFEKIGTPGFSI

SEQ ID NO: 2718545 - protein, 22 aa, Entamoeba histolytica
KVPKPYLSLFKDIQQTFLSFKE

SEQ ID NO: 2718546 - protein, 26 aa, Entamoeba histolytica
KVPKYKQYYIFFTSPINESIIETLAE

SEQ ID NO: 2718547 - protein, 17 aa, Entamoeba histolytica
KVPVPWKPKVSGADDVS

SEQ ID NO: 2718548 - protein, 17 aa, Entamoeba histolytica
KVPVSNILALHNSLYIA

SEQ ID NO: 2718549 - protein, 25 aa, Entamoeba histolytica
KVQEAIVKRKYVFSFIEEQTTRLNE

SEQ ID NO: 2718550 - protein, 19 aa, Entamoeba histolytica
KVQFRYNKKPKMRVAKLEN

SEQ ID NO: 2718551 - protein, 27 aa, Entamoeba histolytica
KVQKLYDTLPLFLPKNAKGFGLFMKYR

SEQ ID NO: 2718552 - protein, 17 aa, Entamoeba histolytica
KVQKYTDIQKQFNFIET

SEQ ID NO: 2718553 - protein, 26 aa, Entamoeba histolytica
KVQLINYHHLHQAILFTYSEHLRKVC

SEQ ID NO: 2718554 - protein, 24 aa, Entamoeba histolytica
KVQLQSLPLGMLWMNCMRNEMQSY

SEQ ID NO: 2718555 - protein, 17 aa, Entamoeba histolytica
KVQNIQITLIRGINFPT

SEQ ID NO: 2718556 - protein, 23 aa, Entamoeba histolytica
KVQPIFTKLYQQAGAAGGMPGGM

SEQ ID NO: 2718557 - protein, 35 aa, Entamoeba histolytica
KVQQLQKLYILFIDIHQFCIGFYFSIQSIKEWEWI

SEQ ID NO: 2718558 - protein, 20 aa, Entamoeba histolytica
KVRELIAVWGTYFPCELSEY

SEQ ID NO: 2718559 - protein, 34 aa, Entamoeba histolytica
KVRLQLESWLPKEEWPLFNKSLVAFGQCCCRKTH

SEQ ID NO: 2718560 - protein, 20 aa, Entamoeba histolytica
KVRTVIALKGLLLDAFEECD

SEQ ID NO: 2718561 - protein, 25 aa, Entamoeba histolytica
KVSENYINLIRLIRENTKYKEETKH

SEQ ID NO: 2718562 - protein, 26 aa, Entamoeba histolytica
KVSENYINLIRLIRENTKYKEETKHS

SEQ ID NO: 2718563 - protein, 20 aa, Entamoeba histolytica
KVSFRVIRCLEPFVKESETE

SEQ ID NO: 2718564 - protein, 22 aa, Entamoeba histolytica
KVSGFLVKKELGYFAKAFDHIN

SEQ ID NO: 2718565 - protein, 26 aa, Entamoeba histolytica
KVSGMCLTLLSRLLTTYLQRIGHTCS

SEQ ID NO: 2718566 - protein, 25 aa, Entamoeba histolytica
KVSNHPWLIQDFVKTFPEVLDGILP

SEQ ID NO: 2718567 - protein, 24 aa, Entamoeba histolytica
KVSPSSICRYMKKQEAREIYERIQ

SEQ ID NO: 2718568 - protein, 20 aa, Entamoeba histolytica
KVSQLIISLLKRFGKHYENW

SEQ ID NO: 2718569 - protein, 23 aa, Entamoeba histolytica
KVSRTIEIFKPKKIERRDPRFTE

SEQ ID NO: 2718570 - protein, 17 aa, Entamoeba histolytica
KVSTPNCIFLIKHRFAK

SEQ ID NO: 2718571 - protein, 25 aa, Entamoeba histolytica
KVTALSFFTYFFSVNSPIIRRKSVV

SEQ ID NO: 2718572 - protein, 26 aa, Entamoeba histolytica
KVTALSFFTYFFSVNSPIIRRKSVVN

SEQ ID NO: 2718573 - protein, 19 aa, Entamoeba histolytica
KVTIYGKFWTRESNPQYLS

SEQ ID NO: 2718574 - protein, 23 aa, Entamoeba histolytica
KVTKQVNSAPWPVAAREFVSVLI

SEQ ID NO: 2718575 - protein, 18 aa, Entamoeba histolytica
KVTLPFDYPFRPPSIEMF

SEQ ID NO: 2718576 - protein, 26 aa, Entamoeba histolytica
KVTQFFEKIFVIDPFERINTFQLMDM

SEQ ID NO: 2718577 - protein, 27 aa, Entamoeba histolytica
KVTQLYHPFCQLLCGLLNFVKGITHFP

SEQ ID NO: 2718578 - protein, 22 aa, Entamoeba histolytica
KVTSFMELFKRAIRSMAMGHVV

SEQ ID NO: 2718579 - protein, 23 aa, Entamoeba histolytica
KVTYFFCHHIPLTTPFHPKTRME

SEQ ID NO: 2718580 - protein, 24 aa, Entamoeba histolytica
KVVDFYFHRNLLYMVMEYHPSDVE

SEQ ID NO: 2718581 - protein, 17 aa, Entamoeba histolytica
KVVFIPNYSVSLAEVII

SEQ ID NO: 2718582 - protein, 19 aa, Entamoeba histolytica
KVVITIPVSFTPRQKKETI

SEQ ID NO: 2718583 - protein, 23 aa, Entamoeba histolytica
KVVIYQILSALKYIKVHNIIHRD

SEQ ID NO: 2718584 - protein, 24 aa, Entamoeba histolytica
KVVKITPIFIFEVQYDLFVEIFKS

SEQ ID NO: 2718585 - protein, 17 aa, Entamoeba histolytica
KVWKILLGIYKIDSFEY

SEQ ID NO: 2718586 - protein, 29 aa, Entamoeba histolytica
KVWKVIEKYFKIIYFINYDSGNYNIHITD

SEQ ID NO: 2718587 - protein, 25 aa, Entamoeba histolytica
KVYAEPFRFFLSFTPTKFPCFNQNM

SEQ ID NO: 2718588 - protein, 20 aa, Entamoeba histolytica
KVYNFVMGFGFDKFVLIDGI

SEQ ID NO: 2718589 - protein, 20 aa, Entamoeba histolytica
KVYSNIIYPKSILLKKGNCQ

SEQ ID NO: 2718590 - protein, 19 aa, Entamoeba histolytica
KWCDDLINMFPLSTKSFKS

SEQ ID NO: 2718591 - protein, 18 aa, Entamoeba histolytica
KWDFVSFYPKYTKLIFTL

SEQ ID NO: 2718592 - protein, 25 aa, Entamoeba histolytica
KWEQQKVLSFIPPDGKFTLFNYRVR

SEQ ID NO: 2718593 - protein, 23 aa, Entamoeba histolytica
KWIEITDEWYIPEAIFVVSEQQL

SEQ ID NO: 2718594 - protein, 18 aa, Entamoeba histolytica
KWIKIIFEQNGFGEWVYH

SEQ ID NO: 2718595 - protein, 21 aa, Entamoeba histolytica
KWINENLTKPKILIVNGPNGC

SEQ ID NO: 2718596 - protein, 18 aa, Entamoeba histolytica
KWIQVYQDELYVLLETDL

SEQ ID NO: 2718597 - protein, 26 aa, Entamoeba histolytica
KWKTHTLWIRLFRGKEKITTVKGIED

SEQ ID NO: 2718598 - protein, 18 aa, Entamoeba histolytica
KWMIQFPRIFHVCKGNKE

SEQ ID NO: 2718599 - protein, 28 aa, Entamoeba histolytica
KWMKCQYDPLFGYPNLVRFGWETSKRII

SEQ ID NO: 2718600 - protein, 35 aa, Entamoeba histolytica
KWSVDGIGFCLLKKQFIKFKSFLYQNIPLSNELKS

SEQ ID NO: 2718601 - protein, 19 aa, Entamoeba histolytica
KWTELSQCQLIFDSTIEYD

SEQ ID NO: 2718602 - protein, 22 aa, Entamoeba histolytica
KWTNLSYFRMVYFSGIDELSTR

SEQ ID NO: 2718603 - protein, 19 aa, Entamoeba histolytica
KWVPIRRKMAADNSCLFHC

SEQ ID NO: 2718604 - protein, 29 aa, Entamoeba histolytica
KYADQWVVLARYLLPYTTDYNYAKAVFDK

SEQ ID NO: 2718605 - protein, 24 aa, Entamoeba histolytica
KYAKGIVNFLVWSEQRYGKKVSVR

SEQ ID NO: 2718606 - protein, 25 aa, Entamoeba histolytica
KYAKTKFVLPIPKAVVFKQEKKEEE

SEQ ID NO: 2718607 - protein, 20 aa, Entamoeba histolytica
KYCHGVFDQLYRATIGVDFA

SEQ ID NO: 2718608 - protein, 19 aa, Entamoeba histolytica
KYCIPLQGICRQVIVKYGV

SEQ ID NO: 2718609 - protein, 20 aa, Entamoeba histolytica
KYCKYALHDDRFDPMTLSEF

SEQ ID NO: 2718610 - protein, 23 aa, Entamoeba histolytica
KYDAKCIAYMLLLKKIFSNTRSN

SEQ ID NO: 2718611 - protein, 17 aa, Entamoeba histolytica
KYDNTLPSSWRFWEVMA

SEQ ID NO: 2718612 - protein, 20 aa, Entamoeba histolytica
KYDPNLLDPKFVFAKEEETQ

SEQ ID NO: 2718613 - protein, 24 aa, Entamoeba histolytica
KYDRAVLFLLTLGQEKVLLPKEDY

SEQ ID NO: 2718614 - protein, 18 aa, Entamoeba histolytica
KYDRIIIFQPTGWAKKTT

SEQ ID NO: 2718615 - protein, 20 aa, Entamoeba histolytica
KYEDQCFTSPFKIKAFREDF

SEQ ID NO: 2718616 - protein, 26 aa, Entamoeba histolytica
KYEEILAQIVYFIISYNFIDCFDQKK

SEQ ID NO: 2718617 - protein, 20 aa, Entamoeba histolytica
KYEEKLQKKVMKPLKMYLEA

SEQ ID NO: 2718618 - protein, 32 aa, Entamoeba histolytica
KYEFISYFEYFYQFLFLNPITTYPIQILDYMT

SEQ ID NO: 2718619 - protein, 18 aa, Entamoeba histolytica
KYEIYVQLFVAISDNIYR

SEQ ID NO: 2718620 - protein, 18 aa, Entamoeba histolytica
KYEKQLFIILDHFNVHPK

SEQ ID NO: 2718621 - protein, 26 aa, Entamoeba histolytica
KYEKSYYALLSFIPRSPLNSYSSFVK

SEQ ID NO: 2718622 - protein, 27 aa, Entamoeba histolytica
KYENEELIKYALPNDLWFHVDSESSAH

SEQ ID NO: 2718623 - protein, 18 aa, Entamoeba histolytica
KYERLEICYSDHLPVRCI

SEQ ID NO: 2718624 - protein, 23 aa, Entamoeba histolytica
KYFNEYLYCVINFVGENHEVLLP

SEQ ID NO: 2718625 - protein, 19 aa, Entamoeba histolytica
KYFSIKKICDLAEALLLAV

SEQ ID NO: 2718626 - protein, 20 aa, Entamoeba histolytica
KYFVGYCIIVMKTLYRCCKL

SEQ ID NO: 2718627 - protein, 31 aa, Entamoeba histolytica
KYGKSRSASLLTFYLLKKYQITVNAAKELFK

SEQ ID NO: 2718628 - protein, 23 aa, Entamoeba histolytica
KYGLEPPKLWLKNDILNFMIHKL

SEQ ID NO: 2718629 - protein, 20 aa, Entamoeba histolytica
KYGVIFGSTFIARAEAKNKG

SEQ ID NO: 2718630 - protein, 23 aa, Entamoeba histolytica
KYHGWSVRHPFNGKILPIIEDDE

SEQ ID NO: 2718631 - protein, 27 aa, Entamoeba histolytica
KYHSLVRLYFKDIKGVLLVFQIDRQES

SEQ ID NO: 2718632 - protein, 26 aa, Entamoeba histolytica
KYHTVKMLDYFLFHGHVCIVTELLSI

SEQ ID NO: 2718633 - protein, 22 aa, Entamoeba histolytica
KYHVITVFVLIAQKKLVPHLKN

SEQ ID NO: 2718634 - protein, 27 aa, Entamoeba histolytica
KYIDIMVNLLFYVPMTNDYLSNLFNGI

SEQ ID NO: 2718635 - protein, 17 aa, Entamoeba histolytica
KYIERWCEILSTKPKSV

SEQ ID NO: 2718636 - protein, 24 aa, Entamoeba histolytica
KYIPNAPFNLLSLKVSLGDIEDYV

SEQ ID NO: 2718637 - protein, 20 aa, Entamoeba histolytica
KYIQFVIENNIRYEINTTLK

SEQ ID NO: 2718638 - protein, 18 aa, Entamoeba histolytica
KYIRVLVACLPQFKPNDL

SEQ ID NO: 2718639 - protein, 20 aa, Entamoeba histolytica
KYIVIKSKKGKNPYIKFCQE

SEQ ID NO: 2718640 - protein, 21 aa, Entamoeba histolytica
KYIVSQLASALYYLHINNFIH

SEQ ID NO: 2718641 - protein, 28 aa, Entamoeba histolytica
KYKDYLNCLFIRYFPRAICLNCVMNLKQ

SEQ ID NO: 2718642 - protein, 25 aa, Entamoeba histolytica
KYKFDQLLFVRDSEFLRCYCAEFVK

SEQ ID NO: 2718643 - protein, 22 aa, Entamoeba histolytica
KYKIFTFRFPLIHSSIYCHVLF

SEQ ID NO: 2718644 - protein, 24 aa, Entamoeba histolytica
KYKKVYLIPNYSQTPYYVCFKNDG

SEQ ID NO: 2718645 - protein, 23 aa, Entamoeba histolytica
KYKTKLVIMLLKYQCFSSEINQN

SEQ ID NO: 2718646 - protein, 27 aa, Entamoeba histolytica
KYKYLQLCMTLRSYGMNIYHGGIEPKG

SEQ ID NO: 2718647 - protein, 27 aa, Entamoeba histolytica
KYLKDTDIVIFFLKTSFNSSLIQRLQF

SEQ ID NO: 2718648 - protein, 24 aa, Entamoeba histolytica
KYLKEFMMSIIINASYTTSISGVL

SEQ ID NO: 2718649 - protein, 24 aa, Entamoeba histolytica
KYLNDIFIDLFNKQFPKINQTITN

SEQ ID NO: 2718650 - protein, 18 aa, Entamoeba histolytica
KYLRAICDAIVIYYEMFK

SEQ ID NO: 2718651 - protein, 24 aa, Entamoeba histolytica
KYMADIYLHYLTNGDFKSIDKDTK

SEQ ID NO: 2718652 - protein, 24 aa, Entamoeba histolytica
KYNDIPFFVKNGFKGVARSMPTSA

SEQ ID NO: 2718653 - protein, 28 aa, Entamoeba histolytica
KYNDKYDSVFRFVLNNTLLVDTLDNARK

SEQ ID NO: 2718654 - protein, 17 aa, Entamoeba histolytica
KYNEFFIAITFTTKVSK

SEQ ID NO: 2718655 - protein, 19 aa, Entamoeba histolytica
KYNITLCSIPTLVSRYLMI

SEQ ID NO: 2718656 - protein, 20 aa, Entamoeba histolytica
KYNKEIGILKEKELIQQNDD

SEQ ID NO: 2718657 - protein, 23 aa, Entamoeba histolytica
KYNKLINYILVEISKIDIPIKTG

SEQ ID NO: 2718658 - protein, 29 aa, Entamoeba histolytica
KYNKRIMINAILILYPNGLQMYLIPLDNT

SEQ ID NO: 2718659 - protein, 20 aa, Entamoeba histolytica
KYNNLWDYCSLYLSKDVETI

SEQ ID NO: 2718660 - protein, 37 aa, Entamoeba histolytica
KYNQKYFITATLPQMMILLLFNTHNILKISEIALDLN

SEQ ID NO: 2718661 - protein, 20 aa, Entamoeba histolytica
KYPFVCFAKITWEDSNKPFP

SEQ ID NO: 2718662 - protein, 26 aa, Entamoeba histolytica
KYPKLDLTWINERPGIKILGCGNHDK

SEQ ID NO: 2718663 - protein, 18 aa, Entamoeba histolytica
KYPYTSPDGQVKLQFILP

SEQ ID NO: 2718664 - protein, 22 aa, Entamoeba histolytica
KYQGKFPQNRFGIAPDYKWDGI

SEQ ID NO: 2718665 - protein, 27 aa, Entamoeba histolytica
KYQMNEVVMILRFLKKQSTHLPQIEFK

SEQ ID NO: 2718666 - protein, 20 aa, Entamoeba histolytica
KYQSTLFVWTKTTKFSVLFD

SEQ ID NO: 2718667 - protein, 26 aa, Entamoeba histolytica
KYQTLLCEQFIPLIMNILMEPLNTQE

SEQ ID NO: 2718668 - protein, 19 aa, Entamoeba histolytica
KYRAITDAYYRGAEGAMCV

SEQ ID NO: 2718669 - protein, 23 aa, Entamoeba histolytica
KYRMGNLFIVGPTKTGKTEFAVQ

SEQ ID NO: 2718670 - protein, 23 aa, Entamoeba histolytica
KYRNDLLPYFIQSISKMIDVMNK

SEQ ID NO: 2718671 - protein, 25 aa, Entamoeba histolytica
KYRNERFNYIIPIFNYLKENEDIVY

SEQ ID NO: 2718672 - protein, 24 aa, Entamoeba histolytica
KYRSMVGMYYRGATVALICYDITS

SEQ ID NO: 2718673 - protein, 22 aa, Entamoeba histolytica
KYRSMVSMYYRGSLGAMLVYDV

SEQ ID NO: 2718674 - protein, 22 aa, Entamoeba histolytica
KYRSMVSMYYRGSSGAVIVYDI

SEQ ID NO: 2718675 - protein, 27 aa, Entamoeba histolytica
KYRSTIDNIPLLSKIYKKVSFLGQASN

SEQ ID NO: 2718676 - protein, 17 aa, Entamoeba histolytica
KYRYIVFKMNDGMTEVV

SEQ ID NO: 2718677 - protein, 44 aa, Entamoeba histolytica
KYRYYGESYIILNVYYKQYLIPLMDILRQNKIQLLFSPKRYFDY

SEQ ID NO: 2718678 - protein, 29 aa, Entamoeba histolytica
KYSELKRYTLLLTNLPHKRLRDVAARVKY

SEQ ID NO: 2718679 - protein, 22 aa, Entamoeba histolytica
KYSEYKRYLNYTFLNDKRSSEF

SEQ ID NO: 2718680 - protein, 27 aa, Entamoeba histolytica
KYSGGYNWWRRNSLTVFLDKKIYKDPA

SEQ ID NO: 2718681 - protein, 31 aa, Entamoeba histolytica
KYSHARVTSIPTILVLNPGSWKALQQTAKEF

SEQ ID NO: 2718682 - protein, 19 aa, Entamoeba histolytica
KYSSIYYKQLLIDLLKEKE

SEQ ID NO: 2718683 - protein, 28 aa, Entamoeba histolytica
KYSTYIFNKGFILKIKHLLKSNFTDSTV

SEQ ID NO: 2718684 - protein, 26 aa, Entamoeba histolytica
KYTDKQMFGLLLLQSIIRGYKTRKLY

SEQ ID NO: 2718685 - protein, 25 aa, Entamoeba histolytica
KYTHVLLLIELAKVIKFYIADDQHF

SEQ ID NO: 2718686 - protein, 20 aa, Entamoeba histolytica
KYTKLIFTLFCNIGMVSCDD

SEQ ID NO: 2718687 - protein, 22 aa, Entamoeba histolytica
KYVICQPKIWSKAIDSSFQFII

SEQ ID NO: 2718688 - protein, 19 aa, Entamoeba histolytica
KYVKLNFGLMEGVALWALR

SEQ ID NO: 2718689 - protein, 18 aa, Entamoeba histolytica
KYVPLSKKFRNMNDSERA

SEQ ID NO: 2718690 - protein, 18 aa, Entamoeba histolytica
KYYCYYCRRGLIPELPQV

SEQ ID NO: 2718691 - protein, 21 aa, Entamoeba histolytica
KYYDFLQYLIQTHAVLFLPQA

SEQ ID NO: 2718692 - protein, 20 aa, Entamoeba histolytica
KYYPFTVYRFGKVTEIMSTY

SEQ ID NO: 2718693 - protein, 23 aa, Entamoeba histolytica
KYYQIHNLYHKWSVDGIGFCLLK

SEQ ID NO: 2718694 - protein, 29 aa, Entamoeba histolytica
KYYYNRFCQQFPLLPPIFCVGTKSDLPPT

SEQ ID NO: 2718695 - protein, 39 aa, Entamoeba histolytica
LAAPALKILVRLCSLFPLIKKYVLACEFFREKLKEYSGT

SEQ ID NO: 2718696 - protein, 27 aa, Entamoeba histolytica
LAAPLTFEITPFSQNFIRIGMNWKQAD

SEQ ID NO: 2718697 - protein, 17 aa, Entamoeba histolytica
LAAVRLLPSYENPTFSV

SEQ ID NO: 2718698 - protein, 20 aa, Entamoeba histolytica
LACLLALMELHPKFEHAPIE

SEQ ID NO: 2718699 - protein, 25 aa, Entamoeba histolytica
LADAPNHMIFILTGPVQNGEELPDI

SEQ ID NO: 2718700 - protein, 19 aa, Entamoeba histolytica
LADGTFWPIPITMSVSEEE

SEQ ID NO: 2718701 - protein, 29 aa, Entamoeba histolytica
LADKEMWEEFKEFLKFKQMLQQEENNKQE

SEQ ID NO: 2718702 - protein, 28 aa, Entamoeba histolytica
LADNLRVLYKLYSSFKMPHLPKVGVLYF

SEQ ID NO: 2718703 - protein, 17 aa, Entamoeba histolytica
LADVFPDINYLSEHPQT

SEQ ID NO: 2718704 - protein, 18 aa, Entamoeba histolytica
LAFEYPSYGLFDQPYSDE

SEQ ID NO: 2718705 - protein, 25 aa, Entamoeba histolytica
LAFGGIQMIICGDFCQLPPISRNGT

SEQ ID NO: 2718706 - protein, 30 aa, Entamoeba histolytica
LAFSSFVIQYYGLILDILLLGPRRAFEIAG

SEQ ID NO: 2718707 - protein, 32 aa, Entamoeba histolytica; identical to SEQ ID NO: 2531177

SEQ ID NO: 2718708 - protein, 24 aa, Entamoeba histolytica
LAHSASLFLIAPATADIIAKLASG

SEQ ID NO: 2718709 - protein, 17 aa, Entamoeba histolytica
LAITIPNASKLSAKCFK

SEQ ID NO: 2718710 - protein, 36 aa, Entamoeba histolytica
LAIYHPRYYNNGFLPTCLDLFFQSHPKMPNVPLSAD

SEQ ID NO: 2718711 - protein, 20 aa, Entamoeba histolytica
LAIYLKHLPPYHNEDIFYQN

SEQ ID NO: 2718712 - protein, 28 aa, Entamoeba histolytica
LAIYNGIILDAKLPIVVYKKILGINLQM

SEQ ID NO: 2718713 - protein, 19 aa, Entamoeba histolytica
LAKFLAKIHQLPITNCESM

SEQ ID NO: 2718714 - protein, 32 aa, Entamoeba histolytica; identical to SEQ ID NO: 2531189

SEQ ID NO: 2718715 - protein, 23 aa, Entamoeba histolytica
LAKKYDIPFFFDAARFAENAYFI

SEQ ID NO: 2718716 - protein, 37 aa, Entamoeba histolytica
LAKMPCLQCVEDCICIGLYYWTYDIPSFNTINNKETT

SEQ ID NO: 2718717 - protein, 23 aa, Entamoeba histolytica
LAKRKKDMKLEIQRNVFAQYEEE

SEQ ID NO: 2718718 - protein, 24 aa, Entamoeba histolytica
LALEKIVYLFLNYPHQNKIISIYS

SEQ ID NO: 2718719 - protein, 19 aa, Entamoeba histolytica
LALFYFQNAKHELALELLL

SEQ ID NO: 2718720 - protein, 19 aa, Entamoeba histolytica
LALKKYLLPSSNWPINIQP

SEQ ID NO: 2718721 - protein, 17 aa, Entamoeba histolytica
LALKRKEQKRRNEEKDI

SEQ ID NO: 2718722 - protein, 27 aa, Entamoeba histolytica
LALRIRGGKPVILLYDNEKKRNEAMSV

SEQ ID NO: 2718723 - protein, 30 aa, Entamoeba histolytica; identical to SEQ ID NO: 2531195

SEQ ID NO: 2718724 - protein, 19 aa, Entamoeba histolytica
LAMIIRSYPGIHVMMIQRV

SEQ ID NO: 2718725 - protein, 25 aa, Entamoeba histolytica
LANDRNICIWASDGKLLKTLPRTDE

SEQ ID NO: 2718726 - protein, 35 aa, Entamoeba histolytica
LANFMEIWMDYKDIPYLVMCIWSKTQDFLISKGVD

SEQ ID NO: 2718727 - protein, 24 aa, Entamoeba histolytica
LANIFICLGPALRGCPFCFNYATV

SEQ ID NO: 2718728 - protein, 17 aa, Entamoeba histolytica
LANYNPITKVNPPPFLS

SEQ ID NO: 2718729 - protein, 24 aa, Entamoeba histolytica
LAPFQVLDRCSLNMLIPAEQSIPS

SEQ ID NO: 2718730 - protein, 26 aa, Entamoeba histolytica
LAQEYYQLLVRALATMLKFLPDSDTQ

SEQ ID NO: 2718731 - protein, 28 aa, Entamoeba histolytica
LAQRKHFPAVNWNISFSKYIKSLDSYYN

SEQ ID NO: 2718732 - protein, 19 aa, Entamoeba histolytica
LAQTKLPFNCLVVALVFDV

SEQ ID NO: 2718733 - protein, 20 aa, Entamoeba histolytica
LAQYNKEIWYAELKILRTKN

SEQ ID NO: 2718734 - protein, 17 aa, Entamoeba histolytica
LARHIISLYWGHEIKTD

SEQ ID NO: 2718735 - protein, 22 aa, Entamoeba histolytica
LARKLFPEKLDQFNPAFVIVDQ

SEQ ID NO: 2718736 - protein, 26 aa, Entamoeba histolytica
LARLQKKKIFIREKRIVFNEEGKGIE

SEQ ID NO: 2718737 - protein, 25 aa, Entamoeba histolytica
LARSLFPKIIHFKCPFDFSLLNDNE

SEQ ID NO: 2718738 - protein, 18 aa, Entamoeba histolytica
LASFNKLFKYQAALILFA

SEQ ID NO: 2718739 - protein, 22 aa, Entamoeba histolytica
LASIKALLTLELQEMKIGLDGL

SEQ ID NO: 2718740 - protein, 27 aa, Entamoeba histolytica
LASLPTLFLNEYAFPLLLALSTTHKGC

SEQ ID NO: 2718741 - protein, 27 aa, Entamoeba histolytica
LASPKWKFTFIQLIATLPAETKMIYSV

SEQ ID NO: 2718742 - protein, 27 aa, Entamoeba histolytica
LASRQMHLAKFLRALQRIADEFSVAVV

SEQ ID NO: 2718743 - protein, 18 aa, Entamoeba histolytica
LASSTLQFIELLKSNKRY

SEQ ID NO: 2718744 - protein, 24 aa, Entamoeba histolytica
LATKIVCLRIFNDLFETFIEKGDL

SEQ ID NO: 2718745 - protein, 26 aa, Entamoeba histolytica
LATTLSAWIERLGGKITIRPKDADVI

SEQ ID NO: 2718746 - protein, 18 aa, Entamoeba histolytica
LAVGYYNRFPTIQSYKLL

SEQ ID NO: 2718747 - protein, 18 aa, Entamoeba histolytica
LAVVIEKLPLPSTLFELI

SEQ ID NO: 2718748 - protein, 17 aa, Entamoeba histolytica
LCCILENYQCEDGIIVP

SEQ ID NO: 2718749 - protein, 18 aa, Entamoeba histolytica
LCCQEKLCFRFVNKTKLY

SEQ ID NO: 2718750 - protein, 18 aa, Entamoeba histolytica
LCCYEANSCWKYLEDFSI

SEQ ID NO: 2718751 - protein, 18 aa, Entamoeba histolytica
LCCYPSYDFVHCLVDSFE

SEQ ID NO: 2718752 - protein, 18 aa, Entamoeba histolytica
LCDAFISRFALLDDPGKM

SEQ ID NO: 2718753 - protein, 18 aa, Entamoeba histolytica
LCDCKVSLMVFKDDKLVV

SEQ ID NO: 2718754 - protein, 30 aa, Entamoeba histolytica; identical to SEQ ID NO: 2531234

SEQ ID NO: 2718755 - protein, 18 aa, Entamoeba histolytica
LCDIKDFRTIKQKTMLMV

SEQ ID NO: 2718756 - protein, 30 aa, Entamoeba histolytica
LCDNDGFHLIYYTIYYDFPELIQLICIWDK

SEQ ID NO: 2718757 - protein, 30 aa, Entamoeba histolytica
LCDSNEQELFLMQYPTRLAWRPFDLSQVKE

SEQ ID NO: 2718758 - protein, 19 aa, Entamoeba histolytica
LCEEVNYWKNKFVTLQEEV

SEQ ID NO: 2718759 - protein, 29 aa, Entamoeba histolytica
LCESKSFLKLLEVILIIGNYMNKASKKPI

SEQ ID NO: 2718760 - protein, 24 aa, Entamoeba histolytica
LCFQLQPVLTERITIVISPLIALM

SEQ ID NO: 2718761 - protein, 24 aa, Entamoeba histolytica
LCGMEFFQHYAGMYDQFKIDGVSV

SEQ ID NO: 2718762 - protein, 20 aa, Entamoeba histolytica
LCGMEFFQYYAGMYDQFKID

SEQ ID NO: 2718763 - protein, 19 aa, Entamoeba histolytica
LCGTEFFQYYAGMYDQFKI

SEQ ID NO: 2718764 - protein, 20 aa, Entamoeba histolytica
LCGTEFFQYYAGMYDQFKID

SEQ ID NO: 2718765 - protein, 17 aa, Entamoeba histolytica
LCIGGVFIRILNKNPTC

SEQ ID NO: 2718766 - protein, 19 aa, Entamoeba histolytica
LCIGSKLKTYIFIDNEVVS

SEQ ID NO: 2718767 - protein, 20 aa, Entamoeba histolytica
LCIGYCLSILAIIPATNVKS

SEQ ID NO: 2718768 - protein, 27 aa, Entamoeba histolytica
LCKFENFFTYKRYKFGVLYAAPGQTKE

SEQ ID NO: 2718769 - protein, 27 aa, Entamoeba histolytica
LCKFENFFTYKRYKFGVLYAAVGQTKE

SEQ ID NO: 2718770 - protein, 20 aa, Entamoeba histolytica
LCKSVQFDKQLGLDSSFDES

SEQ ID NO: 2718771 - protein, 29 aa, Entamoeba histolytica
LCKTKRVCILYPSFSDIYYAFSQFDIPIV

SEQ ID NO: 2718772 - protein, 24 aa, Entamoeba histolytica
LCKTRNPFVLGFIQVKQNSDMTTC

SEQ ID NO: 2718773 - protein, 18 aa, Entamoeba histolytica
LCLALQYITDVTPFFGFE

SEQ ID NO: 2718774 - protein, 22 aa, Entamoeba histolytica
LCLESFMKIQLIDLSHDLPASG

SEQ ID NO: 2718775 - protein, 20 aa, Entamoeba histolytica
LCLIFPYSPPHFSYSLDARK

SEQ ID NO: 2718776 - protein, 17 aa, Entamoeba histolytica
LCLLGNPLPQVDSLFLI

SEQ ID NO: 2718777 - protein, 19 aa, Entamoeba histolytica
LCLRAISILRAIGTRYKPG

SEQ ID NO: 2718778 - protein, 26 aa, Entamoeba histolytica
LCLVITENIFYIANTGDCRCLLIGDD

SEQ ID NO: 2718779 - protein, 19 aa, Entamoeba histolytica
LCLVYALKARYPQQFFIIR

SEQ ID NO: 2718780 - protein, 28 aa, Entamoeba histolytica
LCMTAAPYIDFLKLGFGTLIFTGGLREK

SEQ ID NO: 2718781 - protein, 22 aa, Entamoeba histolytica
LCNLLLILKDNLNILSAYYADG

SEQ ID NO: 2718782 - protein, 27 aa, Entamoeba histolytica
LCPHKTEFLMMLLENYRALMNGQSFPI

SEQ ID NO: 2718783 - protein, 19 aa, Entamoeba histolytica
LCQKEIMVLVVTKVDQKEG

SEQ ID NO: 2718784 - protein, 17 aa, Entamoeba histolytica
LCQYKYCSVVPLLERRF

SEQ ID NO: 2718785 - protein, 17 aa, Entamoeba histolytica
LCRFELKQLFLQAPMVG

SEQ ID NO: 2718786 - protein, 22 aa, Entamoeba histolytica
LCSEKILAQPWTTKTELQFIYE

SEQ ID NO: 2718787 - protein, 24 aa, Entamoeba histolytica
LCTMTKIGLPVPQGFVITTEMCKQ

SEQ ID NO: 2718788 - protein, 17 aa, Entamoeba histolytica
LCVGSTISYYTSLVGIS

SEQ ID NO: 2718789 - protein, 18 aa, Entamoeba histolytica
LCVSLFNQSIPLISQCFV

SEQ ID NO: 2718790 - protein, 18 aa, Entamoeba histolytica
LCYCIKFFNKLEETIIRI

SEQ ID NO: 2718791 - protein, 17 aa, Entamoeba histolytica
LCYLYSPDIQRTISNDE

SEQ ID NO: 2718792 - protein, 19 aa, Entamoeba histolytica
LCYNAPEQLLNSFLRFHCC

SEQ ID NO: 2718793 - protein, 19 aa, Entamoeba histolytica
LCYVLSKHSPITSNPFFKV

SEQ ID NO: 2718794 - protein, 18 aa, Entamoeba histolytica
LCYYKIIQYAPDSIRFVS

SEQ ID NO: 2718795 - protein, 27 aa, Entamoeba histolytica
LDAIRIGMCFFWHSKVDLPFRVVIIGA

SEQ ID NO: 2718796 - protein, 26 aa, Entamoeba histolytica
LDALEYIHRMYLKVGFYLTGETTDFN

SEQ ID NO: 2718797 - protein, 33 aa, Entamoeba histolytica
LDAPLPMDGKLKEPVFNLLLSKPQLSNILNAFF

SEQ ID NO: 2718798 - protein, 21 aa, Entamoeba histolytica
LDCGYTSMQGWRRTMEDAHIV

SEQ ID NO: 2718799 - protein, 24 aa, Entamoeba histolytica
LDCKIKELYFPRALALFCEYPLFN

SEQ ID NO: 2718800 - protein, 18 aa, Entamoeba histolytica
LDCKLQYDYIIKSQVYSS

SEQ ID NO: 2718801 - protein, 17 aa, Entamoeba histolytica
LDCLPPINKAMTIFIIN

SEQ ID NO: 2718802 - protein, 18 aa, Entamoeba histolytica
LDCSKSVRIVWPNLDDPS

SEQ ID NO: 2718803 - protein, 22 aa, Entamoeba histolytica
LDCYDICYLWIGKEVSAIDKKF

SEQ ID NO: 2718804 - protein, 30 aa, Entamoeba histolytica
LDDFNKWTVTLAPLIQSIGYFGYSIDVAIE

SEQ ID NO: 2718805 - protein, 18 aa, Entamoeba histolytica
LDDIYRILIKTNSFPTLS

SEQ ID NO: 2718806 - protein, 17 aa, Entamoeba histolytica
LDDKYLPSILALLKDNN

SEQ ID NO: 2718807 - protein, 25 aa, Entamoeba histolytica
LDEADRMFDMGFGPQIKRIIEGIRP

SEQ ID NO: 2718808 - protein, 27 aa, Entamoeba histolytica
LDEALLRPGRFDRILYVGLPDLDTRKQ

SEQ ID NO: 2718809 - protein, 26 aa, Entamoeba histolytica
LDEASSRYFTWYINNTRLSVVKLMKD

SEQ ID NO: 2718810 - protein, 28 aa, Entamoeba histolytica
LDEEIKYIYTIIKGIRSLNGIYSQAIIT

SEQ ID NO: 2718811 - protein, 25 aa, Entamoeba histolytica
LDEIKNHLIILEQQQNDIYNKIDQH

SEQ ID NO: 2718812 - protein, 24 aa, Entamoeba histolytica
LDEKYWDTLAIRIRYEELQYALGT

SEQ ID NO: 2718813 - protein, 17 aa, Entamoeba histolytica
LDELFIIDVRYPYEYNG

SEQ ID NO: 2718814 - protein, 17 aa, Entamoeba histolytica
LDELRAQGKFKILGEYP

SEQ ID NO: 2718815 - protein, 29 aa, Entamoeba histolytica
LDEMCYRLNKFIITLFPEYKDVFNGNELQ

SEQ ID NO: 2718816 - protein, 17 aa, Entamoeba histolytica
LDENIIQLIFMERRIKA

SEQ ID NO: 2718817 - protein, 25 aa, Entamoeba histolytica
LDERDLRRYFSQYGELKGLAIKKTD

SEQ ID NO: 2718818 - protein, 30 aa, Entamoeba histolytica
LDESKAFLESFLDQFPAFKKWKEETITNAS

SEQ ID NO: 2718819 - protein, 23 aa, Entamoeba histolytica
LDFIDILMILLTNAVEQQQYIFI

SEQ ID NO: 2718820 - protein, 18 aa, Entamoeba histolytica
LDFIPMDNWSIPAEGKWC

SEQ ID NO: 2718821 - protein, 18 aa, Entamoeba histolytica
LDFIQRSFVLFPGNALDC

SEQ ID NO: 2718822 - protein, 19 aa, Entamoeba histolytica
LDFLFDFTLDQQRLIKNFL

SEQ ID NO: 2718823 - protein, 28 aa, Entamoeba histolytica
LDFNELHLIFSVFNLLFKIPQNDVNNEI

SEQ ID NO: 2718824 - protein, 24 aa, Entamoeba histolytica
LDFSYKLLRGIINYCNYPDPDIRT

SEQ ID NO: 2718825 - protein, 26 aa, Entamoeba histolytica
LDFVVCNMLFNWNLPSIVNPSDPLIL

SEQ ID NO: 2718826 - protein, 28 aa, Entamoeba histolytica
LDGDEYLIIWNPLFLPKPEIHSHAPATY

SEQ ID NO: 2718827 - protein, 17 aa, Entamoeba histolytica
LDGFYEPLYGQPHSEPA

SEQ ID NO: 2718828 - protein, 17 aa, Entamoeba histolytica
LDGKYLVVDDHNYHPNC

SEQ ID NO: 2718829 - protein, 22 aa, Entamoeba histolytica
LDGNIELILYVLTDGRDDLKMK

SEQ ID NO: 2718830 - protein, 22 aa, Entamoeba histolytica
LDGSLMCYHRLLLKGNIETEKS

SEQ ID NO: 2718831 - protein, 40 aa, Entamoeba histolytica
LDGVYRKMFIKHLWEVFTTSLFNFLWPPIIERNEGDVVFE

SEQ ID NO: 2718832 - protein, 26 aa, Entamoeba histolytica
LDHGKKYMFSLTWNAPLEAFNDKNEF

SEQ ID NO: 2718833 - protein, 17 aa, Entamoeba histolytica
LDHHFLEYFITFNYNDK

SEQ ID NO: 2718834 - protein, 18 aa, Entamoeba histolytica
LDHHVFIIEVKQTSVFKL

SEQ ID NO: 2718835 - protein, 24 aa, Entamoeba histolytica
LDHPIILSYLTSSVEYFCFKYNKS

SEQ ID NO: 2718836 - protein, 19 aa, Entamoeba histolytica
LDIEHYTRTDLFPWREEMP

SEQ ID NO: 2718837 - protein, 21 aa, Entamoeba histolytica
LDIFGFEIFPVNGFEQFCINY

SEQ ID NO: 2718838 - protein, 19 aa, Entamoeba histolytica
LDILEFRPPRHIDLTQFQP

SEQ ID NO: 2718839 - protein, 19 aa, Entamoeba histolytica
LDIPFIATTFKKYIDTLYE

SEQ ID NO: 2718840 - protein, 21 aa, Entamoeba histolytica
LDIPLDIIIPFISNEWSRKYV

SEQ ID NO: 2718841 - protein, 24 aa, Entamoeba histolytica
LDITEFLHLMKCLEIFESQKGQSK

SEQ ID NO: 2718842 - protein, 27 aa, Entamoeba histolytica
LDIYEVHGLLPLFTKIYQFVGKEKLFL

SEQ ID NO: 2718843 - protein, 29 aa, Entamoeba histolytica
LDKDVDQLFFDKWFRKGIITKETYLASLQ

SEQ ID NO: 2718844 - protein, 24 aa, Entamoeba histolytica
LDKEGNFPEWYSQIVVQSGLIEYY

SEQ ID NO: 2718845 - protein, 26 aa, Entamoeba histolytica
LDKFKRYFRRIVNVAKNFPFVLVVEE

SEQ ID NO: 2718846 - protein, 31 aa, Entamoeba histolytica
LDKFRDEYIIHFYGALFIPNKICMVTEFAEY

SEQ ID NO: 2718847 - protein, 27 aa, Entamoeba histolytica
LDKFRDEYIIQFYGAVFIPNKICMVTE

SEQ ID NO: 2718848 - protein, 29 aa, Entamoeba histolytica
LDKFRDEYIIQFYGTVFIPNKICMITDFV

SEQ ID NO: 2718849 - protein, 26 aa, Entamoeba histolytica
LDKFRDEYIIQFYGTVFIPSKICMVT

SEQ ID NO: 2718850 - protein, 27 aa, Entamoeba histolytica
LDKFRNEYIIHFYGAVFIPNKICMVTE

SEQ ID NO: 2718851 - protein, 29 aa, Entamoeba histolytica
LDKFRNEYIIHFYGAVFIPNKICMVTEYA

SEQ ID NO: 2718852 - protein, 27 aa, Entamoeba histolytica
LDKFRNEYIIQFYGAVFIPNKICMVTE

SEQ ID NO: 2718853 - protein, 18 aa, Entamoeba histolytica
LDKFTFPINLKTLLLTNC

SEQ ID NO: 2718854 - protein, 17 aa, Entamoeba histolytica
LDKITLKSLLLESLLNT

SEQ ID NO: 2718855 - protein, 25 aa, Entamoeba histolytica
LDKLHKYFHVFDRWENPLSSVSPLT

SEQ ID NO: 2718856 - protein, 26 aa, Entamoeba histolytica
LDKLKEMIWEQLNLVRVYTKAPGAFP

SEQ ID NO: 2718857 - protein, 33 aa, Entamoeba histolytica
LDKNIISMDVGYQCLFLIATSSLYCFDINTKQF

SEQ ID NO: 2718858 - protein, 25 aa, Entamoeba histolytica
LDKQNTLQYLFILAQIGISCCPIYD

SEQ ID NO: 2718859 - protein, 22 aa, Entamoeba histolytica
LDKRQNGCFLVRLSSKTVEHPF

SEQ ID NO: 2718860 - protein, 28 aa, Entamoeba histolytica
LDKSKESLLPLMRNILGILLHICFDESQ

SEQ ID NO: 2718861 - protein, 17 aa, Entamoeba histolytica
LDKTFNFLIMKRKRIEI

SEQ ID NO: 2718862 - protein, 27 aa, Entamoeba histolytica
LDKYKEKFLHFPSISYLIWSPQTDNLK

SEQ ID NO: 2718863 - protein, 28 aa, Entamoeba histolytica
LDKYPIVQHFLFGKLLPYELLVRGSTPK

SEQ ID NO: 2718864 - protein, 22 aa, Entamoeba histolytica
LDKYYHLAKQYGYRARSAFKLV

SEQ ID NO: 2718865 - protein, 20 aa, Entamoeba histolytica
LDLLIQIIDLLNKNILKEIE

SEQ ID NO: 2718866 - protein, 17 aa, Entamoeba histolytica
LDLLKMVTAFMLEHKIL

SEQ ID NO: 2718867 - protein, 23 aa, Entamoeba histolytica
LDLNAICFVAQSSNVRLTLSQQY

SEQ ID NO: 2718868 - protein, 20 aa, Entamoeba histolytica
LDLNAICFVASSSNVRLTAS

SEQ ID NO: 2718869 - protein, 27 aa, Entamoeba histolytica
LDLPQGQWPELMPFLLTDGSVAKLKTI

SEQ ID NO: 2718870 - protein, 26 aa, Entamoeba histolytica
LDLQYYIHKGVWFLMNFVREEFSNAQ

SEQ ID NO: 2718871 - protein, 35 aa, Entamoeba histolytica; identical to SEQ ID NO: 2531357

SEQ ID NO: 2718872 - protein, 23 aa, Entamoeba histolytica
LDNGDIYWWLKSIGFEDSIFDFV

SEQ ID NO: 2718873 - protein, 17 aa, Entamoeba histolytica
LDNIILQSISLLMNIPT

SEQ ID NO: 2718874 - protein, 33 aa, Entamoeba histolytica
LDNNQITNLCPFGIFLQLRYLSIKNNLIEDLDN

SEQ ID NO: 2718875 - protein, 24 aa, Entamoeba histolytica
LDNTGLFYDIPPQSPQIVKLENIV

SEQ ID NO: 2718876 - protein, 25 aa, Entamoeba histolytica
LDNYKELLFSLYKFISYGKEITQMI

SEQ ID NO: 2718877 - protein, 28 aa, Entamoeba histolytica
LDPERYITGIGFFINMTLLALDQEDLTK

SEQ ID NO: 2718878 - protein, 19 aa, Entamoeba histolytica
LDPKDFPDIPPFDPVTTEA

SEQ ID NO: 2718879 - protein, 17 aa, Entamoeba histolytica
LDPLFGDVIIKQHEVQK

SEQ ID NO: 2718880 - protein, 25 aa, Entamoeba histolytica
LDPVMYVLSQMIHWSITPIKLNPRT

SEQ ID NO: 2718881 - protein, 23 aa, Entamoeba histolytica
LDQCFYKVVEAIKSYLNFVYPNG

SEQ ID NO: 2718882 - protein, 20 aa, Entamoeba histolytica
LDQFFLPKQKKEPTTTSSVD

SEQ ID NO: 2718883 - protein, 26 aa, Entamoeba histolytica
LDQFGPFVTYLLLPYGTGNDLSLSLG

SEQ ID NO: 2718884 - protein, 19 aa, Entamoeba histolytica
LDQLILSCYSLFDDPKVYL

SEQ ID NO: 2718885 - protein, 33 aa, Entamoeba histolytica
LDQNDLLEKGLLKLLFIRLKTQIIYYLVNNISS

SEQ ID NO: 2718886 - protein, 19 aa, Entamoeba histolytica
LDQTETILIQLEASKRNYD

SEQ ID NO: 2718887 - protein, 24 aa, Entamoeba histolytica
LDQTYLPEKLINTKLVFYDRFVKP

SEQ ID NO: 2718888 - protein, 26 aa, Entamoeba histolytica
LDRMVKPLQLWMRQMSKKKWEFEASP

SEQ ID NO: 2718889 - protein, 21 aa, Entamoeba histolytica
LDRSIDGYTPLYISKSIYSLF

SEQ ID NO: 2718890 - protein, 21 aa, Entamoeba histolytica
LDSFICSFATYDKLDYIPLYF

SEQ ID NO: 2718891 - protein, 18 aa, Entamoeba histolytica
LDSFQIQSIFVLTTHLAN

SEQ ID NO: 2718892 - protein, 22 aa, Entamoeba histolytica
LDSKNIVLSLPPLINGNHSKIT

SEQ ID NO: 2718893 - protein, 26 aa, Entamoeba histolytica
LDSKSDELLLNQMQLDEYIKVNDELN

SEQ ID NO: 2718894 - protein, 26 aa, Entamoeba histolytica
LDSLDYSVFILFNQYLLLSPVELIAS

SEQ ID NO: 2718895 - protein, 30 aa, Entamoeba histolytica
LDSLLELFRIILMYRYSFYKESVKDIFLLI

SEQ ID NO: 2718896 - protein, 26 aa, Entamoeba histolytica
LDSYKKLVILKLPQLTLHSLNLTNCQ

SEQ ID NO: 2718897 - protein, 24 aa, Entamoeba histolytica
LDSYQKYVIAISSNYLFYLDTNED

SEQ ID NO: 2718898 - protein, 21 aa, Entamoeba histolytica
LDTDLLFNFLSQVEGRKIFTQ

SEQ ID NO: 2718899 - protein, 25 aa, Entamoeba histolytica
LDTFNYPHTVLNFGIGMKDFEKIEI

SEQ ID NO: 2718900 - protein, 26 aa, Entamoeba histolytica
LDTPRKVFLYNELVATLLIPDDEIFY

SEQ ID NO: 2718901 - protein, 25 aa, Entamoeba histolytica
LDVDGKLWSLYFKIKLLTSDQPTKA

SEQ ID NO: 2718902 - protein, 33 aa, Entamoeba histolytica
LDVIVPSYHMFFVEVLPIPPSRFRQLNKFGDLI

SEQ ID NO: 2718903 - protein, 17 aa, Entamoeba histolytica
LDVKPIKLPNRLNLTVV

SEQ ID NO: 2718904 - protein, 17 aa, Entamoeba histolytica
LDVLIDSELWDLRMLKL

SEQ ID NO: 2718905 - protein, 28 aa, Entamoeba histolytica
LDVMSIHSLTFFLYELQPFNSSLTTMKS

SEQ ID NO: 2718906 - protein, 19 aa, Entamoeba histolytica
LDVQVLLELGCKYIAEMIK

SEQ ID NO: 2718907 - protein, 25 aa, Entamoeba histolytica
LDVSSLIGICFLNIPLYGGGAHPWG

SEQ ID NO: 2718908 - protein, 17 aa, Entamoeba histolytica
LDVTILEKKGEEFKFRA

SEQ ID NO: 2718909 - protein, 23 aa, Entamoeba histolytica
LDYCRMLNGLLPTDIRCLGWCGV

SEQ ID NO: 2718910 - protein, 19 aa, Entamoeba histolytica
LDYGIYRRKIINDSFYHAG

SEQ ID NO: 2718911 - protein, 31 aa, Entamoeba histolytica
LDYISMTTLTCLFLDFIILAQPNQITTYVFL

SEQ ID NO: 2718912 - protein, 18 aa, Entamoeba histolytica
LDYLLRYIDDWCLRDGIF

SEQ ID NO: 2718913 - protein, 29 aa, Entamoeba histolytica
LDYLTVRICLWVLYQLLCKIKTIIEMEMI

SEQ ID NO: 2718914 - protein, 34 aa, Entamoeba histolytica; identical to SEQ ID NO: 2531383

SEQ ID NO: 2718915 - protein, 22 aa, Entamoeba histolytica
LEAFEELQDFRKKYKCKSYCEV

SEQ ID NO: 2718916 - protein, 18 aa, Entamoeba histolytica
LEAILKTNLGPKGTLKML

SEQ ID NO: 2718917 - protein, 22 aa, Entamoeba histolytica
LECEDYLRVLLLSNKVNRTTIQ

SEQ ID NO: 2718918 - protein, 17 aa, Entamoeba histolytica
LECGKLAHQEGMKNVFV

SEQ ID NO: 2718919 - protein, 27 aa, Entamoeba histolytica
LECNKKILLFDTIQFKSLGYKNNISYN

SEQ ID NO: 2718920 - protein, 18 aa, Entamoeba histolytica
LECRLDVNNRNRIIRRFV

SEQ ID NO: 2718921 - protein, 20 aa, Entamoeba histolytica
LEDCCFLFCLGLEEIHLPTS

SEQ ID NO: 2718922 - protein, 20 aa, Entamoeba histolytica
LEDDIFLPTLKKRVVDIKVE

SEQ ID NO: 2718923 - protein, 17 aa, Entamoeba histolytica
LEDELLIIGWSKERVKG

SEQ ID NO: 2718924 - protein, 17 aa, Entamoeba histolytica
LEDFNPRTPNRPNKKEL

SEQ ID NO: 2718925 - protein, 21 aa, Entamoeba histolytica
LEDIIDINDPEQLGNKLAIIQ

SEQ ID NO: 2718926 - protein, 23 aa, Entamoeba histolytica
LEDKLFYYIPFDKVMPMVTSRRY

SEQ ID NO: 2718927 - protein, 26 aa, Entamoeba histolytica
LEDKRLLEILQIPRTIELLKIVQEEG

SEQ ID NO: 2718928 - protein, 22 aa, Entamoeba histolytica
LEDLFERCGVVLKVNIPINQFT

SEQ ID NO: 2718929 - protein, 24 aa, Entamoeba histolytica
LEDLGNLKWIVVGKLFGLRTIVNK

SEQ ID NO: 2718930 - protein, 27 aa, Entamoeba histolytica
LEDQPLSFYKSFKLVISGLDNLGARRW

SEQ ID NO: 2718931 - protein, 22 aa, Entamoeba histolytica
LEDVTIKLIRVGPLTLEDTRSL

SEQ ID NO: 2718932 - protein, 25 aa, Entamoeba histolytica
LEEAYKAHLIAIDSAAPTLKSYLDK

SEQ ID NO: 2718933 - protein, 26 aa, Entamoeba histolytica
LEEDYSKLMFLLTDKTIEFHNKGGIQ

SEQ ID NO: 2718934 - protein, 27 aa, Entamoeba histolytica
LEEFIMKFPGLLPDIYIKHFLGDIALG

SEQ ID NO: 2718935 - protein, 24 aa, Entamoeba histolytica
LEEHMIINPPQRIIEWVHSIQQTI

SEQ ID NO: 2718936 - protein, 19 aa, Entamoeba histolytica
LEEILKHKVIFLNDCVGEE

SEQ ID NO: 2718937 - protein, 31 aa, Entamoeba histolytica
LEEINVPAPYWIVGKHLFFNKMKLVGCELPS

SEQ ID NO: 2718938 - protein, 23 aa, Entamoeba histolytica
LEEIYRFKSLAPLIDLKVAPATS

SEQ ID NO: 2718939 - protein, 25 aa, Entamoeba histolytica
LEEKYRYLVNYFNKYVNFIKVTRKV

SEQ ID NO: 2718940 - protein, 21 aa, Entamoeba histolytica
LEEMQLNVIVWKKSNKTSVNP

SEQ ID NO: 2718941 - protein, 24 aa, Entamoeba histolytica
LEENRFIVTIKSNHLPMILKSNIE

SEQ ID NO: 2718942 - protein, 20 aa, Entamoeba histolytica
LEEQQLYAYTNFINYIINEE

SEQ ID NO: 2718943 - protein, 32 aa, Entamoeba histolytica
LEEQQLYAYTNFINYTLIEEPFVSNILTDLKD

SEQ ID NO: 2718944 - protein, 18 aa, Entamoeba histolytica
LEERALSSIGFILSILSI

SEQ ID NO: 2718945 - protein, 34 aa, Entamoeba histolytica
LEESSFSILFPKYRESYLKGMWYVINKALDEVCL

SEQ ID NO: 2718946 - protein, 29 aa, Entamoeba histolytica
LEESVKFLLQILSALKYIHKWQICHRDVK

SEQ ID NO: 2718947 - protein, 17 aa, Entamoeba histolytica
LEFIQQIRFNKFISHSC

SEQ ID NO: 2718948 - protein, 19 aa, Entamoeba histolytica
LEFMGSRYEAMEKMKVGVN

SEQ ID NO: 2718949 - protein, 19 aa, Entamoeba histolytica
LEFQAITRLFGPINQLDKF

SEQ ID NO: 2718950 - protein, 25 aa, Entamoeba histolytica
LEGHNWLVFNWCRGKGCILADEMGL

SEQ ID NO: 2718951 - protein, 37 aa, Entamoeba histolytica
LEGLKKLMVVVFPIYYEPFGCYINHPFKKEGWNGDIH

SEQ ID NO: 2718952 - protein, 24 aa, Entamoeba histolytica
LEGRLVPTLCCCPIEIIQQLKLLF

SEQ ID NO: 2718953 - protein, 24 aa, Entamoeba histolytica
LEGRSRFARLGLFVHITASFMNPG

SEQ ID NO: 2718954 - protein, 24 aa, Entamoeba histolytica
LEGYDTNFVLFLSNEFLLQAQKDY

SEQ ID NO: 2718955 - protein, 19 aa, Entamoeba histolytica
LEGYFPGFNEYRELVSCSN

SEQ ID NO: 2718956 - protein, 25 aa, Entamoeba histolytica
LEHEYEYCYYLRYTTTTPKVIIIVT

SEQ ID NO: 2718957 - protein, 19 aa, Entamoeba histolytica
LEHIVLPEKLQYLYEECFS

SEQ ID NO: 2718958 - protein, 18 aa, Entamoeba histolytica
LEHQEFIEIQKLKNDKKS

SEQ ID NO: 2718959 - protein, 30 aa, Entamoeba histolytica
LEHRMNAALVVALPLIRKTVFPSLKNQTQK

SEQ ID NO: 2718960 - protein, 17 aa, Entamoeba histolytica
LEIAEFPLLFGVSLIDG

SEQ ID NO: 2718961 - protein, 18 aa, Entamoeba histolytica
LEIIKLLEQCGHSNDTVC

SEQ ID NO: 2718962 - protein, 17 aa, Entamoeba histolytica
LEIIKLLEQCGHSNNTV

SEQ ID NO: 2718963 - protein, 17 aa, Entamoeba histolytica
LEIKLIKPNYSQVFKSS

SEQ ID NO: 2718964 - protein, 21 aa, Entamoeba histolytica
LEIKPSTESLPFFSSVKQWFQ

SEQ ID NO: 2718965 - protein, 18 aa, Entamoeba histolytica
LEILQSFEKLSLSIFFRI

SEQ ID NO: 2718966 - protein, 19 aa, Entamoeba histolytica
LEILTYLIVQCQPPMLYSN

SEQ ID NO: 2718967 - protein, 27 aa, Entamoeba histolytica
LEITTKQPWHLPNTLQCRLKELKVWNM

SEQ ID NO: 2718968 - protein, 21 aa, Entamoeba histolytica
LEIWIPVYVINNSIIPIMWNE

SEQ ID NO: 2718969 - protein, 26 aa, Entamoeba histolytica
LEIYDVVRYLVYWGKAKVIEAVFLDD

SEQ ID NO: 2718970 - protein, 21 aa, Entamoeba histolytica
LEIYELVQPLYRKAYGNDGVH

SEQ ID NO: 2718971 - protein, 18 aa, Entamoeba histolytica
LEIYKMKGMFRTICLFGS

SEQ ID NO: 2718972 - protein, 25 aa, Entamoeba histolytica
LEKAYDYFHKLPEPKVIREGMSQQE

SEQ ID NO: 2718973 - protein, 34 aa, Entamoeba histolytica
LEKDVLFQVFRGAIFMQIPMLIESCARCIAKHLV

SEQ ID NO: 2718974 - protein, 18 aa, Entamoeba histolytica
LEKGEWITVISTDGEWWE

SEQ ID NO: 2718975 - protein, 24 aa, Entamoeba histolytica
LEKGKNCFFEIVKSYRKMIRTIKQ

SEQ ID NO: 2718976 - protein, 21 aa, Entamoeba histolytica
LEKHDLDVSVKFKPKKMRGST

SEQ ID NO: 2718977 - protein, 19 aa, Entamoeba histolytica
LEKKQIDYAAKDAWIGVCV

SEQ ID NO: 2718978 - protein, 27 aa, Entamoeba histolytica
LEKKREPFMCPALYLISPTKESVDTII

SEQ ID NO: 2718979 - protein, 17 aa, Entamoeba histolytica
LEKLENIWQMKPLVNGE

SEQ ID NO: 2718980 - protein, 18 aa, Entamoeba histolytica
LEKMLIKKDMRGIGNRMK

SEQ ID NO: 2718981 - protein, 19 aa, Entamoeba histolytica
LEKMRAFVNLGFDEEKLKK

SEQ ID NO: 2718982 - protein, 25 aa, Entamoeba histolytica
LEKMRQERLIYLLNQTELNEEKKKI

SEQ ID NO: 2718983 - protein, 26 aa, Entamoeba histolytica
LEKSYFVIEIKKFFISPIRLLKKDEI

SEQ ID NO: 2718984 - protein, 17 aa, Entamoeba histolytica
LEKTDIIEWLKKQLKEI

SEQ ID NO: 2718985 - protein, 18 aa, Entamoeba histolytica
LEKTGVVPYIKSGSHFIA

SEQ ID NO: 2718986 - protein, 18 aa, Entamoeba histolytica
LEKTYYPMKGREIQPDED

SEQ ID NO: 2718987 - protein, 18 aa, Entamoeba histolytica
LEKVFVHFNLMSEKVLKN

SEQ ID NO: 2718988 - protein, 24 aa, Entamoeba histolytica
LEKVQMLLPYIFSSIKQKTFDKIM

SEQ ID NO: 2718989 - protein, 19 aa, Entamoeba histolytica
LELFRGETILLKGKRRKET

SEQ ID NO: 2718990 - protein, 26 aa, Entamoeba histolytica
LELKRVMSLLTKLNKLWDLEDYHSVK

SEQ ID NO: 2718991 - protein, 18 aa, Entamoeba histolytica
LELNIRSQLKYGLQNSFD

SEQ ID NO: 2718992 - protein, 17 aa, Entamoeba histolytica
LELRLSIYGRSLDEWEK

SEQ ID NO: 2718993 - protein, 28 aa, Entamoeba histolytica
LELSSYQGIFVLLKNFCIYAKSNSKIIE

SEQ ID NO: 2718994 - protein, 24 aa, Entamoeba histolytica
LELYSTNILPRFLEQVLLSRDKVT

SEQ ID NO: 2718995 - protein, 26 aa, Entamoeba histolytica
LEMETKSLITHYKFGVIYVKPDQTEE

SEQ ID NO: 2718996 - protein, 18 aa, Entamoeba histolytica
LEMFVYLNNVDPVKYAPH

SEQ ID NO: 2718997 - protein, 20 aa, Entamoeba histolytica
LEMKIHAFDYYRAEKKFKDL

SEQ ID NO: 2718998 - protein, 18 aa, Entamoeba histolytica
LEMKSRALLQFYLEIKPL

SEQ ID NO: 2718999 - protein, 18 aa, Entamoeba histolytica
LEMYYCLCFMDYAVKRNS

SEQ ID NO: 2719000 - protein, 29 aa, Entamoeba histolytica
LENFDRIYNYITKPYLFGYSNLDKTRTMY

SEQ ID NO: 2719001 - protein, 37 aa, Entamoeba histolytica
LENHNRIISLMKWYKIKKMTFLKNWKVAFKIRDDEYF

SEQ ID NO: 2719002 - protein, 24 aa, Entamoeba histolytica
LENKVMALLRFELSKAKNAVCEMV

SEQ ID NO: 2719003 - protein, 17 aa, Entamoeba histolytica
LENLKKLFPTKVIHFIE

SEQ ID NO: 2719004 - protein, 27 aa, Entamoeba histolytica
LENLQEVFLQLIIKEIPLSSWKEYLIN

SEQ ID NO: 2719005 - protein, 30 aa, Entamoeba histolytica
LENNVKDLHKLYLMLVEKANIQLQVLNERK

SEQ ID NO: 2719006 - protein, 19 aa, Entamoeba histolytica
LENPTLEQLFPFLGDQDPS

SEQ ID NO: 2719007 - protein, 28 aa, Entamoeba histolytica
LENQNTLWYIFSFLRRVLEQQDINKMSI

SEQ ID NO: 2719008 - protein, 28 aa, Entamoeba histolytica
LENRGWHYLIRKLIKQAHPQELVSNISD

SEQ ID NO: 2719009 - protein, 28 aa, Entamoeba histolytica
LENRNLHHLLFSIIKTRLLEIDDVYDDD

SEQ ID NO: 2719010 - protein, 18 aa, Entamoeba histolytica
LENVGFKNFLKKVKPSLY

SEQ ID NO: 2719011 - protein, 36 aa, Entamoeba histolytica
LEPDNFIILELQFTETFVFLINLNPPLTLKQILDVI

SEQ ID NO: 2719012 - protein, 20 aa, Entamoeba histolytica
LEPILPIPRCTTYVGDITTG

SEQ ID NO: 2719013 - protein, 19 aa, Entamoeba histolytica
LEPKDIFDDGKGFEREKLD

SEQ ID NO: 2719014 - protein, 33 aa, Entamoeba histolytica
LEPVGKSYLLLMERLFRLLKMIDKNSGVNKMTA

SEQ ID NO: 2719015 - protein, 26 aa, Entamoeba histolytica
LEQKIEEEFLLFSGPLIVSDEDSLVA

SEQ ID NO: 2719016 - protein, 32 aa, Entamoeba histolytica
LEQQEYILILLEYFQIIFVLRKSFFERIGLAD

SEQ ID NO: 2719017 - protein, 23 aa, Entamoeba histolytica
LEQQYYLSIISILQQQKLIIQSL

SEQ ID NO: 2719018 - protein, 29 aa, Entamoeba histolytica
LERATSLLPMVYKLWFKYVRLEETVENFD

SEQ ID NO: 2719019 - protein, 20 aa, Entamoeba histolytica
LERFSYIPIRRIKSCFDYLK

SEQ ID NO: 2719020 - protein, 26 aa, Entamoeba histolytica
LERHKPSLLFSTPRVFEKLNKIVKQK

SEQ ID NO: 2719021 - protein, 18 aa, Entamoeba histolytica
LERMFEQYGNLIDKITSD

SEQ ID NO: 2719022 - protein, 33 aa, Entamoeba histolytica
LERNQTILEYKLLLGFIPLFSSLNTIQNLLEQI

SEQ ID NO: 2719023 - protein, 24 aa, Entamoeba histolytica
LERNVNFYIIKYFNNQYKEEIMKD

SEQ ID NO: 2719024 - protein, 19 aa, Entamoeba histolytica
LERPKWPIYPVDGGVCILS

SEQ ID NO: 2719025 - protein, 28 aa, Entamoeba histolytica
LERSMGVPSFFRWLSQKFPKIIDGCQGS

SEQ ID NO: 2719026 - protein, 19 aa, Entamoeba histolytica
LESFKAVILMLHKENIDDP

SEQ ID NO: 2719027 - protein, 27 aa, Entamoeba histolytica
LESFQQAVLIYLLSRAGVTVEIKKQKK

SEQ ID NO: 2719028 - protein, 20 aa, Entamoeba histolytica
LESGLIYELFNYLDYPFNEQ

SEQ ID NO: 2719029 - protein, 19 aa, Entamoeba histolytica
LESIKKLLKHQSGSYYFVH

SEQ ID NO: 2719030 - protein, 32 aa, Entamoeba histolytica; identical to SEQ ID NO: 2531512

SEQ ID NO: 2719031 - protein, 26 aa, Entamoeba histolytica
LESLGHHIFPIFYSLGINDKYETIIK

SEQ ID NO: 2719032 - protein, 17 aa, Entamoeba histolytica
LESLYQYGNNMEQILLN

SEQ ID NO: 2719033 - protein, 25 aa, Entamoeba histolytica
LESPRVPIISIFLKDVISFKEMESF

SEQ ID NO: 2719034 - protein, 20 aa, Entamoeba histolytica
LESSQPLLSSFRRAYEESVI

SEQ ID NO: 2719035 - protein, 27 aa, Entamoeba histolytica
LESVKPIVLFWGLRICGLMLCSTAEEN

SEQ ID NO: 2719036 - protein, 17 aa, Entamoeba histolytica
LETEKLYVLRLLPIFSM

SEQ ID NO: 2719037 - protein, 25 aa, Entamoeba histolytica
LETKEKYMLVEYQSKLQELQEWCEN

SEQ ID NO: 2719038 - protein, 17 aa, Entamoeba histolytica
LETLYQKLIKKGLSKCD

SEQ ID NO: 2719039 - protein, 24 aa, Entamoeba histolytica
LETQNLIHFIRFAVKTKTLNEFLI

SEQ ID NO: 2719040 - protein, 28 aa, Entamoeba histolytica
LETRDFVYIIMEFISGGNLLRGVRLANE

SEQ ID NO: 2719041 - protein, 24 aa, Entamoeba histolytica
LETYEFELIRELPFTLGSCTFKPI

SEQ ID NO: 2719042 - protein, 22 aa, Entamoeba histolytica
LEVDYLFNEWPLECLASVLSVV

SEQ ID NO: 2719043 - protein, 28 aa, Entamoeba histolytica
LEVIDSKMVGILIRRSFHNTGVDIVRIE

SEQ ID NO: 2719044 - protein, 27 aa, Entamoeba histolytica
LEVIDSKTVGILIRRSFHNTGVDIVRI

SEQ ID NO: 2719045 - protein, 28 aa, Entamoeba histolytica
LEVKQLKYLFSLPNEYIFSGFKVSTMDI

SEQ ID NO: 2719046 - protein, 19 aa, Entamoeba histolytica
LEVSGIRDQLFRVLEKEPD

SEQ ID NO: 2719047 - protein, 21 aa, Entamoeba histolytica
LEWLVKKGLAWKEDLVYCEEN

SEQ ID NO: 2719048 - protein, 20 aa, Entamoeba histolytica
LEYCIKYPLKILQIDQQHMP

SEQ ID NO: 2719049 - protein, 31 aa, Entamoeba histolytica
LEYENDICILKKGIKWFIQLYGNLINSNINI

SEQ ID NO: 2719050 - protein, 20 aa, Entamoeba histolytica
LEYFLLIFHGDFTKTTEYIE

SEQ ID NO: 2719051 - protein, 25 aa, Entamoeba histolytica
LEYKIQLMKLWKLKIGIGSEDCVRD

SEQ ID NO: 2719052 - protein, 26 aa, Entamoeba histolytica
LFAFCVALLSQYFKIEIGLPHTHSTK

SEQ ID NO: 2719053 - protein, 18 aa, Entamoeba histolytica
LFALIRKCNEYLSSTSST

SEQ ID NO: 2719054 - protein, 19 aa, Entamoeba histolytica
LFCATIFREFKNPDGKYYT

SEQ ID NO: 2719055 - protein, 27 aa, Entamoeba histolytica
LFCICPTIVLSLLYENGFKTLKLQDDF

SEQ ID NO: 2719056 - protein, 22 aa, Entamoeba histolytica
LFCKEFLDIDLLLKHMNEKHHI

SEQ ID NO: 2719057 - protein, 18 aa, Entamoeba histolytica
LFCLGGPGAGKGTQCQKI

SEQ ID NO: 2719058 - protein, 18 aa, Entamoeba histolytica
LFCNSVPEPLFTYTSHSL

SEQ ID NO: 2719059 - protein, 22 aa, Entamoeba histolytica
LFDAYGLIVIGRLPAPIVSDHL

SEQ ID NO: 2719060 - protein, 26 aa, Entamoeba histolytica
LFDCASAYFPILYPPKGDEALRIDLT

SEQ ID NO: 2719061 - protein, 19 aa, Entamoeba histolytica
LFDFMNIYFNGKYVISIDT

SEQ ID NO: 2719062 - protein, 17 aa, Entamoeba histolytica
LFDFYNPVFSTGSIVSE

SEQ ID NO: 2719063 - protein, 18 aa, Entamoeba histolytica
LFDHIRMHSICDGIYLLI

SEQ ID NO: 2719064 - protein, 18 aa, Entamoeba histolytica
LFDIQWGMRSNTAAVREP

SEQ ID NO: 2719065 - protein, 28 aa, Entamoeba histolytica
LFDNILAGKFEFRSPFWDNKSLELKDLI

SEQ ID NO: 2719066 - protein, 26 aa, Entamoeba histolytica
LFDPQYKIILRDFFAGLFNPEAPIFK

SEQ ID NO: 2719067 - protein, 26 aa, Entamoeba histolytica
LFDYSIFNILQIQPFLELIYCIDQIG

SEQ ID NO: 2719068 - protein, 23 aa, Entamoeba histolytica
LFEADPTIPVSCTLYINNLDQSI

SEQ ID NO: 2719069 - protein, 41 aa, Entamoeba histolytica
LFEAESYIILYHYKIWAKDMYLLYFWQGRSCAVIDKGTSAR

SEQ ID NO: 2719070 - protein, 18 aa, Entamoeba histolytica
LFECLMKQLGFVYEIKRE

SEQ ID NO: 2719071 - protein, 18 aa, Entamoeba histolytica
LFEETLKIAKKLFIHGKP

SEQ ID NO: 2719072 - protein, 18 aa, Entamoeba histolytica
LFEIKFKFGSMVICSPPI

SEQ ID NO: 2719073 - protein, 19 aa, Entamoeba histolytica
LFEKYYPKQLAENWDNTGI

SEQ ID NO: 2719074 - protein, 19 aa, Entamoeba histolytica
LFEMGYYGCVKKTDYLTFP

SEQ ID NO: 2719075 - protein, 25 aa, Entamoeba histolytica
LFESFRLRWKGNFIILHSISSLINI

SEQ ID NO: 2719076 - protein, 18 aa, Entamoeba histolytica
LFFEYNKVFFELMSTTFI

SEQ ID NO: 2719077 - protein, 21 aa, Entamoeba histolytica
LFFQNFLKKVLELLTTSTVSL

SEQ ID NO: 2719078 - protein, 17 aa, Entamoeba histolytica
LFFTPNDELKEVNCAII

SEQ ID NO: 2719079 - protein, 20 aa, Entamoeba histolytica
LFFYGLSNWSDIGTVISEFN

SEQ ID NO: 2719080 - protein, 19 aa, Entamoeba histolytica
LFGDIVLNGLLLPNSVKRL

SEQ ID NO: 2719081 - protein, 18 aa, Entamoeba histolytica
LFGISFPCFSKRITNTIF

SEQ ID NO: 2719082 - protein, 27 aa, Entamoeba histolytica
LFGSKQTIFYYHFLGELIFTNKDEVVP

SEQ ID NO: 2719083 - protein, 19 aa, Entamoeba histolytica
LFGVYYHSQLIPSGSIFGI

SEQ ID NO: 2719084 - protein, 17 aa, Entamoeba histolytica
LFGYEHGCGPALQYATV

SEQ ID NO: 2719085 - protein, 19 aa, Entamoeba histolytica
LFHFFSKKEISYEDKFILF

SEQ ID NO: 2719086 - protein, 25 aa, Entamoeba histolytica
LFHIDFGHFLGNIIKLGFYNKESAP

SEQ ID NO: 2719087 - protein, 23 aa, Entamoeba histolytica
LFHSSFPIFYDLAFCKLRRTLYA

SEQ ID NO: 2719088 - protein, 19 aa, Entamoeba histolytica
LFHYAIDHQLSLSLSLSGN

SEQ ID NO: 2719089 - protein, 17 aa, Entamoeba histolytica
LFIERRYLTNSNGGGFA

SEQ ID NO: 2719090 - protein, 23 aa, Entamoeba histolytica
LFIGKSLFFQTIALQLYSSASLN

SEQ ID NO: 2719091 - protein, 17 aa, Entamoeba histolytica
LFILCKQADEIVVESVW

SEQ ID NO: 2719092 - protein, 18 aa, Entamoeba histolytica
LFIWLPESKQKTLFISTK

SEQ ID NO: 2719093 - protein, 24 aa, Entamoeba histolytica
LFKHTYGLPICNIVAGKNADIHRV

SEQ ID NO: 2719094 - protein, 20 aa, Entamoeba histolytica
LFKILIIGESGVGKTAIMQR

SEQ ID NO: 2719095 - protein, 19 aa, Entamoeba histolytica
LFKILIVGDSGVGKTAILQ

SEQ ID NO: 2719096 - protein, 18 aa, Entamoeba histolytica
LFKKYQHALSFLAEIKFI

SEQ ID NO: 2719097 - protein, 23 aa, Entamoeba histolytica
LFKSFVRELPSPVIPLNCYDKFV

SEQ ID NO: 2719098 - protein, 19 aa, Entamoeba histolytica
LFLGVSLPLIRKETKVFLN

SEQ ID NO: 2719099 - protein, 20 aa, Entamoeba histolytica
LFLNHGIIKKKTGVYGGIVS

SEQ ID NO: 2719100 - protein, 18 aa, Entamoeba histolytica
LFLSLDLNNTLSISSQPF

SEQ ID NO: 2719101 - protein, 17 aa, Entamoeba histolytica
LFLYGTHYSTPAYVVFF

SEQ ID NO: 2719102 - protein, 18 aa, Entamoeba histolytica
LFMKKYYNATRLKKLCDA

SEQ ID NO: 2719103 - protein, 24 aa, Entamoeba histolytica
LFMKSNVVLLPFCPYNFQVSSKMT

SEQ ID NO: 2719104 - protein, 26 aa, Entamoeba histolytica
LFNEMSEWLWGIYNKNFLKCGKIGNN

SEQ ID NO: 2719105 - protein, 20 aa, Entamoeba histolytica
LFNFIIVYLSKQFDIYQLLT

SEQ ID NO: 2719106 - protein, 18 aa, Entamoeba histolytica
LFNMIGHFQMMIGSETCR

SEQ ID NO: 2719107 - protein, 34 aa, Entamoeba histolytica
LFNNDGYFSIFFYVFALKYIPKFFQSIIHLLYDQ

SEQ ID NO: 2719108 - protein, 22 aa, Entamoeba histolytica
LFNNIYSMRTFTKCGGFTGVYE

SEQ ID NO: 2719109 - protein, 28 aa, Entamoeba histolytica
LFNQIQLLYGANWKYEHPLEIRCVGVSG

SEQ ID NO: 2719110 - protein, 30 aa, Entamoeba histolytica; identical to SEQ ID NO: 2531595

SEQ ID NO: 2719111 - protein, 17 aa, Entamoeba histolytica
LFPKVTPLLPITSKKIK

SEQ ID NO: 2719112 - protein, 18 aa, Entamoeba histolytica
LFPQIKTQYLFNKNDKRI

SEQ ID NO: 2719113 - protein, 17 aa, Entamoeba histolytica
LFQFFKSKKDSETEQNL

SEQ ID NO: 2719114 - protein, 19 aa, Entamoeba histolytica
LFQFFKSKKDSETEQNLVV

SEQ ID NO: 2719115 - protein, 17 aa, Entamoeba histolytica
LFQGDLYIASPVNLKVL

SEQ ID NO: 2719116 - protein, 17 aa, Entamoeba histolytica
LFQQTLCHILQTKPSSI

SEQ ID NO: 2719117 - protein, 17 aa, Entamoeba histolytica
LFRATFFPTWEGLFWEK

SEQ ID NO: 2719118 - protein, 31 aa, Entamoeba histolytica; identical to SEQ ID NO: 2531611

SEQ ID NO: 2719119 - protein, 20 aa, Entamoeba histolytica
LFRIRAKPENLRRHLKCCKY

SEQ ID NO: 2719120 - protein, 19 aa, Entamoeba histolytica
LFRKFLREAAIKNPKNALP

SEQ ID NO: 2719121 - protein, 17 aa, Entamoeba histolytica
LFRVLEKEPDEHICMVL

SEQ ID NO: 2719122 - protein, 27 aa, Entamoeba histolytica
LFSVRPECLISLILFEVLLDNEAVLIK

SEQ ID NO: 2719123 - protein, 29 aa, Entamoeba histolytica
LFTDKRKPWTGILLFGPPGTGKSFLAKAV

SEQ ID NO: 2719124 - protein, 17 aa, Entamoeba histolytica
LFVALPPDQFNPYILPS

SEQ ID NO: 2719125 - protein, 24 aa, Entamoeba histolytica
LFVATEFCLYQFTVPLNYGKEDEP

SEQ ID NO: 2719126 - protein, 17 aa, Entamoeba histolytica
LFVNKLDYFIKITDFGL

SEQ ID NO: 2719127 - protein, 24 aa, Entamoeba histolytica
LFVRPLLGRTGILKDFNLIVGTDK

SEQ ID NO: 2719128 - protein, 17 aa, Entamoeba histolytica
LFVWTKTTKFSVLFDTN

SEQ ID NO: 2719129 - protein, 20 aa, Entamoeba histolytica
LFYELDLHDIEMVKKVFGEI

SEQ ID NO: 2719130 - protein, 17 aa, Entamoeba histolytica
LFYLTPSTKKRASNELR

SEQ ID NO: 2719131 - protein, 17 aa, Entamoeba histolytica
LFYYCISLKSIEIPSKI

SEQ ID NO: 2719132 - protein, 26 aa, Entamoeba histolytica
LGALRTTAPYTLYFAAGTNAASGKKN

SEQ ID NO: 2719133 - protein, 46 aa, Entamoeba histolytica
LGAQPGLGGLPPMGGLGGLPPMGGLGGLPPMGGLGGLPPLGVNAPQ

SEQ ID NO: 2719134 - protein, 26 aa, Entamoeba histolytica
LGAQWEEFISLFKYSTPEDLFDHLIQ

SEQ ID NO: 2719135 - protein, 21 aa, Entamoeba histolytica
LGAQYFVFHPVVRAAIGEHPC

SEQ ID NO: 2719136 - protein, 27 aa, Entamoeba histolytica
LGARCLCYSIIGYYKLLLKDNNGARDE

SEQ ID NO: 2719137 - protein, 19 aa, Entamoeba histolytica
LGCALDLLKRIDIDFKLNG

SEQ ID NO: 2719138 - protein, 29 aa, Entamoeba histolytica
LGCKVEFIIYLIKLILNNTQFKIAVLGDY

SEQ ID NO: 2719139 - protein, 21 aa, Entamoeba histolytica
LGCVYTQMILRTPPFKGHSVS

SEQ ID NO: 2719140 - protein, 25 aa, Entamoeba histolytica
LGDAKWKVEQLLNNQWKKLELEINK

SEQ ID NO: 2719141 - protein, 41 aa, Entamoeba histolytica
LGDAMQLKIDTINRQYLDLKSKYDQLKSDNLMVLSEKEDIE

SEQ ID NO: 2719142 - protein, 18 aa, Entamoeba histolytica
LGDISSLLPLLKQTLVEA

SEQ ID NO: 2719143 - protein, 23 aa, Entamoeba histolytica
LGDKELHPPLSFEPEIYSVNVKK

SEQ ID NO: 2719144 - protein, 24 aa, Entamoeba histolytica
LGDKITMQLLKIPNGFTIPSLVPG

SEQ ID NO: 2719145 - protein, 30 aa, Entamoeba histolytica; identical to SEQ ID NO: 2531643

SEQ ID NO: 2719146 - protein, 20 aa, Entamoeba histolytica
LGEFKLVGIPPAKKGVAKIE

SEQ ID NO: 2719147 - protein, 20 aa, Entamoeba histolytica
LGEIINGKPLFPGSSTLNQL

SEQ ID NO: 2719148 - protein, 24 aa, Entamoeba histolytica
LGEPYRRLIITPEDYPYHNLSRKI

SEQ ID NO: 2719149 - protein, 17 aa, Entamoeba histolytica
LGERYMRFDPVLPNNLD

SEQ ID NO: 2719150 - protein, 18 aa, Entamoeba histolytica
LGEYLVSFVLPQWKSCFE

SEQ ID NO: 2719151 - protein, 19 aa, Entamoeba histolytica
LGFILNKRLDELCKTILLL

SEQ ID NO: 2719152 - protein, 19 aa, Entamoeba histolytica
LGFMFHPLQINIGNPDLHA

SEQ ID NO: 2719153 - protein, 24 aa, Entamoeba histolytica
LGFNDIAFEIMKLQNFNYSTPDLN

SEQ ID NO: 2719154 - protein, 29 aa, Entamoeba histolytica
LGGESALKLWYYFYSLLSDINEHPKDDIY

SEQ ID NO: 2719155 - protein, 26 aa, Entamoeba histolytica
LGGHDLDLTVIDWLRLQDYRIQPKKG

SEQ ID NO: 2719156 - protein, 22 aa, Entamoeba histolytica
LGGHLSLVRQIGRSCKTGLFVG

SEQ ID NO: 2719157 - protein, 17 aa, Entamoeba histolytica
LGGLPLGIMRRTPEPWL

SEQ ID NO: 2719158 - protein, 25 aa, Entamoeba histolytica
LGGQSKIRPLWRHYYEGTQGIVFVV

SEQ ID NO: 2719159 - protein, 26 aa, Entamoeba histolytica
LGIANSVEFFDICRIKDALALAHKLD

SEQ ID NO: 2719160 - protein, 25 aa, Entamoeba histolytica
LGIICYLIPCYAGSIVSYINSHYDN

SEQ ID NO: 2719161 - protein, 23 aa, Entamoeba histolytica
LGIPSVIYWGLYGSYNVMVMDLL

SEQ ID NO: 2719162 - protein, 17 aa, Entamoeba histolytica
LGKDIHIELYKSKKEKA

SEQ ID NO: 2719163 - protein, 35 aa, Entamoeba histolytica
LGKFTSLREKVESGLILNVLIEILCKGDGREEHPI

SEQ ID NO: 2719164 - protein, 21 aa, Entamoeba histolytica
LGKGIILLDDAGLLEDEKHSI

SEQ ID NO: 2719165 - protein, 23 aa, Entamoeba histolytica
LGKLLVVTRWLGRNPVLHDIDTF

SEQ ID NO: 2719166 - protein, 23 aa, Entamoeba histolytica
LGKQILIRKCELDGFPSIINSLE

SEQ ID NO: 2719167 - protein, 32 aa, Entamoeba histolytica
LGKQYMMLNNYLSARIYFLLAASYTNYKNIEI

SEQ ID NO: 2719168 - protein, 28 aa, Entamoeba histolytica
LGKTLQTITLIWTVYKQCNIKKIVIVCP

SEQ ID NO: 2719169 - protein, 24 aa, Entamoeba histolytica
LGKTTLLLKVRCTCVPEGQCVFVG

SEQ ID NO: 2719170 - protein, 22 aa, Entamoeba histolytica
LGKVYIGILTGYDNFMNIVLKN

SEQ ID NO: 2719171 - protein, 31 aa, Entamoeba histolytica
LGKYLERFSSFLLNFIKLPTPNVLPYIIQTQ

SEQ ID NO: 2719172 - protein, 19 aa, Entamoeba histolytica
LGLASLTQLTFLRMFHYKK

SEQ ID NO: 2719173 - protein, 29 aa, Entamoeba histolytica
LGLINIYCPSILKPLYPNSLVPRKSVRSR

SEQ ID NO: 2719174 - protein, 17 aa, Entamoeba histolytica
LGLMRKELNKYKTLLLY

SEQ ID NO: 2719175 - protein, 25 aa, Entamoeba histolytica
LGLVSITFIDCKYLRILDGMAVLTT

SEQ ID NO: 2719176 - protein, 26 aa, Entamoeba histolytica
LGMSLIDIELPLTLFSELWEVFMNQN

SEQ ID NO: 2719177 - protein, 22 aa, Entamoeba histolytica
LGNDIWEMICRCWDIEPQKRPT

SEQ ID NO: 2719178 - protein, 24 aa, Entamoeba histolytica
LGNESCYLLYRSLLNQPTLPNDIR

SEQ ID NO: 2719179 - protein, 25 aa, Entamoeba histolytica
LGNETNILVIFITGAISYSEMRVAY

SEQ ID NO: 2719180 - protein, 18 aa, Entamoeba histolytica
LGNFILKSNVFKFSGSPD

SEQ ID NO: 2719181 - protein, 21 aa, Entamoeba histolytica
LGNIFGGYMKKPIQKTDSLII

SEQ ID NO: 2719182 - protein, 22 aa, Entamoeba histolytica
LGNKPWKELSVEQKQKFLTMEK

SEQ ID NO: 2719183 - protein, 17 aa, Entamoeba histolytica
LGNKTFLWNERFPEVPE

SEQ ID NO: 2719184 - protein, 28 aa, Entamoeba histolytica
LGNLLVEKFFFFLLETINRVKSFEYKKD

SEQ ID NO: 2719185 - protein, 25 aa, Entamoeba histolytica
LGPSFAERIQLEKAIFSYPNRLPGL

SEQ ID NO: 2719186 - protein, 17 aa, Entamoeba histolytica
LGRAVFWELKNRLPRSL

SEQ ID NO: 2719187 - protein, 20 aa, Entamoeba histolytica
LGREHPLFSELYQLVSISKN

SEQ ID NO: 2719188 - protein, 23 aa, Entamoeba histolytica
LGRKCILIFKDKTSPLQNPPFKA

SEQ ID NO: 2719189 - protein, 21 aa, Entamoeba histolytica
LGRPIHPLIYQILISSCKSKL

SEQ ID NO: 2719190 - protein, 23 aa, Entamoeba histolytica
LGRREIGFLAALLYSVTRETNQK

SEQ ID NO: 2719191 - protein, 27 aa, Entamoeba histolytica
LGRSGTFIILFRIYEHHFYSALKGRID

SEQ ID NO: 2719192 - protein, 26 aa, Entamoeba histolytica
LGSAELKLLLKWRDIIVKKIKKEQEE

SEQ ID NO: 2719193 - protein, 29 aa, Entamoeba histolytica
LGSQIPKFNSLLLKHLLALCGKIAQTSSS

SEQ ID NO: 2719194 - protein, 19 aa, Entamoeba histolytica
LGTIIILNQKQLSAIYGII

SEQ ID NO: 2719195 - protein, 18 aa, Entamoeba histolytica
LGTTFSCMAVWKESSKRV

SEQ ID NO: 2719196 - protein, 25 aa, Entamoeba histolytica
LGTVENFWLFISDNSYNQLFYFESF

SEQ ID NO: 2719197 - protein, 20 aa, Entamoeba histolytica
LGVCLYYLVSQRWPPIQNKD

SEQ ID NO: 2719198 - protein, 23 aa, Entamoeba histolytica
LGVERLVMWLLGEDHIRKVCLYP

SEQ ID NO: 2719199 - protein, 25 aa, Entamoeba histolytica
LGYLCNIFQVPLRPMQLQILSRKQA

SEQ ID NO: 2719200 - protein, 20 aa, Entamoeba histolytica
LHAIKSLNPINSPTITVSNW

SEQ ID NO: 2719201 - protein, 33 aa, Entamoeba histolytica
LHCIDEFIYSIPFFFHLKKLKIGYSTYFDFSTL

SEQ ID NO: 2719202 - protein, 21 aa, Entamoeba histolytica
LHCVHIFNMIERKLKTIGGYG

SEQ ID NO: 2719203 - protein, 20 aa, Entamoeba histolytica
LHDALCVLHIIRKDTKMICG

SEQ ID NO: 2719204 - protein, 17 aa, Entamoeba histolytica
LHDGLISNFEFQNYILD

SEQ ID NO: 2719205 - protein, 30 aa, Entamoeba histolytica
LHFEDENNFLLWIIKFLSNEFLSELLVLPP

SEQ ID NO: 2719206 - protein, 18 aa, Entamoeba histolytica
LHFFTIDSSWKEIDLGIC

SEQ ID NO: 2719207 - protein, 22 aa, Entamoeba histolytica
LHFGKFYDFFDHIARLIPSMKR

SEQ ID NO: 2719208 - protein, 17 aa, Entamoeba histolytica
LHFLTTCKFSKTYKQMI

SEQ ID NO: 2719209 - protein, 18 aa, Entamoeba histolytica
LHFNKRLIHRDLKPANLL

SEQ ID NO: 2719210 - protein, 18 aa, Entamoeba histolytica
LHFTITEPIVFQQDDFNE

SEQ ID NO: 2719211 - protein, 25 aa, Entamoeba histolytica
LHGNDFFWVHGYNKGVPKDVDLLKI

SEQ ID NO: 2719212 - protein, 19 aa, Entamoeba histolytica
LHHIYVKCYSLAQYQWSLI

SEQ ID NO: 2719213 - protein, 18 aa, Entamoeba histolytica
LHIQDSFFFLLQKSLEES

SEQ ID NO: 2719214 - protein, 19 aa, Entamoeba histolytica
LHITSTLRKVFLSLSLDDL

SEQ ID NO: 2719215 - protein, 17 aa, Entamoeba histolytica
LHKKQCMIFTPAGKPVF

SEQ ID NO: 2719216 - protein, 25 aa, Entamoeba histolytica
LHNANIIHLDIKPANILISDDCEVK

SEQ ID NO: 2719217 - protein, 17 aa, Entamoeba histolytica
LHNCELAKILFSNEETN

SEQ ID NO: 2719218 - protein, 25 aa, Entamoeba histolytica
LHNKQIIKYIIWYKVSYTYYMKHKS

SEQ ID NO: 2719219 - protein, 26 aa, Entamoeba histolytica
LHPFQNPFVFPMKSSSIISGDNAIKE

SEQ ID NO: 2719220 - protein, 34 aa, Entamoeba histolytica
LHPGIVDFFSYKDSVYLLLISSEFVRYTIKEDKI

SEQ ID NO: 2719221 - protein, 24 aa, Entamoeba histolytica
LHPKRFLLIKEYIKSLFINTALHS

SEQ ID NO: 2719222 - protein, 17 aa, Entamoeba histolytica
LHPTGMFLANCIVLGDT

SEQ ID NO: 2719223 - protein, 24 aa, Entamoeba histolytica
LHQLKEIIQYFYNKTDYEVFSMIN

SEQ ID NO: 2719224 - protein, 26 aa, Entamoeba histolytica
LHRDLKLANFLLKRSKEYPFPIVKLC

SEQ ID NO: 2719225 - protein, 20 aa, Entamoeba histolytica
LHRDLKLDNFLLKTPTQINQ

SEQ ID NO: 2719226 - protein, 25 aa, Entamoeba histolytica
LHRFNQILHVLKSIPKAVPSLICQF

SEQ ID NO: 2719227 - protein, 19 aa, Entamoeba histolytica
LHRLLADWPLLEPQTAIEM

SEQ ID NO: 2719228 - protein, 18 aa, Entamoeba histolytica
LHSIKIIHHDIKAGNILL

SEQ ID NO: 2719229 - protein, 28 aa, Entamoeba histolytica
LHSLGIKHILCVAPLIPSLFPNEFDYKN

SEQ ID NO: 2719230 - protein, 39 aa, Entamoeba histolytica
LHSLLFLTDELAKPSSLPFLKLVLSIPPLLSQQINQPPI

SEQ ID NO: 2719231 - protein, 34 aa, Entamoeba histolytica
LHSNNPCHKLDIPKYLMLPIPSNVLMESIIIPQD

SEQ ID NO: 2719232 - protein, 18 aa, Entamoeba histolytica
LHTFEILNAYKGDVESLI

SEQ ID NO: 2719233 - protein, 22 aa, Entamoeba histolytica
LHTNNRFIPGSMDPDLFKKVIG

SEQ ID NO: 2719234 - protein, 23 aa, Entamoeba histolytica
LHTPRFEMAQGNSPLFDENGHLN

SEQ ID NO: 2719235 - protein, 36 aa, Entamoeba histolytica
LHVIKSVLPLNINLLPQLTFLSLFECKTNELILPSS

SEQ ID NO: 2719236 - protein, 17 aa, Entamoeba histolytica
LHWIAASPPSSLKNSII

SEQ ID NO: 2719237 - protein, 27 aa, Entamoeba histolytica
LHYDFGAPMHCLLIPAPQVDDPELDHL

SEQ ID NO: 2719238 - protein, 22 aa, Entamoeba histolytica
LHYHKVFSFVFPGKRNELFAIG

SEQ ID NO: 2719239 - protein, 19 aa, Entamoeba histolytica
LHYNGIIMTDWYACKDTMK

SEQ ID NO: 2719240 - protein, 17 aa, Entamoeba histolytica
LIAKKPEEPLPSLKITS

SEQ ID NO: 2719241 - protein, 19 aa, Entamoeba histolytica
LICCIDLFTPSSLIKGKLS

SEQ ID NO: 2719242 - protein, 18 aa, Entamoeba histolytica
LICDGLPVGIPVASVPKL

SEQ ID NO: 2719243 - protein, 19 aa, Entamoeba histolytica
LICLDLYELINLKEKERTK

SEQ ID NO: 2719244 - protein, 18 aa, Entamoeba histolytica
LICLPSIIKNIHLIEIDI

SEQ ID NO: 2719245 - protein, 19 aa, Entamoeba histolytica
LICNDILLCSLKIGTIQYS

SEQ ID NO: 2719246 - protein, 19 aa, Entamoeba histolytica
LICPQFCLRFNDLDNIGIS

SEQ ID NO: 2719247 - protein, 32 aa, Entamoeba histolytica
LICPSLSLDQWYIIILCFLDFSLQDISKTTTV

SEQ ID NO: 2719248 - protein, 20 aa, Entamoeba histolytica
LIDARPLLPTLKFSEGVSEW

SEQ ID NO: 2719249 - protein, 26 aa, Entamoeba histolytica
LIDCNIILLLFTYLSKGTYKIFTQFL

SEQ ID NO: 2719250 - protein, 27 aa, Entamoeba histolytica
LIDGNKTYFPPFLDGKIHIAAGSASDQ

SEQ ID NO: 2719251 - protein, 19 aa, Entamoeba histolytica
LIDKLLLYQAIKHVEITYK

SEQ ID NO: 2719252 - protein, 19 aa, Entamoeba histolytica
LIDNLKKMRKMELPFTLIV

SEQ ID NO: 2719253 - protein, 24 aa, Entamoeba histolytica
LIDQTFIPMMILSVDIRSLINSKD

SEQ ID NO: 2719254 - protein, 23 aa, Entamoeba histolytica
LIDSNCCRLFKIPLFHSQLIVNE

SEQ ID NO: 2719255 - protein, 22 aa, Entamoeba histolytica
LIEDKFFYEPIKLHATITLIQQ

SEQ ID NO: 2719256 - protein, 46 aa, Entamoeba histolytica
LIEEKKRVLTAMKRLLAVLPAEERLAILRRLKIEYRFNSVKEMIQD

SEQ ID NO: 2719257 - protein, 23 aa, Entamoeba histolytica
LIEFAFYVIFHEGPAFSSAALSF

SEQ ID NO: 2719258 - protein, 18 aa, Entamoeba histolytica
LIEFLKVTVIDKLSELDV

SEQ ID NO: 2719259 - protein, 25 aa, Entamoeba histolytica
LIEHHPKLYKNLFIRLVKENTTIEY

SEQ ID NO: 2719260 - protein, 25 aa, Entamoeba histolytica
LIEIKLSFILLTLKNLNIKKVPKPY

SEQ ID NO: 2719261 - protein, 30 aa, Entamoeba histolytica
LIEIKLYCDNPFKLLYVANQLRSCGHIVKC

SEQ ID NO: 2719262 - protein, 38 aa, Entamoeba histolytica
LIEITHPTLLFIQNWFSYDPFLFIKEFRKYILQNPLIE

SEQ ID NO: 2719263 - protein, 24 aa, Entamoeba histolytica
LIEKEWVLMGYPFAQYLGIDNDYF

SEQ ID NO: 2719264 - protein, 29 aa, Entamoeba histolytica
LIEKINGKQKIYWYNQSKLTDITPEVIRE

SEQ ID NO: 2719265 - protein, 22 aa, Entamoeba histolytica
LIEKTWFVIDVFTSIQNIAEGF

SEQ ID NO: 2719266 - protein, 17 aa, Entamoeba histolytica
LIELFPSIKLLFNDIYE

SEQ ID NO: 2719267 - protein, 17 aa, Entamoeba histolytica
LIELISKPISIPINISF

SEQ ID NO: 2719268 - protein, 25 aa, Entamoeba histolytica
LIELKEFHRILFSKFPLLSKTLQMF

SEQ ID NO: 2719269 - protein, 19 aa, Entamoeba histolytica
LIELLLIFSSKKKMSKELL

SEQ ID NO: 2719270 - protein, 17 aa, Entamoeba histolytica
LIELMFDGRTRKQIKAK

SEQ ID NO: 2719271 - protein, 35 aa, Entamoeba histolytica
LIELVTHPFKFPGLILHDIILRFIPEQNEFFLTKG

SEQ ID NO: 2719272 - protein, 28 aa, Entamoeba histolytica
LIEPLSWPHPIVTLLPRCYSELVDLPTP

SEQ ID NO: 2719273 - protein, 19 aa, Entamoeba histolytica
LIERKFIHCGGLVGHIEDI

SEQ ID NO: 2719274 - protein, 24 aa, Entamoeba histolytica
LIERYEVPLPSHKWDQPLFNIQPG

SEQ ID NO: 2719275 - protein, 17 aa, Entamoeba histolytica
LIESFVIFHKSNYVFCV

SEQ ID NO: 2719276 - protein, 18 aa, Entamoeba histolytica
LIESVSYLLLHGLMCPLL

SEQ ID NO: 2719277 - protein, 19 aa, Entamoeba histolytica
LIETIEEIIFDPAIGKKKK

SEQ ID NO: 2719278 - protein, 27 aa, Entamoeba histolytica
LIETKKNFAMLLKSLIKANPKPSEIQF

SEQ ID NO: 2719279 - protein, 24 aa, Entamoeba histolytica
LIETLRFILVMDFPGKCGGLLQII

SEQ ID NO: 2719280 - protein, 18 aa, Entamoeba histolytica
LIEVPLDITLKEVSDILD

SEQ ID NO: 2719281 - protein, 18 aa, Entamoeba histolytica
LIFKLCILAEKYLKGKEY

SEQ ID NO: 2719282 - protein, 21 aa, Entamoeba histolytica
LIFREYELVFILRGHNDSVTD

SEQ ID NO: 2719283 - protein, 34 aa, Entamoeba histolytica
LIFVNSIQKCFYVKLFLDLFSIPSVVLNSDLPRD

SEQ ID NO: 2719284 - protein, 21 aa, Entamoeba histolytica
LIGARLICHTGSLINLAKAPG

SEQ ID NO: 2719285 - protein, 17 aa, Entamoeba histolytica
LIGFLEFVLNRDPTKRP

SEQ ID NO: 2719286 - protein, 25 aa, Entamoeba histolytica
LIGIIGMISIFHLYSKFQIQQGELI

SEQ ID NO: 2719287 - protein, 22 aa, Entamoeba histolytica
LIGLGCGCLCNLLLDSPLILKY

SEQ ID NO: 2719288 - protein, 19 aa, Entamoeba histolytica
LIGLKYLHDAGIVYRDLKP

SEQ ID NO: 2719289 - protein, 18 aa, Entamoeba histolytica
LIGLPPPHEMIKLIDELI

SEQ ID NO: 2719290 - protein, 28 aa, Entamoeba histolytica
LIGMKELPFVILRPAIIYGPGDVTGIAP

SEQ ID NO: 2719291 - protein, 28 aa, Entamoeba histolytica
LIGRTFGPDILLRFLCENNLKFIVRSHE

SEQ ID NO: 2719292 - protein, 17 aa, Entamoeba histolytica
LIHIKGKRNPFARLVEC

SEQ ID NO: 2719293 - protein, 28 aa, Entamoeba histolytica
LIHIRDNIYIRIYFTHKHFRREGDDIVY

SEQ ID NO: 2719294 - protein, 25 aa, Entamoeba histolytica
LIHKMDLHPTFGLSYQNIILETNRP

SEQ ID NO: 2719295 - protein, 20 aa, Entamoeba histolytica
LIHLTTLKFLNASSNPILFI

SEQ ID NO: 2719296 - protein, 21 aa, Entamoeba histolytica
LIHQYLSHSFLLSSPLSSIYN

SEQ ID NO: 2719297 - protein, 24 aa, Entamoeba histolytica
LIHSSIYCHVLFIQIPHIKSRESI

SEQ ID NO: 2719298 - protein, 20 aa, Entamoeba histolytica
LIIAAFASLNFIIHFMKNML

SEQ ID NO: 2719299 - protein, 17 aa, Entamoeba histolytica
LIIAIKHKQISTINILL

SEQ ID NO: 2719300 - protein, 19 aa, Entamoeba histolytica
LIICMLEDLIHFIEIIMDC

SEQ ID NO: 2719301 - protein, 38 aa, Entamoeba histolytica
LIIDSNHFLFSLKKKNYLQPLQVLPKKDKLVGLYVHST

SEQ ID NO: 2719302 - protein, 19 aa, Entamoeba histolytica
LIIECIGLMGMYAVDDMTE

SEQ ID NO: 2719303 - protein, 19 aa, Entamoeba histolytica
LIIFEECLSDIQIYRPKLP

SEQ ID NO: 2719304 - protein, 24 aa, Entamoeba histolytica
LIIKNISLIPLKFSGIIRDLMAEI

SEQ ID NO: 2719305 - protein, 21 aa, Entamoeba histolytica
LIINESAFDGFLVGVPLKVIS

SEQ ID NO: 2719306 - protein, 26 aa, Entamoeba histolytica
LIIQKFLFENPLDLSILLLPSIGFIC

SEQ ID NO: 2719307 - protein, 24 aa, Entamoeba histolytica
LIISKGYFDFLIDITIMQPEKMVD

SEQ ID NO: 2719308 - protein, 19 aa, Entamoeba histolytica
LIKDIIELRLEDISPLIIM

SEQ ID NO: 2719309 - protein, 17 aa, Entamoeba histolytica
LIKELITFGLFVPHNDE

SEQ ID NO: 2719310 - protein, 20 aa, Entamoeba histolytica
LIKISFILKGIKRVFYVNEK

SEQ ID NO: 2719311 - protein, 33 aa, Entamoeba histolytica
LIKKFENKVLKLKLEKMFLDLQSINPTDALKIK

SEQ ID NO: 2719312 - protein, 17 aa, Entamoeba histolytica
LIKMVNRFKRIFVRDSN

SEQ ID NO: 2719313 - protein, 19 aa, Entamoeba histolytica
LIKPRFHLHPSRPLECSYR

SEQ ID NO: 2719314 - protein, 18 aa, Entamoeba histolytica
LIKPVTVNGAQYTLQIWD

SEQ ID NO: 2719315 - protein, 19 aa, Entamoeba histolytica
LIKQIILMQKIPISKYQVS

SEQ ID NO: 2719316 - protein, 42 aa, Entamoeba histolytica
LIKRCKSHITLFKNGIKFICGMNGYIFISLNNESDYSNVGFE

SEQ ID NO: 2719317 - protein, 31 aa, Entamoeba histolytica; identical to SEQ ID NO: 2531814

SEQ ID NO: 2719318 - protein, 18 aa, Entamoeba histolytica
LIKSIDFPPFLKELHTSC

SEQ ID NO: 2719319 - protein, 25 aa, Entamoeba histolytica
LIKSNSLPLFFLKNKKIPIDSQLLT

SEQ ID NO: 2719320 - protein, 22 aa, Entamoeba histolytica
LIKTIKYQVKRINKLTAKEYNE

SEQ ID NO: 2719321 - protein, 18 aa, Entamoeba histolytica
LIKTKYYDSFLFDSINDE

SEQ ID NO: 2719322 - protein, 22 aa, Entamoeba histolytica
LIKTNVIIFCDIPSSWKTKEDV

SEQ ID NO: 2719323 - protein, 18 aa, Entamoeba histolytica
LIKYFNYTDGILEANSGV

SEQ ID NO: 2719324 - protein, 17 aa, Entamoeba histolytica
LIKYGDLLVWNAFVSTF

SEQ ID NO: 2719325 - protein, 18 aa, Entamoeba histolytica
LIKYNSIHMMTLKNFAMI

SEQ ID NO: 2719326 - protein, 18 aa, Entamoeba histolytica
LILCDLQCNSPVIEKVGC

SEQ ID NO: 2719327 - protein, 18 aa, Entamoeba histolytica
LILHGCHSLTFYPNLMDL

SEQ ID NO: 2719328 - protein, 24 aa, Entamoeba histolytica
LILSSQFFYKADRLILHSYGKLIV

SEQ ID NO: 2719329 - protein, 21 aa, Entamoeba histolytica
LILTPQFITKLINTLNIMFDG

SEQ ID NO: 2719330 - protein, 18 aa, Entamoeba histolytica
LIMKGDAFVVMYSVTNKN

SEQ ID NO: 2719331 - protein, 17 aa, Entamoeba histolytica
LIMPIYLASISEGVPTQ

SEQ ID NO: 2719332 - protein, 18 aa, Entamoeba histolytica
LIMSMSHHIIYFLRCDST

SEQ ID NO: 2719333 - protein, 20 aa, Entamoeba histolytica
LINDFWKRLAGRQIDETWFI

SEQ ID NO: 2719334 - protein, 21 aa, Entamoeba histolytica
LINDLLIMKPNITFQGCKVVS

SEQ ID NO: 2719335 - protein, 32 aa, Entamoeba histolytica
LINRLDVNIISLIKLFLLEYRVLIIASKEQVA

SEQ ID NO: 2719336 - protein, 25 aa, Entamoeba histolytica
LINTKLFDHIHWQLDVCWDAPAYVS

SEQ ID NO: 2719337 - protein, 19 aa, Entamoeba histolytica
LINTLHLPVYLTAESSESL

SEQ ID NO: 2719338 - protein, 23 aa, Entamoeba histolytica
LINVVPIETFFRIKNTNDIIYIP

SEQ ID NO: 2719339 - protein, 18 aa, Entamoeba histolytica
LIPIIYPNDTVMDLSIAT

SEQ ID NO: 2719340 - protein, 35 aa, Entamoeba histolytica
LIPKYKTCYFTVWRYYGIFLIPMCCYISQGAKDIR

SEQ ID NO: 2719341 - protein, 17 aa, Entamoeba histolytica
LIQCIDSLEKANKKMEQ

SEQ ID NO: 2719342 - protein, 20 aa, Entamoeba histolytica
LIQDSLRWNYSFSGIKFSEN

SEQ ID NO: 2719343 - protein, 29 aa, Entamoeba histolytica
LIQEETNWIYYFFIKEFKKILVEMNNPCN

SEQ ID NO: 2719344 - protein, 24 aa, Entamoeba histolytica
LIQLKQELILFIQRISEALHLISN

SEQ ID NO: 2719345 - protein, 25 aa, Entamoeba histolytica
LIQNKIDPFILPPINDRITHFSFAH

SEQ ID NO: 2719346 - protein, 19 aa, Entamoeba histolytica
LIQRFKEVTVEKSKLEIKI

SEQ ID NO: 2719347 - protein, 17 aa, Entamoeba histolytica
LIQRVCKALALLQTIAS

SEQ ID NO: 2719348 - protein, 18 aa, Entamoeba histolytica
LIQTLYFSKEYEGHSTYI

SEQ ID NO: 2719349 - protein, 23 aa, Entamoeba histolytica
LIRILKYITFDQKCPPFLIGPLK

SEQ ID NO: 2719350 - protein, 18 aa, Entamoeba histolytica
LIRKEILPLGKAIGSMQK

SEQ ID NO: 2719351 - protein, 24 aa, Entamoeba histolytica
LIRKRKIAPIYPSKEPYCDDDKIC

SEQ ID NO: 2719352 - protein, 18 aa, Entamoeba histolytica
LIRNMTPPIIPRLNGRRD

SEQ ID NO: 2719353 - protein, 27 aa, Entamoeba histolytica
LIRRNLLLTVETIGLTFFLIKKNNSFN

SEQ ID NO: 2719354 - protein, 27 aa, Entamoeba histolytica
LIRSRIKLFRFTKNKKWRKGAVLNLLG

SEQ ID NO: 2719355 - protein, 22 aa, Entamoeba histolytica
LIRTAFWDEVNPMKFHIITSTN

SEQ ID NO: 2719356 - protein, 19 aa, Entamoeba histolytica
LIRVAERKLMLNRLVMQSG

SEQ ID NO: 2719357 - protein, 31 aa, Entamoeba histolytica
LIRVSVQGMDKAYWVGIYKSALTSVSNNDYL

SEQ ID NO: 2719358 - protein, 24 aa, Entamoeba histolytica
LISATLSGYIDLITKRKKEAQLAE

SEQ ID NO: 2719359 - protein, 20 aa, Entamoeba histolytica
LISELYKSGLVKSALPVLCM

SEQ ID NO: 2719360 - protein, 24 aa, Entamoeba histolytica
LISEYRTLFKWYDGPLIEAMKNGD

SEQ ID NO: 2719361 - protein, 19 aa, Entamoeba histolytica
LISKLQIATLQFKSLNYLQ

SEQ ID NO: 2719362 - protein, 23 aa, Entamoeba histolytica
LISNDYIFYTTLKHTLHAINTKQ

SEQ ID NO: 2719363 - protein, 18 aa, Entamoeba histolytica
LISNLDYIFVKQRRVALF

SEQ ID NO: 2719364 - protein, 17 aa, Entamoeba histolytica
LISNLFKPYSLELIFDM

SEQ ID NO: 2719365 - protein, 25 aa, Entamoeba histolytica
LISSVSPLFYSMNPAVVVQATLLYF

SEQ ID NO: 2719366 - protein, 24 aa, Entamoeba histolytica
LISSYFAEQLFYISNLKLFSYDIF

SEQ ID NO: 2719367 - protein, 18 aa, Entamoeba histolytica
LISSYRRERDRFWNIGIH

SEQ ID NO: 2719368 - protein, 19 aa, Entamoeba histolytica
LITDFNTILLRMNDLKLTG

SEQ ID NO: 2719369 - protein, 18 aa, Entamoeba histolytica
LITDLGRTQIAPNTITVL

SEQ ID NO: 2719370 - protein, 19 aa, Entamoeba histolytica
LITFSLNLLRMVSSDDKNY

SEQ ID NO: 2719371 - protein, 24 aa, Entamoeba histolytica
LITKAFQRNIVFNNYLLETDVIVS

SEQ ID NO: 2719372 - protein, 17 aa, Entamoeba histolytica
LITMVIPSSVKTINELP

SEQ ID NO: 2719373 - protein, 28 aa, Entamoeba histolytica
LITNKPIGCILIFLPGIYEITTLQKEII

SEQ ID NO: 2719374 - protein, 20 aa, Entamoeba histolytica
LITNTAIVTALHICNFSISM

SEQ ID NO: 2719375 - protein, 30 aa, Entamoeba histolytica
LITSKVWNMLIHQFYLRDALFELKEHDFVQ

SEQ ID NO: 2719376 - protein, 27 aa, Entamoeba histolytica
LITTTHPPFIPSGRVIQMFPGKSVPKP

SEQ ID NO: 2719377 - protein, 26 aa, Entamoeba histolytica
LITVTPLLPLFDRFHKVSQTSPILIG

SEQ ID NO: 2719378 - protein, 26 aa, Entamoeba histolytica
LITYDIYNLIRYINLNHLKNIHLIYY

SEQ ID NO: 2719379 - protein, 19 aa, Entamoeba histolytica
LIVMLNYCYTHTIDSLLLS

SEQ ID NO: 2719380 - protein, 18 aa, Entamoeba histolytica
LIVPGIRAFIPEALRVMK

SEQ ID NO: 2719381 - protein, 19 aa, Entamoeba histolytica
LIVRNIKKNRIAIGDILAL

SEQ ID NO: 2719382 - protein, 20 aa, Entamoeba histolytica
LIVWVKLDPNQRMIYTKLLR

SEQ ID NO: 2719383 - protein, 19 aa, Entamoeba histolytica
LIYDMLQIDPLKRITAIEI

SEQ ID NO: 2719384 - protein, 24 aa, Entamoeba histolytica
LIYPELEAPFFKQGLYEMFAGCLD

SEQ ID NO: 2719385 - protein, 19 aa, Entamoeba histolytica
LIYQYSPLNFTCHKVKIIQ

SEQ ID NO: 2719386 - protein, 24 aa, Entamoeba histolytica
LKNLKILIIFMLLEKYGQMLHLHL

SEQ ID NO: 2719387 - protein, 24 aa, Entamoeba histolytica
LKAKVDDLILLSKVQDSKDEKEAS

SEQ ID NO: 2719388 - protein, 17 aa, Entamoeba histolytica
LKALFNSITVKYPRWFE

SEQ ID NO: 2719389 - protein, 28 aa, Entamoeba histolytica
LKCEGNFLFFIRHSPKGYFIFSINETQF

SEQ ID NO: 2719390 - protein, 29 aa, Entamoeba histolytica
LKCKYLDLYLIHWPIALKVDASNPPKPED

SEQ ID NO: 2719391 - protein, 18 aa, Entamoeba histolytica
LKCLGIANSVEFFDICRI

SEQ ID NO: 2719392 - protein, 33 aa, Entamoeba histolytica
LKCMGELPGPYIKYFVQSIGPAGLYKMAKGFDD

SEQ ID NO: 2719393 - protein, 27 aa, Entamoeba histolytica
LKDGGYGISVSYLSKTIKKMGIKRKPS

SEQ ID NO: 2719394 - protein, 24 aa, Entamoeba histolytica
LKDGTMFMYFQKTEIIQPILCVPT

SEQ ID NO: 2719395 - protein, 30 aa, Entamoeba histolytica
LKDGTPTLLFKYNVNFLFGNNPYLRNNQIT

SEQ ID NO: 2719396 - protein, 25 aa, Entamoeba histolytica
LKDIHFLVALAYTLPRLDLDSIKSK

SEQ ID NO: 2719397 - protein, 25 aa, Entamoeba histolytica
LKDIYEFWGFLWSQMFKILEEHCDG

SEQ ID NO: 2719398 - protein, 27 aa, Entamoeba histolytica
LKDLKDGLVLIRLLRNLSGCDIPNSVE

SEQ ID NO: 2719399 - protein, 17 aa, Entamoeba histolytica
LKDLLNQSYLVLGQCYF

SEQ ID NO: 2719400 - protein, 23 aa, Entamoeba histolytica
LKDLSICIFKKSKFNLYLSKSIN

SEQ ID NO: 2719401 - protein, 17 aa, Entamoeba histolytica
LKDVIPLLKIELNKYIG

SEQ ID NO: 2719402 - protein, 19 aa, Entamoeba histolytica
LKDVIRLREKLTYSHTFGI

SEQ ID NO: 2719403 - protein, 36 aa, Entamoeba histolytica
LKEAGVIVLPYNSFFQLLEKFMFGPTIYYSEPFTNL

SEQ ID NO: 2719404 - protein, 25 aa, Entamoeba histolytica
LKEAYKIYYFFTTLINSRCKQKDLL

SEQ ID NO: 2719405 - protein, 20 aa, Entamoeba histolytica
LKECLEYIKGNVKLITEFIQ

SEQ ID NO: 2719406 - protein, 26 aa, Entamoeba histolytica
LKEETRIKILMLLKNITKCNDHQLAQ

SEQ ID NO: 2719407 - protein, 18 aa, Entamoeba histolytica
LKEEYKMCGLKNNLNKLE

SEQ ID NO: 2719408 - protein, 33 aa, Entamoeba histolytica
LKEFLKEKLVPFSIPTYIFAIEDMPRTSFGKVY

SEQ ID NO: 2719409 - protein, 19 aa, Entamoeba histolytica
LKEFVKEIKLIIPNSTRIN

SEQ ID NO: 2719410 - protein, 18 aa, Entamoeba histolytica
LKEHKLVLDTLSKVEPSR

SEQ ID NO: 2719411 - protein, 29 aa, Entamoeba histolytica
LKEHSRLLLILPSLLQFYQPENLIVYLNE

SEQ ID NO: 2719412 - protein, 30 aa, Entamoeba histolytica
LKEIIKSCFVIINILPQYFIQQQFIGLMNS

SEQ ID NO: 2719413 - protein, 18 aa, Entamoeba histolytica
LKEIQSIFIEQLNKDPSS

SEQ ID NO: 2719414 - protein, 29 aa, Entamoeba histolytica
LKEIRITQPIIIVGLPRSGSTTLFNIMCA

SEQ ID NO: 2719415 - protein, 29 aa, Entamoeba histolytica
LKEIVQWPVLHPELFKRYGQPPSRGVLFY

SEQ ID NO: 2719416 - protein, 23 aa, Entamoeba histolytica
LKEKAELFLIKNNVPYIYYEDKT

SEQ ID NO: 2719417 - protein, 18 aa, Entamoeba histolytica
LKELFARVPFTYTDPIVS

SEQ ID NO: 2719418 - protein, 32 aa, Entamoeba histolytica
LKELFIRIENFIQKLIIFYRINTSRDPTSIVY

SEQ ID NO: 2719419 - protein, 23 aa, Entamoeba histolytica
LKEMLPCFKYLYGHFEGLLEVCH

SEQ ID NO: 2719420 - protein, 21 aa, Entamoeba histolytica
LKESFAYKKFLGIVVSLGNYL

SEQ ID NO: 2719421 - protein, 26 aa, Entamoeba histolytica
LKETKTILPYFFRTLKIDSSSQELIY

SEQ ID NO: 2719422 - protein, 20 aa, Entamoeba histolytica
LKEVKKYGLEPPKLWLKNDI

SEQ ID NO: 2719423 - protein, 25 aa, Entamoeba histolytica
LKEVKTIFSVKLPVGPIDYQTLYIE

SEQ ID NO: 2719424 - protein, 24 aa, Entamoeba histolytica
LKEVVSFLVMVWTKVKPPMENDIG

SEQ ID NO: 2719425 - protein, 22 aa, Entamoeba histolytica
LKEYKFYVDKLKELSFNEFEGY

SEQ ID NO: 2719426 - protein, 25 aa, Entamoeba histolytica
LKEYPPNPLLIFKPKQRLDIIAHTV

SEQ ID NO: 2719427 - protein, 17 aa, Entamoeba histolytica
LKEYSLPSFARNLSENK

SEQ ID NO: 2719428 - protein, 18 aa, Entamoeba histolytica
LKFASKLGPRHVQTTGGG

SEQ ID NO: 2719429 - protein, 25 aa, Entamoeba histolytica
LKFSFKALSGPIYDIAWTGDSQRIC

SEQ ID NO: 2719430 - protein, 26 aa, Entamoeba histolytica
LKGELIQRPWFFQSLESLRFKEEIER

SEQ ID NO: 2719431 - protein, 27 aa, Entamoeba histolytica
LKGGEGMFKFYYIPVGKTCELMTVLDG

SEQ ID NO: 2719432 - protein, 17 aa, Entamoeba histolytica
LKGIYKIAALLPSLKNS

SEQ ID NO: 2719433 - protein, 20 aa, Entamoeba histolytica
LKGKPYISLLKVLLNGITTS

SEQ ID NO: 2719434 - protein, 28 aa, Entamoeba histolytica
LKGLKKPYWSLVYRIARKKGLMWDKPQI

SEQ ID NO: 2719435 - protein, 41 aa, Entamoeba histolytica
LKGLQEGLKSTIILITYMQSFQNFIPPHTNPINLFQMNENA

SEQ ID NO: 2719436 - protein, 23 aa, Entamoeba histolytica
LKGNYIELSALLLNVLLAENMVN

SEQ ID NO: 2719437 - protein, 17 aa, Entamoeba histolytica
LKGWELRLWFGDVTESG

SEQ ID NO: 2719438 - protein, 28 aa, Entamoeba histolytica
LKHETNTYSGILRLFGKVTPQSITKVSK

SEQ ID NO: 2719439 - protein, 17 aa, Entamoeba histolytica
LKHFIQINHKCQRVCNH

SEQ ID NO: 2719440 - protein, 19 aa, Entamoeba histolytica
LKHKTFVPEFSLDIDVKYS

SEQ ID NO: 2719441 - protein, 20 aa, Entamoeba histolytica
LKHLNFIKQLLIKRMNLPKK

SEQ ID NO: 2719442 - protein, 24 aa, Entamoeba histolytica
LKHPWNDLLSLPNLKRIIIKCSYC

SEQ ID NO: 2719443 - protein, 27 aa, Entamoeba histolytica
LKHTQYMTRIIQTIKEYLPIAQRHWEG

SEQ ID NO: 2719444 - protein, 19 aa, Entamoeba histolytica
LKIALVMNTLIRGIVDTGI

SEQ ID NO: 2719445 - protein, 22 aa, Entamoeba histolytica
LKIDETLYFPINSARPNIHFFL

SEQ ID NO: 2719446 - protein, 29 aa, Entamoeba histolytica
LKIDKYHIPHLFPIPYLSDESYSIAFYYN

SEQ ID NO: 2719447 - protein, 26 aa, Entamoeba histolytica
LKIIEIIHLLQWPYWSCIKCLEMKNK

SEQ ID NO: 2719448 - protein, 19 aa, Entamoeba histolytica
LKIIHLKTIIMAANYNRTP

SEQ ID NO: 2719449 - protein, 17 aa, Entamoeba histolytica
LKIMFDILNARATLFNE

SEQ ID NO: 2719450 - protein, 20 aa, Entamoeba histolytica
LKIRLCGSETNWDLFKMWTG

SEQ ID NO: 2719451 - protein, 34 aa, Entamoeba histolytica
LKIVGAFVFLRLINPVLLTPLKFSSKLTKPSPSS

SEQ ID NO: 2719452 - protein, 22 aa, Entamoeba histolytica
LKIYFKYCLLTKNINNQKRNKP

SEQ ID NO: 2719453 - protein, 18 aa, Entamoeba histolytica
LKKCITASYFYNAAKLKG

SEQ ID NO: 2719454 - protein, 27 aa, Entamoeba histolytica
LKKEHSLQLYKMQLPPSLNKSGLVMCI

SEQ ID NO: 2719455 - protein, 19 aa, Entamoeba histolytica
LKKEKYPCGILYGRMEEYL

SEQ ID NO: 2719456 - protein, 24 aa, Entamoeba histolytica
LKKHGVIIYMEPQDFLMKKPDTKS

SEQ ID NO: 2719457 - protein, 17 aa, Entamoeba histolytica
LKKKKIENLIGKFAKRI

SEQ ID NO: 2719458 - protein, 17 aa, Entamoeba histolytica
LKKLIKNTGTFLNLLPL

SEQ ID NO: 2719459 - protein, 29 aa, Entamoeba histolytica
LKKLILSQNILYELPLNISTLSNLTCLNL

SEQ ID NO: 2719460 - protein, 25 aa, Entamoeba histolytica
LKKRCNAVIYLLIRGGLKNELLNYL

SEQ ID NO: 2719461 - protein, 41 aa, Entamoeba histolytica
LKKSIGRELTLKEQWYKVKYDYINIPVSISRIMGYKERWEN

SEQ ID NO: 2719462 - protein, 24 aa, Entamoeba histolytica
LKKVLKIIYAYIKSINKIDFTNGV

SEQ ID NO: 2719463 - protein, 23 aa, Entamoeba histolytica
LKKVYLHNYLTDLAIHDGITIIS

SEQ ID NO: 2719464 - protein, 20 aa, Entamoeba histolytica
LKLCDGFFLAMLHYIRNDIV

SEQ ID NO: 2719465 - protein, 28 aa, Entamoeba histolytica
LKLEEEKLLQSRKRLIRPFEEDKEINKF

SEQ ID NO: 2719466 - protein, 25 aa, Entamoeba histolytica
LKLHDLPRHVLIPSFLIDSGIDSET

SEQ ID NO: 2719467 - protein, 18 aa, Entamoeba histolytica
LKLHLLSINSDFMKGKCL

SEQ ID NO: 2719468 - protein, 29 aa, Entamoeba histolytica
LKLIHLITLPQYYLSFLISGGLHVLLDYG

SEQ ID NO: 2719469 - protein, 21 aa, Entamoeba histolytica
LKLINKKGSTILTKKQGRLYC

SEQ ID NO: 2719470 - protein, 18 aa, Entamoeba histolytica
LKLKTFSFKCECGQLTEC

SEQ ID NO: 2719471 - protein, 17 aa, Entamoeba histolytica
LKLLRTYENTRLEEELQ

SEQ ID NO: 2719472 - protein, 18 aa, Entamoeba histolytica
LKLLSLPVDEQGAQLPEK

SEQ ID NO: 2719473 - protein, 18 aa, Entamoeba histolytica
LKLVDIFGQIFFDSFERQ

SEQ ID NO: 2719474 - protein, 18 aa, Entamoeba histolytica
LKMEGYSKFYHFENLFLP

SEQ ID NO: 2719475 - protein, 32 aa, Entamoeba histolytica
LKMEHSIISSFLYLPNLKILEIDYLPTSLDGL

SEQ ID NO: 2719476 - protein, 17 aa, Entamoeba histolytica
LKMKSLQADLDHLRLID

SEQ ID NO: 2719477 - protein, 29 aa, Entamoeba histolytica
LKMPIELRDIIFYRSLYRCLSTDLPSNSP

SEQ ID NO: 2719478 - protein, 25 aa, Entamoeba histolytica
LKNEKPFELLLPQSLKVLSIEAPQA

SEQ ID NO: 2719479 - protein, 36 aa, Entamoeba histolytica; identical to SEQ ID NO: 2532000

SEQ ID NO: 2719480 - protein, 23 aa, Entamoeba histolytica
LKNGIIYKLGKYKLKLFSKKRRK

SEQ ID NO: 2719481 - protein, 23 aa, Entamoeba histolytica
LKNHANLYVILRGFQKIPTNDEI

SEQ ID NO: 2719482 - protein, 32 aa, Entamoeba histolytica
LKNIKGTYWGLGDLLYHPFFDSLRVQPKFTKS

SEQ ID NO: 2719483 - protein, 21 aa, Entamoeba histolytica
LKNIKIIQSLYLPLNLSFHGT

SEQ ID NO: 2719484 - protein, 26 aa, Entamoeba histolytica
LKNIQFPTIAVLLSFGKGKVIVPISS

SEQ ID NO: 2719485 - protein, 21 aa, Entamoeba histolytica
LKNIVLYLPTFHDISTFIRIN

SEQ ID NO: 2719486 - protein, 26 aa, Entamoeba histolytica
LKNKAQITKLPWKAAISYFKAAFISE

SEQ ID NO: 2719487 - protein, 25 aa, Entamoeba histolytica
LKNKLLELPLMGKLVSIIHCIFDDI

SEQ ID NO: 2719488 - protein, 30 aa, Entamoeba histolytica; identical to SEQ ID NO: 2532004

SEQ ID NO: 2719489 - protein, 28 aa, Entamoeba histolytica
LKNNNIPLLRKTLQLIPPYLVQRPQIEG

SEQ ID NO: 2719490 - protein, 21 aa, Entamoeba histolytica
LKNPIFPKNLQILKMSYCTQV

SEQ ID NO: 2719491 - protein, 21 aa, Entamoeba histolytica
LKNVLLYLPTLKDVGRFAQVS

SEQ ID NO: 2719492 - protein, 18 aa, Entamoeba histolytica
LKNWDGTLLIVSHQRQFL

SEQ ID NO: 2719493 - protein, 18 aa, Entamoeba histolytica
LKPDFYVGKILKEQKREF

SEQ ID NO: 2719494 - protein, 20 aa, Entamoeba histolytica
LKPENILLVELNITYIHLVS

SEQ ID NO: 2719495 - protein, 23 aa, Entamoeba histolytica
LKPVSFINQPPIKYKALQASEHS

SEQ ID NO: 2719496 - protein, 23 aa, Entamoeba histolytica
LKPYHALRFLMYQPSFCSAQTQR

SEQ ID NO: 2719497 - protein, 22 aa, Entamoeba histolytica
LKQCRLLRRHGRLGKKVSLHLN

SEQ ID NO: 2719498 - protein, 26 aa, Entamoeba histolytica
LKQIHHQYHLKYSLLTLGEKGSYVYD

SEQ ID NO: 2719499 - protein, 22 aa, Entamoeba histolytica
LKQILFKIKMVLDDPYVASEFI

SEQ ID NO: 2719500 - protein, 21 aa, Entamoeba histolytica
LKQKVLVHCLLGRSRSATIVT

SEQ ID NO: 2719501 - protein, 18 aa, Entamoeba histolytica
LKQLFPKYRLALENEIDK

SEQ ID NO: 2719502 - protein, 22 aa, Entamoeba histolytica
LKQLIICGNKIKSIPSLERCPI

SEQ ID NO: 2719503 - protein, 24 aa, Entamoeba histolytica
LKQLVRVYFTLMTTTHFTSGIPFH

SEQ ID NO: 2719504 - protein, 18 aa, Entamoeba histolytica
LKQLYSIIAEELLDSKKG

SEQ ID NO: 2719505 - protein, 26 aa, Entamoeba histolytica
LKQPQIIVRDSILKKDIQLIDENEKL

SEQ ID NO: 2719506 - protein, 31 aa, Entamoeba histolytica
LKQSERVMLFVIRILTNLLAFQQFQTTTFNK

SEQ ID NO: 2719507 - protein, 25 aa, Entamoeba histolytica
LKQSKLLIYNYSKQVIKYLSYYGIN

SEQ ID NO: 2719508 - protein, 20 aa, Entamoeba histolytica
LKRCFQAGFGFALTKTYPLE

SEQ ID NO: 2719509 - protein, 28 aa, Entamoeba histolytica
LKRDKIPSELLFFFDYYIDKHVEKGVAE

SEQ ID NO: 2719510 - protein, 24 aa, Entamoeba histolytica
LKRKDVIAIYLPNCVPFIIMEAVI

SEQ ID NO: 2719511 - protein, 20 aa, Entamoeba histolytica
LKRKELTPPWIPPVKSQTET

SEQ ID NO: 2719512 - protein, 39 aa, Entamoeba histolytica
LKRKVKLLCNILQVEDFWKHICIIWTKCTYHISKNEFVA

SEQ ID NO: 2719513 - protein, 17 aa, Entamoeba histolytica
LKRLVVGAVQYPSLYKK

SEQ ID NO: 2719514 - protein, 20 aa, Entamoeba histolytica
LKRMEFLSNGLEKYLNEMVM

SEQ ID NO: 2719515 - protein, 26 aa, Entamoeba histolytica
LKRMGTKFVIHDPAVYKLPSSEHYVI

SEQ ID NO: 2719516 - protein, 24 aa, Entamoeba histolytica
LKRRATILIALLLDYIDTPKGVLV

SEQ ID NO: 2719517 - protein, 19 aa, Entamoeba histolytica
LKRRTYAPSICTLLLVSQN

SEQ ID NO: 2719518 - protein, 17 aa, Entamoeba histolytica
LKRTMERINKHAWEDAM

SEQ ID NO: 2719519 - protein, 22 aa, Entamoeba histolytica
LKSHKLQFVGPLLNLLVKHYSG

SEQ ID NO: 2719520 - protein, 20 aa, Entamoeba histolytica
LKSILLPSSLIQLPNYCFFG

SEQ ID NO: 2719521 - protein, 25 aa, Entamoeba histolytica
LKSINALIRYRALTLASSIIKKGLI

SEQ ID NO: 2719522 - protein, 18 aa, Entamoeba histolytica
LKSINLPSSLLFIGEKSF

SEQ ID NO: 2719523 - protein, 19 aa, Entamoeba histolytica
LKSISVAVPIPFKPGVIGG

SEQ ID NO: 2719524 - protein, 24 aa, Entamoeba histolytica
LKSKSAFILQPLLSIILMTPEEFI

SEQ ID NO: 2719525 - protein, 29 aa, Entamoeba histolytica
LKSSLNSGLPNLLFFGPPGSGKTTSILAV

SEQ ID NO: 2719526 - protein, 26 aa, Entamoeba histolytica
LKSTAFLEYLFKPVSFKEFNGPSEDN

SEQ ID NO: 2719527 - protein, 17 aa, Entamoeba histolytica
LKSWFNVAKGEEKYIFP

SEQ ID NO: 2719528 - protein, 28 aa, Entamoeba histolytica
LKTCIRQYELFPHFGLILIHGGSGVGKT

SEQ ID NO: 2719529 - protein, 26 aa, Entamoeba histolytica
LKTEFASFIMNRYGINVIDVLNGEKS

SEQ ID NO: 2719530 - protein, 29 aa, Entamoeba histolytica
LKTFETQDLYLCLIWILKNVNREVLKRYI

SEQ ID NO: 2719531 - protein, 25 aa, Entamoeba histolytica
LKTKQGFSTLIKRFTRLPVKHVQEF

SEQ ID NO: 2719532 - protein, 24 aa, Entamoeba histolytica
LKTKSMCFLFNDVIVWMDNVVPLV

SEQ ID NO: 2719533 - protein, 24 aa, Entamoeba histolytica
LKTKTPTLAFLDKGGSRASLPNKV

SEQ ID NO: 2719534 - protein, 26 aa, Entamoeba histolytica
LKTLFKDTGIYFAFARDFDKIDDSIC

SEQ ID NO: 2719535 - protein, 37 aa, Entamoeba histolytica
LKTLKIEMQLFLLRWVRLLFCQVYPIKTIKPMWDVIF

SEQ ID NO: 2719536 - protein, 33 aa, Entamoeba histolytica
LKTMIEIICNIFPFYKFWEHVCVVWTNCYNYTP

SEQ ID NO: 2719537 - protein, 25 aa, Entamoeba histolytica
LKTNTEYFIILASSLIEHKISLPRI

SEQ ID NO: 2719538 - protein, 25 aa, Entamoeba histolytica
LKTSQYLFALAYYVQQRKIVIELSN

SEQ ID NO: 2719539 - protein, 20 aa, Entamoeba histolytica
LKTVYVLFQFGCPETVIYDF

SEQ ID NO: 2719540 - protein, 22 aa, Entamoeba histolytica
LKVASMYIPVVADILLEPLINN

SEQ ID NO: 2719541 - protein, 27 aa, Entamoeba histolytica
LKVGGFVVIGTFPCKITEFNKTKDGKH

SEQ ID NO: 2719542 - protein, 21 aa, Entamoeba histolytica
LKVILKSTILAPPNLCGACVF

SEQ ID NO: 2719543 - protein, 17 aa, Entamoeba histolytica
LKVLFNEKPFEGVNGSG

SEQ ID NO: 2719544 - protein, 20 aa, Entamoeba histolytica
LKVLLLNQKFGVDATISFVD

SEQ ID NO: 2719545 - protein, 19 aa, Entamoeba histolytica
LKVMRECPLFILSNNPDLS

SEQ ID NO: 2719546 - protein, 30 aa, Entamoeba histolytica
LKVPMPALNVYKLTVLLLISLKKTETANST

SEQ ID NO: 2719547 - protein, 17 aa, Entamoeba histolytica
LKYLINYDDLPSVAFKS

SEQ ID NO: 2719548 - protein, 17 aa, Entamoeba histolytica
LKYQIQIGRYYFVPTKA

SEQ ID NO: 2719549 - protein, 26 aa, Entamoeba histolytica
LKYTPKGVFCLMTFYGPACPSNSGII

SEQ ID NO: 2719550 - protein, 19 aa, Entamoeba histolytica
LKYWGYDQALLSYLYTSRK

SEQ ID NO: 2719551 - protein, 26 aa, Entamoeba histolytica
LLASSCVYFFLKEFIPIVQINLCLLF

SEQ ID NO: 2719552 - protein, 18 aa, Entamoeba histolytica
LLAWVRQTTEGYAGVNIS

SEQ ID NO: 2719553 - protein, 29 aa, Entamoeba histolytica
LLCDFSIPILFTTLPLNIILDLFESILLE

SEQ ID NO: 2719554 - protein, 21 aa, Entamoeba histolytica
LLCGMEFFQYYAGMYDQFKID

SEQ ID NO: 2719555 - protein, 20 aa, Entamoeba histolytica
LLDIFFNFNHNCTIFRQIAF

SEQ ID NO: 2719556 - protein, 20 aa, Entamoeba histolytica
LLDINKKLNSLLSPKTQITK

SEQ ID NO: 2719557 - protein, 23 aa, Entamoeba histolytica
LLDISVVYIVFDISNIDSYNYAL

SEQ ID NO: 2719558 - protein, 22 aa, Entamoeba histolytica
LLDKIMFCYGVGYKKARKENGP

SEQ ID NO: 2719559 - protein, 25 aa, Entamoeba histolytica
LLDKVIELVFWIHHQPNICKSISSL

SEQ ID NO: 2719560 - protein, 32 aa, Entamoeba histolytica
LLDLNLPYKLIKNKIFLLLNIKNAQSVIKINF

SEQ ID NO: 2719561 - protein, 24 aa, Entamoeba histolytica
LLDSIQPQYYLPLCVYLAIQREDK

SEQ ID NO: 2719562 - protein, 23 aa, Entamoeba histolytica
LLDVEFLSIMKFCRGDPIYIESS

SEQ ID NO: 2719563 - protein, 32 aa, Entamoeba histolytica
LLDYALQHHEILPPLFDLFGGLCLKCLDSVKY

SEQ ID NO: 2719564 - protein, 18 aa, Entamoeba histolytica
LLECVKYLSPYMIYVSDS

SEQ ID NO: 2719565 - protein, 20 aa, Entamoeba histolytica
LLEDVPLKEGLPLPVYDSLK

SEQ ID NO: 2719566 - protein, 18 aa, Entamoeba histolytica
LLEKKKLNMLFQQKWDMF

SEQ ID NO: 2719567 - protein, 39 aa, Entamoeba histolytica
LLEKVRCLYSLAIFIKKLDYVPVKFSAPTLFTPRMNHLG

SEQ ID NO: 2719568 - protein, 20 aa, Entamoeba histolytica
LLELKNCLLLNEALNFREVI

SEQ ID NO: 2719569 - protein, 17 aa, Entamoeba histolytica
LLELRVRMDTVEKGSIV

SEQ ID NO: 2719570 - protein, 25 aa, Entamoeba histolytica
LLENAFGTLSFYYGEAMLSNIQVLE

SEQ ID NO: 2719571 - protein, 20 aa, Entamoeba histolytica
LLENSGFIEIYTLRLERNLT

SEQ ID NO: 2719572 - protein, 18 aa, Entamoeba histolytica
LLERILYIESTPYNKLFE

SEQ ID NO: 2719573 - protein, 19 aa, Entamoeba histolytica
LLERRFISLFMKKGKEDFF

SEQ ID NO: 2719574 - protein, 17 aa, Entamoeba histolytica
LLESKIFYVCEKGNEGL

SEQ ID NO: 2719575 - protein, 29 aa, Entamoeba histolytica
LLEVIDSKMVGILIRRSFHNTGVDIVRIE

SEQ ID NO: 2719576 - protein, 17 aa, Entamoeba histolytica
LLFEEFCLEINAMEFSQ

SEQ ID NO: 2719577 - protein, 19 aa, Entamoeba histolytica
LLFESYKKLHPSISLLFEC

SEQ ID NO: 2719578 - protein, 18 aa, Entamoeba histolytica
LLFFVEHHAFDVCKILLE

SEQ ID NO: 2719579 - protein, 25 aa, Entamoeba histolytica
LLFKQLFSDWTEPILSRPKISSPTI

SEQ ID NO: 2719580 - protein, 22 aa, Entamoeba histolytica
LLFNEFIVDAFKYQIKGYKYFL

SEQ ID NO: 2719581 - protein, 19 aa, Entamoeba histolytica
LLFNGIIEATLPLLNQPEL

SEQ ID NO: 2719582 - protein, 18 aa, Entamoeba histolytica
LLFRKAFKKDLGEIPKLP

SEQ ID NO: 2719583 - protein, 21 aa, Entamoeba histolytica
LLFRVGMELGIYFDESYIKKL

SEQ ID NO: 2719584 - protein, 27 aa, Entamoeba histolytica
LLFVKQAIYLYSSISRLCLLFKKEYEK

SEQ ID NO: 2719585 - protein, 19 aa, Entamoeba histolytica
LLGDFYFKGKELYPNGYNR

SEQ ID NO: 2719586 - protein, 23 aa, Entamoeba histolytica
LLGGYLDAFLPTINRLVNTPQQL

SEQ ID NO: 2719587 - protein, 20 aa, Entamoeba histolytica
LLGNGYGFAVDWWSYGTLIY

SEQ ID NO: 2719588 - protein, 28 aa, Entamoeba histolytica
LLGNVLKKYLNLMPNKLPISLQTVDVDN

SEQ ID NO: 2719589 - protein, 35 aa, Entamoeba histolytica
LLGQQMTPLLYIFDGIFPLNVGIAQLPPLEKVIGI

SEQ ID NO: 2719590 - protein, 27 aa, Entamoeba histolytica
LLHFPQSIFDLITLKTLFVSNNYITTI

SEQ ID NO: 2719591 - protein, 18 aa, Entamoeba histolytica
LLHIIISVNWNRNDLVWS

SEQ ID NO: 2719592 - protein, 22 aa, Entamoeba histolytica
LLHQRPMEFFEIIYVTGTVLRG

SEQ ID NO: 2719593 - protein, 19 aa, Entamoeba histolytica
LLHYTLTLYYNILTQLHSA

SEQ ID NO: 2719594 - protein, 17 aa, Entamoeba histolytica
LLICLINSKLESFQVDL

SEQ ID NO: 2719595 - protein, 20 aa, Entamoeba histolytica
LLICNKRFTLNRKSAFSYDL

SEQ ID NO: 2719596 - protein, 19 aa, Entamoeba histolytica
LLICRNYYGKQCYLLNMLL

SEQ ID NO: 2719597 - protein, 21 aa, Entamoeba histolytica
LLICSKYFRYKSDFINVICVC

SEQ ID NO: 2719598 - protein, 17 aa, Entamoeba histolytica
LLIEFLWLRVNSNCIIQ

SEQ ID NO: 2719599 - protein, 18 aa, Entamoeba histolytica
LLIEFMNNRSLNSFISCR

SEQ ID NO: 2719600 - protein, 20 aa, Entamoeba histolytica
LLIHSLLCQTQFIDPMPKNN

SEQ ID NO: 2719601 - protein, 17 aa, Entamoeba histolytica
LLIILEDATFEMMKADK

SEQ ID NO: 2719602 - protein, 19 aa, Entamoeba histolytica
LLIKFRDEVLIDSTLNKIF

SEQ ID NO: 2719603 - protein, 20 aa, Entamoeba histolytica
LLIPSYLPNIPYELLKKYCV

SEQ ID NO: 2719604 - protein, 17 aa, Entamoeba histolytica
LLITFLTKYPLSKSQYK

SEQ ID NO: 2719605 - protein, 19 aa, Entamoeba histolytica
LLKAVILLKRYGINEMFRS

SEQ ID NO: 2719606 - protein, 34 aa, Entamoeba histolytica
LLKEHYKYDLYIFEYYLMIQLYSITKDDASYNEY

SEQ ID NO: 2719607 - protein, 19 aa, Entamoeba histolytica
LLKEWLLRIEIDKYIIEER

SEQ ID NO: 2719608 - protein, 18 aa, Entamoeba histolytica
LLKFTNWEQWENYNFMSD

SEQ ID NO: 2719609 - protein, 21 aa, Entamoeba histolytica
LLKHNLFGTRVLKKIAAVMPR

SEQ ID NO: 2719610 - protein, 19 aa, Entamoeba histolytica
LLKIFRVLGYPDEKEWPDF

SEQ ID NO: 2719611 - protein, 18 aa, Entamoeba histolytica
LLKKCGYNFIIRQTKKAK

SEQ ID NO: 2719612 - protein, 19 aa, Entamoeba histolytica
LLKKDNVQIFEFIQVALAA

SEQ ID NO: 2719613 - protein, 26 aa, Entamoeba histolytica
LLKKKREERAKRDADFAKLTGSDVDN

SEQ ID NO: 2719614 - protein, 29 aa, Entamoeba histolytica
LLKKYIEIQIKLLYPIAPHFCDYVWRDLL

SEQ ID NO: 2719615 - protein, 24 aa, Entamoeba histolytica
LLKNQIELLINILPTLIQYTNESN

SEQ ID NO: 2719616 - protein, 18 aa, Entamoeba histolytica
LLKPFNAYFEIGAIKEKY

SEQ ID NO: 2719617 - protein, 17 aa, Entamoeba histolytica
LLKPKVFYGLRSDCYIV

SEQ ID NO: 2719618 - protein, 17 aa, Entamoeba histolytica
LLKQDILCQAKSGMGKT

SEQ ID NO: 2719619 - protein, 20 aa, Entamoeba histolytica
LLKQDILCQAKSGMGKTAVF

SEQ ID NO: 2719620 - protein, 20 aa, Entamoeba histolytica
LLKRITFCYKECYYAISNDG

SEQ ID NO: 2719621 - protein, 22 aa, Entamoeba histolytica
LLKRMRFEVLKYINSITGLKEE

SEQ ID NO: 2719622 - protein, 25 aa, Entamoeba histolytica
LLKSTYLLTLDVFNQGYYTPIANSQ

SEQ ID NO: 2719623 - protein, 17 aa, Entamoeba histolytica
LLKTIFDIPQCMGMIGG

SEQ ID NO: 2719624 - protein, 29 aa, Entamoeba histolytica
LLKYCSKIVPSLLLELYHTHIFEMLMQKF

SEQ ID NO: 2719625 - protein, 19 aa, Entamoeba histolytica
LLLALNKMNIIKSPEFLLG

SEQ ID NO: 2719626 - protein, 20 aa, Entamoeba histolytica
LLLALNKMNIIKSPEFLLGN

SEQ ID NO: 2719627 - protein, 17 aa, Entamoeba histolytica
LLLLSLVLHYDSIFILR

SEQ ID NO: 2719628 - protein, 27 aa, Entamoeba histolytica
LLLNTVQQFILLLQKNKIIQFNNQGRV

SEQ ID NO: 2719629 - protein, 32 aa, Entamoeba histolytica
LLLPINLLEYLLNPLLIQFIKMPWYSKLILNT

SEQ ID NO: 2719630 - protein, 21 aa, Entamoeba histolytica
LLLQIIQTPPVSLLSRSFLSN

SEQ ID NO: 2719631 - protein, 31 aa, Entamoeba histolytica
LLMIEEAWWYYIDVYRLLYPELPRLEFIDFV

SEQ ID NO: 2719632 - protein, 18 aa, Entamoeba histolytica
LLMNELLNEQPGASFSSC

SEQ ID NO: 2719633 - protein, 31 aa, Entamoeba histolytica
LLMNLYNHWYYFYLSLVRYPLSLDISMMNQH

SEQ ID NO: 2719634 - protein, 18 aa, Entamoeba histolytica
LLNDFKYALVWGNSVAHS

SEQ ID NO: 2719635 - protein, 25 aa, Entamoeba histolytica
LLNEIEENFLYLSIERFIEKESIEI

SEQ ID NO: 2719636 - protein, 25 aa, Entamoeba histolytica
LLNEPLFIISPQYDNVFFNKIMIGY

SEQ ID NO: 2719637 - protein, 27 aa, Entamoeba histolytica
LLNERITFLQLKRQFPNALDALVYLTS

SEQ ID NO: 2719638 - protein, 17 aa, Entamoeba histolytica
LLNGEYFANKPLNSQDS

SEQ ID NO: 2719639 - protein, 24 aa, Entamoeba histolytica
LLNKNKFICYFTPTVITQLELNYI

SEQ ID NO: 2719640 - protein, 19 aa, Entamoeba histolytica
LLNLNTPIVSPLPQHVNDK

SEQ ID NO: 2719641 - protein, 32 aa, Entamoeba histolytica
LLNYSKQINRLFSFILRNILTIFPSSKRCFSA

SEQ ID NO: 2719642 - protein, 18 aa, Entamoeba histolytica
LLPELVPESKLKLPSILH

SEQ ID NO: 2719643 - protein, 24 aa, Entamoeba histolytica
LLPNSMILGILTFSSFNPTQRLAL

SEQ ID NO: 2719644 - protein, 18 aa, Entamoeba histolytica
LLPNYHQKWNLILCGLHA

SEQ ID NO: 2719645 - protein, 25 aa, Entamoeba histolytica
LLPQGWSCGYFRNERYFINALTNAT

SEQ ID NO: 2719646 - protein, 29 aa, Entamoeba histolytica
LLPSYHSVPILVEPIKYMESYGYNHCTNH

SEQ ID NO: 2719647 - protein, 18 aa, Entamoeba histolytica
LLPTQWKIVLDDPLLVSQ

SEQ ID NO: 2719648 - protein, 19 aa, Entamoeba histolytica
LLPVIPSTCLSWDISCDIA

SEQ ID NO: 2719649 - protein, 17 aa, Entamoeba histolytica
LLQIIATPQYKPLQQIA

SEQ ID NO: 2719650 - protein, 28 aa, Entamoeba histolytica
LLQKSAMKLYGLIHARFILSPNGMKKMK

SEQ ID NO: 2719651 - protein, 17 aa, Entamoeba histolytica
LLQLHKEGMTLLMVTHD

SEQ ID NO: 2719652 - protein, 20 aa, Entamoeba histolytica
LLQMKGIVECTTPDNWKKVI

SEQ ID NO: 2719653 - protein, 22 aa, Entamoeba histolytica
LLQRQTIGWKLVFDLAIQIIDA

SEQ ID NO: 2719654 - protein, 17 aa, Entamoeba histolytica
LLRAVAGVAPRSVYTTG

SEQ ID NO: 2719655 - protein, 27 aa, Entamoeba histolytica
LLRDGTKLLYNFALIVAHNAAATVSEE

SEQ ID NO: 2719656 - protein, 26 aa, Entamoeba histolytica
LLREIPIEILINPNIQFVLNVKRAFD

SEQ ID NO: 2719657 - protein, 20 aa, Entamoeba histolytica
LLRFHINTLVKPNISLAQTA

SEQ ID NO: 2719658 - protein, 27 aa, Entamoeba histolytica
LLSCPDIRLIWIHRNPYDIIKSSIPYF

SEQ ID NO: 2719659 - protein, 33 aa, Entamoeba histolytica
LLSESLGALWKTLPSLPFLPKSNQLKGVSLLYQ

SEQ ID NO: 2719660 - protein, 22 aa, Entamoeba histolytica
LLSFKSSAVPYTLPLAVICALS

SEQ ID NO: 2719661 - protein, 28 aa, Entamoeba histolytica
LLSFPRDNTVTYYFAYGGWIVQMEEKND

SEQ ID NO: 2719662 - protein, 17 aa, Entamoeba histolytica
LLSIDTINPKLLKSISI

SEQ ID NO: 2719663 - protein, 23 aa, Entamoeba histolytica
LLSIKQCMLFKIIGKDGQVKKNA

SEQ ID NO: 2719664 - protein, 23 aa, Entamoeba histolytica
LLSKLLQSLLSPIPTQSYWKNWM

SEQ ID NO: 2719665 - protein, 25 aa, Entamoeba histolytica
LLSLHDFCFYRCSSLVFVSIPSTVT

SEQ ID NO: 2719666 - protein, 19 aa, Entamoeba histolytica
LLSLIPSLQPPPSQIRFII

SEQ ID NO: 2719667 - protein, 20 aa, Entamoeba histolytica
LLSLQNWVGELKRYGPDKGN

SEQ ID NO: 2719668 - protein, 21 aa, Entamoeba histolytica
LLSLSLQQIMKFSGSFAAALN

SEQ ID NO: 2719669 - protein, 26 aa, Entamoeba histolytica
LLSLTLQKSIGILPILIQILQNHMTE

SEQ ID NO: 2719670 - protein, 23 aa, Entamoeba histolytica
LLSNAYHFKRYPITPSFITIERN

SEQ ID NO: 2719671 - protein, 28 aa, Entamoeba histolytica
LLSNEIKWRIIKLTFFIPNEIKVEDKII

SEQ ID NO: 2719672 - protein, 23 aa, Entamoeba histolytica
LLSNGINAVRWVGGVELELLAIA

SEQ ID NO: 2719673 - protein, 41 aa, Entamoeba histolytica
LLSTKFIKKLNSLSLPLMSIYTALRYILQYKPIESVQEYFE

SEQ ID NO: 2719674 - protein, 28 aa, Entamoeba histolytica
LLSTPSLLVSMLFDGTFLQVMTDRIIIY

SEQ ID NO: 2719675 - protein, 18 aa, Entamoeba histolytica
LLSYEEFLHLFYCYSIHT

SEQ ID NO: 2719676 - protein, 17 aa, Entamoeba histolytica
LLSYPFDVLLSRSIHNY

SEQ ID NO: 2719677 - protein, 26 aa, Entamoeba histolytica
LLSYTGYFMFYRFVGNYIASSSNETQ

SEQ ID NO: 2719678 - protein, 35 aa, Entamoeba histolytica
LLTCEKGIYLLLTQLKKDCIMPYLNTVHEYLEKLN

SEQ ID NO: 2719679 - protein, 19 aa, Entamoeba histolytica
LLTELILPQTVNTLGNCCC

SEQ ID NO: 2719680 - protein, 20 aa, Entamoeba histolytica
LLTELLKYTPLKHPDYKYIV

SEQ ID NO: 2719681 - protein, 26 aa, Entamoeba histolytica
LLTKYAILLVNFFSKSQRVGSSFRCL

SEQ ID NO: 2719682 - protein, 19 aa, Entamoeba histolytica
LLTQMIWKEILRNSVMMGA

SEQ ID NO: 2719683 - protein, 18 aa, Entamoeba histolytica
LLTRIRVVYGIDAIRPYQ

SEQ ID NO: 2719684 - protein, 27 aa, Entamoeba histolytica
LLTTRHPFIVHLYWSFATETCFYFIMD

SEQ ID NO: 2719685 - protein, 21 aa, Entamoeba histolytica
LLVIGGRPTINWYKLFKNTSI

SEQ ID NO: 2719686 - protein, 18 aa, Entamoeba histolytica
LLVIKDRYPHVQYVAAGR

SEQ ID NO: 2719687 - protein, 23 aa, Entamoeba histolytica
LLVILEIIMHCFNKRFLSSGNEV

SEQ ID NO: 2719688 - protein, 19 aa, Entamoeba histolytica
LLVKIIRKKLFPINMKEIN

SEQ ID NO: 2719689 - protein, 17 aa, Entamoeba histolytica
LLVLCNDIILICSKPNR

SEQ ID NO: 2719690 - protein, 18 aa, Entamoeba histolytica
LLWIMNDKDFLSGRSYSL

SEQ ID NO: 2719691 - protein, 19 aa, Entamoeba histolytica
LLYEWYVICCDYPNLKRFS

SEQ ID NO: 2719692 - protein, 24 aa, Entamoeba histolytica
LLYGLIHQRFIVTVPGLKKMYEKF

SEQ ID NO: 2719693 - protein, 19 aa, Entamoeba histolytica
LLYSLFHIVWLQSFDEKLV

SEQ ID NO: 2719694 - protein, 18 aa, Entamoeba histolytica
LMALLSKEGITLGSTSSE

SEQ ID NO: 2719695 - protein, 28 aa, Entamoeba histolytica
LMAPMDAFLCARGMKTLPIRMQIHMENG

SEQ ID NO: 2719696 - protein, 18 aa, Entamoeba histolytica
LMATNRIDILDPALLRPG

SEQ ID NO: 2719697 - protein, 17 aa, Entamoeba histolytica
LMAVFQSFDSDCSLSVS

SEQ ID NO: 2719698 - protein, 21 aa, Entamoeba histolytica
LMCEYMTFLLECHSKYNIKIY

SEQ ID NO: 2719699 - protein, 17 aa, Entamoeba histolytica
LMCEYMTFLLECNNKYN

SEQ ID NO: 2719700 - protein, 21 aa, Entamoeba histolytica
LMDDKMLRYYNPSGRFVIGGP

SEQ ID NO: 2719701 - protein, 27 aa, Entamoeba histolytica
LMDDLGNLKWIVVGKLFGLRAIIGNSS

SEQ ID NO: 2719702 - protein, 18 aa, Entamoeba histolytica
LMDINIFKKCFNLRELSC

SEQ ID NO: 2719703 - protein, 25 aa, Entamoeba histolytica
LMDPSGKAPLMWRYDEINAPTCFEV

SEQ ID NO: 2719704 - protein, 27 aa, Entamoeba histolytica
LMDYSQGKNFFLKLPNRKNPITLDGIG

SEQ ID NO: 2719705 - protein, 19 aa, Entamoeba histolytica
LMEEYLNHLTWPYDQLKRG

SEQ ID NO: 2719706 - protein, 26 aa, Entamoeba histolytica
LMEKLYGVFEWAYSAQILLSFEPPEP

SEQ ID NO: 2719707 - protein, 19 aa, Entamoeba histolytica
LMELIRLRNAINSRKEECA

SEQ ID NO: 2719708 - protein, 19 aa, Entamoeba histolytica
LMEYSLQKMMPYPYHLIDI

SEQ ID NO: 2719709 - protein, 18 aa, Entamoeba histolytica
LMFESMLASVIYARDKYL

SEQ ID NO: 2719710 - protein, 26 aa, Entamoeba histolytica
LMGKHYFQVIFDGISYYEGISSIQHA

SEQ ID NO: 2719711 - protein, 19 aa, Entamoeba histolytica
LMGVIRKILELMYKYHHEL

SEQ ID NO: 2719712 - protein, 22 aa, Entamoeba histolytica
LMIGVQQLLKKPSTPTKKRLTE

SEQ ID NO: 2719713 - protein, 19 aa, Entamoeba histolytica
LMILPTVISMYLRAIPVIT

SEQ ID NO: 2719714 - protein, 17 aa, Entamoeba histolytica
LMIVCKKFRILTELYTY

SEQ ID NO: 2719715 - protein, 17 aa, Entamoeba histolytica
LMKIIQRPVCHLNAIDV

SEQ ID NO: 2719716 - protein, 18 aa, Entamoeba histolytica
LMKLIEHVIRYSFKKDSI

SEQ ID NO: 2719717 - protein, 19 aa, Entamoeba histolytica
LMKNIIFISNLLLNSNQMN

SEQ ID NO: 2719718 - protein, 24 aa, Entamoeba histolytica
LMKSNSIIQLPPTKVSLKTNSSEN

SEQ ID NO: 2719719 - protein, 19 aa, Entamoeba histolytica
LMLEKLQTILLDPAKKMDI

SEQ ID NO: 2719720 - protein, 17 aa, Entamoeba histolytica
LMLITNRNHDISAGLLH

SEQ ID NO: 2719721 - protein, 21 aa, Entamoeba histolytica
LMLKAFFTMLKRFYPDRVDLL

SEQ ID NO: 2719722 - protein, 27 aa, Entamoeba histolytica
LMLRRNVGFLTRIISLLFSFDENFTDE

SEQ ID NO: 2719723 - protein, 25 aa, Entamoeba histolytica
LMMMRETIGLFPPSLLCQATQNVNN

SEQ ID NO: 2719724 - protein, 22 aa, Entamoeba histolytica
LMNELYNLKLILRSDVREENIF

SEQ ID NO: 2719725 - protein, 18 aa, Entamoeba histolytica
LMNGRWFDKHQLSCDYYD

SEQ ID NO: 2719726 - protein, 30 aa, Entamoeba histolytica
LMNKLNHQTAWLRKHLFRPNILLSAVEKHV

SEQ ID NO: 2719727 - protein, 25 aa, Entamoeba histolytica
LMNLRTLKEVYLNPIIKLVNKEHAT

SEQ ID NO: 2719728 - protein, 23 aa, Entamoeba histolytica
LMNVAKIQALWRTTEFKPTIQQF

SEQ ID NO: 2719729 - protein, 21 aa, Entamoeba histolytica
LMNVALYFDTTKNLKLFMCIS

SEQ ID NO: 2719730 - protein, 20 aa, Entamoeba histolytica
LMNVLQYFEKFNDIITFLLC

SEQ ID NO: 2719731 - protein, 17 aa, Entamoeba histolytica
LMPKLEVLTLSNNRITS

SEQ ID NO: 2719732 - protein, 18 aa, Entamoeba histolytica
LMPLKYLNRMQSTIYPTV

SEQ ID NO: 2719733 - protein, 26 aa, Entamoeba histolytica
LMPQLPQLIPMFFDLLPHGGDEDSVN

SEQ ID NO: 2719734 - protein, 19 aa, Entamoeba histolytica
LMQQMVPMYYLYDYGTIEF

SEQ ID NO: 2719735 - protein, 18 aa, Entamoeba histolytica
LMSRFDLFFVVLDEPNEE

SEQ ID NO: 2719736 - protein, 24 aa, Entamoeba histolytica
LMSSLHFLQFLLQQNLEIEDICQD

SEQ ID NO: 2719737 - protein, 25 aa, Entamoeba histolytica
LMTCEQFIRPPVIIKVRTFTSNKLA

SEQ ID NO: 2719738 - protein, 25 aa, Entamoeba histolytica
LMTEENVIHLFNVYSKYITNTAKRH

SEQ ID NO: 2719739 - protein, 17 aa, Entamoeba histolytica
LMTMVPFFNIMCADEIE

SEQ ID NO: 2719740 - protein, 22 aa, Entamoeba histolytica
LMTRVKRLYEFICKQYSTIVAP

SEQ ID NO: 2719741 - protein, 18 aa, Entamoeba histolytica
LMTSLILSKPYSIYSFIS

SEQ ID NO: 2719742 - protein, 19 aa, Entamoeba histolytica
LMVKLEVASIFPLITGNAH

SEQ ID NO: 2719743 - protein, 23 aa, Entamoeba histolytica
LMWNVYRRWKEFIKYLISLQKLT

SEQ ID NO: 2719744 - protein, 31 aa, Entamoeba histolytica
LNAHFHELYITPLYVNVLTSGIWPFSTENSL

SEQ ID NO: 2719745 - protein, 18 aa, Entamoeba histolytica
LNAKLMIKFPKKSKIIKP

SEQ ID NO: 2719746 - protein, 27 aa, Entamoeba histolytica
LNAVIWLEHYLMNWKKSLLLVSHDTSF

SEQ ID NO: 2719747 - protein, 21 aa, Entamoeba histolytica
LNCSSLTRLIIPRGVVNISIN

SEQ ID NO: 2719748 - protein, 23 aa, Entamoeba histolytica
LNCYQNLLYHLYMKKKSIEESIE

SEQ ID NO: 2719749 - protein, 19 aa, Entamoeba histolytica
LNDFNYLKEFGHNLLGFEE

SEQ ID NO: 2719750 - protein, 26 aa, Entamoeba histolytica
LNDHDELTLMYSKTTFLRGTAMILKS

SEQ ID NO: 2719751 - protein, 23 aa, Entamoeba histolytica
LNDIAHLVPLKRLLIITNNKVTE

SEQ ID NO: 2719752 - protein, 25 aa, Entamoeba histolytica
LNDLYSNAITFYFTPTELVEQNQKR

SEQ ID NO: 2719753 - protein, 22 aa, Entamoeba histolytica
LNDPFLNCIILTGKSNEEFKCI

SEQ ID NO: 2719754 - protein, 17 aa, Entamoeba histolytica
LNDPVTFSCGHSFCLVC

SEQ ID NO: 2719755 - protein, 21 aa, Entamoeba histolytica
LNDPYSYFMINRINNPLISKN

SEQ ID NO: 2719756 - protein, 24 aa, Entamoeba histolytica
LNEDDMWMKLYGKDIFEGKCCSYN

SEQ ID NO: 2719757 - protein, 26 aa, Entamoeba histolytica
LNEDSYINFSPFWKKKDGTKIPEGTK

SEQ ID NO: 2719758 - protein, 27 aa, Entamoeba histolytica
LNEDSYINFSPFWKKKDGTKIPEGTKA

SEQ ID NO: 2719759 - protein, 18 aa, Entamoeba histolytica
LNEFKNMIEFYLKNSEEE

SEQ ID NO: 2719760 - protein, 21 aa, Entamoeba histolytica
LNEFQNIIEWYDGSKPEEFIP

SEQ ID NO: 2719761 - protein, 20 aa, Entamoeba histolytica
LNEISILRRVNHPCILGCLN

SEQ ID NO: 2719762 - protein, 21 aa, Entamoeba histolytica
LNEISILRRVNHPCILGCLNV

SEQ ID NO: 2719763 - protein, 17 aa, Entamoeba histolytica
LNELKRNLREAERNTRL

SEQ ID NO: 2719764 - protein, 26 aa, Entamoeba histolytica
LNELPIEFIGLYLLVKTILNIFNLTL

SEQ ID NO: 2719765 - protein, 24 aa, Entamoeba histolytica
LNEPDLLFVKSFDELIALCQKHKQ

SEQ ID NO: 2719766 - protein, 25 aa, Entamoeba histolytica
LNERGIDISLTFKLNSYGLVDISKS

SEQ ID NO: 2719767 - protein, 22 aa, Entamoeba histolytica
LNETITLPLKRSELFFSKLTQG

SEQ ID NO: 2719768 - protein, 23 aa, Entamoeba histolytica
LNEVFDALWNPEIPYVIGTSGDG

SEQ ID NO: 2719769 - protein, 18 aa, Entamoeba histolytica
LNFAKKGWKTIAALQLRN

SEQ ID NO: 2719770 - protein, 20 aa, Entamoeba histolytica
LNFIIHFMKNMLDQYFAILM

SEQ ID NO: 2719771 - protein, 27 aa, Entamoeba histolytica
LNFIQPTVLFHKMVPLLSGVTKFDIPS

SEQ ID NO: 2719772 - protein, 17 aa, Entamoeba histolytica
LNFSHFNISWLKITFIE

SEQ ID NO: 2719773 - protein, 25 aa, Entamoeba histolytica
LNGHNGWVWDITFSNNSEYLISAST

SEQ ID NO: 2719774 - protein, 26 aa, Entamoeba histolytica
LNHKKYLCTGFDLFTTHEPCLMCGMA

SEQ ID NO: 2719775 - protein, 37 aa, Entamoeba histolytica
LNHPNILKLFGFFEDKNRWFLVLEYCKKGELYRLLQQ

SEQ ID NO: 2719776 - protein, 49 aa, Entamoeba histolytica
LNHPNILKLFGLFEDKDRWFLVLEYCKKGELYGLLQQAGRFDERRAARY

SEQ ID NO: 2719777 - protein, 25 aa, Entamoeba histolytica
LNHQQLPMKIWLRHAQILHVCLNYK

SEQ ID NO: 2719778 - protein, 18 aa, Entamoeba histolytica
LNHSILVAYLAIISKQMN

SEQ ID NO: 2719779 - protein, 18 aa, Entamoeba histolytica
LNIAPLRPSFNNLNPLQQ

SEQ ID NO: 2719780 - protein, 20 aa, Entamoeba histolytica
LNICLWCSLPEHIQFYLKEI

SEQ ID NO: 2719781 - protein, 19 aa, Entamoeba histolytica
LNIDIFDSFYRILSISYSG

SEQ ID NO: 2719782 - protein, 27 aa, Entamoeba histolytica
LNIIEKYLKYKGYFYERLDGSIKSEDR

SEQ ID NO: 2719783 - protein, 28 aa, Entamoeba histolytica
LNINCGQALDFRLISMYVKTRTPTQVRS

SEQ ID NO: 2719784 - protein, 24 aa, Entamoeba histolytica
LNIRKNLLMPYISKLLITLQQINP

SEQ ID NO: 2719785 - protein, 19 aa, Entamoeba histolytica
LNIYLSLPQTQRIPQLLRF

SEQ ID NO: 2719786 - protein, 31 aa, Entamoeba histolytica
LNKDKHMHVPFPLILIWALNQWRKEKSQTGV

SEQ ID NO: 2719787 - protein, 26 aa, Entamoeba histolytica
LNKEDPMLLHLSYIQAHDNIVGGLYP

SEQ ID NO: 2719788 - protein, 24 aa, Entamoeba histolytica
LNKENLLLIYQTNLKSHLAGIFIK

SEQ ID NO: 2719789 - protein, 27 aa, Entamoeba histolytica
LNKFKEFPLITNLYLPYIISEDLFDTT

SEQ ID NO: 2719790 - protein, 25 aa, Entamoeba histolytica
LNKILVKPWIYRDIYDRARNSCFRG

SEQ ID NO: 2719791 - protein, 31 aa, Entamoeba histolytica
LNKKKMAIKNLRRRDDIAPYLKDLSDGNDKT

SEQ ID NO: 2719792 - protein, 21 aa, Entamoeba histolytica
LNKLWSTVKPLPGAMKILNYF

SEQ ID NO: 2719793 - protein, 20 aa, Entamoeba histolytica
LNKMLLCYGTDYLQEIPLET

SEQ ID NO: 2719794 - protein, 25 aa, Entamoeba histolytica
LNKSAIILWNQFQIPIKDLRGISIQ

SEQ ID NO: 2719795 - protein, 34 aa, Entamoeba histolytica
LNKSENDFILPITKLIISIITHPSFQHAFDSCIP

SEQ ID NO: 2719796 - protein, 25 aa, Entamoeba histolytica
LNKTTQLLGLLKRDIINVKSLYLRD

SEQ ID NO: 2719797 - protein, 21 aa, Entamoeba histolytica
LNLCLFETIFNWRQVNGLKHD

SEQ ID NO: 2719798 - protein, 18 aa, Entamoeba histolytica
LNLEFYYNSLLSNFSNFD

SEQ ID NO: 2719799 - protein, 32 aa, Entamoeba histolytica
LNLGDIHLKFIYQPFLHWPDTMITLIEEMNVL

SEQ ID NO: 2719800 - protein, 20 aa, Entamoeba histolytica
LNLHKRRFGSYGSIRFNYDG

SEQ ID NO: 2719801 - protein, 20 aa, Entamoeba histolytica
LNLIGCSRLILFDPDWNPAK

SEQ ID NO: 2719802 - protein, 19 aa, Entamoeba histolytica
LNLKKLMLYDFPSLLDNGL

SEQ ID NO: 2719803 - protein, 20 aa, Entamoeba histolytica
LNLLANEWISHFPVNIFNSS

SEQ ID NO: 2719804 - protein, 27 aa, Entamoeba histolytica
LNLQEMNLFFFPIHPSFPVLNGITKLD

SEQ ID NO: 2719805 - protein, 17 aa, Entamoeba histolytica
LNLSHAVGIALNYMHMR

SEQ ID NO: 2719806 - protein, 27 aa, Entamoeba histolytica
LNLWNEDLLLNHFPIEKDLPQSPSILL

SEQ ID NO: 2719807 - protein, 26 aa, Entamoeba histolytica
LNMLQPYFTHLYPSIQKGLFCLMHIL

SEQ ID NO: 2719808 - protein, 30 aa, Entamoeba histolytica
LNNEQPYLFIDNYFYLFKKEIIINDIENHV

SEQ ID NO: 2719809 - protein, 24 aa, Entamoeba histolytica
LNNGNMLIFFVNKQAILVNSKKKK

SEQ ID NO: 2719810 - protein, 17 aa, Entamoeba histolytica
LNNLLGPGNWEIMERID

SEQ ID NO: 2719811 - protein, 18 aa, Entamoeba histolytica
LNNLLRPGSWEVIERIES

SEQ ID NO: 2719812 - protein, 21 aa, Entamoeba histolytica
LNNLYNYWKFNKTQCIFIIDY

SEQ ID NO: 2719813 - protein, 17 aa, Entamoeba histolytica
LNNMLYSQLQKGIKFHS

SEQ ID NO: 2719814 - protein, 20 aa, Entamoeba histolytica
LNNMMLFKNIDYLEPYCICI

SEQ ID NO: 2719815 - protein, 21 aa, Entamoeba histolytica
LNNMSWSYNPKEDGLFEVIIF

SEQ ID NO: 2719816 - protein, 28 aa, Entamoeba histolytica
LNNPSFVVNSFLPISAYILAPVSHFSVY

SEQ ID NO: 2719817 - protein, 23 aa, Entamoeba histolytica
LNNPTFLPIIHSISSHISSCTPI

SEQ ID NO: 2719818 - protein, 24 aa, Entamoeba histolytica
LNNSRFLNQRFLLKMVIQAADAFK

SEQ ID NO: 2719819 - protein, 32 aa, Entamoeba histolytica
LNNSSLPIKSFPPNLQYLSLPSIKQLNQLEFP

SEQ ID NO: 2719820 - protein, 25 aa, Entamoeba histolytica
LNNTPIGLCWSFLFGEEGLQLNPKK

SEQ ID NO: 2719821 - protein, 28 aa, Entamoeba histolytica
LNNVIQPIIAKLLRSSFDWLKSIKDSQV

SEQ ID NO: 2719822 - protein, 48 aa, Entamoeba histolytica
LNNVQLLTGLRVYLSSFPKKEVIGFKKLEYIFLLRQCGAKIVKDKKES

SEQ ID NO: 2719823 - protein, 20 aa, Entamoeba histolytica
LNNYSFFDGKINAIAIVHLI

SEQ ID NO: 2719824 - protein, 17 aa, Entamoeba histolytica
LNPIKKESILSSEQIKL

SEQ ID NO: 2719825 - protein, 17 aa, Entamoeba histolytica
LNPIYTSDYTYQATIKQ

SEQ ID NO: 2719826 - protein, 25 aa, Entamoeba histolytica
LNPKDALDIVYIQYIIGTTSKFSNR

SEQ ID NO: 2719827 - protein, 26 aa, Entamoeba histolytica
LNPSDKFLQLFLLYVSKELTVDEEIQ

SEQ ID NO: 2719828 - protein, 20 aa, Entamoeba histolytica
LNPSLIIPYLPIITSEDLLP

SEQ ID NO: 2719829 - protein, 26 aa, Entamoeba histolytica
LNQEINQMKVLIINSIQKAKEEIMKK

SEQ ID NO: 2719830 - protein, 26 aa, Entamoeba histolytica
LNQIHRHELPVPYLLPIIYEDNDVIV

SEQ ID NO: 2719831 - protein, 26 aa, Entamoeba histolytica
LNQIPNRRFTLWWSPTINRGSVYVGF

SEQ ID NO: 2719832 - protein, 30 aa, Entamoeba histolytica
LNQIQTKFNFIILLKFLIVKEIIEDYKEEM

SEQ ID NO: 2719833 - protein, 21 aa, Entamoeba histolytica
LNQLCCSVILSYYNGIKEYKL

SEQ ID NO: 2719834 - protein, 17 aa, Entamoeba histolytica
LNQQFILQPIDPIKSEL

SEQ ID NO: 2719835 - protein, 32 aa, Entamoeba histolytica
LNQSQTHYFMDREKFNVLYNSQQSVIQQLKQN

SEQ ID NO: 2719836 - protein, 18 aa, Entamoeba histolytica
LNQVLMAFSPVELKMLTL

SEQ ID NO: 2719837 - protein, 19 aa, Entamoeba histolytica
LNRQFQKDGFLKTVVPKNM

SEQ ID NO: 2719838 - protein, 24 aa, Entamoeba histolytica
LNRYVKEEVYFPRMFMKIEDDCVR

SEQ ID NO: 2719839 - protein, 22 aa, Entamoeba histolytica
LNSAMIVCMILSRLSSTNLINK

SEQ ID NO: 2719840 - protein, 20 aa, Entamoeba histolytica
LNSELIEPLPRFAIGIAQTR

SEQ ID NO: 2719841 - protein, 26 aa, Entamoeba histolytica
LNSFKELLTQFFNIPCSFDPLTLNKQ

SEQ ID NO: 2719842 - protein, 29 aa, Entamoeba histolytica
LNSGDVFIIDKIDKIYVWIGKDSSRLKRT

SEQ ID NO: 2719843 - protein, 23 aa, Entamoeba histolytica
LNSILDMYATILRVLGQHPPKEP

SEQ ID NO: 2719844 - protein, 29 aa, Entamoeba histolytica
LNSIMYCMEQFIINIPVPRVFALIHKTFP

SEQ ID NO: 2719845 - protein, 22 aa, Entamoeba histolytica
LNSKFNVLFVKYINTTTNTEEI

SEQ ID NO: 2719846 - protein, 18 aa, Entamoeba histolytica
LNSKIMCDILDGSKRQIL

SEQ ID NO: 2719847 - protein, 26 aa, Entamoeba histolytica
LNSKNKRFMDLLKKLSLQKEVKNLNI

SEQ ID NO: 2719848 - protein, 24 aa, Entamoeba histolytica
LNSLEKAFYFKYLNDVRLEMKRIE

SEQ ID NO: 2719849 - protein, 26 aa, Entamoeba histolytica
LNSLMIHLCPSRFSHFLMTSYTPLRQ

SEQ ID NO: 2719850 - protein, 37 aa, Entamoeba histolytica
LNSMKELFFYDLPSTLFKYLLYPIIFKDSFAQQSIIL

SEQ ID NO: 2719851 - protein, 17 aa, Entamoeba histolytica
LNSSYTLPPQFYSNFNH

SEQ ID NO: 2719852 - protein, 23 aa, Entamoeba histolytica
LNSTFSRMLLFIDKTFAPVTQIE

SEQ ID NO: 2719853 - protein, 20 aa, Entamoeba histolytica
LNSVATFYPRLHIIHSFINS

SEQ ID NO: 2719854 - protein, 25 aa, Entamoeba histolytica
LNTAMRNCLIALRKAFADPANATDA

SEQ ID NO: 2719855 - protein, 17 aa, Entamoeba histolytica
LNTDILFGIIKRIIQER

SEQ ID NO: 2719856 - protein, 22 aa, Entamoeba histolytica
LNTIVFKLTAFGSRAGIFVKAI

SEQ ID NO: 2719857 - protein, 18 aa, Entamoeba histolytica
LNTLKKFFPAMETLYLVN

SEQ ID NO: 2719858 - protein, 18 aa, Entamoeba histolytica
LNTMLIPGLRELFIKYKQ

SEQ ID NO: 2719859 - protein, 19 aa, Entamoeba histolytica
LNTNLLVASTFRSFVNQFK

SEQ ID NO: 2719860 - protein, 17 aa, Entamoeba histolytica
LNTQTLNRVLSCRCDII

SEQ ID NO: 2719861 - protein, 24 aa, Entamoeba histolytica
LNTRKFLHTLFENVTFIFNNESGE

SEQ ID NO: 2719862 - protein, 27 aa, Entamoeba histolytica
LNTWVGGKLYLTNYRLIWRTSNESLGS

SEQ ID NO: 2719863 - protein, 24 aa, Entamoeba histolytica
LNVKLKVIDFFKEKYHGFEFSVQM

SEQ ID NO: 2719864 - protein, 26 aa, Entamoeba histolytica
LNVKPICITGYPVNIIKGFLGLLKDP

SEQ ID NO: 2719865 - protein, 21 aa, Entamoeba histolytica
LNVPDWLLKEIGTVQRLSNEE

SEQ ID NO: 2719866 - protein, 22 aa, Entamoeba histolytica
LNVPELYLNDLVIRSVLDLSGL

SEQ ID NO: 2719867 - protein, 28 aa, Entamoeba histolytica
LNVPPPPPNLNVPPPPPPTLNTTSPNPK

SEQ ID NO: 2719868 - protein, 23 aa, Entamoeba histolytica
LNVTQILKRLWKGVWKVVCGIIK

SEQ ID NO: 2719869 - protein, 25 aa, Entamoeba histolytica
LNVVDFWEGYGSGLLPKIILVVIEE

SEQ ID NO: 2719870 - protein, 33 aa, Entamoeba histolytica
LNVWDRIFAYPERKLYYFICSAIILKNGDQIVE

SEQ ID NO: 2719871 - protein, 17 aa, Entamoeba histolytica
LNVYPQQPLQPSAPKRM

SEQ ID NO: 2719872 - protein, 28 aa, Entamoeba histolytica
LNYGEQTLPPIYWKYSFEEGIWSDQIPL

SEQ ID NO: 2719873 - protein, 28 aa, Entamoeba histolytica
LNYHNGPEWIWPYGYYVMAMLMYNPDNL

SEQ ID NO: 2719874 - protein, 20 aa, Entamoeba histolytica
LNYIKLPTSIISLKLYNPPS

SEQ ID NO: 2719875 - protein, 19 aa, Entamoeba histolytica
LNYMEICYYLKELLKALDY

SEQ ID NO: 2719876 - protein, 18 aa, Entamoeba histolytica
LNYTNDWIDGRMIKLILG

SEQ ID NO: 2719877 - protein, 29 aa, Entamoeba histolytica
LPAALVSRFDLLFVLLDDATQDFDKELAL

SEQ ID NO: 2719878 - protein, 20 aa, Entamoeba histolytica
LPAFHPFSINLLQLNQKNKL

SEQ ID NO: 2719879 - protein, 25 aa, Entamoeba histolytica
LPAKEYHYLFISLNEKEFRYDLSST

SEQ ID NO: 2719880 - protein, 30 aa, Entamoeba histolytica; identical to SEQ ID NO: 2532475

SEQ ID NO: 2719881 - protein, 18 aa, Entamoeba histolytica
LPCHCCCYRCLSCFRIML

SEQ ID NO: 2719882 - protein, 35 aa, Entamoeba histolytica
LPCLNGLPPIPTSILPLFEMIGIDGVLAVWLALLE

SEQ ID NO: 2719883 - protein, 19 aa, Entamoeba histolytica
LPCRIGTDSFKYAVRPYPI

SEQ ID NO: 2719884 - protein, 26 aa, Entamoeba histolytica
LPCRQILNHLKLLPEASPFLTPVDPI

SEQ ID NO: 2719885 - protein, 23 aa, Entamoeba histolytica
LPDNHINLFHFIRDGKIEEIKKM

SEQ ID NO: 2719886 - protein, 29 aa, Entamoeba histolytica
LPDTNKYTLWYLCDFLVDVLNHQSVNQMG

SEQ ID NO: 2719887 - protein, 23 aa, Entamoeba histolytica
LPEKKPFIKPKEGIVFIVDCHSY

SEQ ID NO: 2719888 - protein, 28 aa, Entamoeba histolytica
LPEKLKNKLWYSNIYCGIIRGSLEMLKY

SEQ ID NO: 2719889 - protein, 28 aa, Entamoeba histolytica
LPEKQFVAFEKVKWWLDDKALDGNFVLL

SEQ ID NO: 2719890 - protein, 30 aa, Entamoeba histolytica
LPENYNLQLYYYHLILYPTSFVAVTPDNKV

SEQ ID NO: 2719891 - protein, 26 aa, Entamoeba histolytica
LPERFDALRFTILAHLLSSSKIDIFQ

SEQ ID NO: 2719892 - protein, 23 aa, Entamoeba histolytica
LPETLVFHLKRFVYNDQFEIVKY

SEQ ID NO: 2719893 - protein, 18 aa, Entamoeba histolytica
LPEYLICPSLSLDQWYII

SEQ ID NO: 2719894 - protein, 19 aa, Entamoeba histolytica
LPFERRGYFTLPGISQKSI

SEQ ID NO: 2719895 - protein, 25 aa, Entamoeba histolytica
LPFKYGFIEPWYSKNFIFESCSIEA

SEQ ID NO: 2719896 - protein, 17 aa, Entamoeba histolytica
LPGIYEITTLQKEIIST

SEQ ID NO: 2719897 - protein, 23 aa, Entamoeba histolytica
LPGKYSWLKYAEKIYNVLFETED

SEQ ID NO: 2719898 - protein, 19 aa, Entamoeba histolytica
LPGLIRHAALNYSRPVYLA

SEQ ID NO: 2719899 - protein, 26 aa, Entamoeba histolytica
LPGSYKLWYHYLQTILINARKSGIDT

SEQ ID NO: 2719900 - protein, 18 aa, Entamoeba histolytica
LPHNSFSLNVIRDEKRRN

SEQ ID NO: 2719901 - protein, 19 aa, Entamoeba histolytica
LPHSLFKMICVFNIDSIFS

SEQ ID NO: 2719902 - protein, 23 aa, Entamoeba histolytica
LPIAENICALLFPSFSKTITLSC

SEQ ID NO: 2719903 - protein, 24 aa, Entamoeba histolytica
LPIAENICALLFPSFSKTITLSCV

SEQ ID NO: 2719904 - protein, 18 aa, Entamoeba histolytica
LPIRMQIHMENGLKVAKF

SEQ ID NO: 2719905 - protein, 28 aa, Entamoeba histolytica
LPKASLNELFSKMFPHTTDLVIGTLLNS

SEQ ID NO: 2719906 - protein, 35 aa, Entamoeba histolytica
LPKGTLYELFCSYCLPFLFYKQTILVNRDLLMKHT

SEQ ID NO: 2719907 - protein, 20 aa, Entamoeba histolytica
LPKIIDMLLIHEVIPNVKQI

SEQ ID NO: 2719908 - protein, 22 aa, Entamoeba histolytica
LPKPLICNPNTPRLLLSTSGST

SEQ ID NO: 2719909 - protein, 27 aa, Entamoeba histolytica
LPKRERFRLIRRINLRYRFSLGTELDT

SEQ ID NO: 2719910 - protein, 35 aa, Entamoeba histolytica
LPLCINSFQYLTSLRFLLHYFKFSNTIVNSSQSSD

SEQ ID NO: 2719911 - protein, 17 aa, Entamoeba histolytica
LPLFYSESSIKPIFLRK

SEQ ID NO: 2719912 - protein, 17 aa, Entamoeba histolytica
LPLILTTKLTQLKQFIS

SEQ ID NO: 2719913 - protein, 18 aa, Entamoeba histolytica
LPLLLDSIQPQYYLPLCV

SEQ ID NO: 2719914 - protein, 21 aa, Entamoeba histolytica
LPLPVQLSPCKALFIDSCINS

SEQ ID NO: 2719915 - protein, 25 aa, Entamoeba histolytica
LPLQTTYSLIQLKLLYFEGSTEHDK

SEQ ID NO: 2719916 - protein, 20 aa, Entamoeba histolytica
LPMHQSFFVFEFCVYAIQFG

SEQ ID NO: 2719917 - protein, 31 aa, Entamoeba histolytica
LPNCSPLLQTLFKMMFIRNPVQRADIFQVLG

SEQ ID NO: 2719918 - protein, 25 aa, Entamoeba histolytica
LPNENYSLFFYITVLIRQIVESINN

SEQ ID NO: 2719919 - protein, 19 aa, Entamoeba histolytica
LPNIILSFNFQQLLTFIGL

SEQ ID NO: 2719920 - protein, 18 aa, Entamoeba histolytica
LPNMMLLCDFSIPILFTT

SEQ ID NO: 2719921 - protein, 19 aa, Entamoeba histolytica
LPNNLSHQTIPPNEKVIDN

SEQ ID NO: 2719922 - protein, 19 aa, Entamoeba histolytica
LPNYFMPIFTLDDLRKYFG

SEQ ID NO: 2719923 - protein, 34 aa, Entamoeba histolytica
LPPGTYEFPFSFILPHDLPPASYFGPKGLRARYV

SEQ ID NO: 2719924 - protein, 20 aa, Entamoeba histolytica
LPPKKVLTGAPPLPKHPQKN

SEQ ID NO: 2719925 - protein, 35 aa, Entamoeba histolytica
LPPKMEIKIFVQLTPFQKIWYRKVLMGDVTVIIGD

SEQ ID NO: 2719926 - protein, 22 aa, Entamoeba histolytica
LPPQFYSNFNHSFPIPHHQIKA

SEQ ID NO: 2719927 - protein, 25 aa, Entamoeba histolytica
LPQEHQPIISLNLDQLVRPNYESDE

SEQ ID NO: 2719928 - protein, 26 aa, Entamoeba histolytica
LPQNQRIPQLLRIISSLSPQENALIS

SEQ ID NO: 2719929 - protein, 25 aa, Entamoeba histolytica
LPQNTNELFLYKNFAKFGAIEQCNC

SEQ ID NO: 2719930 - protein, 17 aa, Entamoeba histolytica
LPQSFQYISLEQLIGTD

SEQ ID NO: 2719931 - protein, 25 aa, Entamoeba histolytica
LPQTYLNSIVLLLNNVREILNEIGN

SEQ ID NO: 2719932 - protein, 18 aa, Entamoeba histolytica
LPSFNILPKKMSHDQKRF

SEQ ID NO: 2719933 - protein, 17 aa, Entamoeba histolytica
LPSIYYKSYIAANQDDR

SEQ ID NO: 2719934 - protein, 25 aa, Entamoeba histolytica
LPSKRHCRSVPFIPLNTIFINDEEI

SEQ ID NO: 2719935 - protein, 17 aa, Entamoeba histolytica
LPSLLQLLLPHTVLTDR

SEQ ID NO: 2719936 - protein, 17 aa, Entamoeba histolytica
LPSQINIPSLKTLDLSS

SEQ ID NO: 2719937 - protein, 18 aa, Entamoeba histolytica
LPSTLTFLEIRNTPLKAS

SEQ ID NO: 2719938 - protein, 28 aa, Entamoeba histolytica
LPTEIFFSFGKIFTLNKIKRIITERGIT

SEQ ID NO: 2719939 - protein, 18 aa, Entamoeba histolytica
LPTTFPITLSQPNLQSFP

SEQ ID NO: 2719940 - protein, 34 aa, Entamoeba histolytica
LPVDESILMRVENIRNYIFDRFVFSTTGNDTNKI

SEQ ID NO: 2719941 - protein, 28 aa, Entamoeba histolytica
LPVEHLTLFKYIMKLSYKISAYEDINLM

SEQ ID NO: 2719942 - protein, 17 aa, Entamoeba histolytica
LPVIISKGILKTLEVEV

SEQ ID NO: 2719943 - protein, 18 aa, Entamoeba histolytica
LPVQFCLPKVFKLTNMIT

SEQ ID NO: 2719944 - protein, 17 aa, Entamoeba histolytica
LPVVDFNGKILYEKKDK

SEQ ID NO: 2719945 - protein, 18 aa, Entamoeba histolytica
LPYFFHLVSQFNNGMNYL

SEQ ID NO: 2719946 - protein, 26 aa, Entamoeba histolytica
LPYHRRREIFLQLFKESKLSEEHLSG

SEQ ID NO: 2719947 - protein, 25 aa, Entamoeba histolytica
LPYRSLYNCFYLQSIVLPQELIFIR

SEQ ID NO: 2719948 - protein, 19 aa, Entamoeba histolytica
LPYWLYEMTQLKDLNLSTN

SEQ ID NO: 2719949 - protein, 18 aa, Entamoeba histolytica
LQADIERLWLINEEKRLL

SEQ ID NO: 2719950 - protein, 22 aa, Entamoeba histolytica
LQAISIAQYYKTDWPLLVICPS

SEQ ID NO: 2719951 - protein, 17 aa, Entamoeba histolytica
LQALYNDWTFFFNESSL

SEQ ID NO: 2719952 - protein, 25 aa, Entamoeba histolytica
LQCHDPPLFAIPKIFFCDIHTPKKE

SEQ ID NO: 2719953 - protein, 21 aa, Entamoeba histolytica
LQCIGYDGKIFYVNCKTKILT

SEQ ID NO: 2719954 - protein, 19 aa, Entamoeba histolytica
LQCIRKWKSWKITELGLTS

SEQ ID NO: 2719955 - protein, 19 aa, Entamoeba histolytica
LQCVLLTFLSKKCDIVIGR

SEQ ID NO: 2719956 - protein, 25 aa, Entamoeba histolytica
LQCVSNLLGIPREVPVIIPPSELID

SEQ ID NO: 2719957 - protein, 26 aa, Entamoeba histolytica
LQDALKLNAILILPPVYCINDIDLTK

SEQ ID NO: 2719958 - protein, 35 aa, Entamoeba histolytica
LQDQRIIVVTFGNKLYFWAKLEVRLTEIIKLLKTM

SEQ ID NO: 2719959 - protein, 22 aa, Entamoeba histolytica
LQEGDIIIAFGGYKLKSGDMPL

SEQ ID NO: 2719960 - protein, 18 aa, Entamoeba histolytica
LQEQFSLVVYFSYFMNYA

SEQ ID NO: 2719961 - protein, 25 aa, Entamoeba histolytica
LQEQSAIEFLRHKTIQYLEKKEKER

SEQ ID NO: 2719962 - protein, 25 aa, Entamoeba histolytica
LQEWSGLLNCEILFDSDNDDAESDN

SEQ ID NO: 2719963 - protein, 19 aa, Entamoeba histolytica
LQEYYPLIIKKFNDEYIFL

SEQ ID NO: 2719964 - protein, 30 aa, Entamoeba histolytica
LQFESTPLYPIPSFVLSPLTGRIKLYNVGL

SEQ ID NO: 2719965 - protein, 23 aa, Entamoeba histolytica
LQFGEDIIDLPLQILETKQTEKS

SEQ ID NO: 2719966 - protein, 26 aa, Entamoeba histolytica
LQFISGNRIFLNEPILLSIRTPENIK

SEQ ID NO: 2719967 - protein, 19 aa, Entamoeba histolytica
LQFKFELFKMLYREMTMGL

SEQ ID NO: 2719968 - protein, 23 aa, Entamoeba histolytica
LQGIILTIEFTNCKFTDNIKQVI

SEQ ID NO: 2719969 - protein, 23 aa, Entamoeba histolytica
LQGKTILDILMIAAKRGIKIYVL

SEQ ID NO: 2719970 - protein, 24 aa, Entamoeba histolytica
LQGLNGFRKLLLGTQPPLIEIYQS

SEQ ID NO: 2719971 - protein, 21 aa, Entamoeba histolytica
LQHGALLLMVSLLRNCKEYMK

SEQ ID NO: 2719972 - protein, 27 aa, Entamoeba histolytica
LQHVNHPFIVQLYYAFQTPEKLYMVME

SEQ ID NO: 2719973 - protein, 18 aa, Entamoeba histolytica
LQIAHHKYKAALLKAQTE

SEQ ID NO: 2719974 - protein, 25 aa, Entamoeba histolytica
LQIKTKVIFIIDWLHKEDIEEVNDL

SEQ ID NO: 2719975 - protein, 20 aa, Entamoeba histolytica
LQILRIMFTMLKNAELDIRM

SEQ ID NO: 2719976 - protein, 26 aa, Entamoeba histolytica
LQINGIFPLKDTIDAIGFYNLPTSVT

SEQ ID NO: 2719977 - protein, 19 aa, Entamoeba histolytica
LQIVDGRDPLFYYSTDLVK

SEQ ID NO: 2719978 - protein, 18 aa, Entamoeba histolytica
LQIVHAHPFIILKSSSLF

SEQ ID NO: 2719979 - protein, 18 aa, Entamoeba histolytica
LQIYYKNVFIFNHETIIK

SEQ ID NO: 2719980 - protein, 17 aa, Entamoeba histolytica
LQKKFAPQKTFKKQICE

SEQ ID NO: 2719981 - protein, 17 aa, Entamoeba histolytica
LQKKIGELLFDLKKEEE

SEQ ID NO: 2719982 - protein, 19 aa, Entamoeba histolytica
LQKPQALHLTLTTLSICTE

SEQ ID NO: 2719983 - protein, 26 aa, Entamoeba histolytica
LQKRDKIEYFIFNRLLFNKCKIETKD

SEQ ID NO: 2719984 - protein, 22 aa, Entamoeba histolytica
LQKRLMPFDYEKITLLEVCIIS

SEQ ID NO: 2719985 - protein, 20 aa, Entamoeba histolytica
LQKVKFIFWDDLNEKYCEKF

SEQ ID NO: 2719986 - protein, 18 aa, Entamoeba histolytica
LQKVLYVNLVMEYNKEVC

SEQ ID NO: 2719987 - protein, 17 aa, Entamoeba histolytica
LQKYQDLTSLRVLLQKA

SEQ ID NO: 2719988 - protein, 21 aa, Entamoeba histolytica
LQKYVELRLAEREKELISHTV

SEQ ID NO: 2719989 - protein, 19 aa, Entamoeba histolytica
LQLHFTSVPSNCLDSLRSL

SEQ ID NO: 2719990 - protein, 38 aa, Entamoeba histolytica
LQLKYNIICERPYKFKIKSLPFFKVKTLYNVYESIDVQ

SEQ ID NO: 2719991 - protein, 17 aa, Entamoeba histolytica
LQLLLHIKSTEPKTLLH

SEQ ID NO: 2719992 - protein, 18 aa, Entamoeba histolytica
LQLLLKKPKEKSITISQS

SEQ ID NO: 2719993 - protein, 24 aa, Entamoeba histolytica
LQLLPLCIDGFLWSRKSMADDVAK

SEQ ID NO: 2719994 - protein, 17 aa, Entamoeba histolytica
LQLLRTLSSIPLDQFVF

SEQ ID NO: 2719995 - protein, 31 aa, Entamoeba histolytica; identical to SEQ ID NO: 2532604

SEQ ID NO: 2719996 - protein, 21 aa, Entamoeba histolytica
LQLPIEVWTGKYTCFNVIMDC

SEQ ID NO: 2719997 - protein, 17 aa, Entamoeba histolytica
LQLPYLGINCGNVGYLI

SEQ ID NO: 2719998 - protein, 18 aa, Entamoeba histolytica
LQMKHLMKELLQEKLQHF

SEQ ID NO: 2719999 - protein, 19 aa, Entamoeba histolytica
LQMKVHIHPAFRWGNDLGT

SEQ ID NO: 2720000 - protein, 19 aa, Entamoeba histolytica
LQMLKKAMPIIFEAGTLLR

SEQ ID NO: 2720001 - protein, 20 aa, Entamoeba histolytica
LQMLQLMNNIWKSAGLDLRM

SEQ ID NO: 2720002 - protein, 19 aa, Entamoeba histolytica
LQMQSKMGGIPWKTEIDSS

SEQ ID NO: 2720003 - protein, 19 aa, Entamoeba histolytica
LQNDFLKVSLQMVYEKYDE

SEQ ID NO: 2720004 - protein, 25 aa, Entamoeba histolytica
LQNFKRPMPLLEIIKQPFNSKSLIE

SEQ ID NO: 2720005 - protein, 24 aa, Entamoeba histolytica
LQNFLNAITFPDHTMYPIATTNEI

SEQ ID NO: 2720006 - protein, 24 aa, Entamoeba histolytica
LQNKFFTHNLVFSHSLVTNVLFDD

SEQ ID NO: 2720007 - protein, 20 aa, Entamoeba histolytica
LQNLPLLKRSISWHTGSILT

SEQ ID NO: 2720008 - protein, 24 aa, Entamoeba histolytica
LQNYDDRFNLFLTNAIQHINENDK

SEQ ID NO: 2720009 - protein, 20 aa, Entamoeba histolytica
LQPGFLWMECPTIKPRTFDS

SEQ ID NO: 2720010 - protein, 31 aa, Entamoeba histolytica
LQPHQITGLDFGVLLPVVEWLMTKVEEARTI

SEQ ID NO: 2720011 - protein, 19 aa, Entamoeba histolytica
LQPLHVYVCQNHLDEIIKL

SEQ ID NO: 2720012 - protein, 27 aa, Entamoeba histolytica
LQPQGIYYFQPIFSRTYFSIAVTPINE

SEQ ID NO: 2720013 - protein, 18 aa, Entamoeba histolytica
LQPQVAPPPPPPASHSNA

SEQ ID NO: 2720014 - protein, 25 aa, Entamoeba histolytica
LQPVHRSMFSPIALPNQNEILHGSR

SEQ ID NO: 2720015 - protein, 25 aa, Entamoeba histolytica
LQQAQEELLRMRRARYGNAKKPIPS

SEQ ID NO: 2720016 - protein, 19 aa, Entamoeba histolytica
LQQCGSLGVLLLVIKNLLD

SEQ ID NO: 2720017 - protein, 19 aa, Entamoeba histolytica
LQQDTFLPAIESGTIILIG

SEQ ID NO: 2720018 - protein, 19 aa, Entamoeba histolytica
LQQFIDKCKLLYPKGNIEG

SEQ ID NO: 2720019 - protein, 21 aa, Entamoeba histolytica
LQQFLTLPEGPKLMKFVIIHS

SEQ ID NO: 2720020 - protein, 21 aa, Entamoeba histolytica
LQQGIVKGGLLYLLNHFVNDS

SEQ ID NO: 2720021 - protein, 20 aa, Entamoeba histolytica
LQQPALRRYCFESYITINGI

SEQ ID NO: 2720022 - protein, 29 aa, Entamoeba histolytica
LQQTLENLGFWPSILLHVVIKSVGEKKEP

SEQ ID NO: 2720023 - protein, 34 aa, Entamoeba histolytica
LQQTSNFMIMRGMKLFYFIINSSFPFGKKLIEQI

SEQ ID NO: 2720024 - protein, 31 aa, Entamoeba histolytica
LQRFPTLRTRSQIMWLFCSLVRRSENKQIDS

SEQ ID NO: 2720025 - protein, 20 aa, Entamoeba histolytica
LQRHGPQILLVPGRPSINQL

SEQ ID NO: 2720026 - protein, 18 aa, Entamoeba histolytica
LQSILKRCGKIDIQVLKK

SEQ ID NO: 2720027 - protein, 21 aa, Entamoeba histolytica
LQSLVDLQDNLRKRTKELSKT

SEQ ID NO: 2720028 - protein, 24 aa, Entamoeba histolytica
LQSRLKILTAENEKLRKAGAGARL

SEQ ID NO: 2720029 - protein, 26 aa, Entamoeba histolytica
LQSVKPIVLFWALRITSILLCSSADE

SEQ ID NO: 2720030 - protein, 26 aa, Entamoeba histolytica
LQSVVLPSSLFFLSSSFAFCTSLTSI

SEQ ID NO: 2720031 - protein, 24 aa, Entamoeba histolytica
LQSYLRGLLVRNKYKAKLLIKRKR

SEQ ID NO: 2720032 - protein, 28 aa, Entamoeba histolytica
LQTFFAAFNMKLFPRIMIYFGQTDNETR

SEQ ID NO: 2720033 - protein, 33 aa, Entamoeba histolytica
LQTGKSINKRKLTLAPKPVSMPKLTLAANEVQN

SEQ ID NO: 2720034 - protein, 25 aa, Entamoeba histolytica
LQTGMKSYFELLDTSNTKRVEEKYS

SEQ ID NO: 2720035 - protein, 17 aa, Entamoeba histolytica
LQTKLFNITHIYFNALI

SEQ ID NO: 2720036 - protein, 28 aa, Entamoeba histolytica
LQTLDTPFIVFPLLDILEVYENMKADFT

SEQ ID NO: 2720037 - protein, 24 aa, Entamoeba histolytica
LQTPSLFRCYRYSSSRLISHSYEV

SEQ ID NO: 2720038 - protein, 30 aa, Entamoeba histolytica
LQTQDLLSLDRQWLITFGSNIKNLLSMTDT

SEQ ID NO: 2720039 - protein, 39 aa, Entamoeba histolytica
LQVARFVKYLWTQQIKPLDALMLLGYRCPYRAVRAYCVS

SEQ ID NO: 2720040 - protein, 31 aa, Entamoeba histolytica
LQVGEYHLKFLIQPFLHWPDTMMTVIEELKI

SEQ ID NO: 2720041 - protein, 22 aa, Entamoeba histolytica
LQVNLNCFIPMLKSILQEPIEE

SEQ ID NO: 2720042 - protein, 18 aa, Entamoeba histolytica
LQWILVRCHYPEITLIKK

SEQ ID NO: 2720043 - protein, 21 aa, Entamoeba histolytica
LQYFPPDVIIQDWYQLSNFGN

SEQ ID NO: 2720044 - protein, 31 aa, Entamoeba histolytica
LQYILNKKKFCFPLNGRWWNFTIVKNTIQGR

SEQ ID NO: 2720045 - protein, 17 aa, Entamoeba histolytica
LQYIPPEKIINSSNQCI

SEQ ID NO: 2720046 - protein, 17 aa, Entamoeba histolytica
LQYWLNDCQIEELPENE

SEQ ID NO: 2720047 - protein, 18 aa, Entamoeba histolytica
LRCDPQDHYFLLTEPPMN

SEQ ID NO: 2720048 - protein, 18 aa, Entamoeba histolytica
LRCNGVLEGIRITRMGYP

SEQ ID NO: 2720049 - protein, 19 aa, Entamoeba histolytica
LRDMRNLNNPVWELAAHEK

SEQ ID NO: 2720050 - protein, 18 aa, Entamoeba histolytica
LRDMVYEYASPSNALILA

SEQ ID NO: 2720051 - protein, 20 aa, Entamoeba histolytica
LRDVSWKYYQYLNQLSGRVT

SEQ ID NO: 2720052 - protein, 20 aa, Entamoeba histolytica
LREEDALLAWVRQTTEGYAG

SEQ ID NO: 2720053 - protein, 21 aa, Entamoeba histolytica
LREELKFYYSLYQTCIPMINK

SEQ ID NO: 2720054 - protein, 18 aa, Entamoeba histolytica
LRELSDCLIPMQFYQQYV

SEQ ID NO: 2720055 - protein, 29 aa, Entamoeba histolytica
LREPYSIVRFFLERLPLDKIYSIELTPNM

SEQ ID NO: 2720056 - protein, 23 aa, Entamoeba histolytica
LRERALKLLCRFLDLGPWACDQA

SEQ ID NO: 2720057 - protein, 20 aa, Entamoeba histolytica
LREYDYLITVPKIEEGMVLD

SEQ ID NO: 2720058 - protein, 27 aa, Entamoeba histolytica
LRFEQMVKCFLKFVDVFKLYSSFVNNY

SEQ ID NO: 2720059 - protein, 22 aa, Entamoeba histolytica
LRFGARIFSLFPEASKAKVASV

SEQ ID NO: 2720060 - protein, 18 aa, Entamoeba histolytica
LRGDINILMLGDPGTSKS

SEQ ID NO: 2720061 - protein, 24 aa, Entamoeba histolytica
LRGFKHFYAFCRQYKMLGKEDVVP

SEQ ID NO: 2720062 - protein, 22 aa, Entamoeba histolytica
LRGIITAIRFVICSSAQYDISS

SEQ ID NO: 2720063 - protein, 18 aa, Entamoeba histolytica
LRGRGVELLYLYIKNNFI

SEQ ID NO: 2720064 - protein, 28 aa, Entamoeba histolytica
LRHKYQLKHMLYIKFLENPELLDKIEKA

SEQ ID NO: 2720065 - protein, 31 aa, Entamoeba histolytica
LRHPQLFKNIGIKPPRGILLYGPPGCGKTMI

SEQ ID NO: 2720066 - protein, 21 aa, Entamoeba histolytica
LRHPQLFQAIGIKPPKGVLLY

SEQ ID NO: 2720067 - protein, 19 aa, Entamoeba histolytica
LRIEEQCKVLKSYVDKFND

SEQ ID NO: 2720068 - protein, 27 aa, Entamoeba histolytica
LRIGKKLIRYGFAPRISFLTSRTVQLE

SEQ ID NO: 2720069 - protein, 17 aa, Entamoeba histolytica
LRIIVPVKENVIVDSCE

SEQ ID NO: 2720070 - protein, 17 aa, Entamoeba histolytica
LRIMLMEASVNISNIEK

SEQ ID NO: 2720071 - protein, 20 aa, Entamoeba histolytica
LRIVETIITIIRWIQIENNE

SEQ ID NO: 2720072 - protein, 25 aa, Entamoeba histolytica
LRKGEYYRFYQFDSLVSFIDESRKE

SEQ ID NO: 2720073 - protein, 21 aa, Entamoeba histolytica
LRKMFEQMRVTKVFINIFVED

SEQ ID NO: 2720074 - protein, 28 aa, Entamoeba histolytica
LRKMHDTHLFLFKAMRKYVSLKSCPNPL

SEQ ID NO: 2720075 - protein, 32 aa, Entamoeba histolytica
LRKRLNQLAIKYKHLYLTNTQILLGIRISRCK

SEQ ID NO: 2720076 - protein, 33 aa, Entamoeba histolytica
LRKRLNQLAIKYKHLYLTNTQILLGIRISRCKI

SEQ ID NO: 2720077 - protein, 39 aa, Entamoeba histolytica
LRKRLNQLAIKYKHLYLTNTQILLGIRISRCKILVDNRK

SEQ ID NO: 2720078 - protein, 31 aa, Entamoeba histolytica
LRKRLNQLAIKYKHLYLTNTQILLGITVSRC

SEQ ID NO: 2720079 - protein, 25 aa, Entamoeba histolytica
LRKRSVKFIQLFAKTIKDLLNGKCG

SEQ ID NO: 2720080 - protein, 26 aa, Entamoeba histolytica
LRKSTILDLAKYFKQVYVWQGGDDIN

SEQ ID NO: 2720081 - protein, 18 aa, Entamoeba histolytica
LRKTDMIHFLKYLQYWKQ

SEQ ID NO: 2720082 - protein, 26 aa, Entamoeba histolytica
LRLEEMLLQAVLFNDIRLLEAVNDDN

SEQ ID NO: 2720083 - protein, 17 aa, Entamoeba histolytica
LRLKDMEHQLFEEKINV

SEQ ID NO: 2720084 - protein, 20 aa, Entamoeba histolytica
LRLKQEYFFSSATILDVMRR

SEQ ID NO: 2720085 - protein, 21 aa, Entamoeba histolytica
LRLLSQQFFDMSKYSIIKVIG

SEQ ID NO: 2720086 - protein, 24 aa, Entamoeba histolytica
LRLPQMYNLCNYYIGFNAWSTEII

SEQ ID NO: 2720087 - protein, 26 aa, Entamoeba histolytica
LRMAAFFHEPITFSALLPYAEELDCS

SEQ ID NO: 2720088 - protein, 24 aa, Entamoeba histolytica
LRMRNKVFLPIQTKIKIPYQYFLP

SEQ ID NO: 2720089 - protein, 17 aa, Entamoeba histolytica
LRMYINNNYYLNSKQRD

SEQ ID NO: 2720090 - protein, 18 aa, Entamoeba histolytica
LRNAMNNNITFFSQDSGS

SEQ ID NO: 2720091 - protein, 22 aa, Entamoeba histolytica
LRNIVFYFINTKTIKTFCFISK

SEQ ID NO: 2720092 - protein, 29 aa, Entamoeba histolytica
LRNKNIIGHQFFWFLKAEMHDNRVTERYG

SEQ ID NO: 2720093 - protein, 29 aa, Entamoeba histolytica
LRNKNRIGHQFFWFLKAELHDNRVTERYG

SEQ ID NO: 2720094 - protein, 24 aa, Entamoeba histolytica
LRNPFLIQCYGMVYYSATVHIIME

SEQ ID NO: 2720095 - protein, 20 aa, Entamoeba histolytica
LRNRKSCQFIPKKLSEDQQR

SEQ ID NO: 2720096 - protein, 30 aa, Entamoeba histolytica; identical to SEQ ID NO: 2532697

SEQ ID NO: 2720097 - protein, 17 aa, Entamoeba histolytica
LRNYILDCVKSILPSST

SEQ ID NO: 2720098 - protein, 27 aa, Entamoeba histolytica
LRPHINSSIYPIYIARALTVGSENSLI

SEQ ID NO: 2720099 - protein, 25 aa, Entamoeba histolytica
LRPIQALHHPFITREIFNGSFEVPR

SEQ ID NO: 2720100 - protein, 27 aa, Entamoeba histolytica
LRPKAWQILLGYLPPNQFEWGLEIQQK

SEQ ID NO: 2720101 - protein, 17 aa, Entamoeba histolytica
LRPSFDNFLKFISGVSD

SEQ ID NO: 2720102 - protein, 19 aa, Entamoeba histolytica
LRPTSETIIYPAFKNWISG

SEQ ID NO: 2720103 - protein, 32 aa, Entamoeba histolytica
LRQDCLILRAFKLFDNLWRMNGMDWRMTTFRV

SEQ ID NO: 2720104 - protein, 17 aa, Entamoeba histolytica
LRQLEIESFLSPIPSQP

SEQ ID NO: 2720105 - protein, 27 aa, Entamoeba histolytica
LRQTLGTLPLFLPYLTPQQQTHLYHET

SEQ ID NO: 2720106 - protein, 17 aa, Entamoeba histolytica
LRQYPTYKKLYAMQEKI

SEQ ID NO: 2720107 - protein, 20 aa, Entamoeba histolytica
LRRIKYWDNIFVDFVEQCFI

SEQ ID NO: 2720108 - protein, 19 aa, Entamoeba histolytica
LRRRPIYALTLDISLTYKN

SEQ ID NO: 2720109 - protein, 18 aa, Entamoeba histolytica
LRRYCFESYITINGISST

SEQ ID NO: 2720110 - protein, 27 aa, Entamoeba histolytica
LRSCFHFPGRYYLVQTLACEESGIGGY

SEQ ID NO: 2720111 - protein, 23 aa, Entamoeba histolytica
LRSFFVNYIKLLKVNYLSLQEIQ

SEQ ID NO: 2720112 - protein, 25 aa, Entamoeba histolytica
LRSFILSDDLIWQNFYNLYFSISSF

SEQ ID NO: 2720113 - protein, 18 aa, Entamoeba histolytica
LRSRLNQLAIKYKHLYLT

SEQ ID NO: 2720114 - protein, 17 aa, Entamoeba histolytica
LRTACERAKRTLSSAAT

SEQ ID NO: 2720115 - protein, 29 aa, Entamoeba histolytica
LRTTLITLFVYIQTKHLFKPTWKISCELI

SEQ ID NO: 2720116 - protein, 30 aa, Entamoeba histolytica
LRTTLITLFVYIQTKHLFKPTWKISCELIV

SEQ ID NO: 2720117 - protein, 21 aa, Entamoeba histolytica
LRVACLKSGWRYPVPFFRSIQ

SEQ ID NO: 2720118 - protein, 25 aa, Entamoeba histolytica
LRYANPYSFIPKNTYKLSITGQLPL

SEQ ID NO: 2720119 - protein, 18 aa, Entamoeba histolytica
LRYCSQHITPSFAESLFP

SEQ ID NO: 2720120 - protein, 21 aa, Entamoeba histolytica
LRYSIQLISLAMLKAKKRGAE

SEQ ID NO: 2720121 - protein, 25 aa, Entamoeba histolytica
LSAKQSFWMKRVAYLAAQICLHESD

SEQ ID NO: 2720122 - protein, 18 aa, Entamoeba histolytica
LSALRTNKYFTKLNIEST

SEQ ID NO: 2720123 - protein, 35 aa, Entamoeba histolytica
LSALYQHLLFDFDPYYLYSIYNPIIYIFTNNYQQP

SEQ ID NO: 2720124 - protein, 25 aa, Entamoeba histolytica
LSAQGSLLTMILFLSPQTLNNNISF

SEQ ID NO: 2720125 - protein, 29 aa, Entamoeba histolytica
LSAQIHMTLLPLINTIAILHTPYQSCSEH

SEQ ID NO: 2720126 - protein, 18 aa, Entamoeba histolytica
LSCFSSAMKVTEESSLQQ

SEQ ID NO: 2720127 - protein, 17 aa, Entamoeba histolytica
LSCVYKVFHEEFSINLK

SEQ ID NO: 2720128 - protein, 48 aa, Entamoeba histolytica
LSDDYLTKTKALFQVLNDSLIDKITWWAGRLFFNEFEMLMKVLKESNE

SEQ ID NO: 2720129 - protein, 19 aa, Entamoeba histolytica
LSDEKVGLKILYKLMDADG

SEQ ID NO: 2720130 - protein, 20 aa, Entamoeba histolytica
LSDFAPYKPFYIPDDNPYDL

SEQ ID NO: 2720131 - protein, 18 aa, Entamoeba histolytica
LSDILNKLESMGIKEELV

SEQ ID NO: 2720132 - protein, 22 aa, Entamoeba histolytica
LSDVVLRSFATPGLFTCHQSFV

SEQ ID NO: 2720133 - protein, 28 aa, Entamoeba histolytica
LSDYKDWCLYWLGLNNFEPPLTGETPED

SEQ ID NO: 2720134 - protein, 18 aa, Entamoeba histolytica
LSEEFLMAGLLSQPIMKL

SEQ ID NO: 2720135 - protein, 17 aa, Entamoeba histolytica
LSEEIIFHLFDKDTLTS

SEQ ID NO: 2720136 - protein, 20 aa, Entamoeba histolytica
LSEGILKYRSIYDVVTTIVH

SEQ ID NO: 2720137 - protein, 18 aa, Entamoeba histolytica
LSEKLKINVFIGSNYIAT

SEQ ID NO: 2720138 - protein, 23 aa, Entamoeba histolytica
LSELLFDVCHLNCIPNICECEED

SEQ ID NO: 2720139 - protein, 23 aa, Entamoeba histolytica
LSEPLAFNLMFATDIGPAGDLKA

SEQ ID NO: 2720140 - protein, 18 aa, Entamoeba histolytica
LSERILSFLILNSSNVIN

SEQ ID NO: 2720141 - protein, 18 aa, Entamoeba histolytica
LSFFFDKNPYFTNDHFTI

SEQ ID NO: 2720142 - protein, 23 aa, Entamoeba histolytica
LSFIDGIKILKNHLLPIAKFFDE

SEQ ID NO: 2720143 - protein, 18 aa, Entamoeba histolytica
LSFIQAYTTHWNLNEKKE

SEQ ID NO: 2720144 - protein, 18 aa, Entamoeba histolytica
LSFNFGLQYIPPEKIINS

SEQ ID NO: 2720145 - protein, 28 aa, Entamoeba histolytica
LSFQHLKILPKYLHSLNLIKLDLSNNQI

SEQ ID NO: 2720146 - protein, 24 aa, Entamoeba histolytica
LSGICDYLINLFRGRKCKGCVNVS

SEQ ID NO: 2720147 - protein, 22 aa, Entamoeba histolytica
LSGIGWCFYMSKNYIEALKYFQ

SEQ ID NO: 2720148 - protein, 26 aa, Entamoeba histolytica
LSGINYFYLLILQKLINKNQLDKISI

SEQ ID NO: 2720149 - protein, 17 aa, Entamoeba histolytica
LSGLHKCVIFYSFTDSD

SEQ ID NO: 2720150 - protein, 18 aa, Entamoeba histolytica
LSGLLQVISLISPDIFIW

SEQ ID NO: 2720151 - protein, 29 aa, Entamoeba histolytica
LSHIYNYVVIRKIMIPFPICSLKNWDCSC

SEQ ID NO: 2720152 - protein, 20 aa, Entamoeba histolytica
LSHQLNVCCLIFVMIKDTVF

SEQ ID NO: 2720153 - protein, 17 aa, Entamoeba histolytica
LSIDKIVDEGCPAKFLV

SEQ ID NO: 2720154 - protein, 23 aa, Entamoeba histolytica
LSIEKNIWIDEGVKYINEAKATL

SEQ ID NO: 2720155 - protein, 18 aa, Entamoeba histolytica
LSIHWKNRKCIASSLHLL

SEQ ID NO: 2720156 - protein, 22 aa, Entamoeba histolytica
LSIKILFSIIYQLIQENLLSNH

SEQ ID NO: 2720157 - protein, 18 aa, Entamoeba histolytica
LSILAIIPATNVKSISII

SEQ ID NO: 2720158 - protein, 19 aa, Entamoeba histolytica
LSILGVVAGLIPYPHHNQS

SEQ ID NO: 2720159 - protein, 17 aa, Entamoeba histolytica
LSILKQAITKNIIIILD

SEQ ID NO: 2720160 - protein, 21 aa, Entamoeba histolytica
LSILNLPIKKVWKYPHQIFID

SEQ ID NO: 2720161 - protein, 21 aa, Entamoeba histolytica
LSINTPQPFPKLKKKAKCCII

SEQ ID NO: 2720162 - protein, 18 aa, Entamoeba histolytica
LSINVSFPPFIYSSYDIQ

SEQ ID NO: 2720163 - protein, 23 aa, Entamoeba histolytica
LSIRLWAVGILIKSSPNGIENLF

SEQ ID NO: 2720164 - protein, 18 aa, Entamoeba histolytica
LSIRNIILRHIFDIRWWP

SEQ ID NO: 2720165 - protein, 23 aa, Entamoeba histolytica
LSISLFENCFYLKSVQLPSSLQV

SEQ ID NO: 2720166 - protein, 25 aa, Entamoeba histolytica
LSKELLLFMRVIVLERLNEVSVKEI

SEQ ID NO: 2720167 - protein, 24 aa, Entamoeba histolytica
LSKESIVMTLIRGLESNNKILIER

SEQ ID NO: 2720168 - protein, 26 aa, Entamoeba histolytica
LSKGKITPFSLLTTFGSKLIIKGRVV

SEQ ID NO: 2720169 - protein, 27 aa, Entamoeba histolytica
LSKKAEYIILFLKYDKRILDSLKGLLN

SEQ ID NO: 2720170 - protein, 18 aa, Entamoeba histolytica
LSKKIIFQTLTLVDLYTT

SEQ ID NO: 2720171 - protein, 19 aa, Entamoeba histolytica
LSKKIIFQTLTLVDLYTTR

SEQ ID NO: 2720172 - protein, 17 aa, Entamoeba histolytica
LSKKISNFLPYLSQHFL

SEQ ID NO: 2720173 - protein, 20 aa, Entamoeba histolytica
LSKLIENPAYKRRLTCVLHG

SEQ ID NO: 2720174 - protein, 22 aa, Entamoeba histolytica
LSKLLYAQLPSNENRLLFAQCL

SEQ ID NO: 2720175 - protein, 26 aa, Entamoeba histolytica
LSKLNIEVLKLLMTRVKRLYEFICKQ

SEQ ID NO: 2720176 - protein, 19 aa, Entamoeba histolytica
LSKLPTFIHDLLQRYFCFI

SEQ ID NO: 2720177 - protein, 21 aa, Entamoeba histolytica
LSKLVLFLKTGVEKLVLPALH

SEQ ID NO: 2720178 - protein, 37 aa, Entamoeba histolytica
LSKNPVLTDFFRFNFSFRLIEILTLVALCRDEQKKSV

SEQ ID NO: 2720179 - protein, 23 aa, Entamoeba histolytica
LSKPTPLPLICSFLIDGKLCFHT

SEQ ID NO: 2720180 - protein, 23 aa, Entamoeba histolytica
LSKQCFIDKLLNVFIQQGNYGDD

SEQ ID NO: 2720181 - protein, 18 aa, Entamoeba histolytica
LSKTIKKMGIKRKPSQQN

SEQ ID NO: 2720182 - protein, 26 aa, Entamoeba histolytica
LSKTKSLLHQLPIFPSKHSCCAACWS

SEQ ID NO: 2720183 - protein, 27 aa, Entamoeba histolytica
LSKVILQFFPVLFEKIIFRQIMVTPNE

SEQ ID NO: 2720184 - protein, 24 aa, Entamoeba histolytica
LSKYKNLKIALLEKARDVSTGATS

SEQ ID NO: 2720185 - protein, 24 aa, Entamoeba histolytica
LSLCTSSIMLKQKFFASIVDEAAQ

SEQ ID NO: 2720186 - protein, 31 aa, Entamoeba histolytica
LSLDEFGFQLWKLIHKIPIISLNDNAQSNQW

SEQ ID NO: 2720187 - protein, 27 aa, Entamoeba histolytica
LSLEGSGIILFYPLDTIPLGVDYHFPK

SEQ ID NO: 2720188 - protein, 26 aa, Entamoeba histolytica
LSLGEYPLISMKLILEGHIKSIDEID

SEQ ID NO: 2720189 - protein, 18 aa, Entamoeba histolytica
LSLHLSDTYTLCCNSNEY

SEQ ID NO: 2720190 - protein, 19 aa, Entamoeba histolytica
LSLIFKCKVIKWDNLVSTN

SEQ ID NO: 2720191 - protein, 27 aa, Entamoeba histolytica
LSLIGGFVFLRLFCPALAAPEGSNLCG

SEQ ID NO: 2720192 - protein, 32 aa, Entamoeba histolytica
LSLKTQTISALKYLILMKLMQKKINEIDSVLS

SEQ ID NO: 2720193 - protein, 25 aa, Entamoeba histolytica
LSLLNYLCVVLMLLPRSKICSGDGV

SEQ ID NO: 2720194 - protein, 18 aa, Entamoeba histolytica
LSLLSYFNDYFSCPTSLI

SEQ ID NO: 2720195 - protein, 17 aa, Entamoeba histolytica
LSLLTRQFSQWTNSTTL

SEQ ID NO: 2720196 - protein, 24 aa, Entamoeba histolytica
LSLNEIYQLIRYIPMRLTERERGY

SEQ ID NO: 2720197 - protein, 19 aa, Entamoeba histolytica
LSLNLFQDPFEIVGLSKYE

SEQ ID NO: 2720198 - protein, 17 aa, Entamoeba histolytica
LSLPLLPIKSSLNELEG

SEQ ID NO: 2720199 - protein, 19 aa, Entamoeba histolytica
LSLPQLPGKLIFPSSLTSL

SEQ ID NO: 2720200 - protein, 18 aa, Entamoeba histolytica
LSLQPQVCGALVMALNGE

SEQ ID NO: 2720201 - protein, 31 aa, Entamoeba histolytica; identical to SEQ ID NO: 2532809

SEQ ID NO: 2720202 - protein, 19 aa, Entamoeba histolytica
LSLSTLDLAIIYLLQNGCI

SEQ ID NO: 2720203 - protein, 18 aa, Entamoeba histolytica
LSLVVRPFLHEVQHIPMQ

SEQ ID NO: 2720204 - protein, 33 aa, Entamoeba histolytica
LSLYELPFQIHKIFYFLYTVGYSSTGIFRLAGR

SEQ ID NO: 2720205 - protein, 29 aa, Entamoeba histolytica
LSMDDYINLINYFRTFFSIATESAILDVV

SEQ ID NO: 2720206 - protein, 18 aa, Entamoeba histolytica
LSMFEIYNDSFYDLMNEG

SEQ ID NO: 2720207 - protein, 28 aa, Entamoeba histolytica
LSMLYDASFFFIGKARLLLFKDLLIDKW

SEQ ID NO: 2720208 - protein, 24 aa, Entamoeba histolytica
LSMTNLNFKPNLKTSFPLTDEELQ

SEQ ID NO: 2720209 - protein, 25 aa, Entamoeba histolytica
LSNEFLSELLVLPPPITQYPFYSHI

SEQ ID NO: 2720210 - protein, 32 aa, Entamoeba histolytica
LSNIKILFQHWESLFPWPSLDVSRFIYTGIKF

SEQ ID NO: 2720211 - protein, 18 aa, Entamoeba histolytica
LSNKLYLKDIDPTLIAQA

SEQ ID NO: 2720212 - protein, 19 aa, Entamoeba histolytica
LSNKRLMRFCPNGIDLDKN

SEQ ID NO: 2720213 - protein, 31 aa, Entamoeba histolytica
LSNLKMPSINPKNPMWHPERKFVKKLTNQTR

SEQ ID NO: 2720214 - protein, 28 aa, Entamoeba histolytica
LSNLMIHSNWYSIPLKRISLSYLDDFDP

SEQ ID NO: 2720215 - protein, 23 aa, Entamoeba histolytica
LSNLSLLVIFLISLQEKSIQLLP

SEQ ID NO: 2720216 - protein, 27 aa, Entamoeba histolytica
LSNNRSYLLCLLLQYKYKTKHQEFTTF

SEQ ID NO: 2720217 - protein, 18 aa, Entamoeba histolytica
LSNVLWSLGIIIQRYTND

SEQ ID NO: 2720218 - protein, 24 aa, Entamoeba histolytica
LSNVPTRWFPSAKRSKYILNIPFS

SEQ ID NO: 2720219 - protein, 34 aa, Entamoeba histolytica
LSNYSYIYNLIIKYKLMNILLDIFFNFNHNCTIF

SEQ ID NO: 2720220 - protein, 24 aa, Entamoeba histolytica
LSPLAQTFVPYKFNFFASVNNTSF

SEQ ID NO: 2720221 - protein, 26 aa, Entamoeba histolytica
LSPNFSIYPQFMFHLRRSHFLKVFNC

SEQ ID NO: 2720222 - protein, 24 aa, Entamoeba histolytica
LSPNQFKLLLDFVKTFFSSDQSNE

SEQ ID NO: 2720223 - protein, 23 aa, Entamoeba histolytica
LSPTHPLFNPRIPYRSPTIASFT

SEQ ID NO: 2720224 - protein, 26 aa, Entamoeba histolytica
LSPTIQMYFSFRFLKQESAEEKRIGT

SEQ ID NO: 2720225 - protein, 18 aa, Entamoeba histolytica
LSQFTYFYECNAPRITSV

SEQ ID NO: 2720226 - protein, 23 aa, Entamoeba histolytica
LSQIDMVLEFLIKNGYFLTNEDL

SEQ ID NO: 2720227 - protein, 24 aa, Entamoeba histolytica
LSQILIVCLDLLPSPFINDIPNQL

SEQ ID NO: 2720228 - protein, 22 aa, Entamoeba histolytica
LSQKIAFIKDESILGQCIDALK

SEQ ID NO: 2720229 - protein, 24 aa, Entamoeba histolytica
LSQLYILYTDYVLKNPFIISEMII

SEQ ID NO: 2720230 - protein, 35 aa, Entamoeba histolytica
LSQPQAYTPLVIPKEIWRLCDYVLPFMHDPTFISL

SEQ ID NO: 2720231 - protein, 26 aa, Entamoeba histolytica
LSQQIKTISFLKKIPSILQKFQRVTT

SEQ ID NO: 2720232 - protein, 20 aa, Entamoeba histolytica
LSQQLDILKKQLYDCLMMQN

SEQ ID NO: 2720233 - protein, 28 aa, Entamoeba histolytica
LSQQSRDLLDWLFSLLVHVSLFKDQNKM

SEQ ID NO: 2720234 - protein, 24 aa, Entamoeba histolytica
LSQQWLFDCLYNQRLLSINPYLLN

SEQ ID NO: 2720235 - protein, 24 aa, Entamoeba histolytica
LSQQYISLMLFGAILEGGCSLKNL

SEQ ID NO: 2720236 - protein, 22 aa, Entamoeba histolytica
LSQRNIIIPYDTIKLFYEEYND

SEQ ID NO: 2720237 - protein, 23 aa, Entamoeba histolytica
LSQSGDLLIPFIENLINQNAEVL

SEQ ID NO: 2720238 - protein, 17 aa, Entamoeba histolytica
LSRPMELYNILSVLIKD

SEQ ID NO: 2720239 - protein, 28 aa, Entamoeba histolytica
LSSDLSLWGIGALSFPLYSSLITSFLSS

SEQ ID NO: 2720240 - protein, 23 aa, Entamoeba histolytica
LSSFIFHAIDFLTNLRKASKKNK

SEQ ID NO: 2720241 - protein, 18 aa, Entamoeba histolytica
LSSFIQFDIRNNCKNIKC

SEQ ID NO: 2720242 - protein, 22 aa, Entamoeba histolytica
LSSFKRVFAIPIQKAQDGNASI

SEQ ID NO: 2720243 - protein, 22 aa, Entamoeba histolytica
LSSFNKCLLSFKPATIKIRLGE

SEQ ID NO: 2720244 - protein, 18 aa, Entamoeba histolytica
LSSGFIPVDYFTQFFLVC

SEQ ID NO: 2720245 - protein, 17 aa, Entamoeba histolytica
LSSIQFPSLLRSIGIDA

SEQ ID NO: 2720246 - protein, 23 aa, Entamoeba histolytica
LSSIQLIYLPLLDELHLITKNDI

SEQ ID NO: 2720247 - protein, 23 aa, Entamoeba histolytica
LSSKLLLDRFALKKLIKDQPHEE

SEQ ID NO: 2720248 - protein, 19 aa, Entamoeba histolytica
LSSLDDPIIPYFRYDEFVK

SEQ ID NO: 2720249 - protein, 25 aa, Entamoeba histolytica
LSSLINLRLFKFLDNGPFIELDIPS

SEQ ID NO: 2720250 - protein, 24 aa, Entamoeba histolytica
LSSLNNYSFFGGKINAIAIVHLIN

SEQ ID NO: 2720251 - protein, 32 aa, Entamoeba histolytica
LSSPIKQVLFSPLSFVLPLLKDASVFRQYIPS

SEQ ID NO: 2720252 - protein, 20 aa, Entamoeba histolytica
LSSPNHRVYCCYPLIEIHSN

SEQ ID NO: 2720253 - protein, 26 aa, Entamoeba histolytica
LSSQTIYRFRSFTLTLTVSEDWRIIN

SEQ ID NO: 2720254 - protein, 19 aa, Entamoeba histolytica
LSSQYLIKLMKCSFDYSDE

SEQ ID NO: 2720255 - protein, 25 aa, Entamoeba histolytica
LSSQYYPLILHQLKSTPLHPEIKPI

SEQ ID NO: 2720256 - protein, 25 aa, Entamoeba histolytica
LSSVERIALIQKFKLLPNVPEVKEI

SEQ ID NO: 2720257 - protein, 18 aa, Entamoeba histolytica
LSSYAVTATLRKNLRNTA

SEQ ID NO: 2720258 - protein, 26 aa, Entamoeba histolytica
LSSYHFDLFLKLMVKMKLCVKETYRS

SEQ ID NO: 2720259 - protein, 28 aa, Entamoeba histolytica
LSTAKVFRYRPFSLILTMSSTWRENKGL

SEQ ID NO: 2720260 - protein, 26 aa, Entamoeba histolytica
LSTDDPKFLFLLYNIIHNNEPTTLSQ

SEQ ID NO: 2720261 - protein, 27 aa, Entamoeba histolytica
LSTDHFPLARDLFNYAFLSMWQDSTDN

SEQ ID NO: 2720262 - protein, 19 aa, Entamoeba histolytica
LSTESFCLPFYWNGSRNEA

SEQ ID NO: 2720263 - protein, 29 aa, Entamoeba histolytica
LSTIKLLKISIIRFRKFMRINLGIIFTKV

SEQ ID NO: 2720264 - protein, 20 aa, Entamoeba histolytica
LSTILLNNGYFSLDIITLMG

SEQ ID NO: 2720265 - protein, 25 aa, Entamoeba histolytica
LSTIMMQLIQSLKFEATPLSDLAIF

SEQ ID NO: 2720266 - protein, 22 aa, Entamoeba histolytica
LSTKIKKYYYVLEGNKLILCKD

SEQ ID NO: 2720267 - protein, 30 aa, Entamoeba histolytica
LSTKQGMYAYLLFLLTKIEPLKQLSKKIIN

SEQ ID NO: 2720268 - protein, 17 aa, Entamoeba histolytica
LSTLFRITYRNGFTYHL

SEQ ID NO: 2720269 - protein, 25 aa, Entamoeba histolytica
LSTLKALFVILTYDPQIPQTNRIYF

SEQ ID NO: 2720270 - protein, 23 aa, Entamoeba histolytica
LSTNIIALFERLSKLRGDEEVRK

SEQ ID NO: 2720271 - protein, 26 aa, Entamoeba histolytica
LSTNNKLLDIYKGSKSWVFGIEKGFW

SEQ ID NO: 2720272 - protein, 28 aa, Entamoeba histolytica
LSTPPPISFIRYALIQLLNGLQYIRTAC

SEQ ID NO: 2720273 - protein, 22 aa, Entamoeba histolytica
LSTWNSLWRYIGIEKHATYGFY

SEQ ID NO: 2720274 - protein, 37 aa, Entamoeba histolytica
LSVAHSLIIPLLKYPVRIPFMAILPKPISEPWEVQSF

SEQ ID NO: 2720275 - protein, 24 aa, Entamoeba histolytica
LSVAYKNVIGAKRASWRIISSLEQ

SEQ ID NO: 2720276 - protein, 24 aa, Entamoeba histolytica
LSVAYKNVIGSRRASWRIITSLEQ

SEQ ID NO: 2720277 - protein, 18 aa, Entamoeba histolytica
LSVCFYNHYGSIISIGYP

SEQ ID NO: 2720278 - protein, 20 aa, Entamoeba histolytica
LSVHLYRPWSAKHFLEQLPK

SEQ ID NO: 2720279 - protein, 21 aa, Entamoeba histolytica
LSVLHRVRFIFQPNQLMKTTE

SEQ ID NO: 2720280 - protein, 26 aa, Entamoeba histolytica
LSVLKSLFVILSYDPLFLSNNRPNFL

SEQ ID NO: 2720281 - protein, 20 aa, Entamoeba histolytica
LSVSSLLYRDIPSKSLWNAF

SEQ ID NO: 2720282 - protein, 18 aa, Entamoeba histolytica
LSVSTLFEQVKNKKIPLC

SEQ ID NO: 2720283 - protein, 24 aa, Entamoeba histolytica
LSYDPSWFVLFAKSLLKTVVDPGC

SEQ ID NO: 2720284 - protein, 27 aa, Entamoeba histolytica
LSYFYQGQVSDLWLQLSKKGQIHIQVF

SEQ ID NO: 2720285 - protein, 30 aa, Entamoeba histolytica
LSYMMDLMDYLLVIPLPIIQNYIGDNCKMD

SEQ ID NO: 2720286 - protein, 29 aa, Entamoeba histolytica
LSYNAVPHPFWLPKFQNGISYSLPIFCDT

SEQ ID NO: 2720287 - protein, 21 aa, Entamoeba histolytica
LSYNLYDFLMKKNGSLGLSLV

SEQ ID NO: 2720288 - protein, 20 aa, Entamoeba histolytica
LSYSFDYRYIKKLCKSFNIQ

SEQ ID NO: 2720289 - protein, 23 aa, Entamoeba histolytica
LSYTINEFIAWMYQRINIYWDDL

SEQ ID NO: 2720290 - protein, 17 aa, Entamoeba histolytica
LSYWPLDMVLRDKYKFS

SEQ ID NO: 2720291 - protein, 19 aa, Entamoeba histolytica
LTAKYYTFVPHVINGNIIP

SEQ ID NO: 2720292 - protein, 25 aa, Entamoeba histolytica
LTALKHPFCCLSVLNLLVALRQHTF

SEQ ID NO: 2720293 - protein, 17 aa, Entamoeba histolytica
LTALLQLVTKKPSDEII

SEQ ID NO: 2720294 - protein, 21 aa, Entamoeba histolytica
LTAMLDFFPEFSLSERHIAYV

SEQ ID NO: 2720295 - protein, 28 aa, Entamoeba histolytica
LTAQYIRLKELPSFFSKFPSLINLDVDY

SEQ ID NO: 2720296 - protein, 17 aa, Entamoeba histolytica
LTAVVKGAAYLAHLKQE

SEQ ID NO: 2720297 - protein, 25 aa, Entamoeba histolytica
LTCGDLGINCDDYVRRCIHSMGINQ

SEQ ID NO: 2720298 - protein, 32 aa, Entamoeba histolytica
LTDDLVPIFLERLLAFPLDKLTISYKLLCSQA

SEQ ID NO: 2720299 - protein, 25 aa, Entamoeba histolytica
LTDDVYLSPYQRKRLRNIQRMQRKR

SEQ ID NO: 2720300 - protein, 18 aa, Entamoeba histolytica
LTDIKKMFVGQFGTTLIA

SEQ ID NO: 2720301 - protein, 29 aa, Entamoeba histolytica
LTDSPTLKYLYLLTQIGITMSPMANHLTQ

SEQ ID NO: 2720302 - protein, 27 aa, Entamoeba histolytica
LTEEIAKFFRIVIVDALFIGYGLTETT

SEQ ID NO: 2720303 - protein, 24 aa, Entamoeba histolytica
LTEENVKMRAVLLHYFIHVSEEMK

SEQ ID NO: 2720304 - protein, 20 aa, Entamoeba histolytica
LTEFEFLCIAIKPEILFLHL

SEQ ID NO: 2720305 - protein, 25 aa, Entamoeba histolytica
LTEHQLVVPLIIGNVFLQPDTTAPF

SEQ ID NO: 2720306 - protein, 24 aa, Entamoeba histolytica
LTEKNIKMFPSIQTQYIYGNEKKI

SEQ ID NO: 2720307 - protein, 17 aa, Entamoeba histolytica
LTEKQLAFFFPKEEEET

SEQ ID NO: 2720308 - protein, 29 aa, Entamoeba histolytica
LTETALIQFIYRSPRLRVLFLSGTTAVTN

SEQ ID NO: 2720309 - protein, 17 aa, Entamoeba histolytica
LTGFCPFELIQIDPFTA

SEQ ID NO: 2720310 - protein, 29 aa, Entamoeba histolytica
LTGTDIIDALDRLGFEDYCLSLQKHLKHF

SEQ ID NO: 2720311 - protein, 36 aa, Entamoeba histolytica
LTGTMTANLPLFYFAPTNINIPKFKKVNLPPQDPSV

SEQ ID NO: 2720312 - protein, 19 aa, Entamoeba histolytica
LTGTPIKIGKRKATIRGLF

SEQ ID NO: 2720313 - protein, 33 aa, Entamoeba histolytica
LTHCHTEFQKTYWKWFISLSEIPRPSYHCKLFS

SEQ ID NO: 2720314 - protein, 19 aa, Entamoeba histolytica
LTHFFQYIHFPWERNIEKN

SEQ ID NO: 2720315 - protein, 26 aa, Entamoeba histolytica
LTHHNISYLFNLMRKYRVAIREGKSK

SEQ ID NO: 2720316 - protein, 26 aa, Entamoeba histolytica
LTHLESPILRILLLEDNPIYDIQSYF

SEQ ID NO: 2720317 - protein, 33 aa, Entamoeba histolytica; identical to SEQ ID NO: 2532914

SEQ ID NO: 2720318 - protein, 18 aa, Entamoeba histolytica
LTIHRIIHQFNLTIKREE

SEQ ID NO: 2720319 - protein, 18 aa, Entamoeba histolytica
LTIISMIMKYGISDKKEI

SEQ ID NO: 2720320 - protein, 18 aa, Entamoeba histolytica
LTIKLEMETLVPNVILLN

SEQ ID NO: 2720321 - protein, 22 aa, Entamoeba histolytica
LTILSHLFFLQKDESFITLMLK

SEQ ID NO: 2720322 - protein, 22 aa, Entamoeba histolytica
LTINSCFIVGLPALNVNSIIFF

SEQ ID NO: 2720323 - protein, 20 aa, Entamoeba histolytica
LTISYDLLFTTFPSLNQGKV

SEQ ID NO: 2720324 - protein, 23 aa, Entamoeba histolytica
LTKRAYTVGFLAWCLSMYGCEVK

SEQ ID NO: 2720325 - protein, 24 aa, Entamoeba histolytica
LTKTKLVYDILKKGSYKKGSDKIV

SEQ ID NO: 2720326 - protein, 24 aa, Entamoeba histolytica
LTKTRFYEAIFKILDSDKSGLLER

SEQ ID NO: 2720327 - protein, 19 aa, Entamoeba histolytica
LTKVYPHFQKKETSFIQIV

SEQ ID NO: 2720328 - protein, 17 aa, Entamoeba histolytica
LTLDQLYEKEADPEEFK

SEQ ID NO: 2720329 - protein, 18 aa, Entamoeba histolytica
LTLFLKRMVLVKNGAELS

SEQ ID NO: 2720330 - protein, 19 aa, Entamoeba histolytica
LTLFLKRMVLVKNGAELSD

SEQ ID NO: 2720331 - protein, 25 aa, Entamoeba histolytica
LTLGNSPFISFKLIMEGHIEVIEEI

SEQ ID NO: 2720332 - protein, 22 aa, Entamoeba histolytica
LTLLDVFMLYQTSTFPATVRKI

SEQ ID NO: 2720333 - protein, 20 aa, Entamoeba histolytica
LTLRLYKNINIPSTLTSLFL

SEQ ID NO: 2720334 - protein, 17 aa, Entamoeba histolytica
LTLSKFFPISIINTMKM

SEQ ID NO: 2720335 - protein, 27 aa, Entamoeba histolytica
LTLSKQIPFIIFQLCDFMTSIIQIGGY

SEQ ID NO: 2720336 - protein, 32 aa, Entamoeba histolytica
LTLSTIEPQLFKKIIQFLPNKDKKSLSLTSKR

SEQ ID NO: 2720337 - protein, 25 aa, Entamoeba histolytica
LTMDERLSLLSIPLEKEIPQTNSLS

SEQ ID NO: 2720338 - protein, 18 aa, Entamoeba histolytica
LTMKSGFCPVKKALGKGI

SEQ ID NO: 2720339 - protein, 28 aa, Entamoeba histolytica
LTNDFGFPLQFKIPLAFSLSIVANIKDY

SEQ ID NO: 2720340 - protein, 24 aa, Entamoeba histolytica
LTNEIRKMARLGRTNTVKVMAADL

SEQ ID NO: 2720341 - protein, 24 aa, Entamoeba histolytica
LTNHAFLIIGYDLSQPFSLTPKYD

SEQ ID NO: 2720342 - protein, 24 aa, Entamoeba histolytica
LTNHRIIYHMKKGEKVILESGVFF

SEQ ID NO: 2720343 - protein, 20 aa, Entamoeba histolytica
LTNIILFFKDIKSIETFSYI

SEQ ID NO: 2720344 - protein, 24 aa, Entamoeba histolytica
LTNNTFSLGEFSFGLSNEKPKSNS

SEQ ID NO: 2720345 - protein, 20 aa, Entamoeba histolytica
LTNNYFAWTGSIPYVEIPNK

SEQ ID NO: 2720346 - protein, 18 aa, Entamoeba histolytica
LTNPLHFKRYYHGKDIVI

SEQ ID NO: 2720347 - protein, 28 aa, Entamoeba histolytica
LTNTKRIFVCLKFIMIWVKSQVITVRLI

SEQ ID NO: 2720348 - protein, 25 aa, Entamoeba histolytica
LTNVPYIQILALFGLFNSGQSAMER

SEQ ID NO: 2720349 - protein, 25 aa, Entamoeba histolytica
LTPEIIKFIPNRLHLLIQTLGDEYG

SEQ ID NO: 2720350 - protein, 20 aa, Entamoeba histolytica
LTPLHYCCVYGMVHLIDDII

SEQ ID NO: 2720351 - protein, 18 aa, Entamoeba histolytica
LTQDDIQLLVRLKKMFNI

SEQ ID NO: 2720352 - protein, 23 aa, Entamoeba histolytica
LTQLEVCVQLILQYTPSSLSKKY

SEQ ID NO: 2720353 - protein, 26 aa, Entamoeba histolytica
LTQLIEYSFALVYFRDVVIARFSDET

SEQ ID NO: 2720354 - protein, 18 aa, Entamoeba histolytica
LTQLIYNSAFYLKEKRLE

SEQ ID NO: 2720355 - protein, 30 aa, Entamoeba histolytica
LTQLPNNCSVLIYGFLPSLQLNEIPPNVIY

SEQ ID NO: 2720356 - protein, 18 aa, Entamoeba histolytica
LTQLTKYMLVILKEKRIA

SEQ ID NO: 2720357 - protein, 20 aa, Entamoeba histolytica
LTQMAWDVLQPHHGQLEVLS

SEQ ID NO: 2720358 - protein, 21 aa, Entamoeba histolytica
LTQNLKFPLLLQNLSINDCQC

SEQ ID NO: 2720359 - protein, 19 aa, Entamoeba histolytica
LTQNPQAMRAMLMMNPQTA

SEQ ID NO: 2720360 - protein, 18 aa, Entamoeba histolytica
LTQPPGDILFFLTGQEEI

SEQ ID NO: 2720361 - protein, 21 aa, Entamoeba histolytica
LTQQFIFRDIKILQMISIQEV

SEQ ID NO: 2720362 - protein, 24 aa, Entamoeba histolytica
LTQTGHLFAYLSNSPTLAFFGHVD

SEQ ID NO: 2720363 - protein, 23 aa, Entamoeba histolytica
LTQYEKQISFLNKSRGVVLNERN

SEQ ID NO: 2720364 - protein, 22 aa, Entamoeba histolytica
LTQYVLRVNVLMLKSNKEIKRP

SEQ ID NO: 2720365 - protein, 17 aa, Entamoeba histolytica
LTRDQVYRFFYDLTIET

SEQ ID NO: 2720366 - protein, 25 aa, Entamoeba histolytica
LTREFAIVDMIGLFMRSRPLHMNIA

SEQ ID NO: 2720367 - protein, 29 aa, Entamoeba histolytica
LTRFDDEIIFIMFTLIAKKVIIINTHTMK

SEQ ID NO: 2720368 - protein, 23 aa, Entamoeba histolytica
LTRLTKLFILRRTSKVNQKYLPP

SEQ ID NO: 2720369 - protein, 17 aa, Entamoeba histolytica
LTSFPTPLLELSSLIVL

SEQ ID NO: 2720370 - protein, 18 aa, Entamoeba histolytica
LTSILKNSMLQSERICFI

SEQ ID NO: 2720371 - protein, 19 aa, Entamoeba histolytica
LTSKQFTLFASMKLVLKPK

SEQ ID NO: 2720372 - protein, 22 aa, Entamoeba histolytica
LTSKSYYIMPCCTTRYVLDAKY

SEQ ID NO: 2720373 - protein, 27 aa, Entamoeba histolytica
LTSLNGFVYFDFIPIKMESIFDLLSRH

SEQ ID NO: 2720374 - protein, 27 aa, Entamoeba histolytica
LTSLPDSILLKIFSYLRIDAIRNVQLL

SEQ ID NO: 2720375 - protein, 17 aa, Entamoeba histolytica
LTSLQKQLAERPSTVVI

SEQ ID NO: 2720376 - protein, 21 aa, Entamoeba histolytica
LTSLRLFRLNSLSNILFNSSI

SEQ ID NO: 2720377 - protein, 24 aa, Entamoeba histolytica
LTSLTMIIMDPYYRTFKGFETIIE

SEQ ID NO: 2720378 - protein, 30 aa, Entamoeba histolytica
LTSSSLLTQQFLYPVLLSLIQQQPNVFFDY

SEQ ID NO: 2720379 - protein, 19 aa, Entamoeba histolytica
LTSVVSLPFILTYSYEELT

SEQ ID NO: 2720380 - protein, 25 aa, Entamoeba histolytica
LTSYNIYLTSYLDQLILSCYSLFDD

SEQ ID NO: 2720381 - protein, 25 aa, Entamoeba histolytica
LTTCELLTKIIFPTTIISLSVTGCN

SEQ ID NO: 2720382 - protein, 18 aa, Entamoeba histolytica
LTTFMKDLGYDESFLEDL

SEQ ID NO: 2720383 - protein, 17 aa, Entamoeba histolytica
LTTLIKPSLLRETGMII

SEQ ID NO: 2720384 - protein, 17 aa, Entamoeba histolytica
LTTPLKKGMYNISTIPP

SEQ ID NO: 2720385 - protein, 22 aa, Entamoeba histolytica
LTTQFNALYFPSKLSFKTIPSY

SEQ ID NO: 2720386 - protein, 17 aa, Entamoeba histolytica
LTTSYFRKVIYGKRPQE

SEQ ID NO: 2720387 - protein, 25 aa, Entamoeba histolytica
LTTYKLTHPDLPFDSEFELCSFIGK

SEQ ID NO: 2720388 - protein, 25 aa, Entamoeba histolytica
LTVEKLLQFIGEKVNILYTDEYGLK

SEQ ID NO: 2720389 - protein, 21 aa, Entamoeba histolytica
LTVGALRDFYLDLDDLHDLCS

SEQ ID NO: 2720390 - protein, 25 aa, Entamoeba histolytica
LTVGAPVHRCPPPMGAYPPPPMGGC

SEQ ID NO: 2720391 - protein, 28 aa, Entamoeba histolytica
LTVKPGQILFVERFIKTWAICFRADGKK

SEQ ID NO: 2720392 - protein, 25 aa, Entamoeba histolytica
LTVLQNMFEFFMKKAPNILSTMFSN

SEQ ID NO: 2720393 - protein, 23 aa, Entamoeba histolytica
LTYDLDLLRITAPLFVESGYGLN

SEQ ID NO: 2720394 - protein, 20 aa, Entamoeba histolytica
LTYGLYEWLRVCTGAYIMQS

SEQ ID NO: 2720395 - protein, 18 aa, Entamoeba histolytica
LTYIKFLTFNIQPLKIQT

SEQ ID NO: 2720396 - protein, 27 aa, Entamoeba histolytica
LTYLNYDIDQLLLYFGTEQWEAAAHAQ

SEQ ID NO: 2720397 - protein, 24 aa, Entamoeba histolytica
LTYTELYREHVSPLIIACVARLRE

SEQ ID NO: 2720398 - protein, 22 aa, Entamoeba histolytica
LTYVHLPMSLTSLSPYCFLNCS

SEQ ID NO: 2720399 - protein, 20 aa, Entamoeba histolytica
LTYYKNPWSLTLKDSTLNIQ

SEQ ID NO: 2720400 - protein, 21 aa, Entamoeba histolytica
LVATPGRLLYFTEKKIVSLSS

SEQ ID NO: 2720401 - protein, 23 aa, Entamoeba histolytica
LVDGICSIYCSKGIYHICGYCDS

SEQ ID NO: 2720402 - protein, 20 aa, Entamoeba histolytica
LVDKTWIRMKQLGLKANEVT

SEQ ID NO: 2720403 - protein, 24 aa, Entamoeba histolytica
LVDMVKWFRDSIIALGINETNIRI

SEQ ID NO: 2720404 - protein, 35 aa, Entamoeba histolytica; identical to SEQ ID NO: 2533037

SEQ ID NO: 2720405 - protein, 17 aa, Entamoeba histolytica
LVEADYKMFKCHGATFE

SEQ ID NO: 2720406 - protein, 23 aa, Entamoeba histolytica
LVEALPLKEIFLELTSPVPLQYN

SEQ ID NO: 2720407 - protein, 26 aa, Entamoeba histolytica
LVEAVRKGYWIVLDELNLAPSEVLEA

SEQ ID NO: 2720408 - protein, 17 aa, Entamoeba histolytica
LVEFPVCITKCQSLKIL

SEQ ID NO: 2720409 - protein, 25 aa, Entamoeba histolytica
LVEFVKYCLALNHLFDFSKGGEITK

SEQ ID NO: 2720410 - protein, 25 aa, Entamoeba histolytica
LVEIKIIFIGIDKNPPQKLVDLYIQ

SEQ ID NO: 2720411 - protein, 23 aa, Entamoeba histolytica
LVEKGIVDLFITLHKRFPEKKQL

SEQ ID NO: 2720412 - protein, 24 aa, Entamoeba histolytica
LVEKILVNYPNLLNLRLRMPISDD

SEQ ID NO: 2720413 - protein, 27 aa, Entamoeba histolytica
LVEKQLPIYFEFLINPYGPSTYSNEIF

SEQ ID NO: 2720414 - protein, 29 aa, Entamoeba histolytica
LVEKRVAYRALFIHYFLQVAEEMKKLNNF

SEQ ID NO: 2720415 - protein, 18 aa, Entamoeba histolytica
LVELLKKAPSESLFIILQ

SEQ ID NO: 2720416 - protein, 25 aa, Entamoeba histolytica
LVGEDNYKVIQTKRFLIIGNHPSLS

SEQ ID NO: 2720417 - protein, 18 aa, Entamoeba histolytica
LVGTIWFDKMIHICCEKD

SEQ ID NO: 2720418 - protein, 24 aa, Entamoeba histolytica
LVHGKWYLGLYENSIVWGDESDSI

SEQ ID NO: 2720419 - protein, 25 aa, Entamoeba histolytica
LVHKNYYQLFNLVDQLNLTTIPQDF

SEQ ID NO: 2720420 - protein, 26 aa, Entamoeba histolytica
LVHQQAVLIGLLNKYYDINLKKSRKV

SEQ ID NO: 2720421 - protein, 20 aa, Entamoeba histolytica
LVIDYYLTITNLLKNDIYIK

SEQ ID NO: 2720422 - protein, 27 aa, Entamoeba histolytica
LVIGKKNLFFIIFDGDENIFGGYIDKT

SEQ ID NO: 2720423 - protein, 18 aa, Entamoeba histolytica
LVIKLNSVATFYPRLHII

SEQ ID NO: 2720424 - protein, 29 aa, Entamoeba histolytica
LVINGLPGGPYYSAPFVLQAREKRSIKPS

SEQ ID NO: 2720425 - protein, 20 aa, Entamoeba histolytica
LVINQCMMYRIKPMTSPNMK

SEQ ID NO: 2720426 - protein, 30 aa, Entamoeba histolytica
LVISEFLNLYNEFLFKLNYSDKFKQEIDEL

SEQ ID NO: 2720427 - protein, 22 aa, Entamoeba histolytica
LVKALRNGYWILLDEINLASHD

SEQ ID NO: 2720428 - protein, 35 aa, Entamoeba histolytica
LVKGAIIEIDPAPFRLWFLKFYGKDIASTDYYKSL

SEQ ID NO: 2720429 - protein, 28 aa, Entamoeba histolytica
LVKGDIVPLRFFLKNLQLTPTLTNIADI

SEQ ID NO: 2720430 - protein, 19 aa, Entamoeba histolytica
LVKPNSNILPLQQTKQLPQ

SEQ ID NO: 2720431 - protein, 18 aa, Entamoeba histolytica
LVKPYFAIVDPCHSFTLP

SEQ ID NO: 2720432 - protein, 27 aa, Entamoeba histolytica
LVKQNEMLLSIRLAIQCTLCGLNNGID

SEQ ID NO: 2720433 - protein, 18 aa, Entamoeba histolytica
LVKYGAIQSKEYGPLIIF

SEQ ID NO: 2720434 - protein, 17 aa, Entamoeba histolytica
LVLEYNYNSGLTKKYWS

SEQ ID NO: 2720435 - protein, 19 aa, Entamoeba histolytica
LVLIMEYVPFGSLRELIKN

SEQ ID NO: 2720436 - protein, 29 aa, Entamoeba histolytica
LVLKEMVIELIILDILLTSPDYHNEQFEY

SEQ ID NO: 2720437 - protein, 18 aa, Entamoeba histolytica
LVLKILNIPTKELAILKC

SEQ ID NO: 2720438 - protein, 33 aa, Entamoeba histolytica
LVLNLYNRYHVNNIFGLRWGYEGLVPELSEVQR

SEQ ID NO: 2720439 - protein, 20 aa, Entamoeba histolytica
LVLNTLKRPDTISTNAFIPL

SEQ ID NO: 2720440 - protein, 35 aa, Entamoeba histolytica
LVLRDFLNYITSEQAIFIGLLSLEAKVIIGKPLKR

SEQ ID NO: 2720441 - protein, 28 aa, Entamoeba histolytica
LVLSCLLHPFYFITFALDNPITLHINHS

SEQ ID NO: 2720442 - protein, 18 aa, Entamoeba histolytica
LVMMGIGGFSPLNGFMKK

SEQ ID NO: 2720443 - protein, 18 aa, Entamoeba histolytica
LVMMLRQMGYAAIPLHGK

SEQ ID NO: 2720444 - protein, 19 aa, Entamoeba histolytica
LVNCIFINKKWKHSIEYSY

SEQ ID NO: 2720445 - protein, 28 aa, Entamoeba histolytica
LVNDCNHLVFRNGLLLMSSSKGDKQIRI

SEQ ID NO: 2720446 - protein, 24 aa, Entamoeba histolytica
LVNEIIITILKPPQRQRIEGALFN

SEQ ID NO: 2720447 - protein, 22 aa, Entamoeba histolytica
LVNFFGLVPYCKKTKIITATYN

SEQ ID NO: 2720448 - protein, 22 aa, Entamoeba histolytica
LVNFVECVFPESLSFPKKLNAL

SEQ ID NO: 2720449 - protein, 23 aa, Entamoeba histolytica
LVNIGKMKLLKRCKIDIGRQKFD

SEQ ID NO: 2720450 - protein, 29 aa, Entamoeba histolytica
LVNKISFKLPFYSLKPFTTCTWFYIHSFP

SEQ ID NO: 2720451 - protein, 24 aa, Entamoeba histolytica
LVNLKISQIPYRFSCSTLLESDTW

SEQ ID NO: 2720452 - protein, 24 aa, Entamoeba histolytica
LVNMPMGIFMARLDFIIANEQEFN

SEQ ID NO: 2720453 - protein, 23 aa, Entamoeba histolytica
LVNNGFSIFAPKGRKLPITFEGV

SEQ ID NO: 2720454 - protein, 19 aa, Entamoeba histolytica
LVNQTLFPYPLLSQQQHKI

SEQ ID NO: 2720455 - protein, 23 aa, Entamoeba histolytica
LVNVPRIDMIYKAESYYLAEKPE

SEQ ID NO: 2720456 - protein, 19 aa, Entamoeba histolytica
LVPAFQKYLNFIDDKRSFI

SEQ ID NO: 2720457 - protein, 38 aa, Entamoeba histolytica
LVPGQYVIIPMTILPNLFGKFTIVIHELLRSTFENPSV

SEQ ID NO: 2720458 - protein, 21 aa, Entamoeba histolytica
LVPILSRLYVDMALNVKPICI

SEQ ID NO: 2720459 - protein, 24 aa, Entamoeba histolytica
LVPKAVIHFLVFKTRDSLQKELIK

SEQ ID NO: 2720460 - protein, 24 aa, Entamoeba histolytica
LVPKKTPPQPYQKALPKPSASAQS

SEQ ID NO: 2720461 - protein, 34 aa, Entamoeba histolytica
LVPQNKYLIWLFNNFSFLSPKINFDLYKPCFDYL

SEQ ID NO: 2720462 - protein, 17 aa, Entamoeba histolytica
LVPRVKIFAGKAAIGYD

SEQ ID NO: 2720463 - protein, 18 aa, Entamoeba histolytica
LVPTVKCLINISDAPYKV

SEQ ID NO: 2720464 - protein, 25 aa, Entamoeba histolytica
LVQDTRFVMLPLTAINLQERPSNTL

SEQ ID NO: 2720465 - protein, 19 aa, Entamoeba histolytica
LVQFVIELLKYFENGEVIE

SEQ ID NO: 2720466 - protein, 22 aa, Entamoeba histolytica
LVQGVIYIWNFINEFKKEIEIE

SEQ ID NO: 2720467 - protein, 21 aa, Entamoeba histolytica
LVQKKYYRALYDKNREFLNKG

SEQ ID NO: 2720468 - protein, 19 aa, Entamoeba histolytica
LVQLLKFIVGLIRNEKEIP

SEQ ID NO: 2720469 - protein, 18 aa, Entamoeba histolytica
LVQLYLSSLIKICCVGAS

SEQ ID NO: 2720470 - protein, 18 aa, Entamoeba histolytica
LVQNIPESAYFYTLDNDR

SEQ ID NO: 2720471 - protein, 23 aa, Entamoeba histolytica
LVQQLMKQIVSYIAIHVIELLIE

SEQ ID NO: 2720472 - protein, 30 aa, Entamoeba histolytica
LVQSIITPNYRLFFSSKTVLLEYYNILLSF

SEQ ID NO: 2720473 - protein, 26 aa, Entamoeba histolytica
LVQSSFPFLVFLLQSPSNEIVAITSK

SEQ ID NO: 2720474 - protein, 25 aa, Entamoeba histolytica
LVRDAAMKFVLTYIDVFGTKGTKLS

SEQ ID NO: 2720475 - protein, 20 aa, Entamoeba histolytica
LVRIAILWHEAWHEALEEAS

SEQ ID NO: 2720476 - protein, 27 aa, Entamoeba histolytica
LVRKEDLFPLLIQFLQSEDPQYKIGFE

SEQ ID NO: 2720477 - protein, 23 aa, Entamoeba histolytica
LVRSYFSFECSLNNIFNKPKTEE

SEQ ID NO: 2720478 - protein, 17 aa, Entamoeba histolytica
LVRTLLQSGGYPDNLPP

SEQ ID NO: 2720479 - protein, 23 aa, Entamoeba histolytica
LVSDVIKVVFPFASSKSTLFKRT

SEQ ID NO: 2720480 - protein, 19 aa, Entamoeba histolytica
LVSFLEQLNYEDYCLTKTQ

SEQ ID NO: 2720481 - protein, 22 aa, Entamoeba histolytica
LVSNIIITLQRRIIIQKGKSSS

SEQ ID NO: 2720482 - protein, 18 aa, Entamoeba histolytica
LVSQRWPPIQNKDSLWIC

SEQ ID NO: 2720483 - protein, 27 aa, Entamoeba histolytica
LVTLIDLPAFFLQPELPMLMIIRTSHS

SEQ ID NO: 2720484 - protein, 24 aa, Entamoeba histolytica
LVVATRFIRQLGLYSYENDQHNTI

SEQ ID NO: 2720485 - protein, 19 aa, Entamoeba histolytica
LVVFGSYFEVGRSSIILRF

SEQ ID NO: 2720486 - protein, 18 aa, Entamoeba histolytica
LVVGEEIIFSNTGLHYIH

SEQ ID NO: 2720487 - protein, 21 aa, Entamoeba histolytica
LVVKNLPITNIPGLSSLKMLC

SEQ ID NO: 2720488 - protein, 25 aa, Entamoeba histolytica
LVVMLKVFDLFVKSEEWYFIKTKEE

SEQ ID NO: 2720489 - protein, 24 aa, Entamoeba histolytica
LVWGEDSMFWLGKKTMELVIETTK

SEQ ID NO: 2720490 - protein, 30 aa, Entamoeba histolytica
LVYEEIPSNTLLFLVMWKNFSILRSTWVSR

SEQ ID NO: 2720491 - protein, 17 aa, Entamoeba histolytica
LVYLYLAVNKTNPKCFH

SEQ ID NO: 2720492 - protein, 20 aa, Entamoeba histolytica
LVYMYRSAYHYSLDNFYNTL

SEQ ID NO: 2720493 - protein, 18 aa, Entamoeba histolytica
LWCVMMNELIKTIQTRMV

SEQ ID NO: 2720494 - protein, 19 aa, Entamoeba histolytica
LWKKYHSFWKKTMKIEAVV

SEQ ID NO: 2720495 - protein, 19 aa, Entamoeba histolytica
LWLKNDILNFMIHKLGISD

SEQ ID NO: 2720496 - protein, 19 aa, Entamoeba histolytica
LWLNLIDGSVYCGREQMMV

SEQ ID NO: 2720497 - protein, 20 aa, Entamoeba histolytica
LWLSMNSFVLAIFSYLKEAS

SEQ ID NO: 2720498 - protein, 19 aa, Entamoeba histolytica
LWNNNIIWEFAKGLSPGVD

SEQ ID NO: 2720499 - protein, 17 aa, Entamoeba histolytica
LWSELIGWYLKGNKRNE

SEQ ID NO: 2720500 - protein, 18 aa, Entamoeba histolytica
LWVVCELLRIVVSSNLQE

SEQ ID NO: 2720501 - protein, 20 aa, Entamoeba histolytica
LYAYTNFINYIINEEPFVHN

SEQ ID NO: 2720502 - protein, 19 aa, Entamoeba histolytica
LYCELDISELLPKSNLYKI

SEQ ID NO: 2720503 - protein, 27 aa, Entamoeba histolytica
LYCIRKNFFLWLLENKPSSALSYLQNQ

SEQ ID NO: 2720504 - protein, 17 aa, Entamoeba histolytica
LYDAFFKNQKKGSMTVF

SEQ ID NO: 2720505 - protein, 23 aa, Entamoeba histolytica
LYDCLMMQNIPKGVIFKDKLKTN

SEQ ID NO: 2720506 - protein, 18 aa, Entamoeba histolytica
LYDIHVNGKVFNFIKPNH

SEQ ID NO: 2720507 - protein, 25 aa, Entamoeba histolytica
LYDKDYILHDFYIFSMSYLNCYQNE

SEQ ID NO: 2720508 - protein, 18 aa, Entamoeba histolytica
LYDLYVKAVLLQQLPLIS

SEQ ID NO: 2720509 - protein, 21 aa, Entamoeba histolytica
LYDMGPLGCALKQNILQFWRK

SEQ ID NO: 2720510 - protein, 25 aa, Entamoeba histolytica
LYDSQYPAELLYTLQLITSIEGMRQ

SEQ ID NO: 2720511 - protein, 17 aa, Entamoeba histolytica
LYDVICSFLSLNITRQF

SEQ ID NO: 2720512 - protein, 24 aa, Entamoeba histolytica
LYESLSHLFFSTTSCILIVVDLSE

SEQ ID NO: 2720513 - protein, 18 aa, Entamoeba histolytica
LYFDSIRVSNRLSAELYL

SEQ ID NO: 2720514 - protein, 20 aa, Entamoeba histolytica
LYFEARFLPLISQKKNKQPK

SEQ ID NO: 2720515 - protein, 17 aa, Entamoeba histolytica
LYFGMPYSLWRSGVIFK

SEQ ID NO: 2720516 - protein, 20 aa, Entamoeba histolytica
LYFTEKKIVSLSSVRYLIFD

SEQ ID NO: 2720517 - protein, 18 aa, Entamoeba histolytica
LYGTSWKLLLKVICEKEK

SEQ ID NO: 2720518 - protein, 19 aa, Entamoeba histolytica
LYHETISPVLSYFDITPNS

SEQ ID NO: 2720519 - protein, 17 aa, Entamoeba histolytica
LYHQLYHSVYKSIKLLN

SEQ ID NO: 2720520 - protein, 18 aa, Entamoeba histolytica
LYIPRHCSVTHTLIAADD

SEQ ID NO: 2720521 - protein, 18 aa, Entamoeba histolytica
LYIRCEVVALLDDEKNLK

SEQ ID NO: 2720522 - protein, 36 aa, Entamoeba histolytica
LYKHVAQPPPDFSKVPPLFRSTPLIRHHNASKPRLI

SEQ ID NO: 2720523 - protein, 19 aa, Entamoeba histolytica
LYKIKEIYSFSKHAIRVYD

SEQ ID NO: 2720524 - protein, 20 aa, Entamoeba histolytica
LYKNLQLINKYFINPLNEFV

SEQ ID NO: 2720525 - protein, 17 aa, Entamoeba histolytica
LYLIVCITPVQYRLRIV

SEQ ID NO: 2720526 - protein, 20 aa, Entamoeba histolytica
LYLKSFSSKMIKFFGTQALK

SEQ ID NO: 2720527 - protein, 21 aa, Entamoeba histolytica
LYLLIEYIQYPIKVVCSKEYV

SEQ ID NO: 2720528 - protein, 18 aa, Entamoeba histolytica
LYLNKTIDKIKNQKWKPV

SEQ ID NO: 2720529 - protein, 17 aa, Entamoeba histolytica
LYLPNTLMKIVSRNSKI

SEQ ID NO: 2720530 - protein, 17 aa, Entamoeba histolytica
LYLVEDCGHNDIFSNIE

SEQ ID NO: 2720531 - protein, 24 aa, Entamoeba histolytica
LYMWDFCQCDPKRCSGRKLVRQKL

SEQ ID NO: 2720532 - protein, 26 aa, Entamoeba histolytica
LYNDQSIFWKLYYKSTVYNNEHVLLT

SEQ ID NO: 2720533 - protein, 25 aa, Entamoeba histolytica
LYNDYDIIVLCYLLSEKQSIYINEL

SEQ ID NO: 2720534 - protein, 26 aa, Entamoeba histolytica
LYNDYDIIVLCYLLSEKQSIYINELC

SEQ ID NO: 2720535 - protein, 19 aa, Entamoeba histolytica
LYNELLTLNIPFGKTIIEK

SEQ ID NO: 2720536 - protein, 24 aa, Entamoeba histolytica
LYNIRYSLDFIPPTRKVNLQCIVP

SEQ ID NO: 2720537 - protein, 18 aa, Entamoeba histolytica
LYNMVHSFPLLNISTISQ

SEQ ID NO: 2720538 - protein, 41 aa, Entamoeba histolytica
LYNTLIETFMKLKITPFSGGFIFMYDIRYLTDLIRSSSFPL

SEQ ID NO: 2720539 - protein, 27 aa, Entamoeba histolytica
LYPNEIIPCSLLKELFIRFQDEMNKKI

SEQ ID NO: 2720540 - protein, 28 aa, Entamoeba histolytica
LYPNRETSFIFTCHGAFWVLSDGKVYIH

SEQ ID NO: 2720541 - protein, 26 aa, Entamoeba histolytica
LYPQMQALRFPIFSSFHNFGIRYCNA

SEQ ID NO: 2720542 - protein, 19 aa, Entamoeba histolytica
LYQIIQLKGSFPQKMIREG

SEQ ID NO: 2720543 - protein, 18 aa, Entamoeba histolytica
LYQKDILPIIPLKTKRSI

SEQ ID NO: 2720544 - protein, 25 aa, Entamoeba histolytica
LYQKILYSPVIFPTTSPVSAVCKDF

SEQ ID NO: 2720545 - protein, 18 aa, Entamoeba histolytica
LYQQASSPVLSPIGKPQI

SEQ ID NO: 2720546 - protein, 19 aa, Entamoeba histolytica
LYQTILYNLSLNESPFTFE

SEQ ID NO: 2720547 - protein, 28 aa, Entamoeba histolytica
LYRHANAKNLFIPFFQRTKTNGDKYVGA

SEQ ID NO: 2720548 - protein, 18 aa, Entamoeba histolytica
LYRKMVPYMKERTTAGID

SEQ ID NO: 2720549 - protein, 26 aa, Entamoeba histolytica
LYRPIEVTCYPFMYMQTPQPPQPTDK

SEQ ID NO: 2720550 - protein, 30 aa, Entamoeba histolytica; identical to SEQ ID NO: 2533188

SEQ ID NO: 2720551 - protein, 25 aa, Entamoeba histolytica
LYSIFENFGIILDLKQIKTITHPIL

SEQ ID NO: 2720552 - protein, 23 aa, Entamoeba histolytica
LYSLGVILYYMATKEFPFTDIPD

SEQ ID NO: 2720553 - protein, 26 aa, Entamoeba histolytica
LYSNFNIKFYSCISWSIHCCIMAFEK

SEQ ID NO: 2720554 - protein, 19 aa, Entamoeba histolytica
LYSPLLPKPLVADRAPIKC

SEQ ID NO: 2720555 - protein, 25 aa, Entamoeba histolytica
LYTYTFKYIATKIVLLWLSTKIITV

SEQ ID NO: 2720556 - protein, 19 aa, Entamoeba histolytica
LYVMCYGGKQSGKTFSLEG

SEQ ID NO: 2720557 - protein, 21 aa, Entamoeba histolytica
LYVPIIHFLIATYQNHEILLV

SEQ ID NO: 2720558 - protein, 27 aa, Entamoeba histolytica
LYYTSNQFIIWFNTIKQYIINKLNELK

SEQ ID NO: 2720559 - protein, 26 aa, Entamoeba histolytica
MAAVLKRFFRNLPEKVFNRINTNKAL

SEQ ID NO: 2720560 - protein, 17 aa, Entamoeba histolytica
MAAWMKYGLPQTQQEVI

SEQ ID NO: 2720561 - protein, 26 aa, Entamoeba histolytica
MAEDHFRMLIIDSVTSLFRVDFSGRG

SEQ ID NO: 2720562 - protein, 33 aa, Entamoeba histolytica
MAEGDPPYMEFPPLRALFLITTKGIPPLKNAEK

SEQ ID NO: 2720563 - protein, 19 aa, Entamoeba histolytica
MAHHWPVRKPRPTAEKITS

SEQ ID NO: 2720564 - protein, 20 aa, Entamoeba histolytica
MAIMLSDLYAIYNRARGILI

SEQ ID NO: 2720565 - protein, 23 aa, Entamoeba histolytica
MAKDDYAWWKGRLSQMSQYFNAY

SEQ ID NO: 2720566 - protein, 32 aa, Entamoeba histolytica
MAKDLISLKKLWIILGWYYFYETMKENELEKS

SEQ ID NO: 2720567 - protein, 21 aa, Entamoeba histolytica
MAKLDFVIKDQLLQRMKDGVY

SEQ ID NO: 2720568 - protein, 25 aa, Entamoeba histolytica
MALFKDLERVIKLGKYTIIAGSGEY

SEQ ID NO: 2720569 - protein, 31 aa, Entamoeba histolytica
MALGSLPGVIPFLFEKLQKKKSFFLMSAMKE

SEQ ID NO: 2720570 - protein, 17 aa, Entamoeba histolytica
MALKYLHSLNIIHRDLK

SEQ ID NO: 2720571 - protein, 17 aa, Entamoeba histolytica
MALYPNPVIAQSQKIRS

SEQ ID NO: 2720572 - protein, 19 aa, Entamoeba histolytica
MANNLIELLLIFSSKKKMS

SEQ ID NO: 2720573 - protein, 25 aa, Entamoeba histolytica
MAQLVHCLRLIGFDYVFDVDAGADK

SEQ ID NO: 2720574 - protein, 17 aa, Entamoeba histolytica
MAQWIVKKYPSIPEIND

SEQ ID NO: 2720575 - protein, 30 aa, Entamoeba histolytica
MARKMTMRTLHFFVWKKYILPNGKIVTSEM

SEQ ID NO: 2720576 - protein, 27 aa, Entamoeba histolytica
MARLENSLRKWTQMTEELTLNLDDETA

SEQ ID NO: 2720577 - protein, 23 aa, Entamoeba histolytica
MARYLVDVAIKRKTLDNVTVSIC

SEQ ID NO: 2720578 - protein, 18 aa, Entamoeba histolytica
MAVFCTPDFRIALQHSDV

SEQ ID NO: 2720579 - protein, 19 aa, Entamoeba histolytica
MAVLKPKLRGDFSSIIEFL

SEQ ID NO: 2720580 - protein, 19 aa, Entamoeba histolytica
MCDLLLSKYQRLDLLLNNA

SEQ ID NO: 2720581 - protein, 18 aa, Entamoeba histolytica
MCDSVLLALPTQPLLAHL

SEQ ID NO: 2720582 - protein, 35 aa, Entamoeba histolytica
MCIDGNIYYELFLVKMLPFFKDLINKKILVTKVHL

SEQ ID NO: 2720583 - protein, 29 aa, Entamoeba histolytica
MCKDFKAILTLLDGIFTFQNKNLYFYVMV

SEQ ID NO: 2720584 - protein, 23 aa, Entamoeba histolytica
MCKKLFVVPITLSCGHTFCYTCD

SEQ ID NO: 2720585 - protein, 23 aa, Entamoeba histolytica
MCLFLCNGLFKETMNPLPLSCVE

SEQ ID NO: 2720586 - protein, 18 aa, Entamoeba histolytica
MCSTITVFFSKFPSKLLG

SEQ ID NO: 2720587 - protein, 26 aa, Entamoeba histolytica
MCVCPLFPGEFTYKVLLLSDCYIGLD

SEQ ID NO: 2720588 - protein, 17 aa, Entamoeba histolytica
MCYDRYNIIKRLGDGQY

SEQ ID NO: 2720589 - protein, 25 aa, Entamoeba histolytica
MDAANILKPMLSRGELRCIGATTLE

SEQ ID NO: 2720590 - protein, 24 aa, Entamoeba histolytica
MDAKVIAPYLNTILDRMFEMIEFV

SEQ ID NO: 2720591 - protein, 22 aa, Entamoeba histolytica
MDDKGFISTEILAKLLACSPEN

SEQ ID NO: 2720592 - protein, 33 aa, Entamoeba histolytica
MDEIILKRKIIPLETIRLPQLPKVNLLDSLRRC

SEQ ID NO: 2720593 - protein, 30 aa, Entamoeba histolytica
MDFTKKLQLPILSSPFQFIIPSQRCFLLIV

SEQ ID NO: 2720594 - protein, 20 aa, Entamoeba histolytica
MDINQLPIRSIFNCFHRTSV

SEQ ID NO: 2720595 - protein, 18 aa, Entamoeba histolytica
MDKTPILPETSLFRLHGD

SEQ ID NO: 2720596 - protein, 17 aa, Entamoeba histolytica
MDKVLSINPHFKHQIGA

SEQ ID NO: 2720597 - protein, 23 aa, Entamoeba histolytica
MDLLDLYTFIHGLSTPPPISFIR

SEQ ID NO: 2720598 - protein, 17 aa, Entamoeba histolytica
MDMTKFRKLEKLSIIVC

SEQ ID NO: 2720599 - protein, 27 aa, Entamoeba histolytica
MDMVSEKLGKYLLQGWTMLGSCCINHP

SEQ ID NO: 2720600 - protein, 25 aa, Entamoeba histolytica
MDNSHIYMFKTLRSFVFDEKCPNPL

SEQ ID NO: 2720601 - protein, 33 aa, Entamoeba histolytica
MDPAWKELMTLIQDIWFNPIIQKYNCPPYHEDI

SEQ ID NO: 2720602 - protein, 17 aa, Entamoeba histolytica
MDPIIGRDEEIKRVIRI

SEQ ID NO: 2720603 - protein, 33 aa, Entamoeba histolytica
MDPKFTFQWGYDQTLLNYLYYKGELIDVGLDVD

SEQ ID NO: 2720604 - protein, 19 aa, Entamoeba histolytica
MDQLPKALVIIFECMYNKG

SEQ ID NO: 2720605 - protein, 20 aa, Entamoeba histolytica
MDQYIYCYVVGYKVVSQSKE

SEQ ID NO: 2720606 - protein, 24 aa, Entamoeba histolytica
MDTFCKLAHMFGTKLVDCVHLLPS

SEQ ID NO: 2720607 - protein, 26 aa, Entamoeba histolytica
MDTIIKPFQFLHCHILRGYLQITLKV

SEQ ID NO: 2720608 - protein, 19 aa, Entamoeba histolytica
MDTKDKIFKCVFISLISFI

SEQ ID NO: 2720609 - protein, 25 aa, Entamoeba histolytica
MDVLYGRVYPLKLGYIGVLNRSQHD

SEQ ID NO: 2720610 - protein, 44 aa, Entamoeba histolytica
MDVNDFTFFLPFFLKDDIKEYMLWFNRIYDIKSFMGSSLLTFKE

SEQ ID NO: 2720611 - protein, 19 aa, Entamoeba histolytica
MDYYMTLLSKYSILQGCFE

SEQ ID NO: 2720612 - protein, 24 aa, Entamoeba histolytica
MEALTALTLLSFIGAAKPSLILNK

SEQ ID NO: 2720613 - protein, 37 aa, Entamoeba histolytica
MECNASLLMILNTPLILYIIDHLLTQNVEQIFIACNL

SEQ ID NO: 2720614 - protein, 20 aa, Entamoeba histolytica
MEDHPILQLMELGIPCTINT

SEQ ID NO: 2720615 - protein, 24 aa, Entamoeba histolytica
MEDKLALEFLDKFEQKFISQDYYE

SEQ ID NO: 2720616 - protein, 32 aa, Entamoeba histolytica
MEDWKILKDITVLKWALLKKDTGILTPIELCQ

SEQ ID NO: 2720617 - protein, 23 aa, Entamoeba histolytica
MEDWKILKDITVLKWALLTEDTG

SEQ ID NO: 2720618 - protein, 18 aa, Entamoeba histolytica
MEEDLLDLPWNRCWIDGN

SEQ ID NO: 2720619 - protein, 26 aa, Entamoeba histolytica
MEEEYLLKKACEALLLLGMFHGNKIG

SEQ ID NO: 2720620 - protein, 18 aa, Entamoeba histolytica
MEERIQNLHYEELSEKYT

SEQ ID NO: 2720621 - protein, 25 aa, Entamoeba histolytica
MEFKGEACVLKFYLAPKFDEEDEPQ

SEQ ID NO: 2720622 - protein, 21 aa, Entamoeba histolytica
MEIAEKALEFGKSLHLRCDSI

SEQ ID NO: 2720623 - protein, 24 aa, Entamoeba histolytica
MEIEKLLTWARSFKKPINIKREQK

SEQ ID NO: 2720624 - protein, 25 aa, Entamoeba histolytica
MEIKKPLFVIGLPRSGTTFLHHLLA

SEQ ID NO: 2720625 - protein, 25 aa, Entamoeba histolytica
MEKCILWPDYCDLLLIALERSHNKP

SEQ ID NO: 2720626 - protein, 21 aa, Entamoeba histolytica
MEKCISSVWSTELLEQSIPTI

SEQ ID NO: 2720627 - protein, 34 aa, Entamoeba histolytica
MEKFNTQLPHKFIKKPFKIPTINILIKGDENDEK

SEQ ID NO: 2720628 - protein, 24 aa, Entamoeba histolytica
MEKGFLFQQLPQTTPSLILTLNHI

SEQ ID NO: 2720629 - protein, 19 aa, Entamoeba histolytica
MEKIMGRIDLPFIQRIYNS

SEQ ID NO: 2720630 - protein, 31 aa, Entamoeba histolytica
MEKVRLLTVVSLLELYRSLNVLFIKGAHIKS

SEQ ID NO: 2720631 - protein, 29 aa, Entamoeba histolytica
MELAQMKYVTLYKYWWDGLKEKVDIERWS

SEQ ID NO: 2720632 - protein, 19 aa, Entamoeba histolytica
MELEETAIGLIFGKKFITQ

SEQ ID NO: 2720633 - protein, 17 aa, Entamoeba histolytica
MELHNMLCVYFDEWFKK

SEQ ID NO: 2720634 - protein, 27 aa, Entamoeba histolytica
MELKGNVRVFCRVRPPLKNEGISVGVT

SEQ ID NO: 2720635 - protein, 24 aa, Entamoeba histolytica
MELKKLCNHPILINELMNSENEEN

SEQ ID NO: 2720636 - protein, 17 aa, Entamoeba histolytica
MELKQFYILIIKELIQS

SEQ ID NO: 2720637 - protein, 19 aa, Entamoeba histolytica
MELSGKTAFLAKLLAFLRK

SEQ ID NO: 2720638 - protein, 23 aa, Entamoeba histolytica
MELSPAIQKKYPKLAKPNQPLGS

SEQ ID NO: 2720639 - protein, 34 aa, Entamoeba histolytica
MELVDLTSLCYFFIFLQPKYIVHSLPFQELLTLY

SEQ ID NO: 2720640 - protein, 20 aa, Entamoeba histolytica
MEMKLELDSITKTNLIESES

SEQ ID NO: 2720641 - protein, 26 aa, Entamoeba histolytica
MEMNELLLCSPFLRTTQSYLSQIVSL

SEQ ID NO: 2720642 - protein, 25 aa, Entamoeba histolytica
MENDLYIEKVLLFQQRECCSATHIN

SEQ ID NO: 2720643 - protein, 17 aa, Entamoeba histolytica
MENGLLTQMIWKEILRN

SEQ ID NO: 2720644 - protein, 23 aa, Entamoeba histolytica
MENKSIITHFKFGVIYVKPNQND

SEQ ID NO: 2720645 - protein, 25 aa, Entamoeba histolytica
MEPGKDWLLFPNMGAYTISMATNFN

SEQ ID NO: 2720646 - protein, 18 aa, Entamoeba histolytica
MEPVPTPFTIAPENIVKH

SEQ ID NO: 2720647 - protein, 25 aa, Entamoeba histolytica
MEQFHFNPIPLNQYSRKLFPNIETF

SEQ ID NO: 2720648 - protein, 25 aa, Entamoeba histolytica
MEQKTWGNTLIPFSFRNGGSFFIII

SEQ ID NO: 2720649 - protein, 23 aa, Entamoeba histolytica
MEQLCGIVIFMFAKPEIVPLMKN

SEQ ID NO: 2720650 - protein, 24 aa, Entamoeba histolytica
MERFHFNPIPLNQHSRKLFPNINI

SEQ ID NO: 2720651 - protein, 25 aa, Entamoeba histolytica
MERFHFNPIPLNQYSRRLFPNIETF

SEQ ID NO: 2720652 - protein, 23 aa, Entamoeba histolytica
MERFREQFAYIMKNNLETLCMKY

SEQ ID NO: 2720653 - protein, 25 aa, Entamoeba histolytica
MERFRFNPIPLDDYSRKFFPNIETL

SEQ ID NO: 2720654 - protein, 18 aa, Entamoeba histolytica
MERLLKRLDKIKNGIIVI

SEQ ID NO: 2720655 - protein, 19 aa, Entamoeba histolytica
METGQIFGWYLNETIPQRK

SEQ ID NO: 2720656 - protein, 24 aa, Entamoeba histolytica
METMKILLLQYFQCYTEELLKLKS

SEQ ID NO: 2720657 - protein, 19 aa, Entamoeba histolytica
MEYLFKLYDAVDQTITLLS

SEQ ID NO: 2720658 - protein, 17 aa, Entamoeba histolytica
MFDIIKQKLEDNANAGL

SEQ ID NO: 2720659 - protein, 24 aa, Entamoeba histolytica
MFEIGLRFFFTDVKILIDYATKLV

SEQ ID NO: 2720660 - protein, 23 aa, Entamoeba histolytica
MFERDFHFAYEYLKDHLKMHQLE

SEQ ID NO: 2720661 - protein, 18 aa, Entamoeba histolytica
MFGAADWFNKLIGQFWGG

SEQ ID NO: 2720662 - protein, 18 aa, Entamoeba histolytica
MFIEPQPIPLLKEFLYMI

SEQ ID NO: 2720663 - protein, 17 aa, Entamoeba histolytica
MFIGQSIQKAISFGVKA

SEQ ID NO: 2720664 - protein, 17 aa, Entamoeba histolytica
MFIKYRPVDFNENMLDF

SEQ ID NO: 2720665 - protein, 21 aa, Entamoeba histolytica
MFKCVFDILKTLKTLSHFVAL

SEQ ID NO: 2720666 - protein, 17 aa, Entamoeba histolytica
MFLFVLNGKGAYPFKLE

SEQ ID NO: 2720667 - protein, 23 aa, Entamoeba histolytica
MFNAVERLPIVVKMILSNTLEER

SEQ ID NO: 2720668 - protein, 23 aa, Entamoeba histolytica
MFNKPPPINITIKITLKSVKNGL

SEQ ID NO: 2720669 - protein, 34 aa, Entamoeba histolytica
MFNYDYRIHGTSLGYWIIVLDGNGDYILYYQYFI

SEQ ID NO: 2720670 - protein, 24 aa, Entamoeba histolytica
MFQFNEEFLIFIADSLYDGRFTTF

SEQ ID NO: 2720671 - protein, 21 aa, Entamoeba histolytica
MFQTALHEAIPYLAEAMNIPL

SEQ ID NO: 2720672 - protein, 28 aa, Entamoeba histolytica
MFRDGKLNYLQYTKSKLQKLLQQYLAVE

SEQ ID NO: 2720673 - protein, 25 aa, Entamoeba histolytica
MFSQFMKLCYKIHTYSDINLMNAKN

SEQ ID NO: 2720674 - protein, 17 aa, Entamoeba histolytica
MFSSLFDIYSSFISTLC

SEQ ID NO: 2720675 - protein, 27 aa, Entamoeba histolytica
MFSTIKHRYFYIEKGILYSQNITWWTE

SEQ ID NO: 2720676 - protein, 17 aa, Entamoeba histolytica
MFSVSYKNILDIILERI

SEQ ID NO: 2720677 - protein, 18 aa, Entamoeba histolytica
MFTAAQSMKCSCPLPHTP

SEQ ID NO: 2720678 - protein, 26 aa, Entamoeba histolytica
MFTNTFLKEIVLPPCFISLSSMCFDS

SEQ ID NO: 2720679 - protein, 32 aa, Entamoeba histolytica
MFTRKQSLCLISCMLFGLYSLKLRKDSRKFNE

SEQ ID NO: 2720680 - protein, 21 aa, Entamoeba histolytica
MFVKISHWIVGGDGWAYDIGY

SEQ ID NO: 2720681 - protein, 17 aa, Entamoeba histolytica
MFYGLLENQSEKSEKKE

SEQ ID NO: 2720682 - protein, 20 aa, Entamoeba histolytica
MGCTSVVILIIDNTIYCGNA

SEQ ID NO: 2720683 - protein, 24 aa, Entamoeba histolytica
MGECRRLYCPLANSVYATIREFGG

SEQ ID NO: 2720684 - protein, 18 aa, Entamoeba histolytica
MGEIVALNTLLKKNLRSI

SEQ ID NO: 2720685 - protein, 19 aa, Entamoeba histolytica
MGFIGVIITINGKRIYHAG

SEQ ID NO: 2720686 - protein, 24 aa, Entamoeba histolytica
MGIEGFPTLKLFDGTSLISEYEKE

SEQ ID NO: 2720687 - protein, 20 aa, Entamoeba histolytica
MGIVIGNIKKWKFNCKDAEE

SEQ ID NO: 2720688 - protein, 21 aa, Entamoeba histolytica
MGKAIMYCFRYAFSLLDEGEQ

SEQ ID NO: 2720689 - protein, 17 aa, Entamoeba histolytica
MGKLLKPISLLISGMEN

SEQ ID NO: 2720690 - protein, 25 aa, Entamoeba histolytica
MGKTAVFVISILNQGLCLGDYVSAL

SEQ ID NO: 2720691 - protein, 32 aa, Entamoeba histolytica
MGKTAVFVLSILNQGLFLGDHVSAIVICHTRE

SEQ ID NO: 2720692 - protein, 24 aa, Entamoeba histolytica
MGLPSNFMMKFFFKPAEKVSDEIE

SEQ ID NO: 2720693 - protein, 17 aa, Entamoeba histolytica
MGLRRIKYWDNIFVDFV

SEQ ID NO: 2720694 - protein, 24 aa, Entamoeba histolytica
MGMVSPPYPAVTPTAAVSDAIVAE

SEQ ID NO: 2720695 - protein, 26 aa, Entamoeba histolytica
MGNAGLIQWLIKLSDFNIFARKEMGV

SEQ ID NO: 2720696 - protein, 19 aa, Entamoeba histolytica
MGNKYKIIRWAAPGSCVIG

SEQ ID NO: 2720697 - protein, 26 aa, Entamoeba histolytica
MGNVFYEYHPGKHLFPFCIPLKNFPH

SEQ ID NO: 2720698 - protein, 28 aa, Entamoeba histolytica
MGSIGHSLIFLGPLEKSFILLMEKKNVK

SEQ ID NO: 2720699 - protein, 18 aa, Entamoeba histolytica
MGVFNLFKDYEELLFEKR

SEQ ID NO: 2720700 - protein, 17 aa, Entamoeba histolytica
MGYNLLFEGMLASVITA

SEQ ID NO: 2720701 - protein, 17 aa, Entamoeba histolytica
MGYYTMLSLFSIGSRRG

SEQ ID NO: 2720702 - protein, 22 aa, Entamoeba histolytica
MHAKLLIEITQRKFAPTTLKEA

SEQ ID NO: 2720703 - protein, 19 aa, Entamoeba histolytica
MHFAHEQLTYRYFKEMQEI

SEQ ID NO: 2720704 - protein, 20 aa, Entamoeba histolytica
MHIDIRWLFTDSYFQKTTLL

SEQ ID NO: 2720705 - protein, 18 aa, Entamoeba histolytica
MHINFSYISRICDMDRSY

SEQ ID NO: 2720706 - protein, 17 aa, Entamoeba histolytica
MHLVLLNGEPPSVISQT

SEQ ID NO: 2720707 - protein, 18 aa, Entamoeba histolytica
MHRVLEETLYQNVKQQDE

SEQ ID NO: 2720708 - protein, 23 aa, Entamoeba histolytica
MHSNLFYHMILHCKFQQPFILDN

SEQ ID NO: 2720709 - protein, 19 aa, Entamoeba histolytica
MIAWTGYLMSKSGQFTPIE

SEQ ID NO: 2720710 - protein, 19 aa, Entamoeba histolytica
MICLEECIILIKSKKIAED

SEQ ID NO: 2720711 - protein, 34 aa, Entamoeba histolytica
MIDPNAKMLLELKFNKLYGLLDSFYKISKKVSSK

SEQ ID NO: 2720712 - protein, 18 aa, Entamoeba histolytica
MIEASFRAIERKLAQQAL

SEQ ID NO: 2720713 - protein, 24 aa, Entamoeba histolytica
MIENLLNMNLIPEDALRALCDKAK

SEQ ID NO: 2720714 - protein, 22 aa, Entamoeba histolytica
MIETSLFMIAIIRESTQPKCID

SEQ ID NO: 2720715 - protein, 17 aa, Entamoeba histolytica
MIFGFRKGFKEGKGREL

SEQ ID NO: 2720716 - protein, 18 aa, Entamoeba histolytica
MIFILMLITDINSEIQNN

SEQ ID NO: 2720717 - protein, 20 aa, Entamoeba histolytica
MIGDESLPFVLLNSKDNQQL

SEQ ID NO: 2720718 - protein, 61 aa, Entamoeba histolytica
MIGGSDALFFFQYTKLPMNVLSKIWSLSVPPKKPMYLSEFAKALVLIYYAQQNQPISNELF

SEQ ID NO: 2720719 - protein, 20 aa, Entamoeba histolytica
MIGLIAYRNDLVGGIKLSTT

SEQ ID NO: 2720720 - protein, 19 aa, Entamoeba histolytica
MIGPFYCNFGRYISIGDNC

SEQ ID NO: 2720721 - protein, 19 aa, Entamoeba histolytica
MIHFLKYLQYWKQPNYIKF

SEQ ID NO: 2720722 - protein, 21 aa, Entamoeba histolytica
MIIPKELIEKTKQWLKEFILD

SEQ ID NO: 2720723 - protein, 21 aa, Entamoeba histolytica
MIIQAQMIGLKLFKELDELLE

SEQ ID NO: 2720724 - protein, 19 aa, Entamoeba histolytica
MIISHFPYGPTAYFGLYNV

SEQ ID NO: 2720725 - protein, 18 aa, Entamoeba histolytica
MIISPKWVRMSEYYYLGG

SEQ ID NO: 2720726 - protein, 19 aa, Entamoeba histolytica
MIKAFRLACYKFPGRQKLL

SEQ ID NO: 2720727 - protein, 26 aa, Entamoeba histolytica
MIKGTCLEKYLTPEIIKDCKHYEKEE

SEQ ID NO: 2720728 - protein, 31 aa, Entamoeba histolytica
MIKHGKYGRNALLFNLCFVFDEGTTDGAISC

SEQ ID NO: 2720729 - protein, 19 aa, Entamoeba histolytica
MIKLIDKYPPTKIKKKIII

SEQ ID NO: 2720730 - protein, 19 aa, Entamoeba histolytica
MIKLILGPEDPLGKMKEFG

SEQ ID NO: 2720731 - protein, 25 aa, Entamoeba histolytica
MIKTLYGFFDEDIKFPKLPKVYIYK

SEQ ID NO: 2720732 - protein, 17 aa, Entamoeba histolytica
MIKYICLSGNRIKSIQV

SEQ ID NO: 2720733 - protein, 18 aa, Entamoeba histolytica
MIMKAFGANLVLSDGTKG

SEQ ID NO: 2720734 - protein, 18 aa, Entamoeba histolytica
MINAKQGIDIQNISLIYK

SEQ ID NO: 2720735 - protein, 31 aa, Entamoeba histolytica
MINWSSVPKLIKYLLFVPPISLPLNKKDYPN

SEQ ID NO: 2720736 - protein, 19 aa, Entamoeba histolytica
MIPLLFQFQYLLQNKIVYR

SEQ ID NO: 2720737 - protein, 36 aa, Entamoeba histolytica
MIPLTVHKIFTAIEELKTLGWQFKISVKYVEIYNNN

SEQ ID NO: 2720738 - protein, 18 aa, Entamoeba histolytica
MIQEMVRKNFKKCTTLTI

SEQ ID NO: 2720739 - protein, 21 aa, Entamoeba histolytica
MIQIPQLLQLLPLSCFEYSTQ

SEQ ID NO: 2720740 - protein, 17 aa, Entamoeba histolytica
MIQPRMLQSSFLSKVIR

SEQ ID NO: 2720741 - protein, 23 aa, Entamoeba histolytica
MIQPTIELLFSYWKQNKKSVITV

SEQ ID NO: 2720742 - protein, 17 aa, Entamoeba histolytica
MIRLHRMTRYNLRVKLG

SEQ ID NO: 2720743 - protein, 20 aa, Entamoeba histolytica
MISDLLQNKLDLSMLIISKT

SEQ ID NO: 2720744 - protein, 17 aa, Entamoeba histolytica
MISFILTYFEFVSSDYR

SEQ ID NO: 2720745 - protein, 18 aa, Entamoeba histolytica
MISILEAHSFFTEKGIGY

SEQ ID NO: 2720746 - protein, 28 aa, Entamoeba histolytica
MISINTLFFLRYLFIPFKETPSLFKIIQ

SEQ ID NO: 2720747 - protein, 28 aa, Entamoeba histolytica
MITERNYLNIFPFRKWSDKEIPEFHEGE

SEQ ID NO: 2720748 - protein, 30 aa, Entamoeba histolytica
MITSSPYLHLFLQRFKPLADLYFIQNSFIN

SEQ ID NO: 2720749 - protein, 20 aa, Entamoeba histolytica
MIVGYYLQEGCLKQFIKYLI

SEQ ID NO: 2720750 - protein, 24 aa, Entamoeba histolytica
MIVNSKMFFTFNSLSLYTCVFKVI

SEQ ID NO: 2720751 - protein, 18 aa, Entamoeba histolytica
MIVSKYFEDINDFINLEM

SEQ ID NO: 2720752 - protein, 18 aa, Entamoeba histolytica
MIYFIKFMNNIIQTIQRL

SEQ ID NO: 2720753 - protein, 18 aa, Entamoeba histolytica
MIYIPQYHILEAADNMMH

SEQ ID NO: 2720754 - protein, 17 aa, Entamoeba histolytica
MIYKNNVVLLYSITNTL

SEQ ID NO: 2720755 - protein, 30 aa, Entamoeba histolytica
MKAEKEIEELKKFVQQMSVVKDQMIDVVTQ

SEQ ID NO: 2720756 - protein, 24 aa, Entamoeba histolytica
MKAPKAMYKISYPSKINISQNDKF

SEQ ID NO: 2720757 - protein, 30 aa, Entamoeba histolytica
MKCKVCNCNLSISSYKLLKGTNEIYCSVHL

SEQ ID NO: 2720758 - protein, 24 aa, Entamoeba histolytica
MKCSNLHFIGIMTIGMVGDSKKNF

SEQ ID NO: 2720759 - protein, 21 aa, Entamoeba histolytica
MKDYIFEELFDKCKKLYIDEC

SEQ ID NO: 2720760 - protein, 22 aa, Entamoeba histolytica
MKEGPFIFSVDRHTLVGYLKEF

SEQ ID NO: 2720761 - protein, 25 aa, Entamoeba histolytica
MKEHMKPMYFKLADFLIHVIKKTVE

SEQ ID NO: 2720762 - protein, 33 aa, Entamoeba histolytica
MKEIRIELPKPPQTNLFIFIRMSDNTDSVAFIP

SEQ ID NO: 2720763 - protein, 22 aa, Entamoeba histolytica
MKEIRIMKLFHHPNICAFFDYY

SEQ ID NO: 2720764 - protein, 25 aa, Entamoeba histolytica
MKELITMKMNLPSLFVIFNVQDIIG

SEQ ID NO: 2720765 - protein, 26 aa, Entamoeba histolytica
MKETIKYAFFICETNIYPAPTLSGVI

SEQ ID NO: 2720766 - protein, 23 aa, Entamoeba histolytica
MKEWFENELKLQWNPIAYNNPDV

SEQ ID NO: 2720767 - protein, 21 aa, Entamoeba histolytica
MKFDELKYKYLSLPHDCSLHT

SEQ ID NO: 2720768 - protein, 21 aa, Entamoeba histolytica
MKFDRVLCDVPCSGDGTLRKN

SEQ ID NO: 2720769 - protein, 23 aa, Entamoeba histolytica
MKFHLCTHRFVHIDFGYILNKKP

SEQ ID NO: 2720770 - protein, 27 aa, Entamoeba histolytica
MKFNGGYSWWRRNSLTVFIDDKINKDP

SEQ ID NO: 2720771 - protein, 25 aa, Entamoeba histolytica
MKGERFVFLLCTRAGGIGINLSEAD

SEQ ID NO: 2720772 - protein, 22 aa, Entamoeba histolytica
MKGVSHFVSFAPMLDVFGKLED

SEQ ID NO: 2720773 - protein, 24 aa, Entamoeba histolytica
MKGYNTCYLIYSTLTTISIKHPDV

SEQ ID NO: 2720774 - protein, 42 aa, Entamoeba histolytica
MKHFIQKQILYQRMMYQYPYYYYPYCYYPQPYNINGDSPYFF

SEQ ID NO: 2720775 - protein, 18 aa, Entamoeba histolytica
MKHLYFTGSVNFAIGRMI

SEQ ID NO: 2720776 - protein, 19 aa, Entamoeba histolytica
MKHPNLITMYGLYKEKDTI

SEQ ID NO: 2720777 - protein, 28 aa, Entamoeba histolytica
MKIELNDVWNLDIILTTGAAKPVEKETR

SEQ ID NO: 2720778 - protein, 23 aa, Entamoeba histolytica
MKISEPMGIVLYSFKGESPNELD

SEQ ID NO: 2720779 - protein, 34 aa, Entamoeba histolytica; identical to SEQ ID NO: 2533424

SEQ ID NO: 2720780 - protein, 23 aa, Entamoeba histolytica
MKKCVNAFILSHNELTIKEICTS

SEQ ID NO: 2720781 - protein, 27 aa, Entamoeba histolytica
MKKEWDFSFIPTIELTLRLFGNCPYSI

SEQ ID NO: 2720782 - protein, 20 aa, Entamoeba histolytica
MKKRKLIQVIKSSSPPTIVF

SEQ ID NO: 2720783 - protein, 24 aa, Entamoeba histolytica
MKKSHLFIIVIATNQDIFGGFISH

SEQ ID NO: 2720784 - protein, 17 aa, Entamoeba histolytica
MKLETQLIVKNYKFGVL

SEQ ID NO: 2720785 - protein, 24 aa, Entamoeba histolytica
MKLKQDFLTPFLKSISIAISNNLS

SEQ ID NO: 2720786 - protein, 23 aa, Entamoeba histolytica
MKLLFDSDYLPYEMEYIIPCLQF

SEQ ID NO: 2720787 - protein, 25 aa, Entamoeba histolytica
MKLLIKLCEAVHLKEKIEAEFTGVK

SEQ ID NO: 2720788 - protein, 25 aa, Entamoeba histolytica
MKLMDKYFRIPLKEMANKGLLNENE

SEQ ID NO: 2720789 - protein, 19 aa, Entamoeba histolytica
MKLMPGSIYVFKTIKGIEV

SEQ ID NO: 2720790 - protein, 25 aa, Entamoeba histolytica
MKNCGSYFVKNLGRRCSKYIRKMKE

SEQ ID NO: 2720791 - protein, 27 aa, Entamoeba histolytica
MKNFDDFITKLVKLPRISLEQSREVLK

SEQ ID NO: 2720792 - protein, 28 aa, Entamoeba histolytica
MKQGNFYLSLLFLKYAQLFTPQYGDIYI

SEQ ID NO: 2720793 - protein, 25 aa, Entamoeba histolytica
MKQKLFEMLGHVFNYCFINYENTFD

SEQ ID NO: 2720794 - protein, 26 aa, Entamoeba histolytica
MKRARERQERLKQIQAAREAARREAE

SEQ ID NO: 2720795 - protein, 22 aa, Entamoeba histolytica
MKRILSLWAARHPASGYVQGIH

SEQ ID NO: 2720796 - protein, 26 aa, Entamoeba histolytica
MKRTSYTIMFLFYNKGFVNGMNNKIK

SEQ ID NO: 2720797 - protein, 25 aa, Entamoeba histolytica
MKTTKLCVMILKSLKLLKPENEFFS

SEQ ID NO: 2720798 - protein, 18 aa, Entamoeba histolytica
MKVHKLLSNLFKNGNKIT

SEQ ID NO: 2720799 - protein, 18 aa, Entamoeba histolytica
MKVIIKKKHKIFATEACR

SEQ ID NO: 2720800 - protein, 18 aa, Entamoeba histolytica
MKYKTVFVVPVIQSITDV

SEQ ID NO: 2720801 - protein, 19 aa, Entamoeba histolytica
MKYMYLNMFLIPFNDIIEE

SEQ ID NO: 2720802 - protein, 19 aa, Entamoeba histolytica
MLATGIEMQPILPGCPEID

SEQ ID NO: 2720803 - protein, 26 aa, Entamoeba histolytica
MLCTSQLPYLYVYITNNPVSIPYIAI

SEQ ID NO: 2720804 - protein, 27 aa, Entamoeba histolytica
MLDAECFAFLNRALESTLAPIVVFATN

SEQ ID NO: 2720805 - protein, 32 aa, Entamoeba histolytica
MLDKFRNEYIIHFYGAVFIPNKICIVTEYAEY

SEQ ID NO: 2720806 - protein, 25 aa, Entamoeba histolytica
MLEECLITCQILFKASSQLNEEEND

SEQ ID NO: 2720807 - protein, 18 aa, Entamoeba histolytica
MLELESKLNGHLAALRRS

SEQ ID NO: 2720808 - protein, 17 aa, Entamoeba histolytica
MLFDQRLQAIVLNIVDV

SEQ ID NO: 2720809 - protein, 17 aa, Entamoeba histolytica
MLFGFDIEPSLISTLLE

SEQ ID NO: 2720810 - protein, 18 aa, Entamoeba histolytica
MLFQNSSFLVILSSLPDS

SEQ ID NO: 2720811 - protein, 19 aa, Entamoeba histolytica
MLGLLNKYENYSLFLPSKR

SEQ ID NO: 2720812 - protein, 34 aa, Entamoeba histolytica
MLHINPYNVIAYLPYLIKVITNINALYINALEAQ

SEQ ID NO: 2720813 - protein, 17 aa, Entamoeba histolytica
MLHVINKSEFYIPGYWK

SEQ ID NO: 2720814 - protein, 19 aa, Entamoeba histolytica
MLIIAQYFPTINDLFHVML

SEQ ID NO: 2720815 - protein, 17 aa, Entamoeba histolytica
MLIIPKTLIENSGYDVI

SEQ ID NO: 2720816 - protein, 18 aa, Entamoeba histolytica
MLIQIDSVRDGIIPCIRG

SEQ ID NO: 2720817 - protein, 17 aa, Entamoeba histolytica
MLKNLIEFLKVTVIDKL

SEQ ID NO: 2720818 - protein, 17 aa, Entamoeba histolytica
MLNWVCFGGDSLTQQMM

SEQ ID NO: 2720819 - protein, 19 aa, Entamoeba histolytica
MLNYAPIKKELQTSKVIFL

SEQ ID NO: 2720820 - protein, 19 aa, Entamoeba histolytica
MLQFNIYGQPINIPINCSV

SEQ ID NO: 2720821 - protein, 26 aa, Entamoeba histolytica
MLQNEKKRLKLLAQPKTNESNIKKWK

SEQ ID NO: 2720822 - protein, 23 aa, Entamoeba histolytica
MLQVKLLRLWDPSKDLIKICVQK

SEQ ID NO: 2720823 - protein, 21 aa, Entamoeba histolytica
MLRHSDTVRDWVISSILSFFS

SEQ ID NO: 2720824 - protein, 17 aa, Entamoeba histolytica
MLRLKYPSFQITIAGHS

SEQ ID NO: 2720825 - protein, 28 aa, Entamoeba histolytica
MLSDGSYKLGPFLSTLFTVQDEDFEDDR

SEQ ID NO: 2720826 - protein, 18 aa, Entamoeba histolytica
MLSPLIRVEVSKALSLSG

SEQ ID NO: 2720827 - protein, 17 aa, Entamoeba histolytica
MLTPLTCRCGKTKIMPP

SEQ ID NO: 2720828 - protein, 18 aa, Entamoeba histolytica
MLYHFMPMEQSDITYILI

SEQ ID NO: 2720829 - protein, 19 aa, Entamoeba histolytica
MMCHRFHGKNPSKNKIKRT

SEQ ID NO: 2720830 - protein, 18 aa, Entamoeba histolytica
MMDAIIGVIVDRKKYMED

SEQ ID NO: 2720831 - protein, 26 aa, Entamoeba histolytica
MMDARDFVYQLIRYHNKDKTDYILYS

SEQ ID NO: 2720832 - protein, 18 aa, Entamoeba histolytica
MMEAQVWEPALIKLNAIA

SEQ ID NO: 2720833 - protein, 19 aa, Entamoeba histolytica
MMEAQVWEPALIKLNAIAA

SEQ ID NO: 2720834 - protein, 19 aa, Entamoeba histolytica
MMEFLKNKIQSDRLKNALS

SEQ ID NO: 2720835 - protein, 19 aa, Entamoeba histolytica
MMELFKNSLKRMMKTARAQ

SEQ ID NO: 2720836 - protein, 17 aa, Entamoeba histolytica
MMELYASDPMKYQKDFS

SEQ ID NO: 2720837 - protein, 35 aa, Entamoeba histolytica
MMENFFNGKILIALLDLFFDQHHYFYDWMLKRGEG

SEQ ID NO: 2720838 - protein, 23 aa, Entamoeba histolytica
MMIICKYFINIKDIINIELVCKK

SEQ ID NO: 2720839 - protein, 19 aa, Entamoeba histolytica
MMIISKYFNFSSDFIAMVQ

SEQ ID NO: 2720840 - protein, 21 aa, Entamoeba histolytica
MMKFDYLAIRNLIITLRQIKP

SEQ ID NO: 2720841 - protein, 18 aa, Entamoeba histolytica
MMKTMFCVIYREANTKNF

SEQ ID NO: 2720842 - protein, 18 aa, Entamoeba histolytica
MMLLGINGINKIDMIGRD

SEQ ID NO: 2720843 - protein, 30 aa, Entamoeba histolytica
MMNKNQHQLFYPLVSYIFSTYVNVFKTCPT

SEQ ID NO: 2720844 - protein, 18 aa, Entamoeba histolytica
MMRIRIIETMKKCGKYLE

SEQ ID NO: 2720845 - protein, 28 aa, Entamoeba histolytica
MMRMSEGIIILPRRKVLKQLPHMRAGQV

SEQ ID NO: 2720846 - protein, 34 aa, Entamoeba histolytica
MMTPLHYACVFKNIPVALFLYNKGSSLYLQDAMG

SEQ ID NO: 2720847 - protein, 19 aa, Entamoeba histolytica
MMTVAMYLYDFDSLKLFCC

SEQ ID NO: 2720848 - protein, 18 aa, Entamoeba histolytica
MMVLDLMRKNMIIGNVRL

SEQ ID NO: 2720849 - protein, 33 aa, Entamoeba histolytica; identical to SEQ ID NO: 2533510

SEQ ID NO: 2720850 - protein, 19 aa, Entamoeba histolytica
MMYEFDIIDLFLRNLRNEL

SEQ ID NO: 2720851 - protein, 28 aa, Entamoeba histolytica
MNDFPSNIVYLFLFNDIIVETKVVRFNG

SEQ ID NO: 2720852 - protein, 22 aa, Entamoeba histolytica
MNEAMKLYYPYSIELSWLYNEN

SEQ ID NO: 2720853 - protein, 25 aa, Entamoeba histolytica
MNEDSPCAFLLFKEMILFMRAFVEQ

SEQ ID NO: 2720854 - protein, 24 aa, Entamoeba histolytica
MNELQFMVFVFESFFKVHKGSLNN

SEQ ID NO: 2720855 - protein, 25 aa, Entamoeba histolytica
MNETINLRMNLESQILEMESAKVKV

SEQ ID NO: 2720856 - protein, 27 aa, Entamoeba histolytica
MNGFQGHLRLLFLENMLDLGSYERKCN

SEQ ID NO: 2720857 - protein, 18 aa, Entamoeba histolytica
MNGGLFLGGINKIIELLT

SEQ ID NO: 2720858 - protein, 24 aa, Entamoeba histolytica
MNHEGILNITIELPQSLLSSKYEV

SEQ ID NO: 2720859 - protein, 18 aa, Entamoeba histolytica
MNHHLSDISFLRRKKQES

SEQ ID NO: 2720860 - protein, 22 aa, Entamoeba histolytica
MNIIEILILPHLSQSLMCWKEL

SEQ ID NO: 2720861 - protein, 20 aa, Entamoeba histolytica
MNIPFIPISSAITAIPYPKS

SEQ ID NO: 2720862 - protein, 23 aa, Entamoeba histolytica
MNKASLYQFSFIRMTSGYSFEEF

SEQ ID NO: 2720863 - protein, 44 aa, Entamoeba histolytica
MNKCNGFVFVYQWLILLFKREFSLTNIFRIWDSIFAYPSRKFHL

SEQ ID NO: 2720864 - protein, 25 aa, Entamoeba histolytica
MNKIQFYCNCLFKKDSTLIFSKTDI

SEQ ID NO: 2720865 - protein, 24 aa, Entamoeba histolytica
MNKVRELHLIYFQAIETQEVVWHP

SEQ ID NO: 2720866 - protein, 18 aa, Entamoeba histolytica
MNKYNNWIVAGRTWKCCL

SEQ ID NO: 2720867 - protein, 17 aa, Entamoeba histolytica
MNLFEHCGDIVSIRISK

SEQ ID NO: 2720868 - protein, 25 aa, Entamoeba histolytica
MNNEDYLPSWISLSNVKNGLGVIIG

SEQ ID NO: 2720869 - protein, 18 aa, Entamoeba histolytica
MNNEVCVGLWVSEQYRMV

SEQ ID NO: 2720870 - protein, 24 aa, Entamoeba histolytica
MNNLLELWNIMDFTTDGALLGDYS

SEQ ID NO: 2720871 - protein, 18 aa, Entamoeba histolytica
MNNQIIIYNNYTPSIYLL

SEQ ID NO: 2720872 - protein, 24 aa, Entamoeba histolytica
MNQRYSLLDSILKDVVRSLEEMKN

SEQ ID NO: 2720873 - protein, 25 aa, Entamoeba histolytica
MNREVQLLYLIRNELELHLSKKHYE

SEQ ID NO: 2720874 - protein, 32 aa, Entamoeba histolytica
MNRMTMGIIPQPTILPCRCISRYDFIATSDKE

SEQ ID NO: 2720875 - protein, 23 aa, Entamoeba histolytica
MNRPVCVVGMMKLFSLSPFNTLM

SEQ ID NO: 2720876 - protein, 33 aa, Entamoeba histolytica
MNSLSTHLNVIRKTPQSLLKIGDSFLQIFNQED

SEQ ID NO: 2720877 - protein, 25 aa, Entamoeba histolytica
MNSVMIISFLQDYFRKPHIFQIDCK

SEQ ID NO: 2720878 - protein, 27 aa, Entamoeba histolytica
MPECNVAMMYVFALVLKAVESKKEINK

SEQ ID NO: 2720879 - protein, 20 aa, Entamoeba histolytica
MPEILKQLTVLPVESPVLLS

SEQ ID NO: 2720880 - protein, 21 aa, Entamoeba histolytica
MPGMPGMPPPPPPPGMPGMPP

SEQ ID NO: 2720881 - protein, 31 aa, Entamoeba histolytica
MPHDPTYLINYQNPLLWKNIMQPYTSKGYSS

SEQ ID NO: 2720882 - protein, 17 aa, Entamoeba histolytica
MPIPQKPIGYLPPSYPQ

SEQ ID NO: 2720883 - protein, 23 aa, Entamoeba histolytica
MPIQFTSFINWIKEIDFVRIVLI

SEQ ID NO: 2720884 - protein, 18 aa, Entamoeba histolytica
MPLPIPYFEEVYLDLKRI

SEQ ID NO: 2720885 - protein, 17 aa, Entamoeba histolytica
MPNYHNTPMLNPATPMT

SEQ ID NO: 2720886 - protein, 18 aa, Entamoeba histolytica
MPPPPPSNNLPPPGPANV

SEQ ID NO: 2720887 - protein, 19 aa, Entamoeba histolytica
MPYSLWRSGVIFKKEIRNE

SEQ ID NO: 2720888 - protein, 31 aa, Entamoeba histolytica
MQEESTPLMIYLCKLKKILSELPIASTVLHY

SEQ ID NO: 2720889 - protein, 45 aa, Entamoeba histolytica
MQFKHESRYRWFFRPLRKMSPYHMYLFKALRNYFMTQACSNPIQI

SEQ ID NO: 2720890 - protein, 23 aa, Entamoeba histolytica
MQGKWMFEYMSKVASSMTIAGMI

SEQ ID NO: 2720891 - protein, 18 aa, Entamoeba histolytica
MQIFLTSPIYRLKNTISK

SEQ ID NO: 2720892 - protein, 17 aa, Entamoeba histolytica
MQKLTLLNLFYHLDTFN

SEQ ID NO: 2720893 - protein, 26 aa, Entamoeba histolytica
MQNAYDSLFKIRKYEKFLGVKEEEVS

SEQ ID NO: 2720894 - protein, 24 aa, Entamoeba histolytica
MQNDFLAPFITPESASYSFLTQSF

SEQ ID NO: 2720895 - protein, 17 aa, Entamoeba histolytica
MQQIKYPTTISLLSYGT

SEQ ID NO: 2720896 - protein, 26 aa, Entamoeba histolytica
MQQPGMPPMGYPPMGMPPQGYPPMQQ

SEQ ID NO: 2720897 - protein, 23 aa, Entamoeba histolytica
MQRTPRYPLLLNTLIKVTNENSN

SEQ ID NO: 2720898 - protein, 26 aa, Entamoeba histolytica
MQTKKKRWCILTKNKLFYFNCKPEND

SEQ ID NO: 2720899 - protein, 25 aa, Entamoeba histolytica
MREDPELAMNYLLQNLQIGEDIDDD

SEQ ID NO: 2720900 - protein, 29 aa, Entamoeba histolytica
MRESIKYIYELILSPPLSDRFTTFMELVD

SEQ ID NO: 2720901 - protein, 19 aa, Entamoeba histolytica
MREWVLYSSEMRGLFGGDW

SEQ ID NO: 2720902 - protein, 17 aa, Entamoeba histolytica
MRFLCKKGALFFSTLKR

SEQ ID NO: 2720903 - protein, 19 aa, Entamoeba histolytica
MRIVQSWGILFPQEFKVYT

SEQ ID NO: 2720904 - protein, 17 aa, Entamoeba histolytica
MRKMELPFTLIVDDPMA

SEQ ID NO: 2720905 - protein, 21 aa, Entamoeba histolytica
MRLFSFDPVLGRRLDLFMKQL

SEQ ID NO: 2720906 - protein, 18 aa, Entamoeba histolytica
MRLGGIVAILRYELNLED

SEQ ID NO: 2720907 - protein, 23 aa, Entamoeba histolytica
MRNCDIGFMVVNDPLIEITKIEG

SEQ ID NO: 2720908 - protein, 18 aa, Entamoeba histolytica
MRNCVGISHFFVFDVFDK

SEQ ID NO: 2720909 - protein, 48 aa, Entamoeba histolytica
MRNEMQSYLYANRNCLPLLPNLPIGINPWYIWQIIPNINENDKCFLCG

SEQ ID NO: 2720910 - protein, 25 aa, Entamoeba histolytica
MRNNQLILMHLFNEMFKRKNLVDPK

SEQ ID NO: 2720911 - protein, 19 aa, Entamoeba histolytica
MRNSLSVQILLFIRQIYVT

SEQ ID NO: 2720912 - protein, 31 aa, Entamoeba histolytica
MRNYQVFQQAIFIALLSQFFEIVVRPPVKKS

SEQ ID NO: 2720913 - protein, 25 aa, Entamoeba histolytica
MRQKNPIYTFDFLTSYNGGMFTSDC

SEQ ID NO: 2720914 - protein, 26 aa, Entamoeba histolytica
MRQQRPWCLRFEYWKQILPMSASIVE

SEQ ID NO: 2720915 - protein, 27 aa, Entamoeba histolytica
MRTFGVDLFIKLGTFLELCKQKESDVF

SEQ ID NO: 2720916 - protein, 25 aa, Entamoeba histolytica
MRVREWYGWHFPELSKYINDHMAYC

SEQ ID NO: 2720917 - protein, 29 aa, Entamoeba histolytica
MRYVVHFNIILLLPPLDIIKDIPISVAIV

SEQ ID NO: 2720918 - protein, 27 aa, Entamoeba histolytica
MSAFTANLRFPSTLYNSLNSLMIHLCP

SEQ ID NO: 2720919 - protein, 18 aa, Entamoeba histolytica
MSCHLLGNVLKKYLNLMP

SEQ ID NO: 2720920 - protein, 23 aa, Entamoeba histolytica
MSDCSIAWFTAIKSVLKHFMTSE

SEQ ID NO: 2720921 - protein, 21 aa, Entamoeba histolytica
MSESLLGNELLYFHFISLSRN

SEQ ID NO: 2720922 - protein, 19 aa, Entamoeba histolytica
MSFQSAFFNFIMKTAERFY

SEQ ID NO: 2720923 - protein, 25 aa, Entamoeba histolytica
MSGEDPLKLDYWIKGKKKSTKKELK

SEQ ID NO: 2720924 - protein, 20 aa, Entamoeba histolytica
MSGRRNLILLSKVLQNLSNG

SEQ ID NO: 2720925 - protein, 19 aa, Entamoeba histolytica
MSHHIIYFLRCDSTDFSIE

SEQ ID NO: 2720926 - protein, 21 aa, Entamoeba histolytica
MSILNSLKRKAKLLYSVLNEC

SEQ ID NO: 2720927 - protein, 32 aa, Entamoeba histolytica
MSISSWNVVFKSWNNILPMGIGVLKSATELQD

SEQ ID NO: 2720928 - protein, 23 aa, Entamoeba histolytica
MSKKGNIRCLLPNELIRIKEFQP

SEQ ID NO: 2720929 - protein, 23 aa, Entamoeba histolytica
MSKWMAFECITRMVGFYDLDRKD

SEQ ID NO: 2720930 - protein, 29 aa, Entamoeba histolytica
MSLDSSTPWILYWTLNPLRLFGYNVDKYL

SEQ ID NO: 2720931 - protein, 29 aa, Entamoeba histolytica
MSLFTSIPNFLLLDPLMISRQITLIEWEM

SEQ ID NO: 2720932 - protein, 22 aa, Entamoeba histolytica
MSMIHPFNYRTAYPGMVHFVVI

SEQ ID NO: 2720933 - protein, 27 aa, Entamoeba histolytica
MSMMGHKVRVLPFSTFRMNLCDTTPYN

SEQ ID NO: 2720934 - protein, 18 aa, Entamoeba histolytica
MSMPGMMDTILNLGLNDK

SEQ ID NO: 2720935 - protein, 24 aa, Entamoeba histolytica
MSRNNALVLMPTGGGKSLCYQLPS

SEQ ID NO: 2720936 - protein, 18 aa, Entamoeba histolytica
MSRYETPFLKKPQTIMTK

SEQ ID NO: 2720937 - protein, 36 aa, Entamoeba histolytica; identical to SEQ ID NO: 2533614

SEQ ID NO: 2720938 - protein, 23 aa, Entamoeba histolytica
MSTAEKVFIQNIDFTTSASMKPV

SEQ ID NO: 2720939 - protein, 24 aa, Entamoeba histolytica
MSVQKTFLIKILKKVFVEETENKE

SEQ ID NO: 2720940 - protein, 24 aa, Entamoeba histolytica
MSVSFNWILDRCLSYGYEFKKRST

SEQ ID NO: 2720941 - protein, 20 aa, Entamoeba histolytica
MSVTIASFLCKVHYSYFSGS

SEQ ID NO: 2720942 - protein, 19 aa, Entamoeba histolytica
MSVYADALLAVPHALAENS

SEQ ID NO: 2720943 - protein, 21 aa, Entamoeba histolytica
MSYELFTSCFSQLKTKSFNKD

SEQ ID NO: 2720944 - protein, 21 aa, Entamoeba histolytica
MSYLVVDINIHSTIFAGSTSL

SEQ ID NO: 2720945 - protein, 19 aa, Entamoeba histolytica
MTALIPRNSTIPAKKSEIF

SEQ ID NO: 2720946 - protein, 18 aa, Entamoeba histolytica
MTDGILLREVIKDPTLEE

SEQ ID NO: 2720947 - protein, 26 aa, Entamoeba histolytica
MTDYSVDYILLVFVLSTISPSMFNQT

SEQ ID NO: 2720948 - protein, 34 aa, Entamoeba histolytica
MTEGDPPYMELPPLRALFLITTKGIPPLKERDSW

SEQ ID NO: 2720949 - protein, 29 aa, Entamoeba histolytica
MTELLTRLGCEIIPLNIKPTGDFPHIPEP

SEQ ID NO: 2720950 - protein, 27 aa, Entamoeba histolytica
MTEYVHPYYKHIEWLCGFTGSNATIVV

SEQ ID NO: 2720951 - protein, 24 aa, Entamoeba histolytica
MTGDAIRIKYLAAPLIFVALRRRK

SEQ ID NO: 2720952 - protein, 26 aa, Entamoeba histolytica
MTGFKGVLLIVFKTKIEFIDIASFTI

SEQ ID NO: 2720953 - protein, 25 aa, Entamoeba histolytica
MTHKKLCLRFTQDAIIKRLNKTATG

SEQ ID NO: 2720954 - protein, 22 aa, Entamoeba histolytica
MTKDIFAEKVLVQYSGILTIDD

SEQ ID NO: 2720955 - protein, 29 aa, Entamoeba histolytica
MTKHFQTLQYWTGFNHIQIIYDSNKNKFT

SEQ ID NO: 2720956 - protein, 19 aa, Entamoeba histolytica
MTKTCKIYRALFSSITKKD

SEQ ID NO: 2720957 - protein, 17 aa, Entamoeba histolytica
MTLIKRYSTMRFGFIQY

SEQ ID NO: 2720958 - protein, 17 aa, Entamoeba histolytica
MTLLFNDKVYFKDTSDG

SEQ ID NO: 2720959 - protein, 20 aa, Entamoeba histolytica
MTMFLHFHEIIAVNSMLMEK

SEQ ID NO: 2720960 - protein, 23 aa, Entamoeba histolytica
MTNDEIQYFKQYCKIVGEYGVNS

SEQ ID NO: 2720961 - protein, 17 aa, Entamoeba histolytica
MTPLQRKRWEEEERKRL

SEQ ID NO: 2720962 - protein, 23 aa, Entamoeba histolytica
MTRGRQREFCQCDFDIAGEYDPM

SEQ ID NO: 2720963 - protein, 25 aa, Entamoeba histolytica
MTRKGHMFSPLKNFRKWQRKTPKQM

SEQ ID NO: 2720964 - protein, 23 aa, Entamoeba histolytica
MTRNRYEWYILQFAMQRQGIIII

SEQ ID NO: 2720965 - protein, 18 aa, Entamoeba histolytica
MTRSLLLRDRLIELLDSL

SEQ ID NO: 2720966 - protein, 19 aa, Entamoeba histolytica
MTRSLLLRDRLIELLDSLL

SEQ ID NO: 2720967 - protein, 25 aa, Entamoeba histolytica
MTSFRDKFFELISQSYSVLLNQFKS

SEQ ID NO: 2720968 - protein, 17 aa, Entamoeba histolytica
MTSGILLLAKTIQAARE

SEQ ID NO: 2720969 - protein, 24 aa, Entamoeba histolytica
MTSKLIKRYLIPRYQATLERRKSP

SEQ ID NO: 2720970 - protein, 25 aa, Entamoeba histolytica
MTSQQLINFIISALPQRTSVDFKVS

SEQ ID NO: 2720971 - protein, 18 aa, Entamoeba histolytica
MTSTNLCVCFSPSLFRSP

SEQ ID NO: 2720972 - protein, 24 aa, Entamoeba histolytica
MTTEDFFGLFKQFILTVESSIKKM

SEQ ID NO: 2720973 - protein, 24 aa, Entamoeba histolytica
MTVGKLLELVSGKAGLMDGSFKYG

SEQ ID NO: 2720974 - protein, 23 aa, Entamoeba histolytica
MTVSKIIPCQFAVSFQGGVVMLI

SEQ ID NO: 2720975 - protein, 20 aa, Entamoeba histolytica
MTWIRALLKDKGIEEYQDPV

SEQ ID NO: 2720976 - protein, 25 aa, Entamoeba histolytica
MVACGNGMIYWLTTGALKITQSFEI

SEQ ID NO: 2720977 - protein, 25 aa, Entamoeba histolytica
MVAKSLEAKKLLYIPTVNLDEDCED

SEQ ID NO: 2720978 - protein, 31 aa, Entamoeba histolytica; identical to SEQ ID NO: 2533659

SEQ ID NO: 2720979 - protein, 19 aa, Entamoeba histolytica
MVDIFFRGAKGCVIVYDIT

SEQ ID NO: 2720980 - protein, 19 aa, Entamoeba histolytica
MVDYISYLKQWTNKSHFKI

SEQ ID NO: 2720981 - protein, 30 aa, Entamoeba histolytica
MVFWRQDRLNREIIILITNLVIEKKMPLNY

SEQ ID NO: 2720982 - protein, 17 aa, Entamoeba histolytica
MVFYMKSRTHAFLITIN

SEQ ID NO: 2720983 - protein, 23 aa, Entamoeba histolytica
MVGSGRWIDESPFLTLIGVHQKA

SEQ ID NO: 2720984 - protein, 28 aa, Entamoeba histolytica
MVHADLSEYNLLWWKNKVYVIDVGQSIE

SEQ ID NO: 2720985 - protein, 19 aa, Entamoeba histolytica
MVIARATELFLVDLIKKTN

SEQ ID NO: 2720986 - protein, 35 aa, Entamoeba histolytica
MVKIVFEPIFQYLMQTIIERLIIYQNLDSFSYFIY

SEQ ID NO: 2720987 - protein, 26 aa, Entamoeba histolytica
MVKLSLIHSLQLIKFIPIPNNSNEDS

SEQ ID NO: 2720988 - protein, 24 aa, Entamoeba histolytica
MVKTKTFLYSPEPSFWISYTVSSD

SEQ ID NO: 2720989 - protein, 17 aa, Entamoeba histolytica
MVLKTFHFAGVASMNIA

SEQ ID NO: 2720990 - protein, 17 aa, Entamoeba histolytica
MVLQKYSLGLIVDSFDP

SEQ ID NO: 2720991 - protein, 17 aa, Entamoeba histolytica
MVLVVTKVDQKEGRERN

SEQ ID NO: 2720992 - protein, 28 aa, Entamoeba histolytica
MVMDGARVILFFFDLTRVMTLNNIKDWY

SEQ ID NO: 2720993 - protein, 18 aa, Entamoeba histolytica
MVMELLGPSLEDLFTYCG

SEQ ID NO: 2720994 - protein, 28 aa, Entamoeba histolytica
MVNEIILLKKKWINQRWIYHGFNSSNEV

SEQ ID NO: 2720995 - protein, 17 aa, Entamoeba histolytica
MVNLLKKSNIALDIVSF

SEQ ID NO: 2720996 - protein, 27 aa, Entamoeba histolytica
MVNNGFSIFAPKGRKLPITFEGEYFNA

SEQ ID NO: 2720997 - protein, 30 aa, Entamoeba histolytica; identical to SEQ ID NO: 2533683

SEQ ID NO: 2720998 - protein, 20 aa, Entamoeba histolytica
MVTIIQPFIDIGFKNLAENL

SEQ ID NO: 2720999 - protein, 18 aa, Entamoeba histolytica
MVVDHWTFNWKTFKGGNH

SEQ ID NO: 2721000 - protein, 17 aa, Entamoeba histolytica
MVYLLNSLVLDMNEVDA

SEQ ID NO: 2721001 - protein, 29 aa, Entamoeba histolytica
MVYLTSERFMFIPQFLQMPHFMNNQGIKM

SEQ ID NO: 2721002 - protein, 18 aa, Entamoeba histolytica
MWDVYYAPLFTYDERILL

SEQ ID NO: 2721003 - protein, 29 aa, Entamoeba histolytica
MWSIGVITYVLLCGYPPFFASVLGIKYEG

SEQ ID NO: 2721004 - protein, 29 aa, Entamoeba histolytica
MWSLGCITAEFFLGIPIFPGNSEYNQLYK

SEQ ID NO: 2721005 - protein, 28 aa, Entamoeba histolytica
MYCWRCLLQFLVLCPAPHKCPVCNALIY

SEQ ID NO: 2721006 - protein, 17 aa, Entamoeba histolytica
MYDTELIQYLYVNGSTT

SEQ ID NO: 2721007 - protein, 30 aa, Entamoeba histolytica
MYESNQPFPLPLMYGKNLIFKTGGVDAIHC

SEQ ID NO: 2721008 - protein, 21 aa, Entamoeba histolytica
MYGLRGLLNFLNKNDLICLVR

SEQ ID NO: 2721009 - protein, 19 aa, Entamoeba histolytica
MYHNHLEGFKKQRVREVFN

SEQ ID NO: 2721010 - protein, 23 aa, Entamoeba histolytica
MYHSLLLIICRRGSYIFGVFVAE

SEQ ID NO: 2721011 - protein, 20 aa, Entamoeba histolytica
MYIALYLHDLLRKHYSHSTC

SEQ ID NO: 2721012 - protein, 26 aa, Entamoeba histolytica
MYKDSTLIMQLLRDNLTLWTSDACDE

SEQ ID NO: 2721013 - protein, 18 aa, Entamoeba histolytica
MYKDYYPQRLSSMIIKTI

SEQ ID NO: 2721014 - protein, 31 aa, Entamoeba histolytica
MYKHAHIVFYASSFMFNYSNQPLFLASNEIT

SEQ ID NO: 2721015 - protein, 18 aa, Entamoeba histolytica
MYLPTLQVFCQSNIESLS

SEQ ID NO: 2721016 - protein, 19 aa, Entamoeba histolytica
MYRMAILAMIFCPSHLDRN

SEQ ID NO: 2721017 - protein, 17 aa, Entamoeba histolytica
MYSHAHSPLWNIQQFEI

SEQ ID NO: 2721018 - protein, 18 aa, Entamoeba histolytica
MYSSIAYFDINKGESVIV

SEQ ID NO: 2721019 - protein, 24 aa, Entamoeba histolytica
MYSTIFPSRWKVGEALVLEFVSST

SEQ ID NO: 2721020 - protein, 20 aa, Entamoeba histolytica
MYTRYIDKFYMVLRFTEEES

SEQ ID NO: 2721021 - protein, 20 aa, Entamoeba histolytica
MYVDRLYQLSTTSGALRCEE

SEQ ID NO: 2721022 - protein, 29 aa, Entamoeba histolytica
MYVHTRLCFKLFKYIIYTKVPSFFNKETI

SEQ ID NO: 2721023 - protein, 23 aa, Entamoeba histolytica
MYYKTYLFALNKRCEQYINFISL

SEQ ID NO: 2721024 - protein, 25 aa, Entamoeba histolytica
NAAIYWLGRMIFSGENPKYIARRMI

SEQ ID NO: 2721025 - protein, 27 aa, Entamoeba histolytica
NAARMYPFAMSLYPFYGEALYQLKSWK

SEQ ID NO: 2721026 - protein, 30 aa, Entamoeba histolytica
NAARYLNIFKEVIYTLLPSRVGLDPSSLDS

SEQ ID NO: 2721027 - protein, 24 aa, Entamoeba histolytica
NAAVYRFFELLEYLNQHGGEFDRV

SEQ ID NO: 2721028 - protein, 24 aa, Entamoeba histolytica
NACYCLNSIVGLDSLYTCYYLRIT

SEQ ID NO: 2721029 - protein, 23 aa, Entamoeba histolytica
NADIHRVIRCGFILSGGPAAGGH

SEQ ID NO: 2721030 - protein, 20 aa, Entamoeba histolytica
NADYTACHFPNYVKKYKLLD

SEQ ID NO: 2721031 - protein, 23 aa, Entamoeba histolytica
NAEYFFEKKIKQMKIKDIEEMGL

SEQ ID NO: 2721032 - protein, 22 aa, Entamoeba histolytica
NAFASYYRLPKPIGSELYVPST

SEQ ID NO: 2721033 - protein, 24 aa, Entamoeba histolytica
NAFFIESSSWILKTKFADIPKVFL

SEQ ID NO: 2721034 - protein, 17 aa, Entamoeba histolytica
NAFIPLPNEFQQVKNFI

SEQ ID NO: 2721035 - protein, 18 aa, Entamoeba histolytica
NAFMDVVILVGTPPNTQQ

SEQ ID NO: 2721036 - protein, 25 aa, Entamoeba histolytica
NAFNLHSFILVYTSLSSLNNYSFFD

SEQ ID NO: 2721037 - protein, 25 aa, Entamoeba histolytica
NAFNLHSFILVYTSLSSLNNYSFFG

SEQ ID NO: 2721038 - protein, 25 aa, Entamoeba histolytica
NAFSNLLYNLWKPSNKPVIVSIKEF

SEQ ID NO: 2721039 - protein, 22 aa, Entamoeba histolytica
NAFTPLFMFLKDEYEGSLLALY

SEQ ID NO: 2721040 - protein, 23 aa, Entamoeba histolytica
NAFYECLQLKTLLFPSNLEKTIL

SEQ ID NO: 2721041 - protein, 25 aa, Entamoeba histolytica
NAGELNMIIGNGKLLDWCIDNGIEY

SEQ ID NO: 2721042 - protein, 17 aa, Entamoeba histolytica
NAHIKYLLPTGEVGIVQ

SEQ ID NO: 2721043 - protein, 27 aa, Entamoeba histolytica
NAHNLLLAKRWFSLSRLVTRCSSEKAI

SEQ ID NO: 2721044 - protein, 19 aa, Entamoeba histolytica
NAHPAWLKGCELMHIKPII

SEQ ID NO: 2721045 - protein, 25 aa, Entamoeba histolytica
NAHQYILAKALVRTLLQSGGYPDNL

SEQ ID NO: 2721046 - protein, 28 aa, Entamoeba histolytica
NAHQYILAKALVRTLLQSGGYPDNLPPV

SEQ ID NO: 2721047 - protein, 29 aa, Entamoeba histolytica
NAHVTLTATLLPFKQLHPYLKNPWTEDIN

SEQ ID NO: 2721048 - protein, 30 aa, Entamoeba histolytica
NAIDWWGLGVLIYEMLYGTVPFYDENIQRL

SEQ ID NO: 2721049 - protein, 27 aa, Entamoeba histolytica
NAIEGIYSLIQWIKKDLPLSPDDTNQT

SEQ ID NO: 2721050 - protein, 21 aa, Entamoeba histolytica
NAIIIAPFDRSNKTKTATPSV

SEQ ID NO: 2721051 - protein, 26 aa, Entamoeba histolytica
NAINELPEMLYLLKSPETISRMIELI

SEQ ID NO: 2721052 - protein, 26 aa, Entamoeba histolytica
NAIPKAFLDCHLMIENPKRWVMDYVN

SEQ ID NO: 2721053 - protein, 35 aa, Entamoeba histolytica
NAIPYPVFIRSLIINNPYVFIKSALLLSQEYRELC

SEQ ID NO: 2721054 - protein, 34 aa, Entamoeba histolytica
NAISFRYDWRTLLAVIRMHLPPIEYFVGDQVKTF

SEQ ID NO: 2721055 - protein, 26 aa, Entamoeba histolytica
NAIVTDIIHFKDFKLTYYPGDYDTFE

SEQ ID NO: 2721056 - protein, 17 aa, Entamoeba histolytica
NAKPLILNTFNSIIQFI

SEQ ID NO: 2721057 - protein, 24 aa, Entamoeba histolytica
NAKQVPEILILQEPSYPLISCKEK

SEQ ID NO: 2721058 - protein, 25 aa, Entamoeba histolytica
NAKRQIKLRTLYETNLKEIRCYLDQ

SEQ ID NO: 2721059 - protein, 17 aa, Entamoeba histolytica
NAKVFIRFRDGIVTFME

SEQ ID NO: 2721060 - protein, 20 aa, Entamoeba histolytica
NAKYFLKKGGLIIESIKANC

SEQ ID NO: 2721061 - protein, 36 aa, Entamoeba histolytica; identical to SEQ ID NO: 2533726

SEQ ID NO: 2721062 - protein, 27 aa, Entamoeba histolytica
NALEGFTLIQLLIPQNKLPAVEAWIVN

SEQ ID NO: 2721063 - protein, 18 aa, Entamoeba histolytica
NALFQILTNKYSFSELTL

SEQ ID NO: 2721064 - protein, 18 aa, Entamoeba histolytica
NALIQLFELPTLKKVIII

SEQ ID NO: 2721065 - protein, 19 aa, Entamoeba histolytica
NALLTALTNFKVIKASIEP

SEQ ID NO: 2721066 - protein, 19 aa, Entamoeba histolytica
NALLYILSSIGFTFDEKKS

SEQ ID NO: 2721067 - protein, 21 aa, Entamoeba histolytica
NALLYQFHLKKGDAIGFISRN

SEQ ID NO: 2721068 - protein, 22 aa, Entamoeba histolytica
NAMKFGMVLWDSVFEAIAMEYP

SEQ ID NO: 2721069 - protein, 28 aa, Entamoeba histolytica
NAMKSHRTWFTLLLLSQAFQCFLSINSV

SEQ ID NO: 2721070 - protein, 34 aa, Entamoeba histolytica; identical to SEQ ID NO: 2533737

SEQ ID NO: 2721071 - protein, 22 aa, Entamoeba histolytica
NAPKLIFLTKLRHLKTVFLRVK

SEQ ID NO: 2721072 - protein, 36 aa, Entamoeba histolytica
NAPQKKYKYLMNDPEFFIFSLKGYNLYDSPKKFMRK

SEQ ID NO: 2721073 - protein, 23 aa, Entamoeba histolytica
NAQKLFQLIHQKCIMKLKVLLKQ

SEQ ID NO: 2721074 - protein, 26 aa, Entamoeba histolytica
NAQNLATIWIPCLFEIPQESPVVFSC

SEQ ID NO: 2721075 - protein, 23 aa, Entamoeba histolytica
NAQQPTLNLPNNNQYYGQAGTFN

SEQ ID NO: 2721076 - protein, 21 aa, Entamoeba histolytica
NAQSIPCHFLFHSISQPFSFL

SEQ ID NO: 2721077 - protein, 31 aa, Entamoeba histolytica
NAQTKVDQPTNSIVPVVPEEAGATSGEDTAT

SEQ ID NO: 2721078 - protein, 19 aa, Entamoeba histolytica
NARDATWFCMSGIVDYCRM

SEQ ID NO: 2721079 - protein, 28 aa, Entamoeba histolytica
NARYAKYFDPLIFKYPPSGYSYCTMEAI

SEQ ID NO: 2721080 - protein, 25 aa, Entamoeba histolytica
NARYSTFICTLLISIAQQQIISEVV

SEQ ID NO: 2721081 - protein, 25 aa, Entamoeba histolytica
NASGTRPCLYVPQSAFENLISKQVR

SEQ ID NO: 2721082 - protein, 20 aa, Entamoeba histolytica
NASHILIRQNEVPLTICQLY

SEQ ID NO: 2721083 - protein, 26 aa, Entamoeba histolytica
NASVRKDIFLQKKLDKIINLKKLITE

SEQ ID NO: 2721084 - protein, 21 aa, Entamoeba histolytica
NATIILKQCGVSSPLYAGRNV

SEQ ID NO: 2721085 - protein, 28 aa, Entamoeba histolytica
NATQAIYSFWLYDFCDVYLEASKGIFRG

SEQ ID NO: 2721086 - protein, 29 aa, Entamoeba histolytica
NAVINTLRKLIIILFLPIHTKSTKVNKNN

SEQ ID NO: 2721087 - protein, 23 aa, Entamoeba histolytica
NAVNLPILPRLYMKQELCGLHGE

SEQ ID NO: 2721088 - protein, 17 aa, Entamoeba histolytica
NAVPFSRLLSFFSFIRL

SEQ ID NO: 2721089 - protein, 21 aa, Entamoeba histolytica
NAYVTMLPKPTKKVKNFQWQK

SEQ ID NO: 2721090 - protein, 28 aa, Entamoeba histolytica
NCAFKKCYFLQVIQLPIDILTLPKSCFA

SEQ ID NO: 2721091 - protein, 24 aa, Entamoeba histolytica
NCCALKMIQLPLSLIAIGSNAFYN

SEQ ID NO: 2721092 - protein, 28 aa, Entamoeba histolytica
NCCSLQTILLSPYLQRLPQNCFFNCCSL

SEQ ID NO: 2721093 - protein, 24 aa, Entamoeba histolytica
NCDVQLFVPLIPLVVSRLGDKTPA

SEQ ID NO: 2721094 - protein, 17 aa, Entamoeba histolytica
NCFGTEKKTLPLSVFDN

SEQ ID NO: 2721095 - protein, 30 aa, Entamoeba histolytica
NCFSQLFLDLFGRYFAFFEQQSIGFVFNDK

SEQ ID NO: 2721096 - protein, 18 aa, Entamoeba histolytica
NCISLTIPSIGRQRGFVP

SEQ ID NO: 2721097 - protein, 33 aa, Entamoeba histolytica
NCITVVRLHYLINNLFIDLIHFTEVILTSLTSN

SEQ ID NO: 2721098 - protein, 21 aa, Entamoeba histolytica
NCKANQLIFSNTSLSKAPKEI

SEQ ID NO: 2721099 - protein, 22 aa, Entamoeba histolytica
NCKAQLFMKLPEDFDLLCIINS

SEQ ID NO: 2721100 - protein, 37 aa, Entamoeba histolytica
NCKEWDIGIVTPYRQQLLLIKMAIETSLLLKDMSKLC

SEQ ID NO: 2721101 - protein, 17 aa, Entamoeba histolytica
NCLGNIWVYVRDWSEED

SEQ ID NO: 2721102 - protein, 17 aa, Entamoeba histolytica
NCLMSFPVALTNISSLS

SEQ ID NO: 2721103 - protein, 18 aa, Entamoeba histolytica
NCLTLTSGILLINHINEQ

SEQ ID NO: 2721104 - protein, 25 aa, Entamoeba histolytica
NCMEQFIDSLLIDPVSLYTVRNCQD

SEQ ID NO: 2721105 - protein, 19 aa, Entamoeba histolytica
NCMNSIIKLLDKKKKLFGK

SEQ ID NO: 2721106 - protein, 24 aa, Entamoeba histolytica
NCNEIQQWWKIMLAIFASSIKMCR

SEQ ID NO: 2721107 - protein, 23 aa, Entamoeba histolytica
NCNKLLEISLPPTIQNIGDGCFC

SEQ ID NO: 2721108 - protein, 25 aa, Entamoeba histolytica
NCPNIINIPLPFTSALTVDYNGSFK

SEQ ID NO: 2721109 - protein, 23 aa, Entamoeba histolytica
NCRRFMHMLFTYTEELFNEKSFG

SEQ ID NO: 2721110 - protein, 27 aa, Entamoeba histolytica
NCSNISQFIILIPALNRHLQTYDPVQM

SEQ ID NO: 2721111 - protein, 21 aa, Entamoeba histolytica
NCSPIGVNVLWSDGSLSWYSS

SEQ ID NO: 2721112 - protein, 24 aa, Entamoeba histolytica
NCTDKMILPILKFIHGIVSIELVD

SEQ ID NO: 2721113 - protein, 31 aa, Entamoeba histolytica
NCTIFDYFHFSLIRIPFNSLSFTLSFSSFTH

SEQ ID NO: 2721114 - protein, 24 aa, Entamoeba histolytica
NCVEFWKIMTFITMKYIQIYSSDF

SEQ ID NO: 2721115 - protein, 24 aa, Entamoeba histolytica
NCVELLPILLSMKKLEILNIDAST

SEQ ID NO: 2721116 - protein, 25 aa, Entamoeba histolytica
NCWNDYYILNIPFTSTPSTTKNTDL

SEQ ID NO: 2721117 - protein, 22 aa, Entamoeba histolytica
NCWNEYLLMNGTLSYNSYRCMQ

SEQ ID NO: 2721118 - protein, 22 aa, Entamoeba histolytica
NCYATLVYLMNEKKKYVKVFDC

SEQ ID NO: 2721119 - protein, 21 aa, Entamoeba histolytica
NCYETFSREELLWEHISSVHG

SEQ ID NO: 2721120 - protein, 25 aa, Entamoeba histolytica
NCYLINESIHLLIDLLNENRIQTSS

SEQ ID NO: 2721121 - protein, 18 aa, Entamoeba histolytica
NCYSAFWMDTNGMISFNF

SEQ ID NO: 2721122 - protein, 17 aa, Entamoeba histolytica
NCYSLSNIYLPNSLTSI

SEQ ID NO: 2721123 - protein, 25 aa, Entamoeba histolytica
NDAKIVLDILFKKAVNEKKFTGLYV

SEQ ID NO: 2721124 - protein, 30 aa, Entamoeba histolytica
NDDIIINNIILINLLFPSYTSLHSHLPFRK

SEQ ID NO: 2721125 - protein, 24 aa, Entamoeba histolytica
NDDKYGFIIMDGNGTLFGTLQGNT

SEQ ID NO: 2721126 - protein, 22 aa, Entamoeba histolytica
NDDNVIKFIKFLINLIKEVNEH

SEQ ID NO: 2721127 - protein, 22 aa, Entamoeba histolytica
NDDYLKGVPLLIFANKHDLPHA

SEQ ID NO: 2721128 - protein, 26 aa, Entamoeba histolytica
NDEAKFANGVLALLKRRGYTFCEKKT

SEQ ID NO: 2721129 - protein, 25 aa, Entamoeba histolytica
NDEDVNVILFCFISNSNRFNSFNNT

SEQ ID NO: 2721130 - protein, 38 aa, Entamoeba histolytica
NDEERIKIIKEMFPELLQRILLANKISFEKSKEGGVLG

SEQ ID NO: 2721131 - protein, 27 aa, Entamoeba histolytica
NDEFIKQSLLLLFRSICNDEKIESYRF

SEQ ID NO: 2721132 - protein, 20 aa, Entamoeba histolytica
NDEFKLELPFPLNENYQLIF

SEQ ID NO: 2721133 - protein, 32 aa, Entamoeba histolytica
NDEKFCVPFNNQLKVFFKCFAQYLRQRVASRA

SEQ ID NO: 2721134 - protein, 24 aa, Entamoeba histolytica
NDEKKFLFQEKGSFILDQSLNLQI

SEQ ID NO: 2721135 - protein, 24 aa, Entamoeba histolytica
NDEKKILKPIPNEKKPLVNPEVPT

SEQ ID NO: 2721136 - protein, 29 aa, Entamoeba histolytica
NDEKLKLEVFYPSIVIYVVKKKELGVVKK

SEQ ID NO: 2721137 - protein, 17 aa, Entamoeba histolytica
NDELWMELIRVCGNDEK

SEQ ID NO: 2721138 - protein, 38 aa, Entamoeba histolytica
NDENLQFFCSLYTQPIVFPSVFFFNGAGLQKVLIKNEI

SEQ ID NO: 2721139 - protein, 23 aa, Entamoeba histolytica
NDEQLDILQRKSAALKNATNTLL

SEQ ID NO: 2721140 - protein, 18 aa, Entamoeba histolytica
NDFDCDLPLPLDGTEPNS

SEQ ID NO: 2721141 - protein, 19 aa, Entamoeba histolytica
NDFDPKAFFPFLRVAVDER

SEQ ID NO: 2721142 - protein, 29 aa, Entamoeba histolytica
NDFDSIQHFYFQKLPKLIPSSQIPTFPIL

SEQ ID NO: 2721143 - protein, 21 aa, Entamoeba histolytica
NDFIMQIMIQDGGVFFVEIIF

SEQ ID NO: 2721144 - protein, 34 aa, Entamoeba histolytica
NDFINLLKLNIELQREWLFDEIDINEYLGIIVTE

SEQ ID NO: 2721145 - protein, 25 aa, Entamoeba histolytica
NDFKNLALLDLSFNDLIKLPNHNPS

SEQ ID NO: 2721146 - protein, 17 aa, Entamoeba histolytica
NDFLPHIPSLDIRDGAV

SEQ ID NO: 2721147 - protein, 34 aa, Entamoeba histolytica
NDFNKEEVFLVDAGKLWLWFGSKAINETKRFSLQ

SEQ ID NO: 2721148 - protein, 23 aa, Entamoeba histolytica
NDFSYYRRSFPRMKQFKREDELK

SEQ ID NO: 2721149 - protein, 27 aa, Entamoeba histolytica
NDGALLLVSILRIIFSWYNKGSYCQQL

SEQ ID NO: 2721150 - protein, 24 aa, Entamoeba histolytica
NDGDKILIFDFGAGTLDVSLVEMK

SEQ ID NO: 2721151 - protein, 17 aa, Entamoeba histolytica
NDGFAVCVLMKKTADQS

SEQ ID NO: 2721152 - protein, 21 aa, Entamoeba histolytica
NDGIFPYRYNYGPTTPIYIQM

SEQ ID NO: 2721153 - protein, 24 aa, Entamoeba histolytica
NDGKAILALCHAYTRLTGENGFDY

SEQ ID NO: 2721154 - protein, 19 aa, Entamoeba histolytica
NDGRLFMITFEDGRVELRD

SEQ ID NO: 2721155 - protein, 24 aa, Entamoeba histolytica
NDGTTACVLLVTPNEYYTAHVGDS

SEQ ID NO: 2721156 - protein, 26 aa, Entamoeba histolytica
NDHDIKLLCFNLLTKMVILNPDPMVE

SEQ ID NO: 2721157 - protein, 26 aa, Entamoeba histolytica
NDIDASWIFTFDTYDFRLFVGNSEES

SEQ ID NO: 2721158 - protein, 24 aa, Entamoeba histolytica
NDIEGLVRLLNTLNIKCSLLNFSS

SEQ ID NO: 2721159 - protein, 26 aa, Entamoeba histolytica
NDIEGVSLMFLLNIVAMYLIGSCVTM

SEQ ID NO: 2721160 - protein, 23 aa, Entamoeba histolytica
NDIFIVLHDGRLYRFIDFDQFEE

SEQ ID NO: 2721161 - protein, 24 aa, Entamoeba histolytica
NDIFIVLHDGRLYRFIDFDQFEEQ

SEQ ID NO: 2721162 - protein, 20 aa, Entamoeba histolytica
NDIIQFCVNLRLLLGLTDST

SEQ ID NO: 2721163 - protein, 21 aa, Entamoeba histolytica
NDIQALQFVRKIGGIAVAMGN

SEQ ID NO: 2721164 - protein, 23 aa, Entamoeba histolytica
NDISWLSVIYPNSIYYVGDISIP

SEQ ID NO: 2721165 - protein, 25 aa, Entamoeba histolytica
NDITAFELFFLNLKQLTSLKKVIVY

SEQ ID NO: 2721166 - protein, 30 aa, Entamoeba histolytica
NDIVIFDTILLSPIALLRGHSDWVFGSKFI

SEQ ID NO: 2721167 - protein, 24 aa, Entamoeba histolytica
NDKDNIIIPTLLSRYINLIIRKNS

SEQ ID NO: 2721168 - protein, 17 aa, Entamoeba histolytica
NDKIYQFWKIKEPYQMI

SEQ ID NO: 2721169 - protein, 22 aa, Entamoeba histolytica
NDKRIILLQSYLRGLLVRNKYK

SEQ ID NO: 2721170 - protein, 25 aa, Entamoeba histolytica
NDKRKTFMDIIDYIDFNQAIVFVEN

SEQ ID NO: 2721171 - protein, 22 aa, Entamoeba histolytica
NDKRRYAKMFSALGSLGEVDEE

SEQ ID NO: 2721172 - protein, 20 aa, Entamoeba histolytica
NDLDYLLNELKIQINKLNNS

SEQ ID NO: 2721173 - protein, 21 aa, Entamoeba histolytica
NDLETLLSFLEDEDSLDLMLN

SEQ ID NO: 2721174 - protein, 20 aa, Entamoeba histolytica
NDLFAFFIKTLFDEFKRISD

SEQ ID NO: 2721175 - protein, 21 aa, Entamoeba histolytica
NDLIKIFDKFGYPTKQHVYIL

SEQ ID NO: 2721176 - protein, 24 aa, Entamoeba histolytica
NDLKGMPFIIYVNKIDLKPYEPSF

SEQ ID NO: 2721177 - protein, 23 aa, Entamoeba histolytica
NDLKQLYEIIHNKINIEMRELEE

SEQ ID NO: 2721178 - protein, 23 aa, Entamoeba histolytica
NDLKYIIIGFSEGTIRVYKNDDK

SEQ ID NO: 2721179 - protein, 24 aa, Entamoeba histolytica
NDLQYYKQFLAFMIYYIEQIPNNT

SEQ ID NO: 2721180 - protein, 22 aa, Entamoeba histolytica
NDLVQFRIKECLRKLIVGKKFE

SEQ ID NO: 2721181 - protein, 26 aa, Entamoeba histolytica
NDLVSSPWIQHTFFRQIKSNEHNSPF

SEQ ID NO: 2721182 - protein, 28 aa, Entamoeba histolytica
NDLVVNYIMIFTIVASKLSSPSFELFNN

SEQ ID NO: 2721183 - protein, 24 aa, Entamoeba histolytica
NDMFNIFVDALYHPIRYMDHNNYS

SEQ ID NO: 2721184 - protein, 18 aa, Entamoeba histolytica
NDNILEIVKDKEKRKKHI

SEQ ID NO: 2721185 - protein, 24 aa, Entamoeba histolytica
NDNLQIIHFSKPLIEIKLYCDNPF

SEQ ID NO: 2721186 - protein, 24 aa, Entamoeba histolytica
NDNNILIAGLINKGSIDIILFKRN

SEQ ID NO: 2721187 - protein, 25 aa, Entamoeba histolytica
NDNNNLNGTSHILFILPFFIGILFF

SEQ ID NO: 2721188 - protein, 32 aa, Entamoeba histolytica
NDNTIKYQPPKILMPLFPLPRKEEEDITKTEK

SEQ ID NO: 2721189 - protein, 28 aa, Entamoeba histolytica
NDNVQIVAEKWLYDSISSMKVMDYKTYK

SEQ ID NO: 2721190 - protein, 43 aa, Entamoeba histolytica
NDNWQNQLINYIKAVDLPPELAPLPPLPPKVHGKRKKALPPIP

SEQ ID NO: 2721191 - protein, 23 aa, Entamoeba histolytica
NDPFHDFFLTLKSTPSLLETTYL

SEQ ID NO: 2721192 - protein, 26 aa, Entamoeba histolytica
NDPIKSNYLLLLIQTNTIEQNNMKRF

SEQ ID NO: 2721193 - protein, 23 aa, Entamoeba histolytica
NDPIPILFSGGIDSSLIAYYTLL

SEQ ID NO: 2721194 - protein, 23 aa, Entamoeba histolytica
NDPKHFVFAIRNKNKIQGKYEAD

SEQ ID NO: 2721195 - protein, 25 aa, Entamoeba histolytica
NDPNGKVSIFLLSTRSGGLGINLQS

SEQ ID NO: 2721196 - protein, 22 aa, Entamoeba histolytica
NDPSRLISVKTVAKSILKKLKD

SEQ ID NO: 2721197 - protein, 27 aa, Entamoeba histolytica
NDPTTKLIKTFITVLRGTRGMRGGYRG

SEQ ID NO: 2721198 - protein, 31 aa, Entamoeba histolytica
NDPVTFLLMGSYKLIIKLFQYRLKNSVYMMA

SEQ ID NO: 2721199 - protein, 25 aa, Entamoeba histolytica
NDQHSIYKALPFFKDFILSIEQHKN

SEQ ID NO: 2721200 - protein, 23 aa, Entamoeba histolytica
NDQHSLLRFITTKATTITSCFAQ

SEQ ID NO: 2721201 - protein, 25 aa, Entamoeba histolytica
NDQQKMILITNWIKKIQPCLTGIFV

SEQ ID NO: 2721202 - protein, 25 aa, Entamoeba histolytica
NDQTYCSIRYKLGKVRSLIKEKEQQ

SEQ ID NO: 2721203 - protein, 25 aa, Entamoeba histolytica
NDRDVYKYLKYLLSNTCRYCTSEFS

SEQ ID NO: 2721204 - protein, 17 aa, Entamoeba histolytica
NDRLNEQFLPIQLGPSF

SEQ ID NO: 2721205 - protein, 24 aa, Entamoeba histolytica
NDRMSLFFEMIKPSTMYVIAREDE

SEQ ID NO: 2721206 - protein, 28 aa, Entamoeba histolytica
NDRSVIYWDIPFSEYKLGRNLALIKEHV

SEQ ID NO: 2721207 - protein, 31 aa, Entamoeba histolytica; identical to SEQ ID NO: 2533912

SEQ ID NO: 2721208 - protein, 27 aa, Entamoeba histolytica
NDSHSELRPILPSLDTFQSTPSPIKEI

SEQ ID NO: 2721209 - protein, 30 aa, Entamoeba histolytica
NDSIKPLHFVIVSKVPIALLKAKSLCDNLI

SEQ ID NO: 2721210 - protein, 22 aa, Entamoeba histolytica
NDSIVFTLLFNELNLIYINQRS

SEQ ID NO: 2721211 - protein, 21 aa, Entamoeba histolytica
NDSIYTIPLLSESLGALWKTL

SEQ ID NO: 2721212 - protein, 26 aa, Entamoeba histolytica
NDSSNLGFRMQWICPFNASQKTSGEK

SEQ ID NO: 2721213 - protein, 27 aa, Entamoeba histolytica
NDSTAKVWYLANSRLRHSLTGHSGKVT

SEQ ID NO: 2721214 - protein, 30 aa, Entamoeba histolytica
NDTFIYITDYLILESFRKYFRGINVPSFIS

SEQ ID NO: 2721215 - protein, 29 aa, Entamoeba histolytica
NDTIYNMFQLFFFKIFHNYFQCFKANPGG

SEQ ID NO: 2721216 - protein, 23 aa, Entamoeba histolytica
NDTLLYVCPTPRTNVISQILPEF

SEQ ID NO: 2721217 - protein, 25 aa, Entamoeba histolytica
NDTRIKALLTALTNFKVIKASIEPS

SEQ ID NO: 2721218 - protein, 25 aa, Entamoeba histolytica
NDVDTLLKFIIIKSQMPHFASTLRY

SEQ ID NO: 2721219 - protein, 19 aa, Entamoeba histolytica
NDVFEQFIYFVINYKKRRL

SEQ ID NO: 2721220 - protein, 21 aa, Entamoeba histolytica
NDVHFYFMPHGIGHLIGIDTH

SEQ ID NO: 2721221 - protein, 26 aa, Entamoeba histolytica
NDVNVFKILIISSIKLGKDVMQFEET

SEQ ID NO: 2721222 - protein, 31 aa, Entamoeba histolytica
NDVSSGLVYVFYNKILYFAQCGSIKSYIISN

SEQ ID NO: 2721223 - protein, 32 aa, Entamoeba histolytica
NDVSVTSFRWQYIKYLFKMSYNALHYTHLKKY

SEQ ID NO: 2721224 - protein, 26 aa, Entamoeba histolytica
NDVVMGSLFIRLLHVKICRVEMNVIR

SEQ ID NO: 2721225 - protein, 22 aa, Entamoeba histolytica
NDVVTLALYRRVFPLPPLVSAN

SEQ ID NO: 2721226 - protein, 27 aa, Entamoeba histolytica
NDWIKFYKVIYSIYQIIKLLNEYSFKH

SEQ ID NO: 2721227 - protein, 24 aa, Entamoeba histolytica
NDYETKILTLVKVVEQCKNKVNNQ

SEQ ID NO: 2721228 - protein, 21 aa, Entamoeba histolytica
NDYIPCLLQIIATPQYKPLQQ

SEQ ID NO: 2721229 - protein, 29 aa, Entamoeba histolytica
NDYLQILLNNMPFGLQRILGDFTFSNVLS

SEQ ID NO: 2721230 - protein, 30 aa, Entamoeba histolytica
NDYLQILLNNMPFGLQRILGDFTFSNVLSI

SEQ ID NO: 2721231 - protein, 21 aa, Entamoeba histolytica
NDYLYLMMEYLAGGDMMTLLI

SEQ ID NO: 2721232 - protein, 24 aa, Entamoeba histolytica
NEADFIEFPYFCFGININKKITSS

SEQ ID NO: 2721233 - protein, 18 aa, Entamoeba histolytica
NEAGGIEALFKLLEKQEN

SEQ ID NO: 2721234 - protein, 22 aa, Entamoeba histolytica
NEAISFFHLIGRIIHTEPVYNE

SEQ ID NO: 2721235 - protein, 18 aa, Entamoeba histolytica
NEALTKKLTLKEESIIQI

SEQ ID NO: 2721236 - protein, 23 aa, Entamoeba histolytica
NEANYLELLLTKTQTKIILPPTT

SEQ ID NO: 2721237 - protein, 23 aa, Entamoeba histolytica
NECKMCLQALFDAAFMLAEKMKE

SEQ ID NO: 2721238 - protein, 25 aa, Entamoeba histolytica
NEDALTYLSLVNILVHRKSMNCVTI

SEQ ID NO: 2721239 - protein, 33 aa, Entamoeba histolytica
NEDEFLEIYTMLPPRLQMLIPEQIFTSSIDGLS

SEQ ID NO: 2721240 - protein, 26 aa, Entamoeba histolytica
NEDIFKACIGCLWNLSIDPAVTPQMI

SEQ ID NO: 2721241 - protein, 24 aa, Entamoeba histolytica
NEDLSRIMLFPNISTFGIQIKGIK

SEQ ID NO: 2721242 - protein, 22 aa, Entamoeba histolytica
NEDLYAECYPQYGKGEFARIDD

SEQ ID NO: 2721243 - protein, 26 aa, Entamoeba histolytica
NEDRAVFLFLNEFFRETYIIAQNEES

SEQ ID NO: 2721244 - protein, 24 aa, Entamoeba histolytica
NEDSPIKRRPVINMTQRGQRNSPL

SEQ ID NO: 2721245 - protein, 21 aa, Entamoeba histolytica
NEDTFRIIPNAQQLVPMKKNK

SEQ ID NO: 2721246 - protein, 29 aa, Entamoeba histolytica
NEDYKIHFYYRFLIILTNHRMYIYNIRKM

SEQ ID NO: 2721247 - protein, 27 aa, Entamoeba histolytica
NEEEIYQLIRYIPMRLTEKERGYLDVL

SEQ ID NO: 2721248 - protein, 18 aa, Entamoeba histolytica
NEEKLEFITFSDILLKYF

SEQ ID NO: 2721249 - protein, 26 aa, Entamoeba histolytica
NEEKPYIPGFLPPLPDARTYKNTPIY

SEQ ID NO: 2721250 - protein, 23 aa, Entamoeba histolytica
NEEMRKIELIIKKGKYYQEENNS

SEQ ID NO: 2721251 - protein, 22 aa, Entamoeba histolytica
NEENTFIFLGDYVDRGSFSTEI

SEQ ID NO: 2721252 - protein, 35 aa, Entamoeba histolytica
NEETKSQLLMKKKKYVSPIEKFRPKTKQDKQEKIN

SEQ ID NO: 2721253 - protein, 17 aa, Entamoeba histolytica
NEETLFIKKLHKDAIIP

SEQ ID NO: 2721254 - protein, 17 aa, Entamoeba histolytica
NEEVSVSIPWFFDNFDA

SEQ ID NO: 2721255 - protein, 30 aa, Entamoeba histolytica
NEFAKALCLILKSPIALKRIDLSNIGLTDD

SEQ ID NO: 2721256 - protein, 25 aa, Entamoeba histolytica
NEFALKMIIVTFKYMTNIVIRYSAV

SEQ ID NO: 2721257 - protein, 21 aa, Entamoeba histolytica
NEFIMLCCDILKFLFDTVPDL

SEQ ID NO: 2721258 - protein, 21 aa, Entamoeba histolytica
NEFIRFIDYYKNNLNVKNGNV

SEQ ID NO: 2721259 - protein, 18 aa, Entamoeba histolytica
NEFKLFEQSVRGLMDCWS

SEQ ID NO: 2721260 - protein, 27 aa, Entamoeba histolytica
NEFTLINVVFFLQKDFYVPAVIDGFVT

SEQ ID NO: 2721261 - protein, 17 aa, Entamoeba histolytica
NEFVILGRLKDGVKEKE

SEQ ID NO: 2721262 - protein, 20 aa, Entamoeba histolytica
NEFVIQKKSILFPNTKYELN

SEQ ID NO: 2721263 - protein, 32 aa, Entamoeba histolytica
NEGKHLMIQTTKDIFYLFKKVDGKTYISSFPK

SEQ ID NO: 2721264 - protein, 24 aa, Entamoeba histolytica
NEGKNFVDEIEYIGYPQLSKNQEQ

SEQ ID NO: 2721265 - protein, 24 aa, Entamoeba histolytica
NEGNEGDWYFSDNKDLPFDSNEWE

SEQ ID NO: 2721266 - protein, 19 aa, Entamoeba histolytica
NEHIILALLKNAPTIDVNK

SEQ ID NO: 2721267 - protein, 23 aa, Entamoeba histolytica
NEHKFQLLLISYDKIYIYSTSLI

SEQ ID NO: 2721268 - protein, 23 aa, Entamoeba histolytica
NEHKNMGFGDKGKWILVTEKNNK

SEQ ID NO: 2721269 - protein, 31 aa, Entamoeba histolytica
NEHSPEMYSWFPLFFPLISPIEVKRGDILEL

SEQ ID NO: 2721270 - protein, 19 aa, Entamoeba histolytica
NEIANLISLFGDSKKRQTG

SEQ ID NO: 2721271 - protein, 24 aa, Entamoeba histolytica
NEIDPVELFFYNISSIHGVKERLT

SEQ ID NO: 2721272 - protein, 28 aa, Entamoeba histolytica
NEIGFYFSETYLFKFHYCDGTTTLHPMR

SEQ ID NO: 2721273 - protein, 17 aa, Entamoeba histolytica
NEIHELFDALPLAALVE

SEQ ID NO: 2721274 - protein, 18 aa, Entamoeba histolytica
NEIHLFKISPIDKLEKLF

SEQ ID NO: 2721275 - protein, 25 aa, Entamoeba histolytica
NEIICKRTCRFVDAGKYFFDEAIRM

SEQ ID NO: 2721276 - protein, 20 aa, Entamoeba histolytica
NEIICLISNFNQKQQLLYES

SEQ ID NO: 2721277 - protein, 24 aa, Entamoeba histolytica
NEIIRSALWALSNLVFCATINVAN

SEQ ID NO: 2721278 - protein, 21 aa, Entamoeba histolytica
NEIISCPFNLINYPAIKQSVI

SEQ ID NO: 2721279 - protein, 24 aa, Entamoeba histolytica
NEIKELFTSIPIAPLLVSNKKERI

SEQ ID NO: 2721280 - protein, 17 aa, Entamoeba histolytica
NEIKLMYSLNHVQSIVA

SEQ ID NO: 2721281 - protein, 19 aa, Entamoeba histolytica
NEIKQVLPSLLQLLLPHTV

SEQ ID NO: 2721282 - protein, 25 aa, Entamoeba histolytica
NEILRLFEEELLDSSLKDFRDVIDG

SEQ ID NO: 2721283 - protein, 21 aa, Entamoeba histolytica
NEILYIKFEKEIKMYGGISHQ

SEQ ID NO: 2721284 - protein, 20 aa, Entamoeba histolytica
NEIMDVPLYISADETKQIGI

SEQ ID NO: 2721285 - protein, 35 aa, Entamoeba histolytica
NEIMYFLGEICNGLWYLHFTKKLIHRDLKPANLLL

SEQ ID NO: 2721286 - protein, 27 aa, Entamoeba histolytica
NEIPLLDYQEYLLFGPLDNLVNEISQM

SEQ ID NO: 2721287 - protein, 24 aa, Entamoeba histolytica
NEIRERIYRVLDKDPSQHIPICLV

SEQ ID NO: 2721288 - protein, 24 aa, Entamoeba histolytica
NEIRNTCFGWCESLILINIPTSIS

SEQ ID NO: 2721289 - protein, 24 aa, Entamoeba histolytica
NEISEHYIIMPDIIKMFVKQVAEK

SEQ ID NO: 2721290 - protein, 23 aa, Entamoeba histolytica
NEISEHYIIMPDIIKMLVKQVAE

SEQ ID NO: 2721291 - protein, 26 aa, Entamoeba histolytica
NEISKYALVILLKRIILCDLDVRFEN

SEQ ID NO: 2721292 - protein, 26 aa, Entamoeba histolytica
NEIYKKYLFFIERLITITPKISQLFN

SEQ ID NO: 2721293 - protein, 20 aa, Entamoeba histolytica
NEKEAFWEKKKMWMIEDEED

SEQ ID NO: 2721294 - protein, 25 aa, Entamoeba histolytica
NEKELYFHVWMNSFFKESIGTLKIQ

SEQ ID NO: 2721295 - protein, 24 aa, Entamoeba histolytica
NEKILEEFILFKLDEIIEDILKNQ

SEQ ID NO: 2721296 - protein, 24 aa, Entamoeba histolytica
NEKINFYFKQIITGIQYIHSKNII

SEQ ID NO: 2721297 - protein, 23 aa, Entamoeba histolytica
NEKINHFWKLKRDVYKFIHDQTL

SEQ ID NO: 2721298 - protein, 25 aa, Entamoeba histolytica
NEKINPPFVLPYSKRQTIPDFVYKI

SEQ ID NO: 2721299 - protein, 24 aa, Entamoeba histolytica
NEKIPLTTFFIKNFKEIKKYCEEN

SEQ ID NO: 2721300 - protein, 18 aa, Entamoeba histolytica
NEKKGLFNITCATTSMPP

SEQ ID NO: 2721301 - protein, 19 aa, Entamoeba histolytica
NEKKLIINGIITALKMANI

SEQ ID NO: 2721302 - protein, 17 aa, Entamoeba histolytica
NEKLIRRSVKQNGTKEG

SEQ ID NO: 2721303 - protein, 25 aa, Entamoeba histolytica
NEKLTQLIQLLPLNYHGKIIDVDKL

SEQ ID NO: 2721304 - protein, 24 aa, Entamoeba histolytica
NEKMKRRFIKKYGFEPTRDEFLLF

SEQ ID NO: 2721305 - protein, 26 aa, Entamoeba histolytica
NEKNLPIEQFALLKSRMLGMLEEYNR

SEQ ID NO: 2721306 - protein, 24 aa, Entamoeba histolytica
NEKRPIGSFMFLGPSGVGKTELAK

SEQ ID NO: 2721307 - protein, 25 aa, Entamoeba histolytica
NEKSRALLTWLFDLMIEVAKNRETN

SEQ ID NO: 2721308 - protein, 28 aa, Entamoeba histolytica
NEKTDQQIFFIIDIKMIALHKTKPNQFA

SEQ ID NO: 2721309 - protein, 21 aa, Entamoeba histolytica
NEKTFLEMMILEGNSKLRIVE

SEQ ID NO: 2721310 - protein, 20 aa, Entamoeba histolytica
NEKTGIPHLQNLLKDFLLHQ

SEQ ID NO: 2721311 - protein, 25 aa, Entamoeba histolytica
NEKTKYKVIPYPIKNGIYKIKSNET

SEQ ID NO: 2721312 - protein, 23 aa, Entamoeba histolytica
NEKVNQLYEYCKISLIESSNVLY

SEQ ID NO: 2721313 - protein, 19 aa, Entamoeba histolytica
NELFHRLSVSDISSFPWET

SEQ ID NO: 2721314 - protein, 23 aa, Entamoeba histolytica
NELFKNAYHMIPSTTLQNGVHQV

SEQ ID NO: 2721315 - protein, 28 aa, Entamoeba histolytica
NELGDQLYDYILSLGLYDEDLTGRITGV

SEQ ID NO: 2721316 - protein, 23 aa, Entamoeba histolytica
NELHPKFIAQYIDQLLRGVGVGK

SEQ ID NO: 2721317 - protein, 32 aa, Entamoeba histolytica
NELIISSMRRKSQLFLLIDGRIINSQTGKVLS

SEQ ID NO: 2721318 - protein, 27 aa, Entamoeba histolytica
NELIIYRIVIQLLQLYIEQTKIYLYEC

SEQ ID NO: 2721319 - protein, 19 aa, Entamoeba histolytica
NELKIKIHSYHSFFGSIKH

SEQ ID NO: 2721320 - protein, 25 aa, Entamoeba histolytica
NELKISFNYILHPKVWYLIFINFEL

SEQ ID NO: 2721321 - protein, 30 aa, Entamoeba histolytica
NELKTSPMRLALFKQPDFLNSPKVIIHLSG

SEQ ID NO: 2721322 - protein, 18 aa, Entamoeba histolytica
NELLFEKYQLQPDLPNDE

SEQ ID NO: 2721323 - protein, 18 aa, Entamoeba histolytica
NELLYFHFISLSRNFPDL

SEQ ID NO: 2721324 - protein, 22 aa, Entamoeba histolytica
NELNAFLSPFWSHSNPVDVLGD

SEQ ID NO: 2721325 - protein, 24 aa, Entamoeba histolytica
NELNDRMQILLLSTLMDCTSDEHL

SEQ ID NO: 2721326 - protein, 25 aa, Entamoeba histolytica
NELPLHLILSWYEQKAVAVLLALLY

SEQ ID NO: 2721327 - protein, 22 aa, Entamoeba histolytica
NELTIIPMELFTMPSLQSIQFN

SEQ ID NO: 2721328 - protein, 44 aa, Entamoeba histolytica
NELWKVVMKFVITLNTPLLFEKLVLRHILLDRGMIGEYIQICKK

SEQ ID NO: 2721329 - protein, 17 aa, Entamoeba histolytica
NEMIFTTGFSRNAEREM

SEQ ID NO: 2721330 - protein, 21 aa, Entamoeba histolytica
NEMKKFVQVAFRLPSSETIKQ

SEQ ID NO: 2721331 - protein, 24 aa, Entamoeba histolytica
NEMLNKVIISFKYDGKKTIKIIED

SEQ ID NO: 2721332 - protein, 18 aa, Entamoeba histolytica
NEMNEIFPYFLVDCKEIK

SEQ ID NO: 2721333 - protein, 20 aa, Entamoeba histolytica
NEMPKPIRIISHSPSFENFN

SEQ ID NO: 2721334 - protein, 25 aa, Entamoeba histolytica
NEMVNKFITFLSLDSTKPLNRDEWQ

SEQ ID NO: 2721335 - protein, 23 aa, Entamoeba histolytica
NEMWKNWRVKLAANPKTASYLND

SEQ ID NO: 2721336 - protein, 17 aa, Entamoeba histolytica
NENDLKKAYRKLALKWH

SEQ ID NO: 2721337 - protein, 35 aa, Entamoeba histolytica
NENEKSLLTTETRKLLFNYVALGVKLMNASNSNKN

SEQ ID NO: 2721338 - protein, 25 aa, Entamoeba histolytica
NENEMKFYLYFDKAEKIKAGDIGGT

SEQ ID NO: 2721339 - protein, 29 aa, Entamoeba histolytica
NENEPPFVYILLGWLTHLIVMNPSVNEVF

SEQ ID NO: 2721340 - protein, 24 aa, Entamoeba histolytica
NENGILRLALLNNPNKKSKKKGEK

SEQ ID NO: 2721341 - protein, 19 aa, Entamoeba histolytica
NENGSLMTFLLTDLQQRDT

SEQ ID NO: 2721342 - protein, 33 aa, Entamoeba histolytica
NENIPLLIASFYPLFEPFFNNNIIYPKYLQYLS

SEQ ID NO: 2721343 - protein, 29 aa, Entamoeba histolytica
NENISLLFDTLINCYLRMVIQPIEKLAEP

SEQ ID NO: 2721344 - protein, 22 aa, Entamoeba histolytica
NENLHLLTLQNLLLEKKKFLEN

SEQ ID NO: 2721345 - protein, 22 aa, Entamoeba histolytica
NENLRVLPLCIYNIIFNMKKKR

SEQ ID NO: 2721346 - protein, 17 aa, Entamoeba histolytica
NENMIDYHLLFESNFEI

SEQ ID NO: 2721347 - protein, 25 aa, Entamoeba histolytica
NENNELPPVLIRATNPTIEEAAPKK

SEQ ID NO: 2721348 - protein, 26 aa, Entamoeba histolytica
NENNKPVFGLILKKYINEGETKEIQE

SEQ ID NO: 2721349 - protein, 29 aa, Entamoeba histolytica
NENNRIISYVPWWTIVEMANNIFGDDGWS

SEQ ID NO: 2721350 - protein, 24 aa, Entamoeba histolytica
NENSIQIQWLWELLSEWGKEDHIK

SEQ ID NO: 2721351 - protein, 26 aa, Entamoeba histolytica
NENVSIPFYPWYFIGIETPNNNDNKS

SEQ ID NO: 2721352 - protein, 25 aa, Entamoeba histolytica
NENVSIPFYPWYFIGVETPNNNDNK

SEQ ID NO: 2721353 - protein, 26 aa, Entamoeba histolytica
NENVSIPFYPWYFIGVETPNSNDNKS

SEQ ID NO: 2721354 - protein, 27 aa, Entamoeba histolytica
NENWKWKYLTHLSSYLTPTALGTVFCM

SEQ ID NO: 2721355 - protein, 34 aa, Entamoeba histolytica
NEPKKSILPRLPLTRRPRNKILYGSTLGSISEIP

SEQ ID NO: 2721356 - protein, 26 aa, Entamoeba histolytica
NEPSQAFWKFMNLIASKVTLEGYQNY

SEQ ID NO: 2721357 - protein, 24 aa, Entamoeba histolytica
NEQELSLLRQWSGKQKLHVFFNNK

SEQ ID NO: 2721358 - protein, 24 aa, Entamoeba histolytica
NEQERPIELSWYPGGIAYQLNASR

SEQ ID NO: 2721359 - protein, 24 aa, Entamoeba histolytica
NEQFKNFKFIKESEFLYLLCSFYN

SEQ ID NO: 2721360 - protein, 28 aa, Entamoeba histolytica
NEQKLIVSGIVIALKIANPKYEDTKYTV

SEQ ID NO: 2721361 - protein, 23 aa, Entamoeba histolytica
NEQKLQPQIIFNEKQKPVSSLTE

SEQ ID NO: 2721362 - protein, 21 aa, Entamoeba histolytica
NEQLLLIRELLENIEIHPISP

SEQ ID NO: 2721363 - protein, 17 aa, Entamoeba histolytica
NEQPLELPKLPPKRKSG

SEQ ID NO: 2721364 - protein, 31 aa, Entamoeba histolytica
NEQQFYQFGGRPYNPPLPDESLRNIVSRELD

SEQ ID NO: 2721365 - protein, 24 aa, Entamoeba histolytica
NEQTIVYFINIIPQFDLYDLSNRI

SEQ ID NO: 2721366 - protein, 23 aa, Entamoeba histolytica
NEQTMFFMCDISYAIEYLSKNYS

SEQ ID NO: 2721367 - protein, 30 aa, Entamoeba histolytica
NEQVHWSIVLPTLKALYKFLQYVNAEEFIS

SEQ ID NO: 2721368 - protein, 18 aa, Entamoeba histolytica
NERHAEFAEALYLAEKAA

SEQ ID NO: 2721369 - protein, 26 aa, Entamoeba histolytica
NERIHLLEILIKLTQKIFEINGNNQW

SEQ ID NO: 2721370 - protein, 28 aa, Entamoeba histolytica
NERISNVRNLLFLNPSFSDSDDDLWSGE

SEQ ID NO: 2721371 - protein, 18 aa, Entamoeba histolytica
NERKSLGWMAPLYKEYPG

SEQ ID NO: 2721372 - protein, 20 aa, Entamoeba histolytica
NERLILLQKYSQRGQKVDEE

SEQ ID NO: 2721373 - protein, 29 aa, Entamoeba histolytica
NERMNRTILFMVALWRMNGYKCSIRTSKR

SEQ ID NO: 2721374 - protein, 26 aa, Entamoeba histolytica
NERNNVFFKWSCLDYNYNHQPISKTG

SEQ ID NO: 2721375 - protein, 30 aa, Entamoeba histolytica
NERPAFNAMYKLLFFPMSVNDFNVVLDTGI

SEQ ID NO: 2721376 - protein, 18 aa, Entamoeba histolytica
NERPTSFDLLKHSWLSNA

SEQ ID NO: 2721377 - protein, 21 aa, Entamoeba histolytica
NESFYLVTSLLVFTTDYNISL

SEQ ID NO: 2721378 - protein, 21 aa, Entamoeba histolytica
NESHFEIVLWISYCINLLKPL

SEQ ID NO: 2721379 - protein, 24 aa, Entamoeba histolytica
NESIANFCLPLTRLLWNMENEIMK

SEQ ID NO: 2721380 - protein, 24 aa, Entamoeba histolytica
NESINPINLTNMIWKIPGNNRCAE

SEQ ID NO: 2721381 - protein, 22 aa, Entamoeba histolytica
NESLLKYFNSISEFLADCNVPS

SEQ ID NO: 2721382 - protein, 26 aa, Entamoeba histolytica
NESNKEIISIRFSLIKAKQSIKEFCE

SEQ ID NO: 2721383 - protein, 21 aa, Entamoeba histolytica
NESQVIEYAKALNAKMHTNIQ

SEQ ID NO: 2721384 - protein, 26 aa, Entamoeba histolytica
NESSIDYIFKFIIIGEFSVGKTCLLM

SEQ ID NO: 2721385 - protein, 24 aa, Entamoeba histolytica
NESSPIQVLLISKPASIVAEEKYG

SEQ ID NO: 2721386 - protein, 25 aa, Entamoeba histolytica
NESYELLFERFGIDKIYSSPSPVLV

SEQ ID NO: 2721387 - protein, 18 aa, Entamoeba histolytica
NETDLTQFRWDEKKYPFT

SEQ ID NO: 2721388 - protein, 28 aa, Entamoeba histolytica
NETEIIKFIMLLFESFILNKVKVQKSEG

SEQ ID NO: 2721389 - protein, 28 aa, Entamoeba histolytica
NETEYQSRWRKREISPVRKCRSYKERIK

SEQ ID NO: 2721390 - protein, 18 aa, Entamoeba histolytica
NETIDIPMYFVYSQPDED

SEQ ID NO: 2721391 - protein, 21 aa, Entamoeba histolytica
NETLIFKEYFHDLAIKDDMVT

SEQ ID NO: 2721392 - protein, 17 aa, Entamoeba histolytica
NETLLACKLRYIIELDE

SEQ ID NO: 2721393 - protein, 26 aa, Entamoeba histolytica
NETRKNEIFLYLPEVLSTATAFLKDM

SEQ ID NO: 2721394 - protein, 23 aa, Entamoeba histolytica
NETTKLIKLMKLNPKLKKLETII

SEQ ID NO: 2721395 - protein, 35 aa, Entamoeba histolytica
NETTYYFENGLRRVLPYFYTFKVNAKGRWIGRTIV

SEQ ID NO: 2721396 - protein, 25 aa, Entamoeba histolytica
NETVSKYFPQLSQLILNMTEFDPKK

SEQ ID NO: 2721397 - protein, 18 aa, Entamoeba histolytica
NEVLKWLDTVQALVVGPG

SEQ ID NO: 2721398 - protein, 27 aa, Entamoeba histolytica
NEVMTVLHFKLSTIIRVVGGWVRDKLL

SEQ ID NO: 2721399 - protein, 17 aa, Entamoeba histolytica
NEVPIICKCGQKFCFKC

SEQ ID NO: 2721400 - protein, 26 aa, Entamoeba histolytica
NEVTVDFREFFKGNFCVDILSKKFDL

SEQ ID NO: 2721401 - protein, 19 aa, Entamoeba histolytica
NEVYFYQDPFIYSYKTNGT

SEQ ID NO: 2721402 - protein, 25 aa, Entamoeba histolytica
NEVYPKYTFLVIDCPKPQNIPIAVF

SEQ ID NO: 2721403 - protein, 21 aa, Entamoeba histolytica
NEWIGILQLITYPKWSINGIS

SEQ ID NO: 2721404 - protein, 32 aa, Entamoeba histolytica
NEWKKVNILIYQNLIFLLKPGSDTVLAIIYIS

SEQ ID NO: 2721405 - protein, 20 aa, Entamoeba histolytica
NEWMYLINDNIMLLYSIQDN

SEQ ID NO: 2721406 - protein, 31 aa, Entamoeba histolytica
NEYKGKYVVLLFYPLDWTFVCPTEMIGYSEL

SEQ ID NO: 2721407 - protein, 17 aa, Entamoeba histolytica
NEYLKLKPNIKIITFIN

SEQ ID NO: 2721408 - protein, 24 aa, Entamoeba histolytica
NEYNLQVILPKITPLTPVQSYPDS

SEQ ID NO: 2721409 - protein, 31 aa, Entamoeba histolytica
NEYRGKYVVLLFYPLDWTFVCPTEMIGYSEL

SEQ ID NO: 2721410 - protein, 18 aa, Entamoeba histolytica
NFAPLIRKAIDIVRTTHS

SEQ ID NO: 2721411 - protein, 30 aa, Entamoeba histolytica
NFCLIILKRSIIEPLIASALAYISCYVFYS

SEQ ID NO: 2721412 - protein, 19 aa, Entamoeba histolytica
NFCNKLWNAFKFSTMNFRK

SEQ ID NO: 2721413 - protein, 20 aa, Entamoeba histolytica
NFCSTLLLVWDFIEDDYNMV

SEQ ID NO: 2721414 - protein, 26 aa, Entamoeba histolytica
NFCVDILSKKFDLCDLVLSKAYAQFS

SEQ ID NO: 2721415 - protein, 22 aa, Entamoeba histolytica
NFDDFISKLVKLPRISLETSRE

SEQ ID NO: 2721416 - protein, 26 aa, Entamoeba histolytica
NFDDFITKLVTLPRISLEKSREVLKK

SEQ ID NO: 2721417 - protein, 26 aa, Entamoeba histolytica
NFDDFITKLVTLPRISLEKSREVLKR

SEQ ID NO: 2721418 - protein, 25 aa, Entamoeba histolytica
NFDDSLIKIILDKIKQHIGDSTFNK

SEQ ID NO: 2721419 - protein, 25 aa, Entamoeba histolytica
NFDDSLIKVILDKIKQHIGDISFQR

SEQ ID NO: 2721420 - protein, 19 aa, Entamoeba histolytica
NFDFKYLLERAKVLKVKDF

SEQ ID NO: 2721421 - protein, 17 aa, Entamoeba histolytica
NFDFLRTNASMLLYLGD

SEQ ID NO: 2721422 - protein, 25 aa, Entamoeba histolytica
NFDGIDILIFLQLIQEVIYQECKEV

SEQ ID NO: 2721423 - protein, 30 aa, Entamoeba histolytica
NFDGTVPIPAILKPIPKWTGKQVFTQILPT

SEQ ID NO: 2721424 - protein, 21 aa, Entamoeba histolytica
NFDPTLLDYNPIDIGIDAVDW

SEQ ID NO: 2721425 - protein, 33 aa, Entamoeba histolytica; identical to SEQ ID NO: 2534130

SEQ ID NO: 2721426 - protein, 28 aa, Entamoeba histolytica
NFDYNSLPFSIFRLIKNQLQLGKSLNKC

SEQ ID NO: 2721427 - protein, 36 aa, Entamoeba histolytica; identical to SEQ ID NO: 2534133

SEQ ID NO: 2721428 - protein, 18 aa, Entamoeba histolytica
NFELWKVNPYQKIKEFPI

SEQ ID NO: 2721429 - protein, 18 aa, Entamoeba histolytica
NFELYLVEDCGHNDIFSN

SEQ ID NO: 2721430 - protein, 22 aa, Entamoeba histolytica
NFESRLLWRVYVFIADMHKKYV

SEQ ID NO: 2721431 - protein, 24 aa, Entamoeba histolytica
NFESTAPIIVCYFSFKKHTTTPMP

SEQ ID NO: 2721432 - protein, 17 aa, Entamoeba histolytica
NFFIKYAHRFTKLQSIT

SEQ ID NO: 2721433 - protein, 26 aa, Entamoeba histolytica
NFFRDAQGIIICYDVTSPKSLTSIPM

SEQ ID NO: 2721434 - protein, 20 aa, Entamoeba histolytica
NFGLMEGVALWALRKPFNEV

SEQ ID NO: 2721435 - protein, 27 aa, Entamoeba histolytica
NFGVEQYVWFMTKQGFIWSTLLQTLIN

SEQ ID NO: 2721436 - protein, 38 aa, Entamoeba histolytica
NFIEISLSFVIPYFLEEPLPIRILVSLPQLSGTCRADI

SEQ ID NO: 2721437 - protein, 29 aa, Entamoeba histolytica
NFIESGALVQIFWSLCLLLDRHFKNVLFN

SEQ ID NO: 2721438 - protein, 17 aa, Entamoeba histolytica
NFIGEEQVKLLGDKIGE

SEQ ID NO: 2721439 - protein, 18 aa, Entamoeba histolytica
NFIIKKKNLILRKSVLFT

SEQ ID NO: 2721440 - protein, 19 aa, Entamoeba histolytica
NFIQIVGPSWFIPMAMHPA

SEQ ID NO: 2721441 - protein, 22 aa, Entamoeba histolytica
NFITIKQALEKYSARQLRILFL

SEQ ID NO: 2721442 - protein, 20 aa, Entamoeba histolytica
NFIVLSHFIPEGVSLVKDVL

SEQ ID NO: 2721443 - protein, 21 aa, Entamoeba histolytica
NFKTFSWDIFKALCSTRGESI

SEQ ID NO: 2721444 - protein, 25 aa, Entamoeba histolytica
NFKTKIIYIALMVNWILKADETGEL

SEQ ID NO: 2721445 - protein, 38 aa, Entamoeba histolytica
NFKTLAFCRRYVDKIGFAKWQMPFKFLVDDGCVNAYPP

SEQ ID NO: 2721446 - protein, 25 aa, Entamoeba histolytica
NFLCRKQHVTLLFKTTNNKLFGYCN

SEQ ID NO: 2721447 - protein, 31 aa, Entamoeba histolytica
NFLDIEMPEALFIFPRLFKIEIAILYDKLSS

SEQ ID NO: 2721448 - protein, 19 aa, Entamoeba histolytica
NFLIWQYLKEHQWNRTKHI

SEQ ID NO: 2721449 - protein, 18 aa, Entamoeba histolytica
NFLSYHIQISYPDSLEPL

SEQ ID NO: 2721450 - protein, 26 aa, Entamoeba histolytica
NFMCHKHLILDLSPQVNFIVGENGSG

SEQ ID NO: 2721451 - protein, 20 aa, Entamoeba histolytica
NFMKIFFIECKCKNISSLPP

SEQ ID NO: 2721452 - protein, 19 aa, Entamoeba histolytica
NFNCLVFGGLNVYLKDKYQ

SEQ ID NO: 2721453 - protein, 45 aa, Entamoeba histolytica
NFNETKIIQFMKTLILLPSRDIFESLFWKTLYGKIVSGKIKSIDT

SEQ ID NO: 2721454 - protein, 26 aa, Entamoeba histolytica
NFNEVYEYLILKEYYFACAVCLVMYK

SEQ ID NO: 2721455 - protein, 17 aa, Entamoeba histolytica
NFNFIKNSRKNLLAETS

SEQ ID NO: 2721456 - protein, 18 aa, Entamoeba histolytica
NFNKILFIPCWSVGNVGQ

SEQ ID NO: 2721457 - protein, 19 aa, Entamoeba histolytica
NFPDFLDCFNYSLPTLMES

SEQ ID NO: 2721458 - protein, 20 aa, Entamoeba histolytica
NFPIVLKLNPKCQSNYICLH

SEQ ID NO: 2721459 - protein, 17 aa, Entamoeba histolytica
NFPMAYPPFNAERHLRS

SEQ ID NO: 2721460 - protein, 21 aa, Entamoeba histolytica
NFQLQKSFIKEMKLFPHLETK

SEQ ID NO: 2721461 - protein, 25 aa, Entamoeba histolytica
NFQQLLTFIGLELPIPLILNTSKIY

SEQ ID NO: 2721462 - protein, 20 aa, Entamoeba histolytica
NFRELNYGKSLLKFFDDVKL

SEQ ID NO: 2721463 - protein, 22 aa, Entamoeba histolytica
NFRHTIDLIKTLKYPHKFAPFY

SEQ ID NO: 2721464 - protein, 23 aa, Entamoeba histolytica
NFRIVPEFLFLYKDRFISHRNEI

SEQ ID NO: 2721465 - protein, 23 aa, Entamoeba histolytica
NFRKLEEKLNIWKALMQLEANHG

SEQ ID NO: 2721466 - protein, 34 aa, Entamoeba histolytica
NFSCYNELHPLLLKSSLFLLFNEAVTKYSGDAKV

SEQ ID NO: 2721467 - protein, 21 aa, Entamoeba histolytica
NFSKFPFYFEVGGNIAQEIGD

SEQ ID NO: 2721468 - protein, 17 aa, Entamoeba histolytica
NFSKLQALIISNNNLYE

SEQ ID NO: 2721469 - protein, 25 aa, Entamoeba histolytica
NFSKTFLSLILTKVLVKYPEQVSWR

SEQ ID NO: 2721470 - protein, 21 aa, Entamoeba histolytica
NFSQQYIRSVLPPELWKRIEN

SEQ ID NO: 2721471 - protein, 19 aa, Entamoeba histolytica
NFSRIIFKLNIKKANTMFE

SEQ ID NO: 2721472 - protein, 24 aa, Entamoeba histolytica
NFSRTFLIVVPAMVALQWQTEAKK

SEQ ID NO: 2721473 - protein, 21 aa, Entamoeba histolytica
NFTAPDFFLFAAIDGHLGSVV

SEQ ID NO: 2721474 - protein, 35 aa, Entamoeba histolytica
NFTSNNLHFFIGVYEFFILQHLFQQLNDNLKVFFK

SEQ ID NO: 2721475 - protein, 21 aa, Entamoeba histolytica
NFTVLIHLRYLSLSSNNLTTF

SEQ ID NO: 2721476 - protein, 36 aa, Entamoeba histolytica
NFVHVLHAWFHMKILRLFTDSVLHYGLPTKYDLIVM

SEQ ID NO: 2721477 - protein, 21 aa, Entamoeba histolytica
NFVIQAFLDALPEKTKEEMAH

SEQ ID NO: 2721478 - protein, 30 aa, Entamoeba histolytica
NFVKTWENYFYKFLPPFPRHLIQPHIKTYV

SEQ ID NO: 2721479 - protein, 18 aa, Entamoeba histolytica
NFVLFVDYIRLREKLKKE

SEQ ID NO: 2721480 - protein, 17 aa, Entamoeba histolytica
NFVRVLDRLQLDLDKYL

SEQ ID NO: 2721481 - protein, 19 aa, Entamoeba histolytica
NFVSKPFYTLKVIIEDHEG

SEQ ID NO: 2721482 - protein, 19 aa, Entamoeba histolytica
NFVSLFCNSVPEPLFTYTS

SEQ ID NO: 2721483 - protein, 24 aa, Entamoeba histolytica
NFVSRLITPPSYLLGKKLKSIING

SEQ ID NO: 2721484 - protein, 18 aa, Entamoeba histolytica
NFYIIKYFNNQYKEEIMK

SEQ ID NO: 2721485 - protein, 19 aa, Entamoeba histolytica
NFYNGIIKIKFRCPNGKSV

SEQ ID NO: 2721486 - protein, 25 aa, Entamoeba histolytica
NFYSLYNLFDFCDSFDLPPPNMKLN

SEQ ID NO: 2721487 - protein, 31 aa, Entamoeba histolytica
NGCCPTPLIYSDNFPMLYSPKLRKGNNFSET

SEQ ID NO: 2721488 - protein, 26 aa, Entamoeba histolytica
NGCGKTTFLKLLIDALTPVEGTVQRN

SEQ ID NO: 2721489 - protein, 19 aa, Entamoeba histolytica
NGCLLLINGNVLEYIKDIP

SEQ ID NO: 2721490 - protein, 30 aa, Entamoeba histolytica
NGDNKTQFFLQRMKMLFLEEIRSFSVQINT

SEQ ID NO: 2721491 - protein, 35 aa, Entamoeba histolytica; identical to SEQ ID NO: 2534194

SEQ ID NO: 2721492 - protein, 25 aa, Entamoeba histolytica
NGDYILYYQYFILKQTKSNQVHYLN

SEQ ID NO: 2721493 - protein, 25 aa, Entamoeba histolytica
NGECDDLLYFFTHIYHRVQDFYNEH

SEQ ID NO: 2721494 - protein, 21 aa, Entamoeba histolytica
NGEGWIYINGKTYSPSEISSF

SEQ ID NO: 2721495 - protein, 23 aa, Entamoeba histolytica
NGEIETAWIYYHKLKEINESLDE

SEQ ID NO: 2721496 - protein, 18 aa, Entamoeba histolytica
NGELKKVTLPTLAIALII

SEQ ID NO: 2721497 - protein, 25 aa, Entamoeba histolytica
NGERMAMFSPTFKLNYKKTIREQLK

SEQ ID NO: 2721498 - protein, 21 aa, Entamoeba histolytica
NGFLLQYRWDKNIELVSSQFI

SEQ ID NO: 2721499 - protein, 25 aa, Entamoeba histolytica
NGFMKKEDWFSVCKNFTLADGTFWP

SEQ ID NO: 2721500 - protein, 23 aa, Entamoeba histolytica
NGFSFGNIDFGKGFNFGTFSSVE

SEQ ID NO: 2721501 - protein, 19 aa, Entamoeba histolytica
NGFTVCLKKLYKKGKTTSQ

SEQ ID NO: 2721502 - protein, 17 aa, Entamoeba histolytica
NGFYILFKEGFVCIRFE

SEQ ID NO: 2721503 - protein, 21 aa, Entamoeba histolytica
NGGHYYSYCRCGSDWFVFNDD

SEQ ID NO: 2721504 - protein, 20 aa, Entamoeba histolytica
NGGKYIVIDFGGGTFDVSIV

SEQ ID NO: 2721505 - protein, 17 aa, Entamoeba histolytica
NGGNYISFELWNRTLKK

SEQ ID NO: 2721506 - protein, 30 aa, Entamoeba histolytica
NGHARAFIIYGKCLLYYYQFEEARSVFEEA

SEQ ID NO: 2721507 - protein, 18 aa, Entamoeba histolytica
NGHEAATLCRNKLKQVYG

SEQ ID NO: 2721508 - protein, 18 aa, Entamoeba histolytica
NGHIPLYSPEECKLFLKW

SEQ ID NO: 2721509 - protein, 31 aa, Entamoeba histolytica
NGHVFDLKKFPYEPLFNFVLPTERPYRRVTC

SEQ ID NO: 2721510 - protein, 19 aa, Entamoeba histolytica
NGIEMINPQNIFGLGLTLT

SEQ ID NO: 2721511 - protein, 19 aa, Entamoeba histolytica
NGIEWFKQNLPHSNIYGFN

SEQ ID NO: 2721512 - protein, 24 aa, Entamoeba histolytica
NGIKVVWMRHEFDFIGGSLGCAEG

SEQ ID NO: 2721513 - protein, 25 aa, Entamoeba histolytica
NGILHTLLYRMKNGLRMNKHFGLLR

SEQ ID NO: 2721514 - protein, 24 aa, Entamoeba histolytica
NGIRKLDLEYGDFPDDGYDYSQHF

SEQ ID NO: 2721515 - protein, 22 aa, Entamoeba histolytica
NGKEMKINFSPFTKLDAFDGSY

SEQ ID NO: 2721516 - protein, 19 aa, Entamoeba histolytica
NGKFGTFTPGLDSSSPCIS

SEQ ID NO: 2721517 - protein, 17 aa, Entamoeba histolytica
NGKFILFTPSKEEALEW

SEQ ID NO: 2721518 - protein, 22 aa, Entamoeba histolytica
NGKFPFVIIGNKIDKGSVISKE

SEQ ID NO: 2721519 - protein, 27 aa, Entamoeba histolytica
NGKFSGKLIVLYKNNCLTLTSGILLIN

SEQ ID NO: 2721520 - protein, 23 aa, Entamoeba histolytica
NGKILIFNADTFKPIIFEDSLHP

SEQ ID NO: 2721521 - protein, 22 aa, Entamoeba histolytica
NGKIYYVTFVYSYSSILTLDKA

SEQ ID NO: 2721522 - protein, 23 aa, Entamoeba histolytica
NGKKFIAKVLLNCAGVFASQVSE

SEQ ID NO: 2721523 - protein, 24 aa, Entamoeba histolytica
NGKKFIAKVLLNCAGVFASQVSEM

SEQ ID NO: 2721524 - protein, 25 aa, Entamoeba histolytica
NGKKFIAKVLLNCAGVFASQVSEML

SEQ ID NO: 2721525 - protein, 22 aa, Entamoeba histolytica
NGKLIKKLMIRYSKYNNKYENN

SEQ ID NO: 2721526 - protein, 26 aa, Entamoeba histolytica
NGKLLSLNIDCRENVLSGIKKVADAV

SEQ ID NO: 2721527 - protein, 24 aa, Entamoeba histolytica
NGKTINPPVIWKVKNKRLAFLSFC

SEQ ID NO: 2721528 - protein, 23 aa, Entamoeba histolytica
NGLKKYIRLMLSLDFSCHQYYLF

SEQ ID NO: 2721529 - protein, 23 aa, Entamoeba histolytica
NGLLKKFNIYSPSSKLKLSFIIR

SEQ ID NO: 2721530 - protein, 26 aa, Entamoeba histolytica
NGLLRLHTLLQWIKETLQLIKDNKCC

SEQ ID NO: 2721531 - protein, 28 aa, Entamoeba histolytica
NGLPPIPTSILPLFEMIGIDGVLAVWLA

SEQ ID NO: 2721532 - protein, 24 aa, Entamoeba histolytica
NGLPVTVRLLDPPLHEFLPTLEEL

SEQ ID NO: 2721533 - protein, 20 aa, Entamoeba histolytica
NGLQMYLIPLDNTIVESIWI

SEQ ID NO: 2721534 - protein, 17 aa, Entamoeba histolytica
NGLSQQLDILKKQLYDC

SEQ ID NO: 2721535 - protein, 23 aa, Entamoeba histolytica
NGLVLYSICNKLFKQLCCAVIYI

SEQ ID NO: 2721536 - protein, 21 aa, Entamoeba histolytica
NGLYSLLVPKILFQSQAEPQL

SEQ ID NO: 2721537 - protein, 25 aa, Entamoeba histolytica
NGMDFKGIFRFSPFANLKEIEEGTR

SEQ ID NO: 2721538 - protein, 33 aa, Entamoeba histolytica
NGMKFIQQLFITPELHYIIPNELWKWVNKIVNK

SEQ ID NO: 2721539 - protein, 26 aa, Entamoeba histolytica
NGMKGFQINYFVSCIQSQVFKKYISL

SEQ ID NO: 2721540 - protein, 20 aa, Entamoeba histolytica
NGMVLPIQQHTPLNVGYLQP

SEQ ID NO: 2721541 - protein, 18 aa, Entamoeba histolytica
NGNEIFLRLKKKLNISEH

SEQ ID NO: 2721542 - protein, 23 aa, Entamoeba histolytica
NGNELILLSLNTTKWEIFCTTGT

SEQ ID NO: 2721543 - protein, 22 aa, Entamoeba histolytica
NGNILVYYRNAFSKHIHLGILS

SEQ ID NO: 2721544 - protein, 30 aa, Entamoeba histolytica
NGNQSIKQIIWFILMRLPTIISIKNEVKLL

SEQ ID NO: 2721545 - protein, 26 aa, Entamoeba histolytica
NGPVNVLIGFRSLKGIMQCDNCMGAI

SEQ ID NO: 2721546 - protein, 18 aa, Entamoeba histolytica
NGQIMVTRSIGDRSLHPP

SEQ ID NO: 2721547 - protein, 25 aa, Entamoeba histolytica
NGQKPRKLAMWPKYNFYKADQRYME

SEQ ID NO: 2721548 - protein, 24 aa, Entamoeba histolytica
NGQYALPSLLNLLTNYINHFNELF

SEQ ID NO: 2721549 - protein, 23 aa, Entamoeba histolytica
NGRIVTPIRFLPKKNQYDCAVTI

SEQ ID NO: 2721550 - protein, 27 aa, Entamoeba histolytica
NGRNDLMFYKIALDQLSLILFPGSSKQ

SEQ ID NO: 2721551 - protein, 22 aa, Entamoeba histolytica
NGRPFIYKSEFERDSIRSCVAF

SEQ ID NO: 2721552 - protein, 32 aa, Entamoeba histolytica
NGRTASISGLWISILLAIRTGGDVLFCTDGMQ

SEQ ID NO: 2721553 - protein, 23 aa, Entamoeba histolytica
NGSCIFVCFNNHPFSLPKIYPTD

SEQ ID NO: 2721554 - protein, 19 aa, Entamoeba histolytica
NGSEFLSYPTILGSLPNIT

SEQ ID NO: 2721555 - protein, 25 aa, Entamoeba histolytica
NGSIPKELILWASTKNVPIVNKDWL

SEQ ID NO: 2721556 - protein, 26 aa, Entamoeba histolytica
NGSKKAFGFVFHSLTIEGKWLDDEKM

SEQ ID NO: 2721557 - protein, 25 aa, Entamoeba histolytica
NGSSSIIYWNPSLAPVVTLKTAHSE

SEQ ID NO: 2721558 - protein, 26 aa, Entamoeba histolytica
NGTEIRFNLPQWQKFPIFAKIRESQI

SEQ ID NO: 2721559 - protein, 22 aa, Entamoeba histolytica
NGTLIFDTPLHAFCWKEMAKRI

SEQ ID NO: 2721560 - protein, 33 aa, Entamoeba histolytica; identical to SEQ ID NO: 2534280

SEQ ID NO: 2721561 - protein, 24 aa, Entamoeba histolytica
NGTTPLMLSLYKNFPDIIKILLNE

SEQ ID NO: 2721562 - protein, 24 aa, Entamoeba histolytica
NGTVTYMDIILKFENTTAKQAQNE

SEQ ID NO: 2721563 - protein, 28 aa, Entamoeba histolytica
NGVDCGVFMLYFIRKFMEYTPSDGTKFK

SEQ ID NO: 2721564 - protein, 20 aa, Entamoeba histolytica
NGVLVFWKTIDGSQSYLPEI

SEQ ID NO: 2721565 - protein, 24 aa, Entamoeba histolytica
NGVNSAYFFLFNDVLIETQVIRHH

SEQ ID NO: 2721566 - protein, 25 aa, Entamoeba histolytica
NGVNSAYFFLFNDVLIETQVIRHHN

SEQ ID NO: 2721567 - protein, 26 aa, Entamoeba histolytica
NGVTKLPFYLSTFPKWKAKDLHTIFH

SEQ ID NO: 2721568 - protein, 25 aa, Entamoeba histolytica
NGYALELFTLFVKYKCFIEVTYRSQ

SEQ ID NO: 2721569 - protein, 20 aa, Entamoeba histolytica
NGYFCLYPYASGVFSFRDRN

SEQ ID NO: 2721570 - protein, 25 aa, Entamoeba histolytica
NGYIQTKWMNELYLNKLRCFGYKIG

SEQ ID NO: 2721571 - protein, 26 aa, Entamoeba histolytica
NHEFGINPYIVGTLLFSLKNKKINSY

SEQ ID NO: 2721572 - protein, 27 aa, Entamoeba histolytica
NHEIELYYYPLEYQALTIPSTVLYLDN

SEQ ID NO: 2721573 - protein, 25 aa, Entamoeba histolytica
NHEKGKLKIYLYPNQPFNQQDEFDP

SEQ ID NO: 2721574 - protein, 24 aa, Entamoeba histolytica
NHELKRYLSFIKFNPWTYCGDMLF

SEQ ID NO: 2721575 - protein, 26 aa, Entamoeba histolytica
NHENGKLKIYLYPNQPFDQKDEIDAI

SEQ ID NO: 2721576 - protein, 26 aa, Entamoeba histolytica
NHENGKLKIYLYPNQPFNQKDENDAI

SEQ ID NO: 2721577 - protein, 19 aa, Entamoeba histolytica
NHERIESLRLKKMKERQIE

SEQ ID NO: 2721578 - protein, 20 aa, Entamoeba histolytica
NHFIFRRFYSVSKSLKIVDN

SEQ ID NO: 2721579 - protein, 20 aa, Entamoeba histolytica
NHFLFSLSSPYLIEPTKFIG

SEQ ID NO: 2721580 - protein, 30 aa, Entamoeba histolytica
NHFVKNLNIGMIGTPYISPAIVLESGDEII

SEQ ID NO: 2721581 - protein, 24 aa, Entamoeba histolytica
NHHLLLDMLRMYGITFNTTFSSGK

SEQ ID NO: 2721582 - protein, 18 aa, Entamoeba histolytica
NHIRQWLNEIEGNASPNV

SEQ ID NO: 2721583 - protein, 19 aa, Entamoeba histolytica
NHKELITKLFSAPIKVTSK

SEQ ID NO: 2721584 - protein, 29 aa, Entamoeba histolytica
NHKFDIYADSLPRWVVTAAPLNQSTVLAS

SEQ ID NO: 2721585 - protein, 23 aa, Entamoeba histolytica
NHKGKIICHPCMLNKLPKCARCN

SEQ ID NO: 2721586 - protein, 25 aa, Entamoeba histolytica
NHLAKFPLIVLCKKGIHVITTQSNE

SEQ ID NO: 2721587 - protein, 27 aa, Entamoeba histolytica
NHLDEIIKLWRVSLLQHQIVLNDECLE

SEQ ID NO: 2721588 - protein, 22 aa, Entamoeba histolytica
NHLEDIILEKTCFPKQSLSSIQ

SEQ ID NO: 2721589 - protein, 23 aa, Entamoeba histolytica
NHLHETLLFLFNALQSGEESAIP

SEQ ID NO: 2721590 - protein, 26 aa, Entamoeba histolytica
NHLQKEIQLLYKTKLDVNDAAKWFDQ

SEQ ID NO: 2721591 - protein, 34 aa, Entamoeba histolytica
NHLQMKYEPLIKEFPIQTKVFISPVFISQNIFTD

SEQ ID NO: 2721592 - protein, 28 aa, Entamoeba histolytica
NHMTCKCGYQFCWLCGVKYSSDHWTNNT

SEQ ID NO: 2721593 - protein, 28 aa, Entamoeba histolytica
NHPEDVQLLKLLRLLSSNEIKRIETRSK

SEQ ID NO: 2721594 - protein, 26 aa, Entamoeba histolytica
NHPINPFEFHSFFYLRTVELSDEIKE

SEQ ID NO: 2721595 - protein, 19 aa, Entamoeba histolytica
NHPNFLALKGIVLTPLALL

SEQ ID NO: 2721596 - protein, 48 aa, Entamoeba histolytica
NHPNILKLFGLFEDKDRWFLVLEYCKKGELYGLLQQAGRFDERRAARY

SEQ ID NO: 2721597 - protein, 48 aa, Entamoeba histolytica
NHPNILKLFGLFEDKNRWFLVLEYCKKGELYGLLQQAGRFDERRAARY

SEQ ID NO: 2721598 - protein, 22 aa, Entamoeba histolytica
NHPNRVVVKQSTLKIQRKKSSK

SEQ ID NO: 2721599 - protein, 21 aa, Entamoeba histolytica
NHPTVPLMRERGGKKCICVLC

SEQ ID NO: 2721600 - protein, 17 aa, Entamoeba histolytica
NHQLFNLLADYLHNEYQ

SEQ ID NO: 2721601 - protein, 20 aa, Entamoeba histolytica
NHRKLLDAIFVLAGVPREKF

SEQ ID NO: 2721602 - protein, 17 aa, Entamoeba histolytica
NHSLQRKLFERQPLRQK

SEQ ID NO: 2721603 - protein, 17 aa, Entamoeba histolytica
NHVFKTLRINRTRLVHI

SEQ ID NO: 2721604 - protein, 31 aa, Entamoeba histolytica
NHVQPGIEKYIYPPAIPKLKGNWLIDKEKSG

SEQ ID NO: 2721605 - protein, 30 aa, Entamoeba histolytica
NHVWTVTLTIPPRSTRWWYSVTRANQIIRI

SEQ ID NO: 2721606 - protein, 20 aa, Entamoeba histolytica
NIADFPFGVGAVRVAFHGFD

SEQ ID NO: 2721607 - protein, 25 aa, Entamoeba histolytica
NIAEDRIRFPWYVAGGSYNEKSATG

SEQ ID NO: 2721608 - protein, 25 aa, Entamoeba histolytica
NIAMGKLVLGIYLMGKKIIPKHSTI

SEQ ID NO: 2721609 - protein, 17 aa, Entamoeba histolytica
NIASFVRQLNIYGFHKL

SEQ ID NO: 2721610 - protein, 19 aa, Entamoeba histolytica
NIAVGPLHKQKELEKQRLV

SEQ ID NO: 2721611 - protein, 36 aa, Entamoeba histolytica
NIAVKFKSLVTKVLLFKPNCKILIAFTKSDLLNSGI

SEQ ID NO: 2721612 - protein, 29 aa, Entamoeba histolytica
NICLCDQEYKILLILRSFTFDKTGDKVAV

SEQ ID NO: 2721613 - protein, 26 aa, Entamoeba histolytica
NICNTFGRGHPRFRKPRIGGDGVYEF

SEQ ID NO: 2721614 - protein, 17 aa, Entamoeba histolytica
NICTNTAYILFYKKRNV

SEQ ID NO: 2721615 - protein, 25 aa, Entamoeba histolytica
NIDELWTLLNFINPENFPSLENFHE

SEQ ID NO: 2721616 - protein, 23 aa, Entamoeba histolytica
NIDKTLLKKGINYEIRIFKSNYK

SEQ ID NO: 2721617 - protein, 31 aa, Entamoeba histolytica
NIDLLPNDCYIILRQLDFSDVLLLTTSVTKV

SEQ ID NO: 2721618 - protein, 33 aa, Entamoeba histolytica
NIDLTLLPFPSIIEDWFYLQPIPFTDNVTSGRI

SEQ ID NO: 2721619 - protein, 19 aa, Entamoeba histolytica
NIDNIFLRMDIRTELICLG

SEQ ID NO: 2721620 - protein, 23 aa, Entamoeba histolytica
NIDQLIHNYLPFNMQLKYSEDCL

SEQ ID NO: 2721621 - protein, 35 aa, Entamoeba histolytica
NIDSNLMKPYFGDLLKWLLSLLNSNQKKVISEALC

SEQ ID NO: 2721622 - protein, 32 aa, Entamoeba histolytica
NIDVLLEKIWEIIGLFKVYPKTKAGVIDLDHP

SEQ ID NO: 2721623 - protein, 29 aa, Entamoeba histolytica
NIDVMAYLFQILTLYLPQVSSLCEPILNL

SEQ ID NO: 2721624 - protein, 18 aa, Entamoeba histolytica
NIDYYKTFDIVINALDNL

SEQ ID NO: 2721625 - protein, 33 aa, Entamoeba histolytica
NIEDKPIFIDLSWRLDIVLAYKNVYKLIQPQFI

SEQ ID NO: 2721626 - protein, 19 aa, Entamoeba histolytica
NIEEHIFELFPFPHSYEIE

SEQ ID NO: 2721627 - protein, 20 aa, Entamoeba histolytica
NIEELWLPEVAFYDEGAYLG

SEQ ID NO: 2721628 - protein, 24 aa, Entamoeba histolytica
NIEFNFTYPLLYKEYDEKVSFQIT

SEQ ID NO: 2721629 - protein, 27 aa, Entamoeba histolytica
NIEGVLTHQWLCGASVYSNPYFANLLK

SEQ ID NO: 2721630 - protein, 19 aa, Entamoeba histolytica
NIEIEYLPKIISNVIQIYC

SEQ ID NO: 2721631 - protein, 42 aa, Entamoeba histolytica
NIEKYLLEMNHLFERKLKIDQIRIKKLLKMRDTIVCQISRKF

SEQ ID NO: 2721632 - protein, 24 aa, Entamoeba histolytica
NIELLIDILNIYIIHFIRDNSEIT

SEQ ID NO: 2721633 - protein, 21 aa, Entamoeba histolytica
NIELLIEFIIGNESLALFDKE

SEQ ID NO: 2721634 - protein, 20 aa, Entamoeba histolytica
NIELYYKWNQKITNWVAYSI

SEQ ID NO: 2721635 - protein, 26 aa, Entamoeba histolytica
NIEQSLFPFIVFHSSPLIPFNSEIIP

SEQ ID NO: 2721636 - protein, 24 aa, Entamoeba histolytica
NIFEPNYLEPWLIVDFDSDIVVAS

SEQ ID NO: 2721637 - protein, 30 aa, Entamoeba histolytica
NIFEQPLIYLSILHSLFYSTLKLPLTLERI

SEQ ID NO: 2721638 - protein, 27 aa, Entamoeba histolytica
NIFEVYEKYFMMFGAFVECWPDDAFTQ

SEQ ID NO: 2721639 - protein, 33 aa, Entamoeba histolytica
NIFGSYHTILPPKPSQWILRDKGHFVFSLVNPY

SEQ ID NO: 2721640 - protein, 27 aa, Entamoeba histolytica
NIFISDVMISFYLYCGWMDQLTEKLAD

SEQ ID NO: 2721641 - protein, 26 aa, Entamoeba histolytica
NIFKQYGYKLGLTVRETCRFNYNYNE

SEQ ID NO: 2721642 - protein, 18 aa, Entamoeba histolytica
NIFLKEPNILKLKSPIIV

SEQ ID NO: 2721643 - protein, 19 aa, Entamoeba histolytica
NIFMKILTDWELIIEESKS

SEQ ID NO: 2721644 - protein, 32 aa, Entamoeba histolytica
NIFQYIEKVIKLNYIYNLVPWMCKNLVLNQFV

SEQ ID NO: 2721645 - protein, 33 aa, Entamoeba histolytica
NIFSDICPITFGSFFYFIEKVVSLLVKMFPFKF

SEQ ID NO: 2721646 - protein, 19 aa, Entamoeba histolytica
NIFSIKTGVIVGSLFHHTA

SEQ ID NO: 2721647 - protein, 24 aa, Entamoeba histolytica
NIGYNSFTAPLLMIGNSLLTIKSA

SEQ ID NO: 2721648 - protein, 25 aa, Entamoeba histolytica
NIHKKVIFNILLGLNSPTTSMACNT

SEQ ID NO: 2721649 - protein, 26 aa, Entamoeba histolytica
NIHTDIYFLYHLIQQIYHFQIVLTDI

SEQ ID NO: 2721650 - protein, 19 aa, Entamoeba histolytica
NIHTKLTLIKELAAVLVIQ

SEQ ID NO: 2721651 - protein, 25 aa, Entamoeba histolytica
NIIDIKTYDILFDSRFDPLDNRTFN

SEQ ID NO: 2721652 - protein, 18 aa, Entamoeba histolytica
NIIDLRTQNSYLIVSKEQ

SEQ ID NO: 2721653 - protein, 23 aa, Entamoeba histolytica
NIIEKEIEFGYYLEAGICEIQAV

SEQ ID NO: 2721654 - protein, 17 aa, Entamoeba histolytica
NIIKELPLIIISHEPPY

SEQ ID NO: 2721655 - protein, 24 aa, Entamoeba histolytica
NIIKIMNCIIIKFIKLHISSPELI

SEQ ID NO: 2721656 - protein, 18 aa, Entamoeba histolytica
NIIKMESVIRGFLIRREL

SEQ ID NO: 2721657 - protein, 17 aa, Entamoeba histolytica
NIILDLFESILLETSVI

SEQ ID NO: 2721658 - protein, 23 aa, Entamoeba histolytica
NIILSNILFFRGLSGHLHNVKMK

SEQ ID NO: 2721659 - protein, 19 aa, Entamoeba histolytica
NIIPGDVIFVIQTKEHRVF

SEQ ID NO: 2721660 - protein, 18 aa, Entamoeba histolytica
NIIQQLILLGSDDKILLP

SEQ ID NO: 2721661 - protein, 24 aa, Entamoeba histolytica
NIIRYDAIQDFLFHSLKSSLERQI

SEQ ID NO: 2721662 - protein, 19 aa, Entamoeba histolytica
NIISFKDLWNIINKKYTYE

SEQ ID NO: 2721663 - protein, 20 aa, Entamoeba histolytica
NIITLFTFICYDSIEPDCLK

SEQ ID NO: 2721664 - protein, 21 aa, Entamoeba histolytica
NIIYLTPGVLLQQLMRREGRR

SEQ ID NO: 2721665 - protein, 28 aa, Entamoeba histolytica
NIKEVRELFRTYGTLRGVRLPKKVDGQN

SEQ ID NO: 2721666 - protein, 23 aa, Entamoeba histolytica
NIKGRYCLGVFDLIPNGIVRRKS

SEQ ID NO: 2721667 - protein, 25 aa, Entamoeba histolytica
NIKHLILCNVFSQSLYLPNTLMKIV

SEQ ID NO: 2721668 - protein, 19 aa, Entamoeba histolytica
NIKIKERVIFTIKGSGFGT

SEQ ID NO: 2721669 - protein, 18 aa, Entamoeba histolytica
NIKIMKAMPAYSCVAYKY

SEQ ID NO: 2721670 - protein, 25 aa, Entamoeba histolytica
NIKKQMFLHQLPNTLIFQLKRFDFN

SEQ ID NO: 2721671 - protein, 19 aa, Entamoeba histolytica
NIKLPLISTSLQQPIPLTT

SEQ ID NO: 2721672 - protein, 19 aa, Entamoeba histolytica
NIKLRPWKEDNILVKNARA

SEQ ID NO: 2721673 - protein, 25 aa, Entamoeba histolytica
NIKNLSSCFLYLNDDMLLGKELKPE

SEQ ID NO: 2721674 - protein, 25 aa, Entamoeba histolytica
NIKPIYISSPLFDLISPMKLINSKV

SEQ ID NO: 2721675 - protein, 23 aa, Entamoeba histolytica
NIKPLIHVVGTEDIHLPLNNIIL

SEQ ID NO: 2721676 - protein, 20 aa, Entamoeba histolytica
NIKPSKKLIPLINAFQATHK

SEQ ID NO: 2721677 - protein, 18 aa, Entamoeba histolytica
NIKPTSLYVTKALEVKIF

SEQ ID NO: 2721678 - protein, 17 aa, Entamoeba histolytica
NIKPYNLRLVQHSTISL

SEQ ID NO: 2721679 - protein, 19 aa, Entamoeba histolytica
NIKQFADLYFAPTQRICRY

SEQ ID NO: 2721680 - protein, 27 aa, Entamoeba histolytica
NIKRKIATGLIFIKWGYSDIVDVIQEI

SEQ ID NO: 2721681 - protein, 25 aa, Entamoeba histolytica
NIKTLKFISIYYYKIVNNNIINIIS

SEQ ID NO: 2721682 - protein, 31 aa, Entamoeba histolytica
NIKYSSVILESIPTIIIFNEGQYNSFLKRCN

SEQ ID NO: 2721683 - protein, 19 aa, Entamoeba histolytica
NILCFAGAFLISGNCGENE

SEQ ID NO: 2721684 - protein, 20 aa, Entamoeba histolytica
NILEMFHYNPIPILSTTLFP

SEQ ID NO: 2721685 - protein, 19 aa, Entamoeba histolytica
NILHWDSINYLRDSITKYL

SEQ ID NO: 2721686 - protein, 17 aa, Entamoeba histolytica
NILIKDLTKIEINRTDL

SEQ ID NO: 2721687 - protein, 20 aa, Entamoeba histolytica
NILLDLPVFCEDTTEPYFRA

SEQ ID NO: 2721688 - protein, 17 aa, Entamoeba histolytica
NILLPKLEEAINKSHST

SEQ ID NO: 2721689 - protein, 19 aa, Entamoeba histolytica
NILLVDYTKQIKLIDFGSA

SEQ ID NO: 2721690 - protein, 19 aa, Entamoeba histolytica
NILMLAIQLGFNDIAFEIM

SEQ ID NO: 2721691 - protein, 19 aa, Entamoeba histolytica
NILNFLMKHIPDDLSTNKS

SEQ ID NO: 2721692 - protein, 18 aa, Entamoeba histolytica
NILNLLRKKHAEGGLWYG

SEQ ID NO: 2721693 - protein, 31 aa, Entamoeba histolytica
NILPSLNKILPLLIKLHRTDLLPLFSIIMTA

SEQ ID NO: 2721694 - protein, 26 aa, Entamoeba histolytica
NILQKQLEDVIKNPPLQQPSIQFNYS

SEQ ID NO: 2721695 - protein, 24 aa, Entamoeba histolytica
NILRLLEIYMKIYKQFKLEWSELT

SEQ ID NO: 2721696 - protein, 18 aa, Entamoeba histolytica
NILSKKGLSFIYLINYTP

SEQ ID NO: 2721697 - protein, 21 aa, Entamoeba histolytica
NILTSIILRSIGITSKYAGEF

SEQ ID NO: 2721698 - protein, 24 aa, Entamoeba histolytica
NINEIQTIIFPFSSKNKYGFIAYV

SEQ ID NO: 2721699 - protein, 25 aa, Entamoeba histolytica
NINHLFDIIIREWVSFHPVENNTSC

SEQ ID NO: 2721700 - protein, 23 aa, Entamoeba histolytica
NINHWMSSSFYTIALLSISSMKP

SEQ ID NO: 2721701 - protein, 21 aa, Entamoeba histolytica
NINHYKALFVQNVFTQGKEPI

SEQ ID NO: 2721702 - protein, 20 aa, Entamoeba histolytica
NINIISNDSFVDGKAFLALL

SEQ ID NO: 2721703 - protein, 20 aa, Entamoeba histolytica
NINKKIPFKKFALEVFKSDE

SEQ ID NO: 2721704 - protein, 23 aa, Entamoeba histolytica
NINKLKQLILSDPIEKLFGSIFT

SEQ ID NO: 2721705 - protein, 25 aa, Entamoeba histolytica
NINNIQQLKLYGLTLDKLKSYIDTI

SEQ ID NO: 2721706 - protein, 32 aa, Entamoeba histolytica
NINPTFIHEPTAAALYYLDITKDKIENPTKLL

SEQ ID NO: 2721707 - protein, 21 aa, Entamoeba histolytica
NINQLLPFNTNHIKSFELEPI

SEQ ID NO: 2721708 - protein, 20 aa, Entamoeba histolytica
NINRSLVVFGRVIHGLVQAS

SEQ ID NO: 2721709 - protein, 18 aa, Entamoeba histolytica
NINSHTLSKIPSLSFNTI

SEQ ID NO: 2721710 - protein, 26 aa, Entamoeba histolytica
NINSPLYLYIILRLYNQDIQPAYIQQ

SEQ ID NO: 2721711 - protein, 30 aa, Entamoeba histolytica
NIPFDELINLYYLLEHPLLPINVTSLQLDG

SEQ ID NO: 2721712 - protein, 40 aa, Entamoeba histolytica; identical to SEQ ID NO: 2597063

SEQ ID NO: 2721713 - protein, 23 aa, Entamoeba histolytica
NIPFLKELISFPIDKIVLVFLCD

SEQ ID NO: 2721714 - protein, 17 aa, Entamoeba histolytica
NIPHTIKCLICQQLIGI

SEQ ID NO: 2721715 - protein, 25 aa, Entamoeba histolytica
NIPIDNPCILLMQDTSKTFLTATRA

SEQ ID NO: 2721716 - protein, 26 aa, Entamoeba histolytica
NIPMSCFYQCPLLKTLKIKNKTMTYE

SEQ ID NO: 2721717 - protein, 28 aa, Entamoeba histolytica
NIPNYQIDKFLFFGALTTGMLSSMENNE

SEQ ID NO: 2721718 - protein, 17 aa, Entamoeba histolytica
NIPSQRGIIRIPPPSQR

SEQ ID NO: 2721719 - protein, 25 aa, Entamoeba histolytica
NIPVILAVLGVWYNNLYQAQSHAIL

SEQ ID NO: 2721720 - protein, 27 aa, Entamoeba histolytica
NIPVIQLMHFFPVIMSNLFGMFNNHRI

SEQ ID NO: 2721721 - protein, 19 aa, Entamoeba histolytica
NIPVVLVGNKLDLITDENN

SEQ ID NO: 2721722 - protein, 28 aa, Entamoeba histolytica
NIQDAFIKAAPFFLYMREFIGNNSNALK

SEQ ID NO: 2721723 - protein, 24 aa, Entamoeba histolytica
NIQEKLGKYFGFKKNYNNLQVVIK

SEQ ID NO: 2721724 - protein, 23 aa, Entamoeba histolytica
NIQFPTLLTFTFLNKWNFEELKQ

SEQ ID NO: 2721725 - protein, 17 aa, Entamoeba histolytica
NIQIICKIMISGGFMRT

SEQ ID NO: 2721726 - protein, 25 aa, Entamoeba histolytica
NIQIPFPETEKLKLYFRCFKTNKKG

SEQ ID NO: 2721727 - protein, 32 aa, Entamoeba histolytica; identical to SEQ ID NO: 2534450

SEQ ID NO: 2721728 - protein, 37 aa, Entamoeba histolytica
NIQNILSFLPDIYYETLKLLIHYLRLIADASAINKMN

SEQ ID NO: 2721729 - protein, 22 aa, Entamoeba histolytica
NIQRKLVPAINDSNTFIKDSKD

SEQ ID NO: 2721730 - protein, 28 aa, Entamoeba histolytica
NIREPKYREIFLLMYRLYTSPECVINYL

SEQ ID NO: 2721731 - protein, 33 aa, Entamoeba histolytica
NIRHQLLSNNITWINKALFFHPEHHHWLKINFP

SEQ ID NO: 2721732 - protein, 20 aa, Entamoeba histolytica
NIRIIYDDIPEKVISNTPKG

SEQ ID NO: 2721733 - protein, 25 aa, Entamoeba histolytica
NIRTGDGFIIIYSITSLTSFEEMKG

SEQ ID NO: 2721734 - protein, 23 aa, Entamoeba histolytica
NISFPLFPQIVVLMRELYLLIIK

SEQ ID NO: 2721735 - protein, 18 aa, Entamoeba histolytica
NISFRRRVNRRQTLAEFL

SEQ ID NO: 2721736 - protein, 23 aa, Entamoeba histolytica
NISHYLICKKLIVIGLNSELPHA

SEQ ID NO: 2721737 - protein, 19 aa, Entamoeba histolytica
NISIINEQALRKPIETRKL

SEQ ID NO: 2721738 - protein, 18 aa, Entamoeba histolytica
NISKLFGNVLKFSPPTGE

SEQ ID NO: 2721739 - protein, 23 aa, Entamoeba histolytica
NISKLLNYPVGSIALCLEPLLSS

SEQ ID NO: 2721740 - protein, 24 aa, Entamoeba histolytica
NISNINHIFPVNKYIRIRQWINLN

SEQ ID NO: 2721741 - protein, 24 aa, Entamoeba histolytica
NISQLKELLPKPSSIPMKDEKCTV

SEQ ID NO: 2721742 - protein, 31 aa, Entamoeba histolytica
NISQLLLQRHIPLYPSYRLVGVLDPYGILEP

SEQ ID NO: 2721743 - protein, 22 aa, Entamoeba histolytica
NISTILRLVSLLNGRTIQQITT

SEQ ID NO: 2721744 - protein, 24 aa, Entamoeba histolytica
NISTRLLYYYYSNQLSLSFIEICK

SEQ ID NO: 2721745 - protein, 18 aa, Entamoeba histolytica
NISYICSRYYRAPELIFG

SEQ ID NO: 2721746 - protein, 20 aa, Entamoeba histolytica
NITDLMELGFSRSVATEAYI

SEQ ID NO: 2721747 - protein, 20 aa, Entamoeba histolytica
NITIFCPALTDGLFGTCITE

SEQ ID NO: 2721748 - protein, 22 aa, Entamoeba histolytica
NITLKMKKIKHLKYRSVNWDSE

SEQ ID NO: 2721749 - protein, 35 aa, Entamoeba histolytica; identical to SEQ ID NO: 2534480

SEQ ID NO: 2721750 - protein, 23 aa, Entamoeba histolytica
NITQCGIGLFVSEKGRGCITDTL

SEQ ID NO: 2721751 - protein, 21 aa, Entamoeba histolytica
NITYTFPLSTLMSWGTDSSKT

SEQ ID NO: 2721752 - protein, 19 aa, Entamoeba histolytica
NIVAWEYPGYTKGSHYSDE

SEQ ID NO: 2721753 - protein, 33 aa, Entamoeba histolytica; identical to SEQ ID NO: 2534486

SEQ ID NO: 2721754 - protein, 20 aa, Entamoeba histolytica
NIVEGMVLDQGFLSRYFTTD

SEQ ID NO: 2721755 - protein, 23 aa, Entamoeba histolytica
NIVFYGSLFKFRKPVHLDINENQ

SEQ ID NO: 2721756 - protein, 17 aa, Entamoeba histolytica
NIVIYERVPKWMTGIDL

SEQ ID NO: 2721757 - protein, 29 aa, Entamoeba histolytica
NIVKYVECYLINDMLWLVTELMDAGELTN

SEQ ID NO: 2721758 - protein, 31 aa, Entamoeba histolytica
NIVPIIEDARYPLKYRMLVDMVDVIFADVAQ

SEQ ID NO: 2721759 - protein, 19 aa, Entamoeba histolytica
NIVSDPIPVLIIGNKSDIE

SEQ ID NO: 2721760 - protein, 25 aa, Entamoeba histolytica
NIVSFHDITFGYEPDKILFKNLNFA

SEQ ID NO: 2721761 - protein, 26 aa, Entamoeba histolytica
NIVSFRAYVTAALFLGPRQLGKLVVT

SEQ ID NO: 2721762 - protein, 19 aa, Entamoeba histolytica
NIVSLQRLDFVGCNITVLP

SEQ ID NO: 2721763 - protein, 24 aa, Entamoeba histolytica
NIVYDYVIVLLKLYLSSSKLLPGV

SEQ ID NO: 2721764 - protein, 20 aa, Entamoeba histolytica
NIWSEFFDIPVGALSRKSNF

SEQ ID NO: 2721765 - protein, 17 aa, Entamoeba histolytica
NIWVCLPGTLTVSISID

SEQ ID NO: 2721766 - protein, 21 aa, Entamoeba histolytica
NIYDTSYWVLPPSGPDAWHGF

SEQ ID NO: 2721767 - protein, 17 aa, Entamoeba histolytica
NIYKLLCELVGDISITI

SEQ ID NO: 2721768 - protein, 26 aa, Entamoeba histolytica
NIYNDKVLTHHLLLTKKPTSVCEIDN

SEQ ID NO: 2721769 - protein, 27 aa, Entamoeba histolytica
NIYTVEPGIYFIPFLLESGFKNEQVKK

SEQ ID NO: 2721770 - protein, 29 aa, Entamoeba histolytica
NKAFFDEKFHLMITNVLRTPPGYHCIFSQ

SEQ ID NO: 2721771 - protein, 21 aa, Entamoeba histolytica
NKCGQIPLYLLVRGDTEKELN

SEQ ID NO: 2721772 - protein, 31 aa, Entamoeba histolytica
NKCHKTCHHPCHVPFFISAFTNRFCTCIENK

SEQ ID NO: 2721773 - protein, 24 aa, Entamoeba histolytica
NKCPSNEFYSKGSFIFFIKDNISV

SEQ ID NO: 2721774 - protein, 26 aa, Entamoeba histolytica
NKDAIRILLQHHALLNLTFYGKDVMK

SEQ ID NO: 2721775 - protein, 23 aa, Entamoeba histolytica
NKDIGLFVFMNAGRNGSIVNGKT

SEQ ID NO: 2721776 - protein, 23 aa, Entamoeba histolytica
NKDIILGTFIYTCECCEAMLCGE

SEQ ID NO: 2721777 - protein, 28 aa, Entamoeba histolytica
NKDIIREFIYILPPPNIYRGRKIDVVQL

SEQ ID NO: 2721778 - protein, 23 aa, Entamoeba histolytica
NKDNIFYFKWRYCFIDDINIKDR

SEQ ID NO: 2721779 - protein, 26 aa, Entamoeba histolytica
NKDNYKYWHRWALINFEVVNYYENTK

SEQ ID NO: 2721780 - protein, 25 aa, Entamoeba histolytica
NKDSDLISLILMIDTFRIAEVKKNI

SEQ ID NO: 2721781 - protein, 21 aa, Entamoeba histolytica
NKDVLFILMKTICGHCNSSEK

SEQ ID NO: 2721782 - protein, 23 aa, Entamoeba histolytica
NKECIYYLDINKCKEAKKNKCSK

SEQ ID NO: 2721783 - protein, 22 aa, Entamoeba histolytica
NKECYICHQQGHIARNCPKQSG

SEQ ID NO: 2721784 - protein, 25 aa, Entamoeba histolytica
NKEELMFNILFNLIKSKLVFKNNEG

SEQ ID NO: 2721785 - protein, 26 aa, Entamoeba histolytica
NKEFKLLLNDSFSIPLLNFFNRKELT

SEQ ID NO: 2721786 - protein, 24 aa, Entamoeba histolytica
NKEGYIKYFSYLIHHPVGSYIDIK

SEQ ID NO: 2721787 - protein, 24 aa, Entamoeba histolytica
NKEIIPLTYDFERFNIKLGEIEGN

SEQ ID NO: 2721788 - protein, 23 aa, Entamoeba histolytica
NKEIIVKQPPLLLSPKLSFTIKQ

SEQ ID NO: 2721789 - protein, 23 aa, Entamoeba histolytica
NKEIRGFHHLYKCPSCGFGVCSD

SEQ ID NO: 2721790 - protein, 23 aa, Entamoeba histolytica
NKELLDKFRFNPIPLNNQSKKLF

SEQ ID NO: 2721791 - protein, 41 aa, Entamoeba histolytica
NKELTKIITLIQNYALMLTDIKMILTHQFKKTNIILLQSNG

SEQ ID NO: 2721792 - protein, 24 aa, Entamoeba histolytica
NKENKIIHLLFNNKGEEYKGVINL

SEQ ID NO: 2721793 - protein, 26 aa, Entamoeba histolytica
NKENQDLYVLPLYSSLEPKEQEKIFE

SEQ ID NO: 2721794 - protein, 25 aa, Entamoeba histolytica
NKESLYYRELIPRPMFEGIFAKVKQ

SEQ ID NO: 2721795 - protein, 25 aa, Entamoeba histolytica
NKEYIQTLLTYFLDVPFKVIIKVEY

SEQ ID NO: 2721796 - protein, 30 aa, Entamoeba histolytica
NKFCNNIYDSLKEILKKKFLELVEGNHDFI

SEQ ID NO: 2721797 - protein, 30 aa, Entamoeba histolytica
NKFEQPILSIPYIPLFGQPLKNVMLCHRPL

SEQ ID NO: 2721798 - protein, 21 aa, Entamoeba histolytica
NKFHSIIFTSGTLSPLKTYIN

SEQ ID NO: 2721799 - protein, 36 aa, Entamoeba histolytica
NKFIESLHFLIDLLTELHFTLNCKLFLSKNGLEQKE

SEQ ID NO: 2721800 - protein, 21 aa, Entamoeba histolytica
NKFTCESIIPVLLDIMQTTNS

SEQ ID NO: 2721801 - protein, 22 aa, Entamoeba histolytica
NKGIDLVHPLIEQNNLLKKQEE

SEQ ID NO: 2721802 - protein, 25 aa, Entamoeba histolytica
NKHELNLIFLFVSSHPLIVLNRLPT

SEQ ID NO: 2721803 - protein, 22 aa, Entamoeba histolytica
NKHFCAEEPTFACPFCGLDMGS

SEQ ID NO: 2721804 - protein, 26 aa, Entamoeba histolytica
NKHKMEILPLIIIVTTLFEMYGDQTN

SEQ ID NO: 2721805 - protein, 24 aa, Entamoeba histolytica
NKHKQINFIIILNEYRFTNTNLLK

SEQ ID NO: 2721806 - protein, 28 aa, Entamoeba histolytica
NKIDGEVQLIPVQKIKSKPGKRKQITKE

SEQ ID NO: 2721807 - protein, 29 aa, Entamoeba histolytica
NKIDGILIVTLHHIVILDQSFNVVKEIHV

SEQ ID NO: 2721808 - protein, 17 aa, Entamoeba histolytica
NKIGIHTLSPKELFYTI

SEQ ID NO: 2721809 - protein, 22 aa, Entamoeba histolytica
NKIHMLLYSKLEKRDKIEKEPF

SEQ ID NO: 2721810 - protein, 20 aa, Entamoeba histolytica
NKIIELEEIKMVKEVERLEQ

SEQ ID NO: 2721811 - protein, 18 aa, Entamoeba histolytica
NKIIFEKRYKPVINQECW

SEQ ID NO: 2721812 - protein, 24 aa, Entamoeba histolytica
NKIIKTIHYILSQPEIKQNISVYL

SEQ ID NO: 2721813 - protein, 22 aa, Entamoeba histolytica
NKILDIKWVGNVICCIGGLYDG

SEQ ID NO: 2721814 - protein, 23 aa, Entamoeba histolytica
NKILLFGCNGFVGKFILRELIGK

SEQ ID NO: 2721815 - protein, 17 aa, Entamoeba histolytica
NKILRVKEATSFPIVFV

SEQ ID NO: 2721816 - protein, 26 aa, Entamoeba histolytica
NKIMLALVFKKWWGDSLVQSIVPPIA

SEQ ID NO: 2721817 - protein, 19 aa, Entamoeba histolytica
NKIRYECFSECTSLVYIKF

SEQ ID NO: 2721818 - protein, 21 aa, Entamoeba histolytica
NKITLQMSQKVPSLGSLNSSQ

SEQ ID NO: 2721819 - protein, 23 aa, Entamoeba histolytica
NKIVRFECLICDILEIAIKYEHK

SEQ ID NO: 2721820 - protein, 30 aa, Entamoeba histolytica; identical to SEQ ID NO: 2534564

SEQ ID NO: 2721821 - protein, 31 aa, Entamoeba histolytica
NKKCFKEQAIWMLNALWPTYKDTMAEEVWGF

SEQ ID NO: 2721822 - protein, 26 aa, Entamoeba histolytica
NKKDKYTLCIILNLAEAIIQYKDVNQ

SEQ ID NO: 2721823 - protein, 26 aa, Entamoeba histolytica
NKKDVVPILIIPPQPSNTSLVEEVML

SEQ ID NO: 2721824 - protein, 17 aa, Entamoeba histolytica
NKKEAVKWYYKSAKEGC

SEQ ID NO: 2721825 - protein, 25 aa, Entamoeba histolytica
NKKESWVRYFLHTGHLHINGLKMSK

SEQ ID NO: 2721826 - protein, 23 aa, Entamoeba histolytica
NKKGCVIWSVKYPTLCMTVEEGN

SEQ ID NO: 2721827 - protein, 31 aa, Entamoeba histolytica
NKKIGAINCFFYPIIPFKWIADETVTSPMMN

SEQ ID NO: 2721828 - protein, 25 aa, Entamoeba histolytica
NKKITGFRRGGFARPEQLIDTSQLE

SEQ ID NO: 2721829 - protein, 24 aa, Entamoeba histolytica
NKKLGEFKLVGIPPAKKGVAKIEV

SEQ ID NO: 2721830 - protein, 34 aa, Entamoeba histolytica
NKKLSKRIRLLLMNIIQMMESGWTISPFISLQST

SEQ ID NO: 2721831 - protein, 24 aa, Entamoeba histolytica
NKKLYKQILHCAEILPTQAFTPID

SEQ ID NO: 2721832 - protein, 17 aa, Entamoeba histolytica
NKKMIMETFGKYCSKGK

SEQ ID NO: 2721833 - protein, 17 aa, Entamoeba histolytica
NKKNLIIVMEYARGGDL

SEQ ID NO: 2721834 - protein, 22 aa, Entamoeba histolytica
NKKPFETIPYRFSESGNIREPL

SEQ ID NO: 2721835 - protein, 23 aa, Entamoeba histolytica
NKKPTNIQFINHKNIIVSFDNEM

SEQ ID NO: 2721836 - protein, 27 aa, Entamoeba histolytica
NKKRELMELLWPIIKYRSSNELIEAVT

SEQ ID NO: 2721837 - protein, 32 aa, Entamoeba histolytica
NKKSNFHISMKKFEFKKPNLMSKPLKDRMKDS

SEQ ID NO: 2721838 - protein, 28 aa, Entamoeba histolytica
NKKTDGLHLLMDLLNELGFEFNTKLTEG

SEQ ID NO: 2721839 - protein, 22 aa, Entamoeba histolytica
NKKTEIQCTLQAIREAQELIEE

SEQ ID NO: 2721840 - protein, 21 aa, Entamoeba histolytica
NKKVYFLCDPILGDNGKMYTK

SEQ ID NO: 2721841 - protein, 17 aa, Entamoeba histolytica
NKKWIASSLPLLTPEVG

SEQ ID NO: 2721842 - protein, 30 aa, Entamoeba histolytica; identical to SEQ ID NO: 2534587

SEQ ID NO: 2721843 - protein, 26 aa, Entamoeba histolytica
NKLENYIYLNYLFISELPSPSINLPQ

SEQ ID NO: 2721844 - protein, 27 aa, Entamoeba histolytica
NKLERYKLFEIPFFLNQPSANKYKNLN

SEQ ID NO: 2721845 - protein, 21 aa, Entamoeba histolytica
NKLIPPIMALERRISRMFTFE

SEQ ID NO: 2721846 - protein, 28 aa, Entamoeba histolytica
NKLIQNNIKRICNFGEFIVAVCANSAFV

SEQ ID NO: 2721847 - protein, 25 aa, Entamoeba histolytica
NKLKEGMMMIDNLNIVYQRINKIIY

SEQ ID NO: 2721848 - protein, 25 aa, Entamoeba histolytica
NKLQKTLIGTPYWMAPEVILESGHN

SEQ ID NO: 2721849 - protein, 25 aa, Entamoeba histolytica
NKLRPLWRYYYSGTNAIIFVVDSND

SEQ ID NO: 2721850 - protein, 17 aa, Entamoeba histolytica
NKLVDACYTFWQASIFG

SEQ ID NO: 2721851 - protein, 20 aa, Entamoeba histolytica
NKLVHVVIKNMFDLKKPKDE

SEQ ID NO: 2721852 - protein, 21 aa, Entamoeba histolytica
NKMLPCIPTLALYNVLSEPLR

SEQ ID NO: 2721853 - protein, 20 aa, Entamoeba histolytica
NKMSKRLKLLRTYENTRLEE

SEQ ID NO: 2721854 - protein, 21 aa, Entamoeba histolytica
NKMVINSLFKSFDNIFLEDDQ

SEQ ID NO: 2721855 - protein, 23 aa, Entamoeba histolytica
NKNAYPFCLPASLSLPKKNYSKI

SEQ ID NO: 2721856 - protein, 23 aa, Entamoeba histolytica
NKNDNFIMIPFKIGQKNIEKEED

SEQ ID NO: 2721857 - protein, 43 aa, Entamoeba histolytica
NKNEFTHLITNKSSLFFIFQTQSDLFGFYFGSSISAFDKYLSD

SEQ ID NO: 2721858 - protein, 33 aa, Entamoeba histolytica
NKNEIELFIKTLIKINVFNAYYDLVELPELFKS

SEQ ID NO: 2721859 - protein, 22 aa, Entamoeba histolytica
NKNGFISNILLHGILIIDKNVH

SEQ ID NO: 2721860 - protein, 17 aa, Entamoeba histolytica
NKNGKWFLTCSKDFKII

SEQ ID NO: 2721861 - protein, 27 aa, Entamoeba histolytica
NKNGLKPSLFLFSNANNQYFGAFVTNG

SEQ ID NO: 2721862 - protein, 29 aa, Entamoeba histolytica
NKNGSFVIEKLFIKSSIDGKLKIIEEMNS

SEQ ID NO: 2721863 - protein, 25 aa, Entamoeba histolytica
NKNIKQIVYFLFKFKNLTEELKKEY

SEQ ID NO: 2721864 - protein, 17 aa, Entamoeba histolytica
NKNLHSLLFLTDELAKP

SEQ ID NO: 2721865 - protein, 32 aa, Entamoeba histolytica; identical to SEQ ID NO: 2534607

SEQ ID NO: 2721866 - protein, 29 aa, Entamoeba histolytica
NKNQIAKFYTWINKWEKVIPDRRAVLLAG

SEQ ID NO: 2721867 - protein, 33 aa, Entamoeba histolytica
NKNVIIYSCLMGRIGVLIPFNFREDVEFFSKLE

SEQ ID NO: 2721868 - protein, 27 aa, Entamoeba histolytica
NKPFGGICFRPFPTQGFVEIVFCAVDS

SEQ ID NO: 2721869 - protein, 21 aa, Entamoeba histolytica
NKPLRKTLYNNADFFIVCYAI

SEQ ID NO: 2721870 - protein, 23 aa, Entamoeba histolytica
NKPMGLTLSLNLSPNELPSSLNF

SEQ ID NO: 2721871 - protein, 26 aa, Entamoeba histolytica
NKPNKPAIFLPLTTSLTKFFSNYLNA

SEQ ID NO: 2721872 - protein, 27 aa, Entamoeba histolytica
NKPQTIIHTPLLFLKSAYCNQLKLPLS

SEQ ID NO: 2721873 - protein, 32 aa, Entamoeba histolytica; identical to SEQ ID NO: 2534615

SEQ ID NO: 2721874 - protein, 25 aa, Entamoeba histolytica
NKPTWCCPVCRLEFDKPPKPSCFCG

SEQ ID NO: 2721875 - protein, 18 aa, Entamoeba histolytica
NKPVVDIFGFIFEIAKEG

SEQ ID NO: 2721876 - protein, 24 aa, Entamoeba histolytica
NKPYISCILSIFYEKVKEELKEKC

SEQ ID NO: 2721877 - protein, 21 aa, Entamoeba histolytica
NKQFSFFIKKDRTTYQFIGLT

SEQ ID NO: 2721878 - protein, 24 aa, Entamoeba histolytica
NKQFSFIDILPYFSTQTYSIVLKE

SEQ ID NO: 2721879 - protein, 31 aa, Entamoeba histolytica
NKQLCFKMYSIVQQLVMMYWKSDEERKKKLK

SEQ ID NO: 2721880 - protein, 26 aa, Entamoeba histolytica
NKQLVYLIRIIAQQMLFGFDIEPSLI

SEQ ID NO: 2721881 - protein, 23 aa, Entamoeba histolytica
NKQNIVLPLCKRLIYNEIHMKSK

SEQ ID NO: 2721882 - protein, 23 aa, Entamoeba histolytica
NKQTRFLLRRLNPERYNPPEISE

SEQ ID NO: 2721883 - protein, 25 aa, Entamoeba histolytica
NKRDKYMLVIIHLPKSPKYVFHTEP

SEQ ID NO: 2721884 - protein, 22 aa, Entamoeba histolytica
NKRGVYLKFFNNIEGFIPTIEL

SEQ ID NO: 2721885 - protein, 17 aa, Entamoeba histolytica
NKRNKLRKEIEKAKIEL

SEQ ID NO: 2721886 - protein, 18 aa, Entamoeba histolytica
NKRRTYLFSSEQQSKLFS

SEQ ID NO: 2721887 - protein, 29 aa, Entamoeba histolytica
NKRTEYRMLWFRFDIRKLYFLRHGDPREE

SEQ ID NO: 2721888 - protein, 27 aa, Entamoeba histolytica
NKSAVYYEMKQWRFVIQICSNLINKIT

SEQ ID NO: 2721889 - protein, 18 aa, Entamoeba histolytica
NKSFRYELKCHCKSIAST

SEQ ID NO: 2721890 - protein, 26 aa, Entamoeba histolytica
NKSGKAMRLIIMSATLRVSEFTENQR

SEQ ID NO: 2721891 - protein, 23 aa, Entamoeba histolytica
NKSIKFNCQWYITVHFDRYICTP

SEQ ID NO: 2721892 - protein, 26 aa, Entamoeba histolytica
NKSNEFYWSLLHLNPRQLVYSIKDYK

SEQ ID NO: 2721893 - protein, 27 aa, Entamoeba histolytica
NKSNTLLLYNLVYDLLLGEITLNKKII

SEQ ID NO: 2721894 - protein, 25 aa, Entamoeba histolytica
NKSPNLIITPIKLLEPPQIQIQYKQ

SEQ ID NO: 2721895 - protein, 24 aa, Entamoeba histolytica
NKSPYLINLYDNLLLHSIDLEMII

SEQ ID NO: 2721896 - protein, 35 aa, Entamoeba histolytica
NKSTQMLLPFYRFKSQYLLLLKIYIDSVQSFDKNP

SEQ ID NO: 2721897 - protein, 22 aa, Entamoeba histolytica
NKSWNYINWDNIVFYKIHQVFG

SEQ ID NO: 2721898 - protein, 21 aa, Entamoeba histolytica
NKTFQCSIPCIDGNNIPVIIT

SEQ ID NO: 2721899 - protein, 21 aa, Entamoeba histolytica
NKTIDYYLPNPLKEPKVNICI

SEQ ID NO: 2721900 - protein, 29 aa, Entamoeba histolytica
NKTIMNIPHLIFICFGDYGNVYGTYCDLP

SEQ ID NO: 2721901 - protein, 23 aa, Entamoeba histolytica
NKTMLYVIYEVIVLWVSTIKVTQ

SEQ ID NO: 2721902 - protein, 20 aa, Entamoeba histolytica
NKTMNIISNQNIYLSGSAEG

SEQ ID NO: 2721903 - protein, 29 aa, Entamoeba histolytica
NKTNIISHVLLKKYIAYARQNCHPKWSGT

SEQ ID NO: 2721904 - protein, 31 aa, Entamoeba histolytica
NKTQAINILITLAKCYYFKYVISLYNKESKN

SEQ ID NO: 2721905 - protein, 28 aa, Entamoeba histolytica
NKTRDNLTLFPQLKKVYMDSYEICFDSK

SEQ ID NO: 2721906 - protein, 25 aa, Entamoeba histolytica
NKTRQFWFCSFADDLQDFKLIGIVL

SEQ ID NO: 2721907 - protein, 29 aa, Entamoeba histolytica
NKTVPFNCRLYFEVILPNEQRKALWINKN

SEQ ID NO: 2721908 - protein, 23 aa, Entamoeba histolytica
NKVDLTFLIRPSNTNPKFPFTIS

SEQ ID NO: 2721909 - protein, 26 aa, Entamoeba histolytica
NKVICPRMLIWKLEETHRIVLEVICR

SEQ ID NO: 2721910 - protein, 21 aa, Entamoeba histolytica
NKVILNTLKPKYWISGHMHCE

SEQ ID NO: 2721911 - protein, 23 aa, Entamoeba histolytica
NKVNGFYLKLWVDGLLSTYEYIS

SEQ ID NO: 2721912 - protein, 25 aa, Entamoeba histolytica
NKVSDLLMMCQHLSVLRLRKLEAIT

SEQ ID NO: 2721913 - protein, 17 aa, Entamoeba histolytica
NKVTFSCDVYALGLIMW

SEQ ID NO: 2721914 - protein, 22 aa, Entamoeba histolytica
NKVTPLVNNITLQQAKIALDEN

SEQ ID NO: 2721915 - protein, 22 aa, Entamoeba histolytica
NKVYFKSFPIIFGKQLTCSEIM

SEQ ID NO: 2721916 - protein, 37 aa, Entamoeba histolytica
NKWDNWTVVWVKQKGYPWWPAKIIIMDKLNEKTKGQL

SEQ ID NO: 2721917 - protein, 21 aa, Entamoeba histolytica
NKYQILLHYLDKCSLQMRIDY

SEQ ID NO: 2721918 - protein, 38 aa, Entamoeba histolytica
NKYQLAQMFINCGGLSLFYQVLTLKYDGKHQTTMNIIL

SEQ ID NO: 2721919 - protein, 23 aa, Entamoeba histolytica
NKYTLVVVYAFNLGILLNRFFNL

SEQ ID NO: 2721920 - protein, 19 aa, Entamoeba histolytica
NKYVFLGDYVDRGDFGCEV

SEQ ID NO: 2721921 - protein, 22 aa, Entamoeba histolytica
NKYVRCIAALIIRYSIQFNLLL

SEQ ID NO: 2721922 - protein, 21 aa, Entamoeba histolytica
NLAFVVLTSDKWVFGCFSQAR

SEQ ID NO: 2721923 - protein, 20 aa, Entamoeba histolytica
NLAKMRSLSSILKLLHYSQT

SEQ ID NO: 2721924 - protein, 26 aa, Entamoeba histolytica
NLAPADFKLVLPYLDDFWARDGLAGA

SEQ ID NO: 2721925 - protein, 18 aa, Entamoeba histolytica
NLATVFAPVLFSLSIEEL

SEQ ID NO: 2721926 - protein, 18 aa, Entamoeba histolytica
NLCFDDEKPPFLNQSQEP

SEQ ID NO: 2721927 - protein, 17 aa, Entamoeba histolytica
NLCSLPTLYSDFLIFMN

SEQ ID NO: 2721928 - protein, 17 aa, Entamoeba histolytica
NLCYSRNDFLLLNKIYS

SEQ ID NO: 2721929 - protein, 26 aa, Entamoeba histolytica
NLDCIPPIFRPIMSDLICLSPELKLC

SEQ ID NO: 2721930 - protein, 18 aa, Entamoeba histolytica
NLDDYTCKKLTWTSGHIW

SEQ ID NO: 2721931 - protein, 17 aa, Entamoeba histolytica
NLDLHAIKSLNPINSPT

SEQ ID NO: 2721932 - protein, 36 aa, Entamoeba histolytica
NLDLRSYLIMPVQRLPRYELLLKDLLKNTKSDHPDY

SEQ ID NO: 2721933 - protein, 26 aa, Entamoeba histolytica
NLEDKIVLDIILKYYAFVTGVQSGSV

SEQ ID NO: 2721934 - protein, 20 aa, Entamoeba histolytica
NLEEIKFNKSLKTFQCMRCM

SEQ ID NO: 2721935 - protein, 23 aa, Entamoeba histolytica
NLEEIKFNKSLKTFQCMRCMKLT

SEQ ID NO: 2721936 - protein, 25 aa, Entamoeba histolytica
NLEEKLIIDWFGRFGIEVGDFKTSF

SEQ ID NO: 2721937 - protein, 26 aa, Entamoeba histolytica
NLEGKVKCFGIFPKGFEKAAGPSFAP

SEQ ID NO: 2721938 - protein, 17 aa, Entamoeba histolytica
NLEIPSLAEFYSIRLRL

SEQ ID NO: 2721939 - protein, 28 aa, Entamoeba histolytica
NLEPKYPHQLLLQAFYLTVTSSENDPLH

SEQ ID NO: 2721940 - protein, 25 aa, Entamoeba histolytica
NLERFHFNPIPLNEYSRKLFPNIET

SEQ ID NO: 2721941 - protein, 20 aa, Entamoeba histolytica
NLETINELLFEKYQLQPDLP

SEQ ID NO: 2721942 - protein, 27 aa, Entamoeba histolytica
NLETTQKFFLFTYNNNTQQIIHRKKNN

SEQ ID NO: 2721943 - protein, 19 aa, Entamoeba histolytica
NLFDEIFAVLIRISNPQKR

SEQ ID NO: 2721944 - protein, 17 aa, Entamoeba histolytica
NLFELHSLLLKAKELQK

SEQ ID NO: 2721945 - protein, 24 aa, Entamoeba histolytica
NLFKELSICICGQPKILATTLSAW

SEQ ID NO: 2721946 - protein, 20 aa, Entamoeba histolytica
NLFKIIILGDSGVGKTSLLN

SEQ ID NO: 2721947 - protein, 17 aa, Entamoeba histolytica
NLFQIVFSSNNFLSLIE

SEQ ID NO: 2721948 - protein, 18 aa, Entamoeba histolytica
NLFQLLGRIIHRLLHNRN

SEQ ID NO: 2721949 - protein, 20 aa, Entamoeba histolytica
NLFSLVFIDDEICKQCFACI

SEQ ID NO: 2721950 - protein, 25 aa, Entamoeba histolytica
NLGELWTLLNYIEPKTFPSLEEFDH

SEQ ID NO: 2721951 - protein, 24 aa, Entamoeba histolytica
NLGKDEFAMMLQVALIYCKKEEIE

SEQ ID NO: 2721952 - protein, 19 aa, Entamoeba histolytica
NLGLWLNISERGGMDGGWF

SEQ ID NO: 2721953 - protein, 20 aa, Entamoeba histolytica
NLHFPNWNLFEENDIIFEIT

SEQ ID NO: 2721954 - protein, 20 aa, Entamoeba histolytica
NLHIPIGCLYSPLLPKPLVA

SEQ ID NO: 2721955 - protein, 17 aa, Entamoeba histolytica
NLHSFILVYTSLSSLNN

SEQ ID NO: 2721956 - protein, 22 aa, Entamoeba histolytica
NLIDTELFIPCLTFIGNLTIDN

SEQ ID NO: 2721957 - protein, 32 aa, Entamoeba histolytica
NLIHRIDLCCNTLLLFCKDLRSLQQLMKDQKL

SEQ ID NO: 2721958 - protein, 20 aa, Entamoeba histolytica
NLIKNAFFEKGIESRKVNYL

SEQ ID NO: 2721959 - protein, 22 aa, Entamoeba histolytica
NLINIVAIETFFRVKNTNEMIN

SEQ ID NO: 2721960 - protein, 18 aa, Entamoeba histolytica
NLIPFAFDCAIRLRQPNF

SEQ ID NO: 2721961 - protein, 17 aa, Entamoeba histolytica
NLIRPFFSLVQDANKPN

SEQ ID NO: 2721962 - protein, 30 aa, Entamoeba histolytica
NLKDKLKDLYYFFLFKDIFVQTKVKKLHGE

SEQ ID NO: 2721963 - protein, 27 aa, Entamoeba histolytica
NLKDNVSLPYFLNLMKTSFSVARIVVD

SEQ ID NO: 2721964 - protein, 20 aa, Entamoeba histolytica
NLKEFINLQKLFINIKGIIT

SEQ ID NO: 2721965 - protein, 19 aa, Entamoeba histolytica
NLKFMIIQFNEIKSSLISL

SEQ ID NO: 2721966 - protein, 24 aa, Entamoeba histolytica
NLKKDFFVISKLFPQAIAATIDGK

SEQ ID NO: 2721967 - protein, 21 aa, Entamoeba histolytica
NLKLKDIIFQSKKRLFQLVNL

SEQ ID NO: 2721968 - protein, 18 aa, Entamoeba histolytica
NLKLMISQMKLEMKDEFE

SEQ ID NO: 2721969 - protein, 23 aa, Entamoeba histolytica
NLKNYDMVLREIYLFNEKFKKKD

SEQ ID NO: 2721970 - protein, 27 aa, Entamoeba histolytica
NLKQSHLFAMDKGVLSLFLTPMINVTN

SEQ ID NO: 2721971 - protein, 20 aa, Entamoeba histolytica
NLKRRIDSSLFSWKHPTTDR

SEQ ID NO: 2721972 - protein, 26 aa, Entamoeba histolytica
NLKSIFQISMLFPNKSIQQLTMRVHW

SEQ ID NO: 2721973 - protein, 23 aa, Entamoeba histolytica
NLKTTILSRFDMIFMIRDKHDAK

SEQ ID NO: 2721974 - protein, 17 aa, Entamoeba histolytica
NLKYIPIKNIRKLDIIL

SEQ ID NO: 2721975 - protein, 24 aa, Entamoeba histolytica
NLKYPSNIIIYRKANKTSLLKIKE

SEQ ID NO: 2721976 - protein, 21 aa, Entamoeba histolytica
NLLDLLTGPLPINPTPNPTMN

SEQ ID NO: 2721977 - protein, 21 aa, Entamoeba histolytica
NLLELKFKMCLKENYISIDHF

SEQ ID NO: 2721978 - protein, 17 aa, Entamoeba histolytica
NLLIQTLNELKKEVREM

SEQ ID NO: 2721979 - protein, 24 aa, Entamoeba histolytica
NLLKGVYQRFGLIPLQTLFEEATN

SEQ ID NO: 2721980 - protein, 19 aa, Entamoeba histolytica
NLLKLPYTTTLTNINSFIV

SEQ ID NO: 2721981 - protein, 19 aa, Entamoeba histolytica
NLLLLKEIIERKLTFEKLT

SEQ ID NO: 2721982 - protein, 18 aa, Entamoeba histolytica
NLLLNKIAVQLKVNVKDI

SEQ ID NO: 2721983 - protein, 21 aa, Entamoeba histolytica
NLLNYLINLIDYPPSNKDICI

SEQ ID NO: 2721984 - protein, 20 aa, Entamoeba histolytica
NLLRCFRTLGLFAGNQPAAC

SEQ ID NO: 2721985 - protein, 19 aa, Entamoeba histolytica
NLMCYLGVGLVIGKEIYLG

SEQ ID NO: 2721986 - protein, 26 aa, Entamoeba histolytica
NLMEDLLSNVWPYIRFSIDYNIAQSE

SEQ ID NO: 2721987 - protein, 25 aa, Entamoeba histolytica
NLMKKILLSLFEYSSPPVIPTNPPI

SEQ ID NO: 2721988 - protein, 24 aa, Entamoeba histolytica
NLMKKIYKIFGFKTEIALSTRNEK

SEQ ID NO: 2721989 - protein, 17 aa, Entamoeba histolytica
NLMRRCIPLLPTSFDFI

SEQ ID NO: 2721990 - protein, 21 aa, Entamoeba histolytica
NLNAFHDFFMNKNKVVLIPLV

SEQ ID NO: 2721991 - protein, 29 aa, Entamoeba histolytica
NLNEQMKMKLIMIGESSVGKTCCMNRFVS

SEQ ID NO: 2721992 - protein, 23 aa, Entamoeba histolytica
NLNHLIIFVESETSWLCLKDILQ

SEQ ID NO: 2721993 - protein, 20 aa, Entamoeba histolytica
NLNIIMKTAIFFKTTASIGL

SEQ ID NO: 2721994 - protein, 21 aa, Entamoeba histolytica
NLNIIMKTAIFFKTTASIGLT

SEQ ID NO: 2721995 - protein, 29 aa, Entamoeba histolytica
NLNKGIIKSFIPSLQQWTGMQKYDVIYNS

SEQ ID NO: 2721996 - protein, 23 aa, Entamoeba histolytica
NLNPYFRKMLFTGSAEKKGCQLL

SEQ ID NO: 2721997 - protein, 24 aa, Entamoeba histolytica
NLNQLLNNEIFRSVIRRSQQEHYE

SEQ ID NO: 2721998 - protein, 22 aa, Entamoeba histolytica
NLNWIPFSFMTLETPHLGVQKP

SEQ ID NO: 2721999 - protein, 17 aa, Entamoeba histolytica
NLPIEELVSLMNDKYQQ

SEQ ID NO: 2722000 - protein, 33 aa, Entamoeba histolytica
NLPIREMNLLNNPLLKPTIIPQLTIYFSSLEVL

SEQ ID NO: 2722001 - protein, 32 aa, Entamoeba histolytica
NLPKAKFIRLKPLAFDFFKIPNYRVVMEKELR

SEQ ID NO: 2722002 - protein, 48 aa, Entamoeba histolytica
NLPKKSMVGIFFPNRAEWIIVSQALHRIGLIPIPLYATLGVQSINYII

SEQ ID NO: 2722003 - protein, 17 aa, Entamoeba histolytica
NLPLHLVRFGTESQSCI

SEQ ID NO: 2722004 - protein, 20 aa, Entamoeba histolytica
NLPLNLFRLDILYSNNIEII

SEQ ID NO: 2722005 - protein, 18 aa, Entamoeba histolytica
NLPNTKWVFQREKGMSFL

SEQ ID NO: 2722006 - protein, 17 aa, Entamoeba histolytica
NLPPFMTVGSFKNYFYG

SEQ ID NO: 2722007 - protein, 20 aa, Entamoeba histolytica
NLPPYLLAKITINKSSFELS

SEQ ID NO: 2722008 - protein, 23 aa, Entamoeba histolytica
NLQHYAITLFNFIIPYCASTHDF

SEQ ID NO: 2722009 - protein, 25 aa, Entamoeba histolytica
NLQSVNLWICPPVENFDKIINQGCE

SEQ ID NO: 2722010 - protein, 17 aa, Entamoeba histolytica
NLQVFMLMKGLATKKCV

SEQ ID NO: 2722011 - protein, 20 aa, Entamoeba histolytica
NLREWLRVISDKKDGFELKF

SEQ ID NO: 2722012 - protein, 19 aa, Entamoeba histolytica
NLRFNKTIMNIPHLIFICF

SEQ ID NO: 2722013 - protein, 32 aa, Entamoeba histolytica
NLRKRLNHIAIKYKHLYLTNTQILLGIRISRC

SEQ ID NO: 2722014 - protein, 33 aa, Entamoeba histolytica
NLRKRLNHIAIKYKHLYLTNTQILLGIRISRCK

SEQ ID NO: 2722015 - protein, 38 aa, Entamoeba histolytica
NLRRRLNQLAIKYKHLYLTNTQILLGIRISRCKILVDN

SEQ ID NO: 2722016 - protein, 30 aa, Entamoeba histolytica
NLRSKEELGLFLRWLKFTRFFESEDTLGSF

SEQ ID NO: 2722017 - protein, 17 aa, Entamoeba histolytica
NLRVYWGTSPFVNCEEG

SEQ ID NO: 2722018 - protein, 20 aa, Entamoeba histolytica
NLSCFIKLFQRFGEIYSIWG

SEQ ID NO: 2722019 - protein, 21 aa, Entamoeba histolytica
NLSDENLPLWPQDKDIKNYTS

SEQ ID NO: 2722020 - protein, 49 aa, Entamoeba histolytica; identical to SEQ ID NO: 2534756

SEQ ID NO: 2722021 - protein, 25 aa, Entamoeba histolytica
NLSFDKYIFIKYSTSKPLGIICLFN

SEQ ID NO: 2722022 - protein, 21 aa, Entamoeba histolytica
NLSFNLIIEYPNLSQWNQLEE

SEQ ID NO: 2722023 - protein, 19 aa, Entamoeba histolytica
NLSLLRNHLSREGLLHPDC

SEQ ID NO: 2722024 - protein, 38 aa, Entamoeba histolytica
NLSLQDIKVIALAVRYVREKLPFLELAKHPGDSRKVMN

SEQ ID NO: 2722025 - protein, 17 aa, Entamoeba histolytica
NLSNWSIALKYFVIDIS

SEQ ID NO: 2722026 - protein, 30 aa, Entamoeba histolytica
NLSPEEKLFILISEKLTFLKRLSTVSTATC

SEQ ID NO: 2722027 - protein, 30 aa, Entamoeba histolytica
NLSQLSLYNFTYELTHLYFNGANSVCFPTP

SEQ ID NO: 2722028 - protein, 24 aa, Entamoeba histolytica
NLSTEIHFLPKNIDYQIIFCDTGF

SEQ ID NO: 2722029 - protein, 17 aa, Entamoeba histolytica
NLSTKYINYAFIRFSRF

SEQ ID NO: 2722030 - protein, 42 aa, Entamoeba histolytica; identical to SEQ ID NO: 2534763

SEQ ID NO: 2722031 - protein, 27 aa, Entamoeba histolytica
NLTDVVLGQVYFKVVRLPLASMELQIQ

SEQ ID NO: 2722032 - protein, 28 aa, Entamoeba histolytica
NLTDVVLGQVYFKVVRLPLASMELQIQR

SEQ ID NO: 2722033 - protein, 21 aa, Entamoeba histolytica
NLTEFIVCISKLLELDECIHV

SEQ ID NO: 2722034 - protein, 25 aa, Entamoeba histolytica
NLTEPIISRFDLIMIVRDVVDYEKD

SEQ ID NO: 2722035 - protein, 25 aa, Entamoeba histolytica
NLTKKMKLAYLILRYSEIEDHYIRK

SEQ ID NO: 2722036 - protein, 17 aa, Entamoeba histolytica
NLTLIDFGYGWNTIKEG

SEQ ID NO: 2722037 - protein, 24 aa, Entamoeba histolytica
NLTMKMLPFCKKLIAIEIDPRMAA

SEQ ID NO: 2722038 - protein, 26 aa, Entamoeba histolytica
NLTPADFKLVLPYLDDFWARDGLAGA

SEQ ID NO: 2722039 - protein, 27 aa, Entamoeba histolytica
NLTPADFKLVLPYLDDFWARDGLAGAW

SEQ ID NO: 2722040 - protein, 25 aa, Entamoeba histolytica
NLTPQTITCYGISNLHVNINKNLND

SEQ ID NO: 2722041 - protein, 24 aa, Entamoeba histolytica
NLTPTLLRLSINIPQIKMICAVGC

SEQ ID NO: 2722042 - protein, 24 aa, Entamoeba histolytica
NLTRLVRYRLHKHGIRSGFNCVFS

SEQ ID NO: 2722043 - protein, 18 aa, Entamoeba histolytica
NLTRLVVKNLPITNIPGL

SEQ ID NO: 2722044 - protein, 30 aa, Entamoeba histolytica
NLTSLFIKSPVLLKMYLINRLRSIYEKEGD

SEQ ID NO: 2722045 - protein, 31 aa, Entamoeba histolytica
NLVDIKKMLDFVPWFIVEVTLLKRASDLEFK

SEQ ID NO: 2722046 - protein, 22 aa, Entamoeba histolytica
NLVDIVIPCPIVKLKSMRFIKC

SEQ ID NO: 2722047 - protein, 25 aa, Entamoeba histolytica
NLVIRRQFNLSNQSNWFINGRTASH

SEQ ID NO: 2722048 - protein, 18 aa, Entamoeba histolytica
NLVNLPEAWVRNRNVFTC

SEQ ID NO: 2722049 - protein, 30 aa, Entamoeba histolytica
NLVSKPTQWNYFFLFSDRLIGTVIKKYHGK

SEQ ID NO: 2722050 - protein, 31 aa, Entamoeba histolytica
NLYKKLPYQFTPVYQIISLILRGMSEVEYMV

SEQ ID NO: 2722051 - protein, 19 aa, Entamoeba histolytica
NLYSYLIYPFVFPTQVNQQ

SEQ ID NO: 2722052 - protein, 25 aa, Entamoeba histolytica
NMARRSEILIARYALHKLYPDVEMT

SEQ ID NO: 2722053 - protein, 23 aa, Entamoeba histolytica
NMEEYALFLPNDKTREKGQWMIP

SEQ ID NO: 2722054 - protein, 26 aa, Entamoeba histolytica
NMERFHFNPIPLNEYSRKLFPNIETF

SEQ ID NO: 2722055 - protein, 23 aa, Entamoeba histolytica
NMERFHFNPIPLNQYSIEFFPNI

SEQ ID NO: 2722056 - protein, 27 aa, Entamoeba histolytica
NMERFHFNPIPLNRYSRKLFPNIETFH

SEQ ID NO: 2722057 - protein, 23 aa, Entamoeba histolytica
NMGNASLVIQKLPPGQMATNELP

SEQ ID NO: 2722058 - protein, 19 aa, Entamoeba histolytica
NMHLVERMEKYWKINNIKV

SEQ ID NO: 2722059 - protein, 25 aa, Entamoeba histolytica
NMKATYNILFEYIRNIALSTKNCNT

SEQ ID NO: 2722060 - protein, 25 aa, Entamoeba histolytica
NMKIYNEFLTLFDSLPLSALIEGNI

SEQ ID NO: 2722061 - protein, 22 aa, Entamoeba histolytica
NMKRAFSKLFSLTDIHLEGNPV

SEQ ID NO: 2722062 - protein, 28 aa, Entamoeba histolytica
NMLTSLPSNFFMYSQLRSLNLTHNRLSV

SEQ ID NO: 2722063 - protein, 18 aa, Entamoeba histolytica
NMLYEKYGYFASNNKYYF

SEQ ID NO: 2722064 - protein, 26 aa, Entamoeba histolytica
NMNLELPFVPFLSKADLLGGYGFNVK

SEQ ID NO: 2722065 - protein, 17 aa, Entamoeba histolytica
NMNYCFTAARDFLGIPI

SEQ ID NO: 2722066 - protein, 21 aa, Entamoeba histolytica
NMQQLLGQIDLIIGAADCARS

SEQ ID NO: 2722067 - protein, 28 aa, Entamoeba histolytica
NMRLNVLPIYEYKIWKTIPGIKRIVENL

SEQ ID NO: 2722068 - protein, 27 aa, Entamoeba histolytica
NMSYICWDPMGLFLGAVRSYLYSPHAK

SEQ ID NO: 2722069 - protein, 17 aa, Entamoeba histolytica
NMVIKEKAPFIPTEQFV

SEQ ID NO: 2722070 - protein, 18 aa, Entamoeba histolytica
NMVYKGLMKCQIYHQFKA

SEQ ID NO: 2722071 - protein, 21 aa, Entamoeba histolytica
NMVYSTYGKLLPFLLNEMTLA

SEQ ID NO: 2722072 - protein, 23 aa, Entamoeba histolytica
NNADFFIVCYAIDDPISLQKAEN

SEQ ID NO: 2722073 - protein, 26 aa, Entamoeba histolytica
NNAIAQFLLMLIRGYSRKTAMECLDI

SEQ ID NO: 2722074 - protein, 30 aa, Entamoeba histolytica
NNAICNKPNIMLIIVTKDGSIFGTFNSLAV

SEQ ID NO: 2722075 - protein, 27 aa, Entamoeba histolytica
NNAICTLFFIHYLLPFFKNYSDISHLG

SEQ ID NO: 2722076 - protein, 20 aa, Entamoeba histolytica
NNALEFLINYSAGNVLRPHV

SEQ ID NO: 2722077 - protein, 22 aa, Entamoeba histolytica
NNALQRILLPCGIDINKWYNTS

SEQ ID NO: 2722078 - protein, 23 aa, Entamoeba histolytica
NNAWTSLLIPLMNDIPEATFKTM

SEQ ID NO: 2722079 - protein, 18 aa, Entamoeba histolytica
NNCIIIVSFLVLQSTTID

SEQ ID NO: 2722080 - protein, 26 aa, Entamoeba histolytica
NNCLQLVKYIIEKFPHRLNYQDIYGK

SEQ ID NO: 2722081 - protein, 21 aa, Entamoeba histolytica
NNCTWDYNLNCKTLTSLSIHK

SEQ ID NO: 2722082 - protein, 24 aa, Entamoeba histolytica
NNCYSLSLSLLGLKSLIIPLIHIE

SEQ ID NO: 2722083 - protein, 21 aa, Entamoeba histolytica
NNDCILFSALILNSKIVVLGK

SEQ ID NO: 2722084 - protein, 26 aa, Entamoeba histolytica
NNDDLLIKPKKVPLGMNPLQMAMAGE

SEQ ID NO: 2722085 - protein, 26 aa, Entamoeba histolytica
NNDFNRVFMCSFPYFTNSKTVLQKLI

SEQ ID NO: 2722086 - protein, 29 aa, Entamoeba histolytica
NNDPIVQRFRLSFLALFKIITELCDCFDK

SEQ ID NO: 2722087 - protein, 31 aa, Entamoeba histolytica
NNEELLKSFLEKYPKVLFFKTTINDTEGIKK

SEQ ID NO: 2722088 - protein, 27 aa, Entamoeba histolytica
NNEHALGVEDLLFRALLNGGRLEDILN

SEQ ID NO: 2722089 - protein, 23 aa, Entamoeba histolytica
NNEIVINPVIPEMSLLGINEMKE

SEQ ID NO: 2722090 - protein, 23 aa, Entamoeba histolytica
NNEKIPVLLIGNKADLLKTDEEK

SEQ ID NO: 2722091 - protein, 24 aa, Entamoeba histolytica
NNEKKDWYIWSKKPNNWRSFFSGS

SEQ ID NO: 2722092 - protein, 25 aa, Entamoeba histolytica
NNELDLYNEILLFPGLPASIQNEIG

SEQ ID NO: 2722093 - protein, 27 aa, Entamoeba histolytica
NNELSETLLFIRNLPYSINDEKLKELF

SEQ ID NO: 2722094 - protein, 25 aa, Entamoeba histolytica
NNEPLKVDQLFPNVLQPINLLRINH

SEQ ID NO: 2722095 - protein, 23 aa, Entamoeba histolytica
NNERNIKFFKSPSSSLFSNTKIT

SEQ ID NO: 2722096 - protein, 17 aa, Entamoeba histolytica
NNFKLPNEFSLKPLHRM

SEQ ID NO: 2722097 - protein, 18 aa, Entamoeba histolytica
NNFSSFVRQLNIYGFHKV

SEQ ID NO: 2722098 - protein, 24 aa, Entamoeba histolytica
NNFTFVLPMVYSLSFFIQKNTEDY

SEQ ID NO: 2722099 - protein, 24 aa, Entamoeba histolytica
NNFYKSPFIVCTYNYILDPKVENV

SEQ ID NO: 2722100 - protein, 22 aa, Entamoeba histolytica
NNGFLLIHKILVIYPECISNII

SEQ ID NO: 2722101 - protein, 19 aa, Entamoeba histolytica
NNGFLLIHKILVIYSECIS

SEQ ID NO: 2722102 - protein, 25 aa, Entamoeba histolytica
NNGGDPFIFVVNKNTDWNTPYKPQA

SEQ ID NO: 2722103 - protein, 24 aa, Entamoeba histolytica
NNGKFMPAIGLGTWLAAPGEVGKA

SEQ ID NO: 2722104 - protein, 28 aa, Entamoeba histolytica
NNGKLEPRFIFEGEIFLAAGEKALLVPI

SEQ ID NO: 2722105 - protein, 21 aa, Entamoeba histolytica
NNGNFFAFDFGGGTLDTTILK

SEQ ID NO: 2722106 - protein, 32 aa, Entamoeba histolytica
NNGRSLGYYVVPLLLILPFGKGSTTITLNGIT

SEQ ID NO: 2722107 - protein, 25 aa, Entamoeba histolytica
NNHKNIDGTSCIFVIISIIITFSFF

SEQ ID NO: 2722108 - protein, 27 aa, Entamoeba histolytica
NNHMELSFYLVLHFLFHEEMILSPMEK

SEQ ID NO: 2722109 - protein, 22 aa, Entamoeba histolytica
NNIANVMYFIYPDVPKIVKKED

SEQ ID NO: 2722110 - protein, 22 aa, Entamoeba histolytica
NNIDGTSGMFMLLAFVIQLIFF

SEQ ID NO: 2722111 - protein, 23 aa, Entamoeba histolytica
NNIDYLMAFLMYLNQNQKEIIHT

SEQ ID NO: 2722112 - protein, 29 aa, Entamoeba histolytica
NNIFKQYGYKLGLTVRETCRFNYNYNETI

SEQ ID NO: 2722113 - protein, 22 aa, Entamoeba histolytica
NNIIFECPYYIKNDSQLPLLIK

SEQ ID NO: 2722114 - protein, 27 aa, Entamoeba histolytica
NNIIINNPLKFIFSSQFKWYKSELNKT

SEQ ID NO: 2722115 - protein, 24 aa, Entamoeba histolytica
NNIIKMIDYYYGIEGCYIVFESCD

SEQ ID NO: 2722116 - protein, 25 aa, Entamoeba histolytica
NNIKLPPHKNYLYYSSLHDVIMKNP

SEQ ID NO: 2722117 - protein, 17 aa, Entamoeba histolytica
NNIKTTHFYMVRELHDQ

SEQ ID NO: 2722118 - protein, 19 aa, Entamoeba histolytica
NNINLAIQLPLSEKELFIV

SEQ ID NO: 2722119 - protein, 24 aa, Entamoeba histolytica
NNIQISVHVLYKTTIRISLEQIAE

SEQ ID NO: 2722120 - protein, 22 aa, Entamoeba histolytica
NNITKVFLNGVWLKCSEQPQKL

SEQ ID NO: 2722121 - protein, 23 aa, Entamoeba histolytica
NNIVEILSILQLSSIRIIYNNNE

SEQ ID NO: 2722122 - protein, 26 aa, Entamoeba histolytica
NNIYCLKQFFIILYYCFKSSKEVEEF

SEQ ID NO: 2722123 - protein, 23 aa, Entamoeba histolytica
NNKEKIIHFIKRQMNDNAIELMI

SEQ ID NO: 2722124 - protein, 23 aa, Entamoeba histolytica
NNKELVELLLNYSPSKLICQDIH

SEQ ID NO: 2722125 - protein, 21 aa, Entamoeba histolytica
NNKFLPCLPSVLQSLSKLSTG

SEQ ID NO: 2722126 - protein, 25 aa, Entamoeba histolytica
NNKHGYVFFILENQVDIMRKPFVNI

SEQ ID NO: 2722127 - protein, 25 aa, Entamoeba histolytica
NNKIRLPFSYLLNQNKFKFIEIPFK

SEQ ID NO: 2722128 - protein, 30 aa, Entamoeba histolytica; identical to SEQ ID NO: 2534877

SEQ ID NO: 2722129 - protein, 26 aa, Entamoeba histolytica
NNKIVSLPVLFPFQVTRLDLSQNLIS

SEQ ID NO: 2722130 - protein, 28 aa, Entamoeba histolytica
NNKLFSSNRFFLFVFNEALNSTLKRKTE

SEQ ID NO: 2722131 - protein, 22 aa, Entamoeba histolytica
NNKNKTLGLTKFINGVSKVTHK

SEQ ID NO: 2722132 - protein, 26 aa, Entamoeba histolytica
NNKNSFILQPLYDIIHSIKTPQLLVE

SEQ ID NO: 2722133 - protein, 22 aa, Entamoeba histolytica
NNKPLPPPPVISESIVQSVNEQ

SEQ ID NO: 2722134 - protein, 32 aa, Entamoeba histolytica
NNKPTKAFTMTLWLKAIFEQHLAYLMSIKDVS

SEQ ID NO: 2722135 - protein, 26 aa, Entamoeba histolytica
NNKRDLVFWAMYFKSQDMWIKQRETI

SEQ ID NO: 2722136 - protein, 24 aa, Entamoeba histolytica
NNKSTTNNLFSFDLDEPKKENKNL

SEQ ID NO: 2722137 - protein, 23 aa, Entamoeba histolytica
NNKTLLYCTTIQYCILYHFHSKY

SEQ ID NO: 2722138 - protein, 25 aa, Entamoeba histolytica
NNKTQNLFEYVYRSSLRSGEFVEFM

SEQ ID NO: 2722139 - protein, 38 aa, Entamoeba histolytica
NNKTRILHHLPNSYYLERLFCFYIPIITRCSVSVIDST

SEQ ID NO: 2722140 - protein, 22 aa, Entamoeba histolytica
NNLDETSGVFMFLAFVIHLIFF

SEQ ID NO: 2722141 - protein, 22 aa, Entamoeba histolytica
NNLDGTSGMFMFLTFVIHLFFF

SEQ ID NO: 2722142 - protein, 22 aa, Entamoeba histolytica
NNLDGTSGMFMLLDFVIQLIFF

SEQ ID NO: 2722143 - protein, 20 aa, Entamoeba histolytica
NNLEAFVYSMKDKLLFGCLA

SEQ ID NO: 2722144 - protein, 22 aa, Entamoeba histolytica
NNLILKRTMERINKHAWEDAMK

SEQ ID NO: 2722145 - protein, 27 aa, Entamoeba histolytica
NNLLLSQYILFYNGVVLSLKLSFEDIG

SEQ ID NO: 2722146 - protein, 18 aa, Entamoeba histolytica
NNLLYTTAPVDLFGIVKE

SEQ ID NO: 2722147 - protein, 27 aa, Entamoeba histolytica
NNLNKQMILLPLNPLMNDILPKTLPVM

SEQ ID NO: 2722148 - protein, 17 aa, Entamoeba histolytica
NNLPRRRDLPPITEVLA

SEQ ID NO: 2722149 - protein, 17 aa, Entamoeba histolytica
NNLRIIVPVKENVIVDS

SEQ ID NO: 2722150 - protein, 24 aa, Entamoeba histolytica
NNLSLPCDLSFSTSLIPLIYQGRI

SEQ ID NO: 2722151 - protein, 23 aa, Entamoeba histolytica
NNMDFLPQFQFFTQLKEIVLEEC

SEQ ID NO: 2722152 - protein, 20 aa, Entamoeba histolytica
NNMFMRLMCIGKSSIYQEQY

SEQ ID NO: 2722153 - protein, 20 aa, Entamoeba histolytica
NNMMVNQSIEWYISGDYPMY

SEQ ID NO: 2722154 - protein, 27 aa, Entamoeba histolytica
NNNEEELFWKVIIFDQFNSDLLSLQLR

SEQ ID NO: 2722155 - protein, 25 aa, Entamoeba histolytica
NNNKFLVLEYAPNTLISYLNKQKSK

SEQ ID NO: 2722156 - protein, 17 aa, Entamoeba histolytica
NNNPSTARALRNSVRQQ

SEQ ID NO: 2722157 - protein, 27 aa, Entamoeba histolytica
NNNQAYIRSVLPPELWKRIEDVAFEPN

SEQ ID NO: 2722158 - protein, 29 aa, Entamoeba histolytica
NNNVDVLFQDLIKKLLSEPLRLTNKHVSE

SEQ ID NO: 2722159 - protein, 25 aa, Entamoeba histolytica
NNPCALPYPIYNAAMLPPGWSIGQD

SEQ ID NO: 2722160 - protein, 17 aa, Entamoeba histolytica
NNPDFIRVILKNQNKII

SEQ ID NO: 2722161 - protein, 22 aa, Entamoeba histolytica
NNPIIRKSTIEVILKIIEPMNV

SEQ ID NO: 2722162 - protein, 22 aa, Entamoeba histolytica
NNPIMILCDNLILSIQRSTIIK

SEQ ID NO: 2722163 - protein, 23 aa, Entamoeba histolytica
NNPISLFNQLLWSDPELADGFKK

SEQ ID NO: 2722164 - protein, 25 aa, Entamoeba histolytica
NNPKYNLREMFLPGFPGINKCAFVA

SEQ ID NO: 2722165 - protein, 18 aa, Entamoeba histolytica
NNPLKCFNLVILKHIEVI

SEQ ID NO: 2722166 - protein, 25 aa, Entamoeba histolytica
NNPPKLILPEQVSVTPTFLPVAVRP

SEQ ID NO: 2722167 - protein, 17 aa, Entamoeba histolytica
NNPSIKMYLQYLEEYYG

SEQ ID NO: 2722168 - protein, 25 aa, Entamoeba histolytica
NNQHSLWCCFYYSTNKISGSPIVLA

SEQ ID NO: 2722169 - protein, 23 aa, Entamoeba histolytica
NNQKPLPPLPVKKQEITPENNIV

SEQ ID NO: 2722170 - protein, 17 aa, Entamoeba histolytica
NNQMFILYENKLTQIHL

SEQ ID NO: 2722171 - protein, 23 aa, Entamoeba histolytica
NNQTYPYHFTYNSLLSKSKAGQL

SEQ ID NO: 2722172 - protein, 19 aa, Entamoeba histolytica
NNRIRTIPFTVCKLNQLRN

SEQ ID NO: 2722173 - protein, 22 aa, Entamoeba histolytica
NNRPFSLPHIYPTDISITNPRD

SEQ ID NO: 2722174 - protein, 25 aa, Entamoeba histolytica
NNSAWSHRFYTLKSLNLLNDLNQLK

SEQ ID NO: 2722175 - protein, 23 aa, Entamoeba histolytica
NNSLLIKSLLQRGANPTGKYIGN

SEQ ID NO: 2722176 - protein, 24 aa, Entamoeba histolytica
NNSSQFFFVINEQLLITKYTSIPT

SEQ ID NO: 2722177 - protein, 23 aa, Entamoeba histolytica
NNTHNWTLFIRPFNEEDIELFNV

SEQ ID NO: 2722178 - protein, 20 aa, Entamoeba histolytica
NNTKIIQNTLIAVKPKIMEN

SEQ ID NO: 2722179 - protein, 23 aa, Entamoeba histolytica
NNTRIGVMIYSDKITLFKYHNSH

SEQ ID NO: 2722180 - protein, 31 aa, Entamoeba histolytica
NNTSIRYYFQDILKAFDQMFKKRVYLESYRE

SEQ ID NO: 2722181 - protein, 22 aa, Entamoeba histolytica
NNTTIMWAASAGQFELNVMEPV

SEQ ID NO: 2722182 - protein, 35 aa, Entamoeba histolytica
NNTTKKYLLKITSLLFSIKLIPKEYNHLLLSIVES

SEQ ID NO: 2722183 - protein, 23 aa, Entamoeba histolytica
NNTVLLNPLSISSLSIGTNVSKD

SEQ ID NO: 2722184 - protein, 31 aa, Entamoeba histolytica
NNTVRQIFHHFILYKFLFTRRSHLNWSKFDK

SEQ ID NO: 2722185 - protein, 28 aa, Entamoeba histolytica
NNTYCHTPTYLPLYDADGLIIKQEGALN

SEQ ID NO: 2722186 - protein, 20 aa, Entamoeba histolytica
NNVEEILLTNLLKIIKKQEN

SEQ ID NO: 2722187 - protein, 23 aa, Entamoeba histolytica
NNVQWFFDWCSLNYEQTYILYGN

SEQ ID NO: 2722188 - protein, 23 aa, Entamoeba histolytica
NNYIIDVIGLFGYSFQTKTIDIY

SEQ ID NO: 2722189 - protein, 31 aa, Entamoeba histolytica
NNYIKIVEPFFVKLFQNDILIRDIYNESLDS

SEQ ID NO: 2722190 - protein, 29 aa, Entamoeba histolytica
NNYLDQIYSLLPYLLSIHLQPQEITDLIW

SEQ ID NO: 2722191 - protein, 24 aa, Entamoeba histolytica
NNYNPIWNSRFILHHLTKETVLVE

SEQ ID NO: 2722192 - protein, 29 aa, Entamoeba histolytica
NNYQKLPPKILAKQLILFDWRMTENINVN

SEQ ID NO: 2722193 - protein, 17 aa, Entamoeba histolytica
NNYWISCSETSFILLAR

SEQ ID NO: 2722194 - protein, 20 aa, Entamoeba histolytica
NPCDNLLLRIYFEVDDNQYN

SEQ ID NO: 2722195 - protein, 23 aa, Entamoeba histolytica
NPCTSNIFFGKIFPVACFNNEGT

SEQ ID NO: 2722196 - protein, 22 aa, Entamoeba histolytica
NPEIPIALRISGHLLLGICRIY

SEQ ID NO: 2722197 - protein, 18 aa, Entamoeba histolytica
NPEKFVFELFNRIQLVDE

SEQ ID NO: 2722198 - protein, 22 aa, Entamoeba histolytica
NPEKHLSNYTLFFGCGGEIQSL

SEQ ID NO: 2722199 - protein, 26 aa, Entamoeba histolytica
NPEMNRFIFLLCTRAGGFGINLSEAD

SEQ ID NO: 2722200 - protein, 24 aa, Entamoeba histolytica
NPETTILPLLMIKSILPRIESVFL

SEQ ID NO: 2722201 - protein, 22 aa, Entamoeba histolytica
NPEYFIIAIAVRKGVVVLKRYK

SEQ ID NO: 2722202 - protein, 20 aa, Entamoeba histolytica
NPFASGTFSFGSLGLQAEPP

SEQ ID NO: 2722203 - protein, 26 aa, Entamoeba histolytica
NPFLTIENYYITLSKLFLYCNNTNLT

SEQ ID NO: 2722204 - protein, 20 aa, Entamoeba histolytica
NPFMHNNRLIQCFGSFGWSG

SEQ ID NO: 2722205 - protein, 36 aa, Entamoeba histolytica
NPFPISFALELYSRFYPIIPLKFTEGEFKWLGVKFD

SEQ ID NO: 2722206 - protein, 26 aa, Entamoeba histolytica
NPFTEGVVFSVRPPKKAWKNIANLSG

SEQ ID NO: 2722207 - protein, 20 aa, Entamoeba histolytica
NPGFIIQLYEFQLKLGIKDS

SEQ ID NO: 2722208 - protein, 22 aa, Entamoeba histolytica
NPGKRIWINGKKVCFKNFAEYA

SEQ ID NO: 2722209 - protein, 26 aa, Entamoeba histolytica
NPGNGILIAFQKLYTEDFKMLKEIIQ

SEQ ID NO: 2722210 - protein, 17 aa, Entamoeba histolytica
NPICYFHNLGYDGRFLA

SEQ ID NO: 2722211 - protein, 26 aa, Entamoeba histolytica
NPIKTLPTGFFKLKSLRFISLTNTLV

SEQ ID NO: 2722212 - protein, 21 aa, Entamoeba histolytica
NPIMILCDNLILSIQRSTIIK

SEQ ID NO: 2722213 - protein, 23 aa, Entamoeba histolytica
NPKALEIIPLQLPSSIKINFSFE

SEQ ID NO: 2722214 - protein, 28 aa, Entamoeba histolytica
NPKSISLEMIWYMRALYQKHGNNVTAMF

SEQ ID NO: 2722215 - protein, 18 aa, Entamoeba histolytica
NPKTWQISSWQCYQNYYH

SEQ ID NO: 2722216 - protein, 28 aa, Entamoeba histolytica
NPLDANAWFVALAYTIKLSPRLNESKNI

SEQ ID NO: 2722217 - protein, 22 aa, Entamoeba histolytica
NPLEIFEQYLIPVAKYQVQFSH

SEQ ID NO: 2722218 - protein, 33 aa, Entamoeba histolytica
NPLKQPKFIDLLLLRNEPPFLLQPLLSVLPKTK

SEQ ID NO: 2722219 - protein, 19 aa, Entamoeba histolytica
NPLLITSPLDTKIKNDDLV

SEQ ID NO: 2722220 - protein, 18 aa, Entamoeba histolytica
NPLYNYTNPMQNDVKCAL

SEQ ID NO: 2722221 - protein, 27 aa, Entamoeba histolytica
NPMKSTVSDLLLLQPPAYITNNTKTQL

SEQ ID NO: 2722222 - protein, 24 aa, Entamoeba histolytica
NPMNGLLNIPLTFGSVRVLTYKLK

SEQ ID NO: 2722223 - protein, 20 aa, Entamoeba histolytica
NPNIIIIEGGYAYEFELFIT

SEQ ID NO: 2722224 - protein, 20 aa, Entamoeba histolytica
NPNITFCPILPNILGIVASC

SEQ ID NO: 2722225 - protein, 29 aa, Entamoeba histolytica
NPNKINFIAYWTKQPHKIIFSSHFDTVPV

SEQ ID NO: 2722226 - protein, 26 aa, Entamoeba histolytica
NPNLGPPYHLLLDTNFIQFSIGKKVD

SEQ ID NO: 2722227 - protein, 30 aa, Entamoeba histolytica; identical to SEQ ID NO: 2535002

SEQ ID NO: 2722228 - protein, 28 aa, Entamoeba histolytica
NPNMKSITLPTIYSRAFYLCLEKLVPFI

SEQ ID NO: 2722229 - protein, 23 aa, Entamoeba histolytica
NPNNLLLTTFKLSPQKDDIKRLC

SEQ ID NO: 2722230 - protein, 24 aa, Entamoeba histolytica
NPNPKKVRSIVRISKLEDTVDKTS

SEQ ID NO: 2722231 - protein, 26 aa, Entamoeba histolytica
NPNPNQTLLFYQYDSDGFGELTIQEI

SEQ ID NO: 2722232 - protein, 21 aa, Entamoeba histolytica
NPNYINAFNKNLHSLLFLTDE

SEQ ID NO: 2722233 - protein, 17 aa, Entamoeba histolytica
NPQDVSALAFLYSKLQQ

SEQ ID NO: 2722234 - protein, 23 aa, Entamoeba histolytica
NPQNIFGLGLTLTYYQVEEIEIK

SEQ ID NO: 2722235 - protein, 32 aa, Entamoeba histolytica
NPQNVKIISDLTWPAIYTLLQERIKVLEKEGH

SEQ ID NO: 2722236 - protein, 24 aa, Entamoeba histolytica
NPRAQPTVFLPTEVTRLIPHVEHN

SEQ ID NO: 2722237 - protein, 17 aa, Entamoeba histolytica
NPRLGMDQLLITPISQA

SEQ ID NO: 2722238 - protein, 27 aa, Entamoeba histolytica
NPSNTPPVPLILFPKLDQSIVDECINQ

SEQ ID NO: 2722239 - protein, 23 aa, Entamoeba histolytica
NPSQHLFAGTASSWFVEECYLCA

SEQ ID NO: 2722240 - protein, 26 aa, Entamoeba histolytica
NPSSTIPIILILCKADIEIPNIKKDL

SEQ ID NO: 2722241 - protein, 18 aa, Entamoeba histolytica
NPTFFQRGVSTRPLMLIT

SEQ ID NO: 2722242 - protein, 25 aa, Entamoeba histolytica
NPVIQKTMIFKKFLKGEVNRAKESF

SEQ ID NO: 2722243 - protein, 24 aa, Entamoeba histolytica
NPVNGFPLFPKRSISYPMRDTALC

SEQ ID NO: 2722244 - protein, 26 aa, Entamoeba histolytica
NPVVIRLWPYDIENGDLWVLVKHYKS

SEQ ID NO: 2722245 - protein, 20 aa, Entamoeba histolytica
NPWIFWFESGKTSDKSTSIT

SEQ ID NO: 2722246 - protein, 20 aa, Entamoeba histolytica
NPWKTMPDIFYAFPKHFYDN

SEQ ID NO: 2722247 - protein, 25 aa, Entamoeba histolytica
NPWLTTPFSIIKFVYHFNPETVNCC

SEQ ID NO: 2722248 - protein, 18 aa, Entamoeba histolytica
NPYFANLLKELSQQTMDK

SEQ ID NO: 2722249 - protein, 17 aa, Entamoeba histolytica
NPYIHCQRFIQCFGSHG

SEQ ID NO: 2722250 - protein, 27 aa, Entamoeba histolytica
NPYNELYHSILLDLFNINLGKLNSDDS

SEQ ID NO: 2722251 - protein, 18 aa, Entamoeba histolytica
NPYRREFAFEYFNNAELS

SEQ ID NO: 2722252 - protein, 23 aa, Entamoeba histolytica
NQALNHPFFTFKNINDITPKDFY

SEQ ID NO: 2722253 - protein, 25 aa, Entamoeba histolytica
NQANDLIPLFEFLLTFIENNTSGTS

SEQ ID NO: 2722254 - protein, 23 aa, Entamoeba histolytica
NQAVFLFKGWGRSLDKRQSFKMF

SEQ ID NO: 2722255 - protein, 27 aa, Entamoeba histolytica
  misc_feature (25)..(27): Xaa can be any naturally occurring amino acid
NQCSLSLPITLLRFAQPLKFPKQIXXX

SEQ ID NO: 2722256 - protein, 28 aa, Entamoeba histolytica
NQEETLEFHYYLWKVFEFEMKKMNLDTN

SEQ ID NO: 2722257 - protein, 34 aa, Entamoeba histolytica
NQEIIKMKIFNEYLYVSLKNGKILIFNADTFKPI

SEQ ID NO: 2722258 - protein, 20 aa, Entamoeba histolytica
NQEIKIYNIIKEGYQRIKKG

SEQ ID NO: 2722259 - protein, 22 aa, Entamoeba histolytica
NQEIKIYNIIKEGYQRIKKGEI

SEQ ID NO: 2722260 - protein, 26 aa, Entamoeba histolytica
NQELKYPLNDLIPFFSKSLEQITLDN

SEQ ID NO: 2722261 - protein, 21 aa, Entamoeba histolytica
NQFAKIFPNLMELNLSNLDVK

SEQ ID NO: 2722262 - protein, 20 aa, Entamoeba histolytica
NQFGVIMPQCTLFRNSNGYE

SEQ ID NO: 2722263 - protein, 22 aa, Entamoeba histolytica
NQGFHELVGVLYYCISRDIQSW

SEQ ID NO: 2722264 - protein, 27 aa, Entamoeba histolytica
NQICDLRQMILKLNEKKLPQNEIKKIE

SEQ ID NO: 2722265 - protein, 28 aa, Entamoeba histolytica
NQIDLKNKPFFFIYGNRDISLKVGLSSC

SEQ ID NO: 2722266 - protein, 25 aa, Entamoeba histolytica
NQIEQLFPLLKIIASSPLLQHFELV

SEQ ID NO: 2722267 - protein, 24 aa, Entamoeba histolytica
NQIESWCWFNGCMSLTAITLTTRV

SEQ ID NO: 2722268 - protein, 21 aa, Entamoeba histolytica
NQIFKIVAGMLHLGNVEYSQG

SEQ ID NO: 2722269 - protein, 23 aa, Entamoeba histolytica
NQIGRLCEIGFPDGFISVAKTTI

SEQ ID NO: 2722270 - protein, 21 aa, Entamoeba histolytica
NQILALFQSFTLDQTKLSDNG

SEQ ID NO: 2722271 - protein, 23 aa, Entamoeba histolytica
NQINVCLLLLIFSFYENSHERKN

SEQ ID NO: 2722272 - protein, 20 aa, Entamoeba histolytica
NQIPHMLFYGPPGTGKTTTA

SEQ ID NO: 2722273 - protein, 18 aa, Entamoeba histolytica
NQIPLSIIIIFLLKQCTC

SEQ ID NO: 2722274 - protein, 24 aa, Entamoeba histolytica
NQIQFHMIKMFPMLRRMKFDESFL

SEQ ID NO: 2722275 - protein, 18 aa, Entamoeba histolytica
NQKATFVCNLKPSKLRGV

SEQ ID NO: 2722276 - protein, 17 aa, Entamoeba histolytica
NQKIGMISIGQLLKVRI

SEQ ID NO: 2722277 - protein, 32 aa, Entamoeba histolytica
NQKIKLHEIPQLPEYIKYLYVQTRDSNIIINQ

SEQ ID NO: 2722278 - protein, 26 aa, Entamoeba histolytica
NQKKYMVTFPFPYMNGRLHLGHTFTV

SEQ ID NO: 2722279 - protein, 18 aa, Entamoeba histolytica
NQKNYFIETFISPNIDSL

SEQ ID NO: 2722280 - protein, 26 aa, Entamoeba histolytica
NQKTIQLDLYRDTSIPIPSKFIGTAC

SEQ ID NO: 2722281 - protein, 20 aa, Entamoeba histolytica
NQKYYDFRKIFGKVGIMTGD

SEQ ID NO: 2722282 - protein, 26 aa, Entamoeba histolytica
NQLAIKYKHLYLTNTEILLGITMKRC

SEQ ID NO: 2722283 - protein, 25 aa, Entamoeba histolytica
NQLAIKYKHLYLTNTQILLGIRISR

SEQ ID NO: 2722284 - protein, 31 aa, Entamoeba histolytica
NQLDDNSLVLYLSYFIIKDNRFGPSDMKVAE

SEQ ID NO: 2722285 - protein, 38 aa, Entamoeba histolytica
NQLDLRSYLIMPVQRLPRYKLLLTDLIKHTDDDFVDKP

SEQ ID NO: 2722286 - protein, 21 aa, Entamoeba histolytica
NQLGVCKAVILNPKNTIKCYL

SEQ ID NO: 2722287 - protein, 36 aa, Entamoeba histolytica
NQLHQQYIIFSKKLALLRNLLLPYDRISNKDPLISK

SEQ ID NO: 2722288 - protein, 19 aa, Entamoeba histolytica
NQLIDLCDSLNLNHFIECI

SEQ ID NO: 2722289 - protein, 23 aa, Entamoeba histolytica
NQLIQTINQYYLIFISNVNTDIG

SEQ ID NO: 2722290 - protein, 19 aa, Entamoeba histolytica
NQLKSIIPLVLQSIEINIK

SEQ ID NO: 2722291 - protein, 17 aa, Entamoeba histolytica
NQLMDINIFKKCFNLRE

SEQ ID NO: 2722292 - protein, 27 aa, Entamoeba histolytica
NQLQKEIQLLYRTKLDVNDAAKWFDQT

SEQ ID NO: 2722293 - protein, 18 aa, Entamoeba histolytica
NQLVIPLLQLSYSLNTNI

SEQ ID NO: 2722294 - protein, 17 aa, Entamoeba histolytica
NQMAKMRFLCKKGALFF

SEQ ID NO: 2722295 - protein, 18 aa, Entamoeba histolytica
NQMKLNSTWYAKLGMWHK

SEQ ID NO: 2722296 - protein, 17 aa, Entamoeba histolytica
NQMLFINGMTQPALTLY

SEQ ID NO: 2722297 - protein, 23 aa, Entamoeba histolytica
NQNCVALNPKWCRCLLSTKDSGG

SEQ ID NO: 2722298 - protein, 30 aa, Entamoeba histolytica
NQNINLEPYLHQLFPVILTLVVTKQIGTNS

SEQ ID NO: 2722299 - protein, 24 aa, Entamoeba histolytica
NQNKYFLNGGFWLSVDTFNQLLPH

SEQ ID NO: 2722300 - protein, 22 aa, Entamoeba histolytica
NQPELQLDIIWTYCNISSETVD

SEQ ID NO: 2722301 - protein, 25 aa, Entamoeba histolytica
NQPFSQFFHVFFKKFMEVEGVEEQQ

SEQ ID NO: 2722302 - protein, 25 aa, Entamoeba histolytica
NQPKYQQLLNIIKASSEPGEEFFDI

SEQ ID NO: 2722303 - protein, 22 aa, Entamoeba histolytica
NQPLNDLFNILIKDLTKIEINR

SEQ ID NO: 2722304 - protein, 24 aa, Entamoeba histolytica
NQQETIQTLRFLNKLKTIKNVPIY

SEQ ID NO: 2722305 - protein, 35 aa, Entamoeba histolytica
NQQFEFKKLFALCVFLAWHYKMPLKKLINAPQGAQ

SEQ ID NO: 2722306 - protein, 29 aa, Entamoeba histolytica
NQQFKYSICFQWLSIPFHRKKEALLDFCR

SEQ ID NO: 2722307 - protein, 21 aa, Entamoeba histolytica
NQQFVEIFEKELIKFKEQIEE

SEQ ID NO: 2722308 - protein, 22 aa, Entamoeba histolytica
NQQITIQLLNKFKYSQGVNPIE

SEQ ID NO: 2722309 - protein, 23 aa, Entamoeba histolytica
NQQSIPMYLPQQNNFMYLQSIPS

SEQ ID NO: 2722310 - protein, 25 aa, Entamoeba histolytica
NQQWKELVFLYVQVDQVKAIETMIS

SEQ ID NO: 2722311 - protein, 25 aa, Entamoeba histolytica
NQRDLLIYGVYFSDKQKWFKQKHTT

SEQ ID NO: 2722312 - protein, 38 aa, Entamoeba histolytica; identical to SEQ ID NO: 2535114

SEQ ID NO: 2722313 - protein, 20 aa, Entamoeba histolytica
NQRVPLGNYLKFAPVHTVLP

SEQ ID NO: 2722314 - protein, 22 aa, Entamoeba histolytica
NQSFCYFIDSKTPFDIWNDEEI

SEQ ID NO: 2722315 - protein, 21 aa, Entamoeba histolytica
NQSFCYFIDSKTPFDVWNDDE

SEQ ID NO: 2722316 - protein, 21 aa, Entamoeba histolytica
NQSFCYFIDSKTPFDVWNDEE

SEQ ID NO: 2722317 - protein, 18 aa, Entamoeba histolytica
NQSFFPIEKRVSLSFAPL

SEQ ID NO: 2722318 - protein, 26 aa, Entamoeba histolytica
NQSGVLMPFYDPDLSLLYLGGKGDST

SEQ ID NO: 2722319 - protein, 25 aa, Entamoeba histolytica
NQSGVLMPFYDPDSSILYLGGKGEK

SEQ ID NO: 2722320 - protein, 25 aa, Entamoeba histolytica
NQSQLLILKLFGVSHLKYLNTPFPS

SEQ ID NO: 2722321 - protein, 36 aa, Entamoeba histolytica; identical to SEQ ID NO: 2535123

SEQ ID NO: 2722322 - protein, 31 aa, Entamoeba histolytica
NQTFNSPYRRNGMVPLIRPSYINNSTQRQSI

SEQ ID NO: 2722323 - protein, 25 aa, Entamoeba histolytica
NQTSSFLPMIGINNLKFIIKSTKNH

SEQ ID NO: 2722324 - protein, 36 aa, Entamoeba histolytica; identical to SEQ ID NO: 2535133

SEQ ID NO: 2722325 - protein, 28 aa, Entamoeba histolytica
NQVCMSIKLVFDLFNAFYQFTETAKLYD

SEQ ID NO: 2722326 - protein, 30 aa, Entamoeba histolytica
NQVKELCEKFFFNYQIPKQTTIYQQTVVIA

SEQ ID NO: 2722327 - protein, 29 aa, Entamoeba histolytica
NQWVSNIFEILFVATLDFLLEQHEYCMLL

SEQ ID NO: 2722328 - protein, 24 aa, Entamoeba histolytica
NQYLYIIMEYVRGGELLDALKKEK

SEQ ID NO: 2722329 - protein, 33 aa, Entamoeba histolytica
NQYPILEIAQLLNSIILVIPRFVQKTLTCLEQI

SEQ ID NO: 2722330 - protein, 30 aa, Entamoeba histolytica
NQYTPIIPFQSFLNKFLLKKLIIRIEYECQ

SEQ ID NO: 2722331 - protein, 23 aa, Entamoeba histolytica
NRAPALLIAYLIQNNKMSFINAF

SEQ ID NO: 2722332 - protein, 24 aa, Entamoeba histolytica
NRATSYFPFSGAHGIFLVYRNDDD

SEQ ID NO: 2722333 - protein, 25 aa, Entamoeba histolytica
NRCGLKVLVPLWQKDQKEVLNEIIE

SEQ ID NO: 2722334 - protein, 35 aa, Entamoeba histolytica
NRDAAQQSFLIGLLATFGYELKINKLYKKGKTTSQ

SEQ ID NO: 2722335 - protein, 39 aa, Entamoeba histolytica
NRDEFLCHIVTLNRTFHLRELLPFDFRPSDLPSITFPDT

SEQ ID NO: 2722336 - protein, 32 aa, Entamoeba histolytica; identical to SEQ ID NO: 2535149

SEQ ID NO: 2722337 - protein, 17 aa, Entamoeba histolytica
NREILILQDLRDGPNII

SEQ ID NO: 2722338 - protein, 25 aa, Entamoeba histolytica
NRELKLIEPLLCPISFDGDISISIS

SEQ ID NO: 2722339 - protein, 25 aa, Entamoeba histolytica
NREMVLLEWILFLDPVVNKTTKFNW

SEQ ID NO: 2722340 - protein, 25 aa, Entamoeba histolytica
NRERFIAYLPLAHIFEIGIEFALLM

SEQ ID NO: 2722341 - protein, 36 aa, Entamoeba histolytica
NRESFDYLQDWIDDVSMYCPQGVKIVLVGNKVDLEN

SEQ ID NO: 2722342 - protein, 20 aa, Entamoeba histolytica
NRFFSHLHPEYRKKLRENKV

SEQ ID NO: 2722343 - protein, 27 aa, Entamoeba histolytica
NRFIKQEPKLWFQLGCLYEKAGLFEQA

SEQ ID NO: 2722344 - protein, 22 aa, Entamoeba histolytica
NRGFYCIIIEPTRELAAQVVEV

SEQ ID NO: 2722345 - protein, 22 aa, Entamoeba histolytica
NRGINLFTIFGCYQIGQFECSP

SEQ ID NO: 2722346 - protein, 29 aa, Entamoeba histolytica
NRGIPLNRMLMFISIFYLECFRCSQLRFE

SEQ ID NO: 2722347 - protein, 20 aa, Entamoeba histolytica
NRGLFFEINLSPLLEESDQK

SEQ ID NO: 2722348 - protein, 22 aa, Entamoeba histolytica
NRGTVSSYFKKAKIHLLVGSTQ

SEQ ID NO: 2722349 - protein, 24 aa, Entamoeba histolytica
NRHLPIKIILIVEGLTFYQKGIDA

SEQ ID NO: 2722350 - protein, 25 aa, Entamoeba histolytica
NRIDAKWYEIWIGEDIDYKVVDEYA

SEQ ID NO: 2722351 - protein, 26 aa, Entamoeba histolytica
NRIESVIEIFLKYQIFLLSNEQKIEI

SEQ ID NO: 2722352 - protein, 18 aa, Entamoeba histolytica
NRIGGISKLFILLNQKYN

SEQ ID NO: 2722353 - protein, 17 aa, Entamoeba histolytica
NRILFNKTVMNKNNLIF

SEQ ID NO: 2722354 - protein, 22 aa, Entamoeba histolytica
NRITEIPLFIDSFEKLRQFDCS

SEQ ID NO: 2722355 - protein, 19 aa, Entamoeba histolytica
NRKIDMIENILLSIEKESL

SEQ ID NO: 2722356 - protein, 21 aa, Entamoeba histolytica
NRKIFNYQEFDIFGGKNPYDN

SEQ ID NO: 2722357 - protein, 25 aa, Entamoeba histolytica
NRKKQKLRFILTQKIVDTFSRYVQN

SEQ ID NO: 2722358 - protein, 18 aa, Entamoeba histolytica
NRKKYYGIPYNWNELESN

SEQ ID NO: 2722359 - protein, 17 aa, Entamoeba histolytica
NRKTLSIELIPDKSFYG

SEQ ID NO: 2722360 - protein, 23 aa, Entamoeba histolytica
NRKTVIHWFLDFYNSECPYSIHS

SEQ ID NO: 2722361 - protein, 18 aa, Entamoeba histolytica
NRLAIYLSIALEPNELCK

SEQ ID NO: 2722362 - protein, 22 aa, Entamoeba histolytica
NRLAMYLKTRKSSPFNYLKINH

SEQ ID NO: 2722363 - protein, 20 aa, Entamoeba histolytica
NRLFMRAFPFAERLAEDIEA

SEQ ID NO: 2722364 - protein, 26 aa, Entamoeba histolytica
NRLGQLLWDFGVPTAMSIWEASQCSL

SEQ ID NO: 2722365 - protein, 20 aa, Entamoeba histolytica
NRLIIPISFGNHFSPAFSCI

SEQ ID NO: 2722366 - protein, 19 aa, Entamoeba histolytica
NRLVGIDFRKSLLSNLCNI

SEQ ID NO: 2722367 - protein, 26 aa, Entamoeba histolytica
NRNTNTFYLFCLTYGYSPVYEILNKK

SEQ ID NO: 2722368 - protein, 47 aa, Entamoeba histolytica
NRNVYTEFINLFNYLPLCVLLLQPIGTFFLCHGGISPSLRYLSQILR

SEQ ID NO: 2722369 - protein, 22 aa, Entamoeba histolytica
NRNYENLVRELKFSFDCDSVVV

SEQ ID NO: 2722370 - protein, 22 aa, Entamoeba histolytica
NRPELIVLDPPRTGIHPNALSK

SEQ ID NO: 2722371 - protein, 17 aa, Entamoeba histolytica
NRPISEHFKYGIINLDK

SEQ ID NO: 2722372 - protein, 26 aa, Entamoeba histolytica
NRQIYPPINVLPSLSRLMKSAIGEGM

SEQ ID NO: 2722373 - protein, 43 aa, Entamoeba histolytica
NRQLVKYYEWYYKDFQGKLIPGHLKFHVLLTTYEIVISDWEDL

SEQ ID NO: 2722374 - protein, 27 aa, Entamoeba histolytica
NRRRIGHNLFWFLKAEIHDARVTGRYG

SEQ ID NO: 2722375 - protein, 23 aa, Entamoeba histolytica
NRSDFEIHWITFNQLNDLTIEFY

SEQ ID NO: 2722376 - protein, 22 aa, Entamoeba histolytica
NRSIKIPAQIRYLVLNQFVRHL

SEQ ID NO: 2722377 - protein, 32 aa, Entamoeba histolytica
NRSKEEIPLIILYINKIFPFSFCENLLNDANF

SEQ ID NO: 2722378 - protein, 24 aa, Entamoeba histolytica
NRTKSLMLGFFKVIANSEAQPVTL

SEQ ID NO: 2722379 - protein, 24 aa, Entamoeba histolytica
NRTSQLFILLYQRLVENSQKRKKT

SEQ ID NO: 2722380 - protein, 18 aa, Entamoeba histolytica
NRVLSCRCDIIIKNGQVE

SEQ ID NO: 2722381 - protein, 23 aa, Entamoeba histolytica
NRVRRSFLKLIQQNLITLDNNGG

SEQ ID NO: 2722382 - protein, 20 aa, Entamoeba histolytica
NRVVPWFETTFVPNWVRRYG

SEQ ID NO: 2722383 - protein, 25 aa, Entamoeba histolytica
NRWTDGIFMIQTYAKERVSVPIEEL

SEQ ID NO: 2722384 - protein, 25 aa, Entamoeba histolytica
NRYDTPLKCNPLYLLDEKSKNCILQ

SEQ ID NO: 2722385 - protein, 27 aa, Entamoeba histolytica
NRYFGTDILLFVDLLEGSTIVLMFNPS

SEQ ID NO: 2722386 - protein, 37 aa, Entamoeba histolytica
NSAIDCSFLSKYLSFKIKPNQEFIPYEREWSTLITTG

SEQ ID NO: 2722387 - protein, 24 aa, Entamoeba histolytica
NSANILNVGFVKSLLITNCESIDF

SEQ ID NO: 2722388 - protein, 23 aa, Entamoeba histolytica
NSAPRFLNLVYVSIPTTITDYKH

SEQ ID NO: 2722389 - protein, 26 aa, Entamoeba histolytica
NSATFCLLMPIFRWVISKKDKTTEIV

SEQ ID NO: 2722390 - protein, 32 aa, Entamoeba histolytica
NSATVLHLIYLPILRISNQSPSPFYLVCITIQ

SEQ ID NO: 2722391 - protein, 24 aa, Entamoeba histolytica
NSCIQLLFSMKSFVSYLSFNPPNN

SEQ ID NO: 2722392 - protein, 29 aa, Entamoeba histolytica
NSCLELAWSQIQNFLIKVLNNRIFESEHS

SEQ ID NO: 2722393 - protein, 22 aa, Entamoeba histolytica
NSCLIAKPFYLFDEETIKIINE

SEQ ID NO: 2722394 - protein, 26 aa, Entamoeba histolytica
NSCVKFIREFKLFPYIDVLTLNCSYF

SEQ ID NO: 2722395 - protein, 24 aa, Entamoeba histolytica
NSCYILDCYSEMYMWVGTRVIKDR

SEQ ID NO: 2722396 - protein, 17 aa, Entamoeba histolytica
NSDEIWLQAIRLHPIEV

SEQ ID NO: 2722397 - protein, 25 aa, Entamoeba histolytica
NSDFKYLLGLLFQIYMNHHKSNLLS

SEQ ID NO: 2722398 - protein, 41 aa, Entamoeba histolytica
NSDISSFNCIDFWEGIKREIIPNYIILIDDQLIKLNRDTIK

SEQ ID NO: 2722399 - protein, 24 aa, Entamoeba histolytica
NSDPINSLFLLFGTRFNKDVPCQK

SEQ ID NO: 2722400 - protein, 26 aa, Entamoeba histolytica
NSEAKKKWLANRKPSLPLPKPGEVEN

SEQ ID NO: 2722401 - protein, 18 aa, Entamoeba histolytica
NSEIELIIFCSNPQVKFV

SEQ ID NO: 2722402 - protein, 24 aa, Entamoeba histolytica
NSEIIFTMWCVLMGLKIMNIYDLV

SEQ ID NO: 2722403 - protein, 20 aa, Entamoeba histolytica
NSEIPFFREVPQGKFNPQKD

SEQ ID NO: 2722404 - protein, 28 aa, Entamoeba histolytica
NSENEILIYFPKTFGFYISSQPNCTIFD

SEQ ID NO: 2722405 - protein, 31 aa, Entamoeba histolytica
NSEQRIQIITKITPTFFIISKNIHGTRSIQK

SEQ ID NO: 2722406 - protein, 29 aa, Entamoeba histolytica
NSESKIGGLFIKLAPFLKIYGEYCKNYPE

SEQ ID NO: 2722407 - protein, 30 aa, Entamoeba histolytica; identical to SEQ ID NO: 2518335

SEQ ID NO: 2722408 - protein, 26 aa, Entamoeba histolytica
NSEYERIRFLFLTSALLKAVDEHYDL

SEQ ID NO: 2722409 - protein, 21 aa, Entamoeba histolytica
NSEYMKWLKKRVVDLMAVFPS

SEQ ID NO: 2722410 - protein, 20 aa, Entamoeba histolytica
NSFHFLLEGLTHEVFSVQPD

SEQ ID NO: 2722411 - protein, 19 aa, Entamoeba histolytica
NSFIQPPQTAYLVLVEWDD

SEQ ID NO: 2722412 - protein, 22 aa, Entamoeba histolytica
NSFKKEFLPLVDLMFFEQRYNR

SEQ ID NO: 2722413 - protein, 21 aa, Entamoeba histolytica
NSFPKKYLPTVFDNYLAKVQY

SEQ ID NO: 2722414 - protein, 27 aa, Entamoeba histolytica
NSFQLSPFLYFQPDVFVLAFDVSNIKS

SEQ ID NO: 2722415 - protein, 25 aa, Entamoeba histolytica
NSFQNSFIFNLYYEARQVDIGNIIW

SEQ ID NO: 2722416 - protein, 18 aa, Entamoeba histolytica
NSFRQTLRWLTEEPNKEK

SEQ ID NO: 2722417 - protein, 19 aa, Entamoeba histolytica
NSFYQLTPVDLTVGTTGLL

SEQ ID NO: 2722418 - protein, 17 aa, Entamoeba histolytica
NSGQRVLFAYPSSNVMI

SEQ ID NO: 2722419 - protein, 25 aa, Entamoeba histolytica
NSIFTRIIRIFLDNELKQFLKEVIN

SEQ ID NO: 2722420 - protein, 21 aa, Entamoeba histolytica
NSIGLFFELIGQTYRVAMKNI

SEQ ID NO: 2722421 - protein, 21 aa, Entamoeba histolytica
NSIHIFDLRKTDKPIRDVNIE

SEQ ID NO: 2722422 - protein, 19 aa, Entamoeba histolytica
NSIIIIWKNNIKNVDNYLQ

SEQ ID NO: 2722423 - protein, 20 aa, Entamoeba histolytica
NSIISIRRPIISGELKKEGY

SEQ ID NO: 2722424 - protein, 22 aa, Entamoeba histolytica
NSIIYIINPLSCNMCYAYNGHA

SEQ ID NO: 2722425 - protein, 22 aa, Entamoeba histolytica
NSIKEFYIPPLAKVVEVSHCDS

SEQ ID NO: 2722426 - protein, 31 aa, Entamoeba histolytica; identical to SEQ ID NO: 2535246

SEQ ID NO: 2722427 - protein, 17 aa, Entamoeba histolytica
NSILDSISFWYGNNDCR

SEQ ID NO: 2722428 - protein, 19 aa, Entamoeba histolytica
NSIMLFNEKKECKNLFIPV

SEQ ID NO: 2722429 - protein, 17 aa, Entamoeba histolytica
NSISFFIFACDCRLRYT

SEQ ID NO: 2722430 - protein, 20 aa, Entamoeba histolytica
NSIYNFLLEVLSNYGNQINY

SEQ ID NO: 2722431 - protein, 24 aa, Entamoeba histolytica
NSKKKIILYCWSIIMDIKSLQKSG

SEQ ID NO: 2722432 - protein, 17 aa, Entamoeba histolytica
NSKLFIGKSLFFQTIAL

SEQ ID NO: 2722433 - protein, 17 aa, Entamoeba histolytica
NSKLRGMKRPVYVAPEG

SEQ ID NO: 2722434 - protein, 23 aa, Entamoeba histolytica
NSKPINFLNIPCTPFLISEPLNS

SEQ ID NO: 2722435 - protein, 28 aa, Entamoeba histolytica
NSKPTQGIHRMATLPLSSSLSQGISSIP

SEQ ID NO: 2722436 - protein, 24 aa, Entamoeba histolytica
NSKRIIRFNFKGSPYARAFHNITI

SEQ ID NO: 2722437 - protein, 21 aa, Entamoeba histolytica
NSKTVNYQLILDTLSKLFNSQ

SEQ ID NO: 2722438 - protein, 22 aa, Entamoeba histolytica
NSLAVPILKETPIIPTPTLTNN

SEQ ID NO: 2722439 - protein, 25 aa, Entamoeba histolytica
NSLCFKPLQLKYYNKKFIPLTQSKC

SEQ ID NO: 2722440 - protein, 19 aa, Entamoeba histolytica
NSLKEPLTFTFSSSLKEGD

SEQ ID NO: 2722441 - protein, 27 aa, Entamoeba histolytica
NSLKHPVPLLLLMTRHDICPTITLENF

SEQ ID NO: 2722442 - protein, 17 aa, Entamoeba histolytica
NSLLKKAIEFTERRGIK

SEQ ID NO: 2722443 - protein, 30 aa, Entamoeba histolytica
NSLLSFPRDNTVTYYFAYGGWIVQMEEKND

SEQ ID NO: 2722444 - protein, 27 aa, Entamoeba histolytica
NSLLSPIDVFLPIFCSLCKTKRVCILY

SEQ ID NO: 2722445 - protein, 24 aa, Entamoeba histolytica
NSLPNFYCVLFAFGLSFPLNNERS

SEQ ID NO: 2722446 - protein, 24 aa, Entamoeba histolytica
NSLSFSYSMSLPPGIYSPLLVVTP

SEQ ID NO: 2722447 - protein, 19 aa, Entamoeba histolytica
NSLSLIICTLPDEHLLSKL

SEQ ID NO: 2722448 - protein, 29 aa, Entamoeba histolytica
NSLTGSFIMLRYINPAIFSPEKYGIVDDP

SEQ ID NO: 2722449 - protein, 23 aa, Entamoeba histolytica
NSLYFNPLSQLLKAYYPLFSHPS

SEQ ID NO: 2722450 - protein, 25 aa, Entamoeba histolytica
NSLYLTLIDLLLSRERKITGTIEIS

SEQ ID NO: 2722451 - protein, 17 aa, Entamoeba histolytica
NSMEICIKGYYEPLIQS

SEQ ID NO: 2722452 - protein, 17 aa, Entamoeba histolytica
NSMQIIFKCISFNLKII

SEQ ID NO: 2722453 - protein, 23 aa, Entamoeba histolytica
NSNDLMTLLPISQSHLLFLQQWS

SEQ ID NO: 2722454 - protein, 21 aa, Entamoeba histolytica
NSNFRVVKWLYSLVGQLFNQP

SEQ ID NO: 2722455 - protein, 25 aa, Entamoeba histolytica
NSNFSFYWDLLKICQRKIKESQLPF

SEQ ID NO: 2722456 - protein, 28 aa, Entamoeba histolytica
NSNFSILPQFMYHLRRSHFLQVFNCSPD

SEQ ID NO: 2722457 - protein, 18 aa, Entamoeba histolytica
NSNKIQLLKQPRSTFDFV

SEQ ID NO: 2722458 - protein, 24 aa, Entamoeba histolytica
NSNPIKPTFSFPSAFKAPSNIHLF

SEQ ID NO: 2722459 - protein, 21 aa, Entamoeba histolytica
NSNVFSYLKFIKSQLIELNIV

SEQ ID NO: 2722460 - protein, 23 aa, Entamoeba histolytica
NSPFIFTVGFDRMQNRQFGIFDL

SEQ ID NO: 2722461 - protein, 19 aa, Entamoeba histolytica
NSPGLEYFLLIFHGDFTKT

SEQ ID NO: 2722462 - protein, 22 aa, Entamoeba histolytica
NSPIAIQCGLLLSPNSNQYIIP

SEQ ID NO: 2722463 - protein, 25 aa, Entamoeba histolytica
NSPINKQYFSGWKSKGLSLFVSKVD

SEQ ID NO: 2722464 - protein, 26 aa, Entamoeba histolytica
NSPLTVTSCPLHESPRFFIRRSGSHT

SEQ ID NO: 2722465 - protein, 25 aa, Entamoeba histolytica
NSPNFYTPPPYIFPPDEQPLNYQLN

SEQ ID NO: 2722466 - protein, 31 aa, Entamoeba histolytica
NSPTNLFTIQFFFQVARILKLDGVFCLLTDS

SEQ ID NO: 2722467 - protein, 23 aa, Entamoeba histolytica
NSQIPFLYKLKNVQKVIIEQITN

SEQ ID NO: 2722468 - protein, 20 aa, Entamoeba histolytica
NSQLLFSYFVENERLAELIE

SEQ ID NO: 2722469 - protein, 22 aa, Entamoeba histolytica
NSQPLPITRFSKPLYIGTGNSW

SEQ ID NO: 2722470 - protein, 30 aa, Entamoeba histolytica; identical to SEQ ID NO: 2535296

SEQ ID NO: 2722471 - protein, 22 aa, Entamoeba histolytica
NSRDLLFYGIGYNAEQWKRNKP

SEQ ID NO: 2722472 - protein, 25 aa, Entamoeba histolytica
NSRFGRIVLTFTPLLRVYSDYCQIY

SEQ ID NO: 2722473 - protein, 21 aa, Entamoeba histolytica
NSRIILTFQVGKKVKHVEFYE

SEQ ID NO: 2722474 - protein, 17 aa, Entamoeba histolytica
NSRIWLNSALSGKSKRI

SEQ ID NO: 2722475 - protein, 24 aa, Entamoeba histolytica
NSRKKLTLIILYRGVVVTDVPVIR

SEQ ID NO: 2722476 - protein, 27 aa, Entamoeba histolytica
NSRLSRSSIYLIFLGVNDKIITKRMSP

SEQ ID NO: 2722477 - protein, 17 aa, Entamoeba histolytica
NSRQQRFNNWRSFMSKK

SEQ ID NO: 2722478 - protein, 17 aa, Entamoeba histolytica
NSRVVVDFYVTWCGPCK

SEQ ID NO: 2722479 - protein, 22 aa, Entamoeba histolytica
NSSANKAALNKALCLSKGAHPE

SEQ ID NO: 2722480 - protein, 25 aa, Entamoeba histolytica
NSSFIQMCWKEIFEILYIASLDEDI

SEQ ID NO: 2722481 - protein, 23 aa, Entamoeba histolytica
NSSIEFLSVNNLKQIKLHGKGIK

SEQ ID NO: 2722482 - protein, 24 aa, Entamoeba histolytica
NSSIEFLSVNNLKQIKLHGKGIKV

SEQ ID NO: 2722483 - protein, 20 aa, Entamoeba histolytica
NSSIEFLSVNNLKQIKLNGN

SEQ ID NO: 2722484 - protein, 24 aa, Entamoeba histolytica
NSSLLPSILPIELHFKLLSIKSIF

SEQ ID NO: 2722485 - protein, 25 aa, Entamoeba histolytica
NSSLRILTIDGCPLRNLELSLNSLD

SEQ ID NO: 2722486 - protein, 30 aa, Entamoeba histolytica
NSSNLRLELLNQFDFIFVDSLTFNEIILET

SEQ ID NO: 2722487 - protein, 17 aa, Entamoeba histolytica
NSSNPELYLLYVTPEQI

SEQ ID NO: 2722488 - protein, 20 aa, Entamoeba histolytica
NSSYIIKKIPQNPFSDPETT

SEQ ID NO: 2722489 - protein, 17 aa, Entamoeba histolytica
NSTCQTFYHLLCLKRLG

SEQ ID NO: 2722490 - protein, 22 aa, Entamoeba histolytica
NSTHNKWIIQFPKRFVEIKGDN

SEQ ID NO: 2722491 - protein, 31 aa, Entamoeba histolytica
NSTIANVYRLFFYYYCFINDIFFNIRNDSIS

SEQ ID NO: 2722492 - protein, 24 aa, Entamoeba histolytica
NSTIPLGTFQPPVPTLSSPTSTLP

SEQ ID NO: 2722493 - protein, 32 aa, Entamoeba histolytica
NSTKYIMLKYRQWQLALRRAISFVDFLKDSSD

SEQ ID NO: 2722494 - protein, 24 aa, Entamoeba histolytica
NSTQQIYFYVLEMPIGLLMKEQSQ

SEQ ID NO: 2722495 - protein, 25 aa, Entamoeba histolytica
NSVAVDGILKLIPENKRMEASILLD

SEQ ID NO: 2722496 - protein, 28 aa, Entamoeba histolytica
NSVEVIVLLFILKINYPNSIYLLRGNHE

SEQ ID NO: 2722497 - protein, 45 aa, Entamoeba histolytica
NSVLISLCSLFIVTRKVFTMKDFVLSKALRFPMGLQFEELQSYMK

SEQ ID NO: 2722498 - protein, 21 aa, Entamoeba histolytica
NSVLVSRIVRNVMRKLMLNSR

SEQ ID NO: 2722499 - protein, 17 aa, Entamoeba histolytica
NSWFFLKEPEGSELGFS

SEQ ID NO: 2722500 - protein, 20 aa, Entamoeba histolytica
NSWIFGVGYGFHIRGEDKSY

SEQ ID NO: 2722501 - protein, 22 aa, Entamoeba histolytica
NSWNDYFPLIIQNLPITDTSNI

SEQ ID NO: 2722502 - protein, 26 aa, Entamoeba histolytica
NSWNNLTRLIFPPSLKIIGIGCFDNM

SEQ ID NO: 2722503 - protein, 27 aa, Entamoeba histolytica
NSYDNSIYFILLLCSLDIIIHENSLSF

SEQ ID NO: 2722504 - protein, 23 aa, Entamoeba histolytica
NSYFQNPSLSLYPSPRRVPDFQS

SEQ ID NO: 2722505 - protein, 25 aa, Entamoeba histolytica
NSYKRTPRLILLTKSLSNLEQLNKD

SEQ ID NO: 2722506 - protein, 44 aa, Entamoeba histolytica
NSYMGFCINLLPRGWHGLLSLTHMILLYYFPDVTIHLDKMKLTT

SEQ ID NO: 2722507 - protein, 28 aa, Entamoeba histolytica
NSYMSEPFPFIPLLLDENYRISGIVNQR

SEQ ID NO: 2722508 - protein, 23 aa, Entamoeba histolytica
NSYPINFGYIYPINDNVTLDYVS

SEQ ID NO: 2722509 - protein, 40 aa, Entamoeba histolytica
NSYPKFDEFFTQLHLYCLKNPFFYYEIDNEYLYVKTRLND

SEQ ID NO: 2722510 - protein, 17 aa, Entamoeba histolytica
NSYSPSRDYREVRSPPR

SEQ ID NO: 2722511 - protein, 25 aa, Entamoeba histolytica
NSYSSFPCFNLLTDSQQLLLKGMFD

SEQ ID NO: 2722512 - protein, 23 aa, Entamoeba histolytica
NSYYRDELFLKIIEIIKKDNYDN

SEQ ID NO: 2722513 - protein, 26 aa, Entamoeba histolytica
NTAFSSFFSILFSLSGKYLQTEISSS

SEQ ID NO: 2722514 - protein, 20 aa, Entamoeba histolytica
NTAFVLFRLIQEMAEFIGKD

SEQ ID NO: 2722515 - protein, 25 aa, Entamoeba histolytica
NTAGWFKGILYITNYRMLLDCDDTS

SEQ ID NO: 2722516 - protein, 35 aa, Entamoeba histolytica
NTAKFKGIPCFWGRIIKRLPYFTPNTKEYPIIEFI

SEQ ID NO: 2722517 - protein, 24 aa, Entamoeba histolytica
NTANGLYEMLWNKLAYKSNIPLDI

SEQ ID NO: 2722518 - protein, 28 aa, Entamoeba histolytica
NTCLLPPHLRYILRHIYNSVYLIRGEEA

SEQ ID NO: 2722519 - protein, 23 aa, Entamoeba histolytica
NTCSQMELIILYCIMKCKEEEYG

SEQ ID NO: 2722520 - protein, 17 aa, Entamoeba histolytica
NTDMVKLMKSLYVYLHE

SEQ ID NO: 2722521 - protein, 28 aa, Entamoeba histolytica
NTDNMFEFWDWVGGRYSLWSAIGLTIMI

SEQ ID NO: 2722522 - protein, 18 aa, Entamoeba histolytica
NTDVLIGILSRIVKLRNK

SEQ ID NO: 2722523 - protein, 23 aa, Entamoeba histolytica
NTEAPANMMFYLPEFHALCCADN

SEQ ID NO: 2722524 - protein, 43 aa, Entamoeba histolytica
NTEDEFTQMFWKLGMKNFDDFITKLLNLPRISLEKSREVLKRR

SEQ ID NO: 2722525 - protein, 26 aa, Entamoeba histolytica
NTEDEFTQMFWKLGMRNFDDFISKSV

SEQ ID NO: 2722526 - protein, 43 aa, Entamoeba histolytica
NTEDKFTQMFWELGMKNFDDFITKLLKLPRKSLEKSREVLKRR

SEQ ID NO: 2722527 - protein, 24 aa, Entamoeba histolytica
NTEDYYFILLRKVHLYAHSVGPNI

SEQ ID NO: 2722528 - protein, 21 aa, Entamoeba histolytica
NTEEFYFGRNLPLSTKEKNTL

SEQ ID NO: 2722529 - protein, 34 aa, Entamoeba histolytica; identical to SEQ ID NO: 2535336

SEQ ID NO: 2722530 - protein, 25 aa, Entamoeba histolytica
NTEIHKRLIIVGRPNDLIKEPGYEE

SEQ ID NO: 2722531 - protein, 29 aa, Entamoeba histolytica
NTEIVVFAFPIYYFNMPGPIKTLLDRFVP

SEQ ID NO: 2722532 - protein, 24 aa, Entamoeba histolytica
NTEKLSWRVFGPQGALIQNMVDFF

SEQ ID NO: 2722533 - protein, 25 aa, Entamoeba histolytica
NTEKLSWRVFGPQGALIQNMVDFFW

SEQ ID NO: 2722534 - protein, 21 aa, Entamoeba histolytica
NTELILYPDQPIVLAINSSPL

SEQ ID NO: 2722535 - protein, 25 aa, Entamoeba histolytica
NTENKSVVFPLTALSFIHTESNNKK

SEQ ID NO: 2722536 - protein, 37 aa, Entamoeba histolytica
NTENMTFFRQLYKNKVTFPSLFLFNKNGLSTVLTGEK

SEQ ID NO: 2722537 - protein, 17 aa, Entamoeba histolytica
NTEPLFDIKSHSPLIKT

SEQ ID NO: 2722538 - protein, 27 aa, Entamoeba histolytica
NTEPLFYTKRYLLIFNKCIEKLLENPE

SEQ ID NO: 2722539 - protein, 24 aa, Entamoeba histolytica
NTERMLKMFKIRDSIRGYSGELVN

SEQ ID NO: 2722540 - protein, 25 aa, Entamoeba histolytica
NTETNHFLAIFEFMVIRLGKDPSAK

SEQ ID NO: 2722541 - protein, 18 aa, Entamoeba histolytica
NTFAYIYAIKQRLNDPTS

SEQ ID NO: 2722542 - protein, 36 aa, Entamoeba histolytica
NTFDFILCIIRMISCKRFFLLPKLQQKNDVDMIVIL

SEQ ID NO: 2722543 - protein, 23 aa, Entamoeba histolytica
NTFEITLLLNAIDYYEKKNYEVT

SEQ ID NO: 2722544 - protein, 20 aa, Entamoeba histolytica
NTFHIIEKSFLRGEAYSELG

SEQ ID NO: 2722545 - protein, 20 aa, Entamoeba histolytica
NTFQLFLILSEFHQKQYQMK

SEQ ID NO: 2722546 - protein, 25 aa, Entamoeba histolytica
NTGKPLKPIMLWYSEHIYRETYITS

SEQ ID NO: 2722547 - protein, 23 aa, Entamoeba histolytica
NTHICHFQPIALPLQMVMNYYSQ

SEQ ID NO: 2722548 - protein, 27 aa, Entamoeba histolytica
NTHSKTMLPLARIIIEYKSLGCIPNLR

SEQ ID NO: 2722549 - protein, 27 aa, Entamoeba histolytica
NTHWKQTCFYFDLPFDNAAPGDIVKGV

SEQ ID NO: 2722550 - protein, 28 aa, Entamoeba histolytica
NTHWLTFHSGYDFGYMLKLLTCEKLPST

SEQ ID NO: 2722551 - protein, 18 aa, Entamoeba histolytica
NTIDHCYYYFSKISFFSK

SEQ ID NO: 2722552 - protein, 21 aa, Entamoeba histolytica
NTIHLFHHFFPCANVFVISSS

SEQ ID NO: 2722553 - protein, 26 aa, Entamoeba histolytica
NTIIEPISFLFIDTLTFNTINSKTQL

SEQ ID NO: 2722554 - protein, 23 aa, Entamoeba histolytica
NTIKLIFMKLLNEITEWGYGWEL

SEQ ID NO: 2722555 - protein, 26 aa, Entamoeba histolytica
NTIKPVCVIGWSTPNILAYLNILSKV

SEQ ID NO: 2722556 - protein, 22 aa, Entamoeba histolytica
NTIKVLYWRQNFAHIGKDVSVN

SEQ ID NO: 2722557 - protein, 17 aa, Entamoeba histolytica
NTILHNNCVSLNWLDKI

SEQ ID NO: 2722558 - protein, 21 aa, Entamoeba histolytica
NTILTYCGVVLSIQKFETQQF

SEQ ID NO: 2722559 - protein, 17 aa, Entamoeba histolytica
NTILYSHSPICELSIGI

SEQ ID NO: 2722560 - protein, 27 aa, Entamoeba histolytica
NTINPHSIIDFLYNFFEQKMNTSCEDE

SEQ ID NO: 2722561 - protein, 18 aa, Entamoeba histolytica
NTIPLYDFNIMFSNFGIS

SEQ ID NO: 2722562 - protein, 19 aa, Entamoeba histolytica
NTKEFLNPPLILQRCMTLT

SEQ ID NO: 2722563 - protein, 18 aa, Entamoeba histolytica
NTKKIPSYGFIKNDPGHF

SEQ ID NO: 2722564 - protein, 20 aa, Entamoeba histolytica
NTKLEIGMHTAIMPSYLSHI

SEQ ID NO: 2722565 - protein, 37 aa, Entamoeba histolytica
NTKSNVSKYYFFKRLPWILPIQLKRFTWDEKKINGKV

SEQ ID NO: 2722566 - protein, 25 aa, Entamoeba histolytica
NTKTLNLIMIMDIERSWKGLLENAF

SEQ ID NO: 2722567 - protein, 26 aa, Entamoeba histolytica
NTKVYERLFDYFPSNKYRKFVDCKKH

SEQ ID NO: 2722568 - protein, 17 aa, Entamoeba histolytica
NTLALTHKNLCNQGKES

SEQ ID NO: 2722569 - protein, 26 aa, Entamoeba histolytica
NTLEYINLNYTWGFSPGVFIEGRIAV

SEQ ID NO: 2722570 - protein, 17 aa, Entamoeba histolytica
NTLFMQQIKYPTTISLL

SEQ ID NO: 2722571 - protein, 24 aa, Entamoeba histolytica
NTLFTYSNFLSNLFKPLFEVSQNP

SEQ ID NO: 2722572 - protein, 19 aa, Entamoeba histolytica
NTLHLIQPYTIEVLTHNKC

SEQ ID NO: 2722573 - protein, 21 aa, Entamoeba histolytica
NTLIHELQPKLNFGLTTCGEL

SEQ ID NO: 2722574 - protein, 29 aa, Entamoeba histolytica
NTLIVNTFNNYYYFLIKLSECVDKFDSND

SEQ ID NO: 2722575 - protein, 30 aa, Entamoeba histolytica
NTLKNETVWRLIFNFLARNGCFMKYVNTTE

SEQ ID NO: 2722576 - protein, 18 aa, Entamoeba histolytica
NTLLKKNLRSIDYKYCLF

SEQ ID NO: 2722577 - protein, 17 aa, Entamoeba histolytica
NTLLLFNEDGIWKECNK

SEQ ID NO: 2722578 - protein, 28 aa, Entamoeba histolytica
NTLLVHSPFWKEIIKCTITLTPIIAVIQ

SEQ ID NO: 2722579 - protein, 20 aa, Entamoeba histolytica
NTLVYIRNFEQNKAIGLIAE

SEQ ID NO: 2722580 - protein, 25 aa, Entamoeba histolytica
NTMAATINFLLELLQKMGCEYKEKG

SEQ ID NO: 2722581 - protein, 24 aa, Entamoeba histolytica
NTMDVLIYALRMNALVALKAKKNG

SEQ ID NO: 2722582 - protein, 17 aa, Entamoeba histolytica
NTMKLYFKYLHLERWFN

SEQ ID NO: 2722583 - protein, 20 aa, Entamoeba histolytica
NTMVLLSFYNACNKIPELID

SEQ ID NO: 2722584 - protein, 23 aa, Entamoeba histolytica
NTNDEKVLKASISSLLLSSSSEE

SEQ ID NO: 2722585 - protein, 27 aa, Entamoeba histolytica
NTNEKIYGIGFLFLINDKKTKYDVIMY

SEQ ID NO: 2722586 - protein, 22 aa, Entamoeba histolytica
NTNELIKPFYKTIFTSTSKGFV

SEQ ID NO: 2722587 - protein, 25 aa, Entamoeba histolytica
NTNGIKWNTLWFDVEKDSWSSNVAT

SEQ ID NO: 2722588 - protein, 25 aa, Entamoeba histolytica
NTNGSQFFITTVPCPWLDGKHVVFG

SEQ ID NO: 2722589 - protein, 25 aa, Entamoeba histolytica
NTNKNFHLKSMGFIGVIITINGKRI

SEQ ID NO: 2722590 - protein, 29 aa, Entamoeba histolytica
NTNMNLVDFPPIPLSLNILSTISIINLNN

SEQ ID NO: 2722591 - protein, 23 aa, Entamoeba histolytica
NTNMRFDPYVFLSLAIPNKQNSV

SEQ ID NO: 2722592 - protein, 25 aa, Entamoeba histolytica
NTNSLKFELILPSSLQKLFIFSSKF

SEQ ID NO: 2722593 - protein, 24 aa, Entamoeba histolytica
NTNSPYYRELIPKPMFDALFEKAK

SEQ ID NO: 2722594 - protein, 25 aa, Entamoeba histolytica
NTNTIIDMLIVLINTLRANNSDNAI

SEQ ID NO: 2722595 - protein, 23 aa, Entamoeba histolytica
NTPFHYLKVIPPTTPKLTACDPT

SEQ ID NO: 2722596 - protein, 22 aa, Entamoeba histolytica
NTPGEAFFTFLINKKEKRVKIN

SEQ ID NO: 2722597 - protein, 22 aa, Entamoeba histolytica
NTPILTIPLQRTVVSLVASMGD

SEQ ID NO: 2722598 - protein, 18 aa, Entamoeba histolytica
NTPIYPIKRRTDSLPIPV

SEQ ID NO: 2722599 - protein, 24 aa, Entamoeba histolytica
NTPIYQEIKIYNIIKEGYQRIKKG

SEQ ID NO: 2722600 - protein, 19 aa, Entamoeba histolytica
NTPLKKLMEAFCNKQGLNM

SEQ ID NO: 2722601 - protein, 29 aa, Entamoeba histolytica
NTPPSKLVYVFLFNDVLLETKPLKIAGKS

SEQ ID NO: 2722602 - protein, 23 aa, Entamoeba histolytica
NTPRDESFRLIYGKELKEAFEYC

SEQ ID NO: 2722603 - protein, 22 aa, Entamoeba histolytica
NTPRNMLYFLTNKKITDEDVKL

SEQ ID NO: 2722604 - protein, 18 aa, Entamoeba histolytica
NTPTIKALIIIDLDGKRL

SEQ ID NO: 2722605 - protein, 21 aa, Entamoeba histolytica
NTPVIGQFTYNPITPHFQFQQ

SEQ ID NO: 2722606 - protein, 17 aa, Entamoeba histolytica
NTPYLSDFAPYKPFYIP

SEQ ID NO: 2722607 - protein, 22 aa, Entamoeba histolytica
NTQEHLDIIPSDNPIKNIQNIN

SEQ ID NO: 2722608 - protein, 22 aa, Entamoeba histolytica
NTQFAFSSFENAFSGDFSFDTP

SEQ ID NO: 2722609 - protein, 18 aa, Entamoeba histolytica
NTQILLGIRISRCKILVD

SEQ ID NO: 2722610 - protein, 24 aa, Entamoeba histolytica
NTQPFVFTMIKAENKLQFFGKSHE

SEQ ID NO: 2722611 - protein, 25 aa, Entamoeba histolytica
NTQPIQFIPQMIPGQNPQMIHTIQG

SEQ ID NO: 2722612 - protein, 27 aa, Entamoeba histolytica
NTQRDYPIPSFIPPPAKPFINYTNPFL

SEQ ID NO: 2722613 - protein, 22 aa, Entamoeba histolytica
NTRIFNIITYHQVPIIDEPIPD

SEQ ID NO: 2722614 - protein, 17 aa, Entamoeba histolytica
NTRLSLLTFVIPTMLGI

SEQ ID NO: 2722615 - protein, 25 aa, Entamoeba histolytica
NTRLTEVILSPYIRSIPPNCFLECI

SEQ ID NO: 2722616 - protein, 25 aa, Entamoeba histolytica
NTSDTFLINLLKRYYTDIPQDHLKR

SEQ ID NO: 2722617 - protein, 23 aa, Entamoeba histolytica
NTSLNFMLPCGSTTFYMRCVGTC

SEQ ID NO: 2722618 - protein, 26 aa, Entamoeba histolytica
NTSRMTSFLFGAKSLIPFLETNNLTC

SEQ ID NO: 2722619 - protein, 33 aa, Entamoeba histolytica
NTTFDCQIPVIHLLFPIALKYSLIQSSPKSIQD

SEQ ID NO: 2722620 - protein, 26 aa, Entamoeba histolytica
NTTFESVLHYFSFFGKVRAITQDGND

SEQ ID NO: 2722621 - protein, 20 aa, Entamoeba histolytica
NTTFGFYLEAINKVGLDIYK

SEQ ID NO: 2722622 - protein, 26 aa, Entamoeba histolytica
NTTGDYFYNYFSRGFDILFDSTTHCI

SEQ ID NO: 2722623 - protein, 28 aa, Entamoeba histolytica
NTTIGNIFLTFIPFLKVYNEYCSNFRHT

SEQ ID NO: 2722624 - protein, 23 aa, Entamoeba histolytica
NTTILPKPIIPTSTPILQKPIIP

SEQ ID NO: 2722625 - protein, 34 aa, Entamoeba histolytica
NTTLSSLLKKFIRNLKSPIWPEEFLQPLVSCMDS

SEQ ID NO: 2722626 - protein, 26 aa, Entamoeba histolytica
NTTNQSFLPILQIKLKKTSPIEKQEL

SEQ ID NO: 2722627 - protein, 25 aa, Entamoeba histolytica
NTVFGLDEFLSLVQPKWEEESKHFM

SEQ ID NO: 2722628 - protein, 20 aa, Entamoeba histolytica
NTVFLVYELFPRNLSESIKS

SEQ ID NO: 2722629 - protein, 19 aa, Entamoeba histolytica
NTVILLTQLFSYSPLMVVR

SEQ ID NO: 2722630 - protein, 27 aa, Entamoeba histolytica
NTVITNYIQFFSRLFIIKRVVKEDDLT

SEQ ID NO: 2722631 - protein, 31 aa, Entamoeba histolytica; identical to SEQ ID NO: 2535423

SEQ ID NO: 2722632 - protein, 20 aa, Entamoeba histolytica
NTVLTINKVGYRFTFNDCNG

SEQ ID NO: 2722633 - protein, 25 aa, Entamoeba histolytica
NTVRLFDHFLYYNHVCIVTELLGIN

SEQ ID NO: 2722634 - protein, 23 aa, Entamoeba histolytica
NTVRLVDHFLYHSHLCIVTELLG

SEQ ID NO: 2722635 - protein, 24 aa, Entamoeba histolytica
NTWPIQMITYPKDPITICIKAISG

SEQ ID NO: 2722636 - protein, 20 aa, Entamoeba histolytica
NTYHFRIAILPPENEIQNIA

SEQ ID NO: 2722637 - protein, 19 aa, Entamoeba histolytica
NVALKPVLIVRLGDKLYPT

SEQ ID NO: 2722638 - protein, 24 aa, Entamoeba histolytica
NVALRWIDVAKPMTRLRCAGFTKE

SEQ ID NO: 2722639 - protein, 19 aa, Entamoeba histolytica
NVCLKPQPLMALIQSNKTS

SEQ ID NO: 2722640 - protein, 20 aa, Entamoeba histolytica
NVCMELLLGINKLETFQEFV

SEQ ID NO: 2722641 - protein, 27 aa, Entamoeba histolytica
NVCVMVSRWFGGILLGPDRFKDIIMAA

SEQ ID NO: 2722642 - protein, 22 aa, Entamoeba histolytica
NVDDVLIPVKEAQAAAVTAARD

SEQ ID NO: 2722643 - protein, 26 aa, Entamoeba histolytica
NVDGDLCHWLDLLKFPIKSIQLVQKW

SEQ ID NO: 2722644 - protein, 32 aa, Entamoeba histolytica
NVDILFQQIGRLLFQKNLVLSINTPQPFPKLK

SEQ ID NO: 2722645 - protein, 18 aa, Entamoeba histolytica
NVDTLLVSVIRSFKQKNP

SEQ ID NO: 2722646 - protein, 23 aa, Entamoeba histolytica
NVEEAFMTLLKKIYDDSSKSVDG

SEQ ID NO: 2722647 - protein, 24 aa, Entamoeba histolytica
NVEQHPFYPLTMEFSTIPSNERQI

SEQ ID NO: 2722648 - protein, 27 aa, Entamoeba histolytica
NVETPLANPFSLNGFSFGTSTDKQKDT

SEQ ID NO: 2722649 - protein, 18 aa, Entamoeba histolytica
NVEYRQKLMEKEDSILLL

SEQ ID NO: 2722650 - protein, 17 aa, Entamoeba histolytica
NVFHLNKVTKILSIAHS

SEQ ID NO: 2722651 - protein, 18 aa, Entamoeba histolytica
NVFHLNKVTKILSIAHSK

SEQ ID NO: 2722652 - protein, 24 aa, Entamoeba histolytica
NVFNIIMRKYNLAAGDFPPIQLYK

SEQ ID NO: 2722653 - protein, 26 aa, Entamoeba histolytica
NVFNNKLYKKLYYPYLYEGEYNIFLS

SEQ ID NO: 2722654 - protein, 26 aa, Entamoeba histolytica
NVFQKDYILFLFDVSIPIIKSTNVKA

SEQ ID NO: 2722655 - protein, 25 aa, Entamoeba histolytica
NVFVSRGFITLQDTFKFIINSKITQ

SEQ ID NO: 2722656 - protein, 22 aa, Entamoeba histolytica
NVGLISHLLEMIRIGFTCNPFK

SEQ ID NO: 2722657 - protein, 28 aa, Entamoeba histolytica
NVGNEILTIKLLLLFGDHLFSTPKISKQ

SEQ ID NO: 2722658 - protein, 24 aa, Entamoeba histolytica
NVGSPLMVYVPKSLEIISSESLVN

SEQ ID NO: 2722659 - protein, 25 aa, Entamoeba histolytica
NVHDPQACIPYYQKYFTSADHNNYI

SEQ ID NO: 2722660 - protein, 18 aa, Entamoeba histolytica
NVHFVYIIDFGLSKKYIE

SEQ ID NO: 2722661 - protein, 20 aa, Entamoeba histolytica
NVIEWKNGVKVIFADETVVN

SEQ ID NO: 2722662 - protein, 18 aa, Entamoeba histolytica
NVIFYLQTIDELVNFLQI

SEQ ID NO: 2722663 - protein, 19 aa, Entamoeba histolytica
NVIINEKNIEVYPDGTLKP

SEQ ID NO: 2722664 - protein, 19 aa, Entamoeba histolytica
NVIIWTLFDEAHSTTMLEE

SEQ ID NO: 2722665 - protein, 33 aa, Entamoeba histolytica; identical to SEQ ID NO: 2535454

SEQ ID NO: 2722666 - protein, 21 aa, Entamoeba histolytica
NVIKLILPNEEIVLTALNSHE

SEQ ID NO: 2722667 - protein, 24 aa, Entamoeba histolytica
NVIKRILYCLVAIDKIKYTQGMNE

SEQ ID NO: 2722668 - protein, 17 aa, Entamoeba histolytica
NVILYQIGDKYIPSPYI

SEQ ID NO: 2722669 - protein, 33 aa, Entamoeba histolytica
NVIPLFSRFRHISPPMLFFVTSNNQLVSVTFKP

SEQ ID NO: 2722670 - protein, 34 aa, Entamoeba histolytica
NVIPQVVFNLCWWIYTYGYLVEGIFRVSGDTEFT

SEQ ID NO: 2722671 - protein, 22 aa, Entamoeba histolytica
NVISFVQAFEWIRENAQEFVQL

SEQ ID NO: 2722672 - protein, 19 aa, Entamoeba histolytica
NVISFYKDYFNDFLGKINA

SEQ ID NO: 2722673 - protein, 18 aa, Entamoeba histolytica
NVIVWKKSNKTSVNPYFE

SEQ ID NO: 2722674 - protein, 27 aa, Entamoeba histolytica
NVKIRKESCIILLNKQEFMFGNTKEKD

SEQ ID NO: 2722675 - protein, 18 aa, Entamoeba histolytica
NVKMVYAVNRGPFTMIFN

SEQ ID NO: 2722676 - protein, 19 aa, Entamoeba histolytica
NVKMVYAVNRGPFTMIFND

SEQ ID NO: 2722677 - protein, 22 aa, Entamoeba histolytica
NVKPYIFGLKLISTYVGHLPMN

SEQ ID NO: 2722678 - protein, 25 aa, Entamoeba histolytica
NVKSWKKRWFVFTTDGNISYYTNRQ

SEQ ID NO: 2722679 - protein, 26 aa, Entamoeba histolytica
NVKVSYCNIILYIPIKKFTVRVLNGN

SEQ ID NO: 2722680 - protein, 29 aa, Entamoeba histolytica
NVKVYIKDKIWEIIWNCIFEYNKDTIKNN

SEQ ID NO: 2722681 - protein, 17 aa, Entamoeba histolytica
NVKYTHVLLLIELAKVI

SEQ ID NO: 2722682 - protein, 28 aa, Entamoeba histolytica
NVLAPFIITFKLLPLIRKTQNSRVIEVG

SEQ ID NO: 2722683 - protein, 17 aa, Entamoeba histolytica
NVLFFHCKLLAFHISED

SEQ ID NO: 2722684 - protein, 24 aa, Entamoeba histolytica
NVLGTVCWALFFVVTRAAKQNPTF

SEQ ID NO: 2722685 - protein, 19 aa, Entamoeba histolytica
NVLHLFRAMTLHKAILMEG

SEQ ID NO: 2722686 - protein, 35 aa, Entamoeba histolytica
NVLISLPIDISLPLYHSFPLINSYMSEPFPFIPLL

SEQ ID NO: 2722687 - protein, 17 aa, Entamoeba histolytica
NVLLIQKSILREGVSDL

SEQ ID NO: 2722688 - protein, 18 aa, Entamoeba histolytica
NVLNIFSWAMPCKRICIE

SEQ ID NO: 2722689 - protein, 25 aa, Entamoeba histolytica
NVLPMREMHFASKKAFLVVISSNEV

SEQ ID NO: 2722690 - protein, 28 aa, Entamoeba histolytica
NVMDNQLFKFILKQYEFDELGKGIILLD

SEQ ID NO: 2722691 - protein, 18 aa, Entamoeba histolytica
NVMIFIKTENNSLIGSFT

SEQ ID NO: 2722692 - protein, 20 aa, Entamoeba histolytica
NVMVDKFFSFSLQSNLKLQD

SEQ ID NO: 2722693 - protein, 18 aa, Entamoeba histolytica
NVNLKIIATFIKVNKEYQ

SEQ ID NO: 2722694 - protein, 22 aa, Entamoeba histolytica
NVNLNEEWLKKPENQVLKQKAL

SEQ ID NO: 2722695 - protein, 25 aa, Entamoeba histolytica
NVNPFIKRIYYLMKEPQYLEWKLNN

SEQ ID NO: 2722696 - protein, 26 aa, Entamoeba histolytica
NVNSYYNPIHFISISLSPNCPIINQF

SEQ ID NO: 2722697 - protein, 21 aa, Entamoeba histolytica
NVNYYISCVIFYITHIRNSKR

SEQ ID NO: 2722698 - protein, 23 aa, Entamoeba histolytica
NVPFVFTRSLIIVLGKYGRFFHD

SEQ ID NO: 2722699 - protein, 34 aa, Entamoeba histolytica
NVQANQQSVFLALINKYFTITLISPKKRSTVAQQ

SEQ ID NO: 2722700 - protein, 21 aa, Entamoeba histolytica
NVQAWINAIPEHLGLLEEDMP

SEQ ID NO: 2722701 - protein, 32 aa, Entamoeba histolytica
NVQDLALHYCDRAGIIVIRVGSTFDLKRLCRV

SEQ ID NO: 2722702 - protein, 26 aa, Entamoeba histolytica
NVQDLPFKLVLYPPTTNTLTLLSKLH

SEQ ID NO: 2722703 - protein, 19 aa, Entamoeba histolytica
NVQKIRKHNLRPRIQSSKA

SEQ ID NO: 2722704 - protein, 32 aa, Entamoeba histolytica
NVQLRSYKMIICEGFLFFYSSKETFVVALGYY

SEQ ID NO: 2722705 - protein, 29 aa, Entamoeba histolytica
NVQYRSPNSLILPPLHDSTAPIVTHSPML

SEQ ID NO: 2722706 - protein, 26 aa, Entamoeba histolytica
NVRIVDYTTRIALRDLRHCHINTLIR

SEQ ID NO: 2722707 - protein, 19 aa, Entamoeba histolytica
NVRNYFPNAPLYIPVDLET

SEQ ID NO: 2722708 - protein, 17 aa, Entamoeba histolytica
NVRSTLFAASPRALITL

SEQ ID NO: 2722709 - protein, 26 aa, Entamoeba histolytica
NVSKDWMIFGISRFEKMIICWINIMG

SEQ ID NO: 2722710 - protein, 23 aa, Entamoeba histolytica
NVSQALFALFNILTKIISDDDMV

SEQ ID NO: 2722711 - protein, 33 aa, Entamoeba histolytica
NVSQICIPLRADVSLWFIAHSCLSKIPPANNPF

SEQ ID NO: 2722712 - protein, 18 aa, Entamoeba histolytica
NVSQLQPLPLPVQTEFPL

SEQ ID NO: 2722713 - protein, 26 aa, Entamoeba histolytica
NVSVFVNSLILFLLELSHCGSQTNTN

SEQ ID NO: 2722714 - protein, 29 aa, Entamoeba histolytica
NVSYPFLISNILRLLYKFPSLNKGYELMK

SEQ ID NO: 2722715 - protein, 27 aa, Entamoeba histolytica
NVTDLFITLARDVLVKQPKIINKPPPA

SEQ ID NO: 2722716 - protein, 25 aa, Entamoeba histolytica
NVTERKTIIPLYFGEFVVVTESKKV

SEQ ID NO: 2722717 - protein, 27 aa, Entamoeba histolytica
NVTNGFMSILLFQITIAPILDNPSIIC

SEQ ID NO: 2722718 - protein, 19 aa, Entamoeba histolytica
NVTWKCRSIGAYYGEPSYS

SEQ ID NO: 2722719 - protein, 31 aa, Entamoeba histolytica
NVVLFNKLIQKILILPLSLPKELFNEDTFSN

SEQ ID NO: 2722720 - protein, 25 aa, Entamoeba histolytica
NVVQSLNVFYLTKTVWLFEGEKISH

SEQ ID NO: 2722721 - protein, 34 aa, Entamoeba histolytica
NVVTYIECYLINEMLWLVMEYMDGGCLTDIIDRH

SEQ ID NO: 2722722 - protein, 18 aa, Entamoeba histolytica
NVVVLHNIPFLICIKQNC

SEQ ID NO: 2722723 - protein, 21 aa, Entamoeba histolytica
NVVVYLYDYHRIGWDVFMGAV

SEQ ID NO: 2722724 - protein, 28 aa, Entamoeba histolytica
NVYQPGYALSYILPNKLYGVFGMGESLE

SEQ ID NO: 2722725 - protein, 18 aa, Entamoeba histolytica
NWAVTVLNHLVFCNPKNL

SEQ ID NO: 2722726 - protein, 23 aa, Entamoeba histolytica
NWEFGEFLSFQDIAIYGTLIGLL

SEQ ID NO: 2722727 - protein, 18 aa, Entamoeba histolytica
NWENFNHRFIKIGNTLLL

SEQ ID NO: 2722728 - protein, 19 aa, Entamoeba histolytica
NWIIEIIRGILITTYPPKK

SEQ ID NO: 2722729 - protein, 29 aa, Entamoeba histolytica
NWIKEDPQIYYLRILQLLLRNEENHHQSI

SEQ ID NO: 2722730 - protein, 28 aa, Entamoeba histolytica
NWKKECAYLRWIYITLNAGKHFYKKHLD

SEQ ID NO: 2722731 - protein, 18 aa, Entamoeba histolytica
NWKNPKIMCTSEGGVFFV

SEQ ID NO: 2722732 - protein, 17 aa, Entamoeba histolytica
NWRYVFITENISAMMKP

SEQ ID NO: 2722733 - protein, 24 aa, Entamoeba histolytica
NWTNQRAFKVLYNSNFEGLNCEYL

SEQ ID NO: 2722734 - protein, 19 aa, Entamoeba histolytica
NWVGKITLRLLWDLICLST

SEQ ID NO: 2722735 - protein, 28 aa, Entamoeba histolytica
NYAIKVPGRIWPLMVNPTTVIISSYDTI

SEQ ID NO: 2722736 - protein, 26 aa, Entamoeba histolytica
NYAQQEYLMRKKAFDALKRIRMLRRN

SEQ ID NO: 2722737 - protein, 19 aa, Entamoeba histolytica
NYAVVMPKSYHLISEKMCI

SEQ ID NO: 2722738 - protein, 54 aa, Entamoeba histolytica
NYCFTAARDFLGIPIIMEPSLVASGFLDDEVLTMYLVYYVLNDKNIRDDEEIKF

SEQ ID NO: 2722739 - protein, 21 aa, Entamoeba histolytica
NYCIIKIPIIGSNLGEMQIEQ

SEQ ID NO: 2722740 - protein, 34 aa, Entamoeba histolytica
NYCVDPYHFIFSLLSDSIPPTKWMKVPTPQRVLN

SEQ ID NO: 2722741 - protein, 24 aa, Entamoeba histolytica
NYDFIYEPLERYRYDASLRSDGYM

SEQ ID NO: 2722742 - protein, 21 aa, Entamoeba histolytica
NYDFMLDIIKLLQQLLENKAD

SEQ ID NO: 2722743 - protein, 25 aa, Entamoeba histolytica
NYDIKVLINIILRYHGIKLTDGKKT

SEQ ID NO: 2722744 - protein, 18 aa, Entamoeba histolytica
NYDMPLNREVYIHRIGRS

SEQ ID NO: 2722745 - protein, 17 aa, Entamoeba histolytica
NYDNFPMAYPPFNAERH

SEQ ID NO: 2722746 - protein, 21 aa, Entamoeba histolytica
NYDNLILQFKQINTILIEYHS

SEQ ID NO: 2722747 - protein, 19 aa, Entamoeba histolytica
NYEAPKHYTWHYVVRSYDS

SEQ ID NO: 2722748 - protein, 28 aa, Entamoeba histolytica
NYEKKKRIFINNFLIDVCLELGYLFESK

SEQ ID NO: 2722749 - protein, 25 aa, Entamoeba histolytica
NYELIMDLLHYLITNKPIGCILIFL

SEQ ID NO: 2722750 - protein, 24 aa, Entamoeba histolytica
NYERIKIKLMPWKEDNPVVKNSCV

SEQ ID NO: 2722751 - protein, 17 aa, Entamoeba histolytica
NYFCFRSQYGKKLYVKI

SEQ ID NO: 2722752 - protein, 20 aa, Entamoeba histolytica
NYFIETFISPNIDSLRRNTH

SEQ ID NO: 2722753 - protein, 18 aa, Entamoeba histolytica
NYFKQIVMGVSAIHQHCI

SEQ ID NO: 2722754 - protein, 18 aa, Entamoeba histolytica
NYFNSLIPLGVNIIEQSV

SEQ ID NO: 2722755 - protein, 23 aa, Entamoeba histolytica
NYGDLKIHFKIQNPTYLSQQQKD

SEQ ID NO: 2722756 - protein, 17 aa, Entamoeba histolytica
NYGFPCLIGSRKLKEDN

SEQ ID NO: 2722757 - protein, 18 aa, Entamoeba histolytica
NYGKIEELFLWAFKEENC

SEQ ID NO: 2722758 - protein, 26 aa, Entamoeba histolytica
NYGNKKWIITLLYELSVYKDQLLNVL

SEQ ID NO: 2722759 - protein, 20 aa, Entamoeba histolytica
NYHLVAYLYYDSNCTKYYTK

SEQ ID NO: 2722760 - protein, 24 aa, Entamoeba histolytica
NYHRTKYYDNLLYSIIKNITNKEI

SEQ ID NO: 2722761 - protein, 24 aa, Entamoeba histolytica
NYIHQFVMMFDAGSVYFNENEAMN

SEQ ID NO: 2722762 - protein, 18 aa, Entamoeba histolytica
NYIILHMTTSSGKSAFIC

SEQ ID NO: 2722763 - protein, 19 aa, Entamoeba histolytica
NYIKKKAAAAALRIIRKCP

SEQ ID NO: 2722764 - protein, 25 aa, Entamoeba histolytica
NYIKPTPIQAIGWPIVLQGKDVVGI

SEQ ID NO: 2722765 - protein, 18 aa, Entamoeba histolytica
NYILSKLNILKKKSSEDP

SEQ ID NO: 2722766 - protein, 25 aa, Entamoeba histolytica
NYIQNYVPIFSLPQEWLWCESWCNQ

SEQ ID NO: 2722767 - protein, 19 aa, Entamoeba histolytica
NYIYHTYPQVYFNTLDHCY

SEQ ID NO: 2722768 - protein, 20 aa, Entamoeba histolytica
NYIYHTYPQVYFNTLDHCYY

SEQ ID NO: 2722769 - protein, 21 aa, Entamoeba histolytica
NYKAIIIWGLPDKLSHYDAEL

SEQ ID NO: 2722770 - protein, 28 aa, Entamoeba histolytica
NYKAPELLLYIHYYTPAVDIWSCGCVLA

SEQ ID NO: 2722771 - protein, 25 aa, Entamoeba histolytica
NYKPINIFLNFLESNKITFDCIGNE

SEQ ID NO: 2722772 - protein, 18 aa, Entamoeba histolytica
NYKTEITPFVKLLTDSKE

SEQ ID NO: 2722773 - protein, 19 aa, Entamoeba histolytica
NYKVLLMRDIIKGGKELAK

SEQ ID NO: 2722774 - protein, 25 aa, Entamoeba histolytica
NYKVVFVVKCVIFNVSIPLTKIADF

SEQ ID NO: 2722775 - protein, 23 aa, Entamoeba histolytica
NYKVVFVVKCVIFNVSISLTKIA

SEQ ID NO: 2722776 - protein, 22 aa, Entamoeba histolytica
NYLDGFTISRLPRMKKGLVKFK

SEQ ID NO: 2722777 - protein, 19 aa, Entamoeba histolytica
NYLHVLPIPNQFASLESYG

SEQ ID NO: 2722778 - protein, 17 aa, Entamoeba histolytica
NYLLLLREGNRGLPDNF

SEQ ID NO: 2722779 - protein, 26 aa, Entamoeba histolytica
NYLQIKEIVPYIPPIALTCGIKCKRI

SEQ ID NO: 2722780 - protein, 38 aa, Entamoeba histolytica
NYLRVTRIFNSLHAFGLKPYMVSLFSFFKENIQHFKNC

SEQ ID NO: 2722781 - protein, 26 aa, Entamoeba histolytica
NYLSEGLYLFNYNGREIPLRVSLNTQ

SEQ ID NO: 2722782 - protein, 25 aa, Entamoeba histolytica
NYLSYNNIIISYPPLMLHSSHSLSM

SEQ ID NO: 2722783 - protein, 17 aa, Entamoeba histolytica
NYLTNNYFAWTGSIPYV

SEQ ID NO: 2722784 - protein, 18 aa, Entamoeba histolytica
NYLVWKYSFEKRGIYLTK

SEQ ID NO: 2722785 - protein, 37 aa, Entamoeba histolytica
NYNFEKEVFFIKITLRLPKYVPLLRHILQETQRVNNR

SEQ ID NO: 2722786 - protein, 25 aa, Entamoeba histolytica
NYNHQLGILYIYHIKCNIEGFKVMK

SEQ ID NO: 2722787 - protein, 26 aa, Entamoeba histolytica
NYNLVKTLFYHITALRFNDDLLHQFV

SEQ ID NO: 2722788 - protein, 21 aa, Entamoeba histolytica
NYNPYIRHCMYGLDADLIMLA

SEQ ID NO: 2722789 - protein, 22 aa, Entamoeba histolytica
NYNRIRIKLQPWKEDNPVVKNS

SEQ ID NO: 2722790 - protein, 23 aa, Entamoeba histolytica
NYNRIRIKLQPWKENNPVVKNSR

SEQ ID NO: 2722791 - protein, 23 aa, Entamoeba histolytica
NYNRVRILFKFIVSILKVKSYDN

SEQ ID NO: 2722792 - protein, 25 aa, Entamoeba histolytica
NYPMDKNMYLVRWDNYSLLEATWIL

SEQ ID NO: 2722793 - protein, 25 aa, Entamoeba histolytica
NYQDTSIFIYLPRNYNFVNQCIDRM

SEQ ID NO: 2722794 - protein, 27 aa, Entamoeba histolytica
NYQRKKLGRYLLRQVYSFILSDKDFDL

SEQ ID NO: 2722795 - protein, 25 aa, Entamoeba histolytica
NYQTPSLYVPIPSPSSTLPPRQRYS

SEQ ID NO: 2722796 - protein, 20 aa, Entamoeba histolytica
NYRCVIPLGVDPAKYDKAFP

SEQ ID NO: 2722797 - protein, 23 aa, Entamoeba histolytica
NYRIKLYYEYLKSHTFNRVIHCD

SEQ ID NO: 2722798 - protein, 22 aa, Entamoeba histolytica
NYSEILGFLKENNIDVAGCSAE

SEQ ID NO: 2722799 - protein, 18 aa, Entamoeba histolytica
NYSFFERAVLTHKSYLYL

SEQ ID NO: 2722800 - protein, 27 aa, Entamoeba histolytica
NYSLIYGQLVPILASPLQFFPSVVTPK

SEQ ID NO: 2722801 - protein, 22 aa, Entamoeba histolytica
NYSNWGFPKPLFLDGTEVCDTQ

SEQ ID NO: 2722802 - protein, 31 aa, Entamoeba histolytica; identical to SEQ ID NO: 2535580

SEQ ID NO: 2722803 - protein, 26 aa, Entamoeba histolytica
NYTLLDDIHFIDLFNHLQKKIVSQTQ

SEQ ID NO: 2722804 - protein, 33 aa, Entamoeba histolytica
NYTSDLQDGIIFRDLLRTLGIPCGNSLEDVITA

SEQ ID NO: 2722805 - protein, 27 aa, Entamoeba histolytica
NYTTIGRTLFLYLAKKNNNNKKQEGSL

SEQ ID NO: 2722806 - protein, 21 aa, Entamoeba histolytica
NYVDIIYGEPLFGSDIWIVEV

SEQ ID NO: 2722807 - protein, 19 aa, Entamoeba histolytica
NYVFCVPYAFAIVGSGKSA

SEQ ID NO: 2722808 - protein, 24 aa, Entamoeba histolytica
NYVQRVLEVIPEQVFLLINSIAKL

SEQ ID NO: 2722809 - protein, 17 aa, Entamoeba histolytica
NYWGCIEKILSALQGQI

SEQ ID NO: 2722810 - protein, 22 aa, Entamoeba histolytica
NYYDRICFALKLLSTHDPRCLD

SEQ ID NO: 2722811 - protein, 26 aa, Entamoeba histolytica
NYYGKQCYLLNMLLETKEWTLLLDNS

SEQ ID NO: 2722812 - protein, 20 aa, Entamoeba histolytica
NYYPQLIFIISPIVIENIQS

SEQ ID NO: 2722813 - protein, 26 aa, Entamoeba histolytica
PAAPGLSLIIRCYPGFQAVIVYRIAH

SEQ ID NO: 2722814 - protein, 22 aa, Entamoeba histolytica
PAAWTIFMDVFDYFSVAAVIDN

SEQ ID NO: 2722815 - protein, 30 aa, Entamoeba histolytica; identical to SEQ ID NO: 2535589

SEQ ID NO: 2722816 - protein, 28 aa, Entamoeba histolytica
PADPRLPKPLFAWNLPKGYESVLKKAFK

SEQ ID NO: 2722817 - protein, 18 aa, Entamoeba histolytica
PAELLFTINLIDKMNKII

SEQ ID NO: 2722818 - protein, 21 aa, Entamoeba histolytica
PAFCYHGVLGKYILSPSVTEM

SEQ ID NO: 2722819 - protein, 31 aa, Entamoeba histolytica
PAGFIRQFNPKRILLVGGVLRSEEQLTVMQA

SEQ ID NO: 2722820 - protein, 19 aa, Entamoeba histolytica
PAIPISIWPLKKETDEYHQ

SEQ ID NO: 2722821 - protein, 20 aa, Entamoeba histolytica
PALLRGGRLGDWIYLGLPSD

SEQ ID NO: 2722822 - protein, 18 aa, Entamoeba histolytica
PALMQYYKQPQEKHLLII

SEQ ID NO: 2722823 - protein, 25 aa, Entamoeba histolytica
PAMLACFPLQDILSLKLKYIEGRDP

SEQ ID NO: 2722824 - protein, 18 aa, Entamoeba histolytica
PANQRLLRKRLSINYRRL

SEQ ID NO: 2722825 - protein, 23 aa, Entamoeba histolytica
PAPQPIHRPLPQTPSRNPSQQHQ

SEQ ID NO: 2722826 - protein, 23 aa, Entamoeba histolytica
PAQPALYLLMKTFSVCVPRIPFD

SEQ ID NO: 2722827 - protein, 18 aa, Entamoeba histolytica
PAQSGLAPAENPASTSPK

SEQ ID NO: 2722828 - protein, 25 aa, Entamoeba histolytica
PASCLMKMTPFEKQYWNIKKDNYDV

SEQ ID NO: 2722829 - protein, 17 aa, Entamoeba histolytica
PASIRYFELTVSGYNVI

SEQ ID NO: 2722830 - protein, 24 aa, Entamoeba histolytica
PASLVKGFFDYYKNFDFDYPIQPT

SEQ ID NO: 2722831 - protein, 26 aa, Entamoeba histolytica
PAVTNKYTITYILKLNTEGAANNGIL

SEQ ID NO: 2722832 - protein, 25 aa, Entamoeba histolytica
PAYVSWDFKFLEWRDTNYLPGLHQL

SEQ ID NO: 2722833 - protein, 20 aa, Entamoeba histolytica
PCGHICHSKCHFGPCKCTEK

SEQ ID NO: 2722834 - protein, 41 aa, Entamoeba histolytica
PCGTFDYAPPEMLLHAPQYTQLCDIWSFGVTIFVSMCGYYP

SEQ ID NO: 2722835 - protein, 17 aa, Entamoeba histolytica
PCGTQPPQCNYPCLIIP

SEQ ID NO: 2722836 - protein, 35 aa, Entamoeba histolytica
PCLNGLPPIPTSILPLFEMIGIDGVLAVWLALLEE

SEQ ID NO: 2722837 - protein, 23 aa, Entamoeba histolytica
PCLSRPELIPIYLSLIQVHHKTF

SEQ ID NO: 2722838 - protein, 18 aa, Entamoeba histolytica
PCPLCNGLLPPYDGPNKR

SEQ ID NO: 2722839 - protein, 26 aa, Entamoeba histolytica
PCPSKNLFPLIQYQPPNSSKVLCLFD

SEQ ID NO: 2722840 - protein, 20 aa, Entamoeba histolytica
PCSLLKAYSKFYSKFQILKE

SEQ ID NO: 2722841 - protein, 18 aa, Entamoeba histolytica
PCVEATIGGLRIIGRLAV

SEQ ID NO: 2722842 - protein, 33 aa, Entamoeba histolytica
PCVYHIPTYREVPPLFYQLPNYHERSRSRSRGR

SEQ ID NO: 2722843 - protein, 17 aa, Entamoeba histolytica
PCYWVLTRSVLSLYSSK

SEQ ID NO: 2722844 - protein, 24 aa, Entamoeba histolytica
PDAVTLLWHPFIVAQSPPPAQPLL

SEQ ID NO: 2722845 - protein, 25 aa, Entamoeba histolytica
PDDDKLISVLWPCVHFLLSVFQDET

SEQ ID NO: 2722846 - protein, 19 aa, Entamoeba histolytica
PDDQLIQWFWSIVESFSEE

SEQ ID NO: 2722847 - protein, 25 aa, Entamoeba histolytica
PDEMKFMAFDFLKIVKDLDDIKIPC

SEQ ID NO: 2722848 - protein, 24 aa, Entamoeba histolytica
PDESHILCFEKRSFEIGKSSNKIS

SEQ ID NO: 2722849 - protein, 20 aa, Entamoeba histolytica
PDFIHAFGYVKEATAYANCV

SEQ ID NO: 2722850 - protein, 23 aa, Entamoeba histolytica
PDGMIISHFPYGPTAYFGLYNVV

SEQ ID NO: 2722851 - protein, 22 aa, Entamoeba histolytica
PDGVVPISFCVPRKSEFFQDDI

SEQ ID NO: 2722852 - protein, 18 aa, Entamoeba histolytica
PDIRMTVWRMEKNRKIIF

SEQ ID NO: 2722853 - protein, 25 aa, Entamoeba histolytica
PDISYSCFAKLEALLLGINIIDRLP

SEQ ID NO: 2722854 - protein, 25 aa, Entamoeba histolytica
PDIVMKYMYLNMFLIPFNDIIEELM

SEQ ID NO: 2722855 - protein, 24 aa, Entamoeba histolytica
PDKQLMYFVKWVGLQYGECSWEKE

SEQ ID NO: 2722856 - protein, 23 aa, Entamoeba histolytica
PDKSIPFLSSYLTLLDNICKSIS

SEQ ID NO: 2722857 - protein, 24 aa, Entamoeba histolytica
PDKSVILALLRDSSVFRSKLLDVV

SEQ ID NO: 2722858 - protein, 24 aa, Entamoeba histolytica
PDLFSISILLKFSYPICIETQIEN

SEQ ID NO: 2722859 - protein, 26 aa, Entamoeba histolytica
PDNLKTKFVYYSRDWEDFLKSNNHSI

SEQ ID NO: 2722860 - protein, 25 aa, Entamoeba histolytica
PDNNYQYLIIAAEPYQSIAFKIPNM

SEQ ID NO: 2722861 - protein, 24 aa, Entamoeba histolytica
PDNSIEWIKLMQCFIQRKEIDEAR

SEQ ID NO: 2722862 - protein, 22 aa, Entamoeba histolytica
PDPNSLLKIPRAIYPVIEKEAK

SEQ ID NO: 2722863 - protein, 42 aa, Entamoeba histolytica
PDPVEFSKQILPKFFKHSNICSFVRQLNIYGFRKLETQTGFC

SEQ ID NO: 2722864 - protein, 26 aa, Entamoeba histolytica
PDQCKTIQAAKYWRQMIIKEMGQKVS

SEQ ID NO: 2722865 - protein, 32 aa, Entamoeba histolytica
PDQLLQFISTPFYFFVLSYFIQLKDAPFPSAI

SEQ ID NO: 2722866 - protein, 19 aa, Entamoeba histolytica
PDSIIFVMDGAIGQAAFGQ

SEQ ID NO: 2722867 - protein, 20 aa, Entamoeba histolytica
PDSIIFVMDGAIGQAAFGQA

SEQ ID NO: 2722868 - protein, 22 aa, Entamoeba histolytica
PDSLWLMGRLNHSKGKTTCINI

SEQ ID NO: 2722869 - protein, 24 aa, Entamoeba histolytica
PDSLYILGVMYYKGKYVFEDKTLA

SEQ ID NO: 2722870 - protein, 23 aa, Entamoeba histolytica
PDTIKQYYPKGENWQHVFTLGGI

SEQ ID NO: 2722871 - protein, 27 aa, Entamoeba histolytica
PDTILSEAMWVLRNLFIPEGNPHAIYL

SEQ ID NO: 2722872 - protein, 18 aa, Entamoeba histolytica
PDTISTNAFIPLTQTLMT

SEQ ID NO: 2722873 - protein, 21 aa, Entamoeba histolytica
PDVRFVIHHSLPKSLEGYYQE

SEQ ID NO: 2722874 - protein, 23 aa, Entamoeba histolytica
PDVTVMIEIFYRGLGVSFVEGEV

SEQ ID NO: 2722875 - protein, 19 aa, Entamoeba histolytica
PDYNPLLFLCLSKPLYKQP

SEQ ID NO: 2722876 - protein, 18 aa, Entamoeba histolytica
PDYRMLQSAYSGFHQFCQ

SEQ ID NO: 2722877 - protein, 23 aa, Entamoeba histolytica
PDYSNLYILFMKSLAQNSQTLNQ

SEQ ID NO: 2722878 - protein, 20 aa, Entamoeba histolytica
PEADWFYFDKLTEKRLNNMM

SEQ ID NO: 2722879 - protein, 28 aa, Entamoeba histolytica
PEALETWPVDLFGQLLPRHLQLAYQINQ

SEQ ID NO: 2722880 - protein, 25 aa, Entamoeba histolytica
PEATIHYVFVVTLILANKKQYHLLN

SEQ ID NO: 2722881 - protein, 34 aa, Entamoeba histolytica
PEDDLINYLLRILQEKMFNVVVKDIKIVVSIYAN

SEQ ID NO: 2722882 - protein, 23 aa, Entamoeba histolytica
PEDGLFCDLLWSDPLQYDVYEDR

SEQ ID NO: 2722883 - protein, 17 aa, Entamoeba histolytica
PEDITVIAWGFGLERPT

SEQ ID NO: 2722884 - protein, 24 aa, Entamoeba histolytica
PEDKGFFIFSLKNPHHTTATKITP

SEQ ID NO: 2722885 - protein, 32 aa, Entamoeba histolytica
PEDKQPDVMPPPPSGEAPVPEHRERKASFLTR

SEQ ID NO: 2722886 - protein, 31 aa, Entamoeba histolytica
PEDPTDVLTYTNPITQILQKAGIDTSNEAEM

SEQ ID NO: 2722887 - protein, 22 aa, Entamoeba histolytica
PEEFKRKYLPNVQTKRVKSETK

SEQ ID NO: 2722888 - protein, 27 aa, Entamoeba histolytica
PEELSNMIALKILRIGFNKLSGNIDVL

SEQ ID NO: 2722889 - protein, 18 aa, Entamoeba histolytica
PEEMSLPLDSRFRIKKPI

SEQ ID NO: 2722890 - protein, 24 aa, Entamoeba histolytica
PEEPADFTLLYNEKYFALLTHNGN

SEQ ID NO: 2722891 - protein, 29 aa, Entamoeba histolytica
PEEQYKMPLSWIILKRVVQGRDWHYGRTD

SEQ ID NO: 2722892 - protein, 19 aa, Entamoeba histolytica
PEEYKMVFCVRNDLKMGKG

SEQ ID NO: 2722893 - protein, 17 aa, Entamoeba histolytica
PEFDRIQKLRIITEYLE

SEQ ID NO: 2722894 - protein, 17 aa, Entamoeba histolytica
PEFILLYKDIVCSMLQL

SEQ ID NO: 2722895 - protein, 28 aa, Entamoeba histolytica
PEFIRNYPAVVSLLFELLDRLEKMQQNY

SEQ ID NO: 2722896 - protein, 19 aa, Entamoeba histolytica
PEFIVFPVDEESEKKMYAN

SEQ ID NO: 2722897 - protein, 27 aa, Entamoeba histolytica
PEFKSPIYIDAFKLSMPYLFDKLQTAC

SEQ ID NO: 2722898 - protein, 18 aa, Entamoeba histolytica
PEGKWEFFNLFQVIENPS

SEQ ID NO: 2722899 - protein, 28 aa, Entamoeba histolytica
PEGLRQKIIFYLWTPEGCKIREKMLYSA

SEQ ID NO: 2722900 - protein, 18 aa, Entamoeba histolytica
PEGTTQCMFWGLGSDGTV

SEQ ID NO: 2722901 - protein, 25 aa, Entamoeba histolytica
PEGVLDFLGIWKDSLPTNTDMEAGE

SEQ ID NO: 2722902 - protein, 22 aa, Entamoeba histolytica
PEGWYYLTKHTKKPLRGSCVQL

SEQ ID NO: 2722903 - protein, 22 aa, Entamoeba histolytica
PEGYEILFFGGGASLQFLMVAM

SEQ ID NO: 2722904 - protein, 24 aa, Entamoeba histolytica
PEHGYYLMKCVSHFMTMVPFFNIM

SEQ ID NO: 2722905 - protein, 25 aa, Entamoeba histolytica
PEHRERKASFLTRPKKGVNTNDSEQ

SEQ ID NO: 2722906 - protein, 19 aa, Entamoeba histolytica
PEHSLLKRIICLPDVFFER

SEQ ID NO: 2722907 - protein, 25 aa, Entamoeba histolytica
PEHWYNAYLYYMRSHFHFLNPAFEG

SEQ ID NO: 2722908 - protein, 23 aa, Entamoeba histolytica
PEIDEPWYLKFNNSAIYDDNTED

SEQ ID NO: 2722909 - protein, 19 aa, Entamoeba histolytica
PEIDEPWYLKFNNSAIYSD

SEQ ID NO: 2722910 - protein, 21 aa, Entamoeba histolytica
PEIDEPWYLKFNNSAIYSDKT

SEQ ID NO: 2722911 - protein, 24 aa, Entamoeba histolytica
PEIDNPWYLKFNNSAIYDDITEDE

SEQ ID NO: 2722912 - protein, 23 aa, Entamoeba histolytica
PEIDNPWYLKFNNSAIYDDNTED

SEQ ID NO: 2722913 - protein, 22 aa, Entamoeba histolytica
PEIDSPWYLKFNNAAIYDDNTE

SEQ ID NO: 2722914 - protein, 29 aa, Entamoeba histolytica
PEIEGLQSIIILTHLLYEVAKTWSKENNV

SEQ ID NO: 2722915 - protein, 24 aa, Entamoeba histolytica
PEIFNRIYKVLLPGDYIAFRMTGK

SEQ ID NO: 2722916 - protein, 17 aa, Entamoeba histolytica
PEILLKMPSYTSAVDMW

SEQ ID NO: 2722917 - protein, 26 aa, Entamoeba histolytica
PEILSKIAWLFSNFCRFKPSIPEQQL

SEQ ID NO: 2722918 - protein, 32 aa, Entamoeba histolytica
PEKIYQYEQDKLKYYFAVAVFDSIETANEVYN

SEQ ID NO: 2722919 - protein, 34 aa, Entamoeba histolytica
PEKKSFLELELIQKILFPDFFTRRDKRTFNNVLE

SEQ ID NO: 2722920 - protein, 26 aa, Entamoeba histolytica
PEKPKILPCRATVKQLYQPHSDKEIN

SEQ ID NO: 2722921 - protein, 18 aa, Entamoeba histolytica
PEKSLPGLLIYKGDCMVK

SEQ ID NO: 2722922 - protein, 29 aa, Entamoeba histolytica
PELCEYYYEKDMFFILKATTNIGEILIYI

SEQ ID NO: 2722923 - protein, 17 aa, Entamoeba histolytica
PELEEYFFHANPRSFCG

SEQ ID NO: 2722924 - protein, 25 aa, Entamoeba histolytica
PELINNIFMYLNKPLLDTVIVNQER

SEQ ID NO: 2722925 - protein, 24 aa, Entamoeba histolytica
PELIQLICIWDKEALKRRIYNGWT

SEQ ID NO: 2722926 - protein, 18 aa, Entamoeba histolytica
PELKIIPMKEEYKLIVET

SEQ ID NO: 2722927 - protein, 22 aa, Entamoeba histolytica
PELKLRIALNKSGILELVDALL

SEQ ID NO: 2722928 - protein, 27 aa, Entamoeba histolytica
PELKNEKYIFKTYPFTKFTKKGGKDIC

SEQ ID NO: 2722929 - protein, 17 aa, Entamoeba histolytica
PELRHRGSLPIKVQSIA

SEQ ID NO: 2722930 - protein, 26 aa, Entamoeba histolytica
PELTERFELFILKREIANAYTELNNP

SEQ ID NO: 2722931 - protein, 19 aa, Entamoeba histolytica
PEMFYPRILENDITNFKLH

SEQ ID NO: 2722932 - protein, 18 aa, Entamoeba histolytica
PEMILLYENQPISRKSDI

SEQ ID NO: 2722933 - protein, 19 aa, Entamoeba histolytica
PEMMMIERTLLRNINKGFI

SEQ ID NO: 2722934 - protein, 17 aa, Entamoeba histolytica
PENEHILVITPNSLVYQ

SEQ ID NO: 2722935 - protein, 24 aa, Entamoeba histolytica
PENFPLLFDFIGTYFSFVLPVDKT

SEQ ID NO: 2722936 - protein, 32 aa, Entamoeba histolytica
PENICCSKGFQFKFFMTYMDMLSLDDEYKIFK

SEQ ID NO: 2722937 - protein, 24 aa, Entamoeba histolytica
PENMRDFFTIVIKLLDSDGDNELN

SEQ ID NO: 2722938 - protein, 28 aa, Entamoeba histolytica
PENQNGRFFPFIMYGAKATLPTGAGDIT

SEQ ID NO: 2722939 - protein, 23 aa, Entamoeba histolytica
PENQPLGFWIFDTEGVEKAVERW

SEQ ID NO: 2722940 - protein, 18 aa, Entamoeba histolytica
PENVYEISLFLGMLSKWC

SEQ ID NO: 2722941 - protein, 19 aa, Entamoeba histolytica
PEQFEPIIEKEEEDLRVED

SEQ ID NO: 2722942 - protein, 32 aa, Entamoeba histolytica
PEQFYKDLFKRTIPEILYFFDMNQLDIPSNDE

SEQ ID NO: 2722943 - protein, 37 aa, Entamoeba histolytica
PEQLLNSFLRFHCCLLLLDYFGYINRIREFAQFHSCP

SEQ ID NO: 2722944 - protein, 28 aa, Entamoeba histolytica
PEQQQIIKWLINTVKTNDFWEVFDEQEP

SEQ ID NO: 2722945 - protein, 25 aa, Entamoeba histolytica
PEQRNTARFQLPQSILLSGISIKNE

SEQ ID NO: 2722946 - protein, 28 aa, Entamoeba histolytica
PEQSDIILLNIFALIHPEIKAIIPKKYY

SEQ ID NO: 2722947 - protein, 32 aa, Entamoeba histolytica
PERDSYISFLTNQILFIPLPNENRELLVNEIE

SEQ ID NO: 2722948 - protein, 20 aa, Entamoeba histolytica
PESDGFGSVPITNEPFRQKE

SEQ ID NO: 2722949 - protein, 23 aa, Entamoeba histolytica
PESKFQIIWPTEDFIRTSETGYH

SEQ ID NO: 2722950 - protein, 25 aa, Entamoeba histolytica
PESYKYWHHWALINFEIVSYIELDE

SEQ ID NO: 2722951 - protein, 25 aa, Entamoeba histolytica
PETAQGIFTMFKRNLEFNGGKVPFG

SEQ ID NO: 2722952 - protein, 29 aa, Entamoeba histolytica
PETFDKLYLLLEALLSFIYPHFADQANYK

SEQ ID NO: 2722953 - protein, 25 aa, Entamoeba histolytica
PETFKVMMMLKYNKSLINPGEPVGV

SEQ ID NO: 2722954 - protein, 20 aa, Entamoeba histolytica
PETIRVVTSCYVYIQCIGDQ

SEQ ID NO: 2722955 - protein, 29 aa, Entamoeba histolytica
PETKYFPLQSRLSLFITFYNEYSKLFLID

SEQ ID NO: 2722956 - protein, 25 aa, Entamoeba histolytica
PETLFQKIVVFIKKLMSNEFFLDSH

SEQ ID NO: 2722957 - protein, 22 aa, Entamoeba histolytica
PETQPNLWGGIALRNENSTEKI

SEQ ID NO: 2722958 - protein, 24 aa, Entamoeba histolytica
PETQRRFALLLEAFLMVCGAQRTV

SEQ ID NO: 2722959 - protein, 20 aa, Entamoeba histolytica
PEVIVAPPGFPAEYLEMFNS

SEQ ID NO: 2722960 - protein, 19 aa, Entamoeba histolytica
PEVKEWFNLIETIFVSVKK

SEQ ID NO: 2722961 - protein, 25 aa, Entamoeba histolytica
PEVNTFVKKLYYTMKEPSYMDWKLN

SEQ ID NO: 2722962 - protein, 28 aa, Entamoeba histolytica
PEVPQPTYQRPTAPKPTYRPPQQTIPEP

SEQ ID NO: 2722963 - protein, 19 aa, Entamoeba histolytica
PEVVQIRSFLLKPGCIISG

SEQ ID NO: 2722964 - protein, 27 aa, Entamoeba histolytica
PEWRVRSFVQLLLPEIVSFIGADLAQK

SEQ ID NO: 2722965 - protein, 24 aa, Entamoeba histolytica
PEYFEKIMYKLYYEKELEGAFRQC

SEQ ID NO: 2722966 - protein, 18 aa, Entamoeba histolytica
PEYLANITTSPLLIHLIN

SEQ ID NO: 2722967 - protein, 22 aa, Entamoeba histolytica
PEYLFGYALKQHFYTLFKIHDS

SEQ ID NO: 2722968 - protein, 26 aa, Entamoeba histolytica
PFANSGLFKWKYMTHWTIDYGITTSK

SEQ ID NO: 2722969 - protein, 18 aa, Entamoeba histolytica
PFAWINPIKERKLLINGC

SEQ ID NO: 2722970 - protein, 18 aa, Entamoeba histolytica
PFDCIIGPIVKTLDLELE

SEQ ID NO: 2722971 - protein, 17 aa, Entamoeba histolytica
PFDFKSNKIEDEFLMFL

SEQ ID NO: 2722972 - protein, 17 aa, Entamoeba histolytica
PFDLLTKCPTIGLLEEY

SEQ ID NO: 2722973 - protein, 29 aa, Entamoeba histolytica
PFECVEAIIHSPLWYEDFQDNQWKQLTHF

SEQ ID NO: 2722974 - protein, 18 aa, Entamoeba histolytica
PFEFINDRTAFKEVCEYY

SEQ ID NO: 2722975 - protein, 18 aa, Entamoeba histolytica
PFENGFKTYLMATSSKFG

SEQ ID NO: 2722976 - protein, 22 aa, Entamoeba histolytica
PFEQLMSVLPPRSKSCLPQQFH

SEQ ID NO: 2722977 - protein, 25 aa, Entamoeba histolytica
PFEQLNNLILLLHSSILPIKRNLSH

SEQ ID NO: 2722978 - protein, 21 aa, Entamoeba histolytica
PFEYTFAIGLCPLHYKKDKFI

SEQ ID NO: 2722979 - protein, 19 aa, Entamoeba histolytica
PFFSHLQTFWVYSQDNPWL

SEQ ID NO: 2722980 - protein, 20 aa, Entamoeba histolytica
PFFSPCYTTTAYPLNVDSKQ

SEQ ID NO: 2722981 - protein, 47 aa, Entamoeba histolytica
PFGPHPIEVFALIAALRILCPLNFILLNPQYPLLNLPNELIPIFGSI

SEQ ID NO: 2722982 - protein, 26 aa, Entamoeba histolytica
PFGSMPPTPLPQTPSLQTPGLVASTT

SEQ ID NO: 2722983 - protein, 22 aa, Entamoeba histolytica
PFIDCELPFSISLYPHHLKNIK

SEQ ID NO: 2722984 - protein, 22 aa, Entamoeba histolytica
PFIDHILQFSIVDDRIWMRNYQ

SEQ ID NO: 2722985 - protein, 20 aa, Entamoeba histolytica
PFIKHYFIVTMGQTPSFLNT

SEQ ID NO: 2722986 - protein, 19 aa, Entamoeba histolytica
PFILGELFCYFNKTTIIQI

SEQ ID NO: 2722987 - protein, 19 aa, Entamoeba histolytica
PFILLRVIYLCKTANVNID

SEQ ID NO: 2722988 - protein, 19 aa, Entamoeba histolytica
PFIRTLDVLQSREIDGYYS

SEQ ID NO: 2722989 - protein, 24 aa, Entamoeba histolytica
PFISTSIILYILFSIRRTRENILE

SEQ ID NO: 2722990 - protein, 24 aa, Entamoeba histolytica
PFKEYSFHPIITTIPIHLMLSNGS

SEQ ID NO: 2722991 - protein, 28 aa, Entamoeba histolytica
PFKTPRELQVWIWKEIFQETSPFSVVDF

SEQ ID NO: 2722992 - protein, 28 aa, Entamoeba histolytica
PFLLNNQKYFLHFLPRIISSLPNCRFIL

SEQ ID NO: 2722993 - protein, 20 aa, Entamoeba histolytica
PFLNTSHFYPPFSMQGFAQL

SEQ ID NO: 2722994 - protein, 21 aa, Entamoeba histolytica
PFMMNVLLYIQDFRTVTHFFQ

SEQ ID NO: 2722995 - protein, 24 aa, Entamoeba histolytica
PFMPFITEELWQRLPRRNDKEISI

SEQ ID NO: 2722996 - protein, 27 aa, Entamoeba histolytica
PFMRERHIQIWSPILRNNISILVIDPH

SEQ ID NO: 2722997 - protein, 19 aa, Entamoeba histolytica
PFMSILTEYISNGTLTMYL

SEQ ID NO: 2722998 - protein, 17 aa, Entamoeba histolytica
PFNFHKVFKSYTSLLVV

SEQ ID NO: 2722999 - protein, 18 aa, Entamoeba histolytica
PFNIIREFGKKYLGLKCP

SEQ ID NO: 2723000 - protein, 20 aa, Entamoeba histolytica
PFNIIREFGKKYSALKYPHA

SEQ ID NO: 2723001 - protein, 20 aa, Entamoeba histolytica
PFNRLHIYDNRRLCTLFGIE

SEQ ID NO: 2723002 - protein, 26 aa, Entamoeba histolytica
PFPEKSLPGLLIYKGDCMVKSLFGSE

SEQ ID NO: 2723003 - protein, 25 aa, Entamoeba histolytica
PFPNGPIQLFCDASLMFISGLHECC

SEQ ID NO: 2723004 - protein, 17 aa, Entamoeba histolytica
PFQIVLLENEPILDEIE

SEQ ID NO: 2723005 - protein, 17 aa, Entamoeba histolytica
PFSFRNGGSFFIIIGGE

SEQ ID NO: 2723006 - protein, 31 aa, Entamoeba histolytica
PFSLENRWFTFPTLLHQYTILQTPIFYYEVT

SEQ ID NO: 2723007 - protein, 20 aa, Entamoeba histolytica
PFSSLLHKWYDIDLDDYELL

SEQ ID NO: 2723008 - protein, 17 aa, Entamoeba histolytica
PFSSYYQKQSSYYPPCD

SEQ ID NO: 2723009 - protein, 24 aa, Entamoeba histolytica
PFTEMFMCGVIYKLTQQYILMNIR

SEQ ID NO: 2723010 - protein, 17 aa, Entamoeba histolytica
PFTFCVECYKRLCLTLG

SEQ ID NO: 2723011 - protein, 28 aa, Entamoeba histolytica
PFTLSKQQLLLFFPHLVQQNIYHCYDDK

SEQ ID NO: 2723012 - protein, 26 aa, Entamoeba histolytica
PFTTCTWFYIHSFPEYQTPSVSLFSF

SEQ ID NO: 2723013 - protein, 17 aa, Entamoeba histolytica
PFVLQAREKRSIKPSLE

SEQ ID NO: 2723014 - protein, 25 aa, Entamoeba histolytica
PFYGDLLNVLYDRDHYKLALAQLSI

SEQ ID NO: 2723015 - protein, 19 aa, Entamoeba histolytica
PGAILFTTNCLMKPLPSYK

SEQ ID NO: 2723016 - protein, 18 aa, Entamoeba histolytica
PGAMRILNYFKKHNIPIA

SEQ ID NO: 2723017 - protein, 23 aa, Entamoeba histolytica
PGAPSIFLYSNFMGGLSALIPLQ

SEQ ID NO: 2723018 - protein, 20 aa, Entamoeba histolytica
PGAYPPPGYPPMQPGMMPPP

SEQ ID NO: 2723019 - protein, 38 aa, Entamoeba histolytica; identical to SEQ ID NO: 2535810

SEQ ID NO: 2723020 - protein, 24 aa, Entamoeba histolytica
PGCEALPILHNFFSQSNTIRISTF

SEQ ID NO: 2723021 - protein, 30 aa, Entamoeba histolytica
PGDEVIIFSPYFVEYIFYIQNYGGIAIEVP

SEQ ID NO: 2723022 - protein, 22 aa, Entamoeba histolytica
PGDTFKSYYIPGYRFKPEFTEQ

SEQ ID NO: 2723023 - protein, 26 aa, Entamoeba histolytica
PGEKKKWLLWKEYIDTMLKLNRIDVI

SEQ ID NO: 2723024 - protein, 18 aa, Entamoeba histolytica
PGGELYYRLIQEKSFCES

SEQ ID NO: 2723025 - protein, 19 aa, Entamoeba histolytica
PGGFGFRPAAPKPNAYVTM

SEQ ID NO: 2723026 - protein, 17 aa, Entamoeba histolytica
PGGSLQSILKRCGKIDI

SEQ ID NO: 2723027 - protein, 18 aa, Entamoeba histolytica
PGGVGFDINCGVRLIRTN

SEQ ID NO: 2723028 - protein, 18 aa, Entamoeba histolytica
PGHGMMFVRNDAKVFWFC

SEQ ID NO: 2723029 - protein, 17 aa, Entamoeba histolytica
PGHIHFIQEAAQFGRVI

SEQ ID NO: 2723030 - protein, 41 aa, Entamoeba histolytica
PGIGFWAPMWRVWIFLLRGLIPILERWLGNLLARQFEGRKA

SEQ ID NO: 2723031 - protein, 20 aa, Entamoeba histolytica
PGILLLCFQVYKEIVRNSKD

SEQ ID NO: 2723032 - protein, 18 aa, Entamoeba histolytica
PGIYSPLLVVTPMHIPMV

SEQ ID NO: 2723033 - protein, 23 aa, Entamoeba histolytica
PGKDESFFRKLSLVYNDIDDIYL

SEQ ID NO: 2723034 - protein, 27 aa, Entamoeba histolytica
PGKDLLEIININSISKPLIVLTVESIE

SEQ ID NO: 2723035 - protein, 18 aa, Entamoeba histolytica
PGKGLNVIIGPNGAGKSS

SEQ ID NO: 2723036 - protein, 21 aa, Entamoeba histolytica
PGKLDHSTLLAYKVIKRIDAF

SEQ ID NO: 2723037 - protein, 18 aa, Entamoeba histolytica
PGKLIFPSSLTSLTTPYL

SEQ ID NO: 2723038 - protein, 19 aa, Entamoeba histolytica
PGLDKAIALLLQRNEYIQV

SEQ ID NO: 2723039 - protein, 20 aa, Entamoeba histolytica
PGLVMFMNGMAHPSFGKRNG

SEQ ID NO: 2723040 - protein, 22 aa, Entamoeba histolytica
PGLYYLLGEMHFHLGRRNEAIR

SEQ ID NO: 2723041 - protein, 23 aa, Entamoeba histolytica
PGMKKYILWYDVNYTRYLKELEH

SEQ ID NO: 2723042 - protein, 19 aa, Entamoeba histolytica
PGMKVMFPKTLGKISKRGG

SEQ ID NO: 2723043 - protein, 24 aa, Entamoeba histolytica
PGMPGMPPPPPGFGFRPPGAPALK

SEQ ID NO: 2723044 - protein, 21 aa, Entamoeba histolytica
PGPMLEAFQKGTAACYPLGGY

SEQ ID NO: 2723045 - protein, 25 aa, Entamoeba histolytica
PGQYGNLIVHFNIQNPTYLSQEQKD

SEQ ID NO: 2723046 - protein, 24 aa, Entamoeba histolytica
PGSDTVLAIIYISNQYKLVYAENQ

SEQ ID NO: 2723047 - protein, 26 aa, Entamoeba histolytica
PGSDTVLAIIYISNQYKLVYAENQRR

SEQ ID NO: 2723048 - protein, 34 aa, Entamoeba histolytica
PGSTIQILGAEKALFRALKTKKKTPKYGLIFHAA

SEQ ID NO: 2723049 - protein, 25 aa, Entamoeba histolytica
PGSYSYPFVIQLPKGIPSSSFFNDR

SEQ ID NO: 2723050 - protein, 24 aa, Entamoeba histolytica
PGTKVRLIRKLLEGLIVSITNVHI

SEQ ID NO: 2723051 - protein, 17 aa, Entamoeba histolytica
PGVIKSLAMPDAHSGYG

SEQ ID NO: 2723052 - protein, 25 aa, Entamoeba histolytica
PGYEKPIIFGNLHEFAYPLVNPATG

SEQ ID NO: 2723053 - protein, 26 aa, Entamoeba histolytica
PGYGQYQIVRIWGCIFARALSSEVQE

SEQ ID NO: 2723054 - protein, 20 aa, Entamoeba histolytica
PGYPQPGAYPGYPPQQGAPQ

SEQ ID NO: 2723055 - protein, 22 aa, Entamoeba histolytica
PGYSYYNKLLFKEWYHNQKRHS

SEQ ID NO: 2723056 - protein, 20 aa, Entamoeba histolytica
PHDAANLIKTYLRTLPVSIA

SEQ ID NO: 2723057 - protein, 17 aa, Entamoeba histolytica
PHDIIRLDFDLNLVGLI

SEQ ID NO: 2723058 - protein, 24 aa, Entamoeba histolytica
PHDPELFKQFIRIPQNLLPSELQG

SEQ ID NO: 2723059 - protein, 17 aa, Entamoeba histolytica
PHEARLRSLTYSCQLEV

SEQ ID NO: 2723060 - protein, 18 aa, Entamoeba histolytica
PHEIIYEYGRILMNDPSP

SEQ ID NO: 2723061 - protein, 17 aa, Entamoeba histolytica
PHELTLPRRTPNFALKY

SEQ ID NO: 2723062 - protein, 17 aa, Entamoeba histolytica
PHFILKNKEQRKSEKQE

SEQ ID NO: 2723063 - protein, 20 aa, Entamoeba histolytica
PHFMSVNPIKMQFGIMAYQH

SEQ ID NO: 2723064 - protein, 19 aa, Entamoeba histolytica
PHGGACTVVLRGPSKQLLG

SEQ ID NO: 2723065 - protein, 30 aa, Entamoeba histolytica; identical to SEQ ID NO: 2517514

SEQ ID NO: 2723066 - protein, 22 aa, Entamoeba histolytica
PHHFYICVLELIWYVTENKCDN

SEQ ID NO: 2723067 - protein, 18 aa, Entamoeba histolytica
PHILPLVLQKKIILFCPF

SEQ ID NO: 2723068 - protein, 25 aa, Entamoeba histolytica
PHKNHFILLSYQLPEIIYQVLSKNE

SEQ ID NO: 2723069 - protein, 17 aa, Entamoeba histolytica
PHKQIIPLLSKIVSISL

SEQ ID NO: 2723070 - protein, 17 aa, Entamoeba histolytica
PHLFKFAGDMLGLTQFN

SEQ ID NO: 2723071 - protein, 23 aa, Entamoeba histolytica
PHLQPIIPSSLSATPAILPSHID

SEQ ID NO: 2723072 - protein, 18 aa, Entamoeba histolytica
PHLQPPSEQSLPKQNTLP

SEQ ID NO: 2723073 - protein, 21 aa, Entamoeba histolytica
PHLRMHPIRITDLSTYGTFFG

SEQ ID NO: 2723074 - protein, 30 aa, Entamoeba histolytica
PHNDGEFLLVGWTPFLRCLFEIERLRQIAS

SEQ ID NO: 2723075 - protein, 21 aa, Entamoeba histolytica
PHPYLSHNCYFLQKSVLQKLE

SEQ ID NO: 2723076 - protein, 25 aa, Entamoeba histolytica
PHQIVLELVDFSNPLISLTQIWIYH

SEQ ID NO: 2723077 - protein, 24 aa, Entamoeba histolytica
PHQKIPFCRLTGMIKTTIKKDSDL

SEQ ID NO: 2723078 - protein, 17 aa, Entamoeba histolytica
PHQLSINPNLFYKNFNQ

SEQ ID NO: 2723079 - protein, 28 aa, Entamoeba histolytica
PHTIKCLICQQLIGIDSIFSHIVEHVNR

SEQ ID NO: 2723080 - protein, 26 aa, Entamoeba histolytica
PHVPTINIIIFWHRLHLFNGEVIEGI

SEQ ID NO: 2723081 - protein, 17 aa, Entamoeba histolytica
PIALPPVLASKLIYRIS

SEQ ID NO: 2723082 - protein, 21 aa, Entamoeba histolytica
PIAVESIYNYLYDKGFTVPGI

SEQ ID NO: 2723083 - protein, 17 aa, Entamoeba histolytica
PICESKSFKPSYIVAIQ

SEQ ID NO: 2723084 - protein, 17 aa, Entamoeba histolytica
PICQPIHRTISLYSDEF

SEQ ID NO: 2723085 - protein, 28 aa, Entamoeba histolytica
PIDDIIPLFYIFYQNITGILPWDTISNP

SEQ ID NO: 2723086 - protein, 19 aa, Entamoeba histolytica
PIDFFIPDEHISPTMLIAM

SEQ ID NO: 2723087 - protein, 17 aa, Entamoeba histolytica
PIDFFIPQEAVSPSMLI

SEQ ID NO: 2723088 - protein, 17 aa, Entamoeba histolytica
PIDKIHNFVKCIGYILS

SEQ ID NO: 2723089 - protein, 26 aa, Entamoeba histolytica
PIDLHPITHFSFSLAKSFLYDQFEYY

SEQ ID NO: 2723090 - protein, 20 aa, Entamoeba histolytica
PIDPFKILEKYYKELPIAKH

SEQ ID NO: 2723091 - protein, 17 aa, Entamoeba histolytica
PIDVFSFGMTMYHIFTN

SEQ ID NO: 2723092 - protein, 24 aa, Entamoeba histolytica
PIEFKQEIVKFPPLNPIKKVEKSD

SEQ ID NO: 2723093 - protein, 27 aa, Entamoeba histolytica
PIEFLNKILAIPIKFFRKLDAVRSPSE

SEQ ID NO: 2723094 - protein, 18 aa, Entamoeba histolytica
PIEHLFNHFTLKQLILTD

SEQ ID NO: 2723095 - protein, 26 aa, Entamoeba histolytica
PIEHQTIFKELMKLSYKIISFSDLNS

SEQ ID NO: 2723096 - protein, 23 aa, Entamoeba histolytica
PIEIVLHLPILCEDKNVPYVFVG

SEQ ID NO: 2723097 - protein, 25 aa, Entamoeba histolytica
PIEKKPMFHFLPQTMTYSIATVGCN

SEQ ID NO: 2723098 - protein, 18 aa, Entamoeba histolytica
PIELYPIQRVFHLNISQN

SEQ ID NO: 2723099 - protein, 25 aa, Entamoeba histolytica
PIEPQIVTVDIPIYHYFTGCQEEIE

SEQ ID NO: 2723100 - protein, 19 aa, Entamoeba histolytica
PIERACYYLKRVNPEGPML

SEQ ID NO: 2723101 - protein, 31 aa, Entamoeba histolytica
PIETNYKIKFTLGTIIKEIILIEGNTLSNKT

SEQ ID NO: 2723102 - protein, 30 aa, Entamoeba histolytica
PIEVSAMVLRTLYNILIKKIGNRTIGKVVI

SEQ ID NO: 2723103 - protein, 31 aa, Entamoeba histolytica
PIEVSAMVLRTLYNILIKRIGNRKIGKVVIT

SEQ ID NO: 2723104 - protein, 31 aa, Entamoeba histolytica
PIEVSAMVLRTLYNILIKRIGNRKIGKVVVT

SEQ ID NO: 2723105 - protein, 25 aa, Entamoeba histolytica
PIFPQNYCKVAIINGFFDNILKLTE

SEQ ID NO: 2723106 - protein, 17 aa, Entamoeba histolytica
PIFRYITTQNIYSRDDR

SEQ ID NO: 2723107 - protein, 25 aa, Entamoeba histolytica
PIFVQFFPQYIAYTFFQIPEFRLEL

SEQ ID NO: 2723108 - protein, 30 aa, Entamoeba histolytica; identical to SEQ ID NO: 2535896

SEQ ID NO: 2723109 - protein, 17 aa, Entamoeba histolytica
PIGFYVNSLFLDEWFHV

SEQ ID NO: 2723110 - protein, 30 aa, Entamoeba histolytica; identical to SEQ ID NO: 2535899

SEQ ID NO: 2723111 - protein, 19 aa, Entamoeba histolytica
PIHSFVFLPSTSADEDVLF

SEQ ID NO: 2723112 - protein, 30 aa, Entamoeba histolytica
PIIFDDIHMIPFLWIQLTFGCDGCVGYYER

SEQ ID NO: 2723113 - protein, 26 aa, Entamoeba histolytica
PIIGDLLRWLIDIRNYSVRCVNHTKV

SEQ ID NO: 2723114 - protein, 26 aa, Entamoeba histolytica
PIIKELKILIPKLNSLNAILTRQYSC

SEQ ID NO: 2723115 - protein, 34 aa, Entamoeba histolytica
PIIKVVLLDDIYYYIFILKAIVWICNDKGVLHSL

SEQ ID NO: 2723116 - protein, 20 aa, Entamoeba histolytica
PIISDIPRFGSLIIEKMTAS

SEQ ID NO: 2723117 - protein, 24 aa, Entamoeba histolytica
PIKEYPLTMLLKKIEDISGYTIKY

SEQ ID NO: 2723118 - protein, 37 aa, Entamoeba histolytica
PIKNTYIINIIFFNQHFLLESFLKLYQPINLRIDCMN

SEQ ID NO: 2723119 - protein, 40 aa, Entamoeba histolytica
PIKTIELYKFFLHFETYVQYLPFIYKLNFIQKDNIFDLIV

SEQ ID NO: 2723120 - protein, 26 aa, Entamoeba histolytica
PILDEKVDLLSLRKLSDQSSEKSIYG

SEQ ID NO: 2723121 - protein, 18 aa, Entamoeba histolytica
PILEYYQTLVMKITGLKT

SEQ ID NO: 2723122 - protein, 22 aa, Entamoeba histolytica
PILFHPMQRFISKLITFHPDIT

SEQ ID NO: 2723123 - protein, 24 aa, Entamoeba histolytica
PILGKIALDLMKKFSLLTPDNVET

SEQ ID NO: 2723124 - protein, 20 aa, Entamoeba histolytica
PILISLFENKNFRIAIDAIK

SEQ ID NO: 2723125 - protein, 18 aa, Entamoeba histolytica
PILPIKINDHQVGIPEIA

SEQ ID NO: 2723126 - protein, 20 aa, Entamoeba histolytica
PILSYRHLQFSPLVQPSISM

SEQ ID NO: 2723127 - protein, 28 aa, Entamoeba histolytica
PIMNTIIQFIHLIWMSIKRSFNFISSLI

SEQ ID NO: 2723128 - protein, 18 aa, Entamoeba histolytica
PINKPLFDCDQLQCYILY

SEQ ID NO: 2723129 - protein, 18 aa, Entamoeba histolytica
PINLVIDLVPFQWHNKEL

SEQ ID NO: 2723130 - protein, 31 aa, Entamoeba histolytica
PINPKLIEMNMNGIPLGIHSLTGVIHDPNTI

SEQ ID NO: 2723131 - protein, 29 aa, Entamoeba histolytica
PINSARPNIHFFLYKPRLIGSKCVGFYQL

SEQ ID NO: 2723132 - protein, 19 aa, Entamoeba histolytica
PIPGVPPPPPGVPGATGVP

SEQ ID NO: 2723133 - protein, 22 aa, Entamoeba histolytica
PIPPGLLVRQIIVKKLGEVERK

SEQ ID NO: 2723134 - protein, 17 aa, Entamoeba histolytica
PIPPSFDDNFLIKKTVC

SEQ ID NO: 2723135 - protein, 19 aa, Entamoeba histolytica
PIPRFKRILSGIDKLGRVV

SEQ ID NO: 2723136 - protein, 25 aa, Entamoeba histolytica
PIPTGGYIFVTIIADLKKINSVVLK

SEQ ID NO: 2723137 - protein, 18 aa, Entamoeba histolytica
PIQGFIPSLYSTCSIDIS

SEQ ID NO: 2723138 - protein, 23 aa, Entamoeba histolytica
PIQLYGQYYYPPQNNLSIIGLQG

SEQ ID NO: 2723139 - protein, 17 aa, Entamoeba histolytica
PIQPLRLEQPDIITEEE

SEQ ID NO: 2723140 - protein, 26 aa, Entamoeba histolytica
PIQQPIGYEFLLEKIYSILNDNKTLL

SEQ ID NO: 2723141 - protein, 19 aa, Entamoeba histolytica
PIQYASTLAFEYYNKADEM

SEQ ID NO: 2723142 - protein, 26 aa, Entamoeba histolytica
PIRASLLLLELFDKFYSIFNKSIPLI

SEQ ID NO: 2723143 - protein, 19 aa, Entamoeba histolytica
PIRKVIIQQWKKDGNKYIN

SEQ ID NO: 2723144 - protein, 18 aa, Entamoeba histolytica
PIRLCFDLKKIQSIDISC

SEQ ID NO: 2723145 - protein, 26 aa, Entamoeba histolytica
PIRLGLALNFSVFYFEIMNDADKACQ

SEQ ID NO: 2723146 - protein, 25 aa, Entamoeba histolytica
PIRMKVMGFIRSWVNWRFSDFDDID

SEQ ID NO: 2723147 - protein, 18 aa, Entamoeba histolytica
PIRSFGRIKKITAKELNS

SEQ ID NO: 2723148 - protein, 30 aa, Entamoeba histolytica
PIRYKQNGGYFLFTFINFYGIKPQIFYTSK

SEQ ID NO: 2723149 - protein, 29 aa, Entamoeba histolytica
PISIITKKLFPLIQTQYLYFPTDERIPTI

SEQ ID NO: 2723150 - protein, 17 aa, Entamoeba histolytica
PISIWTNEIWFRNRYEA

SEQ ID NO: 2723151 - protein, 31 aa, Entamoeba histolytica
PISKSFKGKYYPYILGIRKDFLKNTSNTSIS

SEQ ID NO: 2723152 - protein, 22 aa, Entamoeba histolytica
PISLGVCNLGVLFQKIIPSGTE

SEQ ID NO: 2723153 - protein, 17 aa, Entamoeba histolytica
PISLQGRTCFTVIMDPS

SEQ ID NO: 2723154 - protein, 21 aa, Entamoeba histolytica
PISMRNVIGITMPPAYSTIQP

SEQ ID NO: 2723155 - protein, 25 aa, Entamoeba histolytica
PISPDPYFPYSSFERTIYKQRVDSP

SEQ ID NO: 2723156 - protein, 20 aa, Entamoeba histolytica
PISPFRNLSSTFLTQRNQRI

SEQ ID NO: 2723157 - protein, 18 aa, Entamoeba histolytica
PISTIFTSSLLRSQLSVQ

SEQ ID NO: 2723158 - protein, 19 aa, Entamoeba histolytica
PISVYAYEFCGYPYHDTCI

SEQ ID NO: 2723159 - protein, 29 aa, Entamoeba histolytica
PITESANILFLLNYLSHGVVRFSPDVPDL

SEQ ID NO: 2723160 - protein, 24 aa, Entamoeba histolytica
PITIKNLFYLICNIIFDCNEEDFN

SEQ ID NO: 2723161 - protein, 20 aa, Entamoeba histolytica
PITMAHCFRRNRENPEVEMK

SEQ ID NO: 2723162 - protein, 18 aa, Entamoeba histolytica
PITPAILSTPAIGRTTTG

SEQ ID NO: 2723163 - protein, 17 aa, Entamoeba histolytica
PITPLNYPNEYLNDSEK

SEQ ID NO: 2723164 - protein, 29 aa, Entamoeba histolytica
PITPSLTPHFQFSTPVLTLSKPTSPRRLR

SEQ ID NO: 2723165 - protein, 19 aa, Entamoeba histolytica
PITPVIALTTLRITSPPNT

SEQ ID NO: 2723166 - protein, 25 aa, Entamoeba histolytica
PITQVRIQLVHLLLSLTLSNYSYIY

SEQ ID NO: 2723167 - protein, 21 aa, Entamoeba histolytica
PITVLPFRYYNIPKEYEYVKN

SEQ ID NO: 2723168 - protein, 19 aa, Entamoeba histolytica
PIVKEFISFALRLINSHSF

SEQ ID NO: 2723169 - protein, 21 aa, Entamoeba histolytica
PIVKNKYDILAQIQLEQQQQQ

SEQ ID NO: 2723170 - protein, 20 aa, Entamoeba histolytica
PIVLSALMDSLPPTLLLEGL

SEQ ID NO: 2723171 - protein, 18 aa, Entamoeba histolytica
PIVLSPQTSSKFPCPLCD

SEQ ID NO: 2723172 - protein, 20 aa, Entamoeba histolytica
PIVQTPVLCYYDGNNLYLPN

SEQ ID NO: 2723173 - protein, 24 aa, Entamoeba histolytica
PIVRRNDIIIKQQKPKLVINDESS

SEQ ID NO: 2723174 - protein, 17 aa, Entamoeba histolytica
PIVSIPQSAPKGNSLAI

SEQ ID NO: 2723175 - protein, 19 aa, Entamoeba histolytica
PIYEYMLKLKIKKQTDLDS

SEQ ID NO: 2723176 - protein, 20 aa, Entamoeba histolytica
PIYKELTRSTKHPLGGTAYL

SEQ ID NO: 2723177 - protein, 19 aa, Entamoeba histolytica
PIYSSLIPSLVYPNKRLIK

SEQ ID NO: 2723178 - protein, 20 aa, Entamoeba histolytica
PKCQLVIFKIYNIFCSKYLD

SEQ ID NO: 2723179 - protein, 23 aa, Entamoeba histolytica
PKDCIPFVPFSLHSTLSIANSKV

SEQ ID NO: 2723180 - protein, 23 aa, Entamoeba histolytica
PKDEKAKIKPWTKLAASQAKADE

SEQ ID NO: 2723181 - protein, 41 aa, Entamoeba histolytica
PKDFDSDDLLSLLTFSLLHSTLKHPFAISILLECFLTDEDF

SEQ ID NO: 2723182 - protein, 19 aa, Entamoeba histolytica
PKDINELKLLKVELICKYQ

SEQ ID NO: 2723183 - protein, 22 aa, Entamoeba histolytica
PKDKFFIDFYDGVNKLKEVEPT

SEQ ID NO: 2723184 - protein, 29 aa, Entamoeba histolytica
PKDKNEHELFTSRLSLRKVADNIVEEKKV

SEQ ID NO: 2723185 - protein, 30 aa, Entamoeba histolytica
PKDKSPIPIRLPYSMAIKLFPLPTELHNKQ

SEQ ID NO: 2723186 - protein, 24 aa, Entamoeba histolytica
PKDLAFVGYTYKGFLNVVNTPSKK

SEQ ID NO: 2723187 - protein, 24 aa, Entamoeba histolytica
PKDLYKIISQYLSKQGWELSEEHL

SEQ ID NO: 2723188 - protein, 23 aa, Entamoeba histolytica
PKDTDFIHTISFADSFPLTLLNT

SEQ ID NO: 2723189 - protein, 22 aa, Entamoeba histolytica
PKDVFVIRQIYSAILNLSKEEM

SEQ ID NO: 2723190 - protein, 26 aa, Entamoeba histolytica
PKDVGSFIKALGDLKIIFSASKHSKT

SEQ ID NO: 2723191 - protein, 19 aa, Entamoeba histolytica
PKDYFVLKYINISEYQINE

SEQ ID NO: 2723192 - protein, 23 aa, Entamoeba histolytica
PKEIDRNIIKYVDTLIVNTNESM

SEQ ID NO: 2723193 - protein, 18 aa, Entamoeba histolytica
PKEVILEVLCDTLSPLNK

SEQ ID NO: 2723194 - protein, 24 aa, Entamoeba histolytica
PKEYHRFLMFVHSQLKAMIYELNK

SEQ ID NO: 2723195 - protein, 17 aa, Entamoeba histolytica
PKEYMKCSYCLNCGAFI

SEQ ID NO: 2723196 - protein, 25 aa, Entamoeba histolytica
PKFASLYVEFFIQVKRNPKIYDKFV

SEQ ID NO: 2723197 - protein, 22 aa, Entamoeba histolytica
PKGDVGLLLRWSDGEIKDIIPR

SEQ ID NO: 2723198 - protein, 25 aa, Entamoeba histolytica
PKGEYLFVLCFNSVRNRILYIYRVI

SEQ ID NO: 2723199 - protein, 17 aa, Entamoeba histolytica
PKGLYISRKKVINASPK

SEQ ID NO: 2723200 - protein, 28 aa, Entamoeba histolytica
PKGRHDFKARLFQFYTSEDNELLCNELR

SEQ ID NO: 2723201 - protein, 18 aa, Entamoeba histolytica
PKGTVLIAAPPPSCTKPT

SEQ ID NO: 2723202 - protein, 26 aa, Entamoeba histolytica
PKGVGALFIRAGKPITPLLHGGEQMG

SEQ ID NO: 2723203 - protein, 26 aa, Entamoeba histolytica
PKGYGISRTLVYNKALKAIGLHKCYC

SEQ ID NO: 2723204 - protein, 18 aa, Entamoeba histolytica
PKHLFLSTCLHRFKFSQQ

SEQ ID NO: 2723205 - protein, 22 aa, Entamoeba histolytica
PKHSYLLQQCYLNCLNKAIKAG

SEQ ID NO: 2723206 - protein, 28 aa, Entamoeba histolytica
PKIFDKSQFLLLFPSDIKITSTDFTCLH

SEQ ID NO: 2723207 - protein, 37 aa, Entamoeba histolytica
PKIIKEDLDRWEYAKSAILVLFKPLDYAMGNGASITI

SEQ ID NO: 2723208 - protein, 26 aa, Entamoeba histolytica
PKIKEGEYFYIDSTLTYTSEGIPYMF

SEQ ID NO: 2723209 - protein, 23 aa, Entamoeba histolytica
PKILSMMCDVILQDLPMLNGETG

SEQ ID NO: 2723210 - protein, 22 aa, Entamoeba histolytica
PKINFDLYKPCFDYLLSCLATN

SEQ ID NO: 2723211 - protein, 26 aa, Entamoeba histolytica
PKISKSLFVFPFQTTTTIPHLSKEQA

SEQ ID NO: 2723212 - protein, 23 aa, Entamoeba histolytica
PKISVMKIIIPPHTHLEKHHHLV

SEQ ID NO: 2723213 - protein, 20 aa, Entamoeba histolytica
PKITQLKRTFAPNTLNQVIG

SEQ ID NO: 2723214 - protein, 30 aa, Entamoeba histolytica
PKKDVYSQILSTLWQMSLIDMKYSMRRIEK

SEQ ID NO: 2723215 - protein, 23 aa, Entamoeba histolytica
PKKEIDDIFSIETPTKPSNNETV

SEQ ID NO: 2723216 - protein, 34 aa, Entamoeba histolytica; identical to SEQ ID NO: 2535993

SEQ ID NO: 2723217 - protein, 21 aa, Entamoeba histolytica
PKKLQFLTFERTKTLPIECEI

SEQ ID NO: 2723218 - protein, 38 aa, Entamoeba histolytica
PKKNEPQITKALVKKIYSQLKLVPPENGKYVSNEESVL

SEQ ID NO: 2723219 - protein, 25 aa, Entamoeba histolytica
PKKRDFYTFFSFKDKSKTAGWRLDY

SEQ ID NO: 2723220 - protein, 22 aa, Entamoeba histolytica
PKLMKFVIIHSSAKARKGLLKE

SEQ ID NO: 2723221 - protein, 18 aa, Entamoeba histolytica
PKMGIMIRIMENDTSAGH

SEQ ID NO: 2723222 - protein, 25 aa, Entamoeba histolytica
PKMKTTRLVLLILKSLKVLNPEIEY

SEQ ID NO: 2723223 - protein, 27 aa, Entamoeba histolytica
PKMNQDTLWYLCSFLYEIQLNEEKTRM

SEQ ID NO: 2723224 - protein, 20 aa, Entamoeba histolytica
PKMRIVFVGTFGVGKTSLIQ

SEQ ID NO: 2723225 - protein, 20 aa, Entamoeba histolytica
PKNALPLFKLQFLQTNNPEV

SEQ ID NO: 2723226 - protein, 22 aa, Entamoeba histolytica
PKNEWLQPVISKTPPEKVLIHQ

SEQ ID NO: 2723227 - protein, 26 aa, Entamoeba histolytica
PKNKEDYMIFLTSFLLILHRVNPTHE

SEQ ID NO: 2723228 - protein, 25 aa, Entamoeba histolytica
PKNKLDVIFLHFPDVQSMNSSFFEQ

SEQ ID NO: 2723229 - protein, 28 aa, Entamoeba histolytica
PKPHQHLLIVTKRPRSFKARPLINHSDG

SEQ ID NO: 2723230 - protein, 25 aa, Entamoeba histolytica
PKPSFNIGIPYYFNKEMHLFSMGIC

SEQ ID NO: 2723231 - protein, 24 aa, Entamoeba histolytica
PKQLHFKISLYGLELRFDSLFGID

SEQ ID NO: 2723232 - protein, 31 aa, Entamoeba histolytica; identical to SEQ ID NO: 2536015

SEQ ID NO: 2723233 - protein, 32 aa, Entamoeba histolytica
PKRKPSNLTLPKWFPTQPIPFDFKSNKIEDEF

SEQ ID NO: 2723234 - protein, 33 aa, Entamoeba histolytica
PKRSDSMGSIKKKKWGFSFFHREKKDKKDSASQ

SEQ ID NO: 2723235 - protein, 24 aa, Entamoeba histolytica
PKRVKAPTWYPIYHTSLNFKNFER

SEQ ID NO: 2723236 - protein, 17 aa, Entamoeba histolytica
PKSFIFCIGNFGGILDL

SEQ ID NO: 2723237 - protein, 20 aa, Entamoeba histolytica
PKSFLNCSKLMKIDVQGLQE

SEQ ID NO: 2723238 - protein, 18 aa, Entamoeba histolytica
PKSFLNCSKLMKIDVQGM

SEQ ID NO: 2723239 - protein, 27 aa, Entamoeba histolytica
PKSLIQLSLIRCKCFIQFNSSQLTRFI

SEQ ID NO: 2723240 - protein, 29 aa, Entamoeba histolytica
PKTQTELYFLQSEYYKIGLFGLNGKYYES

SEQ ID NO: 2723241 - protein, 23 aa, Entamoeba histolytica
PKTTIIAFRYLLAYYRQPEVKQC

SEQ ID NO: 2723242 - protein, 19 aa, Entamoeba histolytica
PKTVTALTLAIRRIDPIKR

SEQ ID NO: 2723243 - protein, 19 aa, Entamoeba histolytica
PKVFFEPFSIRYLAELKDL

SEQ ID NO: 2723244 - protein, 24 aa, Entamoeba histolytica
PKVIEPIYFAQWGTMWIAMRNEKA

SEQ ID NO: 2723245 - protein, 27 aa, Entamoeba histolytica
PKVKKFVYLIMSNLIYYNEQDLNKFFI

SEQ ID NO: 2723246 - protein, 18 aa, Entamoeba histolytica
PKVLAPLPQTIPRNSIPS

SEQ ID NO: 2723247 - protein, 24 aa, Entamoeba histolytica
PKVLQLVNWIPLLSTINLTQFIKS

SEQ ID NO: 2723248 - protein, 23 aa, Entamoeba histolytica
PKVRTDFYRFIDIKISKIAEQFF

SEQ ID NO: 2723249 - protein, 23 aa, Entamoeba histolytica
PKVTYKNTFILPTPPSCNKLKIK

SEQ ID NO: 2723250 - protein, 19 aa, Entamoeba histolytica
PKVYIYKTQEHIIKESIPI

SEQ ID NO: 2723251 - protein, 25 aa, Entamoeba histolytica
PKYSFARYWILDSIRAQHFMKTIQE

SEQ ID NO: 2723252 - protein, 19 aa, Entamoeba histolytica
PLAFCWTFWVDNFNDKNGT

SEQ ID NO: 2723253 - protein, 20 aa, Entamoeba histolytica
PLAKVWIAAHWEGKLTKQQI

SEQ ID NO: 2723254 - protein, 33 aa, Entamoeba histolytica
PLCKNYCFTFIPPVLDTIFQFVLVQPKSSYTDV

SEQ ID NO: 2723255 - protein, 27 aa, Entamoeba histolytica
PLCRHKNPIVIYTKKPMLFKELTKSSP

SEQ ID NO: 2723256 - protein, 17 aa, Entamoeba histolytica
PLDALVRPLALAPCTSD

SEQ ID NO: 2723257 - protein, 26 aa, Entamoeba histolytica
PLDANAWFVALAYTIKLSPRLNESKN

SEQ ID NO: 2723258 - protein, 27 aa, Entamoeba histolytica
PLDDIKTFLYLNISPQRPLFTKSSIDT

SEQ ID NO: 2723259 - protein, 25 aa, Entamoeba histolytica
PLDGPEALTFLKKQAIRFNAICAEP

SEQ ID NO: 2723260 - protein, 18 aa, Entamoeba histolytica
PLDILTLDRVPPTENEIQ

SEQ ID NO: 2723261 - protein, 18 aa, Entamoeba histolytica
PLDLCRYISILDSGNDIA

SEQ ID NO: 2723262 - protein, 19 aa, Entamoeba histolytica
PLDNLQVPYFVFTASRYLE

SEQ ID NO: 2723263 - protein, 19 aa, Entamoeba histolytica
PLDWIYDPNKSFFHIGLLL

SEQ ID NO: 2723264 - protein, 28 aa, Entamoeba histolytica
PLEDAKGKILPKLLIRTLFHNIDQVMTA

SEQ ID NO: 2723265 - protein, 25 aa, Entamoeba histolytica
PLEDEKLVLKLIWNDQLIVEHNETY

SEQ ID NO: 2723266 - protein, 21 aa, Entamoeba histolytica
PLEGRIQAKKRLLNDKLRGKE

SEQ ID NO: 2723267 - protein, 19 aa, Entamoeba histolytica
PLELPKLPPKRKSGFVKES

SEQ ID NO: 2723268 - protein, 32 aa, Entamoeba histolytica
PLEMVQSYHRVFYLFHCPFCLKFTVLRNQLPE

SEQ ID NO: 2723269 - protein, 19 aa, Entamoeba histolytica
PLENGIIKSWNDMELLWNY

SEQ ID NO: 2723270 - protein, 21 aa, Entamoeba histolytica
PLEPEVVFCNVPISHYVTGYQ

SEQ ID NO: 2723271 - protein, 27 aa, Entamoeba histolytica
PLEYAVQLQLPLLVKLILDIGNYTDVK

SEQ ID NO: 2723272 - protein, 17 aa, Entamoeba histolytica
PLFCICITRRELLQFPS

SEQ ID NO: 2723273 - protein, 32 aa, Entamoeba histolytica
PLFDENGHLNPSPIPIAFFLDDMDDEDREVQR

SEQ ID NO: 2723274 - protein, 18 aa, Entamoeba histolytica
PLFEEYFNNIKKLSIDFL

SEQ ID NO: 2723275 - protein, 22 aa, Entamoeba histolytica
PLFQIRDIFILPIQEYSSIYGC

SEQ ID NO: 2723276 - protein, 28 aa, Entamoeba histolytica
PLFSEPLQQKFCILPMLIQIHITLTIIN

SEQ ID NO: 2723277 - protein, 17 aa, Entamoeba histolytica
PLFSIKSWTNCETFEML

SEQ ID NO: 2723278 - protein, 20 aa, Entamoeba histolytica
PLGPQRITALGRSYHPDHFV

SEQ ID NO: 2723279 - protein, 19 aa, Entamoeba histolytica
PLGSFHKKTPIRIKECIMQ

SEQ ID NO: 2723280 - protein, 22 aa, Entamoeba histolytica
PLHIACLTKKLKMVVLLIEHCH

SEQ ID NO: 2723281 - protein, 21 aa, Entamoeba histolytica
PLHIQIPLYELGSNDVINFAS

SEQ ID NO: 2723282 - protein, 17 aa, Entamoeba histolytica
PLICSLISDHFGKRFSD

SEQ ID NO: 2723283 - protein, 19 aa, Entamoeba histolytica
PLIDVTKYHFLPSSTLHSK

SEQ ID NO: 2723284 - protein, 20 aa, Entamoeba histolytica
PLILNTFNSIIQFIQLLQQQ

SEQ ID NO: 2723285 - protein, 19 aa, Entamoeba histolytica
PLINQQLLEKFPFCRGSSA

SEQ ID NO: 2723286 - protein, 26 aa, Entamoeba histolytica
PLIRQRSVYIIMRILNSMPDNYTLTE

SEQ ID NO: 2723287 - protein, 26 aa, Entamoeba histolytica
PLKEVKPFVKLYYKSFNILQKRYENK

SEQ ID NO: 2723288 - protein, 17 aa, Entamoeba histolytica
PLKILQIDQQHMPSFHF

SEQ ID NO: 2723289 - protein, 17 aa, Entamoeba histolytica
PLKSDFMTKLKQIIVAI

SEQ ID NO: 2723290 - protein, 17 aa, Entamoeba histolytica
PLKVFLKSQQDGNNVAT

SEQ ID NO: 2723291 - protein, 17 aa, Entamoeba histolytica
PLLDTWCLFRTEVRKEA

SEQ ID NO: 2723292 - protein, 19 aa, Entamoeba histolytica
PLLFLCLSKPLYKQPQLSL

SEQ ID NO: 2723293 - protein, 18 aa, Entamoeba histolytica
PLLNVFIAKLFTQKAYAP

SEQ ID NO: 2723294 - protein, 21 aa, Entamoeba histolytica
PLLPTLKFSEGVSEWKVFDKH

SEQ ID NO: 2723295 - protein, 17 aa, Entamoeba histolytica
PLLTLSKNNRLLVEKAF

SEQ ID NO: 2723296 - protein, 22 aa, Entamoeba histolytica
PLMIAVACGAIESFKYLRDMGS

SEQ ID NO: 2723297 - protein, 18 aa, Entamoeba histolytica
PLMKTISFLLKKNGKCLI

SEQ ID NO: 2723298 - protein, 26 aa, Entamoeba histolytica
PLNEALILWDYYFAKGCFNVVYITLA

SEQ ID NO: 2723299 - protein, 17 aa, Entamoeba histolytica
PLNIWNFCFGDGLRVSR

SEQ ID NO: 2723300 - protein, 28 aa, Entamoeba histolytica
PLNLNDQYHFFFLIQDVTFPEEQKKETT

SEQ ID NO: 2723301 - protein, 30 aa, Entamoeba histolytica
PLNYNPQLVNWLFLWKHSLPLPLSNSSSST

SEQ ID NO: 2723302 - protein, 18 aa, Entamoeba histolytica
PLPDPIIFLRACMSRIDL

SEQ ID NO: 2723303 - protein, 27 aa, Entamoeba histolytica
PLPENGYFLMKCVSHLMTMVPFFNIMC

SEQ ID NO: 2723304 - protein, 20 aa, Entamoeba histolytica
PLPLCFALALQNIDVWEFVY

SEQ ID NO: 2723305 - protein, 19 aa, Entamoeba histolytica
PLPTFIIEVTLDELFSDSI

SEQ ID NO: 2723306 - protein, 31 aa, Entamoeba histolytica
PLQGLKLEGEFLIFTKRQFKRTRDGKEKIVN

SEQ ID NO: 2723307 - protein, 17 aa, Entamoeba histolytica
PLQKSLLFHRKYPFFTG

SEQ ID NO: 2723308 - protein, 18 aa, Entamoeba histolytica
PLQNASFTPVRRYKQPKQ

SEQ ID NO: 2723309 - protein, 17 aa, Entamoeba histolytica
PLQNRLLFNFSSSSFEL

SEQ ID NO: 2723310 - protein, 23 aa, Entamoeba histolytica
PLQQIACIFLRQSISHTNMDVST

SEQ ID NO: 2723311 - protein, 33 aa, Entamoeba histolytica
PLREKFLSNLVAPTLYYFATIASPSLLTPPKVF

SEQ ID NO: 2723312 - protein, 23 aa, Entamoeba histolytica
PLRLKIMNFVRTWMKNAWKDFEA

SEQ ID NO: 2723313 - protein, 22 aa, Entamoeba histolytica
PLRVIFRIEEYTRAVWPSYRTV

SEQ ID NO: 2723314 - protein, 22 aa, Entamoeba histolytica
PLSIDIFNPLFLLTPQNDQKHI

SEQ ID NO: 2723315 - protein, 23 aa, Entamoeba histolytica
PLSIIIIFLLKQCTCSNELSEEN

SEQ ID NO: 2723316 - protein, 19 aa, Entamoeba histolytica
PLSIVPIHDHLISRFSELE

SEQ ID NO: 2723317 - protein, 20 aa, Entamoeba histolytica
PLSQFLPKYYSKENIDLGFG

SEQ ID NO: 2723318 - protein, 20 aa, Entamoeba histolytica
PLSTKLLMKYAPRDHLPGMP

SEQ ID NO: 2723319 - protein, 19 aa, Entamoeba histolytica
PLSYLLPRGQQVKVITQLY

SEQ ID NO: 2723320 - protein, 25 aa, Entamoeba histolytica
PLTARLAMKKAKPDGIYYLLSNIEE

SEQ ID NO: 2723321 - protein, 25 aa, Entamoeba histolytica
PLTCNLCYRMLRFPDDSIKIISRKH

SEQ ID NO: 2723322 - protein, 18 aa, Entamoeba histolytica
PLTEYILIDSISVTILLT

SEQ ID NO: 2723323 - protein, 20 aa, Entamoeba histolytica
PLTICQLYMNIPSSQRPKVI

SEQ ID NO: 2723324 - protein, 19 aa, Entamoeba histolytica
PLTILSLLGLYLDLIGMEQ

SEQ ID NO: 2723325 - protein, 17 aa, Entamoeba histolytica
PLTYPLVETLNIYLSLP

SEQ ID NO: 2723326 - protein, 19 aa, Entamoeba histolytica
PLVISLMQHIYTHDNFFEN

SEQ ID NO: 2723327 - protein, 26 aa, Entamoeba histolytica
PLVLQKKIILFCPFPSQLNKFKEFPL

SEQ ID NO: 2723328 - protein, 20 aa, Entamoeba histolytica
PLVTGQRILDSLFPCIQGGT

SEQ ID NO: 2723329 - protein, 17 aa, Entamoeba histolytica
PMDVQCEWILPTTITEL

SEQ ID NO: 2723330 - protein, 31 aa, Entamoeba histolytica; identical to SEQ ID NO: 2536125

SEQ ID NO: 2723331 - protein, 17 aa, Entamoeba histolytica
PMEPFKMPFPQKEIKRY

SEQ ID NO: 2723332 - protein, 20 aa, Entamoeba histolytica
PMGGNIYPPGHPLYGVNTTT

SEQ ID NO: 2723333 - protein, 17 aa, Entamoeba histolytica
PMGYWPDAVCRPQEKQK

SEQ ID NO: 2723334 - protein, 19 aa, Entamoeba histolytica
PMHNTLISALHHLYAISAL

SEQ ID NO: 2723335 - protein, 25 aa, Entamoeba histolytica
PMHSGGMLGGWKFSNFKDGVFSEVF

SEQ ID NO: 2723336 - protein, 17 aa, Entamoeba histolytica
PMINPMANFFIGVGIQQ

SEQ ID NO: 2723337 - protein, 21 aa, Entamoeba histolytica
PMKDRWITIKNVRFNKYSSFI

SEQ ID NO: 2723338 - protein, 20 aa, Entamoeba histolytica
PMLQSVVDTFWAVGTPPSEI

SEQ ID NO: 2723339 - protein, 20 aa, Entamoeba histolytica
PMMWSLIELPKPPELFDFIQ

SEQ ID NO: 2723340 - protein, 18 aa, Entamoeba histolytica
PMNFPVSKSASPFWDMGC

SEQ ID NO: 2723341 - protein, 24 aa, Entamoeba histolytica
PMQLLRIPKCKICSAYFSPLTHWI

SEQ ID NO: 2723342 - protein, 37 aa, Entamoeba histolytica; identical to SEQ ID NO: 2536140

SEQ ID NO: 2723343 - protein, 19 aa, Entamoeba histolytica
PMTILPNMNITKTTPFILS

SEQ ID NO: 2723344 - protein, 22 aa, Entamoeba histolytica
PMTLIKISLMKEPIRKLYLLPS

SEQ ID NO: 2723345 - protein, 23 aa, Entamoeba histolytica
PNAILDIFFLHCKKWGLNPNAAT

SEQ ID NO: 2723346 - protein, 24 aa, Entamoeba histolytica
PNALYQMDYPKEQVYLFGFINEVE

SEQ ID NO: 2723347 - protein, 24 aa, Entamoeba histolytica
PNAQAIHVLPYMDTIEGLTGDLFD

SEQ ID NO: 2723348 - protein, 25 aa, Entamoeba histolytica
PNASRKFIRFGLITIYEPEAKTKYR

SEQ ID NO: 2723349 - protein, 19 aa, Entamoeba histolytica
PNCYTPHFSLLQPQIEEDP

SEQ ID NO: 2723350 - protein, 18 aa, Entamoeba histolytica
PNDEVFLNSFIPSSLHDL

SEQ ID NO: 2723351 - protein, 25 aa, Entamoeba histolytica
PNDIKQWAVNPLLYSPIQQENIDNN

SEQ ID NO: 2723352 - protein, 25 aa, Entamoeba histolytica
PNDLPTTFWQRCNISHIESLAQLLR

SEQ ID NO: 2723353 - protein, 36 aa, Entamoeba histolytica
PNDNFKMFLPQIQITNIIQLIQLIQQVNGRTIVAVG

SEQ ID NO: 2723354 - protein, 31 aa, Entamoeba histolytica
PNDYESKLLLYHSFFLSLPPESIHYLGFIDF

SEQ ID NO: 2723355 - protein, 27 aa, Entamoeba histolytica
PNEHYHIGFYWLNVFMSPRTMDSIIAS

SEQ ID NO: 2723356 - protein, 26 aa, Entamoeba histolytica
PNELEEYVFLYNKYKQRGVFFPELKK

SEQ ID NO: 2723357 - protein, 29 aa, Entamoeba histolytica
PNERLCLESFMKIQLIDLSHDLPASGNQL

SEQ ID NO: 2723358 - protein, 18 aa, Entamoeba histolytica
PNETTAYAFVKYDNTLSP

SEQ ID NO: 2723359 - protein, 21 aa, Entamoeba histolytica
PNEYLLALRTLNGKYIGTRPC

SEQ ID NO: 2723360 - protein, 29 aa, Entamoeba histolytica
PNFIPTVIVALVFNYLYPKETTEFRLGAV

SEQ ID NO: 2723361 - protein, 23 aa, Entamoeba histolytica
PNFNEILQGPLTLQQSHRFDLIQ

SEQ ID NO: 2723362 - protein, 23 aa, Entamoeba histolytica
PNIARVVFVHWKGSKCKGMKVVR

SEQ ID NO: 2723363 - protein, 18 aa, Entamoeba histolytica
PNIVSFFGSYLEEGYVWV

SEQ ID NO: 2723364 - protein, 26 aa, Entamoeba histolytica
PNKDIIPGTPFFRVILHCKKQRRSVI

SEQ ID NO: 2723365 - protein, 25 aa, Entamoeba histolytica
PNKKYFRFKTLKELIMRIPLKLGGG

SEQ ID NO: 2723366 - protein, 31 aa, Entamoeba histolytica
PNKKYLTKYLTSKIFDVFYHCSPRLTDPTTG

SEQ ID NO: 2723367 - protein, 32 aa, Entamoeba histolytica
PNKTTASLVLGFIWMLFDKFQEKDIKLSMKEK

SEQ ID NO: 2723368 - protein, 20 aa, Entamoeba histolytica
PNLSLLRNHLSREGLLHPDC

SEQ ID NO: 2723369 - protein, 30 aa, Entamoeba histolytica; identical to SEQ ID NO: 2536176

SEQ ID NO: 2723370 - protein, 23 aa, Entamoeba histolytica
PNNGPLSDILWADPLDEPPEEDL

SEQ ID NO: 2723371 - protein, 22 aa, Entamoeba histolytica
PNNILNCYYIFIGPKDTPYEGG

SEQ ID NO: 2723372 - protein, 25 aa, Entamoeba histolytica
PNNIVEILSILQLSSIRIIYNNNEI

SEQ ID NO: 2723373 - protein, 28 aa, Entamoeba histolytica
PNNKRMTYVLPLITPTLTYSGILRVVCY

SEQ ID NO: 2723374 - protein, 26 aa, Entamoeba histolytica
PNNMPFPPFLTSSWMKKGFGFEDFML

SEQ ID NO: 2723375 - protein, 29 aa, Entamoeba histolytica
PNPCMWDLVAYRIKFFPHPVTGDRLCCYP

SEQ ID NO: 2723376 - protein, 23 aa, Entamoeba histolytica
PNPFILNNRTPILLIQNPDYLIN

SEQ ID NO: 2723377 - protein, 23 aa, Entamoeba histolytica
PNPILNIFKGLNQYYTYFVFGVT

SEQ ID NO: 2723378 - protein, 24 aa, Entamoeba histolytica
PNPKPFHQIKFQLNGKTIPISCSA

SEQ ID NO: 2723379 - protein, 27 aa, Entamoeba histolytica
PNPLPFDMFILLFKSAVDDHYFIAAQT

SEQ ID NO: 2723380 - protein, 31 aa, Entamoeba histolytica
PNPSKHFKGIPAFWHRIFIIENLSDESDMKC

SEQ ID NO: 2723381 - protein, 29 aa, Entamoeba histolytica
PNQFPKFTCQWIELFSHRSLLLSLSKPSE

SEQ ID NO: 2723382 - protein, 21 aa, Entamoeba histolytica
PNQIQFIINALPRITSFSMQG

SEQ ID NO: 2723383 - protein, 27 aa, Entamoeba histolytica
PNQITTYVFLGDRFVLLGSISFVDGWN

SEQ ID NO: 2723384 - protein, 25 aa, Entamoeba histolytica
PNQSLQQMLSKMLGFFVIEHQVQQT

SEQ ID NO: 2723385 - protein, 20 aa, Entamoeba histolytica
PNRLFAPMLGPFIGCKQAVI

SEQ ID NO: 2723386 - protein, 29 aa, Entamoeba histolytica
PNSDIFMSFYFNYIKFIYFTIKGQDDFID

SEQ ID NO: 2723387 - protein, 28 aa, Entamoeba histolytica
PNSDKRFVFTCFSAFWVLSDGTAYIHQG

SEQ ID NO: 2723388 - protein, 21 aa, Entamoeba histolytica
PNSKWVLFTMVELYQITKKID

SEQ ID NO: 2723389 - protein, 22 aa, Entamoeba histolytica
PNSVFNYYKQLLKLRKENPIMP

SEQ ID NO: 2723390 - protein, 24 aa, Entamoeba histolytica
PNSVQAFHLLYLRLSAITEDKEIL

SEQ ID NO: 2723391 - protein, 25 aa, Entamoeba histolytica
PNTAYICTRYYRAPELIFGCVDYTT

SEQ ID NO: 2723392 - protein, 23 aa, Entamoeba histolytica
PNTDLNNIIPWKTKSNTQTKTKK

SEQ ID NO: 2723393 - protein, 28 aa, Entamoeba histolytica
PNTEKQFIFTMYSAFWLTTDGKVTFHQM

SEQ ID NO: 2723394 - protein, 30 aa, Entamoeba histolytica
PNTIAVVTIFFVLRYYNVLNGSIEKIITTN

SEQ ID NO: 2723395 - protein, 27 aa, Entamoeba histolytica
PNTLSTLTLSYCKSLWLSTLTGLENEL

SEQ ID NO: 2723396 - protein, 21 aa, Entamoeba histolytica
PNTMADVFKGLNFTNPFSNQT

SEQ ID NO: 2723397 - protein, 23 aa, Entamoeba histolytica
PNTNTRLNYLKKLKLCLYNYCKD

SEQ ID NO: 2723398 - protein, 22 aa, Entamoeba histolytica
PNTYPIEQLIKKYGFKPEEMVM

SEQ ID NO: 2723399 - protein, 18 aa, Entamoeba histolytica
PNVLRPNKKYITKESVYY

SEQ ID NO: 2723400 - protein, 17 aa, Entamoeba histolytica
PNYFDIIKTPMDLGTVI

SEQ ID NO: 2723401 - protein, 29 aa, Entamoeba histolytica
PNYKKIIHLLEQRIWRYYYIHYKQIQCDQ

SEQ ID NO: 2723402 - protein, 17 aa, Entamoeba histolytica
PNYPPPPSLLEYPRNVF

SEQ ID NO: 2723403 - protein, 27 aa, Entamoeba histolytica
PPAGTLFQPLVASLLRCFLHNPLSPKV

SEQ ID NO: 2723404 - protein, 27 aa, Entamoeba histolytica
PPANNPFILHLNHMPVIFDVLEMLEYP

SEQ ID NO: 2723405 - protein, 19 aa, Entamoeba histolytica
PPCFISLSSMCFDSCRATK

SEQ ID NO: 2723406 - protein, 17 aa, Entamoeba histolytica
PPEILFSSIIKLMKLLL

SEQ ID NO: 2723407 - protein, 27 aa, Entamoeba histolytica
PPENMILTSVPVPPIAIRPSVAMDGGN

SEQ ID NO: 2723408 - protein, 26 aa, Entamoeba histolytica
PPGIHRFPFSFILPQTHCPMLVLPNE

SEQ ID NO: 2723409 - protein, 21 aa, Entamoeba histolytica
PPGIISIFLGNVIQTLIDSIT

SEQ ID NO: 2723410 - protein, 17 aa, Entamoeba histolytica
PPHGQAPSLPPPVPPPR

SEQ ID NO: 2723411 - protein, 19 aa, Entamoeba histolytica
PPHPFAKPFSNRYSTSAEG

SEQ ID NO: 2723412 - protein, 30 aa, Entamoeba histolytica
PPHSELHAMRAIFLIPNRPPPTLSTPEEVS

SEQ ID NO: 2723413 - protein, 18 aa, Entamoeba histolytica
PPIAIRPSVAMDGGNASN

SEQ ID NO: 2723414 - protein, 29 aa, Entamoeba histolytica
PPIYGHYIVKTAIVLVLFGGTRKHDIAKI

SEQ ID NO: 2723415 - protein, 23 aa, Entamoeba histolytica
PPIYHDIFFNKRQSMYFTRHRPN

SEQ ID NO: 2723416 - protein, 24 aa, Entamoeba histolytica
PPKAVECVLIMDGFKMGIYKQKLL

SEQ ID NO: 2723417 - protein, 25 aa, Entamoeba histolytica
PPKLEIPQFPEFLVIRSNIQSKKFD

SEQ ID NO: 2723418 - protein, 24 aa, Entamoeba histolytica
PPKLQYLCTFFSKMNYDINILTTL

SEQ ID NO: 2723419 - protein, 17 aa, Entamoeba histolytica
PPKNNTLLLFNEDGIWK

SEQ ID NO: 2723420 - protein, 30 aa, Entamoeba histolytica
PPLRTDLLTKFKQMIIALPNTSYVLGERFD

SEQ ID NO: 2723421 - protein, 37 aa, Entamoeba histolytica
PPMQGFPQQPPMQGFPQQPPMQGFPQENQYPPIHENP

SEQ ID NO: 2723422 - protein, 19 aa, Entamoeba histolytica
PPNGFLFRFLRDETVLFGV

SEQ ID NO: 2723423 - protein, 20 aa, Entamoeba histolytica
PPNGFLFRFLRDETVLFGVD

SEQ ID NO: 2723424 - protein, 18 aa, Entamoeba histolytica
PPNLIHFSLKDIDFRSLV

SEQ ID NO: 2723425 - protein, 22 aa, Entamoeba histolytica
PPNLPFICPSSIELKVIILSSL

SEQ ID NO: 2723426 - protein, 22 aa, Entamoeba histolytica
PPPGMPGMPPPPPPPGMPGMPP

SEQ ID NO: 2723427 - protein, 20 aa, Entamoeba histolytica
PPPLPGMPGMPPPPPGMPGM

SEQ ID NO: 2723428 - protein, 20 aa, Entamoeba histolytica
PPPMGKGMPPPPGLAPAQTK

SEQ ID NO: 2723429 - protein, 25 aa, Entamoeba histolytica
PPPPGMPGMPPPPPLPGMPGMPPPP

SEQ ID NO: 2723430 - protein, 21 aa, Entamoeba histolytica
PPPPPAGAPPPPSGGMPPPPP

SEQ ID NO: 2723431 - protein, 19 aa, Entamoeba histolytica
PPPPPGGFGFRPAAPKPNA

SEQ ID NO: 2723432 - protein, 18 aa, Entamoeba histolytica
PPPPPGGFGFRPAAPVIN

SEQ ID NO: 2723433 - protein, 19 aa, Entamoeba histolytica
PPPPPPGASSIPPPPPPPG

SEQ ID NO: 2723434 - protein, 26 aa, Entamoeba histolytica
PPPPPPGMPGMPPPPPPPGMPGMPPP

SEQ ID NO: 2723435 - protein, 20 aa, Entamoeba histolytica
PPPVPPRRSPKPKPCSYAPP

SEQ ID NO: 2723436 - protein, 18 aa, Entamoeba histolytica
PPQCNYPCLIIPPCGHPP

SEQ ID NO: 2723437 - protein, 20 aa, Entamoeba histolytica
PPQPFTLTPLKNFSVQQSII

SEQ ID NO: 2723438 - protein, 26 aa, Entamoeba histolytica
PPRNTIHIFASTLLRYFDDQIKEIYD

SEQ ID NO: 2723439 - protein, 18 aa, Entamoeba histolytica
PPSATRLMYSFNGSEFET

SEQ ID NO: 2723440 - protein, 17 aa, Entamoeba histolytica
PPSFELQKKWYFPIIQS

SEQ ID NO: 2723441 - protein, 26 aa, Entamoeba histolytica
PPSILLSPKHRAPPPPLSPRVNGLND

SEQ ID NO: 2723442 - protein, 21 aa, Entamoeba histolytica
PPSIYPHKRFYLKIQDIITQI

SEQ ID NO: 2723443 - protein, 26 aa, Entamoeba histolytica
PPSVRNTWWFPLLNTIPLDQYTRIYQ

SEQ ID NO: 2723444 - protein, 17 aa, Entamoeba histolytica
PPSYREIIPLLYQNKTQ

SEQ ID NO: 2723445 - protein, 17 aa, Entamoeba histolytica
PPVAFPKKDDKIKIGRS

SEQ ID NO: 2723446 - protein, 19 aa, Entamoeba histolytica
PPVAPAIGNPPPPPPIAPP

SEQ ID NO: 2723447 - protein, 34 aa, Entamoeba histolytica
PQAATASQVLGLLWQLIDYDLRKTLGSMDCEGDV

SEQ ID NO: 2723448 - protein, 24 aa, Entamoeba histolytica
PQAKGFVKNSFFTGLNATEFFFHT

SEQ ID NO: 2723449 - protein, 20 aa, Entamoeba histolytica
PQAMRAMLMMNPQTAQMMNN

SEQ ID NO: 2723450 - protein, 25 aa, Entamoeba histolytica
PQDESAVIEPCKYSYEGEVIENEEW

SEQ ID NO: 2723451 - protein, 25 aa, Entamoeba histolytica
PQDESAVIEPCKYSYEGEVVENEEW

SEQ ID NO: 2723452 - protein, 21 aa, Entamoeba histolytica
PQDHYFLLTEPPMNPPENREY

SEQ ID NO: 2723453 - protein, 18 aa, Entamoeba histolytica
PQDKIPTDSTLKKALEQW

SEQ ID NO: 2723454 - protein, 18 aa, Entamoeba histolytica
PQEDVTLLQFKKYFESVK

SEQ ID NO: 2723455 - protein, 21 aa, Entamoeba histolytica
PQEIKQIYIPLAEKQRPKNLE

SEQ ID NO: 2723456 - protein, 23 aa, Entamoeba histolytica
PQEKLEIKKLGKTTLLLKVRCTC

SEQ ID NO: 2723457 - protein, 20 aa, Entamoeba histolytica
PQEMTYYKERYGESDYVLMF

SEQ ID NO: 2723458 - protein, 18 aa, Entamoeba histolytica
PQESFKFISPTPGNLITS

SEQ ID NO: 2723459 - protein, 27 aa, Entamoeba histolytica
PQESIKHEFIKSLQPKKTYIGIDEIFG

SEQ ID NO: 2723460 - protein, 23 aa, Entamoeba histolytica
PQEWLWCESWCNQKVKSKAKTID

SEQ ID NO: 2723461 - protein, 24 aa, Entamoeba histolytica
PQFIHLYIDWVIKTGFNFISFETL

SEQ ID NO: 2723462 - protein, 17 aa, Entamoeba histolytica
PQFWVNLCQSQDDFRIV

SEQ ID NO: 2723463 - protein, 17 aa, Entamoeba histolytica
PQGKCYCLFEYQNPEYK

SEQ ID NO: 2723464 - protein, 23 aa, Entamoeba histolytica
PQGQLIPFITSPPQLCEEVIKLL

SEQ ID NO: 2723465 - protein, 19 aa, Entamoeba histolytica
PQGVIYDMLCSYCLPFLFY

SEQ ID NO: 2723466 - protein, 25 aa, Entamoeba histolytica
PQIFNSITLPFINSIPSSEFQWIYN

SEQ ID NO: 2723467 - protein, 20 aa, Entamoeba histolytica
PQIKYFWEIAKSLTLEQKKK

SEQ ID NO: 2723468 - protein, 31 aa, Entamoeba histolytica
PQINNKGVPFFWIRALNAVSLFLSYNTVEED

SEQ ID NO: 2723469 - protein, 17 aa, Entamoeba histolytica
PQIVKYLMDKEVLMICI

SEQ ID NO: 2723470 - protein, 23 aa, Entamoeba histolytica
PQKKKLLCQVPIMNWDKVMELVK

SEQ ID NO: 2723471 - protein, 19 aa, Entamoeba histolytica
PQKRYLNLAKMRSLSSILK

SEQ ID NO: 2723472 - protein, 17 aa, Entamoeba histolytica
PQLGYLCKIGYVDAIIC

SEQ ID NO: 2723473 - protein, 26 aa, Entamoeba histolytica
PQLIAVIREFFTKMGLPDVRFKPAYN

SEQ ID NO: 2723474 - protein, 33 aa, Entamoeba histolytica
PQLIPHSVFSSYLFTIFLNYSYNSGISTLILPK

SEQ ID NO: 2723475 - protein, 25 aa, Entamoeba histolytica
PQLSKFWTCSGYQPTYLRLTANDIT

SEQ ID NO: 2723476 - protein, 19 aa, Entamoeba histolytica
PQNIFGLGLTLTYYQVEEI

SEQ ID NO: 2723477 - protein, 23 aa, Entamoeba histolytica
PQNKITLFDAYKTLLVCALEENK

SEQ ID NO: 2723478 - protein, 17 aa, Entamoeba histolytica
PQNLVRFHKIGVKLQNA

SEQ ID NO: 2723479 - protein, 24 aa, Entamoeba histolytica
PQPGFHQPQFRYPQQFVGQFRAPF

SEQ ID NO: 2723480 - protein, 30 aa, Entamoeba histolytica
PQPIPLLKEFLYMIYTIPGYITPLIPTNKP

SEQ ID NO: 2723481 - protein, 32 aa, Entamoeba histolytica
PQPPSFELQKKWYFPIIQSIKPQQFSQIIAWF

SEQ ID NO: 2723482 - protein, 17 aa, Entamoeba histolytica
PQPSRDLTLYYKEKRNK

SEQ ID NO: 2723483 - protein, 29 aa, Entamoeba histolytica
PQQMNEMVFWYKYFSFLFKSENQNSLLDD

SEQ ID NO: 2723484 - protein, 18 aa, Entamoeba histolytica
PQRIIVSTLSLFKLDKFS

SEQ ID NO: 2723485 - protein, 24 aa, Entamoeba histolytica
PQRLKWFLEILGASYLLDKGASAF

SEQ ID NO: 2723486 - protein, 18 aa, Entamoeba histolytica
PQRVFDYLFEHPDGKNIL

SEQ ID NO: 2723487 - protein, 17 aa, Entamoeba histolytica
PQRVLSFGKILLENKHY

SEQ ID NO: 2723488 - protein, 41 aa, Entamoeba histolytica
PQSAVSQFWSYRWNFLLMASEGYIIIAPNRRGLPGFGMEWL

SEQ ID NO: 2723489 - protein, 21 aa, Entamoeba histolytica
PQSLQLLIDDIYFISDLLTLP

SEQ ID NO: 2723490 - protein, 28 aa, Entamoeba histolytica
PQTEIFKHCWLVLELLRKSIQQTGADEN

SEQ ID NO: 2723491 - protein, 17 aa, Entamoeba histolytica
PQTQRIPQLLRFVSDLS

SEQ ID NO: 2723492 - protein, 27 aa, Entamoeba histolytica
PQTTPSKQLNFLPPSKYPQSPSQQRKQ

SEQ ID NO: 2723493 - protein, 20 aa, Entamoeba histolytica
PQTYAFFMNTLLEIKIRKEF

SEQ ID NO: 2723494 - protein, 32 aa, Entamoeba histolytica
PQVVYDLCRWIYMHGIEVEGIFRISGNNEYIK

SEQ ID NO: 2723495 - protein, 19 aa, Entamoeba histolytica
PQVYYKPLLEFFKGTSQPN

SEQ ID NO: 2723496 - protein, 20 aa, Entamoeba histolytica
PQYISTPFTSPSLPLPDSKT

SEQ ID NO: 2723497 - protein, 28 aa, Entamoeba histolytica
PQYKKQFPDLKISEIGKKIGVEWKELPE

SEQ ID NO: 2723498 - protein, 17 aa, Entamoeba histolytica
PQYPSYYSTFNSSTSYI

SEQ ID NO: 2723499 - protein, 26 aa, Entamoeba histolytica
PRAIEEIFKILYTKGCYTKGIFRENS

SEQ ID NO: 2723500 - protein, 32 aa, Entamoeba histolytica
PRAKSVLHLYRDILPYLINKPKHIFIENVPLF

SEQ ID NO: 2723501 - protein, 21 aa, Entamoeba histolytica
PRDNQLVSLDKIKPFSDINSV

SEQ ID NO: 2723502 - protein, 18 aa, Entamoeba histolytica
PRDRYNSYSPSRDYREVR

SEQ ID NO: 2723503 - protein, 21 aa, Entamoeba histolytica
PRDYHLIYLMITKKVNPFIHY

SEQ ID NO: 2723504 - protein, 33 aa, Entamoeba histolytica
PRFDNTVLHLLLAYIRKPVPTGKKLYILSTTCL

SEQ ID NO: 2723505 - protein, 17 aa, Entamoeba histolytica
PRIQHFSNLIKLLTVMK

SEQ ID NO: 2723506 - protein, 26 aa, Entamoeba histolytica
PRKKNDIEPWLKREFGEVIIKEQKEI

SEQ ID NO: 2723507 - protein, 23 aa, Entamoeba histolytica
PRKRDIYLQLYKKGTKDRVNVLY

SEQ ID NO: 2723508 - protein, 25 aa, Entamoeba histolytica
PRKRSKITLPFFNVIRISTEKEVVE

SEQ ID NO: 2723509 - protein, 26 aa, Entamoeba histolytica
PRKVITHPTIPLLYILEGDNNSCKVG

SEQ ID NO: 2723510 - protein, 21 aa, Entamoeba histolytica
PRLPKPLFEENLPKGYESVLK

SEQ ID NO: 2723511 - protein, 18 aa, Entamoeba histolytica
PRMLSYYMEYANWCKSID

SEQ ID NO: 2723512 - protein, 17 aa, Entamoeba histolytica
PRMPTIMGFKRKGYSAD

SEQ ID NO: 2723513 - protein, 19 aa, Entamoeba histolytica
PRMRKCGQFLVRTPSIKNF

SEQ ID NO: 2723514 - protein, 29 aa, Entamoeba histolytica
PRPHQHMLIVLKRPRSFKARPIITHSDGT

SEQ ID NO: 2723515 - protein, 17 aa, Entamoeba histolytica
PRQLYQPQPGTCPVTPP

SEQ ID NO: 2723516 - protein, 18 aa, Entamoeba histolytica
PRRVVISEFAVLFKEHDP

SEQ ID NO: 2723517 - protein, 26 aa, Entamoeba histolytica
PRSFNIVFQPPLRIIKKQKITSTWSR

SEQ ID NO: 2723518 - protein, 17 aa, Entamoeba histolytica
PRSLKYLFEKVNAQMDT

SEQ ID NO: 2723519 - protein, 23 aa, Entamoeba histolytica
PRSPRKFIPWGLSPSPTFSRSPS

SEQ ID NO: 2723520 - protein, 20 aa, Entamoeba histolytica
PRSYIYNGFLSFAMIATAAE

SEQ ID NO: 2723521 - protein, 24 aa, Entamoeba histolytica
PRTHYFFSVSRDKSLRYWDADKQI

SEQ ID NO: 2723522 - protein, 30 aa, Entamoeba histolytica; identical to SEQ ID NO: 2536327

SEQ ID NO: 2723523 - protein, 27 aa, Entamoeba histolytica
PRVINELFMTLEKRGLRYRMRVTHVEI

SEQ ID NO: 2723524 - protein, 22 aa, Entamoeba histolytica
PSAFYNCHLLSYIAISTSSSLK

SEQ ID NO: 2723525 - protein, 21 aa, Entamoeba histolytica
PSCFDFLQFTNYTLKSIVSAE

SEQ ID NO: 2723526 - protein, 23 aa, Entamoeba histolytica
PSCKLRLQILKDQLLKQKQIQQG

SEQ ID NO: 2723527 - protein, 24 aa, Entamoeba histolytica
PSCMSDHTIIPVPSQSLLELIKTY

SEQ ID NO: 2723528 - protein, 19 aa, Entamoeba histolytica
PSDAKWFKPIELFTKQGVC

SEQ ID NO: 2723529 - protein, 23 aa, Entamoeba histolytica
PSDFDKFHKLQLIKDTLLDTETR

SEQ ID NO: 2723530 - protein, 25 aa, Entamoeba histolytica
PSDGLALFIATLRYLQSLGSNAPKT

SEQ ID NO: 2723531 - protein, 22 aa, Entamoeba histolytica
PSEFDIFHFFKSDIELFKWNIE

SEQ ID NO: 2723532 - protein, 36 aa, Entamoeba histolytica
PSEQSLPKQNTLPPKPAAPAALPPKHHQSLSPKTSS

SEQ ID NO: 2723533 - protein, 21 aa, Entamoeba histolytica
PSFIPLPPEYIGKIPIQIIKT

SEQ ID NO: 2723534 - protein, 18 aa, Entamoeba histolytica
PSFWKKSFIDKLEGVYEV

SEQ ID NO: 2723535 - protein, 28 aa, Entamoeba histolytica
PSGGMPPPPPPPAGAPPPPVGMPPPPSN

SEQ ID NO: 2723536 - protein, 27 aa, Entamoeba histolytica
PSGLGRVFIEFKTIEGAIKCWKEIIKK

SEQ ID NO: 2723537 - protein, 24 aa, Entamoeba histolytica
PSHPTDFLLLWNTINNFIWTFTKK

SEQ ID NO: 2723538 - protein, 24 aa, Entamoeba histolytica
PSIEIIQFIYLLKTQTHYYQQISN

SEQ ID NO: 2723539 - protein, 21 aa, Entamoeba histolytica
PSIELLNTLHLKELKIIGVNE

SEQ ID NO: 2723540 - protein, 22 aa, Entamoeba histolytica
PSIEYLWIVDKKATSLPAQKYC

SEQ ID NO: 2723541 - protein, 17 aa, Entamoeba histolytica
PSIFTKDGKYYLKNHCE

SEQ ID NO: 2723542 - protein, 29 aa, Entamoeba histolytica
PSIGIYAYELFNFYGVKRIIRIGSAGAFD

SEQ ID NO: 2723543 - protein, 30 aa, Entamoeba histolytica
PSIGIYAYELFNFYGVKRIIRIGSAGAFDE

SEQ ID NO: 2723544 - protein, 19 aa, Entamoeba histolytica
PSINECTVEWNIKGEITPK

SEQ ID NO: 2723545 - protein, 30 aa, Entamoeba histolytica
PSINKNCLWYLIDFLHLISINKAINLMGPM

SEQ ID NO: 2723546 - protein, 25 aa, Entamoeba histolytica
PSIPNEHIILPIIVTFVSVTNKQLE

SEQ ID NO: 2723547 - protein, 17 aa, Entamoeba histolytica
PSIPVYEGMPKYAPVIT

SEQ ID NO: 2723548 - protein, 21 aa, Entamoeba histolytica
PSIYIYTKIILSFSKTLKSLF

SEQ ID NO: 2723549 - protein, 32 aa, Entamoeba histolytica
PSKELFFKNYPEQPMYLVKWQNFSIVESTWIL

SEQ ID NO: 2723550 - protein, 17 aa, Entamoeba histolytica
PSKLVYEEIPSNTLLFL

SEQ ID NO: 2723551 - protein, 22 aa, Entamoeba histolytica
PSKLYHKFFKELPNIKYIIMPG

SEQ ID NO: 2723552 - protein, 20 aa, Entamoeba histolytica
PSKNINSLLPFLNTTHSMLL

SEQ ID NO: 2723553 - protein, 39 aa, Entamoeba histolytica
PSKSQQPLRSILIMPVQRIPRYVLLLKDLLKNTDVNHSQ

SEQ ID NO: 2723554 - protein, 20 aa, Entamoeba histolytica
PSLDESVGFYPVQRSKGSPS

SEQ ID NO: 2723555 - protein, 21 aa, Entamoeba histolytica
PSLDQGTYKILFKKLEYDRDN

SEQ ID NO: 2723556 - protein, 27 aa, Entamoeba histolytica
PSLDYPTLHLIIYNVPKIFDKSQFLLL

SEQ ID NO: 2723557 - protein, 17 aa, Entamoeba histolytica
PSLIFKSSKCVFGGNIT

SEQ ID NO: 2723558 - protein, 18 aa, Entamoeba histolytica
PSLIPNCVELLPILLSMK

SEQ ID NO: 2723559 - protein, 18 aa, Entamoeba histolytica
PSLIPYSKEFKEVFPMVT

SEQ ID NO: 2723560 - protein, 24 aa, Entamoeba histolytica
PSLKKKIYQTLWYSSLETPSKIKP

SEQ ID NO: 2723561 - protein, 25 aa, Entamoeba histolytica
PSLNQPQLIIWNSNRIHLYKPTTTP

SEQ ID NO: 2723562 - protein, 31 aa, Entamoeba histolytica
PSLNYHRVLEFLLIFLVNLNDSIIPSSLYEH

SEQ ID NO: 2723563 - protein, 17 aa, Entamoeba histolytica
PSLPTREPILLKEQDRM

SEQ ID NO: 2723564 - protein, 27 aa, Entamoeba histolytica
PSLVDGSFFFWMAYCPIKPKSEKLIQI

SEQ ID NO: 2723565 - protein, 17 aa, Entamoeba histolytica
PSMIYLYAKGVNSDSGS

SEQ ID NO: 2723566 - protein, 29 aa, Entamoeba histolytica
PSNFDKLFFLVEVMLSYLYPNFAEEAQYK

SEQ ID NO: 2723567 - protein, 28 aa, Entamoeba histolytica
PSNLQQTLLMLPTSNAILLLRWVVDWLE

SEQ ID NO: 2723568 - protein, 25 aa, Entamoeba histolytica
PSPLALEFFNLLGQTIQLKGFTKYK

SEQ ID NO: 2723569 - protein, 19 aa, Entamoeba histolytica
PSPLSLTNFVLEKSTLFKS

SEQ ID NO: 2723570 - protein, 17 aa, Entamoeba histolytica
PSPRLGLIEVIKGDPAK

SEQ ID NO: 2723571 - protein, 20 aa, Entamoeba histolytica
PSPSVIPPATLPLTAISDLF

SEQ ID NO: 2723572 - protein, 17 aa, Entamoeba histolytica
PSQFNALDLKKLLNKIM

SEQ ID NO: 2723573 - protein, 18 aa, Entamoeba histolytica
PSQFYKQFRIAKQLAQHQ

SEQ ID NO: 2723574 - protein, 34 aa, Entamoeba histolytica; identical to SEQ ID NO: 2536380

SEQ ID NO: 2723575 - protein, 27 aa, Entamoeba histolytica
PSRNLKILAFYMNLFYVFTINSDVHKM

SEQ ID NO: 2723576 - protein, 24 aa, Entamoeba histolytica
PSRSIYLSFHQLPKFTLKYQIQIG

SEQ ID NO: 2723577 - protein, 21 aa, Entamoeba histolytica
PSSFDWDLIIDTLKKIKAKKN

SEQ ID NO: 2723578 - protein, 22 aa, Entamoeba histolytica
PSSFDWDLIIDTLKKIKAKKNV

SEQ ID NO: 2723579 - protein, 23 aa, Entamoeba histolytica
PSSFKYIDVLKKYCYDKILMKQN

SEQ ID NO: 2723580 - protein, 20 aa, Entamoeba histolytica
PSSFNFYSKKFIPTTKRKQM

SEQ ID NO: 2723581 - protein, 17 aa, Entamoeba histolytica
PSSIAHSSRRLLSRRLL

SEQ ID NO: 2723582 - protein, 22 aa, Entamoeba histolytica
PSSIEWCHMIGLNYVSCSSYRI

SEQ ID NO: 2723583 - protein, 24 aa, Entamoeba histolytica
PSSKLKLSFIIRMSKKLPYVKQML

SEQ ID NO: 2723584 - protein, 21 aa, Entamoeba histolytica
PSSLAFGFNLMPMPSPNDTPT

SEQ ID NO: 2723585 - protein, 35 aa, Entamoeba histolytica
PSSLKEYPSLKRLVLRPIGWLSLSQLFIDKTHRIE

SEQ ID NO: 2723586 - protein, 26 aa, Entamoeba histolytica
PSSLQKLNELSKGYRTKRNEFISNED

SEQ ID NO: 2723587 - protein, 27 aa, Entamoeba histolytica
PSSNLLAFHFIIIRPKNLLLVDVLERY

SEQ ID NO: 2723588 - protein, 20 aa, Entamoeba histolytica
PSSNYRIEVWLRGSLKEVEM

SEQ ID NO: 2723589 - protein, 25 aa, Entamoeba histolytica
PSSTNAYLLLAFANAYFLKGDLENA

SEQ ID NO: 2723590 - protein, 21 aa, Entamoeba histolytica
PSSVGISPLPPAGMSGQQQNG

SEQ ID NO: 2723591 - protein, 26 aa, Entamoeba histolytica
PSSVGTRFMLLLLGLKIVSLSQREGI

SEQ ID NO: 2723592 - protein, 23 aa, Entamoeba histolytica
PSSYIHSFIQWLAIKYESETLKN

SEQ ID NO: 2723593 - protein, 26 aa, Entamoeba histolytica
PSTIQIKRWEIFGILACSFFNVQWDK

SEQ ID NO: 2723594 - protein, 34 aa, Entamoeba histolytica; identical to SEQ ID NO: 2536394

SEQ ID NO: 2723595 - protein, 21 aa, Entamoeba histolytica
PSTMHFMYFSHNAWIKCHNQL

SEQ ID NO: 2723596 - protein, 25 aa, Entamoeba histolytica
PSTVLRCLFRLRPYTDMILKEMSGR

SEQ ID NO: 2723597 - protein, 24 aa, Entamoeba histolytica
PSTYLPEELILTLLTKVLTISSDE

SEQ ID NO: 2723598 - protein, 38 aa, Entamoeba histolytica
PSVDAFKTFYKITVGFNFLSNFIIIKDYAIYCVQTLAA

SEQ ID NO: 2723599 - protein, 25 aa, Entamoeba histolytica
PSVKFVKSVWTLKTNILFVNTTSYS

SEQ ID NO: 2723600 - protein, 25 aa, Entamoeba histolytica
PSVRYTAARKFLFPNSYKFISFMMF

SEQ ID NO: 2723601 - protein, 17 aa, Entamoeba histolytica
PSVTYTFHCPLSFSEII

SEQ ID NO: 2723602 - protein, 18 aa, Entamoeba histolytica
PSYKISLSPLSKNSTPPL

SEQ ID NO: 2723603 - protein, 29 aa, Entamoeba histolytica
PSYLELSYLKKTYPDIPIIALTATATSKV

SEQ ID NO: 2723604 - protein, 18 aa, Entamoeba histolytica
PTAPMPYLIGIKTSLWEH

SEQ ID NO: 2723605 - protein, 23 aa, Entamoeba histolytica
PTARRTLILLTKILQNIANNVRE

SEQ ID NO: 2723606 - protein, 26 aa, Entamoeba histolytica
PTCDWEFEFPYFQLALCSVLSGNTLK

SEQ ID NO: 2723607 - protein, 28 aa, Entamoeba histolytica
PTDFEYAFILDWPNHQYTLIAEPTRAIL

SEQ ID NO: 2723608 - protein, 21 aa, Entamoeba histolytica
PTDVKILQFLYSISCHSFSYQ

SEQ ID NO: 2723609 - protein, 19 aa, Entamoeba histolytica
PTECLPKVLPFPGHIETKG

SEQ ID NO: 2723610 - protein, 19 aa, Entamoeba histolytica
PTEFREHELREPRQPAGPS

SEQ ID NO: 2723611 - protein, 21 aa, Entamoeba histolytica
PTEKWVAILALLQKNNEIVGK

SEQ ID NO: 2723612 - protein, 22 aa, Entamoeba histolytica
PTEKWVAILALLQKNNEIVGKI

SEQ ID NO: 2723613 - protein, 23 aa, Entamoeba histolytica
PTFDIIDDEQFFWDYKALKKFCQ

SEQ ID NO: 2723614 - protein, 27 aa, Entamoeba histolytica
PTFQHGTIFYKVKLPKKIFNVNDSFMY

SEQ ID NO: 2723615 - protein, 17 aa, Entamoeba histolytica
PTFRFYRQGGLVKEFTG

SEQ ID NO: 2723616 - protein, 23 aa, Entamoeba histolytica
PTGNFLAILYGTQPSKLVLFDTS

SEQ ID NO: 2723617 - protein, 20 aa, Entamoeba histolytica
PTIINLCYILSIIGKEEKAP

SEQ ID NO: 2723618 - protein, 26 aa, Entamoeba histolytica
PTIKVGGCIFYFFVSSIVGSRLVTSL

SEQ ID NO: 2723619 - protein, 25 aa, Entamoeba histolytica
PTINKFHWHFKNFDGFALFQNGERI

SEQ ID NO: 2723620 - protein, 26 aa, Entamoeba histolytica
PTINKFHWHFKNFDGFALFQNGERIL

SEQ ID NO: 2723621 - protein, 44 aa, Entamoeba histolytica
PTIQAFLNVLQPFVWQHILIPILPLFLSSYLSSILPCIIGCTRG

SEQ ID NO: 2723622 - protein, 24 aa, Entamoeba histolytica
PTIQKSIWRIIDPVSEPVVQTHKK

SEQ ID NO: 2723623 - protein, 21 aa, Entamoeba histolytica
PTKGILQFYILVDDSYNFGVN

SEQ ID NO: 2723624 - protein, 19 aa, Entamoeba histolytica
PTKIKTLSLEILTILYSRD

SEQ ID NO: 2723625 - protein, 25 aa, Entamoeba histolytica
PTKIQQLCIPPLLSFHNVLGGAETG

SEQ ID NO: 2723626 - protein, 19 aa, Entamoeba histolytica
PTKLAPKPSFLPPKPQSNA

SEQ ID NO: 2723627 - protein, 23 aa, Entamoeba histolytica
PTKLDDFCTFGFLIKNLHEVDDF

SEQ ID NO: 2723628 - protein, 18 aa, Entamoeba histolytica
PTKSIVLSGYSALGNASI

SEQ ID NO: 2723629 - protein, 27 aa, Entamoeba histolytica
PTKTIPITYSLFLQFAGEYIILGTEEG

SEQ ID NO: 2723630 - protein, 25 aa, Entamoeba histolytica
PTKTTFFIHLNLYKLIKQSQTLLHL

SEQ ID NO: 2723631 - protein, 25 aa, Entamoeba histolytica
PTLDDYVQTYLYLSRIEKKEERNVV

SEQ ID NO: 2723632 - protein, 24 aa, Entamoeba histolytica
PTLDKLPELSLPSNLPKLSNIAEL

SEQ ID NO: 2723633 - protein, 17 aa, Entamoeba histolytica
PTLFTPRMNHLGYIAIT

SEQ ID NO: 2723634 - protein, 19 aa, Entamoeba histolytica
PTLIPRLINFMLEHPTLPI

SEQ ID NO: 2723635 - protein, 28 aa, Entamoeba histolytica
PTLKYKTFEWLFWDVSGAAKFRGLWKSY

SEQ ID NO: 2723636 - protein, 25 aa, Entamoeba histolytica
PTLNPIYEWFLLNTFSIEDSSSVFE

SEQ ID NO: 2723637 - protein, 17 aa, Entamoeba histolytica
PTLPTIPTPVVQPTLPT

SEQ ID NO: 2723638 - protein, 29 aa, Entamoeba histolytica
PTMCKFIAHYFKIWCDRYPFIAEKKGGAI

SEQ ID NO: 2723639 - protein, 20 aa, Entamoeba histolytica
PTMINFVHQFSYFNDTEREC

SEQ ID NO: 2723640 - protein, 19 aa, Entamoeba histolytica
PTNLLPYTSLVSYSEYLLL

SEQ ID NO: 2723641 - protein, 24 aa, Entamoeba histolytica
PTNLMPIITKVLVGKLPQLSVFGN

SEQ ID NO: 2723642 - protein, 27 aa, Entamoeba histolytica
PTNRRLTRSIAPIKLKKPKKGNEDIDT

SEQ ID NO: 2723643 - protein, 26 aa, Entamoeba histolytica
PTNVYWENLLYLFSLIPQEQVIHDRQ

SEQ ID NO: 2723644 - protein, 27 aa, Entamoeba histolytica
PTNYTRFHRIIYYMIRKRGLDEMRESI

SEQ ID NO: 2723645 - protein, 25 aa, Entamoeba histolytica
PTPIQCASIPIALKMRDLIALAETG

SEQ ID NO: 2723646 - protein, 34 aa, Entamoeba histolytica
PTPNFTKLTIYLRKLFYLCALKYPFDSVDIVHGM

SEQ ID NO: 2723647 - protein, 21 aa, Entamoeba histolytica
PTPPFQVPQFQQPNLVCPCYP

SEQ ID NO: 2723648 - protein, 20 aa, Entamoeba histolytica
PTPSLFKRVVTGFAYNLLST

SEQ ID NO: 2723649 - protein, 23 aa, Entamoeba histolytica
PTPTHYFLTYLNKLGYISMLFTQ

SEQ ID NO: 2723650 - protein, 26 aa, Entamoeba histolytica
PTPVQPVMPTIPQPVLPSAPKVNAPI

SEQ ID NO: 2723651 - protein, 23 aa, Entamoeba histolytica
PTREYFTFLTGDKSKVLDYWISS

SEQ ID NO: 2723652 - protein, 25 aa, Entamoeba histolytica
PTRQEKFVYCPLTPKQRSMYLEYVN

SEQ ID NO: 2723653 - protein, 17 aa, Entamoeba histolytica
PTRRREFIINGNKIIYA

SEQ ID NO: 2723654 - protein, 25 aa, Entamoeba histolytica
PTSCKFNVSLLPPPSSPKLRSILHY

SEQ ID NO: 2723655 - protein, 32 aa, Entamoeba histolytica
PTSFDADALLSILQFLLIRSKIQHPFSIIKFI

SEQ ID NO: 2723656 - protein, 21 aa, Entamoeba histolytica
PTSFDLLKHSWLSNAQVRLDT

SEQ ID NO: 2723657 - protein, 21 aa, Entamoeba histolytica
PTSIISLKLYNPPSSLPMNLV

SEQ ID NO: 2723658 - protein, 28 aa, Entamoeba histolytica
PTSLEIFKLIESIPIKPISYYNVLDEFI

SEQ ID NO: 2723659 - protein, 17 aa, Entamoeba histolytica
PTSLYVTKALEVKIFGL

SEQ ID NO: 2723660 - protein, 18 aa, Entamoeba histolytica
PTSQVPIQPISPGKPIMP

SEQ ID NO: 2723661 - protein, 30 aa, Entamoeba histolytica; identical to SEQ ID NO: 2536456

SEQ ID NO: 2723662 - protein, 25 aa, Entamoeba histolytica
PTSYNYLFKILLVGDPNVGKSSLLL

SEQ ID NO: 2723663 - protein, 18 aa, Entamoeba histolytica
PTTNLYIHFNECYNFIES

SEQ ID NO: 2723664 - protein, 20 aa, Entamoeba histolytica
PTTSLPFPPTSIKFIPKSNP

SEQ ID NO: 2723665 - protein, 20 aa, Entamoeba histolytica
PTVCPYIIKNEILHFVVYSK

SEQ ID NO: 2723666 - protein, 25 aa, Entamoeba histolytica
PTVETIIRIRIIVSPLKTVKSESLL

SEQ ID NO: 2723667 - protein, 23 aa, Entamoeba histolytica
PTVETIMNELFRIACSIISECVC

SEQ ID NO: 2723668 - protein, 18 aa, Entamoeba histolytica
PTVKKIFYSSFNFIIEKI

SEQ ID NO: 2723669 - protein, 29 aa, Entamoeba histolytica
PTVTKEFIKLIYYFGLNPSTLKRNSILLS

SEQ ID NO: 2723670 - protein, 24 aa, Entamoeba histolytica
PTYDKLMMIAILSKEPVLKPIIEQ

SEQ ID NO: 2723671 - protein, 19 aa, Entamoeba histolytica
PTYLNWCLGILNKAPQRPS

SEQ ID NO: 2723672 - protein, 19 aa, Entamoeba histolytica
PTYQAPLSQYPQPQSQPPY

SEQ ID NO: 2723673 - protein, 30 aa, Entamoeba histolytica
PTYTLRRLMKFPPVFALRPLIDMAVSICDR

SEQ ID NO: 2723674 - protein, 26 aa, Entamoeba histolytica
PVADAYGFYRCRNFLIYSVNDGCGWG

SEQ ID NO: 2723675 - protein, 25 aa, Entamoeba histolytica
PVAPTSCFASWNISLINFVMNSLEK

SEQ ID NO: 2723676 - protein, 17 aa, Entamoeba histolytica
PVAYAYAILNPNGSFLF

SEQ ID NO: 2723677 - protein, 23 aa, Entamoeba histolytica
PVDEFKSAFYLLLNARARYQGDI

SEQ ID NO: 2723678 - protein, 22 aa, Entamoeba histolytica
PVDEIKSAFYLLDNARARYLGD

SEQ ID NO: 2723679 - protein, 17 aa, Entamoeba histolytica
PVDIKPIKFKKGTFPKF

SEQ ID NO: 2723680 - protein, 18 aa, Entamoeba histolytica
PVDLFGIVKEQIEIAKTS

SEQ ID NO: 2723681 - protein, 18 aa, Entamoeba histolytica
PVDVLVFDEIPDALNCTA

SEQ ID NO: 2723682 - protein, 19 aa, Entamoeba histolytica
PVELQYFLQAILPDVSVMQ

SEQ ID NO: 2723683 - protein, 21 aa, Entamoeba histolytica
PVETFRPIKLIAIDSRNSVIL

SEQ ID NO: 2723684 - protein, 26 aa, Entamoeba histolytica
PVEVSSQILLYLKQQAINSINNKSLS

SEQ ID NO: 2723685 - protein, 30 aa, Entamoeba histolytica
PVFTETTICLLFPSPFFQLTPNQIDERLYL

SEQ ID NO: 2723686 - protein, 17 aa, Entamoeba histolytica
PVFVEKPGKNWGPACKK

SEQ ID NO: 2723687 - protein, 23 aa, Entamoeba histolytica
PVGKYTQPFKTPFGYHIVLVEER

SEQ ID NO: 2723688 - protein, 18 aa, Entamoeba histolytica
PVHDTVSYFIFYNQEDKK

SEQ ID NO: 2723689 - protein, 28 aa, Entamoeba histolytica
PVHFLTTGWTYWFDLGINQVFSTSGVTA

SEQ ID NO: 2723690 - protein, 20 aa, Entamoeba histolytica
PVHRWEIVLKIKRLLDSSHL

SEQ ID NO: 2723691 - protein, 30 aa, Entamoeba histolytica
PVISFDTPGFILITPLFSISNQLTITKYPF

SEQ ID NO: 2723692 - protein, 25 aa, Entamoeba histolytica
PVISKKSIDIFGVKLNLFVTDGKPI

SEQ ID NO: 2723693 - protein, 17 aa, Entamoeba histolytica
PVKLLEDGIRKALGRRL

SEQ ID NO: 2723694 - protein, 19 aa, Entamoeba histolytica
PVMEYQTPKKIQPYVPVKI

SEQ ID NO: 2723695 - protein, 27 aa, Entamoeba histolytica
PVMIRVKTCFIEIWKFIFEKQKIEGKN

SEQ ID NO: 2723696 - protein, 20 aa, Entamoeba histolytica
PVMSISWSSFTNAPLRCLYT

SEQ ID NO: 2723697 - protein, 18 aa, Entamoeba histolytica
PVNFTLLIIFNEDCGFGE

SEQ ID NO: 2723698 - protein, 19 aa, Entamoeba histolytica
PVNGATLYRILQSGAMKQD

SEQ ID NO: 2723699 - protein, 33 aa, Entamoeba histolytica
PVNINICVIPPLPLLKPLPFPPSITVFPGETKI

SEQ ID NO: 2723700 - protein, 17 aa, Entamoeba histolytica
PVNPLLYEQVDSQVMYP

SEQ ID NO: 2723701 - protein, 30 aa, Entamoeba histolytica
PVNQRYIEYYYYLLKYKKNFDRILIIDIRD

SEQ ID NO: 2723702 - protein, 23 aa, Entamoeba histolytica
PVNYDITTLPPFEKNFYVESPIT

SEQ ID NO: 2723703 - protein, 24 aa, Entamoeba histolytica
PVQDICSYYYGTSIYGTQFHSLVA

SEQ ID NO: 2723704 - protein, 25 aa, Entamoeba histolytica
PVQKATIPIVLDKRDLMSCAQTGSG

SEQ ID NO: 2723705 - protein, 22 aa, Entamoeba histolytica
PVQREFVAQLFLLIGVKQNEDL

SEQ ID NO: 2723706 - protein, 26 aa, Entamoeba histolytica
PVQRIMRYPILLKQILKRTSKSHRDY

SEQ ID NO: 2723707 - protein, 28 aa, Entamoeba histolytica
PVQRLPRYNLLLTDLLKRTPDTYVDYPK

SEQ ID NO: 2723708 - protein, 24 aa, Entamoeba histolytica
PVQVVHIHCTLFLTKNGYDEKGLE

SEQ ID NO: 2723709 - protein, 25 aa, Entamoeba histolytica
PVSLTQFLRINIPTTTPRLPSNYNS

SEQ ID NO: 2723710 - protein, 26 aa, Entamoeba histolytica
PVSYSPVLYSDFPHWDISIGGCADGN

SEQ ID NO: 2723711 - protein, 22 aa, Entamoeba histolytica
PVTFDIPPFITLNEQQKQKCKE

SEQ ID NO: 2723712 - protein, 19 aa, Entamoeba histolytica
PVTFQNDFSQFSTFDPQVN

SEQ ID NO: 2723713 - protein, 23 aa, Entamoeba histolytica
PVTSQIILEMLKVGISQGVMIDV

SEQ ID NO: 2723714 - protein, 24 aa, Entamoeba histolytica
PVVFDLIDFSPYNEIFIGGEWVGK

SEQ ID NO: 2723715 - protein, 17 aa, Entamoeba histolytica
PVYDSLKYFKENPTLLE

SEQ ID NO: 2723716 - protein, 20 aa, Entamoeba histolytica
PWFEGINWNTLLNESREDIF

SEQ ID NO: 2723717 - protein, 24 aa, Entamoeba histolytica
PWGTRMRYLYIALEWLSQCSFYCK

SEQ ID NO: 2723718 - protein, 17 aa, Entamoeba histolytica
PWIENTLLCIIRTRYGK

SEQ ID NO: 2723719 - protein, 24 aa, Entamoeba histolytica
PYCKDCFIAKFAKICARCGKPITT

SEQ ID NO: 2723720 - protein, 24 aa, Entamoeba histolytica
PYDDDGLIPVFGFGDKRTQGKAVF

SEQ ID NO: 2723721 - protein, 26 aa, Entamoeba histolytica
PYEPNKILLLLTIIEKIINFQSNLLN

SEQ ID NO: 2723722 - protein, 19 aa, Entamoeba histolytica
PYEVSMYLLKEWQKGRAKT

SEQ ID NO: 2723723 - protein, 25 aa, Entamoeba histolytica
PYFEKEIYVSLPIEKIPLSPSINCE

SEQ ID NO: 2723724 - protein, 19 aa, Entamoeba histolytica
PYFKGIVYGIFNEVGENIK

SEQ ID NO: 2723725 - protein, 21 aa, Entamoeba histolytica
PYFKTSIFWKLCCVYDHIVVH

SEQ ID NO: 2723726 - protein, 22 aa, Entamoeba histolytica
PYFQECFVLAYRLVTTPEKLLE

SEQ ID NO: 2723727 - protein, 25 aa, Entamoeba histolytica
PYGCRVIQRILEKIPPEKSYPLLEE

SEQ ID NO: 2723728 - protein, 17 aa, Entamoeba histolytica
PYGEKTPFWTLDNKQDK

SEQ ID NO: 2723729 - protein, 17 aa, Entamoeba histolytica
PYHIAKKKVPFVNEQGI

SEQ ID NO: 2723730 - protein, 20 aa, Entamoeba histolytica
PYIIDINHFPSYNKSFSLQS

SEQ ID NO: 2723731 - protein, 18 aa, Entamoeba histolytica
PYIQSKFMICCDKWFNGI

SEQ ID NO: 2723732 - protein, 19 aa, Entamoeba histolytica
PYKIPMVEPLSTFLNEMVN

SEQ ID NO: 2723733 - protein, 20 aa, Entamoeba histolytica
PYLAPVFIPNQINPSRINGF

SEQ ID NO: 2723734 - protein, 17 aa, Entamoeba histolytica
PYLIDNTFFSPSMSPSS

SEQ ID NO: 2723735 - protein, 20 aa, Entamoeba histolytica
PYLIETILTNIQPIRKVIAE

SEQ ID NO: 2723736 - protein, 18 aa, Entamoeba histolytica
PYLVANLVKLFIKEIPGN

SEQ ID NO: 2723737 - protein, 20 aa, Entamoeba histolytica
PYMDDPPLRALFQISTKGVP

SEQ ID NO: 2723738 - protein, 28 aa, Entamoeba histolytica
PYNDRLKEAVLFAYRFPQKAEDVRSMLQ

SEQ ID NO: 2723739 - protein, 17 aa, Entamoeba histolytica
PYNPLLGEFYRTSWSHA

SEQ ID NO: 2723740 - protein, 21 aa, Entamoeba histolytica
PYNTEFWMDIPSNEIEMIQNA

SEQ ID NO: 2723741 - protein, 17 aa, Entamoeba histolytica
PYQEVISIISKYLKKYT

SEQ ID NO: 2723742 - protein, 23 aa, Entamoeba histolytica
PYSDLYCKLLIKKWNKMPDMMEQ

SEQ ID NO: 2723743 - protein, 26 aa, Entamoeba histolytica
PYSHPIDMWSLGCILPELLTTEPLFP

SEQ ID NO: 2723744 - protein, 20 aa, Entamoeba histolytica
PYSLIDYVSSPMTYLMGVPS

SEQ ID NO: 2723745 - protein, 18 aa, Entamoeba histolytica
PYTQMAVFNFLLSSNITI

SEQ ID NO: 2723746 - protein, 25 aa, Entamoeba histolytica
PYTRRLKLFWIAEKYFYQKKRETVL

SEQ ID NO: 2723747 - protein, 22 aa, Entamoeba histolytica
PYTTILSLFQKKTSYDFRRLIL

SEQ ID NO: 2723748 - protein, 27 aa, Entamoeba histolytica
PYVLRSMNLTHIFDTLCIMVDPSKLIG

SEQ ID NO: 2723749 - protein, 21 aa, Entamoeba histolytica
PYVSYQYPPQYYPLSIQIQPL

SEQ ID NO: 2723750 - protein, 23 aa, Entamoeba histolytica
PYVTLYKCMLGYTQKYYFSQFSA

SEQ ID NO: 2723751 - protein, 24 aa, Entamoeba histolytica
PYVTLYKCMLGYTQKYYFSQFSAF

SEQ ID NO: 2723752 - protein, 17 aa, Entamoeba histolytica
QACVPIIEALVKEGVCG

SEQ ID NO: 2723753 - protein, 24 aa, Entamoeba histolytica
QADPLIQREWWYPLATSISGTEFK

SEQ ID NO: 2723754 - protein, 38 aa, Entamoeba histolytica
QADPSLISRFDLWLNKYYPFGQLKLKELFLTINNDIHG

SEQ ID NO: 2723755 - protein, 24 aa, Entamoeba histolytica
QAEAMIKLLIVYFKSLYNQKEIDT

SEQ ID NO: 2723756 - protein, 25 aa, Entamoeba histolytica
QAEYYKKADVVPAYYRVADKESGEP

SEQ ID NO: 2723757 - protein, 17 aa, Entamoeba histolytica
QAFHIVSNILACSTILT

SEQ ID NO: 2723758 - protein, 19 aa, Entamoeba histolytica
QAFLFKQYVLYFTHSYSKT

SEQ ID NO: 2723759 - protein, 24 aa, Entamoeba histolytica
QAGRTLVALPFLQVVRIQLSEEDT

SEQ ID NO: 2723760 - protein, 20 aa, Entamoeba histolytica
QAHLIIHHYITSLNPPLIPN

SEQ ID NO: 2723761 - protein, 21 aa, Entamoeba histolytica
QAHLIIHHYITSLNPPLIPNY

SEQ ID NO: 2723762 - protein, 19 aa, Entamoeba histolytica
QAILLAILNPFCGFKLQKP

SEQ ID NO: 2723763 - protein, 20 aa, Entamoeba histolytica
QAIRMWTCNIFPTLVSSEVK

SEQ ID NO: 2723764 - protein, 25 aa, Entamoeba histolytica
QAITKNIIIILDADGLFLINNHLDL

SEQ ID NO: 2723765 - protein, 17 aa, Entamoeba histolytica
QAIVIVLNYNNKKLSSA

SEQ ID NO: 2723766 - protein, 17 aa, Entamoeba histolytica
QAKLEVQILYLLNSRDQ

SEQ ID NO: 2723767 - protein, 17 aa, Entamoeba histolytica
QAKLLHKTFSPSTSFDW

SEQ ID NO: 2723768 - protein, 25 aa, Entamoeba histolytica
QAKLQFSELIRNVTKFLYGLREGLG

SEQ ID NO: 2723769 - protein, 25 aa, Entamoeba histolytica
QAKQHDCLTLWNPAPAPKEIDRNII

SEQ ID NO: 2723770 - protein, 28 aa, Entamoeba histolytica
QAKTLPTTLPLIFRNIDSRFFQQFLFNR

SEQ ID NO: 2723771 - protein, 21 aa, Entamoeba histolytica
QALAHPFILGTAIEGYKIPPR

SEQ ID NO: 2723772 - protein, 24 aa, Entamoeba histolytica
QALCKQLGVILDFVLAFDNKKVTN

SEQ ID NO: 2723773 - protein, 23 aa, Entamoeba histolytica
QALFLKTLLDKKYSLPYAALDAV

SEQ ID NO: 2723774 - protein, 22 aa, Entamoeba histolytica
QALHVSYFIHLASTGAFVIDKD

SEQ ID NO: 2723775 - protein, 19 aa, Entamoeba histolytica
QALKFELHHQSNLAYFLLR

SEQ ID NO: 2723776 - protein, 32 aa, Entamoeba histolytica
QALKFELHHQSNLAYFLLRRALRNKNIIGHQF

SEQ ID NO: 2723777 - protein, 24 aa, Entamoeba histolytica
QALKVFINLLQQHPEFLNDDRLDF

SEQ ID NO: 2723778 - protein, 17 aa, Entamoeba histolytica
QALLTLINEVIPAAVNY

SEQ ID NO: 2723779 - protein, 23 aa, Entamoeba histolytica
QALQHPFITKTPLPSNYTLPPTT

SEQ ID NO: 2723780 - protein, 27 aa, Entamoeba histolytica
QALQLIAQLLPTIKRRGLIDNFISCVC

SEQ ID NO: 2723781 - protein, 21 aa, Entamoeba histolytica
QAMELINFFQTNTTLKQICMS

SEQ ID NO: 2723782 - protein, 17 aa, Entamoeba histolytica
QAMIHEFLGINSNLVEL

SEQ ID NO: 2723783 - protein, 27 aa, Entamoeba histolytica
QAMIKAKPHLLFFYELIGSCFSLPLSH

SEQ ID NO: 2723784 - protein, 25 aa, Entamoeba histolytica
QAMQPSLIHFVSSLPLIPCLTPLNS

SEQ ID NO: 2723785 - protein, 22 aa, Entamoeba histolytica
QANLPTLIQRSNLLDIQDVELK

SEQ ID NO: 2723786 - protein, 26 aa, Entamoeba histolytica
QAPLPKRYGLLLRNYIRHFGDHGNVV

SEQ ID NO: 2723787 - protein, 26 aa, Entamoeba histolytica
QAPTKNLLEFRNSLPTSNEESTVVLE

SEQ ID NO: 2723788 - protein, 22 aa, Entamoeba histolytica
QARDFYFYLRNEIIDDMKKLNN

SEQ ID NO: 2723789 - protein, 17 aa, Entamoeba histolytica
QARRYFITINNPNSNEI

SEQ ID NO: 2723790 - protein, 26 aa, Entamoeba histolytica
QASGKTCLYNIWRGLNIPEEYIKTTE

SEQ ID NO: 2723791 - protein, 23 aa, Entamoeba histolytica
QASLLFLNTFVCDELEYCIKNGI

SEQ ID NO: 2723792 - protein, 33 aa, Entamoeba histolytica; identical to SEQ ID NO: 2536564

SEQ ID NO: 2723793 - protein, 24 aa, Entamoeba histolytica
QAVLLALINRHFSLSLSAPKKKSV

SEQ ID NO: 2723794 - protein, 19 aa, Entamoeba histolytica
QAVYLLKKINAYSDVLKVI

SEQ ID NO: 2723795 - protein, 22 aa, Entamoeba histolytica
QCDDLFKLLLEWCDREEESTMV

SEQ ID NO: 2723796 - protein, 17 aa, Entamoeba histolytica
QCDLAVSLLGKWFNILI

SEQ ID NO: 2723797 - protein, 30 aa, Entamoeba histolytica
QCDLMNIPKYYQEKLYQFYLRDIEQKNEDK

SEQ ID NO: 2723798 - protein, 25 aa, Entamoeba histolytica
QCEEKKLFIEGNARIPQEKFMEKNV

SEQ ID NO: 2723799 - protein, 26 aa, Entamoeba histolytica
QCEGNEFTYYMLLTSEFLLNGIERIG

SEQ ID NO: 2723800 - protein, 23 aa, Entamoeba histolytica
QCEKSIYHVDIKKYAVILYDYEG

SEQ ID NO: 2723801 - protein, 17 aa, Entamoeba histolytica
QCFSCKMFQVHIKKKTK

SEQ ID NO: 2723802 - protein, 29 aa, Entamoeba histolytica
QCFVNKSHLIELPLQHLPPPIIKTKKELF

SEQ ID NO: 2723803 - protein, 23 aa, Entamoeba histolytica
QCGKTSLLFAYIKNEFLDEFTAT

SEQ ID NO: 2723804 - protein, 18 aa, Entamoeba histolytica
QCIHYFKEEIPDLLELSI

SEQ ID NO: 2723805 - protein, 18 aa, Entamoeba histolytica
QCIIHYFHLIFKEITNDK

SEQ ID NO: 2723806 - protein, 17 aa, Entamoeba histolytica
QCILWEFYQSISTTDPR

SEQ ID NO: 2723807 - protein, 24 aa, Entamoeba histolytica
QCIQNAFTLFFKEKISFGVNVKAM

SEQ ID NO: 2723808 - protein, 17 aa, Entamoeba histolytica
QCKLILKTLIQQLQFQQ

SEQ ID NO: 2723809 - protein, 25 aa, Entamoeba histolytica
QCLDLIPEQLAIIEFMFLSRINPYD

SEQ ID NO: 2723810 - protein, 17 aa, Entamoeba histolytica
QCLDVMLPFFQQNLPED

SEQ ID NO: 2723811 - protein, 33 aa, Entamoeba histolytica
QCLHVNSCILPNKSWSIFIPKGTNGKQISGEPY

SEQ ID NO: 2723812 - protein, 18 aa, Entamoeba histolytica
QCLSTLNMLTWKGLKFRV

SEQ ID NO: 2723813 - protein, 17 aa, Entamoeba histolytica
QCPKCNILYCSIECYKA

SEQ ID NO: 2723814 - protein, 17 aa, Entamoeba histolytica
QCRSSCAYETVFARNFI

SEQ ID NO: 2723815 - protein, 25 aa, Entamoeba histolytica
QCSALKYIQLFTKLCNHPSLISKYL

SEQ ID NO: 2723816 - protein, 23 aa, Entamoeba histolytica
QCSVYSYILIPNEFTLQNLITPF

SEQ ID NO: 2723817 - protein, 25 aa, Entamoeba histolytica
QCVFEWQLLPQFIYATNLDIELNID

SEQ ID NO: 2723818 - protein, 17 aa, Entamoeba histolytica
QCVMAILEKLPSIKRTL

SEQ ID NO: 2723819 - protein, 25 aa, Entamoeba histolytica
QCYGMHFFHTFKLFAVAQEKRLHIY

SEQ ID NO: 2723820 - protein, 22 aa, Entamoeba histolytica
QDAELYLEIFFGGEDYDGYGID

SEQ ID NO: 2723821 - protein, 30 aa, Entamoeba histolytica; identical to SEQ ID NO: 2536596

SEQ ID NO: 2723822 - protein, 17 aa, Entamoeba histolytica
QDAPDLMKLSWSSSDPT

SEQ ID NO: 2723823 - protein, 24 aa, Entamoeba histolytica
QDDINLYLVMEYCPGGDLATLLEH

SEQ ID NO: 2723824 - protein, 24 aa, Entamoeba histolytica
QDDWKYIDYIREFWEWESPQNQKR

SEQ ID NO: 2723825 - protein, 23 aa, Entamoeba histolytica
QDELRILTIRFLKNCIAACDING

SEQ ID NO: 2723826 - protein, 22 aa, Entamoeba histolytica
QDFFTQFSQFPIIRHEPQQVQD

SEQ ID NO: 2723827 - protein, 25 aa, Entamoeba histolytica
QDFKKRFSLLLGFEFKSMNAVDAFK

SEQ ID NO: 2723828 - protein, 25 aa, Entamoeba histolytica
QDGYHALYLNDLPGQMIRPVIHRAT

SEQ ID NO: 2723829 - protein, 25 aa, Entamoeba histolytica
QDHRYFYESLFQGLISTLLKHISVP

SEQ ID NO: 2723830 - protein, 21 aa, Entamoeba histolytica
QDHWTGYRHSILSIDKIRLFS

SEQ ID NO: 2723831 - protein, 21 aa, Entamoeba histolytica
QDIIFTTYFRDLGNRVFKVLC

SEQ ID NO: 2723832 - protein, 27 aa, Entamoeba histolytica
QDIKRVWDFILAKPEDKMFLFVMAAIL

SEQ ID NO: 2723833 - protein, 17 aa, Entamoeba histolytica
QDILCQAKSGMGKTAVF

SEQ ID NO: 2723834 - protein, 19 aa, Entamoeba histolytica
QDILTLQMIRLMNTIWKNN

SEQ ID NO: 2723835 - protein, 26 aa, Entamoeba histolytica
QDIQTKYLYLILSILNAYKKRGSQQF

SEQ ID NO: 2723836 - protein, 19 aa, Entamoeba histolytica
QDITYFKIHFKEAVDYIKS

SEQ ID NO: 2723837 - protein, 18 aa, Entamoeba histolytica
QDKELEFQAITRLFGPIN

SEQ ID NO: 2723838 - protein, 26 aa, Entamoeba histolytica
QDKKYPVWVVLLFESSSVLKKIRIIL

SEQ ID NO: 2723839 - protein, 22 aa, Entamoeba histolytica
QDKPSCFPAFILNPPENSICID

SEQ ID NO: 2723840 - protein, 26 aa, Entamoeba histolytica
QDKPSTLQMLPTYAPIPTGKEVGTFM

SEQ ID NO: 2723841 - protein, 28 aa, Entamoeba histolytica
QDKSNITPPLTPPIEKKVMFSVTQAPSI

SEQ ID NO: 2723842 - protein, 24 aa, Entamoeba histolytica
QDKYEFLDLCGVGNFAVVRKVKEI

SEQ ID NO: 2723843 - protein, 18 aa, Entamoeba histolytica
QDLFTIILNVSLNMSYDG

SEQ ID NO: 2723844 - protein, 31 aa, Entamoeba histolytica
QDLHLLIRHSPFPPSLLPFTKSVNPTLFSPL

SEQ ID NO: 2723845 - protein, 31 aa, Entamoeba histolytica; identical to SEQ ID NO: 2536618

SEQ ID NO: 2723846 - protein, 29 aa, Entamoeba histolytica
QDMLTLQMFKLMDDLWKKNGIDFRMTIYN

SEQ ID NO: 2723847 - protein, 30 aa, Entamoeba histolytica; identical to SEQ ID NO: 2536622

SEQ ID NO: 2723848 - protein, 27 aa, Entamoeba histolytica
QDPFPKSEFKFPWKLAEFISTGNRPVI

SEQ ID NO: 2723849 - protein, 23 aa, Entamoeba histolytica
QDPINPIVFFDISVGDRLIGRIK

SEQ ID NO: 2723850 - protein, 25 aa, Entamoeba histolytica
QDPKIMAQFLIDNNFNILFTLGGDG

SEQ ID NO: 2723851 - protein, 34 aa, Entamoeba histolytica
QDPKIMAQFLIDNNFNILFTLGGDGTLRGANAIN

SEQ ID NO: 2723852 - protein, 24 aa, Entamoeba histolytica
QDSELFENLFKQLTFIECRFHLIC

SEQ ID NO: 2723853 - protein, 24 aa, Entamoeba histolytica
QDSKQSLFWQLLDKKQIDCSVEKS

SEQ ID NO: 2723854 - protein, 30 aa, Entamoeba histolytica
QDSNIKYIFRDILFLLISYSLKERCELGKE

SEQ ID NO: 2723855 - protein, 21 aa, Entamoeba histolytica
QDSRLWTVSLTRKEMKPDECE

SEQ ID NO: 2723856 - protein, 23 aa, Entamoeba histolytica
QDTINDMIHWIDDINAVIESIIT

SEQ ID NO: 2723857 - protein, 24 aa, Entamoeba histolytica
QDVLRLFVHYNKSYFQFIEHPLGN

SEQ ID NO: 2723858 - protein, 26 aa, Entamoeba histolytica
QEAKRWELLHLLMDLVTEYGYTVYAE

SEQ ID NO: 2723859 - protein, 25 aa, Entamoeba histolytica
QECIDLLTLILYKGEYSFFKDIHSL

SEQ ID NO: 2723860 - protein, 26 aa, Entamoeba histolytica
QECLEKKIHLPLTSLKLEGAKMGSES

SEQ ID NO: 2723861 - protein, 25 aa, Entamoeba histolytica
QECREKGILPWLRPDSKSQVTLEYE

SEQ ID NO: 2723862 - protein, 17 aa, Entamoeba histolytica
QEDARIVAEVRASPRKA

SEQ ID NO: 2723863 - protein, 25 aa, Entamoeba histolytica
QEDINIVLQPKFVKLLLAISLVRRH

SEQ ID NO: 2723864 - protein, 22 aa, Entamoeba histolytica
QEDKHLFLIIPFGVKSIEEYII

SEQ ID NO: 2723865 - protein, 24 aa, Entamoeba histolytica
QEDKLKIEIEYLKEKIQIEQAEND

SEQ ID NO: 2723866 - protein, 24 aa, Entamoeba histolytica
QEELPWPNYIQTLFSLTQEQGIIQ

SEQ ID NO: 2723867 - protein, 29 aa, Entamoeba histolytica
QEESLVSRLLWQFLMKIKDDMEKVENVMK

SEQ ID NO: 2723868 - protein, 24 aa, Entamoeba histolytica
QEEVEGMPKYLWKQGVEDTVEIIE

SEQ ID NO: 2723869 - protein, 24 aa, Entamoeba histolytica
QEFELAVKIFKTSILIFKDRERYV

SEQ ID NO: 2723870 - protein, 17 aa, Entamoeba histolytica
QEFFFHCMAGREGLIDT

SEQ ID NO: 2723871 - protein, 24 aa, Entamoeba histolytica
QEFPNLYIDLLKLLLPRVQTTNYE

SEQ ID NO: 2723872 - protein, 26 aa, Entamoeba histolytica
QEFRIDIILNHILFTGTLGVLSSSLS

SEQ ID NO: 2723873 - protein, 29 aa, Entamoeba histolytica
QEFSKQMKFLLHRLNTLSSLPFVEDPLTL

SEQ ID NO: 2723874 - protein, 24 aa, Entamoeba histolytica
QEFSQFLVKLFEMLNDKESKRIVE

SEQ ID NO: 2723875 - protein, 23 aa, Entamoeba histolytica
QEGFVEVRYIVIKGNAVAFIEFK

SEQ ID NO: 2723876 - protein, 32 aa, Entamoeba histolytica
QEGVVPPVYDKLSIIGFYIQQKQKSIPLTKTI

SEQ ID NO: 2723877 - protein, 17 aa, Entamoeba histolytica
QEIASVDFLNFSFGSKA

SEQ ID NO: 2723878 - protein, 20 aa, Entamoeba histolytica
QEIENLFPHSPTPPFQVPQF

SEQ ID NO: 2723879 - protein, 21 aa, Entamoeba histolytica
QEIFMKYNTFMLRGDSLFDTY

SEQ ID NO: 2723880 - protein, 20 aa, Entamoeba histolytica
QEIHEVFIGKIKMEELRKRK

SEQ ID NO: 2723881 - protein, 24 aa, Entamoeba histolytica
QEIIKENPWYFDARIRRCYHLWDE

SEQ ID NO: 2723882 - protein, 18 aa, Entamoeba histolytica
QEIKDTINILDKKVSAIS

SEQ ID NO: 2723883 - protein, 33 aa, Entamoeba histolytica
QEIKEYPRFLIPKYFTAFIKKVYNFIVQRTFEG

SEQ ID NO: 2723884 - protein, 18 aa, Entamoeba histolytica
QEIKYVLSEYMRYAEDIR

SEQ ID NO: 2723885 - protein, 30 aa, Entamoeba histolytica; identical to SEQ ID NO: 2536659

SEQ ID NO: 2723886 - protein, 35 aa, Entamoeba histolytica
QEILKKIYCLYLITSRLIPNINIQYLYAAYNEVLA

SEQ ID NO: 2723887 - protein, 34 aa, Entamoeba histolytica; identical to SEQ ID NO: 2536662

SEQ ID NO: 2723888 - protein, 18 aa, Entamoeba histolytica
QEIPSKRKFIFEMNDFND

SEQ ID NO: 2723889 - protein, 29 aa, Entamoeba histolytica
QEKFRTIITSYYRGVQGAVLIYDVTNKST

SEQ ID NO: 2723890 - protein, 31 aa, Entamoeba histolytica
QEKGIENALFLFRWMSLLLTEELPINSLVMF

SEQ ID NO: 2723891 - protein, 17 aa, Entamoeba histolytica
QEKKYSEAIIVLNTFFS

SEQ ID NO: 2723892 - protein, 19 aa, Entamoeba histolytica
QEKLENEYLIDVAAEEFKL

SEQ ID NO: 2723893 - protein, 25 aa, Entamoeba histolytica
QEKQEWLDKLLFLKDKYKPKEHWID

SEQ ID NO: 2723894 - protein, 17 aa, Entamoeba histolytica
QEKQTIPRLIPTSAIDS

SEQ ID NO: 2723895 - protein, 24 aa, Entamoeba histolytica
QEKYIAMTRVYYNGAHGAIIMYDL

SEQ ID NO: 2723896 - protein, 24 aa, Entamoeba histolytica
QELCELVVYLYYKLFYSSEDKLVQ

SEQ ID NO: 2723897 - protein, 18 aa, Entamoeba histolytica
QELIPLIHTFDGKSIPPK

SEQ ID NO: 2723898 - protein, 17 aa, Entamoeba histolytica
QELISHIFVIDPEQRYS

SEQ ID NO: 2723899 - protein, 23 aa, Entamoeba histolytica
QELKELIPVIPKKSMGYIEMKLM

SEQ ID NO: 2723900 - protein, 18 aa, Entamoeba histolytica
QELLRLLSQQFFDMSKYS

SEQ ID NO: 2723901 - protein, 21 aa, Entamoeba histolytica
QELLWVLHCIYQKVLISRGKS

SEQ ID NO: 2723902 - protein, 20 aa, Entamoeba histolytica
QELNIQPGTQINLLLALRGG

SEQ ID NO: 2723903 - protein, 23 aa, Entamoeba histolytica
QELTSSLFDPNSLMIQCDDINKG

SEQ ID NO: 2723904 - protein, 23 aa, Entamoeba histolytica
QEMEKLYKLPKIDTALGLSDENG

SEQ ID NO: 2723905 - protein, 24 aa, Entamoeba histolytica
QEMKKNVIIINMARGPIVVNDDIA

SEQ ID NO: 2723906 - protein, 24 aa, Entamoeba histolytica
QEMLYRTKQLMIRKKRVEARRRSE

SEQ ID NO: 2723907 - protein, 19 aa, Entamoeba histolytica
QEMTYYKERYGESDYVLMF

SEQ ID NO: 2723908 - protein, 20 aa, Entamoeba histolytica
QEMWDRWICFIQQTTKSHWE

SEQ ID NO: 2723909 - protein, 30 aa, Entamoeba histolytica
QEMYKSVALQFLTRELPLFKKNIESIDIIQ

SEQ ID NO: 2723910 - protein, 25 aa, Entamoeba histolytica
QENCRLLWKYRYLVEKTKPGSLARL

SEQ ID NO: 2723911 - protein, 24 aa, Entamoeba histolytica
QENGSQFILPPISTASNAAVSLPP

SEQ ID NO: 2723912 - protein, 25 aa, Entamoeba histolytica
QENNLFQTVVIPQSYRNKTFQCSIP

SEQ ID NO: 2723913 - protein, 25 aa, Entamoeba histolytica
QEPTVIGFPFTIKFKEFQQNPHFFN

SEQ ID NO: 2723914 - protein, 25 aa, Entamoeba histolytica
QEPVRFRLQFKGWDQRKIIDRETQQ

SEQ ID NO: 2723915 - protein, 26 aa, Entamoeba histolytica
QEQLLPGDWFGLFKTSSMSQKHPIVQ

SEQ ID NO: 2723916 - protein, 23 aa, Entamoeba histolytica
QEQSAIEFLRHKTIQYLEKKEKE

SEQ ID NO: 2723917 - protein, 25 aa, Entamoeba histolytica
QEQYEHFFFDLYTLCSGFGKVVDMI

SEQ ID NO: 2723918 - protein, 21 aa, Entamoeba histolytica
QERFMNITAAYFRNTTAVIIV

SEQ ID NO: 2723919 - protein, 26 aa, Entamoeba histolytica
QERFRSLISNFYRGSSGIIVCYDVSE

SEQ ID NO: 2723920 - protein, 35 aa, Entamoeba histolytica
QERFRSMVSSYYRDVNGIIIVFDVTDRKTFDQVQY

SEQ ID NO: 2723921 - protein, 34 aa, Entamoeba histolytica
QERIYYAMNKMLLTFYRYPQAWIICAQYFERRGN

SEQ ID NO: 2723922 - protein, 17 aa, Entamoeba histolytica
QERLFSVYGQLLNIISD

SEQ ID NO: 2723923 - protein, 28 aa, Entamoeba histolytica
QERPELLFELFNPLYQYKDPAISLAGIR

SEQ ID NO: 2723924 - protein, 22 aa, Entamoeba histolytica
QERYRAITNAYYRGAVGALVVY

SEQ ID NO: 2723925 - protein, 25 aa, Entamoeba histolytica
QESIPIQLPSLLPPIQFVYEIVPNN

SEQ ID NO: 2723926 - protein, 24 aa, Entamoeba histolytica
QESKNLLWGIINDPTIRSYPILVW

SEQ ID NO: 2723927 - protein, 19 aa, Entamoeba histolytica
QESLLLLNLEREFYTRLNQ

SEQ ID NO: 2723928 - protein, 26 aa, Entamoeba histolytica
QESPFKSIVPFALRGPLQRYQRESGK

SEQ ID NO: 2723929 - protein, 25 aa, Entamoeba histolytica
QETFKFLFFVADIHNQGFITKTQFS

SEQ ID NO: 2723930 - protein, 27 aa, Entamoeba histolytica
QETFSNELVIFLINGSRFAIPRSCLQK

SEQ ID NO: 2723931 - protein, 26 aa, Entamoeba histolytica
QETKVESFFDLFYPQELALNNDINDD

SEQ ID NO: 2723932 - protein, 17 aa, Entamoeba histolytica
QETLEDVLLKLSNVNLN

SEQ ID NO: 2723933 - protein, 24 aa, Entamoeba histolytica
QETNRRCLSLPNLLLKIFNCKSTV

SEQ ID NO: 2723934 - protein, 27 aa, Entamoeba histolytica
QETTLMALLTQYGIKFIIQSPRKSSDT

SEQ ID NO: 2723935 - protein, 20 aa, Entamoeba histolytica
QEVKSFWNQLSASAQNVFKE

SEQ ID NO: 2723936 - protein, 28 aa, Entamoeba histolytica
QEVPLYFLNKALVSEPFPWALISVGSID

SEQ ID NO: 2723937 - protein, 22 aa, Entamoeba histolytica
QEVQLFIKFIEPNKNEYKIREE

SEQ ID NO: 2723938 - protein, 25 aa, Entamoeba histolytica
QEYKFFVFFNYLHPSNEIYPVLIRK

SEQ ID NO: 2723939 - protein, 23 aa, Entamoeba histolytica
QEYMTFIFPEGFQGSIVLNGTEC

SEQ ID NO: 2723940 - protein, 20 aa, Entamoeba histolytica
QEYWELWNCKSTCAIQLIQT

SEQ ID NO: 2723941 - protein, 19 aa, Entamoeba histolytica
QEYWKQSKSALFLLYCSDP

SEQ ID NO: 2723942 - protein, 25 aa, Entamoeba histolytica
QFALQRHGIIPVPLYTTLGKEAIDY

SEQ ID NO: 2723943 - protein, 41 aa, Entamoeba histolytica
QFCGRYLYVQFGYQIISNLPLNFIRLKHLLNTTFESVLHYF

SEQ ID NO: 2723944 - protein, 23 aa, Entamoeba histolytica
QFDIMIQDILNLTSKKKSTLYLV

SEQ ID NO: 2723945 - protein, 26 aa, Entamoeba histolytica
QFDINSYCRELLFPLVIDESNIGVDN

SEQ ID NO: 2723946 - protein, 18 aa, Entamoeba histolytica
QFDISLKPKRLTKKAIHS

SEQ ID NO: 2723947 - protein, 19 aa, Entamoeba histolytica
QFDLLIEVAARMAEDHFRM

SEQ ID NO: 2723948 - protein, 30 aa, Entamoeba histolytica; identical to SEQ ID NO: 2536728

SEQ ID NO: 2723949 - protein, 24 aa, Entamoeba histolytica
QFERAYHTATYYKKKIYLVGGLQY

SEQ ID NO: 2723950 - protein, 19 aa, Entamoeba histolytica
QFFFESFQPVYSLVTVLHE

SEQ ID NO: 2723951 - protein, 29 aa, Entamoeba histolytica
QFGGPKFMKMLKQHKPKFMLGTPRIYEKI

SEQ ID NO: 2723952 - protein, 20 aa, Entamoeba histolytica
QFGIFDLRQDKPCCIKPFPS

SEQ ID NO: 2723953 - protein, 19 aa, Entamoeba histolytica
QFGIIKPTKIQQLCIPPLL

SEQ ID NO: 2723954 - protein, 22 aa, Entamoeba histolytica
QFGNYVIQHLLEFGNDTIREAI

SEQ ID NO: 2723955 - protein, 26 aa, Entamoeba histolytica
QFHENCQIWYSVIPTEIVNHYMAMAG

SEQ ID NO: 2723956 - protein, 32 aa, Entamoeba histolytica
QFIDAAPPAYLLAGLYLIDSLIRYLSDENAIT

SEQ ID NO: 2723957 - protein, 26 aa, Entamoeba histolytica
QFIDENIFCMSLLRKISFTGVKQIPN

SEQ ID NO: 2723958 - protein, 35 aa, Entamoeba histolytica
QFIEHPLGNVKSLYLQLFKLYDFTERKCYYGVIFV

SEQ ID NO: 2723959 - protein, 18 aa, Entamoeba histolytica
QFIFQLQNVERVYGFLSI

SEQ ID NO: 2723960 - protein, 25 aa, Entamoeba histolytica
QFINHFLQLLRFYHHNQPIAVLCSS

SEQ ID NO: 2723961 - protein, 25 aa, Entamoeba histolytica
QFIQKKMVLISWMETILKVPINPDL

SEQ ID NO: 2723962 - protein, 35 aa, Entamoeba histolytica
QFIQKNQNIILKINKYGWFLLLKNINDEMIESIIE

SEQ ID NO: 2723963 - protein, 17 aa, Entamoeba histolytica
QFISKYTEVLPLNLREI

SEQ ID NO: 2723964 - protein, 21 aa, Entamoeba histolytica
QFITILQHLVPNEKLSVLLQI

SEQ ID NO: 2723965 - protein, 26 aa, Entamoeba histolytica
QFIYSVDPCIPWHISAFHPDYLMDTT

SEQ ID NO: 2723966 - protein, 18 aa, Entamoeba histolytica
QFKFISPNVLKKKAIKQK

SEQ ID NO: 2723967 - protein, 30 aa, Entamoeba histolytica
QFKQQNVINLYLRILLRKTGDHLSKCLEID

SEQ ID NO: 2723968 - protein, 23 aa, Entamoeba histolytica
QFKRDICWVFANLASENVKLRDE

SEQ ID NO: 2723969 - protein, 17 aa, Entamoeba histolytica
QFKSIDFLNGKKVTLRL

SEQ ID NO: 2723970 - protein, 21 aa, Entamoeba histolytica
QFKSKYIEILGCLISSNSLMV

SEQ ID NO: 2723971 - protein, 23 aa, Entamoeba histolytica
QFLKYFETFGPIRKDASGKLAYK

SEQ ID NO: 2723972 - protein, 17 aa, Entamoeba histolytica
QFLQIMTLDPFYTSNSP

SEQ ID NO: 2723973 - protein, 24 aa, Entamoeba histolytica
QFMKKCHGYWPELFCCQDGVVLTE

SEQ ID NO: 2723974 - protein, 19 aa, Entamoeba histolytica
QFMRIFPKEFEFNETFLIE

SEQ ID NO: 2723975 - protein, 21 aa, Entamoeba histolytica
QFNFTNYIKLIYEQKGCIKVS

SEQ ID NO: 2723976 - protein, 19 aa, Entamoeba histolytica
QFNLYCTWMAKPRNQFKVT

SEQ ID NO: 2723977 - protein, 17 aa, Entamoeba histolytica
QFNPYILPSLELASKDK

SEQ ID NO: 2723978 - protein, 17 aa, Entamoeba histolytica
QFNSSQLFNGDGLFYLI

SEQ ID NO: 2723979 - protein, 21 aa, Entamoeba histolytica
QFNWSTLYMRQDTAVSAVAEE

SEQ ID NO: 2723980 - protein, 26 aa, Entamoeba histolytica
QFNYDLSFIGMFKYPSEPIKKIYYSS

SEQ ID NO: 2723981 - protein, 19 aa, Entamoeba histolytica
QFNYYLGKLQDYFLQHKQE

SEQ ID NO: 2723982 - protein, 18 aa, Entamoeba histolytica
QFPNALDALVYLTSNTNE

SEQ ID NO: 2723983 - protein, 18 aa, Entamoeba histolytica
QFPPTQSPIDILLGKEDC

SEQ ID NO: 2723984 - protein, 19 aa, Entamoeba histolytica
QFPRKKIYSTALAQLVFLL

SEQ ID NO: 2723985 - protein, 17 aa, Entamoeba histolytica
QFQLFVSKLRSFSRIAE

SEQ ID NO: 2723986 - protein, 19 aa, Entamoeba histolytica
QFQNDCILIFKICDVKNPK

SEQ ID NO: 2723987 - protein, 26 aa, Entamoeba histolytica
QFQNYILTILIKYPQFIHLYIDWVIK

SEQ ID NO: 2723988 - protein, 25 aa, Entamoeba histolytica
QFQQLPTPPITIPIPTSASNQINQQ

SEQ ID NO: 2723989 - protein, 23 aa, Entamoeba histolytica
QFQSYFERIISNANLRNEKSPFA

SEQ ID NO: 2723990 - protein, 17 aa, Entamoeba histolytica
QFRNEVLKEARFIDGFN

SEQ ID NO: 2723991 - protein, 20 aa, Entamoeba histolytica
QFRNHIVIILLVNSNVVFGV

SEQ ID NO: 2723992 - protein, 26 aa, Entamoeba histolytica
QFSLVVYFSYFMNYAKKVPRKRVIIM

SEQ ID NO: 2723993 - protein, 26 aa, Entamoeba histolytica
QFTLHWELQTWIPLGTYLLPSDNNVI

SEQ ID NO: 2723994 - protein, 20 aa, Entamoeba histolytica
QFVNVFYNAFDTNKANLANF

SEQ ID NO: 2723995 - protein, 19 aa, Entamoeba histolytica
QFVRILSTINRELLKPGTS

SEQ ID NO: 2723996 - protein, 20 aa, Entamoeba histolytica
QFVVLMNDIVNFFREKLREA

SEQ ID NO: 2723997 - protein, 17 aa, Entamoeba histolytica
QFYALFEKSYRKMQKSE

SEQ ID NO: 2723998 - protein, 21 aa, Entamoeba histolytica
QFYDILIGLLLIELDKRKIVN

SEQ ID NO: 2723999 - protein, 18 aa, Entamoeba histolytica
QFYSQFPLISKKLEFYYA

SEQ ID NO: 2724000 - protein, 28 aa, Entamoeba histolytica
QGCEPKIFAELFNLRIVVKKGNYKDTVV

SEQ ID NO: 2724001 - protein, 29 aa, Entamoeba histolytica
QGCQYHGIVPYFFLVERKAVIQYASVESV

SEQ ID NO: 2724002 - protein, 38 aa, Entamoeba histolytica
QGDFALIEFSKKMKYKWYKLKIPSFTTSACVLKKMLHV

SEQ ID NO: 2724003 - protein, 20 aa, Entamoeba histolytica
QGDFMIVSLLKSSIEMKRFR

SEQ ID NO: 2724004 - protein, 26 aa, Entamoeba histolytica
QGDKTLINWFKIRGIGNLIKELMVKQ

SEQ ID NO: 2724005 - protein, 27 aa, Entamoeba histolytica
QGEEFPLQGMTLVLRHLALEGDQKTSV

SEQ ID NO: 2724006 - protein, 24 aa, Entamoeba histolytica
QGENILMKTLLDKSCQLFHAIPQP

SEQ ID NO: 2724007 - protein, 27 aa, Entamoeba histolytica
QGFKDQMYTILKSLPSTVQVGMFSATM

SEQ ID NO: 2724008 - protein, 23 aa, Entamoeba histolytica
QGFLKEMLLWFGWEEIESTPPAT

SEQ ID NO: 2724009 - protein, 25 aa, Entamoeba histolytica
QGGKSLFITFKLVLLQTSFGKSIDD

SEQ ID NO: 2724010 - protein, 18 aa, Entamoeba histolytica
QGGLDIGWTAYLIGAVSE

SEQ ID NO: 2724011 - protein, 24 aa, Entamoeba histolytica
QGIFNIRVNFLEMANPNFYDSRGP

SEQ ID NO: 2724012 - protein, 23 aa, Entamoeba histolytica
QGIKMDYMYLIKTQLIESMTLNG

SEQ ID NO: 2724013 - protein, 36 aa, Entamoeba histolytica
QGIVSYLNAFIQTKTSLGISIEKTLKGLQEGLKSTI

SEQ ID NO: 2724014 - protein, 17 aa, Entamoeba histolytica
QGKAVFDLSPENKPFLG

SEQ ID NO: 2724015 - protein, 26 aa, Entamoeba histolytica
QGKENLCFELFYDKVYTFCCPSQIEF

SEQ ID NO: 2724016 - protein, 17 aa, Entamoeba histolytica
QGKFGNVYLVKYKKYDY

SEQ ID NO: 2724017 - protein, 26 aa, Entamoeba histolytica
QGKFGNVYLVKYKKYNYVCALKVIFK

SEQ ID NO: 2724018 - protein, 18 aa, Entamoeba histolytica
QGKFPQNRFGIAPDYKWD

SEQ ID NO: 2724019 - protein, 24 aa, Entamoeba histolytica
QGKPIFSKQPLTRIESKYFDESLL

SEQ ID NO: 2724020 - protein, 17 aa, Entamoeba histolytica
QGKPILCKVLVSVSVDI

SEQ ID NO: 2724021 - protein, 31 aa, Entamoeba histolytica
QGLFFKPKEDWFFYAFSKFYFEAALKFSDKF

SEQ ID NO: 2724022 - protein, 19 aa, Entamoeba histolytica
QGMIFLGKDLLMSCEEKIV

SEQ ID NO: 2724023 - protein, 19 aa, Entamoeba histolytica
QGMLCFYKKNTFNGKENED

SEQ ID NO: 2724024 - protein, 30 aa, Entamoeba histolytica
QGMPIIQAFLQILIPFEWQGVLIPMLPIEE

SEQ ID NO: 2724025 - protein, 29 aa, Entamoeba histolytica
QGNADVVLPKGLIPWIDIPRCPKCGGLIK

SEQ ID NO: 2724026 - protein, 23 aa, Entamoeba histolytica
QGNEVFWLGCLIQFRKELVRNDT

SEQ ID NO: 2724027 - protein, 26 aa, Entamoeba histolytica
QGNGVIIRFFAWLNYLKENKGKYDRV

SEQ ID NO: 2724028 - protein, 25 aa, Entamoeba histolytica
QGPYERYGMPIGTTGKRGDLYLIIK

SEQ ID NO: 2724029 - protein, 24 aa, Entamoeba histolytica
QGRVALIGTLFKKSKKIPTLLNQY

SEQ ID NO: 2724030 - protein, 23 aa, Entamoeba histolytica
QGTESSSHFAHYSESSLMATDCS

SEQ ID NO: 2724031 - protein, 26 aa, Entamoeba histolytica
QGTKVDFILKCIKIIGSIPGIKLAVL

SEQ ID NO: 2724032 - protein, 22 aa, Entamoeba histolytica
QGTMWWIQRELDEKKKYMPMRK

SEQ ID NO: 2724033 - protein, 31 aa, Entamoeba histolytica; identical to SEQ ID NO: 2536814

SEQ ID NO: 2724034 - protein, 32 aa, Entamoeba histolytica
QGYVLIEAKDRFRLLYTFLRKNKNKKTIVFMS

SEQ ID NO: 2724035 - protein, 17 aa, Entamoeba histolytica
QGYVMYYYQNEWCFINL

SEQ ID NO: 2724036 - protein, 18 aa, Entamoeba histolytica
QHAATLPRCGLVPRSLDV

SEQ ID NO: 2724037 - protein, 22 aa, Entamoeba histolytica
QHCHSLLSFPPLSSLINLRLFK

SEQ ID NO: 2724038 - protein, 27 aa, Entamoeba histolytica
QHENPYFLVPFLYPSQMMVLQNYFNIS

SEQ ID NO: 2724039 - protein, 19 aa, Entamoeba histolytica
QHFLKKTQFIVRTQKLVDL

SEQ ID NO: 2724040 - protein, 21 aa, Entamoeba histolytica
QHFNTWWFSQYLNYKKEWTET

SEQ ID NO: 2724041 - protein, 25 aa, Entamoeba histolytica
QHGLDKIVVLWTATTERYIFLYHQD

SEQ ID NO: 2724042 - protein, 25 aa, Entamoeba histolytica
QHGLDKIVVLWTATTERYVEIKEGL

SEQ ID NO: 2724043 - protein, 21 aa, Entamoeba histolytica
QHHDYLPLDLVSNLFKQIAAS

SEQ ID NO: 2724044 - protein, 23 aa, Entamoeba histolytica
QHHRKTWFTTFHPDYFGKHGMRV

SEQ ID NO: 2724045 - protein, 18 aa, Entamoeba histolytica
QHIFFDTTDYIIQGCDDD

SEQ ID NO: 2724046 - protein, 19 aa, Entamoeba histolytica
QHIFTWHKEIKATTNLKIS

SEQ ID NO: 2724047 - protein, 19 aa, Entamoeba histolytica
QHIQPQITKSFIPVQGKPG

SEQ ID NO: 2724048 - protein, 28 aa, Entamoeba histolytica
QHKNKLEIIIPTFKNLTSKKQVIKPYVV

SEQ ID NO: 2724049 - protein, 29 aa, Entamoeba histolytica
QHKNKLEIIIPTFKNLTSKKQVIKPYVVC

SEQ ID NO: 2724050 - protein, 27 aa, Entamoeba histolytica
QHLQSLHIRLIPRIIPIITKLQSLQSL

SEQ ID NO: 2724051 - protein, 36 aa, Entamoeba histolytica
QHLSVMTPNFFLDFFKTFEIFFSLGNTFFSDNPFIS

SEQ ID NO: 2724052 - protein, 23 aa, Entamoeba histolytica
QHNMDNASSIFIILYVITLSLLF

SEQ ID NO: 2724053 - protein, 29 aa, Entamoeba histolytica
QHNQLELPPLTFCYLLKPGEDVIKVDGLE

SEQ ID NO: 2724054 - protein, 30 aa, Entamoeba histolytica
QHPYRSIPFVKNFFASPPFLNSMFSRCFSD

SEQ ID NO: 2724055 - protein, 24 aa, Entamoeba histolytica
QHQYPTVMSIIKKSKTLPKPLICN

SEQ ID NO: 2724056 - protein, 28 aa, Entamoeba histolytica
QHSKKAIEYAPLWLPQSIQKCQLCGKAF

SEQ ID NO: 2724057 - protein, 25 aa, Entamoeba histolytica
QHVSRIIIIFNMVYPEDLTDQQRYI

SEQ ID NO: 2724058 - protein, 20 aa, Entamoeba histolytica
QHYINIDYISHVPAYKHARS

SEQ ID NO: 2724059 - protein, 20 aa, Entamoeba histolytica
QHYIYFLCHKKDYVRTFASE

SEQ ID NO: 2724060 - protein, 19 aa, Entamoeba histolytica
QIAYVCRETLRALNFIHGL

SEQ ID NO: 2724061 - protein, 30 aa, Entamoeba histolytica
QICMQIIVLAILCYKIPCYYICDKRFVYQE

SEQ ID NO: 2724062 - protein, 34 aa, Entamoeba histolytica
QIDAHYTLKYFLKTWIRFIHLCGTPAQLQDAAVV

SEQ ID NO: 2724063 - protein, 25 aa, Entamoeba histolytica
QIDEKLYLPQLYQDFLEYINKPQDK

SEQ ID NO: 2724064 - protein, 24 aa, Entamoeba histolytica
QIDGKEYLVFFNNRLREINTVLNR

SEQ ID NO: 2724065 - protein, 32 aa, Entamoeba histolytica
QIDLITFNYPEQLPFRFHVPTLRTAMNRGLFF

SEQ ID NO: 2724066 - protein, 36 aa, Entamoeba histolytica; identical to SEQ ID NO: 2536853

SEQ ID NO: 2724067 - protein, 26 aa, Entamoeba histolytica
QIDREKVQLVSWLNKELLTDKKITQE

SEQ ID NO: 2724068 - protein, 25 aa, Entamoeba histolytica
QIDVTFWHEFTKRKLEVFKLSEKAI

SEQ ID NO: 2724069 - protein, 17 aa, Entamoeba histolytica
QIDYAAKDAWIGVCVAE

SEQ ID NO: 2724070 - protein, 20 aa, Entamoeba histolytica
QIEDLISKIDFALEDIEHAE

SEQ ID NO: 2724071 - protein, 27 aa, Entamoeba histolytica
QIEDTSTIDLFIPYLGNEGYFKINSQI

SEQ ID NO: 2724072 - protein, 32 aa, Entamoeba histolytica; identical to SEQ ID NO: 2536857

SEQ ID NO: 2724073 - protein, 19 aa, Entamoeba histolytica
QIEHYIIVVLTSHSVDDYT

SEQ ID NO: 2724074 - protein, 26 aa, Entamoeba histolytica
QIEQLLKLHTLFYNKLTGRIDQAGDD

SEQ ID NO: 2724075 - protein, 19 aa, Entamoeba histolytica
QIEQPLLVIIISDSEKKKY

SEQ ID NO: 2724076 - protein, 23 aa, Entamoeba histolytica
QIEQVHQMFIAINNKLTKERIDE

SEQ ID NO: 2724077 - protein, 20 aa, Entamoeba histolytica
QIERMIISIKTAIQIMKKGI

SEQ ID NO: 2724078 - protein, 17 aa, Entamoeba histolytica
QIERQLIRLSRRGNFMA

SEQ ID NO: 2724079 - protein, 19 aa, Entamoeba histolytica
QIFDSLDVFFPLLNTVDNN

SEQ ID NO: 2724080 - protein, 30 aa, Entamoeba histolytica
QIFENAIKVNLWLIPLTIPINSVLQYIPNI

SEQ ID NO: 2724081 - protein, 19 aa, Entamoeba histolytica
QIFSIMDGLGKFLSVLQSI

SEQ ID NO: 2724082 - protein, 20 aa, Entamoeba histolytica
QIFSNIHDFIILTKARNLIL

SEQ ID NO: 2724083 - protein, 23 aa, Entamoeba histolytica
QIGGDLIIVMYDVTRITTVTYAQ

SEQ ID NO: 2724084 - protein, 17 aa, Entamoeba histolytica
QIGLYSHNIISNKYIIG

SEQ ID NO: 2724085 - protein, 33 aa, Entamoeba histolytica
QIHFKTQTHVFLIYPNFLFPTTATIDILIEQIN

SEQ ID NO: 2724086 - protein, 26 aa, Entamoeba histolytica
QIHINDSVILCYFFSKLNQLKGTDIT

SEQ ID NO: 2724087 - protein, 20 aa, Entamoeba histolytica
QIICKIMISGGFMRTFGVDL

SEQ ID NO: 2724088 - protein, 19 aa, Entamoeba histolytica
QIIEKIPMPIIANDLNRIL

SEQ ID NO: 2724089 - protein, 18 aa, Entamoeba histolytica
QIIFVGMGLQFKSVDEIG

SEQ ID NO: 2724090 - protein, 18 aa, Entamoeba histolytica
QIIIREGLLTQILQYLPI

SEQ ID NO: 2724091 - protein, 21 aa, Entamoeba histolytica
QIIIYNNYTPSIYLLPHRETM

SEQ ID NO: 2724092 - protein, 28 aa, Entamoeba histolytica
QIIKIINDVFPIKDIWKHVCIVWTECEN

SEQ ID NO: 2724093 - protein, 23 aa, Entamoeba histolytica
QIIKNHFISLLLVFMNDPTDYEY

SEQ ID NO: 2724094 - protein, 35 aa, Entamoeba histolytica; identical to SEQ ID NO: 2536884

SEQ ID NO: 2724095 - protein, 22 aa, Entamoeba histolytica
QIIMFNQRLWNTVHFSEFFYSK

SEQ ID NO: 2724096 - protein, 25 aa, Entamoeba histolytica
QIIQIPPIGIVDLFIKTYSSGIKGN

SEQ ID NO: 2724097 - protein, 24 aa, Entamoeba histolytica
QIISDIINFYQTNGATVLTELINK

SEQ ID NO: 2724098 - protein, 17 aa, Entamoeba histolytica
QIKDNGIVLVYDELEKK

SEQ ID NO: 2724099 - protein, 20 aa, Entamoeba histolytica
QIKEELRIWEPKKLIQEQEE

SEQ ID NO: 2724100 - protein, 36 aa, Entamoeba histolytica; identical to SEQ ID NO: 2536892

SEQ ID NO: 2724101 - protein, 17 aa, Entamoeba histolytica
QIKEIGFMICRYNEIIQ

SEQ ID NO: 2724102 - protein, 34 aa, Entamoeba histolytica
QIKGHQWFAGIDWDLLLQKKVPVPWKPKVSGADD

SEQ ID NO: 2724103 - protein, 24 aa, Entamoeba histolytica
QIKHNGYITLFLIESFINKRKEDV

SEQ ID NO: 2724104 - protein, 25 aa, Entamoeba histolytica
QIKIIDRKAFCFKTPQGCFVTPTVI

SEQ ID NO: 2724105 - protein, 18 aa, Entamoeba histolytica
QIKIIEPEQLRKVTEENK

SEQ ID NO: 2724106 - protein, 17 aa, Entamoeba histolytica
QIKINSIFKGELPEIPK

SEQ ID NO: 2724107 - protein, 24 aa, Entamoeba histolytica
QIKKIFDIFSFIKEPIFYIIQCLY

SEQ ID NO: 2724108 - protein, 23 aa, Entamoeba histolytica
QIKKPIYIVALPRSGSTFTHTVL

SEQ ID NO: 2724109 - protein, 22 aa, Entamoeba histolytica
QIKLFNLITQKSSVIFSFTLTE

SEQ ID NO: 2724110 - protein, 19 aa, Entamoeba histolytica
QIKLPVPLQDDLPICKFGK

SEQ ID NO: 2724111 - protein, 28 aa, Entamoeba histolytica
QIKMLYIPFHQIFNFPYDLFNEKLVISF

SEQ ID NO: 2724112 - protein, 17 aa, Entamoeba histolytica
QIKPVVVEFLKQNPTYF

SEQ ID NO: 2724113 - protein, 23 aa, Entamoeba histolytica
QIKQYKFLFKSMRTTKPQLAVGW

SEQ ID NO: 2724114 - protein, 20 aa, Entamoeba histolytica
QIKRICHFCATASRLRTMKF

SEQ ID NO: 2724115 - protein, 23 aa, Entamoeba histolytica
QIKSFSFQLIRSLTYIHSLGICH

SEQ ID NO: 2724116 - protein, 26 aa, Entamoeba histolytica
QIKVSSSLPFYSFTFDAILKDKTIQK

SEQ ID NO: 2724117 - protein, 25 aa, Entamoeba histolytica
QIKVTMPISMWYPQFIEAMKCYARA

SEQ ID NO: 2724118 - protein, 22 aa, Entamoeba histolytica
QIKYWNDFINRIEWEKGIVWDS

SEQ ID NO: 2724119 - protein, 17 aa, Entamoeba histolytica
QILDYKGVLRRSLTCGD

SEQ ID NO: 2724120 - protein, 26 aa, Entamoeba histolytica
QILEKPLPSLFLTRCCVNLATALQYL

SEQ ID NO: 2724121 - protein, 21 aa, Entamoeba histolytica
QILKYKVKELRRGLDSARRDL

SEQ ID NO: 2724122 - protein, 17 aa, Entamoeba histolytica
QILNYLSTKAQLLADNI

SEQ ID NO: 2724123 - protein, 19 aa, Entamoeba histolytica
QILSPYILLVLNLLQQNKS

SEQ ID NO: 2724124 - protein, 28 aa, Entamoeba histolytica
QILYYQQFQILTQLFISPLRNLQMAKES

SEQ ID NO: 2724125 - protein, 19 aa, Entamoeba histolytica
QINDIIVRLPKIEQNKLFN

SEQ ID NO: 2724126 - protein, 17 aa, Entamoeba histolytica
QINGAPRFDQMPPGYNQ

SEQ ID NO: 2724127 - protein, 19 aa, Entamoeba histolytica
QINICVLTLVITFTSIRRI

SEQ ID NO: 2724128 - protein, 24 aa, Entamoeba histolytica
QINKFYLYNHLFVLSNLPTSINEL

SEQ ID NO: 2724129 - protein, 22 aa, Entamoeba histolytica
QINLALCYLWGCGVKKSIDDAK

SEQ ID NO: 2724130 - protein, 23 aa, Entamoeba histolytica
QINLLALQIFYNNVQIIGLTHEK

SEQ ID NO: 2724131 - protein, 25 aa, Entamoeba histolytica
QINQELLIHLLKIHFTILYKIMKSS

SEQ ID NO: 2724132 - protein, 22 aa, Entamoeba histolytica
QINQYKFDIIEIKNIIDGKDKS

SEQ ID NO: 2724133 - protein, 18 aa, Entamoeba histolytica
QIPELPEKFSLLTNLEIL

SEQ ID NO: 2724134 - protein, 19 aa, Entamoeba histolytica
QIPGLIQFKGPMNLKHNRG

SEQ ID NO: 2724135 - protein, 24 aa, Entamoeba histolytica
QIPLKLNIIVFSKFLFNANDIYCS

SEQ ID NO: 2724136 - protein, 19 aa, Entamoeba histolytica
QIPLRKRGEKGWLFGSKQT

SEQ ID NO: 2724137 - protein, 29 aa, Entamoeba histolytica
QIPNWQMIMQQWLNLFPAKSSYDEIVSLL

SEQ ID NO: 2724138 - protein, 18 aa, Entamoeba histolytica
QIPTLPNPMLVYSSAQMH

SEQ ID NO: 2724139 - protein, 25 aa, Entamoeba histolytica
QIPWRSPDIFYKKNQLFLDVIESVN

SEQ ID NO: 2724140 - protein, 24 aa, Entamoeba histolytica
QIPYGIFEMLYLKLPNQIKSNIYK

SEQ ID NO: 2724141 - protein, 24 aa, Entamoeba histolytica
QIPYYYTTFYSACDYVLFFLIRCE

SEQ ID NO: 2724142 - protein, 17 aa, Entamoeba histolytica
QIQFFINTKTTPTTNRK

SEQ ID NO: 2724143 - protein, 21 aa, Entamoeba histolytica
QIQFSIQIISIENIKYLKTIK

SEQ ID NO: 2724144 - protein, 23 aa, Entamoeba histolytica
QIQILYLSINQYCLTQQGFIVQE

SEQ ID NO: 2724145 - protein, 17 aa, Entamoeba histolytica
QIQKYPPPTFKPQFIMP

SEQ ID NO: 2724146 - protein, 22 aa, Entamoeba histolytica
QIQLFTLWMDEVLQQRQMGVKD

SEQ ID NO: 2724147 - protein, 23 aa, Entamoeba histolytica
QIQPEQFWYLIDAHFKENGLVKQ

SEQ ID NO: 2724148 - protein, 17 aa, Entamoeba histolytica
QIQSYAIPIILKGKNLV

SEQ ID NO: 2724149 - protein, 33 aa, Entamoeba histolytica
QIRRGIQILKMRYLIVYKYYPDKSVILALLRDS

SEQ ID NO: 2724150 - protein, 31 aa, Entamoeba histolytica
QIRYVKYFGELLSKQIYFVQTTYLLQTLSIG

SEQ ID NO: 2724151 - protein, 19 aa, Entamoeba histolytica
QISFLKRRYTKSSFDLKFT

SEQ ID NO: 2724152 - protein, 21 aa, Entamoeba histolytica
QISFQVLYSSAYSFSVCYDDG

SEQ ID NO: 2724153 - protein, 32 aa, Entamoeba histolytica
QISQFYPMLKESKLTYIRYPSFFEVTRIVGVE

SEQ ID NO: 2724154 - protein, 17 aa, Entamoeba histolytica
QISQVLTPLITLSRNIV

SEQ ID NO: 2724155 - protein, 34 aa, Entamoeba histolytica
QISVVRPIVLKLADVGLPLKMISILEAHSFFTEK

SEQ ID NO: 2724156 - protein, 24 aa, Entamoeba histolytica
QITEGKVLAIRYILRAMAVASKFT

SEQ ID NO: 2724157 - protein, 18 aa, Entamoeba histolytica
QITIFRSKIWKVFFGFLP

SEQ ID NO: 2724158 - protein, 19 aa, Entamoeba histolytica
QITLPTFLSNLIILKSRYF

SEQ ID NO: 2724159 - protein, 20 aa, Entamoeba histolytica
QITMKLLKSHKNLVTCVAWH

SEQ ID NO: 2724160 - protein, 36 aa, Entamoeba histolytica
QITNIELPELPKHIKYLFIRTKKTKLIINQQYIETL

SEQ ID NO: 2724161 - protein, 27 aa, Entamoeba histolytica
QITQKYNYYIFKVKIKPQFNEELVNIH

SEQ ID NO: 2724162 - protein, 19 aa, Entamoeba histolytica
QIVEIPLSIFLTGGTVEVS

SEQ ID NO: 2724163 - protein, 17 aa, Entamoeba histolytica
QIVISIILSKNNYINFK

SEQ ID NO: 2724164 - protein, 26 aa, Entamoeba histolytica
QIVKWYCIEWIVRDNLIQQLNHSIST

SEQ ID NO: 2724165 - protein, 17 aa, Entamoeba histolytica
QIVLKLAQVRFVEKYPP

SEQ ID NO: 2724166 - protein, 22 aa, Entamoeba histolytica
QIVQNIAFCGMTTRIDACSLLE

SEQ ID NO: 2724167 - protein, 24 aa, Entamoeba histolytica
QIVSSLFGIVRYLISYEGIQMEFM

SEQ ID NO: 2724168 - protein, 25 aa, Entamoeba histolytica
QIVVIQLVNLLQYLSLNSISYGHLR

SEQ ID NO: 2724169 - protein, 24 aa, Entamoeba histolytica
QIVYDILMYFLQQVQHLVFSIKNY

SEQ ID NO: 2724170 - protein, 18 aa, Entamoeba histolytica
QIYCVDLKRLGVIDEIID

SEQ ID NO: 2724171 - protein, 19 aa, Entamoeba histolytica
QIYLLITFNNYCSETNDTI

SEQ ID NO: 2724172 - protein, 17 aa, Entamoeba histolytica
QKALAKILKCNIALFVL

SEQ ID NO: 2724173 - protein, 28 aa, Entamoeba histolytica
QKCSYFEVIIPFLLFADCRLIVTSNTFL

SEQ ID NO: 2724174 - protein, 20 aa, Entamoeba histolytica
QKCYETYLSTPIYQMAYETF

SEQ ID NO: 2724175 - protein, 31 aa, Entamoeba histolytica
QKDENGLPILMYRVKWLGKELFLSDELSSFF

SEQ ID NO: 2724176 - protein, 21 aa, Entamoeba histolytica
QKDIQPMRRFIVRASIADSTS

SEQ ID NO: 2724177 - protein, 24 aa, Entamoeba histolytica
QKDMPKWRELLVAQVIVGKLIVPR

SEQ ID NO: 2724178 - protein, 29 aa, Entamoeba histolytica
QKEELQWCKAYLIGLLILCETRNSLSGLN

SEQ ID NO: 2724179 - protein, 30 aa, Entamoeba histolytica
QKEIGSFERINGLILIRFIEEISHSKCKFP

SEQ ID NO: 2724180 - protein, 26 aa, Entamoeba histolytica
QKEKPLFHTKPSRNLEWPDELKMPVL

SEQ ID NO: 2724181 - protein, 25 aa, Entamoeba histolytica
QKELPLLVIGSYYFRQRIQKNNIIF

SEQ ID NO: 2724182 - protein, 21 aa, Entamoeba histolytica
QKEMILFKEIGIIKKFTTNEC

SEQ ID NO: 2724183 - protein, 29 aa, Entamoeba histolytica
QKERGEEFWVIFGQLLNYSDTLPKFFKEN

SEQ ID NO: 2724184 - protein, 28 aa, Entamoeba histolytica
QKERKTPIDFIILPPLKLKNQQSQIEVI

SEQ ID NO: 2724185 - protein, 18 aa, Entamoeba histolytica
QKEYIDCGRITFIDLPCC

SEQ ID NO: 2724186 - protein, 24 aa, Entamoeba histolytica
QKFEKIRLDCYFDDLCQWTKLNAI

SEQ ID NO: 2724187 - protein, 21 aa, Entamoeba histolytica
QKFITNLEKKGFFNDCTQSQR

SEQ ID NO: 2724188 - protein, 23 aa, Entamoeba histolytica
QKGLLIGIFNFIVDIPSSIDYLN

SEQ ID NO: 2724189 - protein, 24 aa, Entamoeba histolytica
QKGNEFFSFVIYKENISPKISEVQ

SEQ ID NO: 2724190 - protein, 22 aa, Entamoeba histolytica
QKGTFLYYRNQWNFMNCSSNDL

SEQ ID NO: 2724191 - protein, 25 aa, Entamoeba histolytica
QKGVDGIILVLNYNSVVFLDNLESL

SEQ ID NO: 2724192 - protein, 22 aa, Entamoeba histolytica
QKGVFLLLDAIWSLVKETNGKC

SEQ ID NO: 2724193 - protein, 28 aa, Entamoeba histolytica
QKHPNEEIKWRLIKRISQQKNRNVLLNI

SEQ ID NO: 2724194 - protein, 20 aa, Entamoeba histolytica
QKIAIDNLFEEPKVVSGISN

SEQ ID NO: 2724195 - protein, 35 aa, Entamoeba histolytica
QKIEIIDGMRWVVPYLYWFEVMVKERWIGKEIKEI

SEQ ID NO: 2724196 - protein, 27 aa, Entamoeba histolytica
QKIEPFPRQYLIQRLYPIFDIFEIVEI

SEQ ID NO: 2724197 - protein, 32 aa, Entamoeba histolytica; identical to SEQ ID NO: 2536979

SEQ ID NO: 2724198 - protein, 18 aa, Entamoeba histolytica
QKIIHDPVIFPNVSYPTA

SEQ ID NO: 2724199 - protein, 19 aa, Entamoeba histolytica
QKIIPFDKVHNGLCDCEDG

SEQ ID NO: 2724200 - protein, 27 aa, Entamoeba histolytica
QKIKEAIHLLMRLGYKDIKLIMKELYD

SEQ ID NO: 2724201 - protein, 20 aa, Entamoeba histolytica
QKILQKWCNCDNSKIIFDSK

SEQ ID NO: 2724202 - protein, 18 aa, Entamoeba histolytica
QKIRSIIEKKKSLRTNRR

SEQ ID NO: 2724203 - protein, 19 aa, Entamoeba histolytica
QKIVYPNKIIIITEGVFQH

SEQ ID NO: 2724204 - protein, 24 aa, Entamoeba histolytica
QKKEELKPIIKKEEPKPIIKEEEP

SEQ ID NO: 2724205 - protein, 29 aa, Entamoeba histolytica
QKKEIMNIKYYWYFVVKNSSWISELSPST

SEQ ID NO: 2724206 - protein, 28 aa, Entamoeba histolytica
QKKETTLQYFAYRPLFEQGKLIVNGEYK

SEQ ID NO: 2724207 - protein, 20 aa, Entamoeba histolytica
QKKHGIFSFLKKKSKSAKFE

SEQ ID NO: 2724208 - protein, 23 aa, Entamoeba histolytica
QKKKYIDQYYASKAEYNDKLKEY

SEQ ID NO: 2724209 - protein, 24 aa, Entamoeba histolytica
QKKSVLLIISKWKTNHTFDISLCE

SEQ ID NO: 2724210 - protein, 19 aa, Entamoeba histolytica
QKKWGFGSIKSSIVSGVSS

SEQ ID NO: 2724211 - protein, 25 aa, Entamoeba histolytica
QKKYKEALIPTLNKLNGLVNKSQNE

SEQ ID NO: 2724212 - protein, 26 aa, Entamoeba histolytica
QKLERKRHIGNDIVVLVFLEEGVKHF

SEQ ID NO: 2724213 - protein, 25 aa, Entamoeba histolytica
QKLLRKDFLPPLNSLKFTKKGKVLF

SEQ ID NO: 2724214 - protein, 19 aa, Entamoeba histolytica
QKLNLLALKDSFISDCLQE

SEQ ID NO: 2724215 - protein, 22 aa, Entamoeba histolytica
QKLRGLIVQFLIDNGANINVAN

SEQ ID NO: 2724216 - protein, 20 aa, Entamoeba histolytica
QKLRLRLQLLDIGSSMKHHS

SEQ ID NO: 2724217 - protein, 17 aa, Entamoeba histolytica
QKLTYLEMLGQETNWSG

SEQ ID NO: 2724218 - protein, 25 aa, Entamoeba histolytica
QKMCKYIFHIPSMKGCPIAWEDLNK

SEQ ID NO: 2724219 - protein, 20 aa, Entamoeba histolytica
QKMMHILQDAINYNPKFIGK

SEQ ID NO: 2724220 - protein, 30 aa, Entamoeba histolytica
QKMQKLYQQMQGIMLIKGVGPSITSIYNNI

SEQ ID NO: 2724221 - protein, 27 aa, Entamoeba histolytica
QKNCILDSFYFIGWIGKTTLNHNVSKE

SEQ ID NO: 2724222 - protein, 20 aa, Entamoeba histolytica
QKNGIIPVPLYATLGEKAID

SEQ ID NO: 2724223 - protein, 28 aa, Entamoeba histolytica
QKNNIPTIQLIKFYSLLLSSPSLNNNII

SEQ ID NO: 2724224 - protein, 23 aa, Entamoeba histolytica
QKNSLFLVIYCLEHFKASINQKD

SEQ ID NO: 2724225 - protein, 29 aa, Entamoeba histolytica
QKNWVDCGCYMLYYIRKIASQPKRTLKEY

SEQ ID NO: 2724226 - protein, 20 aa, Entamoeba histolytica
QKPIFKISMFLFQQRDTKAD

SEQ ID NO: 2724227 - protein, 34 aa, Entamoeba histolytica
QKPIILTPYHYIISSIFIQFFRDSLEQFDKAIHF

SEQ ID NO: 2724228 - protein, 27 aa, Entamoeba histolytica
QKQKKCIFVKGFPNTWKIKDLKERFDD

SEQ ID NO: 2724229 - protein, 26 aa, Entamoeba histolytica
QKRKKTYSLLFILKSIVLSLEKECNF

SEQ ID NO: 2724230 - protein, 23 aa, Entamoeba histolytica
QKRRHGLIKKAMELSILCDCKVS

SEQ ID NO: 2724231 - protein, 18 aa, Entamoeba histolytica
QKRWLFPNEVKSIGRRMK

SEQ ID NO: 2724232 - protein, 24 aa, Entamoeba histolytica
QKRYYFIHHILYNTSYQVPQFGVS

SEQ ID NO: 2724233 - protein, 25 aa, Entamoeba histolytica
QKSARVKQVFLLLKSLPEENYTLLH

SEQ ID NO: 2724234 - protein, 28 aa, Entamoeba histolytica
QKSGKTEAYFPYRLPSRAIYGGQNIEDS

SEQ ID NO: 2724235 - protein, 29 aa, Entamoeba histolytica
QKSGVDCFQFTILAKSKRGGPVKPGNAKF

SEQ ID NO: 2724236 - protein, 49 aa, Entamoeba histolytica
QKSINELYLYILDDYYIQLWQSLIIPKLLLESNLFNFLYYHKKSCCSKL

SEQ ID NO: 2724237 - protein, 25 aa, Entamoeba histolytica
QKSKQSIFMLLQSYLEKYPESLISF

SEQ ID NO: 2724238 - protein, 23 aa, Entamoeba histolytica
QKSPLLPQNVSPPTPLSNGIIHT

SEQ ID NO: 2724239 - protein, 36 aa, Entamoeba histolytica
QKTTSLFLVQFTIAQDPWIEWGKILNLRCMENQKNE

SEQ ID NO: 2724240 - protein, 19 aa, Entamoeba histolytica
QKVESLIYFSYASDEIIEI

SEQ ID NO: 2724241 - protein, 25 aa, Entamoeba histolytica
QKVIFPTSVMFWETLKKALDDNNIN

SEQ ID NO: 2724242 - protein, 23 aa, Entamoeba histolytica
QKVKLFFEALQSQVDTLQSLESL

SEQ ID NO: 2724243 - protein, 18 aa, Entamoeba histolytica
QKVSVGSLVYIPSVTEIK

SEQ ID NO: 2724244 - protein, 26 aa, Entamoeba histolytica
QKVTSKTMNFYLWKSYKLPNGNNISE

SEQ ID NO: 2724245 - protein, 29 aa, Entamoeba histolytica
QKVYSSISLLPYHYSFIAITTPPISPEFD

SEQ ID NO: 2724246 - protein, 27 aa, Entamoeba histolytica
QKWAKITIFMKIWTDLLPYDFHDKEIL

SEQ ID NO: 2724247 - protein, 24 aa, Entamoeba histolytica
QKWKIDPMNNLRMWNRILSGIEKS

SEQ ID NO: 2724248 - protein, 22 aa, Entamoeba histolytica
QKWMMYVDRFITDDKLWFIIQT

SEQ ID NO: 2724249 - protein, 17 aa, Entamoeba histolytica
QKWNLILCGLHANQMIF

SEQ ID NO: 2724250 - protein, 25 aa, Entamoeba histolytica
QKYGLRPYGVGLLVIGYDTKPRLFE

SEQ ID NO: 2724251 - protein, 20 aa, Entamoeba histolytica
QKYHFAFSLINPHKTAPINV

SEQ ID NO: 2724252 - protein, 17 aa, Entamoeba histolytica
QKYIKIPSYQDLSFLNN

SEQ ID NO: 2724253 - protein, 20 aa, Entamoeba histolytica
QKYKITLDQYFLLTKNNKYY

SEQ ID NO: 2724254 - protein, 35 aa, Entamoeba histolytica
QKYTDIQKQFNFIETQLKLDEEALMKCISEGQMKE

SEQ ID NO: 2724255 - protein, 20 aa, Entamoeba histolytica
QLAALCGGYIMMPLNPLYTK

SEQ ID NO: 2724256 - protein, 24 aa, Entamoeba histolytica
QLAKPLELPQMFSMPFTIEDIQQL

SEQ ID NO: 2724257 - protein, 24 aa, Entamoeba histolytica
QLAKRPQVIVGTPGRIVYHIKNTK

SEQ ID NO: 2724258 - protein, 21 aa, Entamoeba histolytica
QLALKLLCNVVYGYTGAGLSG

SEQ ID NO: 2724259 - protein, 25 aa, Entamoeba histolytica
QLAQDGFQWFFNNTLVTVWSAPKYY

SEQ ID NO: 2724260 - protein, 26 aa, Entamoeba histolytica
QLCFFKAVIQLLLNYKQYIGYTWISN

SEQ ID NO: 2724261 - protein, 18 aa, Entamoeba histolytica
QLCFVKGISLLMKGYEEH

SEQ ID NO: 2724262 - protein, 24 aa, Entamoeba histolytica
QLCWYDNTLYILSIVQGTIIIING

SEQ ID NO: 2724263 - protein, 29 aa, Entamoeba histolytica
QLDCFEDMHFWLNGMKFQQIFIEEAIDNI

SEQ ID NO: 2724264 - protein, 20 aa, Entamoeba histolytica
QLDKQLLLKKQKKIDELFKI

SEQ ID NO: 2724265 - protein, 36 aa, Entamoeba histolytica
QLDLRSYLITPVQRLPRYNLLLNELLKHTPTDHPDY

SEQ ID NO: 2724266 - protein, 20 aa, Entamoeba histolytica
QLDVAGFAIRKSSTKMRIIA

SEQ ID NO: 2724267 - protein, 18 aa, Entamoeba histolytica
QLEDVECLLLLLNKIIPY

SEQ ID NO: 2724268 - protein, 18 aa, Entamoeba histolytica
QLEDYSLLLIQQGSLREI

SEQ ID NO: 2724269 - protein, 19 aa, Entamoeba histolytica
QLEEFIADILLLKNKKEIE

SEQ ID NO: 2724270 - protein, 34 aa, Entamoeba histolytica; identical to SEQ ID NO: 2537052

SEQ ID NO: 2724271 - protein, 24 aa, Entamoeba histolytica
QLEESPFNLLKLDVKIQLKICSFL

SEQ ID NO: 2724272 - protein, 19 aa, Entamoeba histolytica
QLEHVMLVRKLTTGVGARA

SEQ ID NO: 2724273 - protein, 19 aa, Entamoeba histolytica
QLEIPTKIRASKSYLFVQD

SEQ ID NO: 2724274 - protein, 23 aa, Entamoeba histolytica
QLEKYFQFNLYFNQSINNVINCI

SEQ ID NO: 2724275 - protein, 21 aa, Entamoeba histolytica
QLFEQLPKFNYLHKVVIRCDS

SEQ ID NO: 2724276 - protein, 25 aa, Entamoeba histolytica
QLFIINICIYLLRNISLNTQISSGY

SEQ ID NO: 2724277 - protein, 20 aa, Entamoeba histolytica
QLFISSLIKNVPKSIFEILN

SEQ ID NO: 2724278 - protein, 19 aa, Entamoeba histolytica
QLFKITDMLGLPPKNILEQ

SEQ ID NO: 2724279 - protein, 19 aa, Entamoeba histolytica
QLFNGDGLFYLIDNDSSLN

SEQ ID NO: 2724280 - protein, 19 aa, Entamoeba histolytica
QLFNGNGLFYLIDNDSSLN

SEQ ID NO: 2724281 - protein, 19 aa, Entamoeba histolytica
QLFNGNGLFYLIENDSSLN

SEQ ID NO: 2724282 - protein, 18 aa, Entamoeba histolytica
QLFNGNGLFYLIENESSL

SEQ ID NO: 2724283 - protein, 19 aa, Entamoeba histolytica
QLFQCCRVIPDAQSPNEML

SEQ ID NO: 2724284 - protein, 30 aa, Entamoeba histolytica; identical to SEQ ID NO: 2537062

SEQ ID NO: 2724285 - protein, 21 aa, Entamoeba histolytica
QLGDQELLFFSLNAFYNFIKR

SEQ ID NO: 2724286 - protein, 23 aa, Entamoeba histolytica
QLGLVLDFVLQFDNKKLGNSSIQ

SEQ ID NO: 2724287 - protein, 19 aa, Entamoeba histolytica
QLHDNCGIVYYKMGIISCM

SEQ ID NO: 2724288 - protein, 19 aa, Entamoeba histolytica
QLHIIILDELDAICKQRGS

SEQ ID NO: 2724289 - protein, 17 aa, Entamoeba histolytica
QLHVLYQPDGRPRNVYP

SEQ ID NO: 2724290 - protein, 18 aa, Entamoeba histolytica
QLIDIILPFKNKITELNV

SEQ ID NO: 2724291 - protein, 19 aa, Entamoeba histolytica
QLIESRIKIHFQRIGTPQK

SEQ ID NO: 2724292 - protein, 17 aa, Entamoeba histolytica
QLIHLKRLHLYSFSNDI

SEQ ID NO: 2724293 - protein, 18 aa, Entamoeba histolytica
QLIIGPMFSGKTTELIRL

SEQ ID NO: 2724294 - protein, 18 aa, Entamoeba histolytica
QLIKMRLYLTINYNTEFN

SEQ ID NO: 2724295 - protein, 17 aa, Entamoeba histolytica
QLILEKYCKARNLTYIP

SEQ ID NO: 2724296 - protein, 18 aa, Entamoeba histolytica
QLINRMYKLILNGDKEDI

SEQ ID NO: 2724297 - protein, 24 aa, Entamoeba histolytica
QLIQQLYQYQCKCTELIKTRKQNQ

SEQ ID NO: 2724298 - protein, 31 aa, Entamoeba histolytica; identical to SEQ ID NO: 2537072

SEQ ID NO: 2724299 - protein, 18 aa, Entamoeba histolytica
QLISLVLEYAKCAKMPLI

SEQ ID NO: 2724300 - protein, 25 aa, Entamoeba histolytica
QLITQLLPILIYLNDSIDPSILKEL

SEQ ID NO: 2724301 - protein, 20 aa, Entamoeba histolytica
QLKDITFLDLSFQHLKILPK

SEQ ID NO: 2724302 - protein, 22 aa, Entamoeba histolytica
QLKDNMIISFSLHDNNCSLFTL

SEQ ID NO: 2724303 - protein, 17 aa, Entamoeba histolytica
QLKDYVVIDVFEKNIPK

SEQ ID NO: 2724304 - protein, 20 aa, Entamoeba histolytica
QLKKPKTFALSLNKKEQHPP

SEQ ID NO: 2724305 - protein, 24 aa, Entamoeba histolytica
QLKMTTLQFNRYYNYILQNAETQS

SEQ ID NO: 2724306 - protein, 29 aa, Entamoeba histolytica
QLKPFQIDALNWLIRRHHLGVNSILADEM

SEQ ID NO: 2724307 - protein, 18 aa, Entamoeba histolytica
QLKPLRDLLDQLHIEYRS

SEQ ID NO: 2724308 - protein, 23 aa, Entamoeba histolytica
QLKQDFTLVDPRKALFKYNTDQP

SEQ ID NO: 2724309 - protein, 17 aa, Entamoeba histolytica
QLKRHKFLTQVEDNQPV

SEQ ID NO: 2724310 - protein, 31 aa, Entamoeba histolytica; identical to SEQ ID NO: 2537089

SEQ ID NO: 2724311 - protein, 32 aa, Entamoeba histolytica
QLLESKKLLRLMEVILLIGNYLNQGTARAKCH

SEQ ID NO: 2724312 - protein, 19 aa, Entamoeba histolytica
QLLGILYRMGVKQQQKPIE

SEQ ID NO: 2724313 - protein, 18 aa, Entamoeba histolytica
QLLGIRTVQTIIPQQIKL

SEQ ID NO: 2724314 - protein, 20 aa, Entamoeba histolytica
QLLIKKLFDCDDDKIYKMMK

SEQ ID NO: 2724315 - protein, 19 aa, Entamoeba histolytica
QLLIPFLQSLYFYRNTYSQ

SEQ ID NO: 2724316 - protein, 17 aa, Entamoeba histolytica
QLLKQPRSTFDFVELQN

SEQ ID NO: 2724317 - protein, 26 aa, Entamoeba histolytica
QLLLILCNYFQQWLIQNDIPFIQDVL

SEQ ID NO: 2724318 - protein, 21 aa, Entamoeba histolytica
QLLMKALIITRYLISDRPYID

SEQ ID NO: 2724319 - protein, 20 aa, Entamoeba histolytica
QLLNLLYHEIPFKKNDRRSY

SEQ ID NO: 2724320 - protein, 17 aa, Entamoeba histolytica
QLLQKHLALHLLDVFTA

SEQ ID NO: 2724321 - protein, 17 aa, Entamoeba histolytica
QLLQSKQLILPFIVKPE

SEQ ID NO: 2724322 - protein, 28 aa, Entamoeba histolytica
QLLSFGISYIAFMPIPNIIEKRINVSSQ

SEQ ID NO: 2724323 - protein, 24 aa, Entamoeba histolytica
QLLYSSFLIGYFEDLIRKSPDFKE

SEQ ID NO: 2724324 - protein, 20 aa, Entamoeba histolytica
QLMIQYAIKLLSTPSTSISE

SEQ ID NO: 2724325 - protein, 18 aa, Entamoeba histolytica
QLMKKIIPNYKKLADACE

SEQ ID NO: 2724326 - protein, 23 aa, Entamoeba histolytica
QLMKRLLLTYAIKHPASGYVQGM

SEQ ID NO: 2724327 - protein, 19 aa, Entamoeba histolytica
QLMLAEFLHKEAAVVVPMG

SEQ ID NO: 2724328 - protein, 17 aa, Entamoeba histolytica
QLMNGLFQLVGNTLTTC

SEQ ID NO: 2724329 - protein, 29 aa, Entamoeba histolytica
QLNDFTIIYYLLLSWKRLIEITSIRSYPL

SEQ ID NO: 2724330 - protein, 19 aa, Entamoeba histolytica
QLNLIKYILNESDKRYFNS

SEQ ID NO: 2724331 - protein, 25 aa, Entamoeba histolytica
QLNLSTLPTLFAFALSTQSYKNYLI

SEQ ID NO: 2724332 - protein, 17 aa, Entamoeba histolytica
QLNNLRIIVPVKENVIV

SEQ ID NO: 2724333 - protein, 20 aa, Entamoeba histolytica
QLNNSYIIIGLYAHKRKDDK

SEQ ID NO: 2724334 - protein, 24 aa, Entamoeba histolytica
QLNQKKITLLYKTKVFLLCSPKMN

SEQ ID NO: 2724335 - protein, 24 aa, Entamoeba histolytica
QLNQTLFSTLRYSPSQYLTYGCQF

SEQ ID NO: 2724336 - protein, 32 aa, Entamoeba histolytica
QLNVWKSETVKNYILYFGTVKSNEQLEKEKQE

SEQ ID NO: 2724337 - protein, 17 aa, Entamoeba histolytica
QLNYQYSDLLRKNVISK

SEQ ID NO: 2724338 - protein, 20 aa, Entamoeba histolytica
QLPKEYCSILKYIIEHETIN

SEQ ID NO: 2724339 - protein, 24 aa, Entamoeba histolytica
QLPLELRKLVIDGIFLSKIAKQLE

SEQ ID NO: 2724340 - protein, 17 aa, Entamoeba histolytica
QLPPVRIASFVKRILIM

SEQ ID NO: 2724341 - protein, 22 aa, Entamoeba histolytica
QLPQQINQLPILPKPRRIVKKR

SEQ ID NO: 2724342 - protein, 30 aa, Entamoeba histolytica
QLQIDITANILLKWITYLKSEGIILSKLPT

SEQ ID NO: 2724343 - protein, 18 aa, Entamoeba histolytica
QLQKESFKWTQEKHYSLS

SEQ ID NO: 2724344 - protein, 20 aa, Entamoeba histolytica
QLQLFYPNLYLRLNSVHIED

SEQ ID NO: 2724345 - protein, 29 aa, Entamoeba histolytica
QLQNNVNKLWKILTIIYTNGIENIDGVEF

SEQ ID NO: 2724346 - protein, 20 aa, Entamoeba histolytica
QLQPILQTFTVIPSYPILLK

SEQ ID NO: 2724347 - protein, 24 aa, Entamoeba histolytica
QLQSKMTEIYYFLDELKKVQKELK

SEQ ID NO: 2724348 - protein, 27 aa, Entamoeba histolytica
QLQTTPAAPIEQPPTPPKPAHLTSKEE

SEQ ID NO: 2724349 - protein, 26 aa, Entamoeba histolytica
QLQYIVDKLLTTLPPIDPQLTKMANI

SEQ ID NO: 2724350 - protein, 17 aa, Entamoeba histolytica
QLRAQILSMDYLHSAIQ

SEQ ID NO: 2724351 - protein, 28 aa, Entamoeba histolytica
QLRLDSLGHVLFYPQKPLVSTRAAEYVK

SEQ ID NO: 2724352 - protein, 18 aa, Entamoeba histolytica
QLRLVRPEALNPSQHLFA

SEQ ID NO: 2724353 - protein, 19 aa, Entamoeba histolytica
QLRSLLFTFFLCYSQSHFE

SEQ ID NO: 2724354 - protein, 21 aa, Entamoeba histolytica
QLSEGILLELRKKSGEKTPRT

SEQ ID NO: 2724355 - protein, 29 aa, Entamoeba histolytica
QLSENTIRDIWWKGPIGSDGKYMILGNGF

SEQ ID NO: 2724356 - protein, 17 aa, Entamoeba histolytica
QLSFALIRAQSLTLPDS

SEQ ID NO: 2724357 - protein, 25 aa, Entamoeba histolytica
QLSGRVTINLQFTWYDTYLQEDSKP

SEQ ID NO: 2724358 - protein, 18 aa, Entamoeba histolytica
QLSIAKKLIDSIGTEYCK

SEQ ID NO: 2724359 - protein, 22 aa, Entamoeba histolytica
QLSLIHSNMALCWLKLENWNET

SEQ ID NO: 2724360 - protein, 19 aa, Entamoeba histolytica
QLSNFFIGRIFYTNAQTQN

SEQ ID NO: 2724361 - protein, 19 aa, Entamoeba histolytica
QLTFPINLKYISPGSFSCC

SEQ ID NO: 2724362 - protein, 18 aa, Entamoeba histolytica
QLTINGILVERAAFIILG

SEQ ID NO: 2724363 - protein, 21 aa, Entamoeba histolytica
QLTIPYDFILSLNSLFDQLIQ

SEQ ID NO: 2724364 - protein, 18 aa, Entamoeba histolytica
QLTKAEFIIYVLSVTDRE

SEQ ID NO: 2724365 - protein, 17 aa, Entamoeba histolytica
QLTKLKTLIINKSFISC

SEQ ID NO: 2724366 - protein, 21 aa, Entamoeba histolytica
QLTLDRLVDYLDTFHIFGIVS

SEQ ID NO: 2724367 - protein, 17 aa, Entamoeba histolytica
QLTMWKNEFLKNCTTNK

SEQ ID NO: 2724368 - protein, 31 aa, Entamoeba histolytica
QLTVMQALVLKHRWFPKLVKSKEPIVVSVGW

SEQ ID NO: 2724369 - protein, 27 aa, Entamoeba histolytica
QLTYITSYYFRSIKLFELFLWNKCHDE

SEQ ID NO: 2724370 - protein, 28 aa, Entamoeba histolytica
QLVAKRSQIPLQLAWAISIHKSQGMTLE

SEQ ID NO: 2724371 - protein, 28 aa, Entamoeba histolytica
QLVFYIVVHKFIVFLKSLNSNEKKNENL

SEQ ID NO: 2724372 - protein, 22 aa, Entamoeba histolytica
QLVGYPDVMKCSKIAKVFTDAY

SEQ ID NO: 2724373 - protein, 26 aa, Entamoeba histolytica
QLVIQTLLKIKPNKCIIHHFSTRYSI

SEQ ID NO: 2724374 - protein, 25 aa, Entamoeba histolytica
QLVLQICILFLCPFNQNVIQTSQLL

SEQ ID NO: 2724375 - protein, 17 aa, Entamoeba histolytica
QLVLSFLDTYKHFCIDG

SEQ ID NO: 2724376 - protein, 23 aa, Entamoeba histolytica
QLVPFHVAYIKNITTREGFFRIN

SEQ ID NO: 2724377 - protein, 23 aa, Entamoeba histolytica
QLVYLRQGMLELAILTLLNGYYD

SEQ ID NO: 2724378 - protein, 19 aa, Entamoeba histolytica
QLYIGWYDGNPAHLNELPP

SEQ ID NO: 2724379 - protein, 30 aa, Entamoeba histolytica
QLYNIAPLQAMLFGLQLKPLPTVKRILEDQ

SEQ ID NO: 2724380 - protein, 26 aa, Entamoeba histolytica
QMANYIEAEWWSKLIARFPSSKSKIP

SEQ ID NO: 2724381 - protein, 17 aa, Entamoeba histolytica
QMAVFNFLLSSNITINP

SEQ ID NO: 2724382 - protein, 26 aa, Entamoeba histolytica
QMDKDGIIFVLIFKNEQIVFARGRNN

SEQ ID NO: 2724383 - protein, 24 aa, Entamoeba histolytica
QMDLTLLDLLLFSTSGFIEFSISL

SEQ ID NO: 2724384 - protein, 18 aa, Entamoeba histolytica
QMDQQLLESIKKLLKHQS

SEQ ID NO: 2724385 - protein, 24 aa, Entamoeba histolytica
QMDSLTLAKILAPNLCWSKNEGIT

SEQ ID NO: 2724386 - protein, 27 aa, Entamoeba histolytica
QMEFKYIIGEAFLIKNYPRIQTVITKT

SEQ ID NO: 2724387 - protein, 26 aa, Entamoeba histolytica
QMEGLNWLVFNWCRGKGCILADEMGL

SEQ ID NO: 2724388 - protein, 26 aa, Entamoeba histolytica
QMEILKKIINSTFIIRKNETVTLMEI

SEQ ID NO: 2724389 - protein, 26 aa, Entamoeba histolytica
QMEILTIKMRIRKAYYELYAMIKSAQ

SEQ ID NO: 2724390 - protein, 27 aa, Entamoeba histolytica
QMENDDIKPIPQLNLNVFDMPNHEDKD

SEQ ID NO: 2724391 - protein, 18 aa, Entamoeba histolytica
QMFILYENKLTQIHLISY

SEQ ID NO: 2724392 - protein, 17 aa, Entamoeba histolytica
QMHLLICLINSKLESFQ

SEQ ID NO: 2724393 - protein, 19 aa, Entamoeba histolytica
QMIFECIKKCPLTSRRPLL

SEQ ID NO: 2724394 - protein, 17 aa, Entamoeba histolytica
QMKCIISEILHEIPLNC

SEQ ID NO: 2724395 - protein, 17 aa, Entamoeba histolytica
QMLDQKMDSILNKTDES

SEQ ID NO: 2724396 - protein, 17 aa, Entamoeba histolytica
QMLKTNPLIKLQNESQS

SEQ ID NO: 2724397 - protein, 18 aa, Entamoeba histolytica
QMNEKIISSFETYSLFTT

SEQ ID NO: 2724398 - protein, 27 aa, Entamoeba histolytica
QMNENAEKLIRMAKSFGLEVTCSASAI

SEQ ID NO: 2724399 - protein, 17 aa, Entamoeba histolytica
QMNENDWRIIRENLNIF

SEQ ID NO: 2724400 - protein, 22 aa, Entamoeba histolytica
QMNFTGFFEFYSGLNSSAISRL

SEQ ID NO: 2724401 - protein, 18 aa, Entamoeba histolytica
QMNKPLLLTFDDSFVRDI

SEQ ID NO: 2724402 - protein, 18 aa, Entamoeba histolytica
QMNLLAQMKEPLPSTNSP

SEQ ID NO: 2724403 - protein, 19 aa, Entamoeba histolytica
QMNTLFTEKNYKVNIPPFI

SEQ ID NO: 2724404 - protein, 18 aa, Entamoeba histolytica
QMRVVSRYGHFIMKISDI

SEQ ID NO: 2724405 - protein, 19 aa, Entamoeba histolytica
QMSELYWDYTKRRKWDSFY

SEQ ID NO: 2724406 - protein, 29 aa, Entamoeba histolytica
QMSLPAFQPYYYGKRPLLFKIPEGLPPSH

SEQ ID NO: 2724407 - protein, 17 aa, Entamoeba histolytica
QMTAEYFVQPLLNGLDD

SEQ ID NO: 2724408 - protein, 25 aa, Entamoeba histolytica
QMTENLDKALRFIQSRDVKLTGIGP

SEQ ID NO: 2724409 - protein, 19 aa, Entamoeba histolytica
QMTFDRLSSIIPVKNFIVV

SEQ ID NO: 2724410 - protein, 24 aa, Entamoeba histolytica
QMTTQVIQLIILLQTPNALQTLIN

SEQ ID NO: 2724411 - protein, 18 aa, Entamoeba histolytica
QMVHIELVQWFECIAEFD

SEQ ID NO: 2724412 - protein, 26 aa, Entamoeba histolytica
QMVHNLHLAMQFLEKEMLVRNPGCFA

SEQ ID NO: 2724413 - protein, 22 aa, Entamoeba histolytica
QMVMDIVNALQGIVLECCKHPY

SEQ ID NO: 2724414 - protein, 24 aa, Entamoeba histolytica
QMVSLATKPLYTTPLILLNDVEAE

SEQ ID NO: 2724415 - protein, 33 aa, Entamoeba histolytica; identical to SEQ ID NO: 2537178

SEQ ID NO: 2724416 - protein, 20 aa, Entamoeba histolytica
QNCFDIFYLISSIENTQLPK

SEQ ID NO: 2724417 - protein, 25 aa, Entamoeba histolytica
QNDASEFFLFLLDELDKEMRGTQSG

SEQ ID NO: 2724418 - protein, 17 aa, Entamoeba histolytica
QNDDKFFVFTCKNSFGI

SEQ ID NO: 2724419 - protein, 25 aa, Entamoeba histolytica
QNDDSLPEFLPDGILKKLTKKVGAK

SEQ ID NO: 2724420 - protein, 17 aa, Entamoeba histolytica
QNDFFELFNPYLELRID

SEQ ID NO: 2724421 - protein, 20 aa, Entamoeba histolytica
QNDLIKLRSLFSLTSNYKRY

SEQ ID NO: 2724422 - protein, 26 aa, Entamoeba histolytica
QNEFDSIYNMWGSDAFFKFHSNSVYE

SEQ ID NO: 2724423 - protein, 25 aa, Entamoeba histolytica
QNEFKDYRMIFGLQKLFVDMLKGIN

SEQ ID NO: 2724424 - protein, 19 aa, Entamoeba histolytica
QNEIAAMRLLAVTSSEEGC

SEQ ID NO: 2724425 - protein, 28 aa, Entamoeba histolytica
QNERKRIHLVWFVINSAVGRLQPFEEEI

SEQ ID NO: 2724426 - protein, 24 aa, Entamoeba histolytica
QNESHQIKLPVFTNFNATPINQDI

SEQ ID NO: 2724427 - protein, 34 aa, Entamoeba histolytica
QNESKLLLTPYEKNIQFWRQLWRTCEQSDVILQI

SEQ ID NO: 2724428 - protein, 24 aa, Entamoeba histolytica
QNEYKIIQLINLRLETIKSSIKNK

SEQ ID NO: 2724429 - protein, 18 aa, Entamoeba histolytica
QNFHRPLLPARDAEKMHI

SEQ ID NO: 2724430 - protein, 17 aa, Entamoeba histolytica
QNFLLYDAAPEVCIFLL

SEQ ID NO: 2724431 - protein, 21 aa, Entamoeba histolytica
QNFRLVLINGKYYLQAESQEQ

SEQ ID NO: 2724432 - protein, 17 aa, Entamoeba histolytica
QNGGKGFLVCWCGRIEK

SEQ ID NO: 2724433 - protein, 21 aa, Entamoeba histolytica
QNGHLVYKSIAKTLKDQSTLK

SEQ ID NO: 2724434 - protein, 23 aa, Entamoeba histolytica
QNGLYYFIDSLFSLFDQWKKFDQ

SEQ ID NO: 2724435 - protein, 24 aa, Entamoeba histolytica
QNGMLKALLPYYRLTQAVQVGGLE

SEQ ID NO: 2724436 - protein, 26 aa, Entamoeba histolytica
QNGMNALFFDIIGKGKVILSGPHFEL

SEQ ID NO: 2724437 - protein, 26 aa, Entamoeba histolytica
QNGMNALFFDIIGKGKVILSSPHFEL

SEQ ID NO: 2724438 - protein, 22 aa, Entamoeba histolytica
QNGYLGFHLLKQFYKTNYYEES

SEQ ID NO: 2724439 - protein, 26 aa, Entamoeba histolytica
QNHFSKYFLLKEVTLPTSITSLGNSC

SEQ ID NO: 2724440 - protein, 20 aa, Entamoeba histolytica
QNICMLFKEESQRKEWKTSL

SEQ ID NO: 2724441 - protein, 21 aa, Entamoeba histolytica
QNIFISLYHSPIYTRSNKCGC

SEQ ID NO: 2724442 - protein, 24 aa, Entamoeba histolytica
QNIKEYAIILSNLTIQDTPLIINV

SEQ ID NO: 2724443 - protein, 25 aa, Entamoeba histolytica
QNIKKPLFHSNFTSKLVLGKKPITI

SEQ ID NO: 2724444 - protein, 26 aa, Entamoeba histolytica
QNILLPPPVILYKTGKVMFTRKQSLC

SEQ ID NO: 2724445 - protein, 20 aa, Entamoeba histolytica
QNIMKKLYSIKKLGMFAVDE

SEQ ID NO: 2724446 - protein, 21 aa, Entamoeba histolytica
QNIQITLIRGINFPTLKGKQT

SEQ ID NO: 2724447 - protein, 23 aa, Entamoeba histolytica
QNITPYIHSFAKKSFHLFTDSSE

SEQ ID NO: 2724448 - protein, 24 aa, Entamoeba histolytica
QNKGKLLGFYVRCKNNFNGKIFQT

SEQ ID NO: 2724449 - protein, 18 aa, Entamoeba histolytica
QNKIKLCSLLTCFRRSNA

SEQ ID NO: 2724450 - protein, 22 aa, Entamoeba histolytica
QNKLEVYYISYNNSDLKITMIS

SEQ ID NO: 2724451 - protein, 37 aa, Entamoeba histolytica
QNLDLRDYLIMPVQRLPRYSLLLTDLLKHTPTNHCDY

SEQ ID NO: 2724452 - protein, 17 aa, Entamoeba histolytica
QNLLFFPSYIDENKKDQ

SEQ ID NO: 2724453 - protein, 21 aa, Entamoeba histolytica
QNLNIFDLLGGCSSTITIQQP

SEQ ID NO: 2724454 - protein, 18 aa, Entamoeba histolytica
QNLNQFFKSIRPHLKVHF

SEQ ID NO: 2724455 - protein, 27 aa, Entamoeba histolytica
QNLVPFTLYCCSILVMLNIPPSDYSIY

SEQ ID NO: 2724456 - protein, 22 aa, Entamoeba histolytica
QNLVPLLNSCLFSKRSISEYTN

SEQ ID NO: 2724457 - protein, 25 aa, Entamoeba histolytica
QNLVSLISGICPCAFFETSALYNVQ

SEQ ID NO: 2724458 - protein, 23 aa, Entamoeba histolytica
QNLYQFMRSLKKKVPTIYIRLFS

SEQ ID NO: 2724459 - protein, 29 aa, Entamoeba histolytica
QNMFISLETPFLNRIIHLIRLFSNPKDNK

SEQ ID NO: 2724460 - protein, 24 aa, Entamoeba histolytica
QNNCRALFVQLARSILQQLLEALV

SEQ ID NO: 2724461 - protein, 24 aa, Entamoeba histolytica
QNNERNIKFFKSPSSSLFSNKNNI

SEQ ID NO: 2724462 - protein, 31 aa, Entamoeba histolytica; identical to SEQ ID NO: 2537242

SEQ ID NO: 2724463 - protein, 24 aa, Entamoeba histolytica
QNNQGILELPPLDSLQNLTRLVVK

SEQ ID NO: 2724464 - protein, 18 aa, Entamoeba histolytica
QNNSLPSFALNNTPLGRA

SEQ ID NO: 2724465 - protein, 24 aa, Entamoeba histolytica
QNNTTLLYQQLLSQLMQLQKQNLE

SEQ ID NO: 2724466 - protein, 25 aa, Entamoeba histolytica
QNPFPTALSRQLFSLLGGVETLIVA

SEQ ID NO: 2724467 - protein, 18 aa, Entamoeba histolytica
QNPKPYNITLSPFKEYSF

SEQ ID NO: 2724468 - protein, 19 aa, Entamoeba histolytica
QNPLSLSAIITPRGSIRKS

SEQ ID NO: 2724469 - protein, 20 aa, Entamoeba histolytica
QNRAEYNPFLLFCRDHRENV

SEQ ID NO: 2724470 - protein, 28 aa, Entamoeba histolytica
QNRELINGIMLLFLSFSNPEIVTVSLMN

SEQ ID NO: 2724471 - protein, 22 aa, Entamoeba histolytica
QNRIRISFIISWLDDNDVDKVS

SEQ ID NO: 2724472 - protein, 18 aa, Entamoeba histolytica
QNRQFGIFDLRQDKPCCI

SEQ ID NO: 2724473 - protein, 27 aa, Entamoeba histolytica
QNSIRPEDILYAGLRMRVLKVRTTDEV

SEQ ID NO: 2724474 - protein, 24 aa, Entamoeba histolytica
QNSKTYWPLVLDIATKNTVNRITR

SEQ ID NO: 2724475 - protein, 27 aa, Entamoeba histolytica
QNTLKELWSLLHFLHPKKFISFEEFEK

SEQ ID NO: 2724476 - protein, 36 aa, Entamoeba histolytica
QNTLSLLPMNQLCNLLLTYLCMYYKINVSTGFIQKQ

SEQ ID NO: 2724477 - protein, 24 aa, Entamoeba histolytica
QNTYKTIILPQILQQIILSGEVHS

SEQ ID NO: 2724478 - protein, 20 aa, Entamoeba histolytica
QNVDIIIPPHLKSLIINSCK

SEQ ID NO: 2724479 - protein, 24 aa, Entamoeba histolytica
QNVKWYFPIGVIFDALHNGSLPME

SEQ ID NO: 2724480 - protein, 28 aa, Entamoeba histolytica
QNVLSKGPAKFKFEPPPSTTKRGCADIK

SEQ ID NO: 2724481 - protein, 23 aa, Entamoeba histolytica
QNVPNSFQILAKKSFSVIAKDET

SEQ ID NO: 2724482 - protein, 25 aa, Entamoeba histolytica
QNVSMIFYHPKIMNLIICCYSIIKK

SEQ ID NO: 2724483 - protein, 26 aa, Entamoeba histolytica
QNVVYFRVLMMIPKRDSYFTSLNQLR

SEQ ID NO: 2724484 - protein, 20 aa, Entamoeba histolytica
QNWQQQFWEGFKLLSSTTAE

SEQ ID NO: 2724485 - protein, 22 aa, Entamoeba histolytica
QNYFQGPFIKVPFFEAGKNLKN

SEQ ID NO: 2724486 - protein, 21 aa, Entamoeba histolytica
QNYSKRVGYPLILCSSYSGEN

SEQ ID NO: 2724487 - protein, 25 aa, Entamoeba histolytica
QNYTVITELIRFFNQIWICYQPTEI

SEQ ID NO: 2724488 - protein, 18 aa, Entamoeba histolytica
QPCEIRILEYLKGEKIPL

SEQ ID NO: 2724489 - protein, 28 aa, Entamoeba histolytica
QPCSPMGFILPFFLSIYLRSIKEGINPL

SEQ ID NO: 2724490 - protein, 25 aa, Entamoeba histolytica
QPDDKVCFHCGKLGHIGKNCPEQEV

SEQ ID NO: 2724491 - protein, 19 aa, Entamoeba histolytica
QPDEYYAWTIISTLTKLLK

SEQ ID NO: 2724492 - protein, 32 aa, Entamoeba histolytica
QPEIKRLPLESLCLQILLFGEKNPVQFLADAL

SEQ ID NO: 2724493 - protein, 22 aa, Entamoeba histolytica
QPFCIIVMKENGAWKSFYGLHC

SEQ ID NO: 2724494 - protein, 22 aa, Entamoeba histolytica
QPFEIKLKYIETFIPPLVKSLS

SEQ ID NO: 2724495 - protein, 25 aa, Entamoeba histolytica
QPFKKPICLIYKNKEFKLLDKSKYI

SEQ ID NO: 2724496 - protein, 21 aa, Entamoeba histolytica
QPFLKTAFTHFNYFSNLVNEL

SEQ ID NO: 2724497 - protein, 19 aa, Entamoeba histolytica
QPFTLFWNKDENLKQIQSI

SEQ ID NO: 2724498 - protein, 17 aa, Entamoeba histolytica
QPFYINHPFIPNSKQII

SEQ ID NO: 2724499 - protein, 24 aa, Entamoeba histolytica
QPGKFIFSFDDLKMLLGCAKTLKK

SEQ ID NO: 2724500 - protein, 28 aa, Entamoeba histolytica
QPGQNPPLFLYFATILESSSLNALEGFT

SEQ ID NO: 2724501 - protein, 25 aa, Entamoeba histolytica
QPHNFDFYLTYITSLTIQKFLNIKD

SEQ ID NO: 2724502 - protein, 30 aa, Entamoeba histolytica
QPHRYEVITPYVYHLRLLISTMHQALNSYR

SEQ ID NO: 2724503 - protein, 24 aa, Entamoeba histolytica
QPIEIVLHLPILCEDKNVPYVFVG

SEQ ID NO: 2724504 - protein, 25 aa, Entamoeba histolytica
QPIFRDLQFGIYLKSRIGLVGPNGT

SEQ ID NO: 2724505 - protein, 24 aa, Entamoeba histolytica
QPIIQKVIAMPPLELDPIKLQTLY

SEQ ID NO: 2724506 - protein, 18 aa, Entamoeba histolytica
QPIKINKAPLTKPITKPK

SEQ ID NO: 2724507 - protein, 33 aa, Entamoeba histolytica
QPIKKKIVMNLLIDLLIEFGYLFEIQKETKEGY

SEQ ID NO: 2724508 - protein, 17 aa, Entamoeba histolytica
QPIKKPISKPTYISLKP

SEQ ID NO: 2724509 - protein, 28 aa, Entamoeba histolytica
QPINKEFIHQLFYETFDFENYTICKTHG

SEQ ID NO: 2724510 - protein, 29 aa, Entamoeba histolytica
QPISTLSPLLYFYTLILSVLMKNDLTLDI

SEQ ID NO: 2724511 - protein, 18 aa, Entamoeba histolytica
QPITLYWSHGNQNQMLFI

SEQ ID NO: 2724512 - protein, 20 aa, Entamoeba histolytica
QPIYIQPTQPQFVPVRQIQP

SEQ ID NO: 2724513 - protein, 18 aa, Entamoeba histolytica
QPKEIYVSLGKAFVLSDY

SEQ ID NO: 2724514 - protein, 17 aa, Entamoeba histolytica
QPKIQFAPNIRAAGFKP

SEQ ID NO: 2724515 - protein, 25 aa, Entamoeba histolytica
QPKKMTGVLFMPNAIPNHVKLAPLQ

SEQ ID NO: 2724516 - protein, 18 aa, Entamoeba histolytica
QPKLLLSESLNKIKKDSK

SEQ ID NO: 2724517 - protein, 25 aa, Entamoeba histolytica
QPKNKLKAVQWQKIPERQLTNTIFS

SEQ ID NO: 2724518 - protein, 20 aa, Entamoeba histolytica
QPLQCVSGFLVLRVICPAIM

SEQ ID NO: 2724519 - protein, 25 aa, Entamoeba histolytica
QPLSQIVVKKIFPVSFEFVCRTTKD

SEQ ID NO: 2724520 - protein, 18 aa, Entamoeba histolytica
QPMCLVAAFLRLTLSENK

SEQ ID NO: 2724521 - protein, 25 aa, Entamoeba histolytica
QPMNSFTLQLFLYYSGCIALYNRDL

SEQ ID NO: 2724522 - protein, 25 aa, Entamoeba histolytica
QPNLTVIFPIPIYPEKNNYYVVYHN

SEQ ID NO: 2724523 - protein, 24 aa, Entamoeba histolytica
QPNQIKIIPLVLPPTKSSDIVPSF

SEQ ID NO: 2724524 - protein, 26 aa, Entamoeba histolytica
QPNVGKMYDFPFLNLIPTVNTPQLHT

SEQ ID NO: 2724525 - protein, 19 aa, Entamoeba histolytica
QPNYVIPGYQMKGFMTTLI

SEQ ID NO: 2724526 - protein, 26 aa, Entamoeba histolytica
QPPQCNYPCLIIPPCGHPPVQHNCHF

SEQ ID NO: 2724527 - protein, 29 aa, Entamoeba histolytica
QPPYPKMPSSLPYPYHIPVNVPTGVDLLE

SEQ ID NO: 2724528 - protein, 17 aa, Entamoeba histolytica
QPQFGTNSSFAGFNTNQ

SEQ ID NO: 2724529 - protein, 26 aa, Entamoeba histolytica
QPQITQTILYFALKLIESSTKNVQNF

SEQ ID NO: 2724530 - protein, 26 aa, Entamoeba histolytica
QPQQPRNFQWNLLPSSYVSSYSKQQT

SEQ ID NO: 2724531 - protein, 25 aa, Entamoeba histolytica
QPQRYNEDLLLQPPQQLPNTSKQEL

SEQ ID NO: 2724532 - protein, 19 aa, Entamoeba histolytica
QPQVCGALVMALNGEMTDC

SEQ ID NO: 2724533 - protein, 28 aa, Entamoeba histolytica
QPRNVATDLFLKFIRVLESKVELHTNNR

SEQ ID NO: 2724534 - protein, 24 aa, Entamoeba histolytica
QPSLEFFIDKVLTKQGYLRRIIIQ

SEQ ID NO: 2724535 - protein, 18 aa, Entamoeba histolytica
QPSLVIDRGIALHKMIRL

SEQ ID NO: 2724536 - protein, 18 aa, Entamoeba histolytica
QPSTMLDLIISIDGTGFS

SEQ ID NO: 2724537 - protein, 24 aa, Entamoeba histolytica
QPSYEFSWFEGYAWQIIVCESCES

SEQ ID NO: 2724538 - protein, 21 aa, Entamoeba histolytica
QPTHACTKFLYLSQNKPFDDE

SEQ ID NO: 2724539 - protein, 30 aa, Entamoeba histolytica
QPTKQLLNALIIYLTSLISIYKSAKWIGVE

SEQ ID NO: 2724540 - protein, 25 aa, Entamoeba histolytica
QPTYALRSLALFYFITAAETMRTIQ

SEQ ID NO: 2724541 - protein, 31 aa, Entamoeba histolytica
QPVITKYFYEPYLDILKKWTKKEICQVVYDS

SEQ ID NO: 2724542 - protein, 18 aa, Entamoeba histolytica
QPYNYLYSQLKSLSVTIP

SEQ ID NO: 2724543 - protein, 34 aa, Entamoeba histolytica; identical to SEQ ID NO: 2537334

SEQ ID NO: 2724544 - protein, 23 aa, Entamoeba histolytica
QQAFSLLVLRVLFSTIGFCTEIN

SEQ ID NO: 2724545 - protein, 35 aa, Entamoeba histolytica
QQAIRTISTLLYLRYLFIPFATYPSLLVEIQKVVN

SEQ ID NO: 2724546 - protein, 44 aa, Entamoeba histolytica
QQANNNLFIIFPKKYGFFIVPNPNYIIIDFIDISFILIKSITQT

SEQ ID NO: 2724547 - protein, 32 aa, Entamoeba histolytica
QQAQLFKTMRPLFSQKPVVLVLNKIDICPINQ

SEQ ID NO: 2724548 - protein, 24 aa, Entamoeba histolytica
QQARKQWFYYSTKLNKILKNNPNW

SEQ ID NO: 2724549 - protein, 23 aa, Entamoeba histolytica
QQARYYYYLGRIQCIHLKYSDAY

SEQ ID NO: 2724550 - protein, 20 aa, Entamoeba histolytica
QQCYETYLSTPIYQMAYETF

SEQ ID NO: 2724551 - protein, 25 aa, Entamoeba histolytica
QQEGKIKSRWLRKNARRIDMETYTR

SEQ ID NO: 2724552 - protein, 24 aa, Entamoeba histolytica
QQEGRIKARWMRKNARRIDMEQYT

SEQ ID NO: 2724553 - protein, 27 aa, Entamoeba histolytica
QQEKPSKPLPLKKGDTVRFKNEFILGT

SEQ ID NO: 2724554 - protein, 24 aa, Entamoeba histolytica
QQEQQNTIKLIKNYTLDDINKKKL

SEQ ID NO: 2724555 - protein, 25 aa, Entamoeba histolytica
QQERDYIMNIFRKGEKRVLITTDVW

SEQ ID NO: 2724556 - protein, 37 aa, Entamoeba histolytica
QQETKKHLYKIKWFLPSLRELFRKNNRRYSKKRLNDI

SEQ ID NO: 2724557 - protein, 24 aa, Entamoeba histolytica
QQEYLNHALTYYTGLKALVLDSVT

SEQ ID NO: 2724558 - protein, 22 aa, Entamoeba histolytica
QQFFLQNFSLILQRGFNSLASK

SEQ ID NO: 2724559 - protein, 18 aa, Entamoeba histolytica
QQFGIGHWKLILNNFKFD

SEQ ID NO: 2724560 - protein, 18 aa, Entamoeba histolytica
QQFILQPIDPIKSELFRR

SEQ ID NO: 2724561 - protein, 22 aa, Entamoeba histolytica
QQFLEQLGTYFFKVFGNVSVIK

SEQ ID NO: 2724562 - protein, 29 aa, Entamoeba histolytica
QQFLSLFDQNNTLFKCTYKEYLRLLSIDV

SEQ ID NO: 2724563 - protein, 21 aa, Entamoeba histolytica
QQGFHEIMAIIYHTFDTDITT

SEQ ID NO: 2724564 - protein, 22 aa, Entamoeba histolytica
QQGFHELIAILYHSIDFDLSEQ

SEQ ID NO: 2724565 - protein, 25 aa, Entamoeba histolytica
QQGGMDGGWFFPVDTELSIGKNAGD

SEQ ID NO: 2724566 - protein, 19 aa, Entamoeba histolytica
QQGYIGPMGYWPDAVCRPQ

SEQ ID NO: 2724567 - protein, 18 aa, Entamoeba histolytica
QQHGGLAMFIFIKQIMKN

SEQ ID NO: 2724568 - protein, 29 aa, Entamoeba histolytica
QQHILHPEDLLPFLRKPILLIIDSDKQNS

SEQ ID NO: 2724569 - protein, 22 aa, Entamoeba histolytica
QQIALLYFKKYIPQLPHLIIST

SEQ ID NO: 2724570 - protein, 27 aa, Entamoeba histolytica
QQIKDFFILEYVWVSTLIHLNPQHESL

SEQ ID NO: 2724571 - protein, 29 aa, Entamoeba histolytica
QQIKGNFDIIYSSPLHRALITAQKIAGDK

SEQ ID NO: 2724572 - protein, 21 aa, Entamoeba histolytica
QQILNRIKWVAGGKKQNWEEF

SEQ ID NO: 2724573 - protein, 18 aa, Entamoeba histolytica
QQILSLGNNIKVIKKVRS

SEQ ID NO: 2724574 - protein, 18 aa, Entamoeba histolytica
QQIMKFSGSFAAALNGTD

SEQ ID NO: 2724575 - protein, 25 aa, Entamoeba histolytica
QQIYKILVCFFARDLNIHLTSVIYD

SEQ ID NO: 2724576 - protein, 24 aa, Entamoeba histolytica
QQKETYLTPLYNFLKNISVINDVV

SEQ ID NO: 2724577 - protein, 30 aa, Entamoeba histolytica; identical to SEQ ID NO: 2518418

SEQ ID NO: 2724578 - protein, 32 aa, Entamoeba histolytica
QQKIWQMNAPYYYDVFIDFYTPHPTMSFDWTR

SEQ ID NO: 2724579 - protein, 28 aa, Entamoeba histolytica
QQKKIPEGITLTPITPGFIQQQKKKEVD

SEQ ID NO: 2724580 - protein, 24 aa, Entamoeba histolytica
QQKKLIPLFHKITTLTLYKTKEEQ

SEQ ID NO: 2724581 - protein, 22 aa, Entamoeba histolytica
QQKKPMVLPSVQNNSIPRRGQL

SEQ ID NO: 2724582 - protein, 24 aa, Entamoeba histolytica
QQKTSSILLFISLGSRVKKDEDIQ

SEQ ID NO: 2724583 - protein, 35 aa, Entamoeba histolytica
QQKYDGVGIIPLDCPWYICYFMGRPQAHFVCTTQN

SEQ ID NO: 2724584 - protein, 20 aa, Entamoeba histolytica
QQLEPFINYLFNISNQDNPD

SEQ ID NO: 2724585 - protein, 17 aa, Entamoeba histolytica
QQLFMMKEFREKILRIV

SEQ ID NO: 2724586 - protein, 21 aa, Entamoeba histolytica
QQLKKPIPPCPSKNLFPLIQY

SEQ ID NO: 2724587 - protein, 22 aa, Entamoeba histolytica
QQLLATIRKWKTLKVFEKTLCE

SEQ ID NO: 2724588 - protein, 35 aa, Entamoeba histolytica
QQLLPVTVYLEAPVQRFFKYPKIFGNLLASVDPKR

SEQ ID NO: 2724589 - protein, 25 aa, Entamoeba histolytica
QQLLPYHSIFLFKTSKEWISCLTNS

SEQ ID NO: 2724590 - protein, 19 aa, Entamoeba histolytica
QQLNNMLFSLKLRIDEMEE

SEQ ID NO: 2724591 - protein, 22 aa, Entamoeba histolytica
QQLRQYIIDLINTWNGSFPNEI

SEQ ID NO: 2724592 - protein, 22 aa, Entamoeba histolytica
QQLSKLFDLLIPPQLSSEDPES

SEQ ID NO: 2724593 - protein, 22 aa, Entamoeba histolytica
QQLYSLNQILLLLQQSKKPYQF

SEQ ID NO: 2724594 - protein, 20 aa, Entamoeba histolytica
QQMDILQIIKIITESKLFQD

SEQ ID NO: 2724595 - protein, 27 aa, Entamoeba histolytica
QQMEHYFQALFFFPISYDVKSIKEQLE

SEQ ID NO: 2724596 - protein, 27 aa, Entamoeba histolytica
QQMVSVRDQLDGLIIECIGLMGMYAVD

SEQ ID NO: 2724597 - protein, 26 aa, Entamoeba histolytica
QQNAQTLYKQLLYWEPKDANGSVLDE

SEQ ID NO: 2724598 - protein, 35 aa, Entamoeba histolytica; identical to SEQ ID NO: 2537373

SEQ ID NO: 2724599 - protein, 26 aa, Entamoeba histolytica
QQNISKYFYGLDPKELLDKMCSSLIG

SEQ ID NO: 2724600 - protein, 27 aa, Entamoeba histolytica
QQNTIHQLQLLIQQIKILINSFKDQSN

SEQ ID NO: 2724601 - protein, 21 aa, Entamoeba histolytica
QQPEELIPPTVPPKRKTQKTL

SEQ ID NO: 2724602 - protein, 22 aa, Entamoeba histolytica
QQPIITMELSIENDYLLHVIAR

SEQ ID NO: 2724603 - protein, 24 aa, Entamoeba histolytica
QQPIRLHQQLIYTLPSSITSVIAS

SEQ ID NO: 2724604 - protein, 20 aa, Entamoeba histolytica
QQPNPFNLLFGQQPTQNNGL

SEQ ID NO: 2724605 - protein, 28 aa, Entamoeba histolytica
QQPPDMNEFYRNILLKQNTTIKDNFTPE

SEQ ID NO: 2724606 - protein, 25 aa, Entamoeba histolytica
QQQIDFALSLLNPIFKKVSVEEVIT

SEQ ID NO: 2724607 - protein, 24 aa, Entamoeba histolytica
QQQKGIYVLTPSNLIHPLTTNKIN

SEQ ID NO: 2724608 - protein, 23 aa, Entamoeba histolytica
QQQKVIPSFFHLFDDLKHEEEDG

SEQ ID NO: 2724609 - protein, 19 aa, Entamoeba histolytica
QQQYIFILDFSWFSTEEVT

SEQ ID NO: 2724610 - protein, 21 aa, Entamoeba histolytica
QQQYPGYPPQQGYGAYPGYPQ

SEQ ID NO: 2724611 - protein, 24 aa, Entamoeba histolytica
QQQYRKWTKLGIQGNKLFKPVCQT

SEQ ID NO: 2724612 - protein, 27 aa, Entamoeba histolytica
QQQYYYQRMSPPPPIMTVRRDPMDYVS

SEQ ID NO: 2724613 - protein, 20 aa, Entamoeba histolytica
QQRFNNWRSFMSKKNKTLNS

SEQ ID NO: 2724614 - protein, 25 aa, Entamoeba histolytica
QQRILNWLMAFFDAHITLLITDQQF

SEQ ID NO: 2724615 - protein, 17 aa, Entamoeba histolytica
QQRIYEMKSNKNASLGK

SEQ ID NO: 2724616 - protein, 18 aa, Entamoeba histolytica
QQRIYYGAIILKKKVCYN

SEQ ID NO: 2724617 - protein, 23 aa, Entamoeba histolytica
QQRSAIVTPLFSKKYQLVVKGKI

SEQ ID NO: 2724618 - protein, 22 aa, Entamoeba histolytica
QQSIILLTKLFSLGIKDLKGQF

SEQ ID NO: 2724619 - protein, 27 aa, Entamoeba histolytica
QQSPTTPHYPTNPLMAAIAARANRGGS

SEQ ID NO: 2724620 - protein, 24 aa, Entamoeba histolytica
QQSVFIALLSMVYTIVIDHPRKRS

SEQ ID NO: 2724621 - protein, 24 aa, Entamoeba histolytica
QQTFKWIGFCKNQILKQPNIILAI

SEQ ID NO: 2724622 - protein, 21 aa, Entamoeba histolytica
QQTFYPMHPAQRRIPNTQYFH

SEQ ID NO: 2724623 - protein, 24 aa, Entamoeba histolytica
QQTKAIPNEPLFSTIPLTQQYENQ

SEQ ID NO: 2724624 - protein, 23 aa, Entamoeba histolytica
QQTKYYHVFSDLKKYHPSVEDVC

SEQ ID NO: 2724625 - protein, 33 aa, Entamoeba histolytica
QQTLQCWKRSESALFLLFCSDPLMQKENIEKRG

SEQ ID NO: 2724626 - protein, 17 aa, Entamoeba histolytica
QQTLWHILMLYNSNCHP

SEQ ID NO: 2724627 - protein, 27 aa, Entamoeba histolytica
QQTSFNQFPQQQNPFSQFSKLANGSTN

SEQ ID NO: 2724628 - protein, 29 aa, Entamoeba histolytica
QQVILQHEFLIPYVAPPIYDHIKSPTFAA

SEQ ID NO: 2724629 - protein, 18 aa, Entamoeba histolytica
QQVLYLQKLTEVNFNLIF

SEQ ID NO: 2724630 - protein, 24 aa, Entamoeba histolytica
QRALREIYVETFRIALQGNPLTLM

SEQ ID NO: 2724631 - protein, 19 aa, Entamoeba histolytica
QRALSVLAVLFRSIDISNT

SEQ ID NO: 2724632 - protein, 24 aa, Entamoeba histolytica
QRANEILPSLPWGKVFEKDVFESP

SEQ ID NO: 2724633 - protein, 19 aa, Entamoeba histolytica
QRATTLPLLIINLDDIMNT

SEQ ID NO: 2724634 - protein, 21 aa, Entamoeba histolytica
QRCVPIFNSLPIYINSIPVVL

SEQ ID NO: 2724635 - protein, 29 aa, Entamoeba histolytica
QRDIQQFIIDHWYFFSNLEQFRVSQEQWT

SEQ ID NO: 2724636 - protein, 34 aa, Entamoeba histolytica
QRENATLFLLFAHALIDYIFYHSSYIYFNANPPK

SEQ ID NO: 2724637 - protein, 24 aa, Entamoeba histolytica
QREVLIKMKYLNGKFAVFDIKRSV

SEQ ID NO: 2724638 - protein, 23 aa, Entamoeba histolytica
QRFSVQNQIPWEMNWKGFKVIRR

SEQ ID NO: 2724639 - protein, 19 aa, Entamoeba histolytica
QRFYDLMWEYNFSLRLRSE

SEQ ID NO: 2724640 - protein, 24 aa, Entamoeba histolytica
QRGFTPIQTPYFMRRELMAKTAQL

SEQ ID NO: 2724641 - protein, 31 aa, Entamoeba histolytica
QRIDLNTYYKPAVKVFYVWGLSGIGKTKWVF

SEQ ID NO: 2724642 - protein, 25 aa, Entamoeba histolytica
QRIEGALFNYYLVEHWAPLEHILKK

SEQ ID NO: 2724643 - protein, 17 aa, Entamoeba histolytica
QRIGIMLSFFLEALTRN

SEQ ID NO: 2724644 - protein, 19 aa, Entamoeba histolytica
QRILVLIDAWDTTSKYPTG

SEQ ID NO: 2724645 - protein, 36 aa, Entamoeba histolytica; identical to SEQ ID NO: 2537433

SEQ ID NO: 2724646 - protein, 20 aa, Entamoeba histolytica
QRIRGICLLLLESCCEILKY

SEQ ID NO: 2724647 - protein, 23 aa, Entamoeba histolytica
QRITWVYINIHKLYKLYCFEGHT

SEQ ID NO: 2724648 - protein, 30 aa, Entamoeba histolytica
QRIYKWKDCGKIWRMRACCVIYVNFANKKE

SEQ ID NO: 2724649 - protein, 23 aa, Entamoeba histolytica
QRKEFVLTQLLQYKVIPDNNSIA

SEQ ID NO: 2724650 - protein, 23 aa, Entamoeba histolytica
QRKEGNDLYKVISTKIEEVEKQC

SEQ ID NO: 2724651 - protein, 19 aa, Entamoeba histolytica
QRKLEYIKPLLQNHNSIFQ

SEQ ID NO: 2724652 - protein, 38 aa, Entamoeba histolytica
QRLKDLYEIYLSERLKRIENIRWEIGTALPVNIRASMT

SEQ ID NO: 2724653 - protein, 20 aa, Entamoeba histolytica
QRLLMGILCANVNGGLFAIC

SEQ ID NO: 2724654 - protein, 23 aa, Entamoeba histolytica
QRLLNFTLTNGCTYVYQGVELFY

SEQ ID NO: 2724655 - protein, 18 aa, Entamoeba histolytica
QRLMLEKLTPTDSLQATI

SEQ ID NO: 2724656 - protein, 23 aa, Entamoeba histolytica
QRLNHLLIFTNLPKILDNEPCQT

SEQ ID NO: 2724657 - protein, 20 aa, Entamoeba histolytica
QRLRRYERNKIALAFNELVE

SEQ ID NO: 2724658 - protein, 22 aa, Entamoeba histolytica
QRLSLNKIINRLYDSYITRNPQ

SEQ ID NO: 2724659 - protein, 19 aa, Entamoeba histolytica
QRNATLLACKLAEIKNVEL

SEQ ID NO: 2724660 - protein, 22 aa, Entamoeba histolytica
QRNNVYIYPLNIPAIQSIPIDN

SEQ ID NO: 2724661 - protein, 32 aa, Entamoeba histolytica
QRNSFCFFFVCLFLLYKTYPTQFEFNESLLHF

SEQ ID NO: 2724662 - protein, 29 aa, Entamoeba histolytica
QRPDAVTLLWHPFIVAQSPPPAQPLLNLI

SEQ ID NO: 2724663 - protein, 24 aa, Entamoeba histolytica
QRPKGVFIICNKISEGKQMKKRLE

SEQ ID NO: 2724664 - protein, 22 aa, Entamoeba histolytica
QRQALYDRLVGFKKNRGKEPFF

SEQ ID NO: 2724665 - protein, 24 aa, Entamoeba histolytica
QRQERRRRYLAMVRSRGVAPNIKQ

SEQ ID NO: 2724666 - protein, 22 aa, Entamoeba histolytica
QRQFGGMRRGFRNSLIDNVTRE

SEQ ID NO: 2724667 - protein, 29 aa, Entamoeba histolytica
QRQRIEGALFNYYLVEHWAPLEHILKKIS

SEQ ID NO: 2724668 - protein, 30 aa, Entamoeba histolytica
QRQRIEGALFNYYLVEHWAPLEHILKKISN

SEQ ID NO: 2724669 - protein, 23 aa, Entamoeba histolytica
QRRRFELNIDPLYIKESYKRKGY

SEQ ID NO: 2724670 - protein, 28 aa, Entamoeba histolytica
QRRRHIKALCFYYLNQKGYSLEFKKTSI

SEQ ID NO: 2724671 - protein, 19 aa, Entamoeba histolytica
QRRYRLRKEVEKAKIELSA

SEQ ID NO: 2724672 - protein, 27 aa, Entamoeba histolytica
QRSGRTEAYFPYKIPTRTIYGGKNIDV

SEQ ID NO: 2724673 - protein, 27 aa, Entamoeba histolytica
QRSKKYPFMIYALRLFKILYEMNIANE

SEQ ID NO: 2724674 - protein, 24 aa, Entamoeba histolytica
QRSPKLLNHLLLNSTSLSTRDSQN

SEQ ID NO: 2724675 - protein, 24 aa, Entamoeba histolytica
QRSPTFIIWGLYLGSVNSTYDIEF

SEQ ID NO: 2724676 - protein, 20 aa, Entamoeba histolytica
QRTLFRVLRAWSMQDDLGYV

SEQ ID NO: 2724677 - protein, 23 aa, Entamoeba histolytica
QRTRQYHILLIIADGQVDAERAT

SEQ ID NO: 2724678 - protein, 28 aa, Entamoeba histolytica
QRVFKKRIMQLYSRLIRRYPRMLSYYME

SEQ ID NO: 2724679 - protein, 23 aa, Entamoeba histolytica
QRVGQFINFFNPNFKPFKREPSF

SEQ ID NO: 2724680 - protein, 26 aa, Entamoeba histolytica
QRVLFLSSLHHLIPLPTLNQLNYPLF

SEQ ID NO: 2724681 - protein, 17 aa, Entamoeba histolytica
QRYFCFIGNYELPNWTK

SEQ ID NO: 2724682 - protein, 20 aa, Entamoeba histolytica
QRYIELIDDIRFVCQEYGEV

SEQ ID NO: 2724683 - protein, 17 aa, Entamoeba histolytica
QRYSAIAERLWSKESVV

SEQ ID NO: 2724684 - protein, 24 aa, Entamoeba histolytica
QRYSFAIDLWSVGCILGEIINGKP

SEQ ID NO: 2724685 - protein, 17 aa, Entamoeba histolytica
QSAFLVVITSRTSSLEN

SEQ ID NO: 2724686 - protein, 34 aa, Entamoeba histolytica
QSAIKEYCNQKSIWLKLFKECEKDLESYHKAKQL

SEQ ID NO: 2724687 - protein, 35 aa, Entamoeba histolytica; identical to SEQ ID NO: 2537471

SEQ ID NO: 2724688 - protein, 32 aa, Entamoeba histolytica
QSCRYWDVLHLSTFFPIIFRCSALSPDSLYIP

SEQ ID NO: 2724689 - protein, 23 aa, Entamoeba histolytica
QSCSELIPLIPLPVFVCKQMVGN

SEQ ID NO: 2724690 - protein, 25 aa, Entamoeba histolytica
QSDKSLSTLIPLIKKHPPSGLSEIT

SEQ ID NO: 2724691 - protein, 35 aa, Entamoeba histolytica
QSDLEALKIVYPNIPIITVILNYPEYCLAPPKTNE

SEQ ID NO: 2724692 - protein, 26 aa, Entamoeba histolytica
QSDNLLGLLKPLSESFRNGPKLSNEK

SEQ ID NO: 2724693 - protein, 18 aa, Entamoeba histolytica
QSDRLKNALSLKDIKYNN

SEQ ID NO: 2724694 - protein, 24 aa, Entamoeba histolytica
QSDTLQIFQLLRGISTRPTMLFFE

SEQ ID NO: 2724695 - protein, 32 aa, Entamoeba histolytica; identical to SEQ ID NO: 2537479

SEQ ID NO: 2724696 - protein, 25 aa, Entamoeba histolytica
QSDYTLLYTLQLVDKILFPEKDNEN

SEQ ID NO: 2724697 - protein, 28 aa, Entamoeba histolytica
QSECSYKFFLHQLYNILNYTPQIIVCDR

SEQ ID NO: 2724698 - protein, 22 aa, Entamoeba histolytica
QSEKLVRYIFQLAMYDNSFDIR

SEQ ID NO: 2724699 - protein, 24 aa, Entamoeba histolytica
QSELYKQIGIDPPRGCLLYGPPGT

SEQ ID NO: 2724700 - protein, 17 aa, Entamoeba histolytica
QSEQLCNLLLYLPSELS

SEQ ID NO: 2724701 - protein, 28 aa, Entamoeba histolytica
QSERSRIRVVYLCKWFIKNGSNQNVILF

SEQ ID NO: 2724702 - protein, 25 aa, Entamoeba histolytica
QSETLPYYDIIELNPLLDSSAMTPK

SEQ ID NO: 2724703 - protein, 23 aa, Entamoeba histolytica
QSFKEIWRELGMNKELLLESLTN

SEQ ID NO: 2724704 - protein, 20 aa, Entamoeba histolytica
QSFTWAVNALFSCLYEKRLY

SEQ ID NO: 2724705 - protein, 21 aa, Entamoeba histolytica
QSFWMKRVAYLAAQICLHESD

SEQ ID NO: 2724706 - protein, 27 aa, Entamoeba histolytica
QSHAILPYDQYLHRFAAYFQQGDMESN

SEQ ID NO: 2724707 - protein, 34 aa, Entamoeba histolytica
QSHKIHEYLKVQTPLFFVDYFRVFVSHYELGKTY

SEQ ID NO: 2724708 - protein, 28 aa, Entamoeba histolytica
QSHYISFLNEMARLRFINKQYITDMVNG

SEQ ID NO: 2724709 - protein, 26 aa, Entamoeba histolytica
QSIENIHLFVLILNYFMIHFTTNKEI

SEQ ID NO: 2724710 - protein, 20 aa, Entamoeba histolytica
QSIFVLTTHLANHTGYPVVG

SEQ ID NO: 2724711 - protein, 27 aa, Entamoeba histolytica
QSIHDKKLYYLFNKDFLIGLIRHNGQV

SEQ ID NO: 2724712 - protein, 19 aa, Entamoeba histolytica
QSIICAYANRYYQGLNNST

SEQ ID NO: 2724713 - protein, 25 aa, Entamoeba histolytica
QSIPLECKYLWLKNINKTKINLSKY

SEQ ID NO: 2724714 - protein, 22 aa, Entamoeba histolytica
QSIQFIMRKGAVTTFPAILSNI

SEQ ID NO: 2724715 - protein, 24 aa, Entamoeba histolytica
QSITALAHLPCCVLYLMDVSGSCG

SEQ ID NO: 2724716 - protein, 24 aa, Entamoeba histolytica
QSIVLAREYNWNKIPFIESNDSKE

SEQ ID NO: 2724717 - protein, 21 aa, Entamoeba histolytica
QSIVWISLLLDENTWKRWNTL

SEQ ID NO: 2724718 - protein, 20 aa, Entamoeba histolytica
QSIYLYINSKLPSPDRIIRL

SEQ ID NO: 2724719 - protein, 24 aa, Entamoeba histolytica
QSKDLCLIFYCNNCVFGSFHSVIP

SEQ ID NO: 2724720 - protein, 28 aa, Entamoeba histolytica
QSKDLFIVTTICLIPYLTDSELKMIMGI

SEQ ID NO: 2724721 - protein, 36 aa, Entamoeba histolytica
QSKEAQYIVTTFRPELILPANKWYEIKHQNKVSTIL

SEQ ID NO: 2724722 - protein, 27 aa, Entamoeba histolytica
QSKIKPILITYIDNLIWVVHYYLSGIQ

SEQ ID NO: 2724723 - protein, 24 aa, Entamoeba histolytica
QSKKLETVLKPKLTQPTKAGCYAV

SEQ ID NO: 2724724 - protein, 24 aa, Entamoeba histolytica
QSKPSTPITPPQSSSAVGITETTT

SEQ ID NO: 2724725 - protein, 17 aa, Entamoeba histolytica
QSKRNIPNLYSPEIPVV

SEQ ID NO: 2724726 - protein, 24 aa, Entamoeba histolytica
QSKSALFLLYCSDPLKQKENIEKR

SEQ ID NO: 2724727 - protein, 46 aa, Entamoeba histolytica
QSKTFDAIIISHWDADHYKGLLNTGYTTDYLFCPQESIKHEFIKSL

SEQ ID NO: 2724728 - protein, 17 aa, Entamoeba histolytica
QSKWNIWSWWSQPNQEF

SEQ ID NO: 2724729 - protein, 21 aa, Entamoeba histolytica
QSLDILLNCYLKPLNESKYNK

SEQ ID NO: 2724730 - protein, 19 aa, Entamoeba histolytica
QSLITRQMLWFGDYSFYSE

SEQ ID NO: 2724731 - protein, 17 aa, Entamoeba histolytica
QSLKRMEFLSNGLEKYL

SEQ ID NO: 2724732 - protein, 23 aa, Entamoeba histolytica
QSLPMICGILLDATFFVHNNRKL

SEQ ID NO: 2724733 - protein, 17 aa, Entamoeba histolytica
QSLSLCYVLSKHSPITS

SEQ ID NO: 2724734 - protein, 18 aa, Entamoeba histolytica
QSLVDLQDNLRKRTKELS

SEQ ID NO: 2724735 - protein, 18 aa, Entamoeba histolytica
QSMKCSCPLPHTPNFEVI

SEQ ID NO: 2724736 - protein, 25 aa, Entamoeba histolytica
QSMLHFIHGLLQYDPESRWTAKQAL

SEQ ID NO: 2724737 - protein, 21 aa, Entamoeba histolytica
QSMLLMKKYKHKELTEVQMLC

SEQ ID NO: 2724738 - protein, 18 aa, Entamoeba histolytica
QSMNYHARWNYIAKIKER

SEQ ID NO: 2724739 - protein, 20 aa, Entamoeba histolytica
QSMYSPLFKILNILPQITNN

SEQ ID NO: 2724740 - protein, 21 aa, Entamoeba histolytica
QSNCYSLPPKVHLNLNCDMKE

SEQ ID NO: 2724741 - protein, 25 aa, Entamoeba histolytica
QSNEDYYFVIISTTSPRLTVFKKID

SEQ ID NO: 2724742 - protein, 27 aa, Entamoeba histolytica
QSNELLELVYTLFDSFPIAVRVGTKEL

SEQ ID NO: 2724743 - protein, 23 aa, Entamoeba histolytica
QSNSKMFTTIKTGNLFINYLYLL

SEQ ID NO: 2724744 - protein, 21 aa, Entamoeba histolytica
QSPIKAPINKGQVLVKIPKMT

SEQ ID NO: 2724745 - protein, 25 aa, Entamoeba histolytica
QSPLKFTLEVFSLISPIPTPLNSTS

SEQ ID NO: 2724746 - protein, 23 aa, Entamoeba histolytica
QSPSPFYLVCITIQLPIPHKEVI

SEQ ID NO: 2724747 - protein, 22 aa, Entamoeba histolytica
QSPVVVDNPFDFTDSSNQPKHQ

SEQ ID NO: 2724748 - protein, 24 aa, Entamoeba histolytica
QSQEEELYFLELKQKKSDAKKLAQ

SEQ ID NO: 2724749 - protein, 19 aa, Entamoeba histolytica
QSQLRYLQSFAFNGDLLPD

SEQ ID NO: 2724750 - protein, 22 aa, Entamoeba histolytica
QSQNPILLRKVNIKKNIKIENI

SEQ ID NO: 2724751 - protein, 28 aa, Entamoeba histolytica
QSQQQYHHSPFYQQPIQYSGRGYIQQPQ

SEQ ID NO: 2724752 - protein, 24 aa, Entamoeba histolytica
QSQRFMYIIMEYIEGLTLEQYLQL

SEQ ID NO: 2724753 - protein, 30 aa, Entamoeba histolytica
QSQTQIMLYWSFVHLFTICLESHRDIDFRI

SEQ ID NO: 2724754 - protein, 27 aa, Entamoeba histolytica
QSREKGIYPIFVFDGKTKTYLKERTIK

SEQ ID NO: 2724755 - protein, 21 aa, Entamoeba histolytica
QSRYVSCPVIFNLGGVPLSLP

SEQ ID NO: 2724756 - protein, 18 aa, Entamoeba histolytica
QSSCSLATIKYCDFGWLV

SEQ ID NO: 2724757 - protein, 23 aa, Entamoeba histolytica
QSSFLSKVIRVSGIIVSISRVEP

SEQ ID NO: 2724758 - protein, 23 aa, Entamoeba histolytica
QSSLDGYQTCIFAYGQTGSGKTY

SEQ ID NO: 2724759 - protein, 26 aa, Entamoeba histolytica
QSSPNQIFIYYIDSKTPFDIWNDDEI

SEQ ID NO: 2724760 - protein, 24 aa, Entamoeba histolytica
QSSSPILSLLSRLIEREHFERPGE

SEQ ID NO: 2724761 - protein, 18 aa, Entamoeba histolytica
QSSYFKDLTHRLTALDDK

SEQ ID NO: 2724762 - protein, 32 aa, Entamoeba histolytica
QSSYKKELLLFILTYVFYPNIIIPQQIIGKTS

SEQ ID NO: 2724763 - protein, 17 aa, Entamoeba histolytica
QSTLKYVILLEEKTNDQ

SEQ ID NO: 2724764 - protein, 28 aa, Entamoeba histolytica
QSTLLNYITSLVFLINNSIFHYQTYTDE

SEQ ID NO: 2724765 - protein, 28 aa, Entamoeba histolytica
QSTSVLLHPYGPWSIYMKDAEMYLGYDS

SEQ ID NO: 2724766 - protein, 33 aa, Entamoeba histolytica; identical to SEQ ID NO: 2537553

SEQ ID NO: 2724767 - protein, 17 aa, Entamoeba histolytica
QSVIKIARLYQEKNQEG

SEQ ID NO: 2724768 - protein, 25 aa, Entamoeba histolytica
QSVIYPGIIKYFKDIKENIVTKCVI

SEQ ID NO: 2724769 - protein, 33 aa, Entamoeba histolytica
QSVKPDEILLLDTYFYLVVFRGNAVAEWMKQKL

SEQ ID NO: 2724770 - protein, 18 aa, Entamoeba histolytica
QSVLKFYSTLYVNELLEI

SEQ ID NO: 2724771 - protein, 32 aa, Entamoeba histolytica
QSVSPITFILPFYTKVLILFKLNNIEFNIPIE

SEQ ID NO: 2724772 - protein, 18 aa, Entamoeba histolytica
QSYFSLGNKIKKLLNTKN

SEQ ID NO: 2724773 - protein, 31 aa, Entamoeba histolytica
QSYKRIETIHLLIDILREYGYLFKSKYVEGK

SEQ ID NO: 2724774 - protein, 23 aa, Entamoeba histolytica
QTAVQFCPLDYSTHARDLSHADV

SEQ ID NO: 2724775 - protein, 26 aa, Entamoeba histolytica
QTDERAMMLYISLFSQVFKTKEMMDK

SEQ ID NO: 2724776 - protein, 24 aa, Entamoeba histolytica
QTDGWERVLFNQLILGKEHLVFLH

SEQ ID NO: 2724777 - protein, 21 aa, Entamoeba histolytica
QTDNLLFNINQTVNGLMASPS

SEQ ID NO: 2724778 - protein, 18 aa, Entamoeba histolytica
QTDTLLLSKLIQLKDDFR

SEQ ID NO: 2724779 - protein, 27 aa, Entamoeba histolytica
QTEILKSILFFIFKEKKEKIINFICEE

SEQ ID NO: 2724780 - protein, 26 aa, Entamoeba histolytica
QTEKEIDLLFQVQPIPRLPNPRRVKT

SEQ ID NO: 2724781 - protein, 23 aa, Entamoeba histolytica
QTESLTDFIIPQTALNYVANNSK

SEQ ID NO: 2724782 - protein, 17 aa, Entamoeba histolytica
QTFPDINKNTLWLIMRF

SEQ ID NO: 2724783 - protein, 20 aa, Entamoeba histolytica
QTFTILLKGFKNKTPEEVCA

SEQ ID NO: 2724784 - protein, 17 aa, Entamoeba histolytica
QTFWYSRVNSYTSRTGD

SEQ ID NO: 2724785 - protein, 18 aa, Entamoeba histolytica
QTFYVRRCPSRLYKITAN

SEQ ID NO: 2724786 - protein, 28 aa, Entamoeba histolytica
QTGEGKIVLVYRRPWAPNANDRTFTLKV

SEQ ID NO: 2724787 - protein, 18 aa, Entamoeba histolytica
QTGFLRPTSPGITLGNKN

SEQ ID NO: 2724788 - protein, 19 aa, Entamoeba histolytica
QTGLFHISTVSIPVIETVV

SEQ ID NO: 2724789 - protein, 19 aa, Entamoeba histolytica
QTGVLIETLKALGANLRWA

SEQ ID NO: 2724790 - protein, 28 aa, Entamoeba histolytica
QTIDFDKGWYIIFGCTYQPAIERRYLME

SEQ ID NO: 2724791 - protein, 18 aa, Entamoeba histolytica
QTIFPDKGVLYQQRIVCA

SEQ ID NO: 2724792 - protein, 21 aa, Entamoeba histolytica
QTIIYKDHRLFSKSINLALML

SEQ ID NO: 2724793 - protein, 30 aa, Entamoeba histolytica
QTIKQIMIDKINLLKPIKPIIDSLANYLQS

SEQ ID NO: 2724794 - protein, 20 aa, Entamoeba histolytica
QTIKYLYCRPTVSALEQPKK

SEQ ID NO: 2724795 - protein, 25 aa, Entamoeba histolytica
QTINGFIIVSLHNIWFLNSVGEIEA

SEQ ID NO: 2724796 - protein, 19 aa, Entamoeba histolytica
QTIRKWIKCASGDKYRMGN

SEQ ID NO: 2724797 - protein, 20 aa, Entamoeba histolytica
QTIRKWLKCASGNKYRMGNL

SEQ ID NO: 2724798 - protein, 31 aa, Entamoeba histolytica; identical to SEQ ID NO: 2537586

SEQ ID NO: 2724799 - protein, 25 aa, Entamoeba histolytica
QTITKIKGIILPKLSKMKTQLLNTS

SEQ ID NO: 2724800 - protein, 24 aa, Entamoeba histolytica
QTITLSMILLIYKSIDIHESLFNQ

SEQ ID NO: 2724801 - protein, 25 aa, Entamoeba histolytica
QTIVQTFFVVQLLHEKFIENKIEWK

SEQ ID NO: 2724802 - protein, 24 aa, Entamoeba histolytica
QTIWKPVTIVLTTISILIVEIHNN

SEQ ID NO: 2724803 - protein, 26 aa, Entamoeba histolytica
QTIYTLLIRRMRLCSFLILTKNDDEI

SEQ ID NO: 2724804 - protein, 32 aa, Entamoeba histolytica
QTKQIGFEMWYFLSVIILDRNFVQETYLVNVS

SEQ ID NO: 2724805 - protein, 31 aa, Entamoeba histolytica
QTLETEIHPFMFYLNRPLVQTPKYESLIKTM

SEQ ID NO: 2724806 - protein, 18 aa, Entamoeba histolytica
QTLKFKIFEDIANGVAAC

SEQ ID NO: 2724807 - protein, 26 aa, Entamoeba histolytica
QTLVKYYNGFQWYFQKRIVHCKTQEE

SEQ ID NO: 2724808 - protein, 26 aa, Entamoeba histolytica
QTMMENVLLVWALRHPACGYVQGMND

SEQ ID NO: 2724809 - protein, 20 aa, Entamoeba histolytica
QTNCWIHPDINYKLFEMKNG

SEQ ID NO: 2724810 - protein, 24 aa, Entamoeba histolytica
QTNFPFQMEQILFEYFGVSNVCLK

SEQ ID NO: 2724811 - protein, 24 aa, Entamoeba histolytica
QTNKSICPPLPPKAERFNQERELT

SEQ ID NO: 2724812 - protein, 31 aa, Entamoeba histolytica
QTNYTNKYLLHSYYKLLWFVQKFNDERETGH

SEQ ID NO: 2724813 - protein, 27 aa, Entamoeba histolytica
QTPDYLQLRMLFWRIAKREGIEFDGQF

SEQ ID NO: 2724814 - protein, 22 aa, Entamoeba histolytica
QTPKGVLLYGPPGTGKTLMARA

SEQ ID NO: 2724815 - protein, 22 aa, Entamoeba histolytica
QTPRKSIPKAPLLNSLNTSSID

SEQ ID NO: 2724816 - protein, 25 aa, Entamoeba histolytica
QTPTHLVFILDYCAGGELFSYLQKH

SEQ ID NO: 2724817 - protein, 22 aa, Entamoeba histolytica
QTQGIIPVTPFITTQNGQLRLD

SEQ ID NO: 2724818 - protein, 27 aa, Entamoeba histolytica
QTQKKLNLFLTTLEYLRGQGEGLLAEC

SEQ ID NO: 2724819 - protein, 19 aa, Entamoeba histolytica
QTQLNVPITIPLQQQIPNA

SEQ ID NO: 2724820 - protein, 28 aa, Entamoeba histolytica
QTRQKATYPFILVPKILKFWCCNEKNIN

SEQ ID NO: 2724821 - protein, 25 aa, Entamoeba histolytica
QTRRPPPPLPSRKVPPTLPSRSDNN

SEQ ID NO: 2724822 - protein, 29 aa, Entamoeba histolytica
QTSASFNIYRGYGKFISSPEMEYIATLHI

SEQ ID NO: 2724823 - protein, 26 aa, Entamoeba histolytica
QTSCKSRVILLLISALKYFTKNGEEF

SEQ ID NO: 2724824 - protein, 26 aa, Entamoeba histolytica
QTSFNQFPQQQNPFSQFSKLANGSTN

SEQ ID NO: 2724825 - protein, 21 aa, Entamoeba histolytica
QTSLIYFQYQSGHLLTMERKD

SEQ ID NO: 2724826 - protein, 31 aa, Entamoeba histolytica; identical to SEQ ID NO: 2537617

SEQ ID NO: 2724827 - protein, 23 aa, Entamoeba histolytica
QTSNGFNFNLTGLFGSSTPSTLL

SEQ ID NO: 2724828 - protein, 24 aa, Entamoeba histolytica
QTSQVIIYNIKRTKSTPPIKIIDT

SEQ ID NO: 2724829 - protein, 17 aa, Entamoeba histolytica
QTTTVSEIPSFKPSLRY

SEQ ID NO: 2724830 - protein, 21 aa, Entamoeba histolytica
QTVNIHCTLFLTKNGYEEKGL

SEQ ID NO: 2724831 - protein, 31 aa, Entamoeba histolytica
QTVQHHFDLIYQLQLDNIWLITPAINGSQIT

SEQ ID NO: 2724832 - protein, 17 aa, Entamoeba histolytica
QTWYEKLGRWQQALSIY

SEQ ID NO: 2724833 - protein, 30 aa, Entamoeba histolytica
QTYDFLSVIFTRLLFSIQTLSQIQFHKLLP

SEQ ID NO: 2724834 - protein, 24 aa, Entamoeba histolytica
QTYFEIVFDYYLKGTLLSIDKSYL

SEQ ID NO: 2724835 - protein, 26 aa, Entamoeba histolytica
QTYKEFNYLFKTSLPEFPHAFTISAC

SEQ ID NO: 2724836 - protein, 18 aa, Entamoeba histolytica
QTYVIPPLTSNKSIFIST

SEQ ID NO: 2724837 - protein, 23 aa, Entamoeba histolytica
QVAPIYYGIIDHLCMLLKKEKFT

SEQ ID NO: 2724838 - protein, 23 aa, Entamoeba histolytica
QVDDLLYFYCYTYQKIQEHYKKH

SEQ ID NO: 2724839 - protein, 27 aa, Entamoeba histolytica
QVDEMIIQLSFISEIHPYIFPKGEFAS

SEQ ID NO: 2724840 - protein, 24 aa, Entamoeba histolytica
QVDIMPFERLSILIKYIHARNHHQ

SEQ ID NO: 2724841 - protein, 29 aa, Entamoeba histolytica
QVDIWAFGVMLYYLKFGITPFNSSTREVV

SEQ ID NO: 2724842 - protein, 28 aa, Entamoeba histolytica
QVDLFDFHLYVYEKMSVVAYLDLLRNVE

SEQ ID NO: 2724843 - protein, 28 aa, Entamoeba histolytica
QVDSLFLIHTFPFLEIFNNKLFERYNFN

SEQ ID NO: 2724844 - protein, 19 aa, Entamoeba histolytica
QVELCHQYYLGLFTSKSET

SEQ ID NO: 2724845 - protein, 25 aa, Entamoeba histolytica
QVERIHQIFYYNKLWYGYDEIVFLG

SEQ ID NO: 2724846 - protein, 18 aa, Entamoeba histolytica
QVFIGKDSSSLISRLFRI

SEQ ID NO: 2724847 - protein, 21 aa, Entamoeba histolytica
QVFKELLEKTYYPMKGREIQP

SEQ ID NO: 2724848 - protein, 17 aa, Entamoeba histolytica
QVFKYFNNVLFGGEMND

SEQ ID NO: 2724849 - protein, 17 aa, Entamoeba histolytica
QVFMLMKGLATKKCVKE

SEQ ID NO: 2724850 - protein, 26 aa, Entamoeba histolytica
QVFTMNDRILPFIKFLINREFEESRS

SEQ ID NO: 2724851 - protein, 18 aa, Entamoeba histolytica
QVGRIQQPTPREFHSCCE

SEQ ID NO: 2724852 - protein, 17 aa, Entamoeba histolytica
QVHPSLIKRCKSHITLF

SEQ ID NO: 2724853 - protein, 26 aa, Entamoeba histolytica
QVHRRSQLYKVLFPSSIKTPLNTRKF

SEQ ID NO: 2724854 - protein, 33 aa, Entamoeba histolytica
QVHYLNVFVPLIDPLPFNYFVYCISDSYLKCST

SEQ ID NO: 2724855 - protein, 19 aa, Entamoeba histolytica
QVIAFSLGKYRIFGETIDI

SEQ ID NO: 2724856 - protein, 21 aa, Entamoeba histolytica
QVIIKHIIIDPKCISRYFQYP

SEQ ID NO: 2724857 - protein, 24 aa, Entamoeba histolytica
QVILGYLPQFIQVLKFESYTCSSL

SEQ ID NO: 2724858 - protein, 29 aa, Entamoeba histolytica
QVILSVIRYFSNLILLNPLVLEKEEQVLS

SEQ ID NO: 2724859 - protein, 53 aa, Entamoeba histolytica
QVIMQPVSYTQPIYQPPLNQYMVPLMQPPYDPSPMRRPRRSPVAYHQMVPQQF

SEQ ID NO: 2724860 - protein, 19 aa, Entamoeba histolytica
QVLEQIFLSDVYTAKHVIS

SEQ ID NO: 2724861 - protein, 20 aa, Entamoeba histolytica
QVLHYKFGKQHFFIGGSIGT

SEQ ID NO: 2724862 - protein, 17 aa, Entamoeba histolytica
QVLIWRETSNNNYAIVY

SEQ ID NO: 2724863 - protein, 26 aa, Entamoeba histolytica
QVLSRLTFTSALAYLRKISSPVEGKR

SEQ ID NO: 2724864 - protein, 18 aa, Entamoeba histolytica
QVLTYIGSKFRLIMDGTE

SEQ ID NO: 2724865 - protein, 23 aa, Entamoeba histolytica
QVMFNVFNVLWMKSSFLAHPTAF

SEQ ID NO: 2724866 - protein, 32 aa, Entamoeba histolytica
QVMTAFTVLYNYFTTLLVPKTTIINGTFGEYT

SEQ ID NO: 2724867 - protein, 17 aa, Entamoeba histolytica
QVNELFHRLSVSDISSF

SEQ ID NO: 2724868 - protein, 33 aa, Entamoeba histolytica
QVNIYTNVILYRRIIRLVKNIKLNNFIVPIELQ

SEQ ID NO: 2724869 - protein, 17 aa, Entamoeba histolytica
QVNSALRPKAWQILLGY

SEQ ID NO: 2724870 - protein, 19 aa, Entamoeba histolytica
QVNYLFKPSMIIDKYLRSI

SEQ ID NO: 2724871 - protein, 17 aa, Entamoeba histolytica
QVPIVIMLTKCKEKTRI

SEQ ID NO: 2724872 - protein, 20 aa, Entamoeba histolytica
QVPLNLFGEVMYLLGVDVGQ

SEQ ID NO: 2724873 - protein, 18 aa, Entamoeba histolytica
QVPLYLLTDNIYALANTM

SEQ ID NO: 2724874 - protein, 25 aa, Entamoeba histolytica
QVQEFKQILKLLKSGSIRAVRVKTN

SEQ ID NO: 2724875 - protein, 27 aa, Entamoeba histolytica
QVRLPAVFLAPIRGDVVHFVYRNQSKN

SEQ ID NO: 2724876 - protein, 25 aa, Entamoeba histolytica
QVTLIEYDLFMKIHISELYSWNNSN

SEQ ID NO: 2724877 - protein, 20 aa, Entamoeba histolytica
QVTNLLKLKNFSISYNMLTS

SEQ ID NO: 2724878 - protein, 25 aa, Entamoeba histolytica
QVVYDLCRWIYMHGIEVEGIFRISG

SEQ ID NO: 2724879 - protein, 17 aa, Entamoeba histolytica
QVWGHRQYLVGLTGNYL

SEQ ID NO: 2724880 - protein, 24 aa, Entamoeba histolytica
QVWRALLHDFLKKTLEYDPAKRLT

SEQ ID NO: 2724881 - protein, 19 aa, Entamoeba histolytica
QWEKVQIKTFTKWVNMHLA

SEQ ID NO: 2724882 - protein, 28 aa, Entamoeba histolytica
QWEKVQIKTFTKWVNMHLAKKGRKINDV

SEQ ID NO: 2724883 - protein, 17 aa, Entamoeba histolytica
QWLRVCTGAKIFQGYGL

SEQ ID NO: 2724884 - protein, 18 aa, Entamoeba histolytica
QWLYFAQQEKFPFELPMC

SEQ ID NO: 2724885 - protein, 20 aa, Entamoeba histolytica
QWLYYPWDQVTSRAKKVILN

SEQ ID NO: 2724886 - protein, 27 aa, Entamoeba histolytica
QWNDEITIFVMLKYKKWQLSQRKYKTL

SEQ ID NO: 2724887 - protein, 27 aa, Entamoeba histolytica
QWSGKQKLHVFFNNKKERFTRENCLSI

SEQ ID NO: 2724888 - protein, 22 aa, Entamoeba histolytica
QWTSLSGFVRYLETKGIVELEE

SEQ ID NO: 2724889 - protein, 39 aa, Entamoeba histolytica
QWVCVCVPILPRILLEYLTSPFPYILGLPSSYRAEADPI

SEQ ID NO: 2724890 - protein, 17 aa, Entamoeba histolytica
QWYVDTMLLATCLGGEF

SEQ ID NO: 2724891 - protein, 30 aa, Entamoeba histolytica
QYARNYLELILRIFKKPYLTFGDKTGIIQV

SEQ ID NO: 2724892 - protein, 23 aa, Entamoeba histolytica
QYAYLVISKSYFYIESYDEAVNY

SEQ ID NO: 2724893 - protein, 29 aa, Entamoeba histolytica
QYCFSHNYIIQYIPLFSKLFSIDDESVLI

SEQ ID NO: 2724894 - protein, 23 aa, Entamoeba histolytica
QYDDVLRINCQLIEIADGCERCR

SEQ ID NO: 2724895 - protein, 24 aa, Entamoeba histolytica
QYDDVLRINCQLIEIADGCERCRQ

SEQ ID NO: 2724896 - protein, 22 aa, Entamoeba histolytica
QYDFIHKHNKWIKLKENDIRKR

SEQ ID NO: 2724897 - protein, 19 aa, Entamoeba histolytica
QYEIILSGSFFLDENIIQL

SEQ ID NO: 2724898 - protein, 17 aa, Entamoeba histolytica
QYFLVPNPKIKTTRLCV

SEQ ID NO: 2724899 - protein, 32 aa, Entamoeba histolytica
QYGIDQILHDLFLFAAQNLVVGGRLVFWFPSI

SEQ ID NO: 2724900 - protein, 18 aa, Entamoeba histolytica
QYHATRLFFYVKQNDQHS

SEQ ID NO: 2724901 - protein, 18 aa, Entamoeba histolytica
QYIGIERHAQYGYYWMIG

SEQ ID NO: 2724902 - protein, 18 aa, Entamoeba histolytica
QYIMCSTPMIVSDNKLYK

SEQ ID NO: 2724903 - protein, 28 aa, Entamoeba histolytica
QYKIESLPHYLFLQLNRFDSFDVNVMKI

SEQ ID NO: 2724904 - protein, 26 aa, Entamoeba histolytica
QYKLEKIILYFKTISCKVADFILKES

SEQ ID NO: 2724905 - protein, 25 aa, Entamoeba histolytica
QYLNDYRFFSFESTGPEQKPVMEYQ

SEQ ID NO: 2724906 - protein, 24 aa, Entamoeba histolytica
QYLSDLLILYFQPEFPSNLKLHTK

SEQ ID NO: 2724907 - protein, 23 aa, Entamoeba histolytica
QYLSKMECYIMGRLIFPKVENKE

SEQ ID NO: 2724908 - protein, 27 aa, Entamoeba histolytica
QYNALKLLFPHSKLFFCRIHIERSLKK

SEQ ID NO: 2724909 - protein, 22 aa, Entamoeba histolytica
QYNGGIFVTQFTLNGKYIVSGG

SEQ ID NO: 2724910 - protein, 21 aa, Entamoeba histolytica
QYNYNSPLTTPRRTPRKQSKP

SEQ ID NO: 2724911 - protein, 26 aa, Entamoeba histolytica
QYPGLPIDELFPKNIPLFTANSKIDH

SEQ ID NO: 2724912 - protein, 26 aa, Entamoeba histolytica
QYPTYQSFSPYIPQVVQFPPTPQQPQ

SEQ ID NO: 2724913 - protein, 25 aa, Entamoeba histolytica
QYQYYHPIIVLFYGLPRYPHEFIDG

SEQ ID NO: 2724914 - protein, 24 aa, Entamoeba histolytica
QYSHFLYFIFRCIGTPVKLKCFEI

SEQ ID NO: 2724915 - protein, 22 aa, Entamoeba histolytica
QYSMKIFPQQIQTFLLNSVQMV

SEQ ID NO: 2724916 - protein, 22 aa, Entamoeba histolytica
QYSMTIKLITSFLKLVKVPSNF

SEQ ID NO: 2724917 - protein, 18 aa, Entamoeba histolytica
QYSPIFFQFLDCVNILIH

SEQ ID NO: 2724918 - protein, 25 aa, Entamoeba histolytica
QYSRLNLTAIYIVNSFYIQALMNPE

SEQ ID NO: 2724919 - protein, 27 aa, Entamoeba histolytica
QYSTFSHRYIKLINFYSQEHPTLDVMK

SEQ ID NO: 2724920 - protein, 18 aa, Entamoeba histolytica
QYTIFGMYQCHLKTDFKS

SEQ ID NO: 2724921 - protein, 21 aa, Entamoeba histolytica
QYTQAKLFRNSLKNLKKALDK

SEQ ID NO: 2724922 - protein, 18 aa, Entamoeba histolytica
QYTYFWKPSIEEEVNKSC

SEQ ID NO: 2724923 - protein, 24 aa, Entamoeba histolytica
QYVLIYELLDEILDFGYPQFCTKD

SEQ ID NO: 2724924 - protein, 24 aa, Entamoeba histolytica
QYYKPFICIQPLISSSPSYSCIFS

SEQ ID NO: 2724925 - protein, 26 aa, Entamoeba histolytica
RAAGAMYLFPRITLPEKFIKECHERH

SEQ ID NO: 2724926 - protein, 19 aa, Entamoeba histolytica
RAALTFNRLLQLVEKHGYK

SEQ ID NO: 2724927 - protein, 21 aa, Entamoeba histolytica
RACIGLIQHQELMPMLLQVCK

SEQ ID NO: 2724928 - protein, 34 aa, Entamoeba histolytica
RACPFGAILPRSNLIDVLKILPTKKVVACPAPSI

SEQ ID NO: 2724929 - protein, 25 aa, Entamoeba histolytica
RAEDKYKFFLEATQLDMIKESYKQA

SEQ ID NO: 2724930 - protein, 18 aa, Entamoeba histolytica
RAELYKHVLLSGGTSMLP

SEQ ID NO: 2724931 - protein, 40 aa, Entamoeba histolytica; identical to SEQ ID NO: 2537752

SEQ ID NO: 2724932 - protein, 30 aa, Entamoeba histolytica
RAFFHCGLQSLILPFSITSIAFDAFDSSSI

SEQ ID NO: 2724933 - protein, 19 aa, Entamoeba histolytica
RAFKTILELTKKYKRVCFV

SEQ ID NO: 2724934 - protein, 20 aa, Entamoeba histolytica
RAGIIVIRVGSTFDLKRLCR

SEQ ID NO: 2724935 - protein, 39 aa, Entamoeba histolytica
RAGIYPNMLLSLVTSPPLFVASYYLALDPSLHSLILCIR

SEQ ID NO: 2724936 - protein, 21 aa, Entamoeba histolytica
RAGYLSYWNLINQKKREADNN

SEQ ID NO: 2724937 - protein, 23 aa, Entamoeba histolytica
RAHQLIQDGYKWMFNEKIVTVWS

SEQ ID NO: 2724938 - protein, 18 aa, Entamoeba histolytica
RAHQLVNEGYKWCFDKKL

SEQ ID NO: 2724939 - protein, 19 aa, Entamoeba histolytica
RAKDRRDFVFGKASEEEKK

SEQ ID NO: 2724940 - protein, 28 aa, Entamoeba histolytica
RALFHRVYKFVPLNKRKKYWEIELKINQ

SEQ ID NO: 2724941 - protein, 17 aa, Entamoeba histolytica
RALHIERIPLIELQLLE

SEQ ID NO: 2724942 - protein, 17 aa, Entamoeba histolytica
RALKLYKLPEQPNSIGF

SEQ ID NO: 2724943 - protein, 19 aa, Entamoeba histolytica
RALLFVQPCEIRILEYLKG

SEQ ID NO: 2724944 - protein, 18 aa, Entamoeba histolytica
RALLQFYLEIKPLPDEDL

SEQ ID NO: 2724945 - protein, 17 aa, Entamoeba histolytica
RALLRRLTHLQIVPENG

SEQ ID NO: 2724946 - protein, 19 aa, Entamoeba histolytica
RALQFWLDFLKVADIKTDS

SEQ ID NO: 2724947 - protein, 18 aa, Entamoeba histolytica
RALVLYTSLYHHEYLKRK

SEQ ID NO: 2724948 - protein, 17 aa, Entamoeba histolytica
RAMGIVIGNIKKWKFNC

SEQ ID NO: 2724949 - protein, 20 aa, Entamoeba histolytica
RAMKIIKHIGWWGNGKLDDG

SEQ ID NO: 2724950 - protein, 20 aa, Entamoeba histolytica
RAMSASAQALPYLGSRNQNV

SEQ ID NO: 2724951 - protein, 19 aa, Entamoeba histolytica
RAMWLKYFNERGIRVIFYS

SEQ ID NO: 2724952 - protein, 34 aa, Entamoeba histolytica; identical to SEQ ID NO: 2537774

SEQ ID NO: 2724953 - protein, 18 aa, Entamoeba histolytica
RANLYQILAKIIPRMTFY

SEQ ID NO: 2724954 - protein, 25 aa, Entamoeba histolytica
RAPIDRPPLERTPLDRDPRIPIDRP

SEQ ID NO: 2724955 - protein, 19 aa, Entamoeba histolytica
RAQILSMDYLHSAIQPNIT

SEQ ID NO: 2724956 - protein, 27 aa, Entamoeba histolytica
RARFIPLRITQPERKMLRLLEASLHVS

SEQ ID NO: 2724957 - protein, 24 aa, Entamoeba histolytica
RASPTMGLPLIKLHDFSCGIVLEN

SEQ ID NO: 2724958 - protein, 19 aa, Entamoeba histolytica
RASTQMYTLIFLKDKEVAV

SEQ ID NO: 2724959 - protein, 21 aa, Entamoeba histolytica
RATELFLVDLIKKTNTVAEEK

SEQ ID NO: 2724960 - protein, 25 aa, Entamoeba histolytica
RATHIVCHNFGRTIKMLKGISDGKW

SEQ ID NO: 2724961 - protein, 25 aa, Entamoeba histolytica
RATQKFGFPPIPNPILNIFKGLNQY

SEQ ID NO: 2724962 - protein, 17 aa, Entamoeba histolytica
RAWKTVLEMLRDRGYIT

SEQ ID NO: 2724963 - protein, 29 aa, Entamoeba histolytica
RAYTQFAVDYPYALTKHSFMLKYNSQYNQ

SEQ ID NO: 2724964 - protein, 18 aa, Entamoeba histolytica
RCDWPLLHLYIISNNDND

SEQ ID NO: 2724965 - protein, 18 aa, Entamoeba histolytica
RCEQYINFISLKFNIKKG

SEQ ID NO: 2724966 - protein, 18 aa, Entamoeba histolytica
RCFITDHIIISLIQNIGS

SEQ ID NO: 2724967 - protein, 25 aa, Entamoeba histolytica
RCGKIDIQVLKKISLQLLNALQYLH

SEQ ID NO: 2724968 - protein, 25 aa, Entamoeba histolytica
RCGLGEILLPPRQPGSSIMPGKVNP

SEQ ID NO: 2724969 - protein, 17 aa, Entamoeba histolytica
RCHFFYNMNLNNGITNE

SEQ ID NO: 2724970 - protein, 19 aa, Entamoeba histolytica
RCHKTCHYPCYIKGDMKKG

SEQ ID NO: 2724971 - protein, 22 aa, Entamoeba histolytica
RCIKSPYFHPLIGYQEKILNVL

SEQ ID NO: 2724972 - protein, 25 aa, Entamoeba histolytica
RCINLIIQKYPHLFSNQLRTFYCSY

SEQ ID NO: 2724973 - protein, 21 aa, Entamoeba histolytica
RCIRVCTIAIPVVSQIHQCLP

SEQ ID NO: 2724974 - protein, 19 aa, Entamoeba histolytica
RCLEEMDLSYFNGLSIKKL

SEQ ID NO: 2724975 - protein, 18 aa, Entamoeba histolytica
RCPLCKQSCIIKKNQIVC

SEQ ID NO: 2724976 - protein, 19 aa, Entamoeba histolytica
RCPQLRYEYNLYKILMETG

SEQ ID NO: 2724977 - protein, 26 aa, Entamoeba histolytica
RCQASVNIIVLILAKLLQGREDIEEI

SEQ ID NO: 2724978 - protein, 20 aa, Entamoeba histolytica
RCRVLVKKLKQIGYPCGILY

SEQ ID NO: 2724979 - protein, 24 aa, Entamoeba histolytica
RCSEWFRVMFVKYQCVYHILDLLK

SEQ ID NO: 2724980 - protein, 18 aa, Entamoeba histolytica
RCSHKFCLNCWNEYLLMN

SEQ ID NO: 2724981 - protein, 18 aa, Entamoeba histolytica
RCVEIKLFSGIARLIEYY

SEQ ID NO: 2724982 - protein, 27 aa, Entamoeba histolytica
RCVGSYKNILFVIKTTKNEVFGGYCSD

SEQ ID NO: 2724983 - protein, 31 aa, Entamoeba histolytica
RDDITNGYKWLLLAYIPDRAKVRMKMLYSST

SEQ ID NO: 2724984 - protein, 17 aa, Entamoeba histolytica
RDDKHVFELLKNTAKMG

SEQ ID NO: 2724985 - protein, 25 aa, Entamoeba histolytica
RDEEIKLYLLFYEKSYEMIKYQQTI

SEQ ID NO: 2724986 - protein, 24 aa, Entamoeba histolytica
RDEHKGFCFLTYKDPRSCVLAIDN

SEQ ID NO: 2724987 - protein, 21 aa, Entamoeba histolytica
RDELEYIINARYPYIEISSKL

SEQ ID NO: 2724988 - protein, 23 aa, Entamoeba histolytica
RDFCSLLYKKLPTYNFNTFYYIL

SEQ ID NO: 2724989 - protein, 19 aa, Entamoeba histolytica
RDFERGIKIEELQQFLPLE

SEQ ID NO: 2724990 - protein, 17 aa, Entamoeba histolytica
RDFRAYVTSVNWLNKHY

SEQ ID NO: 2724991 - protein, 20 aa, Entamoeba histolytica
RDFVIHLTQFPTTLSTLINF

SEQ ID NO: 2724992 - protein, 25 aa, Entamoeba histolytica
RDHHHGRLILVVDQLPGIPPILSNG

SEQ ID NO: 2724993 - protein, 26 aa, Entamoeba histolytica
RDHHHGRLILVVDQLPGIPPILSNGF

SEQ ID NO: 2724994 - protein, 18 aa, Entamoeba histolytica
RDHIIYDDMLLVILDVVD

SEQ ID NO: 2724995 - protein, 20 aa, Entamoeba histolytica
RDHRLIGRQQDLFFFHVLSP

SEQ ID NO: 2724996 - protein, 20 aa, Entamoeba histolytica
RDHYKLALAQLSIAKKLIDS

SEQ ID NO: 2724997 - protein, 20 aa, Entamoeba histolytica
RDIGDWVGLSLKSKRTKKHI

SEQ ID NO: 2724998 - protein, 34 aa, Entamoeba histolytica
RDIKLENFLLIHHQPFPLLKITDFGFGRSLADEM

SEQ ID NO: 2724999 - protein, 17 aa, Entamoeba histolytica
RDILRFCKLYIEYSSNI

SEQ ID NO: 2725000 - protein, 21 aa, Entamoeba histolytica
RDINEFIIPTTITKLTDECFS

SEQ ID NO: 2725001 - protein, 32 aa, Entamoeba histolytica
RDITDIFSVMKSEKKYWLYLVVSEAGEINVVT

SEQ ID NO: 2725002 - protein, 34 aa, Entamoeba histolytica; identical to SEQ ID NO: 2537824

SEQ ID NO: 2725003 - protein, 23 aa, Entamoeba histolytica
RDKNVFVASFRSPLRKPKDVFVI

SEQ ID NO: 2725004 - protein, 39 aa, Entamoeba histolytica
RDKRNYKIALESVLIALLNRHFEIVLRKPKSKSTTTLSY

SEQ ID NO: 2725005 - protein, 25 aa, Entamoeba histolytica
RDKTGLMVVCKYGEIIFGCYNSNML

SEQ ID NO: 2725006 - protein, 23 aa, Entamoeba histolytica
RDKYYDLYRLYEYKALKRIKVKE

SEQ ID NO: 2725007 - protein, 30 aa, Entamoeba histolytica
RDLESTLSEILLLDYFRLSNYYDRICFALK

SEQ ID NO: 2725008 - protein, 19 aa, Entamoeba histolytica
RDLGIKRWPHRKLQRIEGE

SEQ ID NO: 2725009 - protein, 25 aa, Entamoeba histolytica
RDLKYIPFYADLCVSLSIFISSNFT

SEQ ID NO: 2725010 - protein, 18 aa, Entamoeba histolytica
RDLNRAALTFNWLVGYAE

SEQ ID NO: 2725011 - protein, 26 aa, Entamoeba histolytica
RDNDPFKSWTLWWKEKRNTYPSLSNI

SEQ ID NO: 2725012 - protein, 30 aa, Entamoeba histolytica
RDNQTNADFIIYRGFGKYVSSLGVERVTKL

SEQ ID NO: 2725013 - protein, 26 aa, Entamoeba histolytica
RDNYRRIRIKLQPWKEDNYLVKNSRI

SEQ ID NO: 2725014 - protein, 23 aa, Entamoeba histolytica
RDPLLKEHLGFYGIDISKLSKTQ

SEQ ID NO: 2725015 - protein, 18 aa, Entamoeba histolytica
RDQRHSRDYYYYFLFNFF

SEQ ID NO: 2725016 - protein, 21 aa, Entamoeba histolytica
RDQVYRFFYDLTIETHSSIDI

SEQ ID NO: 2725017 - protein, 23 aa, Entamoeba histolytica
RDRAHIYWRILFDHPQQTHDIML

SEQ ID NO: 2725018 - protein, 17 aa, Entamoeba histolytica
RDRGIFGYYYGLLSVKI

SEQ ID NO: 2725019 - protein, 24 aa, Entamoeba histolytica
RDSHFLIYVYYDKGCKNLQYIFGK

SEQ ID NO: 2725020 - protein, 24 aa, Entamoeba histolytica
RDTFISLRGLLLQTGRFTEAKNTI

SEQ ID NO: 2725021 - protein, 23 aa, Entamoeba histolytica
RDTIKSLYPTIPIICATSNQEEE

SEQ ID NO: 2725022 - protein, 33 aa, Entamoeba histolytica
RDTKVLLKISIPCVYLYPCVIPQEALNNNNYNV

SEQ ID NO: 2725023 - protein, 25 aa, Entamoeba histolytica
RDTSEWLDLLFGLVSAIIDVVSLVQ

SEQ ID NO: 2725024 - protein, 27 aa, Entamoeba histolytica
RDTSNYPIFYSTLLIYEDQTFSLKFAN

SEQ ID NO: 2725025 - protein, 24 aa, Entamoeba histolytica
RDVAARVKYLKYIETHPTMTWSDF

SEQ ID NO: 2725026 - protein, 22 aa, Entamoeba histolytica
RDVLFGRLCTCLALIKAQRVNE

SEQ ID NO: 2725027 - protein, 17 aa, Entamoeba histolytica
RDVMLCVSGSLAYLHSK

SEQ ID NO: 2725028 - protein, 33 aa, Entamoeba histolytica
RDVPNCLFFIDKYSQVPWILSPVLRTTRRMFSH

SEQ ID NO: 2725029 - protein, 26 aa, Entamoeba histolytica
RDVSALCQLFRLLPATSICTCKYLFL

SEQ ID NO: 2725030 - protein, 19 aa, Entamoeba histolytica
RDVYLSIDKLTRSASGKLN

SEQ ID NO: 2725031 - protein, 17 aa, Entamoeba histolytica
RDVYLSIDKLTRSASRI

SEQ ID NO: 2725032 - protein, 26 aa, Entamoeba histolytica
RDWKKYYPMKTLFYLSKPFNDLSSVN

SEQ ID NO: 2725033 - protein, 32 aa, Entamoeba histolytica
RDWRTDIRNFNFYDLKPLDRWTAIVPSQCMSE

SEQ ID NO: 2725034 - protein, 18 aa, Entamoeba histolytica
RDWVISSILSFFSTENRV

SEQ ID NO: 2725035 - protein, 26 aa, Entamoeba histolytica
RDYADYIQIDGLLGLLFCYLITLDLC

SEQ ID NO: 2725036 - protein, 18 aa, Entamoeba histolytica
RDYMIKKWIEQIGGKFAT

SEQ ID NO: 2725037 - protein, 19 aa, Entamoeba histolytica
RDYQTLLYSIRSVYMYAPY

SEQ ID NO: 2725038 - protein, 26 aa, Entamoeba histolytica
REAGIYLFIIFYKEGKLFRTLFNQDC

SEQ ID NO: 2725039 - protein, 18 aa, Entamoeba histolytica
REALHKGFYELTLARDSY

SEQ ID NO: 2725040 - protein, 28 aa, Entamoeba histolytica
RECDNVLLYYILMYLSDVHYLNIQINNK

SEQ ID NO: 2725041 - protein, 25 aa, Entamoeba histolytica
RECKDCGFVLMDVDDVKIQDLRPKE

SEQ ID NO: 2725042 - protein, 25 aa, Entamoeba histolytica
RECLFRIRKIPYSINFFGVPLDAIT

SEQ ID NO: 2725043 - protein, 35 aa, Entamoeba histolytica
REDENKILRLFLFGLYKMKVLSPPVLHIVKQMYFE

SEQ ID NO: 2725044 - protein, 37 aa, Entamoeba histolytica; identical to SEQ ID NO: 2537858

SEQ ID NO: 2725045 - protein, 25 aa, Entamoeba histolytica
REDVAPHVYAIADGAYRAMLDPASK

SEQ ID NO: 2725046 - protein, 24 aa, Entamoeba histolytica
REEDVKQIFLYYDEILRCNREFAS

SEQ ID NO: 2725047 - protein, 19 aa, Entamoeba histolytica
REEGMELALIPQSDKKTGN

SEQ ID NO: 2725048 - protein, 20 aa, Entamoeba histolytica
REELTSFDWIDDFIISGSCK

SEQ ID NO: 2725049 - protein, 21 aa, Entamoeba histolytica
REEPIFFDYNKLGICFRTFSD

SEQ ID NO: 2725050 - protein, 19 aa, Entamoeba histolytica
REESYEFVLAPTKLLQVGA

SEQ ID NO: 2725051 - protein, 19 aa, Entamoeba histolytica
REFGKKYSALKYPHAQFTE

SEQ ID NO: 2725052 - protein, 24 aa, Entamoeba histolytica
REFYHQFILSRSSENVWFIVSENF

SEQ ID NO: 2725053 - protein, 17 aa, Entamoeba histolytica
REGYQMEYWYYYLKACQ

SEQ ID NO: 2725054 - protein, 17 aa, Entamoeba histolytica
REHSKFPGIYIASGKEE

SEQ ID NO: 2725055 - protein, 20 aa, Entamoeba histolytica
REIHIFIYKNLCKEVMEYCF

SEQ ID NO: 2725056 - protein, 26 aa, Entamoeba histolytica
REILLTQLFAICFYKEILTKTKLVYD

SEQ ID NO: 2725057 - protein, 23 aa, Entamoeba histolytica
REIRDGFHFPMRTKEVVLSTQLK

SEQ ID NO: 2725058 - protein, 24 aa, Entamoeba histolytica
REIRDGFHFPMRTKEVVLSTQLKT

SEQ ID NO: 2725059 - protein, 18 aa, Entamoeba histolytica
REITLKDLPFIKKGIESN

SEQ ID NO: 2725060 - protein, 17 aa, Entamoeba histolytica
REIVLSTLSLKKKVKME

SEQ ID NO: 2725061 - protein, 34 aa, Entamoeba histolytica
REIVRTEVPILPLFFLQYCAIEELQFEKLRYQLE

SEQ ID NO: 2725062 - protein, 20 aa, Entamoeba histolytica
REKFIDVYISFKGSIPFLRK

SEQ ID NO: 2725063 - protein, 23 aa, Entamoeba histolytica
REKKAIALKGARLAFFQAKSTVY

SEQ ID NO: 2725064 - protein, 25 aa, Entamoeba histolytica
REKKKSLILSLLKENNKAILPPKES

SEQ ID NO: 2725065 - protein, 27 aa, Entamoeba histolytica
REKLLNNILSSSKFLYKVEYTELIGTG

SEQ ID NO: 2725066 - protein, 20 aa, Entamoeba histolytica
REKRKSLILSLLKENDTAII

SEQ ID NO: 2725067 - protein, 27 aa, Entamoeba histolytica
REKTIQLLFERFKVPSVYFSIQPILSL

SEQ ID NO: 2725068 - protein, 20 aa, Entamoeba histolytica
RELELQGMFITFQSLRSSTD

SEQ ID NO: 2725069 - protein, 22 aa, Entamoeba histolytica
RELEMYVEGIKFLPFELVTKNE

SEQ ID NO: 2725070 - protein, 27 aa, Entamoeba histolytica
RELFDLILNGYYQFISPYWDNISLELK

SEQ ID NO: 2725071 - protein, 25 aa, Entamoeba histolytica
RELFIVRLIYQRIIEGMPLLDCVKG

SEQ ID NO: 2725072 - protein, 32 aa, Entamoeba histolytica
RELKFSFDCDSVVVELPYVRRIYGVDELIEIK

SEQ ID NO: 2725073 - protein, 24 aa, Entamoeba histolytica
RELKLLEEIYYNKYHRILVGTQMG

SEQ ID NO: 2725074 - protein, 19 aa, Entamoeba histolytica
REMEGRGIWGVPKLKPSEM

SEQ ID NO: 2725075 - protein, 21 aa, Entamoeba histolytica
REMREINLIRNLCKDYLLIVR

SEQ ID NO: 2725076 - protein, 18 aa, Entamoeba histolytica
RENDVIICRCGDSPIYVL

SEQ ID NO: 2725077 - protein, 20 aa, Entamoeba histolytica
RENEKFPCFIEVVGIQSPGL

SEQ ID NO: 2725078 - protein, 25 aa, Entamoeba histolytica
RENEQLKEVSKLKWELSELKTENES

SEQ ID NO: 2725079 - protein, 27 aa, Entamoeba histolytica
RENGGYSWWRRNSLTVFLDKKIYKDPQ

SEQ ID NO: 2725080 - protein, 24 aa, Entamoeba histolytica
REPTESWRFLIRPLEIKEREEIEI

SEQ ID NO: 2725081 - protein, 19 aa, Entamoeba histolytica
REQAERIKRAVAERKRQLQ

SEQ ID NO: 2725082 - protein, 24 aa, Entamoeba histolytica
REQKNKRWIIVQQQAFTHWVNETV

SEQ ID NO: 2725083 - protein, 24 aa, Entamoeba histolytica
REQLLKMEMVLGKFPHILSHDSHY

SEQ ID NO: 2725084 - protein, 17 aa, Entamoeba histolytica
REQLYRVLDKDVSEHVS

SEQ ID NO: 2725085 - protein, 46 aa, Entamoeba histolytica; identical to SEQ ID NO: 2537904

SEQ ID NO: 2725086 - protein, 24 aa, Entamoeba histolytica
RERFIELFKKVRKIPWVIPATNDE

SEQ ID NO: 2725087 - protein, 18 aa, Entamoeba histolytica
RERFLLKPLMDVNKILHR

SEQ ID NO: 2725088 - protein, 17 aa, Entamoeba histolytica
RERILLYGTYYDAQIFS

SEQ ID NO: 2725089 - protein, 22 aa, Entamoeba histolytica
RERLDKELRLLEDELKIKQDEF

SEQ ID NO: 2725090 - protein, 18 aa, Entamoeba histolytica
RERLLRRFLFAENNEHCK

SEQ ID NO: 2725091 - protein, 24 aa, Entamoeba histolytica
RESARDLLLMRRIIIDGKPCETLD

SEQ ID NO: 2725092 - protein, 28 aa, Entamoeba histolytica
RESDLFNTVFWLLDLEDIFCPDKLYNDI

SEQ ID NO: 2725093 - protein, 26 aa, Entamoeba histolytica
RETEIQLSIVLLLFKTMKLKEEQIDT

SEQ ID NO: 2725094 - protein, 23 aa, Entamoeba histolytica
RETHGALVVYDISNRDSFEYLQD

SEQ ID NO: 2725095 - protein, 23 aa, Entamoeba histolytica
RETKLWVDYFKIELNEEKAKKAF

SEQ ID NO: 2725096 - protein, 17 aa, Entamoeba histolytica
RETLNSMMLFNSKQDAE

SEQ ID NO: 2725097 - protein, 17 aa, Entamoeba histolytica
RETPLEDLPALFEKIQA

SEQ ID NO: 2725098 - protein, 24 aa, Entamoeba histolytica
REVAYRIPILTIWIHDMLSSLEEE

SEQ ID NO: 2725099 - protein, 29 aa, Entamoeba histolytica
REVDELEKRYRLLTKDILHNYKPTQKKEE

SEQ ID NO: 2725100 - protein, 30 aa, Entamoeba histolytica
REVDELEKRYRLLTKDILLNYKPTQKKEEN

SEQ ID NO: 2725101 - protein, 18 aa, Entamoeba histolytica
REVLGAEQLPPLYSYLLF

SEQ ID NO: 2725102 - protein, 25 aa, Entamoeba histolytica
REVNNKYPTFPFSLGMLENESKAKM

SEQ ID NO: 2725103 - protein, 24 aa, Entamoeba histolytica
REVTELFDSYLPYTNLVGKECVVW

SEQ ID NO: 2725104 - protein, 18 aa, Entamoeba histolytica
REYDFRLFDDANLSSIDW

SEQ ID NO: 2725105 - protein, 33 aa, Entamoeba histolytica; identical to SEQ ID NO: 2518434

SEQ ID NO: 2725106 - protein, 17 aa, Entamoeba histolytica
REYHIEGVLSIGTKPLY

SEQ ID NO: 2725107 - protein, 26 aa, Entamoeba histolytica
REYTTEIITLWYRPPEILLGATHYEA

SEQ ID NO: 2725108 - protein, 24 aa, Entamoeba histolytica
RFAFSLVRKVLPKVTLVMLTMGDV

SEQ ID NO: 2725109 - protein, 22 aa, Entamoeba histolytica
RFAPHIFRCYNPTKISPFIHFL

SEQ ID NO: 2725110 - protein, 31 aa, Entamoeba histolytica
RFDQMPPGYNQMGGMPYYGTQQYPGYNQMGG

SEQ ID NO: 2725111 - protein, 17 aa, Entamoeba histolytica
RFEEDVSLLLKLPSKIK

SEQ ID NO: 2725112 - protein, 18 aa, Entamoeba histolytica
RFEEINIDLFKSTIEPVS

SEQ ID NO: 2725113 - protein, 21 aa, Entamoeba histolytica
RFELKQLFLQAPMVGLAYTIG

SEQ ID NO: 2725114 - protein, 33 aa, Entamoeba histolytica
RFERMYGCLAKFALVQPIKRIPKLIWICYQQCL

SEQ ID NO: 2725115 - protein, 17 aa, Entamoeba histolytica
RFFDDTVLNFISLAQHF

SEQ ID NO: 2725116 - protein, 17 aa, Entamoeba histolytica
RFFKVSSLFNQSSSQEK

SEQ ID NO: 2725117 - protein, 19 aa, Entamoeba histolytica
RFFQQFLFNRFGQHILRVS

SEQ ID NO: 2725118 - protein, 17 aa, Entamoeba histolytica
RFFYFEESKTHEFDLLF

SEQ ID NO: 2725119 - protein, 18 aa, Entamoeba histolytica
RFGSYGSIRFNYDGIPRS

SEQ ID NO: 2725120 - protein, 17 aa, Entamoeba histolytica
RFHFNPIPLNQHSRRLF

SEQ ID NO: 2725121 - protein, 22 aa, Entamoeba histolytica
RFHFNPIPLNQYSRRLFPNIET

SEQ ID NO: 2725122 - protein, 32 aa, Entamoeba histolytica
RFHLEPKHFIYSHFQFFVFPDTDLSKSNVQNG

SEQ ID NO: 2725123 - protein, 17 aa, Entamoeba histolytica
RFHLIPSLVHKNYYQLF

SEQ ID NO: 2725124 - protein, 21 aa, Entamoeba histolytica
RFIEIFFKLYTAYCQFGELNR

SEQ ID NO: 2725125 - protein, 18 aa, Entamoeba histolytica
RFIGKSFDDKVIEKDIKR

SEQ ID NO: 2725126 - protein, 25 aa, Entamoeba histolytica
RFIIQSLLRPYIQKCNSKPLFIFKS

SEQ ID NO: 2725127 - protein, 18 aa, Entamoeba histolytica
RFITKIVQEIKEKRDVGE

SEQ ID NO: 2725128 - protein, 20 aa, Entamoeba histolytica
RFIYNIFELLKFDELFVNTS

SEQ ID NO: 2725129 - protein, 22 aa, Entamoeba histolytica
RFKEIYSIPKNVDIKKIIVSYT

SEQ ID NO: 2725130 - protein, 18 aa, Entamoeba histolytica
RFKFSQQKLKYFNDIGIS

SEQ ID NO: 2725131 - protein, 18 aa, Entamoeba histolytica
RFKNFSKGKKTKLDPRFK

SEQ ID NO: 2725132 - protein, 40 aa, Entamoeba histolytica
RFKTDDFLGTCQLPLKMPINGDVWLKLSIQGKIHVKLETF

SEQ ID NO: 2725133 - protein, 22 aa, Entamoeba histolytica
RFLARFGIINIIMRGKMIYKMV

SEQ ID NO: 2725134 - protein, 17 aa, Entamoeba histolytica
RFMRIFDTSRTGHLNIY

SEQ ID NO: 2725135 - protein, 17 aa, Entamoeba histolytica
RFMTIEPIKKNGYNHCI

SEQ ID NO: 2725136 - protein, 22 aa, Entamoeba histolytica
RFNKFIRRYFQVSAQQQVIQQQ

SEQ ID NO: 2725137 - protein, 18 aa, Entamoeba histolytica
RFNSQGIIPIILDKLSKG

SEQ ID NO: 2725138 - protein, 17 aa, Entamoeba histolytica
RFPPTQSPIDILLGKED

SEQ ID NO: 2725139 - protein, 19 aa, Entamoeba histolytica
RFPPVVFYTPKELGGLGML

SEQ ID NO: 2725140 - protein, 24 aa, Entamoeba histolytica
RFQRSYFYYRFDFKRCSEPLVIIL

SEQ ID NO: 2725141 - protein, 21 aa, Entamoeba histolytica
RFRILTSSFYRKSCGIFLVFD

SEQ ID NO: 2725142 - protein, 22 aa, Entamoeba histolytica
RFRILTSSFYRKSCGIFLVFDL

SEQ ID NO: 2725143 - protein, 23 aa, Entamoeba histolytica
RFRINPIRITSFVKNLFHFLDTQ

SEQ ID NO: 2725144 - protein, 18 aa, Entamoeba histolytica
RFRTITSSYYRGAQGIIV

SEQ ID NO: 2725145 - protein, 30 aa, Entamoeba histolytica; identical to SEQ ID NO: 2537975

SEQ ID NO: 2725146 - protein, 37 aa, Entamoeba histolytica
RFSANLKFIVKVISDVFTIKDIWKRVCIVWTKCPNSF

SEQ ID NO: 2725147 - protein, 34 aa, Entamoeba histolytica
RFSANLQFIINVISDVFTIKDIWKRVCIVWNKCD

SEQ ID NO: 2725148 - protein, 23 aa, Entamoeba histolytica
RFSRLQELKLLPRLQLLSVNCEQ

SEQ ID NO: 2725149 - protein, 24 aa, Entamoeba histolytica
RFSSIQCELLYSASLLLIYNKMEL

SEQ ID NO: 2725150 - protein, 18 aa, Entamoeba histolytica
RFTRENCLSILKNKTDII

SEQ ID NO: 2725151 - protein, 17 aa, Entamoeba histolytica
RFVGNDVVVVVFKEQLN

SEQ ID NO: 2725152 - protein, 18 aa, Entamoeba histolytica
RFVQGIFLVKYDPTIEDS

SEQ ID NO: 2725153 - protein, 18 aa, Entamoeba histolytica
RFVVLPEMFKNSPCLKSS

SEQ ID NO: 2725154 - protein, 31 aa, Entamoeba histolytica
RFYEEFLNVLKKWTGLEHFDLVFEYAVDGYD

SEQ ID NO: 2725155 - protein, 17 aa, Entamoeba histolytica
RFYRWTTTDDPETVNKQ

SEQ ID NO: 2725156 - protein, 18 aa, Entamoeba histolytica
RGAKGCVIVYDITSFQSF

SEQ ID NO: 2725157 - protein, 17 aa, Entamoeba histolytica
RGCADIKPPMTNPSSLN

SEQ ID NO: 2725158 - protein, 22 aa, Entamoeba histolytica
RGCFVVFAMEGNVYIWVGSLSH

SEQ ID NO: 2725159 - protein, 23 aa, Entamoeba histolytica
RGCILFCEVALGKQWETPKDKYM

SEQ ID NO: 2725160 - protein, 25 aa, Entamoeba histolytica
RGEDKYNFFLQATQLDIIKESYKQA

SEQ ID NO: 2725161 - protein, 26 aa, Entamoeba histolytica
RGEIPKFPIILNPYESFTIAFPIHLK

SEQ ID NO: 2725162 - protein, 20 aa, Entamoeba histolytica
RGEVYVICSQPKLLYQLKFK

SEQ ID NO: 2725163 - protein, 17 aa, Entamoeba histolytica
RGFGYVEFKTIEGAMKA

SEQ ID NO: 2725164 - protein, 31 aa, Entamoeba histolytica
RGFRSIEIVVLVFALKVKYPDRFFLLRGNHE

SEQ ID NO: 2725165 - protein, 25 aa, Entamoeba histolytica
RGGMSKFVILYNQKKVFLFEVAPLK

SEQ ID NO: 2725166 - protein, 26 aa, Entamoeba histolytica
RGGNQYMRTLWGKEVWMKTSVLRDDG

SEQ ID NO: 2725167 - protein, 17 aa, Entamoeba histolytica
RGGPFIIIICGDSNEVI

SEQ ID NO: 2725168 - protein, 21 aa, Entamoeba histolytica
RGHISKIYAMHWASDSTHLVS

SEQ ID NO: 2725169 - protein, 27 aa, Entamoeba histolytica
RGIDSFISIYAPKLMWKVRILQGNIDA

SEQ ID NO: 2725170 - protein, 17 aa, Entamoeba histolytica
RGIKIMNNNYYILVLLI

SEQ ID NO: 2725171 - protein, 17 aa, Entamoeba histolytica
RGILSLEYPMQKEPIDY

SEQ ID NO: 2725172 - protein, 31 aa, Entamoeba histolytica; identical to SEQ ID NO: 2537996

SEQ ID NO: 2725173 - protein, 24 aa, Entamoeba histolytica
RGIYGYVYCFLNGISIEILVAQVI

SEQ ID NO: 2725174 - protein, 26 aa, Entamoeba histolytica
RGKAIGYCFLTFTSAEDAYQFVEKVN

SEQ ID NO: 2725175 - protein, 23 aa, Entamoeba histolytica
RGKRSFNMGGMPRDFGGFSGFGM

SEQ ID NO: 2725176 - protein, 18 aa, Entamoeba histolytica
RGLCFHPNRPLVVSGGDD

SEQ ID NO: 2725177 - protein, 17 aa, Entamoeba histolytica
RGLEKKQRFTRVSELNN

SEQ ID NO: 2725178 - protein, 17 aa, Entamoeba histolytica
RGLLISHNLKRERGSKK

SEQ ID NO: 2725179 - protein, 26 aa, Entamoeba histolytica
RGMITYRIRQAFETVLRMKPKKMDMH

SEQ ID NO: 2725180 - protein, 22 aa, Entamoeba histolytica
RGNLFYPRSLKLSDYDSLCNLP

SEQ ID NO: 2725181 - protein, 30 aa, Entamoeba histolytica
RGNSAITLIPLLLDIRLWRGIEYLFEYYIK

SEQ ID NO: 2725182 - protein, 23 aa, Entamoeba histolytica
RGNTPFTRIFNSYTFKFCDELLK

SEQ ID NO: 2725183 - protein, 20 aa, Entamoeba histolytica
RGNVPIPKQIRFITHIQLFD

SEQ ID NO: 2725184 - protein, 24 aa, Entamoeba histolytica
RGRKKSENTFLQDRIRDFLNSNNG

SEQ ID NO: 2725185 - protein, 26 aa, Entamoeba histolytica
RGSEINGTYLNRIIIIKKQKITQENI

SEQ ID NO: 2725186 - protein, 22 aa, Entamoeba histolytica
RGSLEYWIIMEYCSFKSIDEYW

SEQ ID NO: 2725187 - protein, 22 aa, Entamoeba histolytica
RGSLMSLLRQYANLMVEGDRQI

SEQ ID NO: 2725188 - protein, 17 aa, Entamoeba histolytica
RGSLPIKVQSIALPITS

SEQ ID NO: 2725189 - protein, 18 aa, Entamoeba histolytica
RGSSFKLVSHFPSIIAYD

SEQ ID NO: 2725190 - protein, 33 aa, Entamoeba histolytica
RGTAGCGMYWMFGLLLSAGFKQVGVIPKGFQCD

SEQ ID NO: 2725191 - protein, 24 aa, Entamoeba histolytica
RGTKNAPPPPPPLEPKVVAPVSTV

SEQ ID NO: 2725192 - protein, 22 aa, Entamoeba histolytica
RGTSLCDIAVLVVDLMHGLEPQ

SEQ ID NO: 2725193 - protein, 19 aa, Entamoeba histolytica
RGVCLRFPRYIRSRDDKEV

SEQ ID NO: 2725194 - protein, 22 aa, Entamoeba histolytica
RGVLMTFQYLISLDGSPNTAKQ

SEQ ID NO: 2725195 - protein, 25 aa, Entamoeba histolytica
RGYDLEILYMLEIAALAIDLINTIQ

SEQ ID NO: 2725196 - protein, 25 aa, Entamoeba histolytica
RHAQYGYYWMIGSAKLSDYKDWCLY

SEQ ID NO: 2725197 - protein, 20 aa, Entamoeba histolytica
RHCVRPLETLLTKYKKIVVK

SEQ ID NO: 2725198 - protein, 19 aa, Entamoeba histolytica
RHDIFLRHKYQLKHMLYIK

SEQ ID NO: 2725199 - protein, 26 aa, Entamoeba histolytica
RHDYVQWVFPTFVKSMFNWNSYTLDK

SEQ ID NO: 2725200 - protein, 33 aa, Entamoeba histolytica
RHEEHTTFFGKDPGFFVFTLRNPHNIQPIKFIK

SEQ ID NO: 2725201 - protein, 21 aa, Entamoeba histolytica
RHGVNLCYTPMVLSKMFVESK

SEQ ID NO: 2725202 - protein, 28 aa, Entamoeba histolytica
RHIDKLKQWIGLTKYRIIYNTEVDEFTT

SEQ ID NO: 2725203 - protein, 21 aa, Entamoeba histolytica
RHIIVWDRRFTKGIKFFDLKA

SEQ ID NO: 2725204 - protein, 20 aa, Entamoeba histolytica
RHIPIPLDILDPPASQSLIT

SEQ ID NO: 2725205 - protein, 23 aa, Entamoeba histolytica
RHKDVLPLLKLRARKATIPAYTQ

SEQ ID NO: 2725206 - protein, 32 aa, Entamoeba histolytica
RHLDSLFYTFTIPVKLSLLITSPPYLTVLSPD

SEQ ID NO: 2725207 - protein, 32 aa, Entamoeba histolytica
RHMNILGHYFNRLVPVLILEIAEKYPRNLKII

SEQ ID NO: 2725208 - protein, 23 aa, Entamoeba histolytica
RHNGLYFMAFTDQNINSLLNGSL

SEQ ID NO: 2725209 - protein, 23 aa, Entamoeba histolytica
RHNGLYFMAFTDQNINSLLVVSF

SEQ ID NO: 2725210 - protein, 23 aa, Entamoeba histolytica
RHNSIKKILFKPLKAFGSAAKLT

SEQ ID NO: 2725211 - protein, 25 aa, Entamoeba histolytica
RHPQMFPGFLEMLIEYKKQGGIVCV

SEQ ID NO: 2725212 - protein, 24 aa, Entamoeba histolytica
RHQNKHINVILNNLIKELRNPNGK

SEQ ID NO: 2725213 - protein, 17 aa, Entamoeba histolytica
RHVFWDCYDIQLIDLLE

SEQ ID NO: 2725214 - protein, 18 aa, Entamoeba histolytica
RHVGNDVVVIVFLDPKRK

SEQ ID NO: 2725215 - protein, 18 aa, Entamoeba histolytica
RHYFDAVMSPFKSSVLKG

SEQ ID NO: 2725216 - protein, 23 aa, Entamoeba histolytica
RIAEYFMPFVFDFIDNFERITDI

SEQ ID NO: 2725217 - protein, 20 aa, Entamoeba histolytica
RIAFLKQQIRYAISKRAIKG

SEQ ID NO: 2725218 - protein, 18 aa, Entamoeba histolytica
RIARLIALKIIKINPNEI

SEQ ID NO: 2725219 - protein, 17 aa, Entamoeba histolytica
RICDDIVIPPRDSNPIK

SEQ ID NO: 2725220 - protein, 29 aa, Entamoeba histolytica
RICGRSNILIIVLTTKGYVFGSFSSIQIP

SEQ ID NO: 2725221 - protein, 17 aa, Entamoeba histolytica
RICLYWLRYDESTEEVI

SEQ ID NO: 2725222 - protein, 18 aa, Entamoeba histolytica
RICSKLSLLLSYISQEDI

SEQ ID NO: 2725223 - protein, 23 aa, Entamoeba histolytica
RIDETERRRKLVIEKSQETINQI

SEQ ID NO: 2725224 - protein, 34 aa, Entamoeba histolytica; identical to SEQ ID NO: 2538054

SEQ ID NO: 2725225 - protein, 24 aa, Entamoeba histolytica
RIDPFSCFTYYNPTLHLKLRTSIV

SEQ ID NO: 2725226 - protein, 18 aa, Entamoeba histolytica
RIEFLKSFNLEDLTPYTY

SEQ ID NO: 2725227 - protein, 18 aa, Entamoeba histolytica
RIEFVWVPEIVIDFTHVY

SEQ ID NO: 2725228 - protein, 26 aa, Entamoeba histolytica
RIEGILDYLISVTMFDSKRSTFEEGV

SEQ ID NO: 2725229 - protein, 19 aa, Entamoeba histolytica
RIEILIKAKSFFREAINAN

SEQ ID NO: 2725230 - protein, 29 aa, Entamoeba histolytica
RIERIPFEKILPFYNKVAILKIGVYNGTS

SEQ ID NO: 2725231 - protein, 31 aa, Entamoeba histolytica
RIETIKKIIVLLKPIHLMSIYHYVALTNNND

SEQ ID NO: 2725232 - protein, 24 aa, Entamoeba histolytica
RIETLDLFLRVLNQKTKYEPNDEV

SEQ ID NO: 2725233 - protein, 17 aa, Entamoeba histolytica
RIETTSTYLYIPVSFES

SEQ ID NO: 2725234 - protein, 17 aa, Entamoeba histolytica
RIFAMKILRKDIVKERK

SEQ ID NO: 2725235 - protein, 17 aa, Entamoeba histolytica
RIFLIASRPDRQNDREE

SEQ ID NO: 2725236 - protein, 17 aa, Entamoeba histolytica
RIFLKTHPKTKLPESMA

SEQ ID NO: 2725237 - protein, 18 aa, Entamoeba histolytica
RIFMNEPMLISIEIPKNL

SEQ ID NO: 2725238 - protein, 26 aa, Entamoeba histolytica
RIFMNEPMLISIKIPKNLKMINGKNI

SEQ ID NO: 2725239 - protein, 20 aa, Entamoeba histolytica
RIFMNEPVLISIEIPKNLKT

SEQ ID NO: 2725240 - protein, 21 aa, Entamoeba histolytica
RIFMNEPVLISIKILENLTII

SEQ ID NO: 2725241 - protein, 17 aa, Entamoeba histolytica
RIFYLIGKQTVDDLIWP

SEQ ID NO: 2725242 - protein, 23 aa, Entamoeba histolytica
RIGEGYCYRLYSSSVYENIFEEF

SEQ ID NO: 2725243 - protein, 17 aa, Entamoeba histolytica
RIGNSLRRMLDCSKSVR

SEQ ID NO: 2725244 - protein, 18 aa, Entamoeba histolytica
RIHGLFEVLKDKIYQIRG

SEQ ID NO: 2725245 - protein, 27 aa, Entamoeba histolytica
RIICGKKYWKKQAPKKCYDFIGGKYHD

SEQ ID NO: 2725246 - protein, 18 aa, Entamoeba histolytica
RIICLPDVFFERRKLWEQ

SEQ ID NO: 2725247 - protein, 20 aa, Entamoeba histolytica
RIIDGTLLVSDLNSPIVTTS

SEQ ID NO: 2725248 - protein, 24 aa, Entamoeba histolytica
RIIKQIIWYDVSYSRYLEEKKEMN

SEQ ID NO: 2725249 - protein, 19 aa, Entamoeba histolytica
RIIKQLNTLNWRRLNVHFR

SEQ ID NO: 2725250 - protein, 19 aa, Entamoeba histolytica
RIILFNYMTGVEIKSVVMK

SEQ ID NO: 2725251 - protein, 20 aa, Entamoeba histolytica
RIILVIGYIVGIFYHARNYK

SEQ ID NO: 2725252 - protein, 18 aa, Entamoeba histolytica
RIIQPIQPIKKELIDFHG

SEQ ID NO: 2725253 - protein, 25 aa, Entamoeba histolytica
RIIREMFELAKSKAPAIIFIDEIDA

SEQ ID NO: 2725254 - protein, 18 aa, Entamoeba histolytica
RIIRNEIPLLDYQEYLLF

SEQ ID NO: 2725255 - protein, 26 aa, Entamoeba histolytica
RIISFDKQLLLCSLNLFPEENVPEKY

SEQ ID NO: 2725256 - protein, 18 aa, Entamoeba histolytica
RIITARKDLLVFRNLKHF

SEQ ID NO: 2725257 - protein, 19 aa, Entamoeba histolytica
RIIYLDVFRTLKSPVYQNP

SEQ ID NO: 2725258 - protein, 20 aa, Entamoeba histolytica
RIKALLAALASFKVIKASIE

SEQ ID NO: 2725259 - protein, 21 aa, Entamoeba histolytica
RIKDWILSKHPSALYPEPYLL

SEQ ID NO: 2725260 - protein, 19 aa, Entamoeba histolytica
RIKEFQPAFPDLTRGEFYK

SEQ ID NO: 2725261 - protein, 28 aa, Entamoeba histolytica
RIKEKNIIWLFETIRLSVDMRISCFEQN

SEQ ID NO: 2725262 - protein, 19 aa, Entamoeba histolytica
RIKFIPTYLFVECDQHLIG

SEQ ID NO: 2725263 - protein, 17 aa, Entamoeba histolytica
RIKIFLTKTLNGKANLI

SEQ ID NO: 2725264 - protein, 19 aa, Entamoeba histolytica
RIKILTNTEEYLIEKIRET

SEQ ID NO: 2725265 - protein, 17 aa, Entamoeba histolytica
RIKKLLKMRDTIVCQIS

SEQ ID NO: 2725266 - protein, 22 aa, Entamoeba histolytica
RIKMIKELLTKKGEMPFFQFVL

SEQ ID NO: 2725267 - protein, 28 aa, Entamoeba histolytica
RIKNEKFFIRLTLTLVKLGNFNVASTIF

SEQ ID NO: 2725268 - protein, 17 aa, Entamoeba histolytica
RILGELFIIMGEWICNS

SEQ ID NO: 2725269 - protein, 19 aa, Entamoeba histolytica
RILPYPLNYKSQSGGFLGV

SEQ ID NO: 2725270 - protein, 24 aa, Entamoeba histolytica
RILVFDSINRFIVKTIPAMREARM

SEQ ID NO: 2725271 - protein, 17 aa, Entamoeba histolytica
RINALLTALTNFKVIKA

SEQ ID NO: 2725272 - protein, 17 aa, Entamoeba histolytica
RINKIEFYKPTQLSYSY

SEQ ID NO: 2725273 - protein, 24 aa, Entamoeba histolytica
RINKPDNYPLKRPSVFPHIEVSVE

SEQ ID NO: 2725274 - protein, 28 aa, Entamoeba histolytica
RINKQIFHNLSYYVLDTLIQEPENICCS

SEQ ID NO: 2725275 - protein, 19 aa, Entamoeba histolytica
RINLILQKEKNEPWSSFEK

SEQ ID NO: 2725276 - protein, 21 aa, Entamoeba histolytica
RINQFLFQHSTFRVELAPFAK

SEQ ID NO: 2725277 - protein, 30 aa, Entamoeba histolytica
RINRDMFIFIIDFLQFLVPFESLTKMDMDN

SEQ ID NO: 2725278 - protein, 18 aa, Entamoeba histolytica
RIPKEFIFFIDEIGYQLT

SEQ ID NO: 2725279 - protein, 23 aa, Entamoeba histolytica
RIPKLIWICYQQCLKKELLPNPL

SEQ ID NO: 2725280 - protein, 21 aa, Entamoeba histolytica
RIPKVVQLLQDFFNGKEPNKS

SEQ ID NO: 2725281 - protein, 21 aa, Entamoeba histolytica
RIPVLTWIHPQTRKVLLRSSQ

SEQ ID NO: 2725282 - protein, 20 aa, Entamoeba histolytica
RIQIIIPTILQCHETIKLKG

SEQ ID NO: 2725283 - protein, 21 aa, Entamoeba histolytica
RIRKHAKQPLLYSNITQDINK

SEQ ID NO: 2725284 - protein, 21 aa, Entamoeba histolytica
RIRKLKRQLYDKNGKLKEIKR

SEQ ID NO: 2725285 - protein, 17 aa, Entamoeba histolytica
RISDIFTTLIKRINSSN

SEQ ID NO: 2725286 - protein, 47 aa, Entamoeba histolytica
RISGKQLLVLTGFLPILFNGRKFGIPLLIGFPYDYPLSPPEIICNIS

SEQ ID NO: 2725287 - protein, 21 aa, Entamoeba histolytica
RISKPKITVSLYLFPEVDPKT

SEQ ID NO: 2725288 - protein, 24 aa, Entamoeba histolytica
RISLYRTLIESIGLTPLMVLDNET

SEQ ID NO: 2725289 - protein, 29 aa, Entamoeba histolytica
RISPSILEAFYKFKIPKATDFLHDFIDCF

SEQ ID NO: 2725290 - protein, 23 aa, Entamoeba histolytica
RISRMMMQYYPNGQSKGCCFIEF

SEQ ID NO: 2725291 - protein, 22 aa, Entamoeba histolytica
RISWDELFVHPFITQKLQCVFV

SEQ ID NO: 2725292 - protein, 29 aa, Entamoeba histolytica
RITAYNLDFFIYPFIYYQRIKNNPRSIQI

SEQ ID NO: 2725293 - protein, 23 aa, Entamoeba histolytica
RITEMCPGTFKYAFFIHTNENFH

SEQ ID NO: 2725294 - protein, 24 aa, Entamoeba histolytica
RITPDWMALIFKTTQYPGCLHEHH

SEQ ID NO: 2725295 - protein, 24 aa, Entamoeba histolytica
RIVECVFLFATECFKIYNIEPFPQ

SEQ ID NO: 2725296 - protein, 22 aa, Entamoeba histolytica
RIVELWKQHGIYTQLNKLKAIF

SEQ ID NO: 2725297 - protein, 18 aa, Entamoeba histolytica
RIVINREILQQMIAGFQQ

SEQ ID NO: 2725298 - protein, 21 aa, Entamoeba histolytica
RIVNGYLKKYQGKCIPMSFND

SEQ ID NO: 2725299 - protein, 32 aa, Entamoeba histolytica
RIVSVSLQFICNELYIRYLKLTNEQLGVIFEP

SEQ ID NO: 2725300 - protein, 25 aa, Entamoeba histolytica
RIVYKEKLIFVFKTENGFIGFYQSD

SEQ ID NO: 2725301 - protein, 20 aa, Entamoeba histolytica
RIWNLISFIIGNKIIEAYRK

SEQ ID NO: 2725302 - protein, 18 aa, Entamoeba histolytica
RIYNLPKILDERDLRRYF

SEQ ID NO: 2725303 - protein, 34 aa, Entamoeba histolytica; identical to SEQ ID NO: 2538149

SEQ ID NO: 2725304 - protein, 17 aa, Entamoeba histolytica
RIYVLSSSYLEDVVTRE

SEQ ID NO: 2725305 - protein, 26 aa, Entamoeba histolytica
RKANKERYFVLFNDILIYGEGNEHSV

SEQ ID NO: 2725306 - protein, 25 aa, Entamoeba histolytica
RKAPKPRYFVLCTDILFYTRPKKRE

SEQ ID NO: 2725307 - protein, 18 aa, Entamoeba histolytica
RKATIRGLFTQPSDAKWF

SEQ ID NO: 2725308 - protein, 24 aa, Entamoeba histolytica
RKATITIYLTLFCTIKLHGMKIPS

SEQ ID NO: 2725309 - protein, 18 aa, Entamoeba histolytica
RKAYYELYAMIKSAQMST

SEQ ID NO: 2725310 - protein, 22 aa, Entamoeba histolytica
RKCFRLINGVMVERTASEIIPA

SEQ ID NO: 2725311 - protein, 26 aa, Entamoeba histolytica
RKCYYGVIFVLKYMMVLDLMRKNMII

SEQ ID NO: 2725312 - protein, 24 aa, Entamoeba histolytica
RKDCFEIMYHVVPLLTERSATKLF

SEQ ID NO: 2725313 - protein, 20 aa, Entamoeba histolytica
RKDCILVAKTNERFVDVFCG

SEQ ID NO: 2725314 - protein, 28 aa, Entamoeba histolytica
RKDEIFSIPDFLWITKQKCWIEVDDFCA

SEQ ID NO: 2725315 - protein, 25 aa, Entamoeba histolytica
RKDEIQFLIDFLIKYPNMKAVKNSD

SEQ ID NO: 2725316 - protein, 25 aa, Entamoeba histolytica
RKDFKDPFFFKKNKIKKSKKVDDSS

SEQ ID NO: 2725317 - protein, 24 aa, Entamoeba histolytica
RKDKGKPLTFKQMKELYITRENAL

SEQ ID NO: 2725318 - protein, 26 aa, Entamoeba histolytica
RKDMVYGIFYCLSKIIKYLKGEEEKN

SEQ ID NO: 2725319 - protein, 18 aa, Entamoeba histolytica
RKDPLFRMKIPSATVVYR

SEQ ID NO: 2725320 - protein, 24 aa, Entamoeba histolytica
RKDTYFFLLSKRMNAKVVHLIPAI

SEQ ID NO: 2725321 - protein, 25 aa, Entamoeba histolytica
RKEDWHPYLLFCKVKRDSVVNDGIS

SEQ ID NO: 2725322 - protein, 19 aa, Entamoeba histolytica
RKEFSGTAIGRLCIGKDDQ

SEQ ID NO: 2725323 - protein, 46 aa, Entamoeba histolytica
RKEINFFHIELILQYLKILLKHQYYKEFQIIIKTLLLSLENPHFND

SEQ ID NO: 2725324 - protein, 19 aa, Entamoeba histolytica
RKENIVCTLIESGYASLKI

SEQ ID NO: 2725325 - protein, 18 aa, Entamoeba histolytica
RKESIYPQYFFTTFGIYN

SEQ ID NO: 2725326 - protein, 19 aa, Entamoeba histolytica
RKEWINLNGIWKYQITDII

SEQ ID NO: 2725327 - protein, 18 aa, Entamoeba histolytica
RKEYLLEVIQSITLPVLT

SEQ ID NO: 2725328 - protein, 18 aa, Entamoeba histolytica
RKFASWLGANLLDKENIG

SEQ ID NO: 2725329 - protein, 25 aa, Entamoeba histolytica
RKFELRFIVLMKYDVMWKSQKPDIY

SEQ ID NO: 2725330 - protein, 19 aa, Entamoeba histolytica
RKFSFHSFFILGMTKNQII

SEQ ID NO: 2725331 - protein, 20 aa, Entamoeba histolytica
RKFSYSAGACLYIICRRERS

SEQ ID NO: 2725332 - protein, 30 aa, Entamoeba histolytica
RKFTRKADGYSLWVFGSIDNLLSVNGAFVL

SEQ ID NO: 2725333 - protein, 25 aa, Entamoeba histolytica
RKGEIIVAAVVYLLSREYSDKKEIG

SEQ ID NO: 2725334 - protein, 21 aa, Entamoeba histolytica
RKGHIGILEWKTQKLINEFHV

SEQ ID NO: 2725335 - protein, 21 aa, Entamoeba histolytica
RKGYWIVLDELNLAPSEVLEA

SEQ ID NO: 2725336 - protein, 20 aa, Entamoeba histolytica
RKHLQPIHDKSLEKKIESQT

SEQ ID NO: 2725337 - protein, 20 aa, Entamoeba histolytica
RKHNLRPRIQSSKAVDFIDE

SEQ ID NO: 2725338 - protein, 22 aa, Entamoeba histolytica
RKIIDGLIKLLNNVILYQIGDK

SEQ ID NO: 2725339 - protein, 18 aa, Entamoeba histolytica
RKIILRFIVSLVEHILKT

SEQ ID NO: 2725340 - protein, 21 aa, Entamoeba histolytica
RKILEILVKNFLETLDEELPL

SEQ ID NO: 2725341 - protein, 31 aa, Entamoeba histolytica
RKILENIFSSMLFEYIWPPCYDKFQTSKEVV

SEQ ID NO: 2725342 - protein, 27 aa, Entamoeba histolytica
RKIMNIAIPPTIPFIGSTLTDLIYTSD

SEQ ID NO: 2725343 - protein, 24 aa, Entamoeba histolytica
RKIRDVLPNIPVHIPPSLDEKYWD

SEQ ID NO: 2725344 - protein, 26 aa, Entamoeba histolytica
RKIRITRPIIYSFIKGINNYRNLIHL

SEQ ID NO: 2725345 - protein, 21 aa, Entamoeba histolytica
RKIVQNIPNSAYFYITDDDRV

SEQ ID NO: 2725346 - protein, 31 aa, Entamoeba histolytica
RKKDLILNVVMYKNGFIVNDGPLRNYEDPNN

SEQ ID NO: 2725347 - protein, 19 aa, Entamoeba histolytica
RKKEIFKQQYQTALNEREQ

SEQ ID NO: 2725348 - protein, 23 aa, Entamoeba histolytica
RKKEPLFPSLGPSSTSLMNANNT

SEQ ID NO: 2725349 - protein, 17 aa, Entamoeba histolytica
RKKIKKGKEIKTIYVKF

SEQ ID NO: 2725350 - protein, 23 aa, Entamoeba histolytica
RKKQEEELWLRRLNELADEKNTA

SEQ ID NO: 2725351 - protein, 35 aa, Entamoeba histolytica
RKKQIKRIIKWFDMVFPKAVQLRWKIPDCTLENSP

SEQ ID NO: 2725352 - protein, 18 aa, Entamoeba histolytica
RKKRKLEQMTQELNFLKG

SEQ ID NO: 2725353 - protein, 22 aa, Entamoeba histolytica
RKKRNEIFYSLLKELYTSPSSA

SEQ ID NO: 2725354 - protein, 20 aa, Entamoeba histolytica
RKKYRIEKISEEIKIILSTN

SEQ ID NO: 2725355 - protein, 20 aa, Entamoeba histolytica
RKLEEKLNIWKALMQLEANH

SEQ ID NO: 2725356 - protein, 25 aa, Entamoeba histolytica
RKLFVSQLFCFYISYEDPINLRIEK

SEQ ID NO: 2725357 - protein, 27 aa, Entamoeba histolytica
RKLISILNLYWLVRLDCFEISSLQCPA

SEQ ID NO: 2725358 - protein, 25 aa, Entamoeba histolytica
RKLPKKTITELPKWTKPKPNDTEKD

SEQ ID NO: 2725359 - protein, 22 aa, Entamoeba histolytica
RKLPSKLLITTLNSIQSVLPNS

SEQ ID NO: 2725360 - protein, 30 aa, Entamoeba histolytica; identical to SEQ ID NO: 2518442

SEQ ID NO: 2725361 - protein, 26 aa, Entamoeba histolytica
RKMFLSACKLSDYKYVRALKSTVFVL

SEQ ID NO: 2725362 - protein, 24 aa, Entamoeba histolytica
RKMKNEFMSLWDGLKSKEMERVIV

SEQ ID NO: 2725363 - protein, 24 aa, Entamoeba histolytica
RKMKNEFMTLWDGLKSQNLEQIIV

SEQ ID NO: 2725364 - protein, 25 aa, Entamoeba histolytica
RKMNPHLKLPTRPFKRMTYADAIKY

SEQ ID NO: 2725365 - protein, 35 aa, Entamoeba histolytica
RKMNVLMEMGFPDYICIFALRKYKWNVEESIPWII

SEQ ID NO: 2725366 - protein, 25 aa, Entamoeba histolytica
RKMPLENVTLLRSILKLCSKIDSMS

SEQ ID NO: 2725367 - protein, 24 aa, Entamoeba histolytica
RKMYEKYFYFFNENEFKYDLKEDS

SEQ ID NO: 2725368 - protein, 26 aa, Entamoeba histolytica
RKNELLEETIDLWKKLRERAGIIRDE

SEQ ID NO: 2725369 - protein, 20 aa, Entamoeba histolytica
RKNLINKIKLHFNKVYLWEN

SEQ ID NO: 2725370 - protein, 22 aa, Entamoeba histolytica
RKNLVLLFETTKNALFGCYLEA

SEQ ID NO: 2725371 - protein, 28 aa, Entamoeba histolytica
RKNPRKVEFLIDEYIPYMHLKENTNTQP

SEQ ID NO: 2725372 - protein, 33 aa, Entamoeba histolytica; identical to SEQ ID NO: 2538203

SEQ ID NO: 2725373 - protein, 27 aa, Entamoeba histolytica
RKQITKEGFAYRKTLSCETDQSLNKVR

SEQ ID NO: 2725374 - protein, 20 aa, Entamoeba histolytica
RKQLYENAGLVSAPTISVNK

SEQ ID NO: 2725375 - protein, 24 aa, Entamoeba histolytica
RKQTTRFEMLRLQSDNIRNEKEFQ

SEQ ID NO: 2725376 - protein, 17 aa, Entamoeba histolytica
RKRIVNEYLVKHKNHQL

SEQ ID NO: 2725377 - protein, 23 aa, Entamoeba histolytica
RKRKILHRNIIKNELQNLREMLD

SEQ ID NO: 2725378 - protein, 18 aa, Entamoeba histolytica
RKRKKEIEEFKLFSAKKK

SEQ ID NO: 2725379 - protein, 24 aa, Entamoeba histolytica
RKRKKLFYEKFKSNALSETEDLKV

SEQ ID NO: 2725380 - protein, 20 aa, Entamoeba histolytica
RKRLPPKTKPLPQPNQTHQP

SEQ ID NO: 2725381 - protein, 20 aa, Entamoeba histolytica
RKRLYVIQLNKMLVEHFRKG

SEQ ID NO: 2725382 - protein, 21 aa, Entamoeba histolytica
RKRPLLTCEPITKCVRDLLVL

SEQ ID NO: 2725383 - protein, 22 aa, Entamoeba histolytica
RKRTGQMVFASSGKIVAAPPPL

SEQ ID NO: 2725384 - protein, 28 aa, Entamoeba histolytica
RKSDIWALGCLLFETAIGTPPFSAPLCI

SEQ ID NO: 2725385 - protein, 18 aa, Entamoeba histolytica
RKSEVRLDRKISCLHKVS

SEQ ID NO: 2725386 - protein, 28 aa, Entamoeba histolytica
RKSFERVRFLLKQLSFLEITRNFIVDII

SEQ ID NO: 2725387 - protein, 26 aa, Entamoeba histolytica
RKSIIQQIYYILPDLIFGINKQITEQ

SEQ ID NO: 2725388 - protein, 18 aa, Entamoeba histolytica
RKSIVPGAVLIIVAGKYA

SEQ ID NO: 2725389 - protein, 23 aa, Entamoeba histolytica
RKSNKTLLYYPIDFDAKICSLIS

SEQ ID NO: 2725390 - protein, 32 aa, Entamoeba histolytica
RKSNMNMHILFKIILKNTIHLSLSNYIILLKL

SEQ ID NO: 2725391 - protein, 23 aa, Entamoeba histolytica
RKSSEICQFLDLVRIYGKNINID

SEQ ID NO: 2725392 - protein, 28 aa, Entamoeba histolytica
RKSSKDFLILPYYLKLRMLYDTARGMSF

SEQ ID NO: 2725393 - protein, 33 aa, Entamoeba histolytica
RKSVVNEYIRFAFKLFIKIYYKDTWTDDDIRVL

SEQ ID NO: 2725394 - protein, 18 aa, Entamoeba histolytica
RKTEQYILELERSLSQID

SEQ ID NO: 2725395 - protein, 29 aa, Entamoeba histolytica
RKTIKPRYFYLFNDILIYGIGDSNNMVIS

SEQ ID NO: 2725396 - protein, 20 aa, Entamoeba histolytica
RKTLIPLIVLHLRKGEYPPQ

SEQ ID NO: 2725397 - protein, 25 aa, Entamoeba histolytica
RKTWDPFIIIKARDMLKLLSRGVPA

SEQ ID NO: 2725398 - protein, 22 aa, Entamoeba histolytica
RKYGNYWQQLMIGFVSLKGELE

SEQ ID NO: 2725399 - protein, 18 aa, Entamoeba histolytica
RKYKHFFEYFKVNPIDDI

SEQ ID NO: 2725400 - protein, 24 aa, Entamoeba histolytica
RKYKSFNVWKYCTEAFDYLGLAAI

SEQ ID NO: 2725401 - protein, 30 aa, Entamoeba histolytica
RKYKWNVEESIPWIIDNLRTFPKPESQENK

SEQ ID NO: 2725402 - protein, 26 aa, Entamoeba histolytica
RKYNELYLAIFKKVLFELIHPPQPGL

SEQ ID NO: 2725403 - protein, 18 aa, Entamoeba histolytica
RLACYKFPGRQKLLVSNK

SEQ ID NO: 2725404 - protein, 27 aa, Entamoeba histolytica
RLANNPQIFQIIINSIAPAIYGHDASK

SEQ ID NO: 2725405 - protein, 22 aa, Entamoeba histolytica
RLCANYGINKLYIVNPLCEIGE

SEQ ID NO: 2725406 - protein, 18 aa, Entamoeba histolytica
RLCGLGFGRSQCLQAYIA

SEQ ID NO: 2725407 - protein, 17 aa, Entamoeba histolytica
RLCKKNTALLLDCKTHQ

SEQ ID NO: 2725408 - protein, 28 aa, Entamoeba histolytica
RLDELCKTILLLIDSYNPHVRYGAALAL

SEQ ID NO: 2725409 - protein, 23 aa, Entamoeba histolytica
RLDQIEMFLPVLLQMNQFPQQQT

SEQ ID NO: 2725410 - protein, 26 aa, Entamoeba histolytica
RLDRCMRFLPQLQNTGGFFVAVLEKV

SEQ ID NO: 2725411 - protein, 19 aa, Entamoeba histolytica
RLDYMFHWKKPNENPVITC

SEQ ID NO: 2725412 - protein, 27 aa, Entamoeba histolytica
RLEASPALQYLYYLSQIGLAVSPLSNH

SEQ ID NO: 2725413 - protein, 17 aa, Entamoeba histolytica
RLEELTKYLNSPGIKDF

SEQ ID NO: 2725414 - protein, 21 aa, Entamoeba histolytica
RLEICYSDHLPVRCIAIIKPR

SEQ ID NO: 2725415 - protein, 19 aa, Entamoeba histolytica
RLEIFWEQFLLSVLSFCLK

SEQ ID NO: 2725416 - protein, 28 aa, Entamoeba histolytica
RLEIIINKWFIQKWKLQPNKVGEFCFEL

SEQ ID NO: 2725417 - protein, 20 aa, Entamoeba histolytica
RLEILTVLQLIIFSKSEQLI

SEQ ID NO: 2725418 - protein, 33 aa, Entamoeba histolytica
RLEQGYVLEYIKTIKWLLQVPQEIKEYTSQNYY

SEQ ID NO: 2725419 - protein, 25 aa, Entamoeba histolytica
RLETDLMCFYMIKGYKSFFQKRYFQ

SEQ ID NO: 2725420 - protein, 18 aa, Entamoeba histolytica
RLETLPYDLELSEPKQED

SEQ ID NO: 2725421 - protein, 17 aa, Entamoeba histolytica
RLFESYISLLKEGKTNE

SEQ ID NO: 2725422 - protein, 32 aa, Entamoeba histolytica
RLFEVFPRMNIKIREWLGLNPTTNLYSRIAVT

SEQ ID NO: 2725423 - protein, 18 aa, Entamoeba histolytica
RLFFTCFDHIIEGMTGFF

SEQ ID NO: 2725424 - protein, 20 aa, Entamoeba histolytica
RLFGAGYIFSASAPTFSCTA

SEQ ID NO: 2725425 - protein, 17 aa, Entamoeba histolytica
RLFIIKRVVKEDDLTQL

SEQ ID NO: 2725426 - protein, 18 aa, Entamoeba histolytica
RLFKKISDLLLSSGYYRV

SEQ ID NO: 2725427 - protein, 18 aa, Entamoeba histolytica
RLFNKEITLLLKTKQDTF

SEQ ID NO: 2725428 - protein, 29 aa, Entamoeba histolytica
RLFSKSINLALMLLVKIYISKYSITQFDK

SEQ ID NO: 2725429 - protein, 17 aa, Entamoeba histolytica
RLFSVYGQLLNIISDID

SEQ ID NO: 2725430 - protein, 22 aa, Entamoeba histolytica
RLGAVFSFLNMLQPYFTHLYPS

SEQ ID NO: 2725431 - protein, 38 aa, Entamoeba histolytica; identical to SEQ ID NO: 2538264

SEQ ID NO: 2725432 - protein, 17 aa, Entamoeba histolytica
RLGIPYLTKTLNEILMQ

SEQ ID NO: 2725433 - protein, 32 aa, Entamoeba histolytica
RLGNCPVKMIDFTKWIKSILKIEDTSFDLKKE

SEQ ID NO: 2725434 - protein, 24 aa, Entamoeba histolytica
RLGNDLPLIIFLSTKPEYREYAIK

SEQ ID NO: 2725435 - protein, 26 aa, Entamoeba histolytica
RLGYNEIMIVSKYFEYINDFINLEER

SEQ ID NO: 2725436 - protein, 35 aa, Entamoeba histolytica; identical to SEQ ID NO: 2538268

SEQ ID NO: 2725437 - protein, 28 aa, Entamoeba histolytica
RLHKKRSLLLLFLFKEDLTYPLNCRRFM

SEQ ID NO: 2725438 - protein, 18 aa, Entamoeba histolytica
RLIDVIRLYLYTGHVEMA

SEQ ID NO: 2725439 - protein, 17 aa, Entamoeba histolytica
RLIEIIGFTSANHFAVC

SEQ ID NO: 2725440 - protein, 34 aa, Entamoeba histolytica
RLIEIYFRLKDIKHWKYWNLMKWVVEHKLPESGS

SEQ ID NO: 2725441 - protein, 24 aa, Entamoeba histolytica
RLIERPPLKYLFQTNAFTTIDNIQ

SEQ ID NO: 2725442 - protein, 33 aa, Entamoeba histolytica
RLIPIEIPQLPEFVKHFSIKAIYSKFIINNKQL

SEQ ID NO: 2725443 - protein, 18 aa, Entamoeba histolytica
RLIPVYGENFDALVSNGF

SEQ ID NO: 2725444 - protein, 20 aa, Entamoeba histolytica
RLIRKAEHFIYIEQQYFLSN

SEQ ID NO: 2725445 - protein, 25 aa, Entamoeba histolytica
RLIYEQVFPLFPRDAFTYYINTEKH

SEQ ID NO: 2725446 - protein, 20 aa, Entamoeba histolytica
RLKDFPVELLQLPQLIELNL

SEQ ID NO: 2725447 - protein, 19 aa, Entamoeba histolytica
RLKFMMRNGLINNVTQCLD

SEQ ID NO: 2725448 - protein, 29 aa, Entamoeba histolytica
RLKKELAICNFYRNFLFMSRKTGFEQMEE

SEQ ID NO: 2725449 - protein, 19 aa, Entamoeba histolytica
RLKNALSLKDIKYNNDLDK

SEQ ID NO: 2725450 - protein, 26 aa, Entamoeba histolytica
RLKPNHPELPMWVSSNLRIVVETSND

SEQ ID NO: 2725451 - protein, 26 aa, Entamoeba histolytica
RLKRNRIIYSIHLLEDILGELGYSFK

SEQ ID NO: 2725452 - protein, 37 aa, Entamoeba histolytica
RLKVIKKLIPLIKTFDELIIINIFKILFSQSYCEKFA

SEQ ID NO: 2725453 - protein, 20 aa, Entamoeba histolytica
RLLELYLMTQDMEISCDCSN

SEQ ID NO: 2725454 - protein, 17 aa, Entamoeba histolytica
RLLFPDELQHWISGKSS

SEQ ID NO: 2725455 - protein, 26 aa, Entamoeba histolytica
RLLGAGFIFSASAPPFTCRAGKIAFE

SEQ ID NO: 2725456 - protein, 18 aa, Entamoeba histolytica
RLLGKLKEKPFLSTSIDM

SEQ ID NO: 2725457 - protein, 19 aa, Entamoeba histolytica
RLLGLSQETTQTGLFNYFF

SEQ ID NO: 2725458 - protein, 17 aa, Entamoeba histolytica
RLLKCWTLYNFDGGYQQ

SEQ ID NO: 2725459 - protein, 19 aa, Entamoeba histolytica
RLLMLLQYHIIPDDEIVAL

SEQ ID NO: 2725460 - protein, 21 aa, Entamoeba histolytica
RLLRVGIIDFIRTYTWDKQLE

SEQ ID NO: 2725461 - protein, 22 aa, Entamoeba histolytica
RLLVEGIELARQHLFDYLPKVV

SEQ ID NO: 2725462 - protein, 20 aa, Entamoeba histolytica
RLLWTYRSLVMKTKPRSIAR

SEQ ID NO: 2725463 - protein, 21 aa, Entamoeba histolytica
RLMKEVIKLYKRAEGTRIKKQ

SEQ ID NO: 2725464 - protein, 17 aa, Entamoeba histolytica
RLMMYKIISTTLCSNVV

SEQ ID NO: 2725465 - protein, 17 aa, Entamoeba histolytica
RLMNVLICTPGRLLYHL

SEQ ID NO: 2725466 - protein, 18 aa, Entamoeba histolytica
RLMYNTKRRFCLVPLTAE

SEQ ID NO: 2725467 - protein, 30 aa, Entamoeba histolytica
RLNCKNLHCLLLHNYPIFEKELKSIEGKTT

SEQ ID NO: 2725468 - protein, 25 aa, Entamoeba histolytica
RLNDNSLFWITPLISELSNLTFLGL

SEQ ID NO: 2725469 - protein, 19 aa, Entamoeba histolytica
RLNEQFLPIQLGPSFAERI

SEQ ID NO: 2725470 - protein, 17 aa, Entamoeba histolytica
RLNFVIEAPKIDIGEVT

SEQ ID NO: 2725471 - protein, 24 aa, Entamoeba histolytica
RLNKDKGYAFIKFSKHESATSAIL

SEQ ID NO: 2725472 - protein, 29 aa, Entamoeba histolytica
RLNQLAIKYKHLYLTNTQILLGIRISRCK

SEQ ID NO: 2725473 - protein, 27 aa, Entamoeba histolytica
RLNQLAIKYKHLYLTNTQILLGITISR

SEQ ID NO: 2725474 - protein, 22 aa, Entamoeba histolytica
RLNQLAIKYKHLYLTNTQSLLG

SEQ ID NO: 2725475 - protein, 18 aa, Entamoeba histolytica
RLPFKARYFISNSNYSQI

SEQ ID NO: 2725476 - protein, 26 aa, Entamoeba histolytica
RLPGESFLHFLQRKAKQQKKIERLEK

SEQ ID NO: 2725477 - protein, 23 aa, Entamoeba histolytica
RLPGIFNALLPHVKDFENIMKSR

SEQ ID NO: 2725478 - protein, 19 aa, Entamoeba histolytica
RLQFAQQLTLFDQAKLRSI

SEQ ID NO: 2725479 - protein, 17 aa, Entamoeba histolytica
RLRAERAAELERKKKEL

SEQ ID NO: 2725480 - protein, 18 aa, Entamoeba histolytica
RLRCSPQMRVVSRYGHFI

SEQ ID NO: 2725481 - protein, 18 aa, Entamoeba histolytica
RLRERKNIGMIDFDREFE

SEQ ID NO: 2725482 - protein, 19 aa, Entamoeba histolytica
RLRIGNILIYRTILEEAAV

SEQ ID NO: 2725483 - protein, 24 aa, Entamoeba histolytica
RLSKQFRIMIYTASKKEYADQVVS

SEQ ID NO: 2725484 - protein, 21 aa, Entamoeba histolytica
RLSLLTFVIPTMLGIGVICSD

SEQ ID NO: 2725485 - protein, 21 aa, Entamoeba histolytica
RLSRQARRLFRNAKKKVRRQL

SEQ ID NO: 2725486 - protein, 26 aa, Entamoeba histolytica
RLSWREFFAHQFVYRAMQHHAAQACF

SEQ ID NO: 2725487 - protein, 37 aa, Entamoeba histolytica
RLTQEYFSFQLEPHLPFFFKYPILFEPHSFVLEKDLS

SEQ ID NO: 2725488 - protein, 18 aa, Entamoeba histolytica
RLTSCGHMYCWRCLLQFL

SEQ ID NO: 2725489 - protein, 25 aa, Entamoeba histolytica
RLTSIMPHYITPKDIMYVGIRSIDV

SEQ ID NO: 2725490 - protein, 24 aa, Entamoeba histolytica
RLTSIRGIQPSQPKIQFAPNIRAA

SEQ ID NO: 2725491 - protein, 29 aa, Entamoeba histolytica
RLTSIRGIQPSQPKIQFAPNIRAAGFKPE

SEQ ID NO: 2725492 - protein, 20 aa, Entamoeba histolytica
RLVFMPTGPLQKFLIRRITL

SEQ ID NO: 2725493 - protein, 19 aa, Entamoeba histolytica
RLVKYFIGEIERTYKKDIS

SEQ ID NO: 2725494 - protein, 27 aa, Entamoeba histolytica
RLVTYLPKLKNICYCDHFVKQVIVVNH

SEQ ID NO: 2725495 - protein, 19 aa, Entamoeba histolytica
RLVVGAVQYPSLYKKFGVD

SEQ ID NO: 2725496 - protein, 24 aa, Entamoeba histolytica
RLWDSFISFPKDKLYLFLSATILI

SEQ ID NO: 2725497 - protein, 17 aa, Entamoeba histolytica
RLWNTVHFSEFFYSKNT

SEQ ID NO: 2725498 - protein, 19 aa, Entamoeba histolytica
RLYNKFKKAIDMMYPNEPY

SEQ ID NO: 2725499 - protein, 25 aa, Entamoeba histolytica
RLYVELTEKVTLLQALLNGEQPKEV

SEQ ID NO: 2725500 - protein, 19 aa, Entamoeba histolytica
RMCDNEYNCWPIINKQLKE

SEQ ID NO: 2725501 - protein, 20 aa, Entamoeba histolytica
RMDCDVPVVLLFVALGYEND

SEQ ID NO: 2725502 - protein, 29 aa, Entamoeba histolytica
RMDYYKNQLPYLFPGVPLTFIDHFPRDEN

SEQ ID NO: 2725503 - protein, 18 aa, Entamoeba histolytica
RMEKYWKINNIKVDYLIV

SEQ ID NO: 2725504 - protein, 24 aa, Entamoeba histolytica
RMELAGQLMSLLFEDLFKQFNTDL

SEQ ID NO: 2725505 - protein, 24 aa, Entamoeba histolytica
RMENLMYKYKRPFVLDLKIGTQTW

SEQ ID NO: 2725506 - protein, 24 aa, Entamoeba histolytica
RMEVSYMRMFHHPNIISFYGTIQT

SEQ ID NO: 2725507 - protein, 17 aa, Entamoeba histolytica
RMFNINQYISLVKEILE

SEQ ID NO: 2725508 - protein, 37 aa, Entamoeba histolytica; identical to SEQ ID NO: 2538335

SEQ ID NO: 2725509 - protein, 26 aa, Entamoeba histolytica
RMHAKIILNALLKRQLIIGPEGQNSF

SEQ ID NO: 2725510 - protein, 25 aa, Entamoeba histolytica
RMIAKYYHDITLSRFSQLLGISLEE

SEQ ID NO: 2725511 - protein, 29 aa, Entamoeba histolytica
RMIIEKMTFYNFKSYYDKVELGPFHESFT

SEQ ID NO: 2725512 - protein, 19 aa, Entamoeba histolytica
RMKEYFLSFFIKQEPSFDT

SEQ ID NO: 2725513 - protein, 19 aa, Entamoeba histolytica
RMKGVAAELLYFPDENHWV

SEQ ID NO: 2725514 - protein, 24 aa, Entamoeba histolytica
RMKLFPNVGLLYPVGMNALAAATD

SEQ ID NO: 2725515 - protein, 31 aa, Entamoeba histolytica
RMKSYVDCVKGILFIHKITLKLQRIDSIQKY

SEQ ID NO: 2725516 - protein, 41 aa, Entamoeba histolytica
RMKYLAHARKAMKDKNFAMARDDLQKLKKLLTDALDDPELD

SEQ ID NO: 2725517 - protein, 31 aa, Entamoeba histolytica
RMLEGACPISLPKLIYIKELGEVMGKLGYED

SEQ ID NO: 2725518 - protein, 26 aa, Entamoeba histolytica
RMLKGEIFPFLEFFPHDSSDLNPLND

SEQ ID NO: 2725519 - protein, 18 aa, Entamoeba histolytica
RMLMNFNDFLWNGSKMVV

SEQ ID NO: 2725520 - protein, 20 aa, Entamoeba histolytica
RMNENCFIQCLITSKAFKEE

SEQ ID NO: 2725521 - protein, 20 aa, Entamoeba histolytica
RMNYKDQLLIVDEWKSKVII

SEQ ID NO: 2725522 - protein, 22 aa, Entamoeba histolytica
RMPIHLFTYIHGISYHLLEIVI

SEQ ID NO: 2725523 - protein, 20 aa, Entamoeba histolytica
RMRARGVLLSNIKWNENDEL

SEQ ID NO: 2725524 - protein, 26 aa, Entamoeba histolytica
RMRDDYAKLIFILQDITVNSINEELG

SEQ ID NO: 2725525 - protein, 23 aa, Entamoeba histolytica
RMRNEMFKLFTKVERVKTVDQEY

SEQ ID NO: 2725526 - protein, 32 aa, Entamoeba histolytica
RMSDRVNEICFWVASLILSFPDLNNRAKMMTK

SEQ ID NO: 2725527 - protein, 25 aa, Entamoeba histolytica
RMSKIVLLRSILIRREIYKKNIKDM

SEQ ID NO: 2725528 - protein, 24 aa, Entamoeba histolytica
RMSRDYMILTRNDSKIYPLTSKCV

SEQ ID NO: 2725529 - protein, 30 aa, Entamoeba histolytica
RNAFTMFDQLFRYFGLKKAEYLQAGFKNLV

SEQ ID NO: 2725530 - protein, 23 aa, Entamoeba histolytica
RNAIFTFNYAYVYNPVDQEVVNL

SEQ ID NO: 2725531 - protein, 24 aa, Entamoeba histolytica
RNALTIIVRNRVAYYLQVLEQSKS

SEQ ID NO: 2725532 - protein, 24 aa, Entamoeba histolytica
RNAMVYHKILKWNDIIMVCSDGIH

SEQ ID NO: 2725533 - protein, 18 aa, Entamoeba histolytica
RNAQQLRIMLMEASVNIS

SEQ ID NO: 2725534 - protein, 35 aa, Entamoeba histolytica
RNDLNMAYHILRNSYQIIYEVIQSTAPKSVAELNT

SEQ ID NO: 2725535 - protein, 24 aa, Entamoeba histolytica
RNDYKRIKEFYKTKPPYLHSQLDF

SEQ ID NO: 2725536 - protein, 18 aa, Entamoeba histolytica
RNEDELVILLKAIVLGDE

SEQ ID NO: 2725537 - protein, 29 aa, Entamoeba histolytica
RNEETLVYNGLLYLLVKMGFDAQVKKTKK

SEQ ID NO: 2725538 - protein, 25 aa, Entamoeba histolytica
RNETAPICILVFLPGMAEIEEMKSR

SEQ ID NO: 2725539 - protein, 25 aa, Entamoeba histolytica
RNETLYVYHLLLPFVQKLSISIDND

SEQ ID NO: 2725540 - protein, 25 aa, Entamoeba histolytica
RNEVEFLRKYIWISRQHFQIEIKGE

SEQ ID NO: 2725541 - protein, 18 aa, Entamoeba histolytica
RNEYQFGIISRINEIERK

SEQ ID NO: 2725542 - protein, 36 aa, Entamoeba histolytica
RNGKIILSGIKILNKLLLLSFPSQEIIYPSIIKAAE

SEQ ID NO: 2725543 - protein, 24 aa, Entamoeba histolytica
RNGKLWAGYIDYIIMKYGDDIEVS

SEQ ID NO: 2725544 - protein, 29 aa, Entamoeba histolytica
RNGRLLISLPILNICPYSLLLHSISFDKT

SEQ ID NO: 2725545 - protein, 17 aa, Entamoeba histolytica
RNHFNFNFIKNSRKNLL

SEQ ID NO: 2725546 - protein, 19 aa, Entamoeba histolytica
RNHHKDQLFLSLDLNNTLS

SEQ ID NO: 2725547 - protein, 26 aa, Entamoeba histolytica
RNHLQPLFVKLIFSSLINYVQPSSRI

SEQ ID NO: 2725548 - protein, 17 aa, Entamoeba histolytica
RNHLRKVGVTSFKKISM

SEQ ID NO: 2725549 - protein, 25 aa, Entamoeba histolytica
RNIPPTIIELPQLKALILNNNNINT

SEQ ID NO: 2725550 - protein, 18 aa, Entamoeba histolytica
RNISVWETSLKKSKGVKE

SEQ ID NO: 2725551 - protein, 28 aa, Entamoeba histolytica
RNIVRRMFSILAKNGWWEKLGGMDGLME

SEQ ID NO: 2725552 - protein, 20 aa, Entamoeba histolytica
RNKCCFTSDGKYLFIASKED

SEQ ID NO: 2725553 - protein, 26 aa, Entamoeba histolytica
RNKCGKYLFTLGMISSWNNGEIETAW

SEQ ID NO: 2725554 - protein, 28 aa, Entamoeba histolytica
RNKMEHWYVQLILLAPPNQRLGILKRII

SEQ ID NO: 2725555 - protein, 27 aa, Entamoeba histolytica
RNKSLLQRWRFEREPFPLELNEYQQKT

SEQ ID NO: 2725556 - protein, 31 aa, Entamoeba histolytica
RNKVYAYGELFYLLNLYSDNIKWFFIDFDPA

SEQ ID NO: 2725557 - protein, 27 aa, Entamoeba histolytica
RNLCKDYLLIVRKSIKDLVPKAVIHFL

SEQ ID NO: 2725558 - protein, 18 aa, Entamoeba histolytica
RNLFSKYLSLRRQELEMA

SEQ ID NO: 2725559 - protein, 23 aa, Entamoeba histolytica
RNLQHLTELFISYGYCKVEHFMS

SEQ ID NO: 2725560 - protein, 19 aa, Entamoeba histolytica
RNMGEGQTLMVLPFKNMIV

SEQ ID NO: 2725561 - protein, 26 aa, Entamoeba histolytica
RNMKRYLPDTLLVDKLIEAMKLSGVE

SEQ ID NO: 2725562 - protein, 23 aa, Entamoeba histolytica
RNNKFIYNLKQYGNIYGYITIKF

SEQ ID NO: 2725563 - protein, 32 aa, Entamoeba histolytica
RNNNHPATFIIKARIKIIKTNDLTYYGCETCR

SEQ ID NO: 2725564 - protein, 24 aa, Entamoeba histolytica
RNQHQSVFGFFTKASIQPTTHWQL

SEQ ID NO: 2725565 - protein, 33 aa, Entamoeba histolytica
RNQNEMTIIANQAWIVMKIVDENWIIGKRSGVE

SEQ ID NO: 2725566 - protein, 18 aa, Entamoeba histolytica
RNRAECNPFLLFCKDHKE

SEQ ID NO: 2725567 - protein, 29 aa, Entamoeba histolytica
RNRESAFNSFLSWILIEKGIKLICRISSQ

SEQ ID NO: 2725568 - protein, 20 aa, Entamoeba histolytica
RNRFNQIYKIKLGKSLDLSK

SEQ ID NO: 2725569 - protein, 21 aa, Entamoeba histolytica
RNRHVMCFCFDITKKASFSSI

SEQ ID NO: 2725570 - protein, 17 aa, Entamoeba histolytica
RNRIEILIKAKSFFREA

SEQ ID NO: 2725571 - protein, 25 aa, Entamoeba histolytica
RNRRNEWFIKQFHPINLRERRMAKQ

SEQ ID NO: 2725572 - protein, 20 aa, Entamoeba histolytica
RNSLVEYGLPIVIKDGAWIG

SEQ ID NO: 2725573 - protein, 21 aa, Entamoeba histolytica
RNSLVEYGLPIVIKDGAWIGA

SEQ ID NO: 2725574 - protein, 22 aa, Entamoeba histolytica
RNSSYFPFKNVTIAVVVFNSQD

SEQ ID NO: 2725575 - protein, 27 aa, Entamoeba histolytica
RNTIDCGVFMLYFIDKIARTNPATLLE

SEQ ID NO: 2725576 - protein, 30 aa, Entamoeba histolytica; identical to SEQ ID NO: 2538401

SEQ ID NO: 2725577 - protein, 18 aa, Entamoeba histolytica
RNTVVIALFIMLHHFMDD

SEQ ID NO: 2725578 - protein, 27 aa, Entamoeba histolytica
RNVISWQYICRVIFYCLSVIHKKNGYF

SEQ ID NO: 2725579 - protein, 30 aa, Entamoeba histolytica
RNVISWQYICRVIFYCLSVIYKKNGYFSLK

SEQ ID NO: 2725580 - protein, 26 aa, Entamoeba histolytica
RNVNVFLFNDNLVIAKILTTGTLHKG

SEQ ID NO: 2725581 - protein, 18 aa, Entamoeba histolytica
RNVPGACSLLINTMQHDL

SEQ ID NO: 2725582 - protein, 18 aa, Entamoeba histolytica
RNVQFFRSAFIYAKIKTA

SEQ ID NO: 2725583 - protein, 25 aa, Entamoeba histolytica
RNVSLPSLFVFSMKDQYIPFDNTQY

SEQ ID NO: 2725584 - protein, 23 aa, Entamoeba histolytica
RNVTKFLYGLREGLGQLLKKIPE

SEQ ID NO: 2725585 - protein, 20 aa, Entamoeba histolytica
RNWIIRTLTPIIVLPYEHIL

SEQ ID NO: 2725586 - protein, 25 aa, Entamoeba histolytica
RNYCYRQELCSMFPPLVIESLINKY

SEQ ID NO: 2725587 - protein, 19 aa, Entamoeba histolytica
RNYELVNRKPKVLSYALDC

SEQ ID NO: 2725588 - protein, 24 aa, Entamoeba histolytica
RNYHAICGIVFAFVRIPEIEQLKL

SEQ ID NO: 2725589 - protein, 27 aa, Entamoeba histolytica
RNYHRRKIIIEFISWIFGEVKSMDEGL

SEQ ID NO: 2725590 - protein, 23 aa, Entamoeba histolytica
RNYIPLSHFKWKKQIKEKRMFDL

SEQ ID NO: 2725591 - protein, 24 aa, Entamoeba histolytica
RNYQVYQQALFLGILNQSSSMIIQ

SEQ ID NO: 2725592 - protein, 25 aa, Entamoeba histolytica
RNYQVYQQALFLGILNQSSSMIIQK

SEQ ID NO: 2725593 - protein, 25 aa, Entamoeba histolytica
RPCCFKFLHIPIQSGSTSVLDAMKR

SEQ ID NO: 2725594 - protein, 22 aa, Entamoeba histolytica
RPDDIFIRILSICLIKFDSILP

SEQ ID NO: 2725595 - protein, 20 aa, Entamoeba histolytica
RPDDSPFNLIKLLLELKEAT

SEQ ID NO: 2725596 - protein, 24 aa, Entamoeba histolytica
RPFEQLMSVLPPRSKSCLPYQFHD

SEQ ID NO: 2725597 - protein, 23 aa, Entamoeba histolytica
RPGGGYYLIMQKFKTNAILFDTF

SEQ ID NO: 2725598 - protein, 23 aa, Entamoeba histolytica
RPGPSNMKLTYLESWKAVELSNA

SEQ ID NO: 2725599 - protein, 26 aa, Entamoeba histolytica
RPIKNEQLLQLIFKAIDIDGNGEIDL

SEQ ID NO: 2725600 - protein, 31 aa, Entamoeba histolytica
RPINLEFEKVFFPYLLISKKRYAGLYFNRAD

SEQ ID NO: 2725601 - protein, 24 aa, Entamoeba histolytica
RPIQALHHPFITREIFNGSFEVPR

SEQ ID NO: 2725602 - protein, 23 aa, Entamoeba histolytica
RPKKLFVKLHNRQIQTPRGDTSD

SEQ ID NO: 2725603 - protein, 22 aa, Entamoeba histolytica
RPKRDIIMGVAYLEWARNKYSQ

SEQ ID NO: 2725604 - protein, 18 aa, Entamoeba histolytica
RPKRIQYFQDNYGFICDC

SEQ ID NO: 2725605 - protein, 18 aa, Entamoeba histolytica
RPKTMNLTMAGSRLSEKL

SEQ ID NO: 2725606 - protein, 18 aa, Entamoeba histolytica
RPLIEVPVVFIQEWTKYI

SEQ ID NO: 2725607 - protein, 18 aa, Entamoeba histolytica
RPLILQLVNLPSTETKEW

SEQ ID NO: 2725608 - protein, 25 aa, Entamoeba histolytica
RPLNQRFKFELIDKTIKTFQVNVTL

SEQ ID NO: 2725609 - protein, 24 aa, Entamoeba histolytica
RPLSNVICLWQSSSPYRSLLLNEV

SEQ ID NO: 2725610 - protein, 20 aa, Entamoeba histolytica
RPLYQRTFTTFAKLWKLQQT

SEQ ID NO: 2725611 - protein, 27 aa, Entamoeba histolytica
RPMQLQILSRKQAFLEMLIFADKHGYK

SEQ ID NO: 2725612 - protein, 30 aa, Entamoeba histolytica
RPNAAQILHYTFLLPILSELHYQTKSIYVS

SEQ ID NO: 2725613 - protein, 21 aa, Entamoeba histolytica
RPQAFFKGLIFPLCQEKDVTL

SEQ ID NO: 2725614 - protein, 17 aa, Entamoeba histolytica
RPRFFYFEESKTHEFDL

SEQ ID NO: 2725615 - protein, 33 aa, Entamoeba histolytica; identical to SEQ ID NO: 2538444

SEQ ID NO: 2725616 - protein, 17 aa, Entamoeba histolytica
RPSLLLEISLTLNSPIL

SEQ ID NO: 2725617 - protein, 18 aa, Entamoeba histolytica
RPSNIILSLSRTIKLTNF

SEQ ID NO: 2725618 - protein, 26 aa, Entamoeba histolytica
RPSNNQMYWVRFGPRDNQLVSLDKIK

SEQ ID NO: 2725619 - protein, 17 aa, Entamoeba histolytica
RPTQPLRPMPSSSLQII

SEQ ID NO: 2725620 - protein, 24 aa, Entamoeba histolytica
RPVDKPLRLPLQDVYKISGIGTVP

SEQ ID NO: 2725621 - protein, 25 aa, Entamoeba histolytica
RPVPLSTRPNLFMQNSYGYSPISAF

SEQ ID NO: 2725622 - protein, 26 aa, Entamoeba histolytica
RQAINKQIVLLILQSCYELSQESDVT

SEQ ID NO: 2725623 - protein, 18 aa, Entamoeba histolytica
RQAQPIYIQPTQPQFVPV

SEQ ID NO: 2725624 - protein, 39 aa, Entamoeba histolytica
RQCGIMDQSLPFFMFEWNYLWFIHSLKFELAIRVFDVIL

SEQ ID NO: 2725625 - protein, 31 aa, Entamoeba histolytica
RQDNQITLKFIRMYRLFINFLGGDIVDLSTG

SEQ ID NO: 2725626 - protein, 29 aa, Entamoeba histolytica
RQEINEYRIYVPTFICNCFKEIMNSHGIE

SEQ ID NO: 2725627 - protein, 23 aa, Entamoeba histolytica
RQELPPHIFALSEETYRNMKNEK

SEQ ID NO: 2725628 - protein, 27 aa, Entamoeba histolytica
RQENNLFQTVVIPQSYRNKTFQCSIPC

SEQ ID NO: 2725629 - protein, 20 aa, Entamoeba histolytica
RQFHPSTMWASFSYLSLYVK

SEQ ID NO: 2725630 - protein, 29 aa, Entamoeba histolytica
RQINYLPSPFFNNLIISLKTWLSIHPDKP

SEQ ID NO: 2725631 - protein, 23 aa, Entamoeba histolytica
RQIQTSFVYEPPPGYSVFMEQKT

SEQ ID NO: 2725632 - protein, 19 aa, Entamoeba histolytica
RQITSKTQTIKLLKEKEKQ

SEQ ID NO: 2725633 - protein, 29 aa, Entamoeba histolytica
RQKLMEKEDSILLLHQFFGENNEMVNKFI

SEQ ID NO: 2725634 - protein, 21 aa, Entamoeba histolytica
RQKRICGQTTLYYGTVKDALE

SEQ ID NO: 2725635 - protein, 27 aa, Entamoeba histolytica
RQKVESFFDLFYTPALPENLNLEEMEE

SEQ ID NO: 2725636 - protein, 39 aa, Entamoeba histolytica
RQLDIMDFLVKPIQRITKYPLFIREIKPLLVSIDTIELG

SEQ ID NO: 2725637 - protein, 25 aa, Entamoeba histolytica
RQLEGIINIYLDPFANFVQLLDSKP

SEQ ID NO: 2725638 - protein, 24 aa, Entamoeba histolytica
RQLNIQLYPIIFKRDSFISFCEVL

SEQ ID NO: 2725639 - protein, 17 aa, Entamoeba histolytica
RQLYDKNGKLKEIKRLP

SEQ ID NO: 2725640 - protein, 24 aa, Entamoeba histolytica
RQMICMARALLKGAKILIMDEATA

SEQ ID NO: 2725641 - protein, 23 aa, Entamoeba histolytica
RQPLIALKVLLPLLKVPMPALNV

SEQ ID NO: 2725642 - protein, 33 aa, Entamoeba histolytica
RQQDLFFFHVLSPGSCFWLPHGTRIYNKLVELM

SEQ ID NO: 2725643 - protein, 19 aa, Entamoeba histolytica
RQQIKNTEQLLEQLKKEEQ

SEQ ID NO: 2725644 - protein, 20 aa, Entamoeba histolytica
RQQVFELHRSTGLAKIPLIQ

SEQ ID NO: 2725645 - protein, 20 aa, Entamoeba histolytica
RQRATITQLKRHKFLTQVED

SEQ ID NO: 2725646 - protein, 27 aa, Entamoeba histolytica
RQRIEGALFNYYLVEHWAPLEHILKKY

SEQ ID NO: 2725647 - protein, 24 aa, Entamoeba histolytica
RQSIYSCNPIGTLNPSYNCNINNS

SEQ ID NO: 2725648 - protein, 26 aa, Entamoeba histolytica
RQSVASLLTIPFITQNRFIAIINTLE

SEQ ID NO: 2725649 - protein, 23 aa, Entamoeba histolytica
RQTVIKNYLFLDDYYEATTLGTI

SEQ ID NO: 2725650 - protein, 33 aa, Entamoeba histolytica; identical to SEQ ID NO: 2538470

SEQ ID NO: 2725651 - protein, 24 aa, Entamoeba histolytica
RQTVQFLSYLHSRGIIHCDIKPEN

SEQ ID NO: 2725652 - protein, 19 aa, Entamoeba histolytica
RQWINLNNKDCLYPYPFLS

SEQ ID NO: 2725653 - protein, 35 aa, Entamoeba histolytica
RQYYKKAIADAPFILSAGEQPLLAPKLDPITNQMI

SEQ ID NO: 2725654 - protein, 25 aa, Entamoeba histolytica
RRAGFAYRAPFARFLQTYKKLSPKT

SEQ ID NO: 2725655 - protein, 19 aa, Entamoeba histolytica
RRDIKKYRYLKKTLHITLI

SEQ ID NO: 2725656 - protein, 25 aa, Entamoeba histolytica
RREAMRFLQDILIEFGYFVEVEIET

SEQ ID NO: 2725657 - protein, 18 aa, Entamoeba histolytica
RREFIINGNKIIYASLDA

SEQ ID NO: 2725658 - protein, 23 aa, Entamoeba histolytica
RRENWLIKVWSMVCLARLIEQET

SEQ ID NO: 2725659 - protein, 23 aa, Entamoeba histolytica
RREREEFYRKAGLKGLEKEMERE

SEQ ID NO: 2725660 - protein, 20 aa, Entamoeba histolytica
RRETFESLDYWIDLTRKSGG

SEQ ID NO: 2725661 - protein, 21 aa, Entamoeba histolytica
RRFNHMSSWGVLLMTIRVGAC

SEQ ID NO: 2725662 - protein, 26 aa, Entamoeba histolytica
RRFSLKTVLMLLNQMLKRLQFVHSKG

SEQ ID NO: 2725663 - protein, 25 aa, Entamoeba histolytica
RRGNSFRQTLLWLTEELNKERKRQK

SEQ ID NO: 2725664 - protein, 31 aa, Entamoeba histolytica
RRINKFSYWIEPIMSNFLYESPMILYSPQQR

SEQ ID NO: 2725665 - protein, 33 aa, Entamoeba histolytica
RRINMIMQTVFFKLANVIPFEKAIVLLKEAVQK

SEQ ID NO: 2725666 - protein, 28 aa, Entamoeba histolytica
RRKHDYMPLALNLILFLGKRHKLEQEIE

SEQ ID NO: 2725667 - protein, 17 aa, Entamoeba histolytica
RRKHSIILPQHLTSITI

SEQ ID NO: 2725668 - protein, 25 aa, Entamoeba histolytica
RRKIELLCKGICKRTEYPCLQCMKD

SEQ ID NO: 2725669 - protein, 21 aa, Entamoeba histolytica
RRKLAEEAALLMAQFMGDSSE

SEQ ID NO: 2725670 - protein, 17 aa, Entamoeba histolytica
RRKMMRIIQARKAARLR

SEQ ID NO: 2725671 - protein, 22 aa, Entamoeba histolytica
RRKNIPLVRKIYGAAIGWCHKD

SEQ ID NO: 2725672 - protein, 43 aa, Entamoeba histolytica
RRLGRTFIRFCEELKFDLPFVDPCLYLQRFGEDLSFEKTGDVV

SEQ ID NO: 2725673 - protein, 30 aa, Entamoeba histolytica
RRLIGRLPEILKIYPQLIVVLQKVDVIMQL

SEQ ID NO: 2725674 - protein, 25 aa, Entamoeba histolytica
RRLNAIKMIYINILGYEVDVGFIEI

SEQ ID NO: 2725675 - protein, 25 aa, Entamoeba histolytica
RRLVKRLYIPLPDIEARMTLVKTLL

SEQ ID NO: 2725676 - protein, 20 aa, Entamoeba histolytica
RRLVQRLMPATYDGYIVYII

SEQ ID NO: 2725677 - protein, 22 aa, Entamoeba histolytica
RRNAILLFALLNNDSIKREESL

SEQ ID NO: 2725678 - protein, 26 aa, Entamoeba histolytica
RRPMNNDQFLIIKNATLLCVLKDVLL

SEQ ID NO: 2725679 - protein, 21 aa, Entamoeba histolytica
RRQIVDLHKWAPYLKSEEGFG

SEQ ID NO: 2725680 - protein, 23 aa, Entamoeba histolytica
RRQTLAEFLFISNSPEPVEENVI

SEQ ID NO: 2725681 - protein, 26 aa, Entamoeba histolytica
RRRIINPHFAAMYVYLLKPGEGMLYT

SEQ ID NO: 2725682 - protein, 34 aa, Entamoeba histolytica
RRRKIMKEFLEDLLFEYGIIFIDSTNRVTTINRT

SEQ ID NO: 2725683 - protein, 24 aa, Entamoeba histolytica
RRRKKFERPLESPKRSNSTVSTSS

SEQ ID NO: 2725684 - protein, 25 aa, Entamoeba histolytica
RRRLRSYVIELKQKELNPWNSYVLL

SEQ ID NO: 2725685 - protein, 35 aa, Entamoeba histolytica
RRRMNKSVIFFILNYLLDLLREFGFFFDSIYAKKT

SEQ ID NO: 2725686 - protein, 28 aa, Entamoeba histolytica
RRRTKDYILLAWYYSPALAVGYYNRFPT

SEQ ID NO: 2725687 - protein, 18 aa, Entamoeba histolytica
RRSIFIDCPLFKSKKKPS

SEQ ID NO: 2725688 - protein, 19 aa, Entamoeba histolytica
RRTCFKYFFQLCFEDYIQV

SEQ ID NO: 2725689 - protein, 20 aa, Entamoeba histolytica
RRTEDMVYLLNSLVLDMNEV

SEQ ID NO: 2725690 - protein, 17 aa, Entamoeba histolytica
RRTVPPGFFTPSPTGVS

SEQ ID NO: 2725691 - protein, 18 aa, Entamoeba histolytica
RRVNGIINITRSLGDKEL

SEQ ID NO: 2725692 - protein, 24 aa, Entamoeba histolytica
RRVNRLPRKYLEIALTELYSHSSL

SEQ ID NO: 2725693 - protein, 22 aa, Entamoeba histolytica
RRYEYNLTVLRCCCSILANVGP

SEQ ID NO: 2725694 - protein, 23 aa, Entamoeba histolytica
RRYIRVTTICRLFTSISSEGLNR

SEQ ID NO: 2725695 - protein, 20 aa, Entamoeba histolytica
RRYLRHIKGCPNNPARKSTY

SEQ ID NO: 2725696 - protein, 21 aa, Entamoeba histolytica
RSAAAVGYYPPYQGYADGGIF

SEQ ID NO: 2725697 - protein, 24 aa, Entamoeba histolytica
RSCFHFPGRYNLVQTLACEESGAG

SEQ ID NO: 2725698 - protein, 17 aa, Entamoeba histolytica
RSCLQKPVALKSAISVF

SEQ ID NO: 2725699 - protein, 17 aa, Entamoeba histolytica
RSCLWVCKQLRSLKISQ

SEQ ID NO: 2725700 - protein, 49 aa, Entamoeba histolytica
RSDEKKIILLTSCGLREIECKNKLDRDLWLSTIETIRVLCIQSNEKYLS

SEQ ID NO: 2725701 - protein, 27 aa, Entamoeba histolytica
RSDEKKIWNLNRSLLRQFNSCIVHMES

SEQ ID NO: 2725702 - protein, 25 aa, Entamoeba histolytica
RSDTKLLWLHYPQRSICQCALMEPF

SEQ ID NO: 2725703 - protein, 24 aa, Entamoeba histolytica
RSECQKLLTLLTELDKSNITTVTL

SEQ ID NO: 2725704 - protein, 20 aa, Entamoeba histolytica
RSEEEIEMLLTWACSLLPIN

SEQ ID NO: 2725705 - protein, 20 aa, Entamoeba histolytica
RSEEFVSLDKIIPILRDPMA

SEQ ID NO: 2725706 - protein, 26 aa, Entamoeba histolytica
RSEKEIENFLTWAYDLNTFEKKGNEK

SEQ ID NO: 2725707 - protein, 19 aa, Entamoeba histolytica
RSFEKYKIILKVSCCLYMG

SEQ ID NO: 2725708 - protein, 20 aa, Entamoeba histolytica
RSFIHRLISGNFSGNPVIFK

SEQ ID NO: 2725709 - protein, 24 aa, Entamoeba histolytica
RSFRKCFNLITIQLPFTINTIKSS

SEQ ID NO: 2725710 - protein, 18 aa, Entamoeba histolytica
RSFSIQDVLGLYMRARPL

SEQ ID NO: 2725711 - protein, 24 aa, Entamoeba histolytica
RSFSPTSYYELYLNALNNGIVLNI

SEQ ID NO: 2725712 - protein, 25 aa, Entamoeba histolytica
RSFSPTSYYELYLNALNNGIVLNIQ

SEQ ID NO: 2725713 - protein, 21 aa, Entamoeba histolytica
RSHCITIIRVGKGTLVFVDLA

SEQ ID NO: 2725714 - protein, 33 aa, Entamoeba histolytica; identical to SEQ ID NO: 2538556

SEQ ID NO: 2725715 - protein, 19 aa, Entamoeba histolytica
RSIGKIDSILPSSLTFLRP

SEQ ID NO: 2725716 - protein, 25 aa, Entamoeba histolytica
RSIHPVYIEMTNALFKQYCVDETLI

SEQ ID NO: 2725717 - protein, 30 aa, Entamoeba histolytica
RSIIEKKKSLRTNRRLDRPQLISSIISDIV

SEQ ID NO: 2725718 - protein, 17 aa, Entamoeba histolytica
RSILFNQFLTYQKGNCH

SEQ ID NO: 2725719 - protein, 41 aa, Entamoeba histolytica
RSISENTSRPGVPGGQPLFGGFNPATFKLKKTTVKKENIPE

SEQ ID NO: 2725720 - protein, 22 aa, Entamoeba histolytica
RSKEFFKYILSFITDNEIVIGE

SEQ ID NO: 2725721 - protein, 22 aa, Entamoeba histolytica
RSKFAIIIYIGSLEIKWVNNVL

SEQ ID NO: 2725722 - protein, 17 aa, Entamoeba histolytica
RSKPKYYCFYYNVYERG

SEQ ID NO: 2725723 - protein, 17 aa, Entamoeba histolytica
RSKQIVELLTDNDYLKQ

SEQ ID NO: 2725724 - protein, 22 aa, Entamoeba histolytica
RSLDLSFFINKLKEFEYRSTQS

SEQ ID NO: 2725725 - protein, 37 aa, Entamoeba histolytica
RSLFNSCILNKPNLLFLCFSKPMIVGLWSSTEIKTFN

SEQ ID NO: 2725726 - protein, 21 aa, Entamoeba histolytica
RSLFSKEPLMLLCKKDGKVKQ

SEQ ID NO: 2725727 - protein, 19 aa, Entamoeba histolytica
RSLGRIILSIRDAQTISFH

SEQ ID NO: 2725728 - protein, 21 aa, Entamoeba histolytica
RSLGVSFKRKYPTVILNISVA

SEQ ID NO: 2725729 - protein, 23 aa, Entamoeba histolytica
RSLNELILLLKDNLFTLSSDYNG

SEQ ID NO: 2725730 - protein, 21 aa, Entamoeba histolytica
RSLNKLFASGLYQFQQIYLSP

SEQ ID NO: 2725731 - protein, 17 aa, Entamoeba histolytica
RSLPKKERIFIKEYIDF

SEQ ID NO: 2725732 - protein, 21 aa, Entamoeba histolytica
RSLVCLAPKLPQSTLNGEVFR

SEQ ID NO: 2725733 - protein, 24 aa, Entamoeba histolytica
RSNEHLYVFLNKGPLQFCCVSNTK

SEQ ID NO: 2725734 - protein, 22 aa, Entamoeba histolytica
RSNISIFPNKKVPIVFICHTGK

SEQ ID NO: 2725735 - protein, 17 aa, Entamoeba histolytica
RSNLAFVVLTSDKWVFG

SEQ ID NO: 2725736 - protein, 17 aa, Entamoeba histolytica
RSNLIKLAQGEFVAVEN

SEQ ID NO: 2725737 - protein, 25 aa, Entamoeba histolytica
RSNLSSVILLLKTLGIDDILHFDFM

SEQ ID NO: 2725738 - protein, 27 aa, Entamoeba histolytica
RSPIAGGLLVMYLLSLNEPMIPIEHTK

SEQ ID NO: 2725739 - protein, 29 aa, Entamoeba histolytica
RSPISCVEAVLYLFHQMKQWSVCVPKLNA

SEQ ID NO: 2725740 - protein, 21 aa, Entamoeba histolytica
RSPLSMFIPSNPRIFSIFTSF

SEQ ID NO: 2725741 - protein, 24 aa, Entamoeba histolytica
RSQFKTIPQCPLQPPPDLKTYREI

SEQ ID NO: 2725742 - protein, 26 aa, Entamoeba histolytica
RSRENDVCYLCGKTGHWARDCKEKRY

SEQ ID NO: 2725743 - protein, 25 aa, Entamoeba histolytica
RSRERYRPTYYSPRRSRSISPRDFH

SEQ ID NO: 2725744 - protein, 19 aa, Entamoeba histolytica
RSRFYHEDEWEFFVITERF

SEQ ID NO: 2725745 - protein, 23 aa, Entamoeba histolytica
RSRKPAIYRGTPPTFTSTLRCVQ

SEQ ID NO: 2725746 - protein, 20 aa, Entamoeba histolytica
RSRLIIFDLGTKKKSFVSEW

SEQ ID NO: 2725747 - protein, 19 aa, Entamoeba histolytica
RSRQYLQCFCVSMIISIKD

SEQ ID NO: 2725748 - protein, 17 aa, Entamoeba histolytica
RSSFNPRTAGNFVDLTW

SEQ ID NO: 2725749 - protein, 17 aa, Entamoeba histolytica
RSSIEFLELLFVDLLFG

SEQ ID NO: 2725750 - protein, 19 aa, Entamoeba histolytica
RSSLFDESPSLLFCYCDKL

SEQ ID NO: 2725751 - protein, 17 aa, Entamoeba histolytica
RSSLTVFIPIKKTVSSN

SEQ ID NO: 2725752 - protein, 25 aa, Entamoeba histolytica
RSSPLLHLSWLNNIIEKEIEFGYYL

SEQ ID NO: 2725753 - protein, 28 aa, Entamoeba histolytica
RSTFSDVLLKTLFLSRSMLVMIDGSAYS

SEQ ID NO: 2725754 - protein, 28 aa, Entamoeba histolytica
RSTGLAKIPLIQAYLDDVLDSGIKKVVV

SEQ ID NO: 2725755 - protein, 17 aa, Entamoeba histolytica
RSTLLKQKFFASIVDEA

SEQ ID NO: 2725756 - protein, 24 aa, Entamoeba histolytica
RSTQSFDILLKDALNYYYQDIPDL

SEQ ID NO: 2725757 - protein, 26 aa, Entamoeba histolytica
RSVCDTFLMLQKQFQDLILQPTKIIN

SEQ ID NO: 2725758 - protein, 18 aa, Entamoeba histolytica
RSVKELCELLQKSEMKKI

SEQ ID NO: 2725759 - protein, 19 aa, Entamoeba histolytica
RSYAFLEFRTLEEAVKALS

SEQ ID NO: 2725760 - protein, 29 aa, Entamoeba histolytica
RSYHDLTQYPIFPWILKDYKSTSLNLNDE

SEQ ID NO: 2725761 - protein, 22 aa, Entamoeba histolytica
RTAPFFTLQEKVFIAYQLINAV

SEQ ID NO: 2725762 - protein, 27 aa, Entamoeba histolytica
RTASSIQPEWLFEASPKYFAQLDKFKE

SEQ ID NO: 2725763 - protein, 25 aa, Entamoeba histolytica
RTCEPLPDPIIFLRACLKINEMNKE

SEQ ID NO: 2725764 - protein, 29 aa, Entamoeba histolytica
RTEEGYRIYTLEELGLDKNKFGGNTPLCP

SEQ ID NO: 2725765 - protein, 31 aa, Entamoeba histolytica
RTFDKIALLGYDYWLYFTNKCPELKQLIVKR

SEQ ID NO: 2725766 - protein, 22 aa, Entamoeba histolytica
RTFPSLFEPVHGSALDIAGKGI

SEQ ID NO: 2725767 - protein, 20 aa, Entamoeba histolytica
RTFVWKLVLGYYRFDMTTKQ

SEQ ID NO: 2725768 - protein, 24 aa, Entamoeba histolytica
RTGEYFYFSFYEKFSYEIVFHVAP

SEQ ID NO: 2725769 - protein, 24 aa, Entamoeba histolytica
RTGKPIYNAIVWQSKQSGNETSYL

SEQ ID NO: 2725770 - protein, 24 aa, Entamoeba histolytica
RTHKIRMDYPKLDKSRLKIKVPVL

SEQ ID NO: 2725771 - protein, 28 aa, Entamoeba histolytica
RTIATDLLFGLLKDIIRFRSDLKLIIAS

SEQ ID NO: 2725772 - protein, 23 aa, Entamoeba histolytica
RTIGPFKTLILNDMFKVLNISFY

SEQ ID NO: 2725773 - protein, 17 aa, Entamoeba histolytica
RTIKGFIALIEKEWVLM

SEQ ID NO: 2725774 - protein, 29 aa, Entamoeba histolytica
RTIKIIPHKYFTFKKVWRAYANYARRRKN

SEQ ID NO: 2725775 - protein, 28 aa, Entamoeba histolytica
RTIKVGGRALITVWAKEQKKFENEEGQD

SEQ ID NO: 2725776 - protein, 17 aa, Entamoeba histolytica
RTIPFTVCKLNQLRNFK

SEQ ID NO: 2725777 - protein, 17 aa, Entamoeba histolytica
RTITRNIRTLFRKDFLA

SEQ ID NO: 2725778 - protein, 19 aa, Entamoeba histolytica
RTIYPVIPQQIVNALIQFI

SEQ ID NO: 2725779 - protein, 23 aa, Entamoeba histolytica
RTKFMLMDLIDLRDLNWAKQTKK

SEQ ID NO: 2725780 - protein, 17 aa, Entamoeba histolytica
RTKLYPDQYNEHTHCGF

SEQ ID NO: 2725781 - protein, 24 aa, Entamoeba histolytica
RTKQLLDRWKFKPKEFPLQLNPSQ

SEQ ID NO: 2725782 - protein, 25 aa, Entamoeba histolytica
RTKQTIKMLLPETIVLNNTVYDQSS

SEQ ID NO: 2725783 - protein, 17 aa, Entamoeba histolytica
RTKRKMLSYWKRNLEDI

SEQ ID NO: 2725784 - protein, 21 aa, Entamoeba histolytica
RTKYYQGVDCILFVVSMEDIE

SEQ ID NO: 2725785 - protein, 24 aa, Entamoeba histolytica
RTLDMDILNKCTLVFDIGGVYNHK

SEQ ID NO: 2725786 - protein, 25 aa, Entamoeba histolytica
RTLDSVLFQYKKFVKPAYDKWVYPQ

SEQ ID NO: 2725787 - protein, 28 aa, Entamoeba histolytica
RTLEQLLIQPVQRTMRYPMLINELIKAT

SEQ ID NO: 2725788 - protein, 21 aa, Entamoeba histolytica
RTLFESPMWNADDVKLTVIIL

SEQ ID NO: 2725789 - protein, 21 aa, Entamoeba histolytica
RTLKVLKTEVFNFLDKKKQVE

SEQ ID NO: 2725790 - protein, 33 aa, Entamoeba histolytica; identical to SEQ ID NO: 2538636

SEQ ID NO: 2725791 - protein, 22 aa, Entamoeba histolytica
RTMLIAIYDGALPSAVGGGANL

SEQ ID NO: 2725792 - protein, 26 aa, Entamoeba histolytica
RTNATSVFYLFVRTNYEILGSTQCMR

SEQ ID NO: 2725793 - protein, 33 aa, Entamoeba histolytica
RTNEVTDNMLFIKNLPFAITEEKLKEMFSKFGV

SEQ ID NO: 2725794 - protein, 26 aa, Entamoeba histolytica
RTNSDRIFLFVNKRPIEHKKLQQIIT

SEQ ID NO: 2725795 - protein, 25 aa, Entamoeba histolytica
RTNVVPYYILFNKEPKYVVGQPTKI

SEQ ID NO: 2725796 - protein, 23 aa, Entamoeba histolytica
RTPFHYAVLGGHLSLVRQIGRSC

SEQ ID NO: 2725797 - protein, 17 aa, Entamoeba histolytica
RTPILLIQNPDYLINTT

SEQ ID NO: 2725798 - protein, 23 aa, Entamoeba histolytica
RTPPGYHCIFSQSGKLFICELHV

SEQ ID NO: 2725799 - protein, 32 aa, Entamoeba histolytica; identical to SEQ ID NO: 2538643

SEQ ID NO: 2725800 - protein, 23 aa, Entamoeba histolytica
RTQDRFTFTIDTISFNGSIYDEP

SEQ ID NO: 2725801 - protein, 26 aa, Entamoeba histolytica
RTQVAEFSFMALLQQIGKMKKLHEEA

SEQ ID NO: 2725802 - protein, 20 aa, Entamoeba histolytica
RTQVIIVVNPLPSSNYRIEV

SEQ ID NO: 2725803 - protein, 30 aa, Entamoeba histolytica
RTREAQICNGLLYLLRSSGYSFTIRKTKRA

SEQ ID NO: 2725804 - protein, 17 aa, Entamoeba histolytica
RTRFIAEPGRYMASNAF

SEQ ID NO: 2725805 - protein, 17 aa, Entamoeba histolytica
RTRYYVMARLTPFKNEI

SEQ ID NO: 2725806 - protein, 17 aa, Entamoeba histolytica
RTSEYGTDPFRFFEEMF

SEQ ID NO: 2725807 - protein, 25 aa, Entamoeba histolytica
RTSKPQFTFALQPPTFIPLFLEDCN

SEQ ID NO: 2725808 - protein, 17 aa, Entamoeba histolytica
RTSPFAFIGNRFEFRAV

SEQ ID NO: 2725809 - protein, 26 aa, Entamoeba histolytica
RTSSVKIMLFLNEIGNFDKSKIKVTF

SEQ ID NO: 2725810 - protein, 20 aa, Entamoeba histolytica
RTTDCTIKLLIPNKLHGQII

SEQ ID NO: 2725811 - protein, 27 aa, Entamoeba histolytica
RTTKEDLIKLFSTVGKVISITIPVNHS

SEQ ID NO: 2725812 - protein, 25 aa, Entamoeba histolytica
RTTYQKMMHILQDAILYNPSFIGPE

SEQ ID NO: 2725813 - protein, 22 aa, Entamoeba histolytica
RTVGIDILFGLLKETIKRRPEF

SEQ ID NO: 2725814 - protein, 25 aa, Entamoeba histolytica
RTVSTDILFGVLKSLLEEREDLKIV

SEQ ID NO: 2725815 - protein, 23 aa, Entamoeba histolytica
RTYAIPQPYQSQYLKFGFHGLSY

SEQ ID NO: 2725816 - protein, 17 aa, Entamoeba histolytica
RTYAVLALKRFETSQLV

SEQ ID NO: 2725817 - protein, 22 aa, Entamoeba histolytica
RTYFKKIRLLDQKPLGTAFQFP

SEQ ID NO: 2725818 - protein, 24 aa, Entamoeba histolytica
RVAITDFRDVMWFADGFATIKPDE

SEQ ID NO: 2725819 - protein, 24 aa, Entamoeba histolytica
RVASATFVLFMKNELEKNVLRTTE

SEQ ID NO: 2725820 - protein, 22 aa, Entamoeba histolytica
RVDGTFLIRISTTDPKYPFTLT

SEQ ID NO: 2725821 - protein, 24 aa, Entamoeba histolytica
RVDKENWIYQKPSLYSTPEMVIVN

SEQ ID NO: 2725822 - protein, 26 aa, Entamoeba histolytica
RVDKIYTQRIILFVGSPLNINSDEAQ

SEQ ID NO: 2725823 - protein, 23 aa, Entamoeba histolytica
RVDWRNMLLFYKDIDSLEYAVNN

SEQ ID NO: 2725824 - protein, 28 aa, Entamoeba histolytica
RVEGLQGIILTMDFYTCKFTDNIKQVIE

SEQ ID NO: 2725825 - protein, 22 aa, Entamoeba histolytica
RVEGVIALSRSLGDRTLHPPLS

SEQ ID NO: 2725826 - protein, 21 aa, Entamoeba histolytica
RVEIEWNNIQWCYSGKPCSSH

SEQ ID NO: 2725827 - protein, 25 aa, Entamoeba histolytica
RVEQQLFFILDFQISYKTDICTVPV

SEQ ID NO: 2725828 - protein, 17 aa, Entamoeba histolytica
RVFHLKANKYYCPSINV

SEQ ID NO: 2725829 - protein, 17 aa, Entamoeba histolytica
RVFKPRPVAHGNGGLGI

SEQ ID NO: 2725830 - protein, 19 aa, Entamoeba histolytica
RVFRGIRFSAKYGFKIEDN

SEQ ID NO: 2725831 - protein, 18 aa, Entamoeba histolytica
RVFYRQVIAGATKGYFLS

SEQ ID NO: 2725832 - protein, 25 aa, Entamoeba histolytica
RVGSTFDLKRLCRVTGATPFISLTT

SEQ ID NO: 2725833 - protein, 17 aa, Entamoeba histolytica
RVGVSWKSIFSWCSEQE

SEQ ID NO: 2725834 - protein, 24 aa, Entamoeba histolytica
RVHCKLLIRYATGYGLLREVLSSL

SEQ ID NO: 2725835 - protein, 18 aa, Entamoeba histolytica
RVIAEKQIKFYTIDAIKI

SEQ ID NO: 2725836 - protein, 18 aa, Entamoeba histolytica
RVINVCKYVIYIPEKDCR

SEQ ID NO: 2725837 - protein, 21 aa, Entamoeba histolytica
RVIVHYLMKLFEKNLDEKRYI

SEQ ID NO: 2725838 - protein, 26 aa, Entamoeba histolytica
RVKEATSFPIVFVANKVDLVKDRDVS

SEQ ID NO: 2725839 - protein, 28 aa, Entamoeba histolytica
RVKGTLVWLLNIGMLWVDDQFPLDGKTT

SEQ ID NO: 2725840 - protein, 23 aa, Entamoeba histolytica
RVKRTALLILNQKLTALTPEEMS

SEQ ID NO: 2725841 - protein, 35 aa, Entamoeba histolytica
RVKVIVNIIRRSLLLLSRYPLPLFKDLEPEVEEMR

SEQ ID NO: 2725842 - protein, 21 aa, Entamoeba histolytica
RVKWPGTFELFISEEPDTFFN

SEQ ID NO: 2725843 - protein, 24 aa, Entamoeba histolytica
RVLAEDLLFQRKKLAAAPTGNARD

SEQ ID NO: 2725844 - protein, 28 aa, Entamoeba histolytica
RVLHPFMPFITEELWQRLPRRNDKEISI

SEQ ID NO: 2725845 - protein, 18 aa, Entamoeba histolytica
RVLKIPSRLKEFISSGFI

SEQ ID NO: 2725846 - protein, 25 aa, Entamoeba histolytica
RVLRDRIDFSTFIMSVLLKSRYEAT

SEQ ID NO: 2725847 - protein, 28 aa, Entamoeba histolytica
RVLYWKNKIFHLIFNLEKERYKTVTSVL

SEQ ID NO: 2725848 - protein, 17 aa, Entamoeba histolytica
RVMYYSAFDGYCGITTR

SEQ ID NO: 2725849 - protein, 26 aa, Entamoeba histolytica
RVNQNGITLPFLYKELFIIDCCNCFL

SEQ ID NO: 2725850 - protein, 25 aa, Entamoeba histolytica
RVNSQFLSMFKRKAFLHLYTEEGME

SEQ ID NO: 2725851 - protein, 17 aa, Entamoeba histolytica
RVNTDLVCAWYLNNTCC

SEQ ID NO: 2725852 - protein, 26 aa, Entamoeba histolytica
RVPTDLLGLMLYYIDLRVDAYLQTKT

SEQ ID NO: 2725853 - protein, 28 aa, Entamoeba histolytica
RVQCQIMLDPMLRNNWWWNLVQSVSVTQ

SEQ ID NO: 2725854 - protein, 28 aa, Entamoeba histolytica
RVREKNPDLFIPWIPNNMQLAVCDVPPK

SEQ ID NO: 2725855 - protein, 25 aa, Entamoeba histolytica
RVRIMNGLRYILIECWGAISNKIEV

SEQ ID NO: 2725856 - protein, 17 aa, Entamoeba histolytica
RVRIVSVSLQFICNELY

SEQ ID NO: 2725857 - protein, 17 aa, Entamoeba histolytica
RVRLKEFLRTPSADLTL

SEQ ID NO: 2725858 - protein, 17 aa, Entamoeba histolytica
RVRMDTVEKGSIVNDVR

SEQ ID NO: 2725859 - protein, 19 aa, Entamoeba histolytica
RVSTLVGIPSSCICLSLSY

SEQ ID NO: 2725860 - protein, 18 aa, Entamoeba histolytica
RVTAITRFNLFVVIGLAD

SEQ ID NO: 2725861 - protein, 17 aa, Entamoeba histolytica
RVTFFIVKYDQVFYENR

SEQ ID NO: 2725862 - protein, 17 aa, Entamoeba histolytica
RVTILEKDMLLAMRLKS

SEQ ID NO: 2725863 - protein, 29 aa, Entamoeba histolytica
RVVCYIYKKLNLWYYPKLKDGAIMATTLY

SEQ ID NO: 2725864 - protein, 17 aa, Entamoeba histolytica
RVVFADLAYKQPHLLLL

SEQ ID NO: 2725865 - protein, 31 aa, Entamoeba histolytica
RVVGIMKNFTIITLLKTLGIKTKTEVCGFLS

SEQ ID NO: 2725866 - protein, 23 aa, Entamoeba histolytica
RVVGVLLGFIRKGIVDVMNSFAV

SEQ ID NO: 2725867 - protein, 19 aa, Entamoeba histolytica
RVVKYLCGVAKQCWKLLDS

SEQ ID NO: 2725868 - protein, 23 aa, Entamoeba histolytica
RVVQEDEVVLALRGILTARRQDT

SEQ ID NO: 2725869 - protein, 21 aa, Entamoeba histolytica
RVVVDFYVTWCGPCKMISPIF

SEQ ID NO: 2725870 - protein, 19 aa, Entamoeba histolytica
RVVYEKYISILLNNLEIPS

SEQ ID NO: 2725871 - protein, 25 aa, Entamoeba histolytica
RVYDPLIEGPFGFVPRKSIPEGKNW

SEQ ID NO: 2725872 - protein, 20 aa, Entamoeba histolytica
RVYTLFGRFGNINRVIMGVN

SEQ ID NO: 2725873 - protein, 17 aa, Entamoeba histolytica
RWAVTILNHLIFSNPKN

SEQ ID NO: 2725874 - protein, 28 aa, Entamoeba histolytica
RWEFSHPYPFIRTREFLWQEGHTAFATQ

SEQ ID NO: 2725875 - protein, 20 aa, Entamoeba histolytica
RWFGTLFEPTSDQLAAIALQ

SEQ ID NO: 2725876 - protein, 18 aa, Entamoeba histolytica
RWITLKRTIREDKPCSIP

SEQ ID NO: 2725877 - protein, 36 aa, Entamoeba histolytica
RWKDLIPIIKSFSIPTSFFIYLSNKLPIEKAYYLIE

SEQ ID NO: 2725878 - protein, 30 aa, Entamoeba histolytica
RWSATQLLKHPFIEWAPTSYFYKKYHHIEN

SEQ ID NO: 2725879 - protein, 20 aa, Entamoeba histolytica
RYAAILNRYKVLKAHGMKVV

SEQ ID NO: 2725880 - protein, 21 aa, Entamoeba histolytica
RYADVMVHRLLAQAIGFDQID

SEQ ID NO: 2725881 - protein, 32 aa, Entamoeba histolytica
RYCCSIESSLLKWLFNPLSDGSIHIVFKLNDT

SEQ ID NO: 2725882 - protein, 24 aa, Entamoeba histolytica
RYCEEEFFEFYPINTLTAKKTGEW

SEQ ID NO: 2725883 - protein, 18 aa, Entamoeba histolytica
RYCIIREGSYLKVINSYN

SEQ ID NO: 2725884 - protein, 28 aa, Entamoeba histolytica
RYEECYESFLWLFGKLLQKEELDLIRSR

SEQ ID NO: 2725885 - protein, 20 aa, Entamoeba histolytica
RYEWYLTQFALQRHGIIPVP

SEQ ID NO: 2725886 - protein, 20 aa, Entamoeba histolytica
RYFNHLCSRVIKDKWTKEED

SEQ ID NO: 2725887 - protein, 32 aa, Entamoeba histolytica
RYGRDLRLWKIDFTQFIPLTKVQLQYIVDKLL

SEQ ID NO: 2725888 - protein, 28 aa, Entamoeba histolytica
RYHEFIEHLIYLYIPLDIFEKKLEENPA

SEQ ID NO: 2725889 - protein, 19 aa, Entamoeba histolytica
RYHSLTPMYYRGSNAALVV

SEQ ID NO: 2725890 - protein, 18 aa, Entamoeba histolytica
RYHTLLTELLKYTPLKHP

SEQ ID NO: 2725891 - protein, 27 aa, Entamoeba histolytica
RYIDSFIYSFPLFLTKKELIDLIIKQH

SEQ ID NO: 2725892 - protein, 18 aa, Entamoeba histolytica
RYIGSQYLKLIVGNKIDS

SEQ ID NO: 2725893 - protein, 33 aa, Entamoeba histolytica
RYINLQVIQNHFAIFNLLPGTYHVCSYSKESLE

SEQ ID NO: 2725894 - protein, 18 aa, Entamoeba histolytica
RYIVIPNEKIRKIYSRKS

SEQ ID NO: 2725895 - protein, 19 aa, Entamoeba histolytica
RYKHPSTSVLACALTKFKG

SEQ ID NO: 2725896 - protein, 24 aa, Entamoeba histolytica
RYKQFMRCLGWYQSLEGLICDPEL

SEQ ID NO: 2725897 - protein, 34 aa, Entamoeba histolytica
RYKRNMIFIIIDNQILDILKYFFGFSFEECVKKK

SEQ ID NO: 2725898 - protein, 18 aa, Entamoeba histolytica
RYLALDTFVLLGQANYKN

SEQ ID NO: 2725899 - protein, 18 aa, Entamoeba histolytica
RYLLTKQMSYLDIIPKCC

SEQ ID NO: 2725900 - protein, 18 aa, Entamoeba histolytica
RYNSKLGGNPYLPKGFEY

SEQ ID NO: 2725901 - protein, 24 aa, Entamoeba histolytica
RYQIQKLNPFWWTHQRHDGKLWNL

SEQ ID NO: 2725902 - protein, 24 aa, Entamoeba histolytica
RYQSILQFIIQKQWIDYCINTFYS

SEQ ID NO: 2725903 - protein, 19 aa, Entamoeba histolytica
RYRKGFCKSNPRKMVKMWA

SEQ ID NO: 2725904 - protein, 21 aa, Entamoeba histolytica
RYRMGNLFIVGPTKTGKTEFA

SEQ ID NO: 2725905 - protein, 18 aa, Entamoeba histolytica
RYRNSLFIGIQKPSLTIT

SEQ ID NO: 2725906 - protein, 24 aa, Entamoeba histolytica
RYRSLSSIYYRNATVALLVYDITK

SEQ ID NO: 2725907 - protein, 26 aa, Entamoeba histolytica
RYSSGITLLLKYKPLKDITDYLIVVT

SEQ ID NO: 2725908 - protein, 25 aa, Entamoeba histolytica
RYSVSINIVLRWFAKLEMTIPKDLP

SEQ ID NO: 2725909 - protein, 19 aa, Entamoeba histolytica
RYTVPPTYIAHQLFQYWVN

SEQ ID NO: 2725910 - protein, 30 aa, Entamoeba histolytica
RYVEITNLKEIYRLFGELPKDITGLCALQH

SEQ ID NO: 2725911 - protein, 22 aa, Entamoeba histolytica
RYVLELMNIIKLIQGGLKHVYD

SEQ ID NO: 2725912 - protein, 25 aa, Entamoeba histolytica
RYYNDEIWLMKPCTGSVLFDIIFNI

SEQ ID NO: 2725913 - protein, 27 aa, Entamoeba histolytica
SACDYVLFFLIRCEPYTTMFIKMNNGH

SEQ ID NO: 2725914 - protein, 26 aa, Entamoeba histolytica
SACNYRPIKFMVINRPKLTEVLTHLA

SEQ ID NO: 2725915 - protein, 21 aa, Entamoeba histolytica
SADIVLWERHPIEAHDIFCSG

SEQ ID NO: 2725916 - protein, 27 aa, Entamoeba histolytica
SADLLLPTIIYCIIYSSPSNLVSTIEY

SEQ ID NO: 2725917 - protein, 23 aa, Entamoeba histolytica
SADTLRELLIFSLDIFDKKEITK

SEQ ID NO: 2725918 - protein, 24 aa, Entamoeba histolytica
SADTVVFAELYWTPGVLRQAEDRV

SEQ ID NO: 2725919 - protein, 24 aa, Entamoeba histolytica
SADVWSLGILLFKCFTSQYPFEST

SEQ ID NO: 2725920 - protein, 26 aa, Entamoeba histolytica
SAEELWNYVELFASLDLENGKEGSDL

SEQ ID NO: 2725921 - protein, 24 aa, Entamoeba histolytica
SAENLKAMWPRKGFYLGNFDIDYR

SEQ ID NO: 2725922 - protein, 23 aa, Entamoeba histolytica
SAEQFIWFMEQGVKSFLAIRQYY

SEQ ID NO: 2725923 - protein, 26 aa, Entamoeba histolytica
SAFDLLNYISSLPLEQALPPSKVVYQ

SEQ ID NO: 2725924 - protein, 21 aa, Entamoeba histolytica
SAFIYRLPHSSSLFDYKVIPY

SEQ ID NO: 2725925 - protein, 19 aa, Entamoeba histolytica
SAFIYSFEHDISIGILFYL

SEQ ID NO: 2725926 - protein, 19 aa, Entamoeba histolytica
SAFNLPVIISKGILKTLEV

SEQ ID NO: 2725927 - protein, 24 aa, Entamoeba histolytica
SAFTRLFFYYIESSSTKYLNKVIS

SEQ ID NO: 2725928 - protein, 21 aa, Entamoeba histolytica
SAGDLMFCTYAIPSTSFVQTQ

SEQ ID NO: 2725929 - protein, 19 aa, Entamoeba histolytica
SAGILFKNLFPIKGSHKAQ

SEQ ID NO: 2725930 - protein, 25 aa, Entamoeba histolytica
SAGIVLFELLEGYPPHYELRGEELM

SEQ ID NO: 2725931 - protein, 19 aa, Entamoeba histolytica
SAGLFWDNFKDIPTQSDDS

SEQ ID NO: 2725932 - protein, 18 aa, Entamoeba histolytica
SAGLIYKYYGREIIIKLC

SEQ ID NO: 2725933 - protein, 28 aa, Entamoeba histolytica
SAGMYVLYCYYSTYPLSCSASIQLKAYL

SEQ ID NO: 2725934 - protein, 26 aa, Entamoeba histolytica
SAGNELLLTELLFSGVFSTLNAKQAT

SEQ ID NO: 2725935 - protein, 23 aa, Entamoeba histolytica
SAGYGFFYGIFQTTIESAFFGQV

SEQ ID NO: 2725936 - protein, 20 aa, Entamoeba histolytica
SAHILIDLCAAPGGWCQVAT

SEQ ID NO: 2725937 - protein, 18 aa, Entamoeba histolytica
SAHLLFPNYICPAIEQTI

SEQ ID NO: 2725938 - protein, 25 aa, Entamoeba histolytica
SAINLLTNTFFYRRIRSNPSYYFVE

SEQ ID NO: 2725939 - protein, 28 aa, Entamoeba histolytica
SAISSLLLDFYRYSFGFYISTYREKVNQ

SEQ ID NO: 2725940 - protein, 27 aa, Entamoeba histolytica
SAKLCKRYMKYLMKKYLKKNNLREWLR

SEQ ID NO: 2725941 - protein, 25 aa, Entamoeba histolytica
SAKMIDLDMIIGKYTIIQKSSDEVP

SEQ ID NO: 2725942 - protein, 23 aa, Entamoeba histolytica
SAKQGLLLWCQKKCEPYPVKVEN

SEQ ID NO: 2725943 - protein, 18 aa, Entamoeba histolytica
SAKQSFWMKRVAYLAAQI

SEQ ID NO: 2725944 - protein, 19 aa, Entamoeba histolytica
SAKSDMFFFVTSQGLLLKM

SEQ ID NO: 2725945 - protein, 18 aa, Entamoeba histolytica
SALAFLYSKLQQPALRRY

SEQ ID NO: 2725946 - protein, 24 aa, Entamoeba histolytica
SALEDIHTMYLKIGFNKTGSFCDF

SEQ ID NO: 2725947 - protein, 25 aa, Entamoeba histolytica
SALKKFIRKLRQWKLYGRLILSNKR

SEQ ID NO: 2725948 - protein, 28 aa, Entamoeba histolytica
SALKLHKEFGVLVIVTLGDKGCLIVGEE

SEQ ID NO: 2725949 - protein, 24 aa, Entamoeba histolytica
SALPRATKLLLLLGDAPTPTFEEE

SEQ ID NO: 2725950 - protein, 29 aa, Entamoeba histolytica
SALQNRKYLAWTGAALLAGMSTLLDEEKC

SEQ ID NO: 2725951 - protein, 31 aa, Entamoeba histolytica
SALSQIIFMRYFLYNSLNSCDPLYVLSASIF

SEQ ID NO: 2725952 - protein, 21 aa, Entamoeba histolytica
SALTVPHLKILDLSKNQIAVL

SEQ ID NO: 2725953 - protein, 18 aa, Entamoeba histolytica
SAMELCEKLRIVLEPSLA

SEQ ID NO: 2725954 - protein, 18 aa, Entamoeba histolytica
SAMKRLLIPTGYPKMIDK

SEQ ID NO: 2725955 - protein, 32 aa, Entamoeba histolytica
SANETIRLALWQLYLTWTNVFPAQTLNQIRTS

SEQ ID NO: 2725956 - protein, 24 aa, Entamoeba histolytica
SANINAVVECPYWLAPEVINGEPF

SEQ ID NO: 2725957 - protein, 17 aa, Entamoeba histolytica
SAPISPFRNLSSTFLTQ

SEQ ID NO: 2725958 - protein, 24 aa, Entamoeba histolytica
SAPTVSFTDLIYAQSNNLKPTEIE

SEQ ID NO: 2725959 - protein, 19 aa, Entamoeba histolytica
SAPVKILMISPKVGVPQLN

SEQ ID NO: 2725960 - protein, 22 aa, Entamoeba histolytica
SAQIFIEWCYCKSSPTLEKMAP

SEQ ID NO: 2725961 - protein, 27 aa, Entamoeba histolytica
SAQKEFAFMKALYAKGFPTPIPVDCNR

SEQ ID NO: 2725962 - protein, 23 aa, Entamoeba histolytica
SAQKNCKFCPKCEAGLLMTDNKV

SEQ ID NO: 2725963 - protein, 33 aa, Entamoeba histolytica
SAREYLSLCTVQHLSLLKTLLKPSLKDTSPSNG

SEQ ID NO: 2725964 - protein, 17 aa, Entamoeba histolytica
SARSRFYHEDEWEFFVI

SEQ ID NO: 2725965 - protein, 18 aa, Entamoeba histolytica
SASLFPHEARLRSLTYSC

SEQ ID NO: 2725966 - protein, 25 aa, Entamoeba histolytica
SASRRYYNRFPALVWYNNEYKNVLM

SEQ ID NO: 2725967 - protein, 31 aa, Entamoeba histolytica; identical to SEQ ID NO: 2538814

SEQ ID NO: 2725968 - protein, 30 aa, Entamoeba histolytica
SATFERIKPIKGFILLFEYNKQTINYIRNE

SEQ ID NO: 2725969 - protein, 26 aa, Entamoeba histolytica
SATQRKVFELALLSSNTILLERLSSL

SEQ ID NO: 2725970 - protein, 24 aa, Entamoeba histolytica
SAVDYFGKQLLKYGYNYYGSEPLY

SEQ ID NO: 2725971 - protein, 30 aa, Entamoeba histolytica
SAVITTLRKLIIILFLPIHTKSTKVNKNNI

SEQ ID NO: 2725972 - protein, 23 aa, Entamoeba histolytica
SAVLNHPVFCHSKTPEVVCVGSI

SEQ ID NO: 2725973 - protein, 27 aa, Entamoeba histolytica
SAVTRNVLLDWLFLVSQDEFATTIETY

SEQ ID NO: 2725974 - protein, 23 aa, Entamoeba histolytica
SAYATMLFRELLKMPTDLDCQKQ

SEQ ID NO: 2725975 - protein, 20 aa, Entamoeba histolytica
SAYFSPLTHWICPHSRYYCC

SEQ ID NO: 2725976 - protein, 43 aa, Entamoeba histolytica
SAYYKMSERLRWESPLLFTNIFHAFQTLFSTGDLFFSCNDTLT

SEQ ID NO: 2725977 - protein, 19 aa, Entamoeba histolytica
SCANRLFILCKQADEIVVE

SEQ ID NO: 2725978 - protein, 30 aa, Entamoeba histolytica; identical to SEQ ID NO: 2538825

SEQ ID NO: 2725979 - protein, 33 aa, Entamoeba histolytica; identical to SEQ ID NO: 2538826

SEQ ID NO: 2725980 - protein, 27 aa, Entamoeba histolytica
SCDIWALGCLLYELYTSKMLFAIADVG

SEQ ID NO: 2725981 - protein, 20 aa, Entamoeba histolytica
SCEIYISSFYITLKKINLES

SEQ ID NO: 2725982 - protein, 20 aa, Entamoeba histolytica
SCEVYGGGIWHTWIDRDLGI

SEQ ID NO: 2725983 - protein, 18 aa, Entamoeba histolytica
SCFFNTISFSYNSQFLAI

SEQ ID NO: 2725984 - protein, 20 aa, Entamoeba histolytica
SCFPNLKSQFMYLKEQLVNA

SEQ ID NO: 2725985 - protein, 20 aa, Entamoeba histolytica
SCFYDQFFCLKQDSDYYKAV

SEQ ID NO: 2725986 - protein, 21 aa, Entamoeba histolytica
SCFYDQFFCLKQDSDYYKAVV

SEQ ID NO: 2725987 - protein, 20 aa, Entamoeba histolytica
SCGGCFVTYTLHGDLRGCIG

SEQ ID NO: 2725988 - protein, 35 aa, Entamoeba histolytica
SCGIDVWSAGCICAELILGIPLFPGSSEYNELYKI

SEQ ID NO: 2725989 - protein, 18 aa, Entamoeba histolytica
SCGIDWVKSRILPSVISL

SEQ ID NO: 2725990 - protein, 23 aa, Entamoeba histolytica
SCGIVLYNMICNSFPFDCSLNPS

SEQ ID NO: 2725991 - protein, 21 aa, Entamoeba histolytica
SCGVLMYTLAVGRNPFEFNGH

SEQ ID NO: 2725992 - protein, 27 aa, Entamoeba histolytica
SCHMKRTIIVRRDYFHYVSKYQRYEKR

SEQ ID NO: 2725993 - protein, 24 aa, Entamoeba histolytica
SCHQYYLFDSLKSLSPQQITALEE

SEQ ID NO: 2725994 - protein, 19 aa, Entamoeba histolytica
SCINLYFDEIFFKSNKEIG

SEQ ID NO: 2725995 - protein, 33 aa, Entamoeba histolytica
SCIPPFTCPPTEYYLYKKIQSISSPPLLQFQKN

SEQ ID NO: 2725996 - protein, 27 aa, Entamoeba histolytica
SCIQSVNYHYSLFSQLQFMDKTPILPE

SEQ ID NO: 2725997 - protein, 26 aa, Entamoeba histolytica
SCITPDKIVLYYIYEKEECDYQSDLE

SEQ ID NO: 2725998 - protein, 24 aa, Entamoeba histolytica
SCKKGVLLFRLTINNKPTSFATYH

SEQ ID NO: 2725999 - protein, 26 aa, Entamoeba histolytica
SCKSCGFIMFAIPKKGLEKKFSTNGK

SEQ ID NO: 2726000 - protein, 26 aa, Entamoeba histolytica
SCKVKIIPITKAIPTLSLLKLKTSLS

SEQ ID NO: 2726001 - protein, 22 aa, Entamoeba histolytica
SCLDEYPLLLRMVEDDVIAPLK

SEQ ID NO: 2726002 - protein, 25 aa, Entamoeba histolytica
SCLDTKLWKYIIPYVNIAIKQKDIS

SEQ ID NO: 2726003 - protein, 28 aa, Entamoeba histolytica
SCLVKLPLILPFIKKKMHYRILGLNAIP

SEQ ID NO: 2726004 - protein, 17 aa, Entamoeba histolytica
SCNIRWITLKRTIREDK

SEQ ID NO: 2726005 - protein, 25 aa, Entamoeba histolytica
SCPCYFTCYYFTESITRLYPCQCSK

SEQ ID NO: 2726006 - protein, 17 aa, Entamoeba histolytica
SCPTTSLPFPPTSIKFI

SEQ ID NO: 2726007 - protein, 21 aa, Entamoeba histolytica
SCQITFMKIYYDDIQNEVFVS

SEQ ID NO: 2726008 - protein, 26 aa, Entamoeba histolytica
SCQKELDLYNRILANFVEFVHMLGEE

SEQ ID NO: 2726009 - protein, 18 aa, Entamoeba histolytica
SCQKISHVFSYLDRFFIK

SEQ ID NO: 2726010 - protein, 17 aa, Entamoeba histolytica
SCQLFHAIPQPKPRKEG

SEQ ID NO: 2726011 - protein, 19 aa, Entamoeba histolytica
SCRRFIVSGYCKYLDMESP

SEQ ID NO: 2726012 - protein, 20 aa, Entamoeba histolytica
SCRVYAFTVKRFMRITNETA

SEQ ID NO: 2726013 - protein, 20 aa, Entamoeba histolytica
SCSEAFRIKILKDVIKALKI

SEQ ID NO: 2726014 - protein, 20 aa, Entamoeba histolytica
SCSFFLRSNFVKTWENYFYK

SEQ ID NO: 2726015 - protein, 22 aa, Entamoeba histolytica
SCSLFYSISFVVHFIKWIKINK

SEQ ID NO: 2726016 - protein, 26 aa, Entamoeba histolytica
SCTEMTSLYLLLQTKLFNITHIYFNA

SEQ ID NO: 2726017 - protein, 25 aa, Entamoeba histolytica
SCTKLGIRFIVIRSLSDVPSEDGKS

SEQ ID NO: 2726018 - protein, 18 aa, Entamoeba histolytica
SCYIFDCMTRMYVWMGDE

SEQ ID NO: 2726019 - protein, 19 aa, Entamoeba histolytica
SCYSVLYYDYWPSNSYQNI

SEQ ID NO: 2726020 - protein, 18 aa, Entamoeba histolytica
SDAKRFQEISEKIKAQNE

SEQ ID NO: 2726021 - protein, 30 aa, Entamoeba histolytica
SDALANLHIILFDILKNPVHFFKGTMGQYE

SEQ ID NO: 2726022 - protein, 29 aa, Entamoeba histolytica
SDALHLGHLIPFIFTKYLQDAFDCQLVVQ

SEQ ID NO: 2726023 - protein, 23 aa, Entamoeba histolytica
SDASLILKIVRLLLQPEVNDIDA

SEQ ID NO: 2726024 - protein, 22 aa, Entamoeba histolytica
SDASQHFSLLDLLLQEFSNKIE

SEQ ID NO: 2726025 - protein, 29 aa, Entamoeba histolytica
SDAWQILTNLFDCLPLSALIDQRYFCVHG

SEQ ID NO: 2726026 - protein, 20 aa, Entamoeba histolytica
SDCCDNFFFSFNEFQKQTPP

SEQ ID NO: 2726027 - protein, 20 aa, Entamoeba histolytica
SDDHHFIFTLQTSLSNVPTR

SEQ ID NO: 2726028 - protein, 24 aa, Entamoeba histolytica
SDDKFFTCIVGNKADLEKKVEESA

SEQ ID NO: 2726029 - protein, 29 aa, Entamoeba histolytica
SDDVVVINSFFLIKKSRELWIPSEPFKEN

SEQ ID NO: 2726030 - protein, 31 aa, Entamoeba histolytica
SDEDDIILKKAQTKLIKSYRALKYEQDHNPK

SEQ ID NO: 2726031 - protein, 31 aa, Entamoeba histolytica
SDEDVNKFYTFWYSFKSWRDPPLDEMYNIEE

SEQ ID NO: 2726032 - protein, 30 aa, Entamoeba histolytica
SDEEKVFFFCDELMFKRWTKYINDSVEGKD

SEQ ID NO: 2726033 - protein, 26 aa, Entamoeba histolytica
SDESYRFYQLLLFNFSHFVADEDFNR

SEQ ID NO: 2726034 - protein, 18 aa, Entamoeba histolytica
SDFNAFFTKDVHIAIKDG

SEQ ID NO: 2726035 - protein, 26 aa, Entamoeba histolytica
SDFNNFPFILLPHRNGQLEFANEMVI

SEQ ID NO: 2726036 - protein, 29 aa, Entamoeba histolytica
SDFQRLPNLVYFLQSVPFVRLQSMFDMLV

SEQ ID NO: 2726037 - protein, 17 aa, Entamoeba histolytica
SDFWNECKNKIIPDVTD

SEQ ID NO: 2726038 - protein, 29 aa, Entamoeba histolytica
SDGAMEIFIEWMYLQRSPLLESQSIDSIA

SEQ ID NO: 2726039 - protein, 22 aa, Entamoeba histolytica
SDGQLRSYMRTPTAYYVSQLMS

SEQ ID NO: 2726040 - protein, 18 aa, Entamoeba histolytica
SDGSFLPLLVCLPKKYIS

SEQ ID NO: 2726041 - protein, 24 aa, Entamoeba histolytica
SDGTRQTFWYSRVNSYTSRTGDIS

SEQ ID NO: 2726042 - protein, 37 aa, Entamoeba histolytica
SDHCLLMTDILHRGLKKFWWKAMDYLSFKTLNKRKKE

SEQ ID NO: 2726043 - protein, 23 aa, Entamoeba histolytica
SDHKRVFFFQNAYVFYSRDENNT

SEQ ID NO: 2726044 - protein, 26 aa, Entamoeba histolytica
SDHPFAKLVLEYRKISKLLSGVIEQI

SEQ ID NO: 2726045 - protein, 18 aa, Entamoeba histolytica
SDIATLCKDAIYQPVRTL

SEQ ID NO: 2726046 - protein, 25 aa, Entamoeba histolytica
SDIEIDGRRLILQKAINKEQAQDRS

SEQ ID NO: 2726047 - protein, 28 aa, Entamoeba histolytica
SDIFTPNNPWIVPLLQVVCEVSLSPELL

SEQ ID NO: 2726048 - protein, 17 aa, Entamoeba histolytica
SDIIHFIKFIQLNPSEK

SEQ ID NO: 2726049 - protein, 23 aa, Entamoeba histolytica
SDIIKKKIVRIWTTREEMQLMEG

SEQ ID NO: 2726050 - protein, 29 aa, Entamoeba histolytica
SDIKDSEAYLYLLHHLNNNCSLEALNSSN

SEQ ID NO: 2726051 - protein, 17 aa, Entamoeba histolytica
SDIKLKVLELPLKDGKY

SEQ ID NO: 2726052 - protein, 32 aa, Entamoeba histolytica
SDIMKGMKLLHTEGYLIFNTDMFRKMMQTAKA

SEQ ID NO: 2726053 - protein, 28 aa, Entamoeba histolytica
SDISSFPWETLASTLKRFVRELPGMLFC

SEQ ID NO: 2726054 - protein, 26 aa, Entamoeba histolytica
SDITRRLIELLLIRGYSFNRTADFET

SEQ ID NO: 2726055 - protein, 33 aa, Entamoeba histolytica
SDIVMLDDLLWTRHFPIAFLMRQHMLLLGRSEE

SEQ ID NO: 2726056 - protein, 20 aa, Entamoeba histolytica
SDIYPILLHYIRINGGSLHT

SEQ ID NO: 2726057 - protein, 34 aa, Entamoeba histolytica; identical to SEQ ID NO: 2538909

SEQ ID NO: 2726058 - protein, 26 aa, Entamoeba histolytica
SDKESYFLFTCFCAFWVTLDGQLRIH

SEQ ID NO: 2726059 - protein, 18 aa, Entamoeba histolytica
SDKHDILFTFMFQTQTEE

SEQ ID NO: 2726060 - protein, 17 aa, Entamoeba histolytica
SDKIRQKYAILLGEDEV

SEQ ID NO: 2726061 - protein, 29 aa, Entamoeba histolytica
SDKPILTIEMWYEVLWNIGLVEYYKTEVG

SEQ ID NO: 2726062 - protein, 37 aa, Entamoeba histolytica
SDKPITITLFAAQSMIYFDLPHLDHILHFLYNDHEQQ

SEQ ID NO: 2726063 - protein, 26 aa, Entamoeba histolytica
SDKRIGYLALMLLLDETQEVLTLVTN

SEQ ID NO: 2726064 - protein, 34 aa, Entamoeba histolytica
SDKRKLKWEVILPFEIPYGFELLTKLIKMYTENN

SEQ ID NO: 2726065 - protein, 27 aa, Entamoeba histolytica
SDKSNYKNFLWKILKTLFDDYVDFVDA

SEQ ID NO: 2726066 - protein, 24 aa, Entamoeba histolytica
SDKSSFFFHVLPTGKLVVTKEFNL

SEQ ID NO: 2726067 - protein, 28 aa, Entamoeba histolytica
SDKSSQVHWWYYEDKWVQFRQKESTKIE

SEQ ID NO: 2726068 - protein, 17 aa, Entamoeba histolytica
SDKWVFGCFSQARIPKI

SEQ ID NO: 2726069 - protein, 25 aa, Entamoeba histolytica
SDLEKLFNWTLWKEIPINAKKPIKK

SEQ ID NO: 2726070 - protein, 31 aa, Entamoeba histolytica; identical to SEQ ID NO: 2538917

SEQ ID NO: 2726071 - protein, 25 aa, Entamoeba histolytica
SDLNRFIFSIIVSDISFIFVMDDEN

SEQ ID NO: 2726072 - protein, 20 aa, Entamoeba histolytica
SDLSLLRQWTGKQTFRLLFD

SEQ ID NO: 2726073 - protein, 20 aa, Entamoeba histolytica
SDLTFIEMLNNIRYGFVTKK

SEQ ID NO: 2726074 - protein, 26 aa, Entamoeba histolytica
SDLTFKLNKSAVFLEMEKYDECIKLC

SEQ ID NO: 2726075 - protein, 29 aa, Entamoeba histolytica
SDLVSLYIQLFRYKNYPIEYIIPCVKRIP

SEQ ID NO: 2726076 - protein, 19 aa, Entamoeba histolytica
SDMLQLAINVYFQPIQKSN

SEQ ID NO: 2726077 - protein, 22 aa, Entamoeba histolytica
SDNFYHNRKLSTITAPSDVLKD

SEQ ID NO: 2726078 - protein, 25 aa, Entamoeba histolytica
SDNIPLNAFGYVQSKWMGEQICKRG

SEQ ID NO: 2726079 - protein, 24 aa, Entamoeba histolytica
SDNVWEMYYLLFGMMEQEQLDSML

SEQ ID NO: 2726080 - protein, 26 aa, Entamoeba histolytica
SDNYLLRIWDSIFAFPTSKFYYFLVV

SEQ ID NO: 2726081 - protein, 25 aa, Entamoeba histolytica
SDPTTFIFSLRNPMKRSPIKFPFTG

SEQ ID NO: 2726082 - protein, 19 aa, Entamoeba histolytica
SDQFRNIISKCTKPHFICI

SEQ ID NO: 2726083 - protein, 25 aa, Entamoeba histolytica
SDQIRLLFHFIITSYNDSFIQPICI

SEQ ID NO: 2726084 - protein, 22 aa, Entamoeba histolytica
SDQLSRLFPRVTPKLVVTIKRF

SEQ ID NO: 2726085 - protein, 23 aa, Entamoeba histolytica
SDRAPLYDWVVDTFGMRKPIIEV

SEQ ID NO: 2726086 - protein, 25 aa, Entamoeba histolytica
SDREDYLILSAIKLALEQQMSTLTS

SEQ ID NO: 2726087 - protein, 25 aa, Entamoeba histolytica
SDRFDPRWLTSHFNSIFLVVTPEKT

SEQ ID NO: 2726088 - protein, 25 aa, Entamoeba histolytica
SDRIIPTLKSISLIMKWMLSNDLKE

SEQ ID NO: 2726089 - protein, 25 aa, Entamoeba histolytica
SDRRAGDFIIYYNTNFYIGKPETSA

SEQ ID NO: 2726090 - protein, 39 aa, Entamoeba histolytica; identical to SEQ ID NO: 2538949

SEQ ID NO: 2726091 - protein, 32 aa, Entamoeba histolytica
SDTLISLLNVRLPMYLPPLQQQPMIPQYPSYY

SEQ ID NO: 2726092 - protein, 19 aa, Entamoeba histolytica
SDTMRWFDKMTTDSGEVLL

SEQ ID NO: 2726093 - protein, 30 aa, Entamoeba histolytica; identical to SEQ ID NO: 2538950

SEQ ID NO: 2726094 - protein, 25 aa, Entamoeba histolytica
SDTYQDLLVKLIQEGIRKVEDKEVT

SEQ ID NO: 2726095 - protein, 20 aa, Entamoeba histolytica
SDVISYFNFNKDFIPLFSCI

SEQ ID NO: 2726096 - protein, 25 aa, Entamoeba histolytica
SDVKKAILLMLVGATPKIRLRSRVR

SEQ ID NO: 2726097 - protein, 26 aa, Entamoeba histolytica
SDVKKYAILLPINGQLVPFHVAYIKN

SEQ ID NO: 2726098 - protein, 19 aa, Entamoeba histolytica
SDVLKQKLGERALPGDISC

SEQ ID NO: 2726099 - protein, 18 aa, Entamoeba histolytica
SDVRKIVQNIPNSAYFYI

SEQ ID NO: 2726100 - protein, 24 aa, Entamoeba histolytica
SDVSCPWCYVGRKRMLNAISTIKD

SEQ ID NO: 2726101 - protein, 31 aa, Entamoeba histolytica
SDVSYLWSLGIILLRFWFGYKEASSPEEYLR

SEQ ID NO: 2726102 - protein, 32 aa, Entamoeba histolytica
SDVVTYLQQNTPRYILKLSVNYISEAKIEFCE

SEQ ID NO: 2726103 - protein, 27 aa, Entamoeba histolytica
SDVWKMCCDLFDLLALSALIDNRILCV

SEQ ID NO: 2726104 - protein, 27 aa, Entamoeba histolytica
SDVYFGGLYFNMNLMEFGMSKLKAINK

SEQ ID NO: 2726105 - protein, 24 aa, Entamoeba histolytica
SDVYSYGMILWELSTLSAPFPQFH

SEQ ID NO: 2726106 - protein, 27 aa, Entamoeba histolytica
SDWGRTYIIPIISLYYTHPNYKIRQST

SEQ ID NO: 2726107 - protein, 24 aa, Entamoeba histolytica
SDWKPLTVPPLPLLKTMKIKQCQT

SEQ ID NO: 2726108 - protein, 25 aa, Entamoeba histolytica
SDWYVELFVDYVRNGKMPLIITCNE

SEQ ID NO: 2726109 - protein, 29 aa, Entamoeba histolytica
SDYFSLGSMIFEFICGIPPFHEETPDAIF

SEQ ID NO: 2726110 - protein, 27 aa, Entamoeba histolytica
SDYIRSTYFHPTKPWILSCSDDRTIRI

SEQ ID NO: 2726111 - protein, 22 aa, Entamoeba histolytica
SDYTFKILIIGESGVGKTAILE

SEQ ID NO: 2726112 - protein, 27 aa, Entamoeba histolytica
SEAATQATLLLYPDYKDIRKQVNVRIV

SEQ ID NO: 2726113 - protein, 25 aa, Entamoeba histolytica
SEAMKFLLARYYAGRMIQPSYSHVT

SEQ ID NO: 2726114 - protein, 23 aa, Entamoeba histolytica
SECLPLTIYLKYPDDVEFKGNNP

SEQ ID NO: 2726115 - protein, 42 aa, Entamoeba histolytica
SECQNTELFNRPSIFLFIFDENNNVFGWYFPQGINENGIGEY

SEQ ID NO: 2726116 - protein, 32 aa, Entamoeba histolytica
SEDAHKLIKRFWPGALTIIFPRNEAVPNEVTA

SEQ ID NO: 2726117 - protein, 19 aa, Entamoeba histolytica
SEDCNICIWNIPEDCPSGN

SEQ ID NO: 2726118 - protein, 24 aa, Entamoeba histolytica
SEDLDKIFNAALKKTFKFTETGEM

SEQ ID NO: 2726119 - protein, 25 aa, Entamoeba histolytica
SEDTYKLIHYLIKYAENESDDQLIQ

SEQ ID NO: 2726120 - protein, 31 aa, Entamoeba histolytica
SEEDKYMNIFYGFELFFIISKQGVIVLNTTN

SEQ ID NO: 2726121 - protein, 25 aa, Entamoeba histolytica
SEEEDPYVLLFKRCDVNGDGVLDKK

SEQ ID NO: 2726122 - protein, 23 aa, Entamoeba histolytica
SEEEIEMLLTWASSLPSLNVERI

SEQ ID NO: 2726123 - protein, 28 aa, Entamoeba histolytica
SEEEILQYKFIIPIIPKLQANHFINFLE

SEQ ID NO: 2726124 - protein, 25 aa, Entamoeba histolytica
SEEEQLFAFFKYYEFIISQSDNMVE

SEQ ID NO: 2726125 - protein, 37 aa, Entamoeba histolytica; identical to SEQ ID NO: 2538993

SEQ ID NO: 2726126 - protein, 23 aa, Entamoeba histolytica
SEEKSMMPFGRYKRDITDIFSVM

SEQ ID NO: 2726127 - protein, 38 aa, Entamoeba histolytica
SEELWSLALDPFLPDYLTSIFVYVAPLFTTLEFIVDHL

SEQ ID NO: 2726128 - protein, 33 aa, Entamoeba histolytica
SEEQYNFIIQLLNEFYTKIYPFIPSNKSHVIDQ

SEQ ID NO: 2726129 - protein, 27 aa, Entamoeba histolytica
SEEVPPPIYQPPYIPTPQQPSFIMSQP

SEQ ID NO: 2726130 - protein, 35 aa, Entamoeba histolytica
SEEYARLRPLSYPGTDVFIVLFSITDPDSYNHVEK

SEQ ID NO: 2726131 - protein, 34 aa, Entamoeba histolytica
SEEYNLPPDLLQTYKYSIMIKPVSDEEKVFFFCD

SEQ ID NO: 2726132 - protein, 23 aa, Entamoeba histolytica
SEFEKEIFTVELPRIVVKNNVNI

SEQ ID NO: 2726133 - protein, 17 aa, Entamoeba histolytica
SEFKILMKFLSKNFDNF

SEQ ID NO: 2726134 - protein, 24 aa, Entamoeba histolytica
SEFKVSFFNAMVDKFYSSIIEEQT

SEQ ID NO: 2726135 - protein, 24 aa, Entamoeba histolytica
SEFLKVFVIALQRHGPQILLVPGR

SEQ ID NO: 2726136 - protein, 23 aa, Entamoeba histolytica
SEFMKAIVLPGIGFIGIADKHIV

SEQ ID NO: 2726137 - protein, 25 aa, Entamoeba histolytica
SEGDSFTHSFALQQEDLEKKEENNE

SEQ ID NO: 2726138 - protein, 26 aa, Entamoeba histolytica
SEGGKYYVWKLGEFLKRNPGAQKYKE

SEQ ID NO: 2726139 - protein, 23 aa, Entamoeba histolytica
SEGGLIRTGIRPNRKTGRQAPTK

SEQ ID NO: 2726140 - protein, 17 aa, Entamoeba histolytica
SEGLNKLYTYLCDEIRA

SEQ ID NO: 2726141 - protein, 25 aa, Entamoeba histolytica
SEGNNYLPPIFTIEPIEIDLDTFQT

SEQ ID NO: 2726142 - protein, 24 aa, Entamoeba histolytica
SEGQYGIPKGIFFSMPVVCYGGEY

SEQ ID NO: 2726143 - protein, 33 aa, Entamoeba histolytica
SEGRLYYQLPRIIENILVYLYNKGCTTHGIFRE

SEQ ID NO: 2726144 - protein, 23 aa, Entamoeba histolytica
SEGVDLIQFWNNTVKPLFISSPQ

SEQ ID NO: 2726145 - protein, 21 aa, Entamoeba histolytica
SEGVGLILEILPQNNKLLVLN

SEQ ID NO: 2726146 - protein, 24 aa, Entamoeba histolytica
SEGYYAFSILLKGIELNLFTFEED

SEQ ID NO: 2726147 - protein, 23 aa, Entamoeba histolytica
SEHATRIKLLLNELNKQMSVYGQ

SEQ ID NO: 2726148 - protein, 17 aa, Entamoeba histolytica
SEHWRPSSYYPKIKINR

SEQ ID NO: 2726149 - protein, 28 aa, Entamoeba histolytica
SEHWSFIVMELIETGCLLDYLYKHQLTN

SEQ ID NO: 2726150 - protein, 17 aa, Entamoeba histolytica
SEHYVVYGEPRNEYMDE

SEQ ID NO: 2726151 - protein, 19 aa, Entamoeba histolytica
SEIFAFMKTPVHNLCFYKN

SEQ ID NO: 2726152 - protein, 21 aa, Entamoeba histolytica
SEIGDFWFYGCSSLKSINIPT

SEQ ID NO: 2726153 - protein, 28 aa, Entamoeba histolytica
SEIGECCFFWCYSLRTINIPTSVNEIGD

SEQ ID NO: 2726154 - protein, 46 aa, Entamoeba histolytica
SEIIPFFLDIFGSLLLKFNIYGGWTFIYQILYSVLKYNSSSILPLN

SEQ ID NO: 2726155 - protein, 20 aa, Entamoeba histolytica
SEIISFHFFNSFNYLPIACL

SEQ ID NO: 2726156 - protein, 31 aa, Entamoeba histolytica
SEIKDGRIIISLPFRLKYVCSFENIPFVKLG

SEQ ID NO: 2726157 - protein, 27 aa, Entamoeba histolytica
SEIKDIKYILLKIIRKITKKVISRKEV

SEQ ID NO: 2726158 - protein, 19 aa, Entamoeba histolytica
SEIKIMKMQNRKNVLKPKG

SEQ ID NO: 2726159 - protein, 18 aa, Entamoeba histolytica
SEINFIKQQFKFSKPFMT

SEQ ID NO: 2726160 - protein, 31 aa, Entamoeba histolytica
SEIVFQKIWKYLVPFYIRCGLHPIEDVAMSV

SEQ ID NO: 2726161 - protein, 21 aa, Entamoeba histolytica
SEIVRGIIVNLFEYKLYVILD

SEQ ID NO: 2726162 - protein, 26 aa, Entamoeba histolytica
SEKAQHILYFWQGRDASLMDMGTLAH

SEQ ID NO: 2726163 - protein, 24 aa, Entamoeba histolytica
SEKDLQIILVKDTRYFLTLHQQNH

SEQ ID NO: 2726164 - protein, 27 aa, Entamoeba histolytica
SEKEKEMILPLLKWKGKDIDLSTSMFI

SEQ ID NO: 2726165 - protein, 22 aa, Entamoeba histolytica
SEKFFKVFVPVFIQCFHDQLQD

SEQ ID NO: 2726166 - protein, 23 aa, Entamoeba histolytica
SEKGIIKIIKARHPLIENNSINS

SEQ ID NO: 2726167 - protein, 30 aa, Entamoeba histolytica
SEKIIGDILKLPTFQRLLMTYSFCGNVGNQ

SEQ ID NO: 2726168 - protein, 17 aa, Entamoeba histolytica
SEKKLFDFITNTFLASI

SEQ ID NO: 2726169 - protein, 22 aa, Entamoeba histolytica
SEKNFLIRGIGSLLFENIKGVK

SEQ ID NO: 2726170 - protein, 26 aa, Entamoeba histolytica
SEKNKLLHKLGITTTVPGFFNCQGRL

SEQ ID NO: 2726171 - protein, 27 aa, Entamoeba histolytica
SEKNKQKFGFWLEDKEGVIFKFTKTTE

SEQ ID NO: 2726172 - protein, 22 aa, Entamoeba histolytica
SEKQILSHFLFTNKIADYATLK

SEQ ID NO: 2726173 - protein, 22 aa, Entamoeba histolytica
SEKRVYWKEFTEAVVSLLMKGK

SEQ ID NO: 2726174 - protein, 21 aa, Entamoeba histolytica
SELDWNGYFPTIIEILRDPRP

SEQ ID NO: 2726175 - protein, 26 aa, Entamoeba histolytica
SELECSLLTLPMIWNENRFKETIETY

SEQ ID NO: 2726176 - protein, 29 aa, Entamoeba histolytica
SELGTRRRVFVIPYLLYQTMNRASLPGEV

SEQ ID NO: 2726177 - protein, 25 aa, Entamoeba histolytica
SELKVELPFPLKKTHHLLFTITDVS

SEQ ID NO: 2726178 - protein, 25 aa, Entamoeba histolytica
SELKYSNITLFRNLIDYLPSLAKED

SEQ ID NO: 2726179 - protein, 24 aa, Entamoeba histolytica
SELTMIMLDFIKRGIKRLSVLLSG

SEQ ID NO: 2726180 - protein, 22 aa, Entamoeba histolytica
SELYIAYQYYYFYDKDVDFKQF

SEQ ID NO: 2726181 - protein, 23 aa, Entamoeba histolytica
SEMELYHFVYVISIAPGELWKTL

SEQ ID NO: 2726182 - protein, 28 aa, Entamoeba histolytica
SEMLGGLQACARAFAARKHFSVLREQQV

SEQ ID NO: 2726183 - protein, 19 aa, Entamoeba histolytica
SEMLLFICGLNKTSNKRKI

SEQ ID NO: 2726184 - protein, 24 aa, Entamoeba histolytica
SEMRRYICDVLSLDTGRFSDLFRS

SEQ ID NO: 2726185 - protein, 18 aa, Entamoeba histolytica
SEMRSGLTGLKFYNPETK

SEQ ID NO: 2726186 - protein, 22 aa, Entamoeba histolytica
SENDLRLTLEYYSRTFNQPEKQ

SEQ ID NO: 2726187 - protein, 17 aa, Entamoeba histolytica
SENIGITNLPRYLTYII

SEQ ID NO: 2726188 - protein, 22 aa, Entamoeba histolytica
SENIVPPLPFKMKAISDFMEIS

SEQ ID NO: 2726189 - protein, 32 aa, Entamoeba histolytica
SENKIISVNKLLLKPSLFLNLTNNQITSIGDI

SEQ ID NO: 2726190 - protein, 24 aa, Entamoeba histolytica
SENKRQCEFYIYGTKPNSIEKIKH

SEQ ID NO: 2726191 - protein, 25 aa, Entamoeba histolytica
SENKVEWKLVVKKAENWLASKPAIS

SEQ ID NO: 2726192 - protein, 27 aa, Entamoeba histolytica
SENLNKWIDLIFGYLQRPPAAFDADNV

SEQ ID NO: 2726193 - protein, 32 aa, Entamoeba histolytica; identical to SEQ ID NO: 2539061

SEQ ID NO: 2726194 - protein, 23 aa, Entamoeba histolytica
SEQLTVIFKNKFLNFLKNYDHKH

SEQ ID NO: 2726195 - protein, 23 aa, Entamoeba histolytica
SEQLWKIPMILSCGEYKQTYLLT

SEQ ID NO: 2726196 - protein, 26 aa, Entamoeba histolytica
SEQTNLIFFMYFDNGNIMGLYFQKKI

SEQ ID NO: 2726197 - protein, 24 aa, Entamoeba histolytica
SEQYIKIMPFEVIVLNAYLHMLKD

SEQ ID NO: 2726198 - protein, 20 aa, Entamoeba histolytica
SERFRSMVSMYYRGVSSCMI

SEQ ID NO: 2726199 - protein, 19 aa, Entamoeba histolytica
SERGAVIIPIYYQNNEKVE

SEQ ID NO: 2726200 - protein, 27 aa, Entamoeba histolytica
SERLCVLHILYKNLFIDQFKIQYQTIH

SEQ ID NO: 2726201 - protein, 19 aa, Entamoeba histolytica
SERLVYLSLNLINNLIASF

SEQ ID NO: 2726202 - protein, 26 aa, Entamoeba histolytica
SESDLNIILFRILSSGTPLQVIDLHH

SEQ ID NO: 2726203 - protein, 24 aa, Entamoeba histolytica
SESIPAWYHALSLIRLLCSDAPES

SEQ ID NO: 2726204 - protein, 21 aa, Entamoeba histolytica
SESKFSSLLLVLHKYTATSHP

SEQ ID NO: 2726205 - protein, 23 aa, Entamoeba histolytica
SESKRILVTLTGDFGKILSGLHE

SEQ ID NO: 2726206 - protein, 25 aa, Entamoeba histolytica
SESLILLLPSIRYYSQLFSHLSVVD

SEQ ID NO: 2726207 - protein, 28 aa, Entamoeba histolytica
SESQNHLVLKVPPLTIPIQSSFTYKPQS

SEQ ID NO: 2726208 - protein, 23 aa, Entamoeba histolytica
SESRELFLPLRMSVELSLESFFR

SEQ ID NO: 2726209 - protein, 22 aa, Entamoeba histolytica
SESSIKPIFLRKASTSVSVNAK

SEQ ID NO: 2726210 - protein, 29 aa, Entamoeba histolytica
SESTEFLSICQFLLPIELRYSSQLSISLL

SEQ ID NO: 2726211 - protein, 26 aa, Entamoeba histolytica
SETFYYTFPSIYFQRSPTFIIWGLYL

SEQ ID NO: 2726212 - protein, 22 aa, Entamoeba histolytica
SETMFVLLKQLLGITFNVIPQG

SEQ ID NO: 2726213 - protein, 28 aa, Entamoeba histolytica
SETNVFVKNLPFTLTDEGFKKLFEKYDV

SEQ ID NO: 2726214 - protein, 24 aa, Entamoeba histolytica
SETRIKYEFIIDPSAFHELQTFAD

SEQ ID NO: 2726215 - protein, 24 aa, Entamoeba histolytica
SETSFILLARGIHKVTFYAMIRNS

SEQ ID NO: 2726216 - protein, 28 aa, Entamoeba histolytica
SETSQNFFYFPFINVLVQPVTVALESKF

SEQ ID NO: 2726217 - protein, 28 aa, Entamoeba histolytica
SETVYISSLALLKMLKHGRAGVPVEVMG

SEQ ID NO: 2726218 - protein, 28 aa, Entamoeba histolytica
SEVLELHRLLNKWPLLEPTHALELLDFR

SEQ ID NO: 2726219 - protein, 29 aa, Entamoeba histolytica
SEVLELHRLLNKWPLLEPTHALELLDFRF

SEQ ID NO: 2726220 - protein, 25 aa, Entamoeba histolytica
SEVRPLQVLYKSLNYVLTKYKENKK

SEQ ID NO: 2726221 - protein, 25 aa, Entamoeba histolytica
SEVSSNFRICALDPAPIITPGESSM

SEQ ID NO: 2726222 - protein, 26 aa, Entamoeba histolytica
SEYEVVKMRSILYGLLEKIEILTMKV

SEQ ID NO: 2726223 - protein, 28 aa, Entamoeba histolytica
SEYFDNAPVFIIPGRRFPVTIEYLTEPE

SEQ ID NO: 2726224 - protein, 35 aa, Entamoeba histolytica
SEYGVSYVTILHELQKTYNWKKSFGVIKKTKKVVV

SEQ ID NO: 2726225 - protein, 27 aa, Entamoeba histolytica
SEYIPFTNNYFFKWQFNDTITCKLGIQ

SEQ ID NO: 2726226 - protein, 24 aa, Entamoeba histolytica
SEYLPHLRNLFKALSLTYKKMSTQ

SEQ ID NO: 2726227 - protein, 20 aa, Entamoeba histolytica
SEYNLLFKMIDMLGMLPNEM

SEQ ID NO: 2726228 - protein, 40 aa, Entamoeba histolytica
SEYNMIYHFKGKQYVLTFPRKVVKIYPLNVPFSLEYVVMV

SEQ ID NO: 2726229 - protein, 25 aa, Entamoeba histolytica
SEYNMLFKFINMLGMPPRNLLDKGS

SEQ ID NO: 2726230 - protein, 28 aa, Entamoeba histolytica
SEYQNGVPCFWLHVLKNSGIFDGLSGNE

SEQ ID NO: 2726231 - protein, 17 aa, Entamoeba histolytica
SEYWTYFGTAYKNMCKD

SEQ ID NO: 2726232 - protein, 24 aa, Entamoeba histolytica
SFAEGLVHIIPSQAEILAGQQEIP

SEQ ID NO: 2726233 - protein, 20 aa, Entamoeba histolytica
SFALPAPRQSIRRSIVPPRQ

SEQ ID NO: 2726234 - protein, 17 aa, Entamoeba histolytica
SFAPYCLPLIPKTVEWL

SEQ ID NO: 2726235 - protein, 24 aa, Entamoeba histolytica
SFCEGDEMIALSSDLKWVYVQHPE

SEQ ID NO: 2726236 - protein, 18 aa, Entamoeba histolytica
SFCFLKQYTQLKSLSLIV

SEQ ID NO: 2726237 - protein, 17 aa, Entamoeba histolytica
SFCLPFYWNGSRNEADF

SEQ ID NO: 2726238 - protein, 25 aa, Entamoeba histolytica
SFCNYFKRVKIFKALISLSIGEINV

SEQ ID NO: 2726239 - protein, 28 aa, Entamoeba histolytica
SFCQRSFIQAFLFIFRNSIDTANQQISA

SEQ ID NO: 2726240 - protein, 24 aa, Entamoeba histolytica
SFDFKNDYYIGHTGLIYGTTDENN

SEQ ID NO: 2726241 - protein, 19 aa, Entamoeba histolytica
SFDIDGIDPEFILGTGTPV

SEQ ID NO: 2726242 - protein, 20 aa, Entamoeba histolytica
SFDLKNTNQLFSEYKTRTNK

SEQ ID NO: 2726243 - protein, 25 aa, Entamoeba histolytica
SFDLTNFQYIKLLIDKIITSDELEA

SEQ ID NO: 2726244 - protein, 28 aa, Entamoeba histolytica
SFDSDYFPLPMLFHTVPPLQLSPSKVET

SEQ ID NO: 2726245 - protein, 32 aa, Entamoeba histolytica
SFEALQQGMLFALLSNYGYGFRLKRPERMAKK

SEQ ID NO: 2726246 - protein, 18 aa, Entamoeba histolytica
SFEEYFQWFIGGLKNAMN

SEQ ID NO: 2726247 - protein, 30 aa, Entamoeba histolytica
SFEIKYTKPLYRTILSCILKNIEWNMLDNK

SEQ ID NO: 2726248 - protein, 27 aa, Entamoeba histolytica
SFELQKKWYFPIIQSIKPQQFSQIIAW

SEQ ID NO: 2726249 - protein, 20 aa, Entamoeba histolytica
SFENVVVTVPLSFGENEREA

SEQ ID NO: 2726250 - protein, 20 aa, Entamoeba histolytica
SFEPPCIYVLQKTGMTFRIS

SEQ ID NO: 2726251 - protein, 23 aa, Entamoeba histolytica
SFETTLTRPILMHFAVESITYEV

SEQ ID NO: 2726252 - protein, 24 aa, Entamoeba histolytica
SFEVPCQIALYLPIRGLSYEKKDC

SEQ ID NO: 2726253 - protein, 20 aa, Entamoeba histolytica
SFFQKRYFQFLLSNPSQSRS

SEQ ID NO: 2726254 - protein, 25 aa, Entamoeba histolytica
SFGDTLFNAPISVPPKLSIGDFNEF

SEQ ID NO: 2726255 - protein, 31 aa, Entamoeba histolytica; identical to SEQ ID NO: 2539128

SEQ ID NO: 2726256 - protein, 17 aa, Entamoeba histolytica
SFGVIKKTKKVVVPIDV

SEQ ID NO: 2726257 - protein, 21 aa, Entamoeba histolytica
SFGVLNILKYLTKQEIKEMFD

SEQ ID NO: 2726258 - protein, 19 aa, Entamoeba histolytica
SFGYKLLERILYIESTPYN

SEQ ID NO: 2726259 - protein, 33 aa, Entamoeba histolytica
SFHSNEIYQHLYFPCLIPLKETIDILKGFYPET

SEQ ID NO: 2726260 - protein, 19 aa, Entamoeba histolytica
SFHYLIKTLCLEDLMSLRC

SEQ ID NO: 2726261 - protein, 20 aa, Entamoeba histolytica
SFIDFPTILSKLPKLQRLSL

SEQ ID NO: 2726262 - protein, 35 aa, Entamoeba histolytica
SFIEFEGKYLLGDRFFRLNPKLPYQIDLDYCKDVE

SEQ ID NO: 2726263 - protein, 22 aa, Entamoeba histolytica
SFIIPDFLPNEIMTLPIPLSES

SEQ ID NO: 2726264 - protein, 28 aa, Entamoeba histolytica
SFIKGLPKNNIMIIKQLFGLLYKINTYS

SEQ ID NO: 2726265 - protein, 19 aa, Entamoeba histolytica
SFIKNGMIYSYRKDPEPTS

SEQ ID NO: 2726266 - protein, 19 aa, Entamoeba histolytica
SFIQYLSNLGGISLTLILP

SEQ ID NO: 2726267 - protein, 21 aa, Entamoeba histolytica
SFITLDFGLIKRLEITDSEVI

SEQ ID NO: 2726268 - protein, 18 aa, Entamoeba histolytica
SFIYTFQCLPLCCLVSTL

SEQ ID NO: 2726269 - protein, 19 aa, Entamoeba histolytica
SFKDGVLLQILFNKLNNNI

SEQ ID NO: 2726270 - protein, 21 aa, Entamoeba histolytica
SFKEMLYYENYYKAIMWILYL

SEQ ID NO: 2726271 - protein, 28 aa, Entamoeba histolytica
SFKEVFNQYLPFNPFLFSQKKQQIEFKT

SEQ ID NO: 2726272 - protein, 19 aa, Entamoeba histolytica
SFKFHLNSLINYNILSSSN

SEQ ID NO: 2726273 - protein, 18 aa, Entamoeba histolytica
SFKGKRLSFREKKKEGIE

SEQ ID NO: 2726274 - protein, 23 aa, Entamoeba histolytica
SFKHRIIIQLESRFQLISTIKNY

SEQ ID NO: 2726275 - protein, 19 aa, Entamoeba histolytica
SFKKPKRVISVQRELKENE

SEQ ID NO: 2726276 - protein, 24 aa, Entamoeba histolytica
SFKLKRPQLKRKYLTILKQLRTEI

SEQ ID NO: 2726277 - protein, 17 aa, Entamoeba histolytica
SFKMPHLPKVGVLYFNG

SEQ ID NO: 2726278 - protein, 18 aa, Entamoeba histolytica
SFKMYLNNVFYNAGISQV

SEQ ID NO: 2726279 - protein, 35 aa, Entamoeba histolytica
SFKRGDMIDLLRKDGLWWFGELNGIKGYFPSNYVQ

SEQ ID NO: 2726280 - protein, 29 aa, Entamoeba histolytica
SFKTIEGFSLQYFLIINIHLKDTSNSKTE

SEQ ID NO: 2726281 - protein, 21 aa, Entamoeba histolytica
SFKTWWNYIEYFDESHFQSKI

SEQ ID NO: 2726282 - protein, 18 aa, Entamoeba histolytica
SFKWTQEKHYSLSKPVFD

SEQ ID NO: 2726283 - protein, 17 aa, Entamoeba histolytica
SFKYNLGQITFKHFIIL

SEQ ID NO: 2726284 - protein, 19 aa, Entamoeba histolytica
SFLCALHGNDFFWVHGYNK

SEQ ID NO: 2726285 - protein, 17 aa, Entamoeba histolytica
SFLDKYVVFLHKHILES

SEQ ID NO: 2726286 - protein, 27 aa, Entamoeba histolytica
SFLEHLYSFQKLQGPFLIVVPLSMIEH

SEQ ID NO: 2726287 - protein, 17 aa, Entamoeba histolytica
SFLFPFAADIRPRANEW

SEQ ID NO: 2726288 - protein, 19 aa, Entamoeba histolytica
SFLLVHVLSTLGKTSHFPL

SEQ ID NO: 2726289 - protein, 19 aa, Entamoeba histolytica
SFLPGGVIIDQVLDRVPKW

SEQ ID NO: 2726290 - protein, 17 aa, Entamoeba histolytica
SFLQFLKSKSAKKENQK

SEQ ID NO: 2726291 - protein, 34 aa, Entamoeba histolytica
SFMADPFARMLILRFVFCRLVLLSLKLPGDADNF

SEQ ID NO: 2726292 - protein, 28 aa, Entamoeba histolytica
SFMEEYSILNLFMKKLISSPSPREKDVK

SEQ ID NO: 2726293 - protein, 25 aa, Entamoeba histolytica
SFMGKVLCGILKRAQKYKIKVIAIG

SEQ ID NO: 2726294 - protein, 33 aa, Entamoeba histolytica
SFMPSTMLMPFIRRVIFFLAPTTELRTITVSHN

SEQ ID NO: 2726295 - protein, 20 aa, Entamoeba histolytica
SFMSFMENPFWRVRLQIASS

SEQ ID NO: 2726296 - protein, 27 aa, Entamoeba histolytica
SFNAVRRFYIFLCLQPHVMGLVKALKI

SEQ ID NO: 2726297 - protein, 23 aa, Entamoeba histolytica
SFNDGLLICQVIDKIKPGVINWS

SEQ ID NO: 2726298 - protein, 19 aa, Entamoeba histolytica
SFNDLIIMPVQRLMRYPIL

SEQ ID NO: 2726299 - protein, 19 aa, Entamoeba histolytica
SFNIINDFKSFFDELLKDY

SEQ ID NO: 2726300 - protein, 24 aa, Entamoeba histolytica
SFNLKTLFMMLTVPRRTKVISSQS

SEQ ID NO: 2726301 - protein, 19 aa, Entamoeba histolytica
SFNLKYIQEWTGHKSHTII

SEQ ID NO: 2726302 - protein, 23 aa, Entamoeba histolytica
SFNLLYHDVTLPKEPLYSQNGVI

SEQ ID NO: 2726303 - protein, 22 aa, Entamoeba histolytica
SFNQLLSFGYLFDQSECSYKLF

SEQ ID NO: 2726304 - protein, 18 aa, Entamoeba histolytica
SFPIYRLEHLFLQLNEND

SEQ ID NO: 2726305 - protein, 20 aa, Entamoeba histolytica
SFPKRPISDTLVKLISALLQ

SEQ ID NO: 2726306 - protein, 23 aa, Entamoeba histolytica
SFPNEPIIIPIRIKRSKPKYYCF

SEQ ID NO: 2726307 - protein, 18 aa, Entamoeba histolytica
SFPWIQLSNFFIGRIFYT

SEQ ID NO: 2726308 - protein, 22 aa, Entamoeba histolytica
SFQEYMWLTQLEFVRTVRGQLV

SEQ ID NO: 2726309 - protein, 19 aa, Entamoeba histolytica
SFQKLFLKFIKNLIERDDI

SEQ ID NO: 2726310 - protein, 25 aa, Entamoeba histolytica
SFQLSPFLYFQPDVFVLAFDVSNIK

SEQ ID NO: 2726311 - protein, 26 aa, Entamoeba histolytica
SFQYSTFFIPFYNQFVRYYFKNYLLD

SEQ ID NO: 2726312 - protein, 19 aa, Entamoeba histolytica
SFRCLCHYIRLFCENPLCS

SEQ ID NO: 2726313 - protein, 25 aa, Entamoeba histolytica
SFRDSKQFPHLLLCGQPGIGKTTSI

SEQ ID NO: 2726314 - protein, 18 aa, Entamoeba histolytica
SFRFGSWPHAGCGIGLER

SEQ ID NO: 2726315 - protein, 21 aa, Entamoeba histolytica
SFRHVYNWLSEARRFCNKENV

SEQ ID NO: 2726316 - protein, 41 aa, Entamoeba histolytica; identical to SEQ ID NO: 2539184

SEQ ID NO: 2726317 - protein, 18 aa, Entamoeba histolytica
SFRMLNLNQIAYVGRDLY

SEQ ID NO: 2726318 - protein, 23 aa, Entamoeba histolytica
SFRNLLLSINILSLLIPVGFCNE

SEQ ID NO: 2726319 - protein, 18 aa, Entamoeba histolytica
SFSAYITFKTAESSIQCI

SEQ ID NO: 2726320 - protein, 25 aa, Entamoeba histolytica
SFSKLTLNIPWKNKKWIASSLPLLT

SEQ ID NO: 2726321 - protein, 30 aa, Entamoeba histolytica
SFSKRLWDNLDQILIGILLRKIEKTEEIRK

SEQ ID NO: 2726322 - protein, 30 aa, Entamoeba histolytica
SFSSPDFTYFPQWILDYLHIQPGDVATIFK

SEQ ID NO: 2726323 - protein, 24 aa, Entamoeba histolytica
SFSTVYEIMRLDFLCVIRDYPLMI

SEQ ID NO: 2726324 - protein, 26 aa, Entamoeba histolytica
SFSVQWNIFMKTGILMLKYLDPSRKE

SEQ ID NO: 2726325 - protein, 18 aa, Entamoeba histolytica
SFTAIFVGSILKGKSIEQ

SEQ ID NO: 2726326 - protein, 19 aa, Entamoeba histolytica
SFTANFLKSLPKGLAKCVD

SEQ ID NO: 2726327 - protein, 41 aa, Entamoeba histolytica
SFTKELQFFPFLETLKLTFFSPLILCYIPTSVKRIYLQKEI

SEQ ID NO: 2726328 - protein, 35 aa, Entamoeba histolytica
SFTKELQFFPLLETLKLTFFSPLILCCIPTSVKRI

SEQ ID NO: 2726329 - protein, 19 aa, Entamoeba histolytica
SFTPTILMIKKSIEYLIQK

SEQ ID NO: 2726330 - protein, 36 aa, Entamoeba histolytica
SFTTQYIEMILFYIQVFRTPTLTKFFKIVITDYNGL

SEQ ID NO: 2726331 - protein, 18 aa, Entamoeba histolytica
SFVKLLVLPLYDASNTLT

SEQ ID NO: 2726332 - protein, 24 aa, Entamoeba histolytica
SFVLNGGKFLGICAGAYFSSSYIK

SEQ ID NO: 2726333 - protein, 21 aa, Entamoeba histolytica
SFVLSFTFKPNPYLLYNTLTK

SEQ ID NO: 2726334 - protein, 27 aa, Entamoeba histolytica
SFVNAIYGIKITDDFRYIIINEDNLKQ

SEQ ID NO: 2726335 - protein, 25 aa, Entamoeba histolytica
SFVNALYGIKITDDFRYIIINEDNL

SEQ ID NO: 2726336 - protein, 26 aa, Entamoeba histolytica
SFVNALYGIKITDDFRYIIINEGDLK

SEQ ID NO: 2726337 - protein, 21 aa, Entamoeba histolytica
SFVTTYLPIDGNNVKIVIWDT

SEQ ID NO: 2726338 - protein, 17 aa, Entamoeba histolytica
SFWTWKATALGKNMTSV

SEQ ID NO: 2726339 - protein, 22 aa, Entamoeba histolytica
SGAKFQIIYKGDGTSFKIVDTK

SEQ ID NO: 2726340 - protein, 28 aa, Entamoeba histolytica
SGASNEILVLIHRLMYQRQGSQKERLNN

SEQ ID NO: 2726341 - protein, 22 aa, Entamoeba histolytica
SGCKHLLGTYALFQHLEQRTNG

SEQ ID NO: 2726342 - protein, 20 aa, Entamoeba histolytica
SGCNYIKCICGCGYCYKCHK

SEQ ID NO: 2726343 - protein, 17 aa, Entamoeba histolytica
SGCNYLHVLPIPNQFAS

SEQ ID NO: 2726344 - protein, 25 aa, Entamoeba histolytica
SGCTAAVVLVIGRFLICANVGDSEV

SEQ ID NO: 2726345 - protein, 23 aa, Entamoeba histolytica
SGCVQLKEILLPSSLKRIEEKCF

SEQ ID NO: 2726346 - protein, 27 aa, Entamoeba histolytica
SGDANGKIFIWSWKKGKILKVFEHAHK

SEQ ID NO: 2726347 - protein, 26 aa, Entamoeba histolytica
SGDEKGIFRIWDFRTMKTIKAFQAPN

SEQ ID NO: 2726348 - protein, 22 aa, Entamoeba histolytica
SGDWDLIVEGRYDYIIGGDVTY

SEQ ID NO: 2726349 - protein, 38 aa, Entamoeba histolytica
SGEFLFPGLIDCHLHAPQYAFIGTAFGKPLLEWLEATV

SEQ ID NO: 2726350 - protein, 25 aa, Entamoeba histolytica
SGEILHQLLMIYYSKYPLFNNFEQF

SEQ ID NO: 2726351 - protein, 22 aa, Entamoeba histolytica
SGEMAPFNGLDWIETPVNTIIL

SEQ ID NO: 2726352 - protein, 17 aa, Entamoeba histolytica
SGFPQEFSQFLVKLFEM

SEQ ID NO: 2726353 - protein, 30 aa, Entamoeba histolytica
SGFTTLPFDSSFFIGLLDLGGKELLKKLIL

SEQ ID NO: 2726354 - protein, 38 aa, Entamoeba histolytica
SGGQKSLLALSLILAILLYKPSPLYILDEVDAALDVSN

SEQ ID NO: 2726355 - protein, 24 aa, Entamoeba histolytica
SGHQRFLMTILDPAVTPGQNQKDI

SEQ ID NO: 2726356 - protein, 18 aa, Entamoeba histolytica
SGIKHWCKNTHVFSVEID

SEQ ID NO: 2726357 - protein, 20 aa, Entamoeba histolytica
SGILLFAKTKIFASSFQSIL

SEQ ID NO: 2726358 - protein, 27 aa, Entamoeba histolytica
SGILYDEYIMMQIPSVLPIQKGVEIEN

SEQ ID NO: 2726359 - protein, 22 aa, Entamoeba histolytica
SGIVPRLFYYLGNVRFNGITNT

SEQ ID NO: 2726360 - protein, 35 aa, Entamoeba histolytica
SGIYGCCEYPLTPDIYTAVFFGWQNSPTTCVMAIT

SEQ ID NO: 2726361 - protein, 24 aa, Entamoeba histolytica
SGKFDQETFLTIMLEYGQEVDSTE

SEQ ID NO: 2726362 - protein, 23 aa, Entamoeba histolytica
SGKKFVMVIPPPNVTGKLHLGHA

SEQ ID NO: 2726363 - protein, 23 aa, Entamoeba histolytica
SGKLLFVEKLINLFQLTEKKVVV

SEQ ID NO: 2726364 - protein, 23 aa, Entamoeba histolytica
SGKMGHFFKPDSFIFGHGGAGNN

SEQ ID NO: 2726365 - protein, 25 aa, Entamoeba histolytica
SGKNNFFIIVRLFSGELFGSYYSKT

SEQ ID NO: 2726366 - protein, 22 aa, Entamoeba histolytica
SGKTISFTLPLMERLRAENERK

SEQ ID NO: 2726367 - protein, 24 aa, Entamoeba histolytica
SGKTLAFLIPIVEILNKIHFQTRN

SEQ ID NO: 2726368 - protein, 24 aa, Entamoeba histolytica
SGKTSVLIRFFSGYFVQMYDPGIE

SEQ ID NO: 2726369 - protein, 22 aa, Entamoeba histolytica
SGLIIIGNIPTLITSKVWNMLI

SEQ ID NO: 2726370 - protein, 30 aa, Entamoeba histolytica
SGLNIALYRLNYVMYLFSIEEPFAKITLNQ

SEQ ID NO: 2726371 - protein, 32 aa, Entamoeba histolytica
SGLVIKLVSSPLYVLFLTLPERQKGMEIMYAA

SEQ ID NO: 2726372 - protein, 23 aa, Entamoeba histolytica
SGMILKYIYDIVKRRIGNNTISN

SEQ ID NO: 2726373 - protein, 21 aa, Entamoeba histolytica
SGMSIVDCTFLTKQKIEAYEN

SEQ ID NO: 2726374 - protein, 24 aa, Entamoeba histolytica
SGMTLDLLCKVLSSLLIPIQSKEF

SEQ ID NO: 2726375 - protein, 24 aa, Entamoeba histolytica
SGNDFIIFPPFIHQIDNIQVTKGC

SEQ ID NO: 2726376 - protein, 23 aa, Entamoeba histolytica
SGNIPGLLIRPADGKSKCTILYS

SEQ ID NO: 2726377 - protein, 25 aa, Entamoeba histolytica
SGNKTGLFHLILRDYGTLESAKIMA

SEQ ID NO: 2726378 - protein, 21 aa, Entamoeba histolytica
SGNPFGTNNLLNSSTTGIQTN

SEQ ID NO: 2726379 - protein, 29 aa, Entamoeba histolytica
SGNYAWNAGIFLWTAKTIINQLKQFAPTV

SEQ ID NO: 2726380 - protein, 20 aa, Entamoeba histolytica
SGNYSQWIEKILSPYDDVNY

SEQ ID NO: 2726381 - protein, 25 aa, Entamoeba histolytica
SGPDIIVATPGRLTFILEGANISLN

SEQ ID NO: 2726382 - protein, 21 aa, Entamoeba histolytica
SGPIDPWRAFKCSCGGIIYPE

SEQ ID NO: 2726383 - protein, 26 aa, Entamoeba histolytica
SGRVAKILHIYQFTKIFVQCPGVLEN

SEQ ID NO: 2726384 - protein, 24 aa, Entamoeba histolytica
SGSFGKVYRGIVAGLPVAIKVPNK

SEQ ID NO: 2726385 - protein, 27 aa, Entamoeba histolytica
SGSIGFFEFLALWNFMNLCNETFKHFD

SEQ ID NO: 2726386 - protein, 25 aa, Entamoeba histolytica
SGSLDVSFLHLAKSSKLLAQWIVLC

SEQ ID NO: 2726387 - protein, 37 aa, Entamoeba histolytica; identical to SEQ ID NO: 2539283

SEQ ID NO: 2726388 - protein, 17 aa, Entamoeba histolytica
SGSTYIWGYCDAHFKKN

SEQ ID NO: 2726389 - protein, 30 aa, Entamoeba histolytica
SGSYSTNLLFLPTDKRFPPIRIKARDPAKL

SEQ ID NO: 2726390 - protein, 28 aa, Entamoeba histolytica
SGTKKVRGFFVFPYIKSMSLLQREMEGR

SEQ ID NO: 2726391 - protein, 24 aa, Entamoeba histolytica
SGTKSIFFTPLLSSLTNLKYLDLS

SEQ ID NO: 2726392 - protein, 25 aa, Entamoeba histolytica
SGTSKQLIYFTPNPKWYESAIQNGH

SEQ ID NO: 2726393 - protein, 18 aa, Entamoeba histolytica
SGVFFTDTPQRGTRYGRR

SEQ ID NO: 2726394 - protein, 24 aa, Entamoeba histolytica
SGVGKSCLLLRFADDTYTDTHIAT

SEQ ID NO: 2726395 - protein, 21 aa, Entamoeba histolytica
SGVTYRLTLGVIKNIMPAIAS

SEQ ID NO: 2726396 - protein, 23 aa, Entamoeba histolytica
SGVYRMDLKFRDFLMQKMINGER

SEQ ID NO: 2726397 - protein, 32 aa, Entamoeba histolytica
SGWFEEAIFFQQGTKFLLFRNGSIQTYECQER

SEQ ID NO: 2726398 - protein, 34 aa, Entamoeba histolytica
SGYRTLSILHQKYPYLPFFFHCRKSWSDLCQLNK

SEQ ID NO: 2726399 - protein, 24 aa, Entamoeba histolytica
SHAELLGLLYRFSGTLGKYAKKLE

SEQ ID NO: 2726400 - protein, 18 aa, Entamoeba histolytica
SHCFHILCIKKEFAQHPT

SEQ ID NO: 2726401 - protein, 17 aa, Entamoeba histolytica
SHCFKLCVITKQPVVKV

SEQ ID NO: 2726402 - protein, 24 aa, Entamoeba histolytica
SHDGIIKKIYILNDTIITIANDKK

SEQ ID NO: 2726403 - protein, 46 aa, Entamoeba histolytica; identical to SEQ ID NO: 2539303

SEQ ID NO: 2726404 - protein, 25 aa, Entamoeba histolytica
SHDHYTLFNPYIKKSIPILTDKQLN

SEQ ID NO: 2726405 - protein, 25 aa, Entamoeba histolytica
SHEKGKLKIYLYPNQPFNQKDENDA

SEQ ID NO: 2726406 - protein, 24 aa, Entamoeba histolytica
SHEMARFYIAELLLAIDSIHQLNY

SEQ ID NO: 2726407 - protein, 26 aa, Entamoeba histolytica
SHENGKLKIYLYPNEPFNQIDENDAI

SEQ ID NO: 2726408 - protein, 25 aa, Entamoeba histolytica
SHENGKLKIYLYPNQPFNQKDENDA

SEQ ID NO: 2726409 - protein, 19 aa, Entamoeba histolytica
SHEQLILKDKFPLYLHFNP

SEQ ID NO: 2726410 - protein, 20 aa, Entamoeba histolytica
SHFSLIIICFDKTSGFSDLN

SEQ ID NO: 2726411 - protein, 18 aa, Entamoeba histolytica
SHGAWIKTSILGLLEMEP

SEQ ID NO: 2726412 - protein, 18 aa, Entamoeba histolytica
SHGCMIFEMLTGDYLFKP

SEQ ID NO: 2726413 - protein, 31 aa, Entamoeba histolytica
SHHNDIMFYRGYKFVVSLKVSGVALGPKEIV

SEQ ID NO: 2726414 - protein, 25 aa, Entamoeba histolytica
SHIETKIILFTTYKILLSAENDVPD

SEQ ID NO: 2726415 - protein, 18 aa, Entamoeba histolytica
SHIFSIITAITDFCNGLS

SEQ ID NO: 2726416 - protein, 32 aa, Entamoeba histolytica
SHIRLTQETLLKLIKFFSVENKYLITESGFAE

SEQ ID NO: 2726417 - protein, 19 aa, Entamoeba histolytica
SHKGGVLSYKYSSKFIKIL

SEQ ID NO: 2726418 - protein, 21 aa, Entamoeba histolytica
SHKIFELYCTKSNMLDLLKII

SEQ ID NO: 2726419 - protein, 21 aa, Entamoeba histolytica
SHKLFKYLRTINPTVPKKYFH

SEQ ID NO: 2726420 - protein, 18 aa, Entamoeba histolytica
SHKLFLTGTPLQNTLHEL

SEQ ID NO: 2726421 - protein, 28 aa, Entamoeba histolytica
SHKSWKKRWFQTTPRNPFRLDYYTNDSC

SEQ ID NO: 2726422 - protein, 31 aa, Entamoeba histolytica
SHLEDIYIKLPFYFERPFTDWTLSLLQKSIQ

SEQ ID NO: 2726423 - protein, 33 aa, Entamoeba histolytica
SHLEDIYIKLPFYFERPFTDWTLSLLQKSIQDK

SEQ ID NO: 2726424 - protein, 20 aa, Entamoeba histolytica
SHLFTWLCILNDDVDSWNKG

SEQ ID NO: 2726425 - protein, 21 aa, Entamoeba histolytica
SHLIYTKLPCTPLSITCNEDC

SEQ ID NO: 2726426 - protein, 17 aa, Entamoeba histolytica
SHLLILKEQTRTLNDKN

SEQ ID NO: 2726427 - protein, 25 aa, Entamoeba histolytica
SHLLLERKFIFISESLQLLSSSVHT

SEQ ID NO: 2726428 - protein, 18 aa, Entamoeba histolytica
SHLTLLRNYVFLSRIENV

SEQ ID NO: 2726429 - protein, 22 aa, Entamoeba histolytica
SHNKLIDFSLLCNMTNLKVLNL

SEQ ID NO: 2726430 - protein, 22 aa, Entamoeba histolytica
SHPIAYEFIKQCGTPIAAPSAN

SEQ ID NO: 2726431 - protein, 29 aa, Entamoeba histolytica
SHPLHGIMIPIPQYPLYSASISQFGGFQI

SEQ ID NO: 2726432 - protein, 29 aa, Entamoeba histolytica
SHQKTFFTPFQYKLFPRVMIYFKQVEDSD

SEQ ID NO: 2726433 - protein, 17 aa, Entamoeba histolytica
SHQQVYEKSVIQIFDEI

SEQ ID NO: 2726434 - protein, 21 aa, Entamoeba histolytica
SHQRFQAFKPSREKIPHYWSY

SEQ ID NO: 2726435 - protein, 25 aa, Entamoeba histolytica
SHRVTVFPVALILAPTRELGQQIYE

SEQ ID NO: 2726436 - protein, 22 aa, Entamoeba histolytica
SHSFFTVDNFVLLIEQIKDVPL

SEQ ID NO: 2726437 - protein, 18 aa, Entamoeba histolytica
SHSFLLSSPLSSIYNQLR

SEQ ID NO: 2726438 - protein, 27 aa, Entamoeba histolytica
SHSLKSLILALKYMKTLPPSAHLLFPN

SEQ ID NO: 2726439 - protein, 28 aa, Entamoeba histolytica
SHSNNFEIMFHVAPLLPLLQNDEQALER

SEQ ID NO: 2726440 - protein, 20 aa, Entamoeba histolytica
SHSSLKLSFMEGDNIKVVDR

SEQ ID NO: 2726441 - protein, 25 aa, Entamoeba histolytica
SHTGLNVIDFGIPLLSMHSIREIGG

SEQ ID NO: 2726442 - protein, 20 aa, Entamoeba histolytica
SHTKSLIFSLVKRQGRSWKI

SEQ ID NO: 2726443 - protein, 17 aa, Entamoeba histolytica
SHTLSKIPSLSFNTIDE

SEQ ID NO: 2726444 - protein, 21 aa, Entamoeba histolytica
SHTNCWNHLFPTQPHGSCIVQ

SEQ ID NO: 2726445 - protein, 23 aa, Entamoeba histolytica
SHTVFMKRYDSPIISLTPNSFTT

SEQ ID NO: 2726446 - protein, 26 aa, Entamoeba histolytica
SHTWCCDVLLFVIRLLKEAKGIFNKQ

SEQ ID NO: 2726447 - protein, 22 aa, Entamoeba histolytica
SHVIKRWTMTKVDRLAKLEEVN

SEQ ID NO: 2726448 - protein, 26 aa, Entamoeba histolytica
SHVLTPKYSLQLQPPPSKLMSSKQRK

SEQ ID NO: 2726449 - protein, 24 aa, Entamoeba histolytica
SIADIFIDFFNWKEVYDAYARYLV

SEQ ID NO: 2726450 - protein, 24 aa, Entamoeba histolytica
SIAIKIVMQLMLSHPLHGIMIPNP

SEQ ID NO: 2726451 - protein, 18 aa, Entamoeba histolytica
SIALCFKSKMLKNNDETL

SEQ ID NO: 2726452 - protein, 23 aa, Entamoeba histolytica
SIANFEPFKWIQPSNIYSFEEMY

SEQ ID NO: 2726453 - protein, 26 aa, Entamoeba histolytica
SIAPGELWKTLYSNLILFLNHFCESI

SEQ ID NO: 2726454 - protein, 30 aa, Entamoeba histolytica
SIAQPTPLPLFSKQLLLPEQLKALGMNDFI

SEQ ID NO: 2726455 - protein, 23 aa, Entamoeba histolytica
SIAQVLGIRETDRWYYGGGLYMG

SEQ ID NO: 2726456 - protein, 25 aa, Entamoeba histolytica
SIAQYLIYNKRRFYNINRGEKKLLV

SEQ ID NO: 2726457 - protein, 38 aa, Entamoeba histolytica; identical to SEQ ID NO: 2539344

SEQ ID NO: 2726458 - protein, 19 aa, Entamoeba histolytica
SICLHQVIIPLPAHRVTMP

SEQ ID NO: 2726459 - protein, 22 aa, Entamoeba histolytica
SIDLTPQLFYANGSLINLIAEA

SEQ ID NO: 2726460 - protein, 23 aa, Entamoeba histolytica
SIDPQISVFWGWKEGGKVKTIKR

SEQ ID NO: 2726461 - protein, 20 aa, Entamoeba histolytica
SIDVVGKMNLALKGGLVRTN

SEQ ID NO: 2726462 - protein, 21 aa, Entamoeba histolytica
SIDVVGKMNLSLKGGLVRTND

SEQ ID NO: 2726463 - protein, 18 aa, Entamoeba histolytica
SIDYHAFDLIFVNPKESK

SEQ ID NO: 2726464 - protein, 28 aa, Entamoeba histolytica
SIDYYKVSPLIPFLLKQLGSSSCEAISN

SEQ ID NO: 2726465 - protein, 35 aa, Entamoeba histolytica
SIEDKAMKKLYPLFLWILSGLFPQFANISGVKSFI

SEQ ID NO: 2726466 - protein, 26 aa, Entamoeba histolytica
SIEDMRRVLLFPSISSYSIGIKGVKM

SEQ ID NO: 2726467 - protein, 21 aa, Entamoeba histolytica
SIEECGTALILFKANDQSKET

SEQ ID NO: 2726468 - protein, 18 aa, Entamoeba histolytica
SIEEIYKYPLIGTEWGCA

SEQ ID NO: 2726469 - protein, 35 aa, Entamoeba histolytica
SIEFFTRTIFVFAKDLPLIVLYDKGLTILSIGEMW

SEQ ID NO: 2726470 - protein, 22 aa, Entamoeba histolytica
SIELFSTGSFLFCISWAFGITN

SEQ ID NO: 2726471 - protein, 27 aa, Entamoeba histolytica
SIENLKSLLFPFEWCNICIDSLPYSLI

SEQ ID NO: 2726472 - protein, 21 aa, Entamoeba histolytica
SIEPIDLIQPIQPLLVSNPHP

SEQ ID NO: 2726473 - protein, 24 aa, Entamoeba histolytica
SIEQLIKELTFLSSSCLMGIPKNQ

SEQ ID NO: 2726474 - protein, 25 aa, Entamoeba histolytica
SIETCGFIMIPLNPAYKPDQLERLF

SEQ ID NO: 2726475 - protein, 21 aa, Entamoeba histolytica
SIEYLGKRYCLACYKKVSACI

SEQ ID NO: 2726476 - protein, 23 aa, Entamoeba histolytica
SIFDFILNFCEVKRMTISKRKVF

SEQ ID NO: 2726477 - protein, 18 aa, Entamoeba histolytica
SIFDIVLEKGIKFPSTTS

SEQ ID NO: 2726478 - protein, 17 aa, Entamoeba histolytica
SIFFFSSIAKKCTTYFE

SEQ ID NO: 2726479 - protein, 25 aa, Entamoeba histolytica
SIFKKGIWMNLIEKGFMTFQSIEDG

SEQ ID NO: 2726480 - protein, 19 aa, Entamoeba histolytica
SIFKLTNHLYIIFSMNGES

SEQ ID NO: 2726481 - protein, 31 aa, Entamoeba histolytica
SIFLALLNDYFEIELLPPIKRSNVAIQLLRI

SEQ ID NO: 2726482 - protein, 17 aa, Entamoeba histolytica
SIFPLLSSHEQELLKPL

SEQ ID NO: 2726483 - protein, 19 aa, Entamoeba histolytica
SIFTNWVVSFYSFIISNIN

SEQ ID NO: 2726484 - protein, 17 aa, Entamoeba histolytica
SIFVGMLNIIEQNKEKQ

SEQ ID NO: 2726485 - protein, 43 aa, Entamoeba histolytica
SIGFELNYFITWFADLFIDVFPVRLVIRIWDYYLYEGKDVLYI

SEQ ID NO: 2726486 - protein, 24 aa, Entamoeba histolytica
SIGFFPVLFISQTMRFEGCEWGYL

SEQ ID NO: 2726487 - protein, 24 aa, Entamoeba histolytica
SIGKDNVLIIWDMQSLKPTKTIPI

SEQ ID NO: 2726488 - protein, 24 aa, Entamoeba histolytica
SIGQVFIREGWGCLTMNSKIIERV

SEQ ID NO: 2726489 - protein, 26 aa, Entamoeba histolytica
SIGSFVDLIFILYIKWERTNDDWVQL

SEQ ID NO: 2726490 - protein, 19 aa, Entamoeba histolytica
SIGVIFFMLVHGHHPLEIG

SEQ ID NO: 2726491 - protein, 25 aa, Entamoeba histolytica
SIHDIINTNYLSSDFYFIGCVLEKG

SEQ ID NO: 2726492 - protein, 24 aa, Entamoeba histolytica
SIHKDVLPHIIKLLRGKFGQDIHE

SEQ ID NO: 2726493 - protein, 17 aa, Entamoeba histolytica
SIHKFVIDQFRGGSDYY

SEQ ID NO: 2726494 - protein, 35 aa, Entamoeba histolytica
SIHMMTLKNFAMILGPLIIHIPYEINPLDSTCYQI

SEQ ID NO: 2726495 - protein, 34 aa, Entamoeba histolytica
SIHPDKPSKPCILPMIFRLFLRKDYTYEVFGLIC

SEQ ID NO: 2726496 - protein, 19 aa, Entamoeba histolytica
SIHRLRLTKRFLGEDGNCI

SEQ ID NO: 2726497 - protein, 17 aa, Entamoeba histolytica
SIIDIDLDFPYYSHYFK

SEQ ID NO: 2726498 - protein, 26 aa, Entamoeba histolytica
SIILISPLIASYFKLTHLSKISVLFI

SEQ ID NO: 2726499 - protein, 19 aa, Entamoeba histolytica
SIILYCCLNSHFTIPSYPN

SEQ ID NO: 2726500 - protein, 18 aa, Entamoeba histolytica
SIIMEYIHNIPLNQISKK

SEQ ID NO: 2726501 - protein, 21 aa, Entamoeba histolytica
SIINIIKPLFITIIASYSKDY

SEQ ID NO: 2726502 - protein, 23 aa, Entamoeba histolytica
SIINKFIVMIQTSLIDIFNTIVN

SEQ ID NO: 2726503 - protein, 19 aa, Entamoeba histolytica
SIISLIKDIPEFGALLVYS

SEQ ID NO: 2726504 - protein, 26 aa, Entamoeba histolytica
SIISNRLINYLKPKKFPFVKIEKQEE

SEQ ID NO: 2726505 - protein, 21 aa, Entamoeba histolytica
SIITYDLYLCDIQKPSLLGMN

SEQ ID NO: 2726506 - protein, 33 aa, Entamoeba histolytica
SIKDEFKQYLPTIIPILLSELTKLKYSKKEDDS

SEQ ID NO: 2726507 - protein, 30 aa, Entamoeba histolytica
SIKEALINYLKTFGFIPNSFDDQVAMKCPK

SEQ ID NO: 2726508 - protein, 25 aa, Entamoeba histolytica
SIKEFGYINYFGLQRFGSCGTTHLI

SEQ ID NO: 2726509 - protein, 18 aa, Entamoeba histolytica
SIKIINKKKLEKKLLVLC

SEQ ID NO: 2726510 - protein, 17 aa, Entamoeba histolytica
SIKIWDIMPDGLTNDMS

SEQ ID NO: 2726511 - protein, 26 aa, Entamoeba histolytica
SIKKFYTLLIITKYFNYFYIGYFTDE

SEQ ID NO: 2726512 - protein, 26 aa, Entamoeba histolytica
SIKKVTFIPLRLFIETPRTSSLRRQF

SEQ ID NO: 2726513 - protein, 19 aa, Entamoeba histolytica
SIKLLDNLIPPMMMVERKV

SEQ ID NO: 2726514 - protein, 18 aa, Entamoeba histolytica
SIKLLPQNTINILKELIF

SEQ ID NO: 2726515 - protein, 19 aa, Entamoeba histolytica
SIKMYLQYLEEYYGINEDE

SEQ ID NO: 2726516 - protein, 19 aa, Entamoeba histolytica
SIKRRNSLSAFSPAAPSEF

SEQ ID NO: 2726517 - protein, 19 aa, Entamoeba histolytica
SIKSLYLYCSSIRIFNKND

SEQ ID NO: 2726518 - protein, 25 aa, Entamoeba histolytica
SIKTINYHILLPTFFGKFDGVKANE

SEQ ID NO: 2726519 - protein, 28 aa, Entamoeba histolytica
SILFNEYNLFIPTQLLRLTINSINPNII

SEQ ID NO: 2726520 - protein, 28 aa, Entamoeba histolytica
SILHCLKFLPTHFIIILSKIFQKITYIH

SEQ ID NO: 2726521 - protein, 22 aa, Entamoeba histolytica
SILIKSLSSLLLWNLSDEISDN

SEQ ID NO: 2726522 - protein, 17 aa, Entamoeba histolytica
SILIQMYKDYYPQRLSS

SEQ ID NO: 2726523 - protein, 24 aa, Entamoeba histolytica
SILKALLSGYFLNTAQLTKEGIYR

SEQ ID NO: 2726524 - protein, 25 aa, Entamoeba histolytica
SILKPLADYGILNPVSRKAGPMTYQ

SEQ ID NO: 2726525 - protein, 24 aa, Entamoeba histolytica
SILKRCWYKKRPAILKIYNTDMQS

SEQ ID NO: 2726526 - protein, 28 aa, Entamoeba histolytica
SILLDGPMIIEMVRLLQITPVEEFIPDD

SEQ ID NO: 2726527 - protein, 20 aa, Entamoeba histolytica
SILLIDNIDLLPNDCYIILR

SEQ ID NO: 2726528 - protein, 17 aa, Entamoeba histolytica
SILLRWCHANKFCIIYN

SEQ ID NO: 2726529 - protein, 25 aa, Entamoeba histolytica
SILPVLNPPYFKQIFSWLISNLESQ

SEQ ID NO: 2726530 - protein, 26 aa, Entamoeba histolytica
SILQQLLEALVILFRNGIIHCDLKPE

SEQ ID NO: 2726531 - protein, 21 aa, Entamoeba histolytica
SILQRLFSEYGEIKKIVIIKD

SEQ ID NO: 2726532 - protein, 18 aa, Entamoeba histolytica
SIMEKVYLYIQLNKNEKT

SEQ ID NO: 2726533 - protein, 19 aa, Entamoeba histolytica
SIMNDLLSKCKNSSISLLE

SEQ ID NO: 2726534 - protein, 26 aa, Entamoeba histolytica
SIMSICQMYLPETIHLRPFIISTKYQ

SEQ ID NO: 2726535 - protein, 17 aa, Entamoeba histolytica
SINECTVEWNIKGEITP

SEQ ID NO: 2726536 - protein, 26 aa, Entamoeba histolytica
SINFERVHVLFNAGLITFRNATSLVS

SEQ ID NO: 2726537 - protein, 17 aa, Entamoeba histolytica
SINIPTRVRRIGYYCFF

SEQ ID NO: 2726538 - protein, 23 aa, Entamoeba histolytica
SINNFGKFSKIIGLEAFVEFKTS

SEQ ID NO: 2726539 - protein, 34 aa, Entamoeba histolytica
SINPDKPVEIEFFKPLTLITGPNGAGKTTIIESV

SEQ ID NO: 2726540 - protein, 18 aa, Entamoeba histolytica
SINPPLQSPFVICQQPFL

SEQ ID NO: 2726541 - protein, 19 aa, Entamoeba histolytica
SINSILPYGYHLPKRANAI

SEQ ID NO: 2726542 - protein, 24 aa, Entamoeba histolytica
SINTTPSAFIKKFIRFSSLDQSFS

SEQ ID NO: 2726543 - protein, 24 aa, Entamoeba histolytica
SINVKMQFIIIYNNPIDCQLLGNS

SEQ ID NO: 2726544 - protein, 18 aa, Entamoeba histolytica
SIPCIDGNNIPVIITGQE

SEQ ID NO: 2726545 - protein, 32 aa, Entamoeba histolytica; identical to SEQ ID NO: 2539464

SEQ ID NO: 2726546 - protein, 21 aa, Entamoeba histolytica
SIPKIITGELYHWMKQRNKMI

SEQ ID NO: 2726547 - protein, 24 aa, Entamoeba histolytica
SIPKKFILHTLIDPQFDYDFRGIN

SEQ ID NO: 2726548 - protein, 18 aa, Entamoeba histolytica
SIPKVMVCVLYPQINKID

SEQ ID NO: 2726549 - protein, 20 aa, Entamoeba histolytica
SIPLKRIRFFTSHTIISDDV

SEQ ID NO: 2726550 - protein, 29 aa, Entamoeba histolytica
SIPNSHYNLFIYLLSFIKEILRQNSSLHP

SEQ ID NO: 2726551 - protein, 21 aa, Entamoeba histolytica
SIPPPVSFQLQPSSIPPVAIP

SEQ ID NO: 2726552 - protein, 22 aa, Entamoeba histolytica
SIPQTGEVLLRIQWEGDVLPVQ

SEQ ID NO: 2726553 - protein, 19 aa, Entamoeba histolytica
SIPSRLPPTTIQPSLQPSL

SEQ ID NO: 2726554 - protein, 24 aa, Entamoeba histolytica
SIPTEMTIYILTKLKEQNPNYFKA

SEQ ID NO: 2726555 - protein, 18 aa, Entamoeba histolytica
SIPTFYKKAMCNDTIRLA

SEQ ID NO: 2726556 - protein, 25 aa, Entamoeba histolytica
SIQDVLGLYMRARPLHLQIALNQSG

SEQ ID NO: 2726557 - protein, 27 aa, Entamoeba histolytica
SIQEATYFHWILPFPFKRCYVSSSIFE

SEQ ID NO: 2726558 - protein, 36 aa, Entamoeba histolytica
SIQEPKPLLHTETVPIINSNPFNQIQNPTLIQKEKT

SEQ ID NO: 2726559 - protein, 36 aa, Entamoeba histolytica
SIQEPKPLLHTETVPIITSNPFNQIQNPTLIQKEKT

SEQ ID NO: 2726560 - protein, 22 aa, Entamoeba histolytica
SIQNNFFRTYSINTLHESFSGA

SEQ ID NO: 2726561 - protein, 23 aa, Entamoeba histolytica
SIQQFKNKFYKICVCKYMRDIAI

SEQ ID NO: 2726562 - protein, 27 aa, Entamoeba histolytica
SIQQFLTLRYTIQHLLMSTLSVIVNHP

SEQ ID NO: 2726563 - protein, 24 aa, Entamoeba histolytica
SIQRLICIFAYFHVMIEMDEKTLQ

SEQ ID NO: 2726564 - protein, 29 aa, Entamoeba histolytica
SIQSFTNDYWLLPSFITLPEITFIHSNYS

SEQ ID NO: 2726565 - protein, 30 aa, Entamoeba histolytica
SIQSPLTNSPYSFSPLFTSPHHTSPQSNSP

SEQ ID NO: 2726566 - protein, 24 aa, Entamoeba histolytica
SIQTKINFFNKELSIPLIIGAMTG

SEQ ID NO: 2726567 - protein, 19 aa, Entamoeba histolytica
SIRFNYDGIPRSNQTKYKP

SEQ ID NO: 2726568 - protein, 18 aa, Entamoeba histolytica
SIRFNYNGIPRSTRQQYK

SEQ ID NO: 2726569 - protein, 28 aa, Entamoeba histolytica
SIRSETILIIIVWFFHYKEKEVPYYISQ

SEQ ID NO: 2726570 - protein, 17 aa, Entamoeba histolytica
SISDHMYRMAILAMIFC

SEQ ID NO: 2726571 - protein, 25 aa, Entamoeba histolytica
SISESCFVWCRNLQHIKLPEGITSI

SEQ ID NO: 2726572 - protein, 18 aa, Entamoeba histolytica
SISFITFVIENYPSIFPD

SEQ ID NO: 2726573 - protein, 27 aa, Entamoeba histolytica
SISMSVAIFHKKLTWLKKFPKEQEELA

SEQ ID NO: 2726574 - protein, 19 aa, Entamoeba histolytica
SISPFPPYLDSGVYRMDLK

SEQ ID NO: 2726575 - protein, 18 aa, Entamoeba histolytica
SISPILISLFENKNFRIA

SEQ ID NO: 2726576 - protein, 27 aa, Entamoeba histolytica
SISPRPAFLSLPRPTKLAPKPSFLPPK

SEQ ID NO: 2726577 - protein, 27 aa, Entamoeba histolytica
SISQMRIKLYQFLFEALKTIPKISSPL

SEQ ID NO: 2726578 - protein, 19 aa, Entamoeba histolytica
SISSLFFDVLQKNGICCDG

SEQ ID NO: 2726579 - protein, 27 aa, Entamoeba histolytica
SITACGALFYCSYLPSGIKRSKQTFKE

SEQ ID NO: 2726580 - protein, 23 aa, Entamoeba histolytica
SITALVRIQIKPTEQFWTQIKDS

SEQ ID NO: 2726581 - protein, 26 aa, Entamoeba histolytica
SITCYKTLLPDFVLNQKIKLHEIPQL

SEQ ID NO: 2726582 - protein, 23 aa, Entamoeba histolytica
SITDKCRRLLNSSFKNTNCYILS

SEQ ID NO: 2726583 - protein, 21 aa, Entamoeba histolytica
SITEVPLNWYLQQKKLLQNKE

SEQ ID NO: 2726584 - protein, 18 aa, Entamoeba histolytica
SITFNKPNLYFITIDEMG

SEQ ID NO: 2726585 - protein, 22 aa, Entamoeba histolytica
SITFYFQFNFIDTSSLFKNGSF

SEQ ID NO: 2726586 - protein, 33 aa, Entamoeba histolytica
SITHHQTNWLRPLIIPLLKLKPYELLQHMIIIT

SEQ ID NO: 2726587 - protein, 30 aa, Entamoeba histolytica
SITKSIKKLIKLLRIIIKEITDLSKYTPAF

SEQ ID NO: 2726588 - protein, 24 aa, Entamoeba histolytica
SITLIIKMLCEWGLFYHPNNKNQG

SEQ ID NO: 2726589 - protein, 24 aa, Entamoeba histolytica
SITLPSFISKIGKWCFFKCSSLKS

SEQ ID NO: 2726590 - protein, 17 aa, Entamoeba histolytica
SITPRIPVYSFWINDMN

SEQ ID NO: 2726591 - protein, 25 aa, Entamoeba histolytica
SITTTLESFLKLLLEMFKKFEIELT

SEQ ID NO: 2726592 - protein, 17 aa, Entamoeba histolytica
SITVRFVQGIFLVKYDP

SEQ ID NO: 2726593 - protein, 24 aa, Entamoeba histolytica
SITYPITVYLVESLVPISIMKGKE

SEQ ID NO: 2726594 - protein, 25 aa, Entamoeba histolytica
SIVAYLHHEFLLKFIPTIPKNHILF

SEQ ID NO: 2726595 - protein, 25 aa, Entamoeba histolytica
SIVNASSIFLLYNTTLNTGESTIIS

SEQ ID NO: 2726596 - protein, 30 aa, Entamoeba histolytica
SIVPIYIKYTWSTIYKLLYKTNPDIVMKYM

SEQ ID NO: 2726597 - protein, 20 aa, Entamoeba histolytica
SIVSLMEMIFRSPSQNRTFS

SEQ ID NO: 2726598 - protein, 28 aa, Entamoeba histolytica
SIVYNKKILFLLLHIVETISKMNTSNPL

SEQ ID NO: 2726599 - protein, 19 aa, Entamoeba histolytica
SIVYQILQGLAFCHYHQIL

SEQ ID NO: 2726600 - protein, 28 aa, Entamoeba histolytica
SIYEDIFPLLSLLYPRIESINTTYFILS

SEQ ID NO: 2726601 - protein, 25 aa, Entamoeba histolytica
SIYENLFTNLLIPLLDSIDKFIALT

SEQ ID NO: 2726602 - protein, 17 aa, Entamoeba histolytica
SIYIPYVVQQLGKGYYI

SEQ ID NO: 2726603 - protein, 24 aa, Entamoeba histolytica
SIYRQYLNDIFSILIQKKRNLINN

SEQ ID NO: 2726604 - protein, 21 aa, Entamoeba histolytica
SIYYRTIIESSNALKVRREGT

SEQ ID NO: 2726605 - protein, 30 aa, Entamoeba histolytica
SKAEYYFNLTDWYIGYLIQLYKNGDKSIEN

SEQ ID NO: 2726606 - protein, 25 aa, Entamoeba histolytica
SKAHNISVVKLYYAFQDDINLYLVM

SEQ ID NO: 2726607 - protein, 26 aa, Entamoeba histolytica
SKALLPSLLLYPKIYHHLKSSLLLKY

SEQ ID NO: 2726608 - protein, 18 aa, Entamoeba histolytica
SKCDITNFWKVKGNIKMF

SEQ ID NO: 2726609 - protein, 26 aa, Entamoeba histolytica
SKCICSFKRISFLKLFVNEEAKKWLN

SEQ ID NO: 2726610 - protein, 27 aa, Entamoeba histolytica
SKCKGKLSPKFYMRRDKIYKKIKKEEE

SEQ ID NO: 2726611 - protein, 21 aa, Entamoeba histolytica
SKCYMLGYIPPQYKNGHIFKT

SEQ ID NO: 2726612 - protein, 27 aa, Entamoeba histolytica
SKCYTRLFEIINLKFHKAWEISLNQNC

SEQ ID NO: 2726613 - protein, 23 aa, Entamoeba histolytica
SKDAIFIWLNLLHEMNLNIPLES

SEQ ID NO: 2726614 - protein, 31 aa, Entamoeba histolytica
SKDILPQGFAPLLFYGLTPGLSERILSFLIL

SEQ ID NO: 2726615 - protein, 29 aa, Entamoeba histolytica
SKDLIVGSHNFFILKHGMCKITNPEQDYT

SEQ ID NO: 2726616 - protein, 21 aa, Entamoeba histolytica
SKDMELIRVMRLKNKIMNQLD

SEQ ID NO: 2726617 - protein, 24 aa, Entamoeba histolytica
SKDVYQLIPFQPLIKTQAKYHASS

SEQ ID NO: 2726618 - protein, 23 aa, Entamoeba histolytica
SKEAFLIQYTFYPEGSEKAQHIL

SEQ ID NO: 2726619 - protein, 26 aa, Entamoeba histolytica
SKEAWKNIILAYEPVWAIGTGKTATP

SEQ ID NO: 2726620 - protein, 25 aa, Entamoeba histolytica
SKECYVVVLLYKNGIEGCDILSARL

SEQ ID NO: 2726621 - protein, 18 aa, Entamoeba histolytica
SKEFTINGGIYPIHNLVD

SEQ ID NO: 2726622 - protein, 23 aa, Entamoeba histolytica
SKEIKVIIFIRVIKNENVVVLHN

SEQ ID NO: 2726623 - protein, 23 aa, Entamoeba histolytica
SKEIMEQIIRWMNYHNEHPHMYN

SEQ ID NO: 2726624 - protein, 25 aa, Entamoeba histolytica
SKEKAIGLAIFYYQRRKIKEQPLYD

SEQ ID NO: 2726625 - protein, 24 aa, Entamoeba histolytica
SKELFMKGVILYTDYKGLIIVEGT

SEQ ID NO: 2726626 - protein, 24 aa, Entamoeba histolytica
SKEMMPLTHVLSTKLILRLQECRE

SEQ ID NO: 2726627 - protein, 27 aa, Entamoeba histolytica
SKENPPYFYYMYYTYANIASLNYYRKQ

SEQ ID NO: 2726628 - protein, 27 aa, Entamoeba histolytica
SKEQALPIMPFKEPLPFIPDDIKMTEG

SEQ ID NO: 2726629 - protein, 26 aa, Entamoeba histolytica
SKERAVYIRIGFQQTFTSLEVKKVEG

SEQ ID NO: 2726630 - protein, 19 aa, Entamoeba histolytica
SKERLLSFMFKRKTNEKTT

SEQ ID NO: 2726631 - protein, 24 aa, Entamoeba histolytica
SKETFVVALGYYKIKLYYDSIKDK

SEQ ID NO: 2726632 - protein, 24 aa, Entamoeba histolytica
SKEVLYIILLLTKNQIINNSLITK

SEQ ID NO: 2726633 - protein, 25 aa, Entamoeba histolytica
SKEWKVDTLILKKYPALVDEILSTP

SEQ ID NO: 2726634 - protein, 19 aa, Entamoeba histolytica
SKFLFYREKLGNPQNILAP

SEQ ID NO: 2726635 - protein, 21 aa, Entamoeba histolytica
SKFMNIIRKDWRDSIFFFGSN

SEQ ID NO: 2726636 - protein, 19 aa, Entamoeba histolytica
SKFYSKFQILKESDEKPPH

SEQ ID NO: 2726637 - protein, 18 aa, Entamoeba histolytica
SKGIINCIGLLPPSIHKI

SEQ ID NO: 2726638 - protein, 20 aa, Entamoeba histolytica
SKGTNDFYYAFIEYDRPEDA

SEQ ID NO: 2726639 - protein, 27 aa, Entamoeba histolytica
SKGYGSFWCGFMKVLLKDPYAMEYIGL

SEQ ID NO: 2726640 - protein, 24 aa, Entamoeba histolytica
SKHFEKFLELLGKKIKLQGYNGFA

SEQ ID NO: 2726641 - protein, 17 aa, Entamoeba histolytica
SKHFFVISSIKKGINEF

SEQ ID NO: 2726642 - protein, 22 aa, Entamoeba histolytica
SKHSPITSNPFFKVLRKEYLKA

SEQ ID NO: 2726643 - protein, 23 aa, Entamoeba histolytica
SKHSPLCYPNYLSPLKATRKIRK

SEQ ID NO: 2726644 - protein, 26 aa, Entamoeba histolytica
SKHVNDLCEDKWYGSAPYMAPEVVFK

SEQ ID NO: 2726645 - protein, 24 aa, Entamoeba histolytica
SKHYSAYILFYQKEKPTMDIPPVK

SEQ ID NO: 2726646 - protein, 20 aa, Entamoeba histolytica
SKIADRLGIPYLTKTLNEIL

SEQ ID NO: 2726647 - protein, 21 aa, Entamoeba histolytica
SKICLIGSASYKPFAFGIGSG

SEQ ID NO: 2726648 - protein, 28 aa, Entamoeba histolytica
SKIDMVMIQLCFLLPFNCFASLFTTDIE

SEQ ID NO: 2726649 - protein, 26 aa, Entamoeba histolytica
SKIENPPLYAYPDPKVFNIKETLSVV

SEQ ID NO: 2726650 - protein, 17 aa, Entamoeba histolytica
SKIESLLNNDILYWIKA

SEQ ID NO: 2726651 - protein, 19 aa, Entamoeba histolytica
SKIFIVSDRMIYKLGYVER

SEQ ID NO: 2726652 - protein, 22 aa, Entamoeba histolytica
SKIFQNYYLRICHATVSLIIDE

SEQ ID NO: 2726653 - protein, 23 aa, Entamoeba histolytica
SKIHPIQTFYLDDIISFTNYSID

SEQ ID NO: 2726654 - protein, 19 aa, Entamoeba histolytica
SKIIIETIFKCVIVPITLS

SEQ ID NO: 2726655 - protein, 32 aa, Entamoeba histolytica
SKIISKYHYNPIKSFLLFKEVTTQLLFTKKDI

SEQ ID NO: 2726656 - protein, 26 aa, Entamoeba histolytica
SKIKGKYCFISFYNGVTILCYRMNVS

SEQ ID NO: 2726657 - protein, 26 aa, Entamoeba histolytica
SKIKKKLFLTFVHHINQFFDNYGDAS

SEQ ID NO: 2726658 - protein, 23 aa, Entamoeba histolytica
SKILQMLELYFTGCIVSLGEMEE

SEQ ID NO: 2726659 - protein, 20 aa, Entamoeba histolytica
SKIMWIFNNVEGAKALAEEG

SEQ ID NO: 2726660 - protein, 26 aa, Entamoeba histolytica
SKINEPYIPLINAFLKDIEKFEDENP

SEQ ID NO: 2726661 - protein, 24 aa, Entamoeba histolytica
SKISKGYAFIYFPTLNEANKVIQK

SEQ ID NO: 2726662 - protein, 25 aa, Entamoeba histolytica
SKISPDLRWIWRTNTFEMKATTLKS

SEQ ID NO: 2726663 - protein, 26 aa, Entamoeba histolytica
SKISRESLDLLKLRYGKELTQDDIQL

SEQ ID NO: 2726664 - protein, 18 aa, Entamoeba histolytica
SKIYIVTSLYHGPTKDGL

SEQ ID NO: 2726665 - protein, 26 aa, Entamoeba histolytica
SKKERRVITIITPINAKDIKKLNESK

SEQ ID NO: 2726666 - protein, 21 aa, Entamoeba histolytica
SKKIQLPQFIGCAAYLGQIRT

SEQ ID NO: 2726667 - protein, 21 aa, Entamoeba histolytica
SKKIYFIVHEQYKKIFFNEEL

SEQ ID NO: 2726668 - protein, 26 aa, Entamoeba histolytica
SKKLFTFDVEPTSTIGYLKELISKQE

SEQ ID NO: 2726669 - protein, 17 aa, Entamoeba histolytica
SKKMAIGDGIKRAFRLF

SEQ ID NO: 2726670 - protein, 17 aa, Entamoeba histolytica
SKKNDVLSLWKKKYETL

SEQ ID NO: 2726671 - protein, 23 aa, Entamoeba histolytica
SKKQLTVELVIPIGSFCVLDSIK

SEQ ID NO: 2726672 - protein, 24 aa, Entamoeba histolytica
SKKREEIVFLTNRLSYFHENIQVA

SEQ ID NO: 2726673 - protein, 24 aa, Entamoeba histolytica
SKKSSFISTPKPLTSFTQYQQTQP

SEQ ID NO: 2726674 - protein, 23 aa, Entamoeba histolytica
SKKSSVADRMKYLAHARKAMKDK

SEQ ID NO: 2726675 - protein, 21 aa, Entamoeba histolytica
SKLGITLNLFYLCELKENTQI

SEQ ID NO: 2726676 - protein, 28 aa, Entamoeba histolytica
SKLGTHFQTIFLPTLQLITRPQTNDLLK

SEQ ID NO: 2726677 - protein, 24 aa, Entamoeba histolytica
SKLIIAQLFVIRQNALELLRILKN

SEQ ID NO: 2726678 - protein, 17 aa, Entamoeba histolytica
SKLIILVYRIITVDQNN

SEQ ID NO: 2726679 - protein, 21 aa, Entamoeba histolytica
SKLILQHDILYPKKPKSNKEE

SEQ ID NO: 2726680 - protein, 25 aa, Entamoeba histolytica
SKLNPVNIFFFSDALNQIIYENSLD

SEQ ID NO: 2726681 - protein, 27 aa, Entamoeba histolytica
SKLPFKPTLVFLPIVLNHLIHSKLQQI

SEQ ID NO: 2726682 - protein, 17 aa, Entamoeba histolytica
SKLTQGAKGVLLFGPPG

SEQ ID NO: 2726683 - protein, 20 aa, Entamoeba histolytica
SKLYSPMFQSNSFFIKEPIS

SEQ ID NO: 2726684 - protein, 24 aa, Entamoeba histolytica
SKMSPFIFFMQEFAHNKFYITYRL

SEQ ID NO: 2726685 - protein, 26 aa, Entamoeba histolytica
SKMYEALFVLLHHSILKYSNEEPVII

SEQ ID NO: 2726686 - protein, 37 aa, Entamoeba histolytica
SKNELESFIIFYLMMKLIRPFYLIQTNASASLNKLQV

SEQ ID NO: 2726687 - protein, 33 aa, Entamoeba histolytica
SKNEYSLCIDFIRFCILSFTSLFPQDIDPVVTK

SEQ ID NO: 2726688 - protein, 18 aa, Entamoeba histolytica
SKNIAVCLTPSLLTFDDT

SEQ ID NO: 2726689 - protein, 18 aa, Entamoeba histolytica
SKNILPEQFEPIIEKEEE

SEQ ID NO: 2726690 - protein, 17 aa, Entamoeba histolytica
SKNITYGWWDLNRSDCW

SEQ ID NO: 2726691 - protein, 29 aa, Entamoeba histolytica
SKNPEEYFRFLWELRLVFNSNLTQLEEVT

SEQ ID NO: 2726692 - protein, 18 aa, Entamoeba histolytica
SKNQITFSIIGKKQLSRR

SEQ ID NO: 2726693 - protein, 24 aa, Entamoeba histolytica
SKNQSLVLNLFGRQLDSLTQPEKG

SEQ ID NO: 2726694 - protein, 21 aa, Entamoeba histolytica
SKNYLAFIETLKPFVSDTYQV

SEQ ID NO: 2726695 - protein, 32 aa, Entamoeba histolytica
SKNYSPFRLKDTLRFILMTKIKDWKCELESPL

SEQ ID NO: 2726696 - protein, 32 aa, Entamoeba histolytica
SKPIEMELIQFIKIIIKYFSKEIDFPSIKKQW

SEQ ID NO: 2726697 - protein, 20 aa, Entamoeba histolytica
SKPIKWYCESLKKENTQFKC

SEQ ID NO: 2726698 - protein, 31 aa, Entamoeba histolytica
SKPISKKVMGYLLLFPRLKINYHCFYNKLYN

SEQ ID NO: 2726699 - protein, 35 aa, Entamoeba histolytica
SKPTLVQVFALSKNFYIVYIAIYDEYYLTPNSPVV

SEQ ID NO: 2726700 - protein, 31 aa, Entamoeba histolytica
SKPYSLEELYIFYIHLRPLIPNELLCPSIEN

SEQ ID NO: 2726701 - protein, 23 aa, Entamoeba histolytica
SKQLVKMFSPPINVDFLNKMFNE

SEQ ID NO: 2726702 - protein, 22 aa, Entamoeba histolytica
SKQYFNFSIFNNQIKYQTFNPS

SEQ ID NO: 2726703 - protein, 20 aa, Entamoeba histolytica
SKRKFIFEMNDFNDEIESCP

SEQ ID NO: 2726704 - protein, 22 aa, Entamoeba histolytica
SKRLSYILRHGAIKERIPITND

SEQ ID NO: 2726705 - protein, 24 aa, Entamoeba histolytica
SKRNNLFRRGGIIKTVNLNEIEEY

SEQ ID NO: 2726706 - protein, 17 aa, Entamoeba histolytica
SKRNYHRRKIIIEFISW

SEQ ID NO: 2726707 - protein, 18 aa, Entamoeba histolytica
SKRQIISVMFKTFESSNS

SEQ ID NO: 2726708 - protein, 18 aa, Entamoeba histolytica
SKRVIEEYPLFIKRKNAL

SEQ ID NO: 2726709 - protein, 18 aa, Entamoeba histolytica
SKRYPILLQGPTSAGKTS

SEQ ID NO: 2726710 - protein, 25 aa, Entamoeba histolytica
SKSELDIMSLFMSSSKNKQVMMFSA

SEQ ID NO: 2726711 - protein, 36 aa, Entamoeba histolytica
SKSFSAYFFRILLKIFRVYMKIARYQTIGLGLSERV

SEQ ID NO: 2726712 - protein, 19 aa, Entamoeba histolytica
SKSLCIYSSKSKDLIVGSH

SEQ ID NO: 2726713 - protein, 27 aa, Entamoeba histolytica
SKSQTPLIPFIGILTKDLLVGDEMYAS

SEQ ID NO: 2726714 - protein, 24 aa, Entamoeba histolytica
SKTAGWRLDYFFVSKDLVDSVTQI

SEQ ID NO: 2726715 - protein, 37 aa, Entamoeba histolytica
SKTPIKYMSLINLNFQILFPPFLEQLFCVSSSKFDIN

SEQ ID NO: 2726716 - protein, 31 aa, Entamoeba histolytica
SKTSYPHVFLEWLYGLLLFLQSPFEPEVSAT

SEQ ID NO: 2726717 - protein, 19 aa, Entamoeba histolytica
SKTVNYQLILDTLSKLFNS

SEQ ID NO: 2726718 - protein, 33 aa, Entamoeba histolytica
SKTVSELYLRWAPLFWNFLRNPNIPFDKKLKLF

SEQ ID NO: 2726719 - protein, 24 aa, Entamoeba histolytica
SKVCCHENMFIIVTTKEGYVLGFF

SEQ ID NO: 2726720 - protein, 19 aa, Entamoeba histolytica
SKVIGYGAFGIVFLATNIK

SEQ ID NO: 2726721 - protein, 25 aa, Entamoeba histolytica
SKVLCLFDYYSTDILELSFKRGDMI

SEQ ID NO: 2726722 - protein, 21 aa, Entamoeba histolytica
SKVLQLLILEFVPDKLPSFND

SEQ ID NO: 2726723 - protein, 35 aa, Entamoeba histolytica
SKVLSKFLVLLYPSQYLEDIVPLAQSLFSVTTGLQ

SEQ ID NO: 2726724 - protein, 28 aa, Entamoeba histolytica
SKVQRIYIPFCFTSYRYEGELNYVLINA

SEQ ID NO: 2726725 - protein, 21 aa, Entamoeba histolytica
SKWEYILTEGIFRVPGNMTDI

SEQ ID NO: 2726726 - protein, 23 aa, Entamoeba histolytica
SKWIEIFISYLCQELLNLLFKFK

SEQ ID NO: 2726727 - protein, 38 aa, Entamoeba histolytica
SKYCKYLYHGLGIPAKGYLIEKVLLMLSLLSGKDMHEN

SEQ ID NO: 2726728 - protein, 24 aa, Entamoeba histolytica
SKYCNYIFTKRVDFSFQLLKNIIK

SEQ ID NO: 2726729 - protein, 20 aa, Entamoeba histolytica
SKYFPILMKSFDLNGISIKT

SEQ ID NO: 2726730 - protein, 22 aa, Entamoeba histolytica
SKYKNLKIALLEKARDVSTGAT

SEQ ID NO: 2726731 - protein, 25 aa, Entamoeba histolytica
SKYSSHQYISLEGFLPIVYERKVFG

SEQ ID NO: 2726732 - protein, 34 aa, Entamoeba histolytica
SKYVIYHELLLTTKSYMRCITSIEGKWLPELGEV

SEQ ID NO: 2726733 - protein, 25 aa, Entamoeba histolytica
SLAHSASLFLIAPATADIIAKLASG

SEQ ID NO: 2726734 - protein, 17 aa, Entamoeba histolytica
SLAIENFALPGDGKFCL

SEQ ID NO: 2726735 - protein, 23 aa, Entamoeba histolytica
SLAKWKRLQLHELKIPIGEGIVT

SEQ ID NO: 2726736 - protein, 25 aa, Entamoeba histolytica
SLATINFFVRIFAIGNKDLLTKYAI

SEQ ID NO: 2726737 - protein, 24 aa, Entamoeba histolytica
SLCEGKLFFCDFPELAVDDEILNK

SEQ ID NO: 2726738 - protein, 22 aa, Entamoeba histolytica
SLCGFHYFYNPAAAVGVFILNE

SEQ ID NO: 2726739 - protein, 18 aa, Entamoeba histolytica
SLCGLLLLEGLPKPDIHD

SEQ ID NO: 2726740 - protein, 21 aa, Entamoeba histolytica
SLCHKNILLPFSLIKIHLNNL

SEQ ID NO: 2726741 - protein, 19 aa, Entamoeba histolytica
SLCKKGYNTGYLPTKILKK

SEQ ID NO: 2726742 - protein, 19 aa, Entamoeba histolytica
SLCMLGVKEFRFETIPFSK

SEQ ID NO: 2726743 - protein, 23 aa, Entamoeba histolytica
SLCTFGNLPFRKVVKRFGCDVTM

SEQ ID NO: 2726744 - protein, 26 aa, Entamoeba histolytica
SLDGCRPFFNLQRLSVRNNLIESFQN

SEQ ID NO: 2726745 - protein, 25 aa, Entamoeba histolytica
SLDKINKLYFLQKVNRIKEWILTKN

SEQ ID NO: 2726746 - protein, 29 aa, Entamoeba histolytica
SLDPALLRPGRLDRKIEFPLPDRRQKRLI

SEQ ID NO: 2726747 - protein, 28 aa, Entamoeba histolytica
SLDPNEFFQFYYLFEYYVDENGEFDYVS

SEQ ID NO: 2726748 - protein, 19 aa, Entamoeba histolytica
SLDQFNTLPLWKRENLKKA

SEQ ID NO: 2726749 - protein, 27 aa, Entamoeba histolytica
SLDSFTTEWPFLTQLVIQKASIRQISP

SEQ ID NO: 2726750 - protein, 24 aa, Entamoeba histolytica
SLDSIISFLLGWIKDIPLELEQSL

SEQ ID NO: 2726751 - protein, 17 aa, Entamoeba histolytica
SLDTWKKEFLNGANVTN

SEQ ID NO: 2726752 - protein, 19 aa, Entamoeba histolytica
SLDVEIRSIVFFSERLEDI

SEQ ID NO: 2726753 - protein, 20 aa, Entamoeba histolytica
SLDWKLYFPNGKPAEMLDIG

SEQ ID NO: 2726754 - protein, 36 aa, Entamoeba histolytica; identical to SEQ ID NO: 2539702

SEQ ID NO: 2726755 - protein, 25 aa, Entamoeba histolytica
SLDYYNDVVGFRRSLRKKEEEFNTL

SEQ ID NO: 2726756 - protein, 28 aa, Entamoeba histolytica
SLECVRWLQNYLQLPLEIISYIETYGMT

SEQ ID NO: 2726757 - protein, 24 aa, Entamoeba histolytica
SLEDILRYESRLEKICYTDLYEND

SEQ ID NO: 2726758 - protein, 25 aa, Entamoeba histolytica
SLEELCFNLYNFIIQKTKRARECKV

SEQ ID NO: 2726759 - protein, 26 aa, Entamoeba histolytica
SLEKKRIPILQSPVVNRPMFTSPLKS

SEQ ID NO: 2726760 - protein, 23 aa, Entamoeba histolytica
SLELMDCLPFKEVLFHSIVRDAQ

SEQ ID NO: 2726761 - protein, 24 aa, Entamoeba histolytica
SLELMDCLPFKEVLFHSIVRDAQG

SEQ ID NO: 2726762 - protein, 26 aa, Entamoeba histolytica
SLEPQHLLLNKWTYWFDSNKYESQSR

SEQ ID NO: 2726763 - protein, 25 aa, Entamoeba histolytica
SLEQFMQLIIQSLNVHDYLLKKLSE

SEQ ID NO: 2726764 - protein, 26 aa, Entamoeba histolytica
SLEQWKGIILKYENEKWLKTHLQHVI

SEQ ID NO: 2726765 - protein, 19 aa, Entamoeba histolytica
SLERSKCYLLKPRKSFKKN

SEQ ID NO: 2726766 - protein, 29 aa, Entamoeba histolytica
SLESLSVLKKLRALYLQSNNLLHFPQSIF

SEQ ID NO: 2726767 - protein, 25 aa, Entamoeba histolytica
SLETNGIILFYPVDTIPLGIDYHFQ

SEQ ID NO: 2726768 - protein, 19 aa, Entamoeba histolytica
SLEVFLTKLKTVFGEFVNN

SEQ ID NO: 2726769 - protein, 26 aa, Entamoeba histolytica
SLEYHQIFRYIGITHLRLLIQVSKEV

SEQ ID NO: 2726770 - protein, 17 aa, Entamoeba histolytica
SLFILLNNDLVQSIITP

SEQ ID NO: 2726771 - protein, 23 aa, Entamoeba histolytica
SLFLDSLHLTKLLFYNVNGIEIL

SEQ ID NO: 2726772 - protein, 17 aa, Entamoeba histolytica
SLFPNPSTMNDGYSFEI

SEQ ID NO: 2726773 - protein, 19 aa, Entamoeba histolytica
SLFVIFNVQDIIGLRDYYI

SEQ ID NO: 2726774 - protein, 22 aa, Entamoeba histolytica
SLFVSQLEATGWKRGKGLGKNE

SEQ ID NO: 2726775 - protein, 19 aa, Entamoeba histolytica
SLGCMIYEMLVGVPPFNDK

SEQ ID NO: 2726776 - protein, 26 aa, Entamoeba histolytica
SLGCMVYEMLLGIPPFHCDSPNQIFE

SEQ ID NO: 2726777 - protein, 18 aa, Entamoeba histolytica
SLGKKTIEAFLIVSHNIL

SEQ ID NO: 2726778 - protein, 25 aa, Entamoeba histolytica
SLGSLEALLKFLKDSKIPVSGVGLG

SEQ ID NO: 2726779 - protein, 23 aa, Entamoeba histolytica
SLGTTIIGVVYNGGVLLGADGRT

SEQ ID NO: 2726780 - protein, 20 aa, Entamoeba histolytica
SLHALRFMDLSINRIQSVPK

SEQ ID NO: 2726781 - protein, 17 aa, Entamoeba histolytica
SLHFSFSKDILPQGFAP

SEQ ID NO: 2726782 - protein, 25 aa, Entamoeba histolytica
SLHHLQIQIYPTKPIPHPPSTGHLK

SEQ ID NO: 2726783 - protein, 23 aa, Entamoeba histolytica
SLHTLLHRVHPKEILLLNSISDD

SEQ ID NO: 2726784 - protein, 27 aa, Entamoeba histolytica
SLHWKYLDFIFICPKNIESIKLSKVKF

SEQ ID NO: 2726785 - protein, 26 aa, Entamoeba histolytica
SLICYDRLMWVIPLGLDKTSYSINLE

SEQ ID NO: 2726786 - protein, 24 aa, Entamoeba histolytica
SLIDVLHLLPLIYDKEYARQLLFY

SEQ ID NO: 2726787 - protein, 17 aa, Entamoeba histolytica
SLIFKWVLDGQYDVDCL

SEQ ID NO: 2726788 - protein, 27 aa, Entamoeba histolytica
SLIFPKNNFRLFFSEKRLPPFGSLKVK

SEQ ID NO: 2726789 - protein, 25 aa, Entamoeba histolytica
SLIGDFIIDQLLLKYADNFAVMALD

SEQ ID NO: 2726790 - protein, 17 aa, Entamoeba histolytica
SLIGPFCYLELPDLLFV

SEQ ID NO: 2726791 - protein, 20 aa, Entamoeba histolytica
SLIICPTRELALQTIKVFNE

SEQ ID NO: 2726792 - protein, 26 aa, Entamoeba histolytica
SLIKCNILPIKRMLSPLIRVEVSKAL

SEQ ID NO: 2726793 - protein, 23 aa, Entamoeba histolytica
SLIKNIISKYYKPTTPTLLARAT

SEQ ID NO: 2726794 - protein, 19 aa, Entamoeba histolytica
SLILAGFPNVGKSSLMNVI

SEQ ID NO: 2726795 - protein, 32 aa, Entamoeba histolytica
SLILITKNKEILPYHTLLYQLIPTFKENIFDV

SEQ ID NO: 2726796 - protein, 29 aa, Entamoeba histolytica
SLILLPSHSFSFLSSLRSMGFFFQHPTCN

SEQ ID NO: 2726797 - protein, 18 aa, Entamoeba histolytica
SLIMYKKSKPLASGEGIS

SEQ ID NO: 2726798 - protein, 22 aa, Entamoeba histolytica
SLIQSPLPITPAILSTPAIGRT

SEQ ID NO: 2726799 - protein, 20 aa, Entamoeba histolytica
SLIRQFIHDVDWGELDYLII

SEQ ID NO: 2726800 - protein, 18 aa, Entamoeba histolytica
SLITFFFSLVTDVPKQYI

SEQ ID NO: 2726801 - protein, 18 aa, Entamoeba histolytica
SLITFLEKTKRPSQRVTT

SEQ ID NO: 2726802 - protein, 18 aa, Entamoeba histolytica
SLITQYVDNLFTPVFVST

SEQ ID NO: 2726803 - protein, 27 aa, Entamoeba histolytica
SLIVQLFPCYIELLIKYVQFDSNILRV

SEQ ID NO: 2726804 - protein, 17 aa, Entamoeba histolytica
SLIYFSYASDEIIEIII

SEQ ID NO: 2726805 - protein, 30 aa, Entamoeba histolytica
SLKEELCIVPLRKQLNWKALNNPQMGRIIE

SEQ ID NO: 2726806 - protein, 25 aa, Entamoeba histolytica
SLKETSKLRYFISHPTLEINDIHPQ

SEQ ID NO: 2726807 - protein, 24 aa, Entamoeba histolytica
SLKEYIKLYFFDGEKYRNDLLPYF

SEQ ID NO: 2726808 - protein, 23 aa, Entamoeba histolytica
SLKFELAIRVFDVILLEGFTAMF

SEQ ID NO: 2726809 - protein, 26 aa, Entamoeba histolytica
SLKGFEGSLSLKFTPLPSSDSLIQIS

SEQ ID NO: 2726810 - protein, 18 aa, Entamoeba histolytica
SLKGTFCIPFEFFEDVLP

SEQ ID NO: 2726811 - protein, 32 aa, Entamoeba histolytica
SLKHKKILIYITKKITLLLLNKPSLKDNRIQW

SEQ ID NO: 2726812 - protein, 21 aa, Entamoeba histolytica
SLKICFYCRISYQRSLKEIKK

SEQ ID NO: 2726813 - protein, 21 aa, Entamoeba histolytica
SLKIPSLSSLALDVLYIIYVT

SEQ ID NO: 2726814 - protein, 22 aa, Entamoeba histolytica
SLKIRKSIHLFLLKKMGKCQDS

SEQ ID NO: 2726815 - protein, 25 aa, Entamoeba histolytica
SLKITSPIDLLPFNNLKQLIVDISS

SEQ ID NO: 2726816 - protein, 36 aa, Entamoeba histolytica
SLKKLKFYEPIISGTTLFFAYTFIIDGITTLTFTCD

SEQ ID NO: 2726817 - protein, 36 aa, Entamoeba histolytica; identical to SEQ ID NO: 2539778

SEQ ID NO: 2726818 - protein, 18 aa, Entamoeba histolytica
SLKLYKRKGLYQLTEMKE

SEQ ID NO: 2726819 - protein, 26 aa, Entamoeba histolytica
SLKQFELKFEPLISTFISMHGGVCLE

SEQ ID NO: 2726820 - protein, 18 aa, Entamoeba histolytica
SLKTINIPSSITSFGVGC

SEQ ID NO: 2726821 - protein, 18 aa, Entamoeba histolytica
SLKTWLSIHPDKPSKPCI

SEQ ID NO: 2726822 - protein, 28 aa, Entamoeba histolytica
SLKVECPLLIPQLSLIPKFLKSGNEQVV

SEQ ID NO: 2726823 - protein, 17 aa, Entamoeba histolytica
SLKVIHFYVWDSIITPG

SEQ ID NO: 2726824 - protein, 18 aa, Entamoeba histolytica
SLLACRYIDNVIIGAPRG

SEQ ID NO: 2726825 - protein, 27 aa, Entamoeba histolytica
SLLEEIRSLLLQFKRGLLLLNGKYLED

SEQ ID NO: 2726826 - protein, 29 aa, Entamoeba histolytica
SLLEKLRGIYAKWILSIAYKKLDNFTGDR

SEQ ID NO: 2726827 - protein, 21 aa, Entamoeba histolytica
SLLFHRKYPFFTGKFSLPNGI

SEQ ID NO: 2726828 - protein, 23 aa, Entamoeba histolytica
SLLHPPSLLFPDTPTHTFFQFPH

SEQ ID NO: 2726829 - protein, 20 aa, Entamoeba histolytica
SLLITYRDGKFPRDYIPIMF

SEQ ID NO: 2726830 - protein, 19 aa, Entamoeba histolytica
SLLKHDVNVSYIGCLINYY

SEQ ID NO: 2726831 - protein, 20 aa, Entamoeba histolytica
SLLKKLWENEKLLDKYNLSE

SEQ ID NO: 2726832 - protein, 22 aa, Entamoeba histolytica
SLLKNMEMMKIYFADPLENEPK

SEQ ID NO: 2726833 - protein, 26 aa, Entamoeba histolytica
SLLKQIEAFVLKFPLIVKGISLEERE

SEQ ID NO: 2726834 - protein, 20 aa, Entamoeba histolytica
SLLLRHFKWNVNKMNDVYFD

SEQ ID NO: 2726835 - protein, 18 aa, Entamoeba histolytica
SLLLSNYSVIYKLVDEFG

SEQ ID NO: 2726836 - protein, 17 aa, Entamoeba histolytica
SLLLYISSKLRSFGMAV

SEQ ID NO: 2726837 - protein, 24 aa, Entamoeba histolytica
SLLNLTKMTLLYLHKNEITSIKDI

SEQ ID NO: 2726838 - protein, 24 aa, Entamoeba histolytica
SLLNNPSMRPMIGMVAQMMGMSVE

SEQ ID NO: 2726839 - protein, 18 aa, Entamoeba histolytica
SLLPLLKQTLVEAVAATI

SEQ ID NO: 2726840 - protein, 29 aa, Entamoeba histolytica
SLLSGMMKCLYYNKAYPMPIRMFEVGDTV

SEQ ID NO: 2726841 - protein, 18 aa, Entamoeba histolytica
SLLTISSLPGFGLLLFNN

SEQ ID NO: 2726842 - protein, 19 aa, Entamoeba histolytica
SLLTRERMIYSLELHPIDG

SEQ ID NO: 2726843 - protein, 17 aa, Entamoeba histolytica
SLLYLTSLQHLQSLHIR

SEQ ID NO: 2726844 - protein, 27 aa, Entamoeba histolytica
SLMGQKKFYPYCSFTLNGSVYSTYYVD

SEQ ID NO: 2726845 - protein, 17 aa, Entamoeba histolytica
SLMNKYSKKIYLTEDCN

SEQ ID NO: 2726846 - protein, 23 aa, Entamoeba histolytica
SLMQTIIFGLKGICAYVCHAHLL

SEQ ID NO: 2726847 - protein, 18 aa, Entamoeba histolytica
SLNALCKIVGLFNQTKKE

SEQ ID NO: 2726848 - protein, 19 aa, Entamoeba histolytica
SLNCILQKLSSLATNLRKG

SEQ ID NO: 2726849 - protein, 21 aa, Entamoeba histolytica
SLNEKILINQVIFEEKQKSVN

SEQ ID NO: 2726850 - protein, 24 aa, Entamoeba histolytica
SLNEKVPSSCLIFINMKSQNIINE

SEQ ID NO: 2726851 - protein, 32 aa, Entamoeba histolytica
SLNETIFCMKKESKFFTGENIKILGSLNEDTI

SEQ ID NO: 2726852 - protein, 27 aa, Entamoeba histolytica
SLNHMLEWFNSFEKRYFAFIDIEKRLP

SEQ ID NO: 2726853 - protein, 27 aa, Entamoeba histolytica
SLNIKESYWYLGLLYEYGAGVIQNSKL

SEQ ID NO: 2726854 - protein, 23 aa, Entamoeba histolytica
SLNKTLLFFTNYTIFSLKKNEQR

SEQ ID NO: 2726855 - protein, 24 aa, Entamoeba histolytica
SLNKTTLSYLQKLGLKQIKCTEEE

SEQ ID NO: 2726856 - protein, 19 aa, Entamoeba histolytica
SLNLKKAYPLFGIKNFRST

SEQ ID NO: 2726857 - protein, 25 aa, Entamoeba histolytica
SLNLLLEYDCLLAHLSQALLGAPLP

SEQ ID NO: 2726858 - protein, 21 aa, Entamoeba histolytica
SLNNYSFFDGKINAIAIVHLI

SEQ ID NO: 2726859 - protein, 26 aa, Entamoeba histolytica
SLNPFTYFHFILSFNKAISLNYFQVV

SEQ ID NO: 2726860 - protein, 37 aa, Entamoeba histolytica
SLNRGKLRYEKLGYYQLCGVVLYVFFNTKIQNEISEV

SEQ ID NO: 2726861 - protein, 24 aa, Entamoeba histolytica
SLNSNWNLIFKTVDFYYYKDIHCI

SEQ ID NO: 2726862 - protein, 34 aa, Entamoeba histolytica
SLNTAIDPPLLSRFDIILLLLDDRSKIWDEQVSD

SEQ ID NO: 2726863 - protein, 18 aa, Entamoeba histolytica
SLNVIRDEKRRNKLYEMF

SEQ ID NO: 2726864 - protein, 27 aa, Entamoeba histolytica
SLNVVNPLLVFLSAVKLATDTVALILK

SEQ ID NO: 2726865 - protein, 21 aa, Entamoeba histolytica
SLNWINIMEAVNSDPVAFAEK

SEQ ID NO: 2726866 - protein, 18 aa, Entamoeba histolytica
SLPFVLLNSKDNQQLIDV

SEQ ID NO: 2726867 - protein, 21 aa, Entamoeba histolytica
SLPGLLIYKGDCMVKSLFGSE

SEQ ID NO: 2726868 - protein, 19 aa, Entamoeba histolytica
SLPGRPLGAPPRKPAAKPK

SEQ ID NO: 2726869 - protein, 24 aa, Entamoeba histolytica
SLPKLSNSYLLKRGGSPLKTENGN

SEQ ID NO: 2726870 - protein, 20 aa, Entamoeba histolytica
SLPKPLNLFCNEKYQIGRNR

SEQ ID NO: 2726871 - protein, 22 aa, Entamoeba histolytica
SLPMKLLITQLFKNIGLISYST

SEQ ID NO: 2726872 - protein, 20 aa, Entamoeba histolytica
SLPNIPPPQRKQLIKISAMY

SEQ ID NO: 2726873 - protein, 25 aa, Entamoeba histolytica
SLPSKFHLQFLTQFLNPHTYQLIDI

SEQ ID NO: 2726874 - protein, 18 aa, Entamoeba histolytica
SLPSLKIIKVTSLSLTLS

SEQ ID NO: 2726875 - protein, 26 aa, Entamoeba histolytica
SLPTLAVFHPQLGFAILLHKNIVSKN

SEQ ID NO: 2726876 - protein, 22 aa, Entamoeba histolytica
SLPYSLIDYVSSPMTYLMGVPS

SEQ ID NO: 2726877 - protein, 24 aa, Entamoeba histolytica
SLQALFHCKLFRDDVIKEKLDIGS

SEQ ID NO: 2726878 - protein, 25 aa, Entamoeba histolytica
SLQKFSIEYLKILIPLCCVHSFDDE

SEQ ID NO: 2726879 - protein, 20 aa, Entamoeba histolytica
SLQKLFIFSSKFTIPNLNDI

SEQ ID NO: 2726880 - protein, 28 aa, Entamoeba histolytica
SLQLISLKNIIFLRSISNYFLRCTEDSY

SEQ ID NO: 2726881 - protein, 23 aa, Entamoeba histolytica
SLQPNILFCLYSLKELDPHILPL

SEQ ID NO: 2726882 - protein, 21 aa, Entamoeba histolytica
SLQQFLVNCLFISGCNNYFNS

SEQ ID NO: 2726883 - protein, 18 aa, Entamoeba histolytica
SLQQLYLQVVNYNSLFIK

SEQ ID NO: 2726884 - protein, 19 aa, Entamoeba histolytica
SLQVKYYNKQPTEVAYCCF

SEQ ID NO: 2726885 - protein, 24 aa, Entamoeba histolytica
SLQVRPMFDCIVTDPPYGIREGAK

SEQ ID NO: 2726886 - protein, 26 aa, Entamoeba histolytica
SLREARFWGIFIGDLMSFMQSQVDTF

SEQ ID NO: 2726887 - protein, 18 aa, Entamoeba histolytica
SLRKMISFIFTELHFHRI

SEQ ID NO: 2726888 - protein, 20 aa, Entamoeba histolytica
SLRLIKLYGEFITMLNSIVP

SEQ ID NO: 2726889 - protein, 21 aa, Entamoeba histolytica
SLRMLTLPNISFLLDCVNIEF

SEQ ID NO: 2726890 - protein, 17 aa, Entamoeba histolytica
SLRPSLQPPLRQSLSVI

SEQ ID NO: 2726891 - protein, 18 aa, Entamoeba histolytica
SLRSIEIPSTITSFGYGC

SEQ ID NO: 2726892 - protein, 17 aa, Entamoeba histolytica
SLRSLFSKEPLMLLCKK

SEQ ID NO: 2726893 - protein, 25 aa, Entamoeba histolytica
SLSAKYIHQVLDGLAFIHDQGIVHR

SEQ ID NO: 2726894 - protein, 28 aa, Entamoeba histolytica
SLSDSSVCSSLILSLPSHENNISKEVTD

SEQ ID NO: 2726895 - protein, 23 aa, Entamoeba histolytica
SLSECRAFYWDDMRLRKPNTMVV

SEQ ID NO: 2726896 - protein, 21 aa, Entamoeba histolytica
SLSKMACWLTSLNYKVMIAAC

SEQ ID NO: 2726897 - protein, 25 aa, Entamoeba histolytica
SLSLNNICFLKLPILNEIKRCFPNE

SEQ ID NO: 2726898 - protein, 22 aa, Entamoeba histolytica
SLSLPPYLRELPYRSLYNCFYL

SEQ ID NO: 2726899 - protein, 25 aa, Entamoeba histolytica
SLSLWALQEMYIFLPVMLSSNNYEE

SEQ ID NO: 2726900 - protein, 29 aa, Entamoeba histolytica
SLSMFRGTYGQLFECFRKLFICKTDTDNK

SEQ ID NO: 2726901 - protein, 34 aa, Entamoeba histolytica; identical to SEQ ID NO: 2539848

SEQ ID NO: 2726902 - protein, 28 aa, Entamoeba histolytica
SLSPQQLDLLFFTPTSARHISQSSSPTT

SEQ ID NO: 2726903 - protein, 24 aa, Entamoeba histolytica
SLSVFLFPCFAVNNQINLTIFKEV

SEQ ID NO: 2726904 - protein, 33 aa, Entamoeba histolytica
SLSVSIFPVFTNQALLKISYILSLFGSKAFPIS

SEQ ID NO: 2726905 - protein, 19 aa, Entamoeba histolytica
SLSYCIYAMLILPKLRDPD

SEQ ID NO: 2726906 - protein, 19 aa, Entamoeba histolytica
SLTHQLFKIKTLIFDNEVF

SEQ ID NO: 2726907 - protein, 26 aa, Entamoeba histolytica
SLTKLEDCFYLYTKTFPFLKNITIIQ

SEQ ID NO: 2726908 - protein, 19 aa, Entamoeba histolytica
SLTLSKFFPISIINTMKMD

SEQ ID NO: 2726909 - protein, 21 aa, Entamoeba histolytica
SLTPLDREAMRKERLSSGINS

SEQ ID NO: 2726910 - protein, 22 aa, Entamoeba histolytica
SLTQQLYMNPYFRNSIMNVKAT

SEQ ID NO: 2726911 - protein, 27 aa, Entamoeba histolytica
SLTSLLVLRQKATLGVLKLLLSIPDNF

SEQ ID NO: 2726912 - protein, 25 aa, Entamoeba histolytica
SLTYCTGIPILFVGSGQHYTDLKLL

SEQ ID NO: 2726913 - protein, 19 aa, Entamoeba histolytica
SLVCIMQIFLTSPIYRLKN

SEQ ID NO: 2726914 - protein, 27 aa, Entamoeba histolytica
SLVELLLDKYYRTLEGFIVLIEKDWKS

SEQ ID NO: 2726915 - protein, 24 aa, Entamoeba histolytica
SLVELMLDPFYRTISGFAVLIEKD

SEQ ID NO: 2726916 - protein, 26 aa, Entamoeba histolytica
SLVERIPLELLLLHPRGTDPMSSISF

SEQ ID NO: 2726917 - protein, 24 aa, Entamoeba histolytica
SLVIDYIESIYFNYFCFKRKDIDH

SEQ ID NO: 2726918 - protein, 31 aa, Entamoeba histolytica
SLVLDVKIWTPELIQLFINLGNKRVNSLLMG

SEQ ID NO: 2726919 - protein, 18 aa, Entamoeba histolytica
SLVLFLKDRISSSANEII

SEQ ID NO: 2726920 - protein, 24 aa, Entamoeba histolytica
SLVLHYDSIFILRKDTRQIFDKNK

SEQ ID NO: 2726921 - protein, 20 aa, Entamoeba histolytica
SLVLSYLMYANKFTFDEALA

SEQ ID NO: 2726922 - protein, 29 aa, Entamoeba histolytica
SLVLTVKGVPFLLKFVEIQLVGAKGEIIE

SEQ ID NO: 2726923 - protein, 19 aa, Entamoeba histolytica
SLVLVLQILLTRALSIEDK

SEQ ID NO: 2726924 - protein, 18 aa, Entamoeba histolytica
SLVMFWDRILANLRSRQY

SEQ ID NO: 2726925 - protein, 34 aa, Entamoeba histolytica
SLVNFISKTYKGRIIRIILPVEIDSIKKTIEMII

SEQ ID NO: 2726926 - protein, 29 aa, Entamoeba histolytica
SLVPTHPIRLGLALNFSVFYYEIMNDADK

SEQ ID NO: 2726927 - protein, 31 aa, Entamoeba histolytica
SLVQEYSRSLIRHNFLYGKERLMTSIIEGKS

SEQ ID NO: 2726928 - protein, 26 aa, Entamoeba histolytica
SLVRRFAFQILSALHFLQQPDIRVIH

SEQ ID NO: 2726929 - protein, 27 aa, Entamoeba histolytica
SLVTQLFEVIGYLFIYHSEYCEMYFET

SEQ ID NO: 2726930 - protein, 25 aa, Entamoeba histolytica
SLVVSFERRLWTCKLWDIEERLREA

SEQ ID NO: 2726931 - protein, 28 aa, Entamoeba histolytica
SLVYMNKMPVIWKLYIEWLIENGEITQM

SEQ ID NO: 2726932 - protein, 32 aa, Entamoeba histolytica
SLVYQIIEIEFIPIWDILHIIYGNQLINELFD

SEQ ID NO: 2726933 - protein, 30 aa, Entamoeba histolytica; identical to SEQ ID NO: 2539892

SEQ ID NO: 2726934 - protein, 27 aa, Entamoeba histolytica
SLYPSSKIYLIYLYKKIKIQHIESNEI

SEQ ID NO: 2726935 - protein, 35 aa, Entamoeba histolytica
SLYQYLGACIYTSIKSFHWQFLITKSKRSSQRMLA

SEQ ID NO: 2726936 - protein, 18 aa, Entamoeba histolytica
SLYRIYLHILQHHLQHQN

SEQ ID NO: 2726937 - protein, 22 aa, Entamoeba histolytica
SLYSDITLIYRGYKLTDSSLFS

SEQ ID NO: 2726938 - protein, 18 aa, Entamoeba histolytica
SLYSQFILSFQYYINQSN

SEQ ID NO: 2726939 - protein, 17 aa, Entamoeba histolytica
SLYVTKALEVKIFGLEY

SEQ ID NO: 2726940 - protein, 23 aa, Entamoeba histolytica
SLYYLLTTFARWSHRLYECGEEK

SEQ ID NO: 2726941 - protein, 26 aa, Entamoeba histolytica
SMDNPEDFMIFPVKTPKCPTRFVFKN

SEQ ID NO: 2726942 - protein, 34 aa, Entamoeba histolytica; identical to SEQ ID NO: 2539905

SEQ ID NO: 2726943 - protein, 17 aa, Entamoeba histolytica
SMFIANPSPMMAHLVTI

SEQ ID NO: 2726944 - protein, 17 aa, Entamoeba histolytica
SMFLFQQRDTKADKAIL

SEQ ID NO: 2726945 - protein, 18 aa, Entamoeba histolytica
SMFQLINSSGSYQSLVAD

SEQ ID NO: 2726946 - protein, 18 aa, Entamoeba histolytica
SMGRILLQIAYASPLDRP

SEQ ID NO: 2726947 - protein, 27 aa, Entamoeba histolytica
SMIIQQSITFIILSLTMLNGEAIFQEV

SEQ ID NO: 2726948 - protein, 27 aa, Entamoeba histolytica
SMILNDSLQSTILFGPPGSGKTTIARI

SEQ ID NO: 2726949 - protein, 18 aa, Entamoeba histolytica
SMISIIFNKKQSICVVID

SEQ ID NO: 2726950 - protein, 19 aa, Entamoeba histolytica
SMITLIMKPMEQISKMMQK

SEQ ID NO: 2726951 - protein, 26 aa, Entamoeba histolytica
SMKKRIINSIFLFETPIIVDIPHNID

SEQ ID NO: 2726952 - protein, 26 aa, Entamoeba histolytica
SMKNWSFVPVTLADYLYLPYSSKKVD

SEQ ID NO: 2726953 - protein, 25 aa, Entamoeba histolytica
SMKTKSHMIALPLYSALPQQEQQRV

SEQ ID NO: 2726954 - protein, 17 aa, Entamoeba histolytica
SMLFSTIKKCPLTSRRP

SEQ ID NO: 2726955 - protein, 17 aa, Entamoeba histolytica
SMLQSRRYWSTEEHTKF

SEQ ID NO: 2726956 - protein, 41 aa, Entamoeba histolytica
SMLSHLRLLNISHNRLYQLPPYLPFSLRTLLINSNHLICLP

SEQ ID NO: 2726957 - protein, 23 aa, Entamoeba histolytica
SMNDLIDEIIFSNLAKVSIDDAY

SEQ ID NO: 2726958 - protein, 19 aa, Entamoeba histolytica
SMNDVFVRLLLNAPDVSNR

SEQ ID NO: 2726959 - protein, 26 aa, Entamoeba histolytica
SMNNELPWWKTVFAIVMKYISTNCPN

SEQ ID NO: 2726960 - protein, 24 aa, Entamoeba histolytica
SMNPKRSFFKKSIKPMIVQQEHTE

SEQ ID NO: 2726961 - protein, 22 aa, Entamoeba histolytica
SMPFQHIMRYKIQLNRIMETLP

SEQ ID NO: 2726962 - protein, 26 aa, Entamoeba histolytica
SMRIKEWYSWHFPELYNILNNDNTKF

SEQ ID NO: 2726963 - protein, 17 aa, Entamoeba histolytica
SMRSNVFLPVSGLVNVK

SEQ ID NO: 2726964 - protein, 21 aa, Entamoeba histolytica
SMTELCNVLFNPSIFNYLNEI

SEQ ID NO: 2726965 - protein, 25 aa, Entamoeba histolytica
SMVDLVRRGVVPTYVVFQNRPKRDI

SEQ ID NO: 2726966 - protein, 20 aa, Entamoeba histolytica
SMVNGLRRVIMAETPTIAIQ

SEQ ID NO: 2726967 - protein, 17 aa, Entamoeba histolytica
SMYCMYHYYAGMTMLIK

SEQ ID NO: 2726968 - protein, 25 aa, Entamoeba histolytica
SNAILLLRWVVDWLEKDKRILMSVT

SEQ ID NO: 2726969 - protein, 25 aa, Entamoeba histolytica
SNAIPLPPLLIFPSSPSLPSSLSSL

SEQ ID NO: 2726970 - protein, 17 aa, Entamoeba histolytica
SNALIELINTRFEDLVF

SEQ ID NO: 2726971 - protein, 21 aa, Entamoeba histolytica
SNAPTLIHLFKKITTLGRQSK

SEQ ID NO: 2726972 - protein, 27 aa, Entamoeba histolytica
SNAQKDYVITLLQMYENMYGVKVNKNE

SEQ ID NO: 2726973 - protein, 26 aa, Entamoeba histolytica
SNCESLPQFIKISGNIPGLLIRPADG

SEQ ID NO: 2726974 - protein, 24 aa, Entamoeba histolytica
SNCLQKKVVLPQPIQVWLQQRKCD

SEQ ID NO: 2726975 - protein, 19 aa, Entamoeba histolytica
SNCPIYLDLSKYSFIKELD

SEQ ID NO: 2726976 - protein, 35 aa, Entamoeba histolytica
SNDFINLLKLKIELQREWLFDEIDINEYLGIIVTE

SEQ ID NO: 2726977 - protein, 24 aa, Entamoeba histolytica
SNDISHIINLYFKELWGKSVEHKI

SEQ ID NO: 2726978 - protein, 27 aa, Entamoeba histolytica
SNDKSIMVWDYRKPEFPLKTLQNHTGE

SEQ ID NO: 2726979 - protein, 23 aa, Entamoeba histolytica
SNDLMKYILAFGFNEDKTFIYTD

SEQ ID NO: 2726980 - protein, 24 aa, Entamoeba histolytica
SNDNEHYVLRPSGSLVKMGDFGAY

SEQ ID NO: 2726981 - protein, 25 aa, Entamoeba histolytica
SNDNPKVIFYISAMILCNMDSKNVS

SEQ ID NO: 2726982 - protein, 17 aa, Entamoeba histolytica
SNDNRYIVIPNEKIRKI

SEQ ID NO: 2726983 - protein, 27 aa, Entamoeba histolytica
SNDSNNTKWLFYNQGRYLLEYETNGEF

SEQ ID NO: 2726984 - protein, 32 aa, Entamoeba histolytica
SNDTIIARKFLCCGPLFIVEKVTEIPQKWMYC

SEQ ID NO: 2726985 - protein, 17 aa, Entamoeba histolytica
SNDYPIQVIFPKNGGEL

SEQ ID NO: 2726986 - protein, 40 aa, Entamoeba histolytica
SNECYVFHYTYPWKNLFRHALFFWLGKNASILHRGKAAAL

SEQ ID NO: 2726987 - protein, 31 aa, Entamoeba histolytica
SNEIPSFYNVMKALLICFRNGIEKPSVLKVM

SEQ ID NO: 2726988 - protein, 26 aa, Entamoeba histolytica
SNEKIYGIGFLFILNDKKTKYDVIMY

SEQ ID NO: 2726989 - protein, 22 aa, Entamoeba histolytica
SNEKIYQFPLVKTKNIVTIVSI

SEQ ID NO: 2726990 - protein, 31 aa, Entamoeba histolytica
SNELFTKPPPYNSPIIDIPFFLKEDQIKQAD

SEQ ID NO: 2726991 - protein, 17 aa, Entamoeba histolytica
SNELLHQIFSYLPLEDL

SEQ ID NO: 2726992 - protein, 26 aa, Entamoeba histolytica
SNELSIFLDMLFKKSINEPKFASLYV

SEQ ID NO: 2726993 - protein, 18 aa, Entamoeba histolytica
SNEMFLFVLNGKGAYPFK

SEQ ID NO: 2726994 - protein, 17 aa, Entamoeba histolytica
SNENMIFILMLITDINS

SEQ ID NO: 2726995 - protein, 23 aa, Entamoeba histolytica
SNERIHYFITVLSVADGYTFNSN

SEQ ID NO: 2726996 - protein, 38 aa, Entamoeba histolytica
SNEVFHPKRGFFGNLYQMIFHPIEYFTPKETKLGEVKI

SEQ ID NO: 2726997 - protein, 17 aa, Entamoeba histolytica
SNFALFELGIESEKIKK

SEQ ID NO: 2726998 - protein, 23 aa, Entamoeba histolytica
SNFHISMKKFEFKKPNLMSKPLK

SEQ ID NO: 2726999 - protein, 25 aa, Entamoeba histolytica
SNFRRIEVLHLNNAICNKPNIMLII

SEQ ID NO: 2727000 - protein, 24 aa, Entamoeba histolytica
SNFVLTIASAFWILADRTVHIHPS

SEQ ID NO: 2727001 - protein, 23 aa, Entamoeba histolytica
SNFYDAIQFVLCDEKFGNLRAGD

SEQ ID NO: 2727002 - protein, 24 aa, Entamoeba histolytica
SNGFKGMLLVSAKTGFHVEETMEN

SEQ ID NO: 2727003 - protein, 24 aa, Entamoeba histolytica
SNGGKLFVRDPTMSATKKTDAYIN

SEQ ID NO: 2727004 - protein, 22 aa, Entamoeba histolytica
SNGKILLPIIQNFSLIKNQQMR

SEQ ID NO: 2727005 - protein, 27 aa, Entamoeba histolytica
SNGNLSFVVLYPKIFEIEPTLFVFKAT

SEQ ID NO: 2727006 - protein, 24 aa, Entamoeba histolytica
SNGQYAIILWKKQNEWYLSYLKRN

SEQ ID NO: 2727007 - protein, 29 aa, Entamoeba histolytica
SNGTMIIRIELPFGIWCDGCKNLIGKGTR

SEQ ID NO: 2727008 - protein, 30 aa, Entamoeba histolytica
SNHLFYSEALYFHQPLQPSYPQFLTNSTVN

SEQ ID NO: 2727009 - protein, 21 aa, Entamoeba histolytica
SNHLTDFLKRVIVEHPELVEG

SEQ ID NO: 2727010 - protein, 23 aa, Entamoeba histolytica
SNHYLWVVWDRALELCLLQINNH

SEQ ID NO: 2727011 - protein, 21 aa, Entamoeba histolytica
SNICSYLFSCANDKKECYLPR

SEQ ID NO: 2727012 - protein, 25 aa, Entamoeba histolytica
SNIDETFFDLILKAVNADFAKKGLP

SEQ ID NO: 2727013 - protein, 26 aa, Entamoeba histolytica
SNIDQRYKWFLDKIKVAKYKYDNTLP

SEQ ID NO: 2727014 - protein, 26 aa, Entamoeba histolytica
SNIFNPIQPINWIVYGIEPSRQEIAN

SEQ ID NO: 2727015 - protein, 22 aa, Entamoeba histolytica
SNIFRGLQMFYEAGENFCRAGE

SEQ ID NO: 2727016 - protein, 21 aa, Entamoeba histolytica
SNIHIEGCIKTFFSSTKTLND

SEQ ID NO: 2727017 - protein, 40 aa, Entamoeba histolytica; identical to SEQ ID NO: 2539989

SEQ ID NO: 2727018 - protein, 26 aa, Entamoeba histolytica
SNIKQVDRRKVAWDLTIETTAFDGSR

SEQ ID NO: 2727019 - protein, 22 aa, Entamoeba histolytica
SNILAQLYFSLFSHDHASALQF

SEQ ID NO: 2727020 - protein, 33 aa, Entamoeba histolytica; identical to SEQ ID NO: 2539994

SEQ ID NO: 2727021 - protein, 24 aa, Entamoeba histolytica
SNIRTLWMFYNNLNKLKGIEGIKH

SEQ ID NO: 2727022 - protein, 22 aa, Entamoeba histolytica
SNISCGLLILRGDEIMVIGGLN

SEQ ID NO: 2727023 - protein, 19 aa, Entamoeba histolytica
SNISLFQSLSSYINDLNLI

SEQ ID NO: 2727024 - protein, 20 aa, Entamoeba histolytica
SNITIYPPLIFDTSELDPSD

SEQ ID NO: 2727025 - protein, 17 aa, Entamoeba histolytica
SNIYIHYAWEMFGLEDN

SEQ ID NO: 2727026 - protein, 24 aa, Entamoeba histolytica
SNKECYICHQQGHIARNCPKQSGR

SEQ ID NO: 2727027 - protein, 21 aa, Entamoeba histolytica
SNKFIVIKTFSKFLKHIVHSF

SEQ ID NO: 2727028 - protein, 30 aa, Entamoeba histolytica
SNKKVLRIGMRPLKTIPLKSLSPVERKKKA

SEQ ID NO: 2727029 - protein, 25 aa, Entamoeba histolytica
SNKNISFLRFFSIVAILNCENLKDY

SEQ ID NO: 2727030 - protein, 30 aa, Entamoeba histolytica
SNKNTSLLYFPFIIPVDYKMKFLHKEAKQE

SEQ ID NO: 2727031 - protein, 25 aa, Entamoeba histolytica
SNKPLILRIEFSGCSNLTIIDTPGF

SEQ ID NO: 2727032 - protein, 24 aa, Entamoeba histolytica
SNKQLNYPQLLIKKLKNLNCPALP

SEQ ID NO: 2727033 - protein, 19 aa, Entamoeba histolytica
SNLIFKCHQMKASSLFFVL

SEQ ID NO: 2727034 - protein, 20 aa, Entamoeba histolytica
SNLLNDVYSRCLQLYVAPRR

SEQ ID NO: 2727035 - protein, 24 aa, Entamoeba histolytica
SNLLSLIKLYHYHGIPLEITKEIS

SEQ ID NO: 2727036 - protein, 24 aa, Entamoeba histolytica
SNLLSMVPYVYSHRIKFTNTSFKA

SEQ ID NO: 2727037 - protein, 27 aa, Entamoeba histolytica
SNLMDAISFVLGVKVGLLRGSNLKDLI

SEQ ID NO: 2727038 - protein, 31 aa, Entamoeba histolytica
SNLPYPTLTIISFIVMLLRHSALSEDAYLII

SEQ ID NO: 2727039 - protein, 30 aa, Entamoeba histolytica; identical to SEQ ID NO: 2540021

SEQ ID NO: 2727040 - protein, 18 aa, Entamoeba histolytica
SNNDMISEYSWLKFIASC

SEQ ID NO: 2727041 - protein, 27 aa, Entamoeba histolytica
SNNELELLPDLLYINLTQLQDLQVESN

SEQ ID NO: 2727042 - protein, 24 aa, Entamoeba histolytica
SNNGLYLYLASRDGSLYCFELETG

SEQ ID NO: 2727043 - protein, 36 aa, Entamoeba histolytica; identical to SEQ ID NO: 2540024

SEQ ID NO: 2727044 - protein, 18 aa, Entamoeba histolytica
SNNIISALPLIKCTTIKS

SEQ ID NO: 2727045 - protein, 25 aa, Entamoeba histolytica
SNNKRVFIFYDYPKEVKRFPYVWGQ

SEQ ID NO: 2727046 - protein, 22 aa, Entamoeba histolytica
SNNLLTTLLWHDDMLKCIKMNT

SEQ ID NO: 2727047 - protein, 31 aa, Entamoeba histolytica
SNNPFTCFPFFVPRRNWFVKAIFLTELEQRS

SEQ ID NO: 2727048 - protein, 24 aa, Entamoeba histolytica
SNNQLLYDLFPWSAEQEAAKTGQK

SEQ ID NO: 2727049 - protein, 28 aa, Entamoeba histolytica
SNNVFAYKWIVLLFKRYISDNYLLRIWD

SEQ ID NO: 2727050 - protein, 24 aa, Entamoeba histolytica
SNNYDLYSVLRILSIWFNCKSDNN

SEQ ID NO: 2727051 - protein, 22 aa, Entamoeba histolytica
SNPAKLFGIYPEKGCLGIGSDA

SEQ ID NO: 2727052 - protein, 32 aa, Entamoeba histolytica
SNPEYYSRSYSWLPLLYGLTKEDFFGALIHLI

SEQ ID NO: 2727053 - protein, 17 aa, Entamoeba histolytica
SNPFLSITFNSNTWFRI

SEQ ID NO: 2727054 - protein, 19 aa, Entamoeba histolytica
SNPIHYWRYRCHVDMDEII

SEQ ID NO: 2727055 - protein, 31 aa, Entamoeba histolytica
SNPPMFQVQLTRYIPFIFKSTLTLEEKEYIS

SEQ ID NO: 2727056 - protein, 24 aa, Entamoeba histolytica
SNPQFHISVMALILNLLKQPDVPA

SEQ ID NO: 2727057 - protein, 23 aa, Entamoeba histolytica
SNQALEIILWILTAISSFENFDS

SEQ ID NO: 2727058 - protein, 28 aa, Entamoeba histolytica
SNQLRVLSPLICFLTSLVNLNLSRNKLE

SEQ ID NO: 2727059 - protein, 22 aa, Entamoeba histolytica
SNQTHFLECYGAFILESDSNSK

SEQ ID NO: 2727060 - protein, 31 aa, Entamoeba histolytica
SNQTPIQITVLPYIPISPKQPGLSSSRVTSR

SEQ ID NO: 2727061 - protein, 18 aa, Entamoeba histolytica
SNRLIKDQFIDEEKATIA

SEQ ID NO: 2727062 - protein, 23 aa, Entamoeba histolytica
SNRTSIVGTPYWMAPELIRSQRY

SEQ ID NO: 2727063 - protein, 35 aa, Entamoeba histolytica
SNSFNKFIYCPIVLPYFLRLLTHCLSIQDFTISPF

SEQ ID NO: 2727064 - protein, 30 aa, Entamoeba histolytica
SNSFVCICCNTLFFAEKNILRYCSFGSDKI

SEQ ID NO: 2727065 - protein, 31 aa, Entamoeba histolytica
SNSHFNKFLWDLLYSHPSFIKFKETLAGIIG

SEQ ID NO: 2727066 - protein, 19 aa, Entamoeba histolytica
SNSLTFYSLGRDLMRDTRF

SEQ ID NO: 2727067 - protein, 22 aa, Entamoeba histolytica
SNSVPISFTRKVVRKPACNWSV

SEQ ID NO: 2727068 - protein, 30 aa, Entamoeba histolytica
SNTASMPDIPFSNPFYFPMFNNRELPDSPQ

SEQ ID NO: 2727069 - protein, 22 aa, Entamoeba histolytica
SNTCWHLYGIILRTEKHYEEAA

SEQ ID NO: 2727070 - protein, 25 aa, Entamoeba histolytica
SNTDDFIWKLVRLLVNNGLSPNEQK

SEQ ID NO: 2727071 - protein, 33 aa, Entamoeba histolytica; identical to SEQ ID NO: 2540055

SEQ ID NO: 2727072 - protein, 33 aa, Entamoeba histolytica; identical to SEQ ID NO: 2540056

SEQ ID NO: 2727073 - protein, 25 aa, Entamoeba histolytica
SNTFYYIIMECSAYGSLFNFISMNP

SEQ ID NO: 2727074 - protein, 24 aa, Entamoeba histolytica
SNTKKFAYLLSRIFYNAQYFERKQ

SEQ ID NO: 2727075 - protein, 24 aa, Entamoeba histolytica
SNTKYQILFAKYDGINKLVTLTDQ

SEQ ID NO: 2727076 - protein, 27 aa, Entamoeba histolytica
SNTPYSPFPSFSPYIPQSVQFPQQQPP

SEQ ID NO: 2727077 - protein, 34 aa, Entamoeba histolytica
SNTSWICLGGFIFLRYICPAIIRPLEWGLVYDIP

SEQ ID NO: 2727078 - protein, 25 aa, Entamoeba histolytica
SNVAIKKMIEWGRGLKLINTEEINK

SEQ ID NO: 2727079 - protein, 27 aa, Entamoeba histolytica
SNVLMTLTPILLFLSNDIQPLHLTSTE

SEQ ID NO: 2727080 - protein, 24 aa, Entamoeba histolytica
SNVQYVFRKMFNIKSIILDGNDIC

SEQ ID NO: 2727081 - protein, 31 aa, Entamoeba histolytica
SNWECGEYLLYFVRIFLQYKPKTIKEFRSFL

SEQ ID NO: 2727082 - protein, 20 aa, Entamoeba histolytica
SNWSIALKYFVIDISVTSNT

SEQ ID NO: 2727083 - protein, 26 aa, Entamoeba histolytica
SNYIPKYICESYLPAYKIEVVYIADR

SEQ ID NO: 2727084 - protein, 17 aa, Entamoeba histolytica
SNYKATVDPCRFMGCGP

SEQ ID NO: 2727085 - protein, 20 aa, Entamoeba histolytica
SNYLSSFLIQKGMTLTCQVM

SEQ ID NO: 2727086 - protein, 23 aa, Entamoeba histolytica
SNYPEILMKLIQEGINKLQDNNI

SEQ ID NO: 2727087 - protein, 18 aa, Entamoeba histolytica
SNYPSSHLLILKEQTRTL

SEQ ID NO: 2727088 - protein, 26 aa, Entamoeba histolytica
SNYSAWWFLIHITSFKNLRYLTIILE

SEQ ID NO: 2727089 - protein, 31 aa, Entamoeba histolytica
SNYVHGLFHVKFWIILTKTCFAIQDALLYST

SEQ ID NO: 2727090 - protein, 21 aa, Entamoeba histolytica
SNYYSYQFSFQPELQSYQEAR

SEQ ID NO: 2727091 - protein, 21 aa, Entamoeba histolytica
SPAGALWWLARELEEAKKYKP

SEQ ID NO: 2727092 - protein, 21 aa, Entamoeba histolytica
SPAIRVEYVDFFEDEIFVDEK

SEQ ID NO: 2727093 - protein, 20 aa, Entamoeba histolytica
SPAQSGLAPAENPASTSPKG

SEQ ID NO: 2727094 - protein, 24 aa, Entamoeba histolytica
SPDAPMIFTLSFLGKDPISCVYSV

SEQ ID NO: 2727095 - protein, 26 aa, Entamoeba histolytica
SPDIADRFWYFLKKEYVELQGNVFCP

SEQ ID NO: 2727096 - protein, 24 aa, Entamoeba histolytica
SPDPLQTLLLPLNNDIPAGVLKYF

SEQ ID NO: 2727097 - protein, 18 aa, Entamoeba histolytica
SPDVPLLTIPVISSIPFG

SEQ ID NO: 2727098 - protein, 19 aa, Entamoeba histolytica
SPDVVAFQFAVRGKIAIVS

SEQ ID NO: 2727099 - protein, 25 aa, Entamoeba histolytica
SPECVLYAAKIFPFGEQMIALCRVL

SEQ ID NO: 2727100 - protein, 29 aa, Entamoeba histolytica
SPEDLITIPFNMFLKPLSLSPTTSSQINT

SEQ ID NO: 2727101 - protein, 32 aa, Entamoeba histolytica
SPEERSLFCYCPNIVAFPLASVSPRSTSSDSS

SEQ ID NO: 2727102 - protein, 23 aa, Entamoeba histolytica
SPEMLLQDGWSYATDLWSVGCTL

SEQ ID NO: 2727103 - protein, 20 aa, Entamoeba histolytica
SPFAFIGNRFEFRAVGSEQN

SEQ ID NO: 2727104 - protein, 27 aa, Entamoeba histolytica
SPFAKRRLLELSKRIGPYILRRTKKDV

SEQ ID NO: 2727105 - protein, 23 aa, Entamoeba histolytica
SPFDIKTFLWKDHPFQLPEFQDG

SEQ ID NO: 2727106 - protein, 17 aa, Entamoeba histolytica
SPFFNLYTTLKTLIEEW

SEQ ID NO: 2727107 - protein, 18 aa, Entamoeba histolytica
SPFWDNKSLELKDLIKHM

SEQ ID NO: 2727108 - protein, 24 aa, Entamoeba histolytica
SPGSFKMRKPFPQPWRGLRDKELE

SEQ ID NO: 2727109 - protein, 18 aa, Entamoeba histolytica
SPHYIFNEKVPLTSFFIK

SEQ ID NO: 2727110 - protein, 24 aa, Entamoeba histolytica
SPIDFEQFPLLTKISLRTYCSVPT

SEQ ID NO: 2727111 - protein, 24 aa, Entamoeba histolytica
SPIDLEQFPLLTKISLRTYCSVPT

SEQ ID NO: 2727112 - protein, 26 aa, Entamoeba histolytica
SPIFLQFIDCIYQFMRIFPKEFEFNE

SEQ ID NO: 2727113 - protein, 17 aa, Entamoeba histolytica
SPIGYGLFKVKEKEEIG

SEQ ID NO: 2727114 - protein, 20 aa, Entamoeba histolytica
SPIKAPINKGQVLVKIPKMT

SEQ ID NO: 2727115 - protein, 22 aa, Entamoeba histolytica
SPILSHDILLPNNIYIDIVDAN

SEQ ID NO: 2727116 - protein, 19 aa, Entamoeba histolytica
SPIPLIKLTNLFSLVTDLE

SEQ ID NO: 2727117 - protein, 19 aa, Entamoeba histolytica
SPIQKQYYRWIITKNSDAL

SEQ ID NO: 2727118 - protein, 34 aa, Entamoeba histolytica
SPISAFSMPAPKQVYSPLLVVTPMDTPMVEEDSE

SEQ ID NO: 2727119 - protein, 17 aa, Entamoeba histolytica
SPKGYFIFSINETQFVN

SEQ ID NO: 2727120 - protein, 18 aa, Entamoeba histolytica
SPKKDSLFSLFRSNDEDL

SEQ ID NO: 2727121 - protein, 29 aa, Entamoeba histolytica
SPKNILVFLELFLFHDFITDLHSLFQDWF

SEQ ID NO: 2727122 - protein, 23 aa, Entamoeba histolytica
SPKQLYNILILLKVAKSHHPMKM

SEQ ID NO: 2727123 - protein, 22 aa, Entamoeba histolytica
SPKSFLNCSKLMKIDVQGLQEM

SEQ ID NO: 2727124 - protein, 17 aa, Entamoeba histolytica
SPLFIKVELLRYERKVP

SEQ ID NO: 2727125 - protein, 30 aa, Entamoeba histolytica
SPLFIQFFPHYLAFMFFQIPEFRSQLLKIV

SEQ ID NO: 2727126 - protein, 19 aa, Entamoeba histolytica
SPLIKFPYIIDSTKNLIFS

SEQ ID NO: 2727127 - protein, 25 aa, Entamoeba histolytica
SPLLSRFDLIFVLVDNPDAEADKEL

SEQ ID NO: 2727128 - protein, 19 aa, Entamoeba histolytica
SPLPFIHRFEKHPSPDTSI

SEQ ID NO: 2727129 - protein, 17 aa, Entamoeba histolytica
SPMYTINSPFKKTMRKE

SEQ ID NO: 2727130 - protein, 24 aa, Entamoeba histolytica
SPNQSFCYFIDSKTLFDVWNDEEI

SEQ ID NO: 2727131 - protein, 24 aa, Entamoeba histolytica
SPNQSFIYYIDSKTPFDVWNDDEI

SEQ ID NO: 2727132 - protein, 30 aa, Entamoeba histolytica
SPPTTCFSSVLPFPFSVPISSPTPSPSICS

SEQ ID NO: 2727133 - protein, 19 aa, Entamoeba histolytica
SPQEFFFHAMAGRQGIIDT

SEQ ID NO: 2727134 - protein, 34 aa, Entamoeba histolytica
SPQIDFQIGSCLRVKQFSLPSLVLNKEKAQQIQA

SEQ ID NO: 2727135 - protein, 23 aa, Entamoeba histolytica
SPQIFGFEHCFKQLIQFIENIQK

SEQ ID NO: 2727136 - protein, 44 aa, Entamoeba histolytica; identical to SEQ ID NO: 2540119

SEQ ID NO: 2727137 - protein, 24 aa, Entamoeba histolytica
SPRNRILAVIIINKLFTIDQKNRS

SEQ ID NO: 2727138 - protein, 23 aa, Entamoeba histolytica
SPRSLFSPISILSPKTLFSPRTP

SEQ ID NO: 2727139 - protein, 23 aa, Entamoeba histolytica
SPSDGFIYLAGCNSLRYLYLNES

SEQ ID NO: 2727140 - protein, 18 aa, Entamoeba histolytica
SPSEISSFILKKLKKDAE

SEQ ID NO: 2727141 - protein, 20 aa, Entamoeba histolytica
SPSEISSFILKKLKKDAEAK

SEQ ID NO: 2727142 - protein, 25 aa, Entamoeba histolytica
SPSFNQYFYQTLFEWSIKERNISKE

SEQ ID NO: 2727143 - protein, 21 aa, Entamoeba histolytica
SPSFYLIQFIEKLEKARFIIA

SEQ ID NO: 2727144 - protein, 21 aa, Entamoeba histolytica
SPSKIDTFINSLSRLFNSETT

SEQ ID NO: 2727145 - protein, 24 aa, Entamoeba histolytica
SPSLHLPLMIKNLQLRWFNKCTSI

SEQ ID NO: 2727146 - protein, 17 aa, Entamoeba histolytica
SPSNKTLPYPFWKEWIA

SEQ ID NO: 2727147 - protein, 95 aa, Entamoeba histolytica
SPSSIATPPPPPPTLSMPPPPPPTLSMPPPPPPTLSMPPPPPPTLSMPPPPPPTLSMPPPPPPTLSMPPPPPPTLSMPPPPPPTLNVTSSPTTTM

SEQ ID NO: 2727148 - protein, 20 aa, Entamoeba histolytica
SPSYIYRLVAQLYNPEDTFF

SEQ ID NO: 2727149 - protein, 33 aa, Entamoeba histolytica
SPTAPIISIKFPDPVIKIFYQPYEAKYPQVPKN

SEQ ID NO: 2727150 - protein, 21 aa, Entamoeba histolytica
SPTCLTAHPTYPLLLVGCIDG

SEQ ID NO: 2727151 - protein, 25 aa, Entamoeba histolytica
SPTENIMEFLPTALLFIDENIKRNR

SEQ ID NO: 2727152 - protein, 17 aa, Entamoeba histolytica
SPTFRAKRLAIRQNQLE

SEQ ID NO: 2727153 - protein, 20 aa, Entamoeba histolytica
SPTKTFNLSFLPQSTQNLIK

SEQ ID NO: 2727154 - protein, 30 aa, Entamoeba histolytica
SPVEDKIIEQFQLLIQFIQQQKKEMEEEIK

SEQ ID NO: 2727155 - protein, 29 aa, Entamoeba histolytica
SPVFHQFIECVFILLQQYPTSFQYNEDFL

SEQ ID NO: 2727156 - protein, 19 aa, Entamoeba histolytica
SPVIQYLAAFGIGKLVIVD

SEQ ID NO: 2727157 - protein, 18 aa, Entamoeba histolytica
SPVLSYFDITPNSIIVES

SEQ ID NO: 2727158 - protein, 24 aa, Entamoeba histolytica
SPVNKLFWDFVKTVKKRLSVTKDE

SEQ ID NO: 2727159 - protein, 18 aa, Entamoeba histolytica
SPVWLATISSNSITGRKC

SEQ ID NO: 2727160 - protein, 19 aa, Entamoeba histolytica
SPWIFWFESGKDSDRSTSI

SEQ ID NO: 2727161 - protein, 20 aa, Entamoeba histolytica
SPYCPFMAYLTSCSIVYPEC

SEQ ID NO: 2727162 - protein, 36 aa, Entamoeba histolytica
SPYDSGLVFGIFFPERNRFPGVIDLYRKEIGKPCKL

SEQ ID NO: 2727163 - protein, 25 aa, Entamoeba histolytica
SPYINYLSAIGEAVPVFGWICVEKT

SEQ ID NO: 2727164 - protein, 20 aa, Entamoeba histolytica
SPYRSTFLHLLFQHNVTLSQ

SEQ ID NO: 2727165 - protein, 20 aa, Entamoeba histolytica
SPYVIFGERIVDLAVSRLMN

SEQ ID NO: 2727166 - protein, 28 aa, Entamoeba histolytica
SQALSQWCDDFIGFFTINSSIQSTLLNY

SEQ ID NO: 2727167 - protein, 34 aa, Entamoeba histolytica
SQCIGQNFQLSDYPSMMTIYSAVSNLTTLTDDCI

SEQ ID NO: 2727168 - protein, 23 aa, Entamoeba histolytica
SQCNEIWICRGDMGVQLGFVGMA

SEQ ID NO: 2727169 - protein, 25 aa, Entamoeba histolytica
SQDFSSFFTDNQQPFGFGTTNNLSF

SEQ ID NO: 2727170 - protein, 42 aa, Entamoeba histolytica
SQDSPSGEMVPPKKVPVGGVSLFGGFNPAKVSLRKTNYPKEE

SEQ ID NO: 2727171 - protein, 17 aa, Entamoeba histolytica
SQECAVWRNIYLSGAHD

SEQ ID NO: 2727172 - protein, 32 aa, Entamoeba histolytica
SQEEECFNLMYYMYKYPFSVLDLNIYKQHTVD

SEQ ID NO: 2727173 - protein, 18 aa, Entamoeba histolytica
SQEGIVFAFAYGIEQMRN

SEQ ID NO: 2727174 - protein, 18 aa, Entamoeba histolytica
SQEIIYPSIIKAAERISN

SEQ ID NO: 2727175 - protein, 25 aa, Entamoeba histolytica
SQEKKYLFFTIKKIAEYLKGEFAVY

SEQ ID NO: 2727176 - protein, 17 aa, Entamoeba histolytica
SQELIPIIYPNDTVMDL

SEQ ID NO: 2727177 - protein, 26 aa, Entamoeba histolytica
SQEMERWYNYLIYRIEKMEITKHENR

SEQ ID NO: 2727178 - protein, 22 aa, Entamoeba histolytica
SQERKQFYAGQLVQFIGKGKRQ

SEQ ID NO: 2727179 - protein, 23 aa, Entamoeba histolytica
SQFFSFVTFHLWAYGEYTINYNI

SEQ ID NO: 2727180 - protein, 17 aa, Entamoeba histolytica
SQFKDHPYIQQYIPLLI

SEQ ID NO: 2727181 - protein, 29 aa, Entamoeba histolytica
SQFNQPIKTIRRPLPPLPTQESKTRSTET

SEQ ID NO: 2727182 - protein, 17 aa, Entamoeba histolytica
SQFPLISKKLEFYYAFV

SEQ ID NO: 2727183 - protein, 26 aa, Entamoeba histolytica
SQFQVDLYRLFIRKNFQLANLWVGKL

SEQ ID NO: 2727184 - protein, 20 aa, Entamoeba histolytica
SQFTTLKIKVKNHLTFFHKA

SEQ ID NO: 2727185 - protein, 25 aa, Entamoeba histolytica
SQGISLMWSLFDKEMKHQFLGVVAN

SEQ ID NO: 2727186 - protein, 25 aa, Entamoeba histolytica
SQHEDMLFKVIFKLTNKKGEQIATL

SEQ ID NO: 2727187 - protein, 24 aa, Entamoeba histolytica
SQHSSYLFTITFLEVNPNNTDEQK

SEQ ID NO: 2727188 - protein, 28 aa, Entamoeba histolytica
SQILNFTYKNLPMQLLYSLQFSGQVHQI

SEQ ID NO: 2727189 - protein, 23 aa, Entamoeba histolytica
SQILPFYHLINVHAPLKSSLPSM

SEQ ID NO: 2727190 - protein, 26 aa, Entamoeba histolytica
SQINAHPMFYAFEPIITLFSRILPID

SEQ ID NO: 2727191 - protein, 23 aa, Entamoeba histolytica
SQINRVYTFLSKKYYDFLQYLIQ

SEQ ID NO: 2727192 - protein, 18 aa, Entamoeba histolytica
SQIPEFIHYAKTSKLKEI

SEQ ID NO: 2727193 - protein, 23 aa, Entamoeba histolytica
SQIQFHKLLPPYTSLLNISDIAQ

SEQ ID NO: 2727194 - protein, 29 aa, Entamoeba histolytica
SQIQMKYFQFISQFAFSLPIILSQQEQQL

SEQ ID NO: 2727195 - protein, 24 aa, Entamoeba histolytica
SQITEFFNNIVLIPVINNVKKSDE

SEQ ID NO: 2727196 - protein, 26 aa, Entamoeba histolytica
SQIVPPIIDMSFFNAGLKQQRYQNNV

SEQ ID NO: 2727197 - protein, 24 aa, Entamoeba histolytica
SQIVYLIQNLLPVIRKLYVSDTEE

SEQ ID NO: 2727198 - protein, 27 aa, Entamoeba histolytica
SQKEIIVDGLLYSLSIWDTAGHEKYQS

SEQ ID NO: 2727199 - protein, 19 aa, Entamoeba histolytica
SQKIELLWEVIDPIFNNNV

SEQ ID NO: 2727200 - protein, 22 aa, Entamoeba histolytica
SQKIFERYYPLILIDDDENQTL

SEQ ID NO: 2727201 - protein, 24 aa, Entamoeba histolytica
SQKKNFLSAPTLYMTDEKADKLKQ

SEQ ID NO: 2727202 - protein, 43 aa, Entamoeba histolytica
SQKLPHEYLTLEQKLRLMIGEYICLMNPFKFFPSLNEIKSCVW

SEQ ID NO: 2727203 - protein, 23 aa, Entamoeba histolytica
SQKSIFYINKLFADAAQERNYGK

SEQ ID NO: 2727204 - protein, 24 aa, Entamoeba histolytica
SQLEIEFFLIRTTSSVFDELEKTN

SEQ ID NO: 2727205 - protein, 20 aa, Entamoeba histolytica
SQLFNGDGLFYLIENDSSLN

SEQ ID NO: 2727206 - protein, 24 aa, Entamoeba histolytica
SQLIQVICGIYPLSQLREPYSIVR

SEQ ID NO: 2727207 - protein, 19 aa, Entamoeba histolytica
SQLKPLRDLLDQLHIEYRS

SEQ ID NO: 2727208 - protein, 21 aa, Entamoeba histolytica
SQLLEIYKTWGKNVRPGISFE

SEQ ID NO: 2727209 - protein, 20 aa, Entamoeba histolytica
SQLLEMYLKLINSTLEYPMH

SEQ ID NO: 2727210 - protein, 21 aa, Entamoeba histolytica
SQLLPTITYFLFTKNNFLFHS

SEQ ID NO: 2727211 - protein, 20 aa, Entamoeba histolytica
SQLLTFMHKVAPRGMYTSGR

SEQ ID NO: 2727212 - protein, 25 aa, Entamoeba histolytica
SQLMKAFQYLYCHGLFHGNVTKESI

SEQ ID NO: 2727213 - protein, 39 aa, Entamoeba histolytica
SQLNHPNILKLFGFFEDIKRWFLVLEYCKNGELSRLLQQ

SEQ ID NO: 2727214 - protein, 19 aa, Entamoeba histolytica
SQLTKLKTLIINKSFISCL

SEQ ID NO: 2727215 - protein, 20 aa, Entamoeba histolytica
SQMILGFFKQIDKLPEFINF

SEQ ID NO: 2727216 - protein, 24 aa, Entamoeba histolytica
SQMIRTIPITFYKYKATTPMNSPD

SEQ ID NO: 2727217 - protein, 30 aa, Entamoeba histolytica
SQMKNWENFYRWFLPVKNVISGIFNGSKEI

SEQ ID NO: 2727218 - protein, 24 aa, Entamoeba histolytica
SQMRFDDLFIWTLKLEHKIPLQYI

SEQ ID NO: 2727219 - protein, 23 aa, Entamoeba histolytica
SQNAYDLLMKFNTLKRLGVVDKD

SEQ ID NO: 2727220 - protein, 25 aa, Entamoeba histolytica
SQNFLNNWVLVLRKLYKTNTLSNIY

SEQ ID NO: 2727221 - protein, 25 aa, Entamoeba histolytica
SQNKRQYIFITPHNLDGVVSNDNVK

SEQ ID NO: 2727222 - protein, 30 aa, Entamoeba histolytica
SQNKVLYSVKRFYKLNKMSASLFTKKIAIE

SEQ ID NO: 2727223 - protein, 18 aa, Entamoeba histolytica
SQNSIFDIVLEKGIKFPS

SEQ ID NO: 2727224 - protein, 26 aa, Entamoeba histolytica
SQNSSFIQVIRKRLLEKCKESHDLEV

SEQ ID NO: 2727225 - protein, 24 aa, Entamoeba histolytica
SQPQFVVLIDLLRKLFVTQDSRLT

SEQ ID NO: 2727226 - protein, 32 aa, Entamoeba histolytica
SQPRLEELLHLPFIHLTQLVPLFNSLKDDFSD

SEQ ID NO: 2727227 - protein, 21 aa, Entamoeba histolytica
SQQAWLISTFGINVNLGNIAP

SEQ ID NO: 2727228 - protein, 23 aa, Entamoeba histolytica
SQQFASLFFKCYETQFSSIISAT

SEQ ID NO: 2727229 - protein, 18 aa, Entamoeba histolytica
SQQIFIDIICITISIIEL

SEQ ID NO: 2727230 - protein, 22 aa, Entamoeba histolytica
SQQLTFFSVQAAADAWILQNIQ

SEQ ID NO: 2727231 - protein, 25 aa, Entamoeba histolytica
SQQQQYEIILKWLQDILNLYEIDLS

SEQ ID NO: 2727232 - protein, 24 aa, Entamoeba histolytica
SQQYQQPCWFWGISKFDIEQSDIS

SEQ ID NO: 2727233 - protein, 19 aa, Entamoeba histolytica
SQREAFIATLFDCSLAAKA

SEQ ID NO: 2727234 - protein, 20 aa, Entamoeba histolytica
SQRNLFYNFLHRSYAERSHR

SEQ ID NO: 2727235 - protein, 24 aa, Entamoeba histolytica
SQRSKGFGFVTFEKDEDAKKAIEE

SEQ ID NO: 2727236 - protein, 27 aa, Entamoeba histolytica
SQRWLPEIKHFCPNAPFLLAATKTDLR

SEQ ID NO: 2727237 - protein, 26 aa, Entamoeba histolytica
SQRYKQKALMLLKQKKQHEQHRDITE

SEQ ID NO: 2727238 - protein, 21 aa, Entamoeba histolytica
SQSEKELLLIKTPILSTDDNS

SEQ ID NO: 2727239 - protein, 30 aa, Entamoeba histolytica
SQSHILTPPFFLQIKIPFFHPQYPLHFEDE

SEQ ID NO: 2727240 - protein, 23 aa, Entamoeba histolytica
SQSIQFIMRKGAVTTFPAILSNI

SEQ ID NO: 2727241 - protein, 24 aa, Entamoeba histolytica
SQSIYFLMSLIYDADVFTIMCIDG

SEQ ID NO: 2727242 - protein, 18 aa, Entamoeba histolytica
SQSLYLPNTLMKIVSRNS

SEQ ID NO: 2727243 - protein, 26 aa, Entamoeba histolytica
SQSQEPLPLPPLLATKLLQVVSNNPN

SEQ ID NO: 2727244 - protein, 25 aa, Entamoeba histolytica
SQSRTEYIFIRGNQVRFVVLPEMFK

SEQ ID NO: 2727245 - protein, 26 aa, Entamoeba histolytica
SQTIERYFYIIIASLNAYTGNEQNNK

SEQ ID NO: 2727246 - protein, 23 aa, Entamoeba histolytica
SQTKIYVTQPRRISAVGLSSRVI

SEQ ID NO: 2727247 - protein, 23 aa, Entamoeba histolytica
SQTRVIIGLFNKCVLALEEMRKR

SEQ ID NO: 2727248 - protein, 25 aa, Entamoeba histolytica
SQWIKRDKLYLLYDSKINGIEKDSL

SEQ ID NO: 2727249 - protein, 20 aa, Entamoeba histolytica
SQWRVPLPIFRAMQYLEEHK

SEQ ID NO: 2727250 - protein, 19 aa, Entamoeba histolytica
SQYFQFPFPICLIDSSQFI

SEQ ID NO: 2727251 - protein, 26 aa, Entamoeba histolytica
SQYVLIYELLDEILDFGYPQFCTKDE

SEQ ID NO: 2727252 - protein, 24 aa, Entamoeba histolytica
SQYYEKFMVLYQQYKIALHVKCSN

SEQ ID NO: 2727253 - protein, 18 aa, Entamoeba histolytica
SRAFTHRFITSSPNIYTS

SEQ ID NO: 2727254 - protein, 21 aa, Entamoeba histolytica
SRAPPEYLFNVNFGDIFVVRS

SEQ ID NO: 2727255 - protein, 32 aa, Entamoeba histolytica; identical to SEQ ID NO: 2540222

SEQ ID NO: 2727256 - protein, 26 aa, Entamoeba histolytica
SREEIVRPLIPKPLLDDIRMVPPMLK

SEQ ID NO: 2727257 - protein, 25 aa, Entamoeba histolytica
SREELGWFINIPKQQFIGTKNEKFV

SEQ ID NO: 2727258 - protein, 23 aa, Entamoeba histolytica
SREHFRYIIKYVFSFISKDKQHE

SEQ ID NO: 2727259 - protein, 25 aa, Entamoeba histolytica
SREKGIYPIFVFDGKTKTYLKERTI

SEQ ID NO: 2727260 - protein, 27 aa, Entamoeba histolytica
SREMKDGYIISFNSILKGKLNYIEIGD

SEQ ID NO: 2727261 - protein, 28 aa, Entamoeba histolytica
SREMKDGYIISFNSILKGKLNYIEIGDN

SEQ ID NO: 2727262 - protein, 17 aa, Entamoeba histolytica
SREMNFYRTFILTPDNI

SEQ ID NO: 2727263 - protein, 22 aa, Entamoeba histolytica
SREQLFILHKILNNSLESQEIK

SEQ ID NO: 2727264 - protein, 24 aa, Entamoeba histolytica
SRFGRIVLTFTPLLRVYSDYCQIY

SEQ ID NO: 2727265 - protein, 22 aa, Entamoeba histolytica
SRFKKDARFKNFSKGKKTKLDP

SEQ ID NO: 2727266 - protein, 20 aa, Entamoeba histolytica
SRFRTPIPLVRRTIESLIER

SEQ ID NO: 2727267 - protein, 25 aa, Entamoeba histolytica
SRFSPFLVPILPKPASIKEIHKVNK

SEQ ID NO: 2727268 - protein, 22 aa, Entamoeba histolytica
SRGLVPLLSYPSNTTYIAVCIS

SEQ ID NO: 2727269 - protein, 21 aa, Entamoeba histolytica
SRGMLSLPIKISKLTSLTKLN

SEQ ID NO: 2727270 - protein, 24 aa, Entamoeba histolytica
SRGRKDLVELFLSKWKEGASSRDK

SEQ ID NO: 2727271 - protein, 18 aa, Entamoeba histolytica
SRHAFICSLISLTETQYL

SEQ ID NO: 2727272 - protein, 28 aa, Entamoeba histolytica
SRIACLRLIIFLLRKDIKMFKFVYAKVG

SEQ ID NO: 2727273 - protein, 31 aa, Entamoeba histolytica
SRICLCLDLPGGPFYSAPFILQARDKKEYQK

SEQ ID NO: 2727274 - protein, 22 aa, Entamoeba histolytica
SRICLDPYHRTIEGFLGLIEYE

SEQ ID NO: 2727275 - protein, 27 aa, Entamoeba histolytica
SRIDKFHFDLFIRDWKKYYPMKTLFYL

SEQ ID NO: 2727276 - protein, 18 aa, Entamoeba histolytica
SRKFSKDKRVYLGALKFL

SEQ ID NO: 2727277 - protein, 17 aa, Entamoeba histolytica
SRKRVLKIPSRLKEFIS

SEQ ID NO: 2727278 - protein, 19 aa, Entamoeba histolytica
SRKSSFALPAPRQSIRRSI

SEQ ID NO: 2727279 - protein, 29 aa, Entamoeba histolytica
SRKSYQNDLLFKVYLQKYNTHFLSLIGDH

SEQ ID NO: 2727280 - protein, 22 aa, Entamoeba histolytica
SRKYWHFIKVMGRSASHIALEA

SEQ ID NO: 2727281 - protein, 17 aa, Entamoeba histolytica
SRLIKEHGLIPLVELVF

SEQ ID NO: 2727282 - protein, 18 aa, Entamoeba histolytica
SRLMTPQIAPAIERFFKQ

SEQ ID NO: 2727283 - protein, 27 aa, Entamoeba histolytica
SRLNKFKILRDIAVGLAFIHSLAKIPH

SEQ ID NO: 2727284 - protein, 27 aa, Entamoeba histolytica
SRLNWCIPPLVFALLKAGRIQESLRDF

SEQ ID NO: 2727285 - protein, 24 aa, Entamoeba histolytica
SRLTTLPQSFTAPPLQLAARTSHS

SEQ ID NO: 2727286 - protein, 30 aa, Entamoeba histolytica
SRLYSAILEQFGVALLKYAKKYPFQSQFCQ

SEQ ID NO: 2727287 - protein, 18 aa, Entamoeba histolytica
SRMLGMLEEYNRQLYQGT

SEQ ID NO: 2727288 - protein, 24 aa, Entamoeba histolytica
SRMRQILDAIYFSKSKEITNNCRC

SEQ ID NO: 2727289 - protein, 24 aa, Entamoeba histolytica
SRNDTLTLYLFLSKLIQPTELVMA

SEQ ID NO: 2727290 - protein, 21 aa, Entamoeba histolytica
SRNIQCIIKRNAVYTGTPDEM

SEQ ID NO: 2727291 - protein, 20 aa, Entamoeba histolytica
SRNLEWPDELKMPVLKVGVK

SEQ ID NO: 2727292 - protein, 24 aa, Entamoeba histolytica
SRNLPCLMVLKRHSLDQMILLTGK

SEQ ID NO: 2727293 - protein, 23 aa, Entamoeba histolytica
SRNQFIFLKEFIDYNVQYIEEQS

SEQ ID NO: 2727294 - protein, 25 aa, Entamoeba histolytica
SRNRKLWNELFYWNSFNTPLTKELL

SEQ ID NO: 2727295 - protein, 31 aa, Entamoeba histolytica
SRNSIIRYILVYKSYFFNISYKPNELSMYLV

SEQ ID NO: 2727296 - protein, 30 aa, Entamoeba histolytica; identical to SEQ ID NO: 2540259

SEQ ID NO: 2727297 - protein, 29 aa, Entamoeba histolytica
SRQIRGKVAAFFLFIAPPSMEILEQRLRS

SEQ ID NO: 2727298 - protein, 21 aa, Entamoeba histolytica
SRRFILMFTELIKLTSRIIPS

SEQ ID NO: 2727299 - protein, 22 aa, Entamoeba histolytica
SRRINGTPISWPLTSVKNNIIG

SEQ ID NO: 2727300 - protein, 18 aa, Entamoeba histolytica
SRRLIIVYNLMEEIKNYR

SEQ ID NO: 2727301 - protein, 23 aa, Entamoeba histolytica
SRRNLISHIIVVGGLVLDGIEER

SEQ ID NO: 2727302 - protein, 22 aa, Entamoeba histolytica
SRRSIIVRCFTCKWNQWIKENI

SEQ ID NO: 2727303 - protein, 28 aa, Entamoeba histolytica
SRSFHPRDLLMLIWDKLKEDGDRVVFPE

SEQ ID NO: 2727304 - protein, 41 aa, Entamoeba histolytica
SRSVLYSIIQLYLRSGFYGRVLDYHIELIMLDNLDGVKLFE

SEQ ID NO: 2727305 - protein, 24 aa, Entamoeba histolytica
SRTIKSYIYKQCEEKKLFIEGNAR

SEQ ID NO: 2727306 - protein, 29 aa, Entamoeba histolytica
SRTLSYKHLLRLYGRMNLLLSQIDKKQQL

SEQ ID NO: 2727307 - protein, 21 aa, Entamoeba histolytica
SRTRELMFGTSPFNQTNTSPF

SEQ ID NO: 2727308 - protein, 26 aa, Entamoeba histolytica
SRTRQYFFLDYLLDKQFNSLAYFWEE

SEQ ID NO: 2727309 - protein, 24 aa, Entamoeba histolytica
SRYEATVTHFLWRSVKQADDLVKM

SEQ ID NO: 2727310 - protein, 22 aa, Entamoeba histolytica
SRYEILDFLGIGGFGVVRKVKR

SEQ ID NO: 2727311 - protein, 22 aa, Entamoeba histolytica
SRYNEIIQLYLATSAQQEQIPI

SEQ ID NO: 2727312 - protein, 32 aa, Entamoeba histolytica
SSADALIVGSYFKVDGFWKNELSKERILKLIS

SEQ ID NO: 2727313 - protein, 30 aa, Entamoeba histolytica
SSAKDMLILYNNSMRRLILGKELIQKGVVQ

SEQ ID NO: 2727314 - protein, 25 aa, Entamoeba histolytica
SSALNVIFPYQFITSILLACSRKKS

SEQ ID NO: 2727315 - protein, 23 aa, Entamoeba histolytica
SSAPRFLNLVYVSIPTTITDYKH

SEQ ID NO: 2727316 - protein, 23 aa, Entamoeba histolytica
SSAPRFLNLVYVSIPTTVTDYKH

SEQ ID NO: 2727317 - protein, 23 aa, Entamoeba histolytica
SSAPRFLNLVYVTIPNSVTDYKH

SEQ ID NO: 2727318 - protein, 23 aa, Entamoeba histolytica
SSARKFICCGPVFAIQNMNDFPS

SEQ ID NO: 2727319 - protein, 25 aa, Entamoeba histolytica
SSARSLYAAALWYLDDWNEFDSIVS

SEQ ID NO: 2727320 - protein, 30 aa, Entamoeba histolytica
SSAVLPFELIKNIIIPHHLSNILIIGSGVI

SEQ ID NO: 2727321 - protein, 28 aa, Entamoeba histolytica
SSCLSIGYCPFITKIPYLGQDGYFLKKN

SEQ ID NO: 2727322 - protein, 18 aa, Entamoeba histolytica
SSDFDLFIPSFDMYYMIN

SEQ ID NO: 2727323 - protein, 21 aa, Entamoeba histolytica
SSDILCFRYNSNGTVLASASA

SEQ ID NO: 2727324 - protein, 21 aa, Entamoeba histolytica
SSDILFSKIKLLSNNRVSTVN

SEQ ID NO: 2727325 - protein, 31 aa, Entamoeba histolytica
SSDNIDLLLSLYLPSLYSFNLPSFSIVSLRT

SEQ ID NO: 2727326 - protein, 29 aa, Entamoeba histolytica
SSDQMLHFYVLISHVILLKDTLLKAPSAE

SEQ ID NO: 2727327 - protein, 25 aa, Entamoeba histolytica
SSDRSIHIWDPNLPIPTIEKIRNVR

SEQ ID NO: 2727328 - protein, 26 aa, Entamoeba histolytica
SSEDKWKWLTVFRDAFYRSAKDKLIE

SEQ ID NO: 2727329 - protein, 29 aa, Entamoeba histolytica
SSEDYCYLHDFYLLPSFRGQGLGHKLMDK

SEQ ID NO: 2727330 - protein, 34 aa, Entamoeba histolytica
SSEERGMLFLVELSPILFKLIWKTENEIDHLTIF

SEQ ID NO: 2727331 - protein, 33 aa, Entamoeba histolytica
SSEFAEETLPFLIQFIPLFFERCLLTEELIYKI

SEQ ID NO: 2727332 - protein, 25 aa, Entamoeba histolytica
SSEFPTLLKLLLIESKTIFLSTNDS

SEQ ID NO: 2727333 - protein, 27 aa, Entamoeba histolytica
SSEKREFMRELLLFPVIRELTCDNYFL

SEQ ID NO: 2727334 - protein, 24 aa, Entamoeba histolytica
SSENIFLQLLKALTMQKFYSFLYT

SEQ ID NO: 2727335 - protein, 22 aa, Entamoeba histolytica
SSEPIAHRPLWEQILKELKKAI

SEQ ID NO: 2727336 - protein, 24 aa, Entamoeba histolytica
SSERIREMIDWSKMKMSVKFQVSD

SEQ ID NO: 2727337 - protein, 34 aa, Entamoeba histolytica
SSESKRFLNTVLLIKIVPLIKRDVIQRIDRIPFI

SEQ ID NO: 2727338 - protein, 24 aa, Entamoeba histolytica
SSESLKVLFRSFKQLKYLNTEACV

SEQ ID NO: 2727339 - protein, 29 aa, Entamoeba histolytica
SSESVIPFTRFLRVFLPYTLVNSEEGNPF

SEQ ID NO: 2727340 - protein, 18 aa, Entamoeba histolytica
SSFDYLSCLLELQGIRKE

SEQ ID NO: 2727341 - protein, 24 aa, Entamoeba histolytica
SSFEDLIKRLVDVKFEIYVIEEEQ

SEQ ID NO: 2727342 - protein, 22 aa, Entamoeba histolytica
SSFIEALVGFQFNVVESTIGTR

SEQ ID NO: 2727343 - protein, 17 aa, Entamoeba histolytica
SSFILKKLKKDAEAKLG

SEQ ID NO: 2727344 - protein, 27 aa, Entamoeba histolytica
SSFIQIRGNIPLIWKTKEKDLFKPRGK

SEQ ID NO: 2727345 - protein, 19 aa, Entamoeba histolytica
SSFIRPSITILTHGLSMVV

SEQ ID NO: 2727346 - protein, 18 aa, Entamoeba histolytica
SSFLFIPIEDDDILLMNC

SEQ ID NO: 2727347 - protein, 20 aa, Entamoeba histolytica
SSFLVILSSLPDSSILCDEG

SEQ ID NO: 2727348 - protein, 18 aa, Entamoeba histolytica
SSFNFRYEVLKKGESPTT

SEQ ID NO: 2727349 - protein, 22 aa, Entamoeba histolytica
SSFNSLFYYQLNNPPICSSINL

SEQ ID NO: 2727350 - protein, 29 aa, Entamoeba histolytica
SSFNYAFYWALTTIKPFPLITSSSLSKFL

SEQ ID NO: 2727351 - protein, 33 aa, Entamoeba histolytica
SSFSKPIPHDFPFPPIFPLYQPSLRSQISAKYS

SEQ ID NO: 2727352 - protein, 24 aa, Entamoeba histolytica
SSFVRIFTVLLHNLPPTIEADLVE

SEQ ID NO: 2727353 - protein, 26 aa, Entamoeba histolytica
SSGDKFISYEPWLNKLSKSKSNIPRE

SEQ ID NO: 2727354 - protein, 23 aa, Entamoeba histolytica
SSGDLSPFCNFSLSLDPSKSPLK

SEQ ID NO: 2727355 - protein, 18 aa, Entamoeba histolytica
SSGKFIRIPTRKASLNMS

SEQ ID NO: 2727356 - protein, 31 aa, Entamoeba histolytica
SSGKIHIYQSIPYWVWMIMKEDNNEIEEIEY

SEQ ID NO: 2727357 - protein, 29 aa, Entamoeba histolytica
SSGKSTLLNYLFNTKFRILNEVMGRSRTT

SEQ ID NO: 2727358 - protein, 25 aa, Entamoeba histolytica
SSHALRPFYITLLSSKSCLSLKFAN

SEQ ID NO: 2727359 - protein, 29 aa, Entamoeba histolytica
SSHDFLKHVCIVWNKCYYYISDRQLTNQK

SEQ ID NO: 2727360 - protein, 18 aa, Entamoeba histolytica
SSHFVHWVCGSLIQKINA

SEQ ID NO: 2727361 - protein, 20 aa, Entamoeba histolytica
SSHFVPVPTSKDNVPMYCVE

SEQ ID NO: 2727362 - protein, 20 aa, Entamoeba histolytica
SSHLHQWIDLIFGYKSTGNE

SEQ ID NO: 2727363 - protein, 25 aa, Entamoeba histolytica
SSHPDVFQMFINSFAPNIFGHENIK

SEQ ID NO: 2727364 - protein, 18 aa, Entamoeba histolytica
SSHPLIVLNRLPTTTPTL

SEQ ID NO: 2727365 - protein, 22 aa, Entamoeba histolytica
SSHTLRPFYITLPSSKSCLSLK

SEQ ID NO: 2727366 - protein, 23 aa, Entamoeba histolytica
SSHTLRPFYITLPSSKSCLSLKF

SEQ ID NO: 2727367 - protein, 19 aa, Entamoeba histolytica
SSIFQLICFSHEIGSYIIQ

SEQ ID NO: 2727368 - protein, 30 aa, Entamoeba histolytica
SSIIFDIEKEFQIGTLESKIGITRKENEEN

SEQ ID NO: 2727369 - protein, 19 aa, Entamoeba histolytica
SSIILPTTLCSLPHLCFYD

SEQ ID NO: 2727370 - protein, 17 aa, Entamoeba histolytica
SSIKQKTFDKIMADALW

SEQ ID NO: 2727371 - protein, 26 aa, Entamoeba histolytica
SSIKRSIRIFWSNKVPKGYFNKEFIR

SEQ ID NO: 2727372 - protein, 22 aa, Entamoeba histolytica
SSILDPFYIVLHFLCLHNVHET

SEQ ID NO: 2727373 - protein, 19 aa, Entamoeba histolytica
SSILPIPRVKFYATELLLA

SEQ ID NO: 2727374 - protein, 24 aa, Entamoeba histolytica
SSINQMIHFLSLSKEYLPLDYFDA

SEQ ID NO: 2727375 - protein, 22 aa, Entamoeba histolytica
SSIPFSLKRYLSSQLPVLEQFN

SEQ ID NO: 2727376 - protein, 31 aa, Entamoeba histolytica
SSIPKQETSLLFGIAFDRRLEKLKEQYAEQP

SEQ ID NO: 2727377 - protein, 17 aa, Entamoeba histolytica
SSIQIPPPPRLGDLHVG

SEQ ID NO: 2727378 - protein, 30 aa, Entamoeba histolytica
SSIQKEAELLFSRAKTLGLDDCIEEWNKDL

SEQ ID NO: 2727379 - protein, 17 aa, Entamoeba histolytica
SSIQSTLLNYITSLVFL

SEQ ID NO: 2727380 - protein, 24 aa, Entamoeba histolytica
SSIRTTLLSYGRLWRNINIEDTFE

SEQ ID NO: 2727381 - protein, 23 aa, Entamoeba histolytica
SSISNCMILILDSTGNLFGIFTP

SEQ ID NO: 2727382 - protein, 23 aa, Entamoeba histolytica
SSISYICSRYYRAPELIFDCTHY

SEQ ID NO: 2727383 - protein, 22 aa, Entamoeba histolytica
SSITLFFDNKLNMIKIIEVAKL

SEQ ID NO: 2727384 - protein, 19 aa, Entamoeba histolytica
SSIWVTIFDEEMKKIIGKS

SEQ ID NO: 2727385 - protein, 28 aa, Entamoeba histolytica
SSIYNQLRRMIALTYIPSFLASVSIPDE

SEQ ID NO: 2727386 - protein, 23 aa, Entamoeba histolytica
SSKDIITPEPFIDRKTIELHQMD

SEQ ID NO: 2727387 - protein, 25 aa, Entamoeba histolytica
SSKGRLFNVPFMKIAKPNMKVIINN

SEQ ID NO: 2727388 - protein, 25 aa, Entamoeba histolytica
SSKKFKDFTAWVKKLARNTSTHKMY

SEQ ID NO: 2727389 - protein, 17 aa, Entamoeba histolytica
SSKKKPLLLILQNYDPA

SEQ ID NO: 2727390 - protein, 17 aa, Entamoeba histolytica
SSKLITLFNLYKERKCL

SEQ ID NO: 2727391 - protein, 26 aa, Entamoeba histolytica
SSKLKPVSVIDILFGEREFGKKNHID

SEQ ID NO: 2727392 - protein, 21 aa, Entamoeba histolytica
SSKMIKFFGTQALKKLIVVSL

SEQ ID NO: 2727393 - protein, 28 aa, Entamoeba histolytica
SSKNLFGIFYGYWLKVNKTYIIDSMIYE

SEQ ID NO: 2727394 - protein, 17 aa, Entamoeba histolytica
SSKPPSRPIPNNKRRVI

SEQ ID NO: 2727395 - protein, 34 aa, Entamoeba histolytica
SSKQYDVLYIFYRNIKHFLFTQRKLFVSQLFCFY

SEQ ID NO: 2727396 - protein, 17 aa, Entamoeba histolytica
SSKRPIKNEQLLQLIFK

SEQ ID NO: 2727397 - protein, 23 aa, Entamoeba histolytica
SSKTALTIRLTIDTPIVAPNIFI

SEQ ID NO: 2727398 - protein, 25 aa, Entamoeba histolytica
SSKVGIINVFQPQSTPRMTGELKAT

SEQ ID NO: 2727399 - protein, 22 aa, Entamoeba histolytica
SSKWLYHINKILKGTYLTTNKF

SEQ ID NO: 2727400 - protein, 22 aa, Entamoeba histolytica
SSKYCMKYLRRYCKATPMTVHS

SEQ ID NO: 2727401 - protein, 18 aa, Entamoeba histolytica
SSLALDVLYIIYVTLVNA

SEQ ID NO: 2727402 - protein, 24 aa, Entamoeba histolytica
SSLALKLSVIFLICADFIPEKKDL

SEQ ID NO: 2727403 - protein, 18 aa, Entamoeba histolytica
SSLFSTPVRMLILGLDSA

SEQ ID NO: 2727404 - protein, 23 aa, Entamoeba histolytica
SSLHFIGYSKLIILVYRIITVDQ

SEQ ID NO: 2727405 - protein, 23 aa, Entamoeba histolytica
SSLIDLLGIQLLDSLKNLLSGNN

SEQ ID NO: 2727406 - protein, 25 aa, Entamoeba histolytica
SSLKNIRLERLFYLKSIQGLKQCDL

SEQ ID NO: 2727407 - protein, 18 aa, Entamoeba histolytica
SSLLIYSYITLNSTQYTI

SEQ ID NO: 2727408 - protein, 30 aa, Entamoeba histolytica
SSLLKGIITVRIFNIPFTWKEHDVLEYFKE

SEQ ID NO: 2727409 - protein, 22 aa, Entamoeba histolytica
SSLLMTYQYIENKLQPMIMKYF

SEQ ID NO: 2727410 - protein, 21 aa, Entamoeba histolytica
SSLNKIFTTIDLILDVSVAQE

SEQ ID NO: 2727411 - protein, 18 aa, Entamoeba histolytica
SSLPGFGLLLFNNYDCDI

SEQ ID NO: 2727412 - protein, 25 aa, Entamoeba histolytica
SSLPKKPLYDLYTQQYSFITNYFEI

SEQ ID NO: 2727413 - protein, 34 aa, Entamoeba histolytica
SSLQYGPLPLKYIPKLIYPFEKIDILTILKCYSK

SEQ ID NO: 2727414 - protein, 20 aa, Entamoeba histolytica
SSLSFLRYRNLCSVQHLLEQ

SEQ ID NO: 2727415 - protein, 17 aa, Entamoeba histolytica
SSLSFTVKCSEQYPAEV

SEQ ID NO: 2727416 - protein, 24 aa, Entamoeba histolytica
SSMLPIIICTPFISSVQCVEFLAS

SEQ ID NO: 2727417 - protein, 25 aa, Entamoeba histolytica
SSMNSFLLYLIQESVITPFLSSPSF

SEQ ID NO: 2727418 - protein, 24 aa, Entamoeba histolytica
SSNDLFDVLLKSPSSKSPAHAPET

SEQ ID NO: 2727419 - protein, 24 aa, Entamoeba histolytica
SSNHLFIRNFSIKGFGQIIVHSYI

SEQ ID NO: 2727420 - protein, 24 aa, Entamoeba histolytica
SSNKFNITIQFIKEILIKSKEKVV

SEQ ID NO: 2727421 - protein, 25 aa, Entamoeba histolytica
SSNKRQYIFITPHNLDGVISTDSVK

SEQ ID NO: 2727422 - protein, 25 aa, Entamoeba histolytica
SSNPQKYFPVFRQNFHTRQTTLNEY

SEQ ID NO: 2727423 - protein, 25 aa, Entamoeba histolytica
SSNTGIFQTLFPKLEDLNKIILVNQ

SEQ ID NO: 2727424 - protein, 33 aa, Entamoeba histolytica
SSNYFNAMKSHKTWFTRLLLSQAFQCFLSINSV

SEQ ID NO: 2727425 - protein, 22 aa, Entamoeba histolytica
SSNYNILLLSSKAGGVGLNLIG

SEQ ID NO: 2727426 - protein, 17 aa, Entamoeba histolytica
SSPLPPQSSPLPPTATP

SEQ ID NO: 2727427 - protein, 20 aa, Entamoeba histolytica
SSPMLMQFTPRFSSGPSPYN

SEQ ID NO: 2727428 - protein, 31 aa, Entamoeba histolytica
SSPNVLLSPSLPLSPLPSLSSLFLYSKHSLH

SEQ ID NO: 2727429 - protein, 20 aa, Entamoeba histolytica
SSPSILYPGKWWKCDYCQQV

SEQ ID NO: 2727430 - protein, 23 aa, Entamoeba histolytica
SSPVYKLMFRPVEDDSYFQQSVT

SEQ ID NO: 2727431 - protein, 23 aa, Entamoeba histolytica
SSQGLPYTILLDDNLNISNEAIS

SEQ ID NO: 2727432 - protein, 24 aa, Entamoeba histolytica
SSQLLLRKVPPILSTLETMKPAAM

SEQ ID NO: 2727433 - protein, 24 aa, Entamoeba histolytica
SSQNPAWPMTVINTIFAVAVEEMT

SEQ ID NO: 2727434 - protein, 24 aa, Entamoeba histolytica
SSQRPKVILDIFKQIILSSQDESV

SEQ ID NO: 2727435 - protein, 26 aa, Entamoeba histolytica
SSRELLKHKWFITNGIKVEEEVKKTN

SEQ ID NO: 2727436 - protein, 25 aa, Entamoeba histolytica
SSRFGKFIEIQFSNGGKIVGCIMSS

SEQ ID NO: 2727437 - protein, 20 aa, Entamoeba histolytica
SSRFGYLYHNVESSYKDVVG

SEQ ID NO: 2727438 - protein, 26 aa, Entamoeba histolytica
SSRIHFNIYTYLIDSLPSNILIPLLQ

SEQ ID NO: 2727439 - protein, 22 aa, Entamoeba histolytica
SSRIQFLTFTAIQSIARAQEIV

SEQ ID NO: 2727440 - protein, 24 aa, Entamoeba histolytica
SSRIQFLTFTAIQSIARAQEIVDI

SEQ ID NO: 2727441 - protein, 25 aa, Entamoeba histolytica
SSSERIREMIDWSKLKMSVKFQVSD

SEQ ID NO: 2727442 - protein, 24 aa, Entamoeba histolytica
SSSIDRLGSYIFWDCYNLKELEIP

SEQ ID NO: 2727443 - protein, 24 aa, Entamoeba histolytica
SSSKLMELLIIRFNPTHPQGINFE

SEQ ID NO: 2727444 - protein, 26 aa, Entamoeba histolytica
SSSKTIPPYSIYPSLYQPPYTSTYPS

SEQ ID NO: 2727445 - protein, 24 aa, Entamoeba histolytica
SSSLFHIFHLSSIQLIYLPLLDEL

SEQ ID NO: 2727446 - protein, 21 aa, Entamoeba histolytica
SSSLVRILALKYDSFISNLIK

SEQ ID NO: 2727447 - protein, 29 aa, Entamoeba histolytica
SSSMFNKNPRWILFYELVLTTKEYVRQVS

SEQ ID NO: 2727448 - protein, 23 aa, Entamoeba histolytica
SSSNQLPPVPPVNPGRKALSQKT

SEQ ID NO: 2727449 - protein, 29 aa, Entamoeba histolytica
SSSQSVVPLLELCLKRKRPLVVISDTIDG

SEQ ID NO: 2727450 - protein, 24 aa, Entamoeba histolytica
SSSRRRRYSRRYSSRSRSRSPYSR

SEQ ID NO: 2727451 - protein, 25 aa, Entamoeba histolytica
SSSRYFLDTLFQLFNDKKIIIVSSS

SEQ ID NO: 2727452 - protein, 26 aa, Entamoeba histolytica
SSSSLLETLKLQLDLFYKTVENKNEN

SEQ ID NO: 2727453 - protein, 20 aa, Entamoeba histolytica
SSSTALLIKAGIKKGYAIQL

SEQ ID NO: 2727454 - protein, 17 aa, Entamoeba histolytica
SSSYFQQPLVPPQSKTP

SEQ ID NO: 2727455 - protein, 25 aa, Entamoeba histolytica
SSTERKFIFLISLQLEIVSCQEMIK

SEQ ID NO: 2727456 - protein, 35 aa, Entamoeba histolytica; identical to SEQ ID NO: 2540419

SEQ ID NO: 2727457 - protein, 25 aa, Entamoeba histolytica
SSTNNFLTDLLIHLGYSINFKKTRS

SEQ ID NO: 2727458 - protein, 26 aa, Entamoeba histolytica
SSTPLYYVHLILDCSQFLYSTIIPNY

SEQ ID NO: 2727459 - protein, 22 aa, Entamoeba histolytica
SSTSFYYGAFQILIDILDVTDG

SEQ ID NO: 2727460 - protein, 30 aa, Entamoeba histolytica
SSTSSTLLLRSALYYIQKMLKVFGIEEKQV

SEQ ID NO: 2727461 - protein, 26 aa, Entamoeba histolytica
SSTVLIAYLMYKKMWRYKEAVTFVKK

SEQ ID NO: 2727462 - protein, 25 aa, Entamoeba histolytica
SSVAFNWIVKILQNIGYSFEFMHSK

SEQ ID NO: 2727463 - protein, 24 aa, Entamoeba histolytica
SSVEFCLFPSFFTGLASFKDQKKS

SEQ ID NO: 2727464 - protein, 24 aa, Entamoeba histolytica
SSVEYFCFKYNKSLLNDFKYALVW

SEQ ID NO: 2727465 - protein, 18 aa, Entamoeba histolytica
SSVKNYFKLKTKGTLKKI

SEQ ID NO: 2727466 - protein, 22 aa, Entamoeba histolytica
SSVQLLYSSTFFLKAGKLDITK

SEQ ID NO: 2727467 - protein, 24 aa, Entamoeba histolytica
SSVTILYHLIDFLYSINSIEKYHQ

SEQ ID NO: 2727468 - protein, 22 aa, Entamoeba histolytica
SSYDFIKGCLIFIPKTAISKLA

SEQ ID NO: 2727469 - protein, 17 aa, Entamoeba histolytica
SSYEQIISDCYAILNTS

SEQ ID NO: 2727470 - protein, 22 aa, Entamoeba histolytica
SSYLCDEFIAHRLGLIPIDSTQ

SEQ ID NO: 2727471 - protein, 24 aa, Entamoeba histolytica
SSYNELMKLLKKIHPIIKEKEARK

SEQ ID NO: 2727472 - protein, 19 aa, Entamoeba histolytica
SSYQYNLLLDKCKNINDIV

SEQ ID NO: 2727473 - protein, 17 aa, Entamoeba histolytica
SSYYQKQSSYYPPCDPF

SEQ ID NO: 2727474 - protein, 23 aa, Entamoeba histolytica
SSYYSRDRLYRRRTERSRSRERY

SEQ ID NO: 2727475 - protein, 17 aa, Entamoeba histolytica
STAEKVFIQNIDFTTSA

SEQ ID NO: 2727476 - protein, 27 aa, Entamoeba histolytica
STAISVKPYIIQCGIFNKILQKLPTLT

SEQ ID NO: 2727477 - protein, 24 aa, Entamoeba histolytica
STCIVGCYSCYFVETLDNESTVDW

SEQ ID NO: 2727478 - protein, 26 aa, Entamoeba histolytica
STCWVFSTIFQLEYAYNKDLSNKYIS

SEQ ID NO: 2727479 - protein, 25 aa, Entamoeba histolytica
STDCVHFFPVIMNGLLNVNKILLEP

SEQ ID NO: 2727480 - protein, 31 aa, Entamoeba histolytica
STDENELYIFRSGKYFNYIKEYVLSKQLVIN

SEQ ID NO: 2727481 - protein, 23 aa, Entamoeba histolytica
STDGEFWEFTIKNPEIKSDSDNI

SEQ ID NO: 2727482 - protein, 27 aa, Entamoeba histolytica
STDHKMYIFQFMFMINNDADMPKKTKI

SEQ ID NO: 2727483 - protein, 26 aa, Entamoeba histolytica
STDHKMYIFQFMFMINNDTDSTKKTK

SEQ ID NO: 2727484 - protein, 20 aa, Entamoeba histolytica
STDKLVQIHRLFYGTMGVAT

SEQ ID NO: 2727485 - protein, 28 aa, Entamoeba histolytica
STDPVPFLFHRIVTSYSLILLSTHNHYS

SEQ ID NO: 2727486 - protein, 29 aa, Entamoeba histolytica
STEEEKLLHLIKIFPSQWQTISKSVGRTP

SEQ ID NO: 2727487 - protein, 20 aa, Entamoeba histolytica
STEGFLFKTYHACGDNTFLV

SEQ ID NO: 2727488 - protein, 25 aa, Entamoeba histolytica
STEGIIIFFDLITSSILKILNFNGT

SEQ ID NO: 2727489 - protein, 34 aa, Entamoeba histolytica
STEIILYLCACKINYPHRFFLLRGNHENVDVPPC

SEQ ID NO: 2727490 - protein, 23 aa, Entamoeba histolytica
STFLNKRVLKMMKFLYDTKSTVT

SEQ ID NO: 2727491 - protein, 35 aa, Entamoeba histolytica; identical to SEQ ID NO: 2540461

SEQ ID NO: 2727492 - protein, 22 aa, Entamoeba histolytica
STGMLILKPFIQNGMIKQIYKS

SEQ ID NO: 2727493 - protein, 39 aa, Entamoeba histolytica
STGVIQFSWLRRPIQITCRFYQIGLLMLFNDNKEITYAE

SEQ ID NO: 2727494 - protein, 20 aa, Entamoeba histolytica
STHKGRVMYYSAFDGYCGIT

SEQ ID NO: 2727495 - protein, 20 aa, Entamoeba histolytica
STICIYILNIIGDLTTIGSD

SEQ ID NO: 2727496 - protein, 26 aa, Entamoeba histolytica
STIEFEYFTLLLQQLDVMIDGASAFD

SEQ ID NO: 2727497 - protein, 19 aa, Entamoeba histolytica
STIFATAAILEGCPFVNGS

SEQ ID NO: 2727498 - protein, 19 aa, Entamoeba histolytica
STIIFPYVYATLLSSEFLN

SEQ ID NO: 2727499 - protein, 29 aa, Entamoeba histolytica
STILYESQGLVPLLRLAWNHFDPNFIATF

SEQ ID NO: 2727500 - protein, 24 aa, Entamoeba histolytica
STIRQLVFDIQYPNSTLLSEIIQQ

SEQ ID NO: 2727501 - protein, 27 aa, Entamoeba histolytica
STISIPYNVLMIKLKTLPSLTGLIHIP

SEQ ID NO: 2727502 - protein, 24 aa, Entamoeba histolytica
STISLHYLPLLPYENKYLNNFKKY

SEQ ID NO: 2727503 - protein, 19 aa, Entamoeba histolytica
STISLMCVCPLFPGEFTYK

SEQ ID NO: 2727504 - protein, 21 aa, Entamoeba histolytica
STITFSYIHTPLINELIDHIN

SEQ ID NO: 2727505 - protein, 21 aa, Entamoeba histolytica
STITYFLKTYKSYAKFTCFFE

SEQ ID NO: 2727506 - protein, 24 aa, Entamoeba histolytica
STKARFRTTLGGSTFLYEIHGTVF

SEQ ID NO: 2727507 - protein, 24 aa, Entamoeba histolytica
STKDQMYLAFDLGGGTLDVTILEK

SEQ ID NO: 2727508 - protein, 31 aa, Entamoeba histolytica
STKMENIVILTKAYIAYFKERASLENEYGKG

SEQ ID NO: 2727509 - protein, 27 aa, Entamoeba histolytica
STKNSSLSFTLPLDSSLSQKKTDQTNQ

SEQ ID NO: 2727510 - protein, 18 aa, Entamoeba histolytica
STKSNCLLLLLQLTSVDP

SEQ ID NO: 2727511 - protein, 25 aa, Entamoeba histolytica
STKTMKTFLTKYLEFERKYGDESRQ

SEQ ID NO: 2727512 - protein, 23 aa, Entamoeba histolytica
STKTVLERVSSIGKPLAGLTPTV

SEQ ID NO: 2727513 - protein, 22 aa, Entamoeba histolytica
STKYINYAFIRFSRFIGNCITK

SEQ ID NO: 2727514 - protein, 19 aa, Entamoeba histolytica
STLCDLYKTIKSKIFVASM

SEQ ID NO: 2727515 - protein, 17 aa, Entamoeba histolytica
STLDFSSLYPSIMISHN

SEQ ID NO: 2727516 - protein, 18 aa, Entamoeba histolytica
STLFIPASCLMKMTPFEK

SEQ ID NO: 2727517 - protein, 21 aa, Entamoeba histolytica
STLIHGLKKSLPKKERIFIKE

SEQ ID NO: 2727518 - protein, 18 aa, Entamoeba histolytica
STLILPKGSFLQSLPNQF

SEQ ID NO: 2727519 - protein, 21 aa, Entamoeba histolytica
STLIRRLKRSLPKGESIFVKE

SEQ ID NO: 2727520 - protein, 26 aa, Entamoeba histolytica
STLISLFLGFYKIKPIESLSAFIYRL

SEQ ID NO: 2727521 - protein, 20 aa, Entamoeba histolytica
STLKCVIIHIVTVQLDLTTK

SEQ ID NO: 2727522 - protein, 21 aa, Entamoeba histolytica
STLMNFKVCFIKSLSLQVSTD

SEQ ID NO: 2727523 - protein, 21 aa, Entamoeba histolytica
STLMNFRVCFIKSISLQVSID

SEQ ID NO: 2727524 - protein, 25 aa, Entamoeba histolytica
STLNIVNQRKPFYPHCILFDENELI

SEQ ID NO: 2727525 - protein, 22 aa, Entamoeba histolytica
STLNMLTWKGLKFRVEYANPNI

SEQ ID NO: 2727526 - protein, 21 aa, Entamoeba histolytica
STLPILMTLVGYDIDTVIKIY

SEQ ID NO: 2727527 - protein, 25 aa, Entamoeba histolytica
STLPKIIEDIISSCLNKYLIMPEDY

SEQ ID NO: 2727528 - protein, 26 aa, Entamoeba histolytica
STLTICTRSIMLKQKFFASIVDEAAQ

SEQ ID NO: 2727529 - protein, 32 aa, Entamoeba histolytica
STLVGHTAAIWQVKWSHPRFGPVLASCSYDKQ

SEQ ID NO: 2727530 - protein, 25 aa, Entamoeba histolytica
STMKGWEKLRWEDILHIKTIVEDDV

SEQ ID NO: 2727531 - protein, 20 aa, Entamoeba histolytica
STMKSWLEKEIPTRIEIFLI

SEQ ID NO: 2727532 - protein, 23 aa, Entamoeba histolytica
STMPPPPPPPGASSIPPPPPPPG

SEQ ID NO: 2727533 - protein, 26 aa, Entamoeba histolytica
STMRRSVFIFLIEYQLQFGTKENVQQ

SEQ ID NO: 2727534 - protein, 25 aa, Entamoeba histolytica
STNDCIIDFYAEWCGPCRFISPLFE

SEQ ID NO: 2727535 - protein, 30 aa, Entamoeba histolytica
STNIIPILCYHFYFQVYPIHPEYTYAHGFT

SEQ ID NO: 2727536 - protein, 28 aa, Entamoeba histolytica
STNIVFSVLPPFVPWVLLSTATTTFELQ

SEQ ID NO: 2727537 - protein, 24 aa, Entamoeba histolytica
STNKRRMIIITNNSQWFISQSSLL

SEQ ID NO: 2727538 - protein, 18 aa, Entamoeba histolytica
STNLNYLRKLDILDINII

SEQ ID NO: 2727539 - protein, 18 aa, Entamoeba histolytica
STNPTLQKLLIQTSIKAA

SEQ ID NO: 2727540 - protein, 18 aa, Entamoeba histolytica
STNQILIIHLKRFGNSNG

SEQ ID NO: 2727541 - protein, 25 aa, Entamoeba histolytica
STNQITLHPYPTKPISPNSSHQVTV

SEQ ID NO: 2727542 - protein, 29 aa, Entamoeba histolytica
STPAYVVFFLVRLVPEFMLHLQSGVFDKP

SEQ ID NO: 2727543 - protein, 23 aa, Entamoeba histolytica
STPGFYEEKLLQFIIENIEGKRI

SEQ ID NO: 2727544 - protein, 17 aa, Entamoeba histolytica
STPIQQKIRDALKFILQ

SEQ ID NO: 2727545 - protein, 36 aa, Entamoeba histolytica
STPNKTTASLVLGFIWMLFDKFQEKDIKLSMKEKGV

SEQ ID NO: 2727546 - protein, 26 aa, Entamoeba histolytica
STPYRLMKMPLRRYISSSKHNELFIS

SEQ ID NO: 2727547 - protein, 28 aa, Entamoeba histolytica
STQFMKLPSIYIPVLLNGKVIGKVSPHE

SEQ ID NO: 2727548 - protein, 18 aa, Entamoeba histolytica
STQIPILRWVELEYCIKY

SEQ ID NO: 2727549 - protein, 17 aa, Entamoeba histolytica
STQIPLRKRGEKGWLFG

SEQ ID NO: 2727550 - protein, 20 aa, Entamoeba histolytica
STQLYNFRISLKEINIELTE

SEQ ID NO: 2727551 - protein, 23 aa, Entamoeba histolytica
STQQRILAFLSIRKITPTTHQSV

SEQ ID NO: 2727552 - protein, 22 aa, Entamoeba histolytica
STRAYQQPQFTKPKITPSQSNT

SEQ ID NO: 2727553 - protein, 25 aa, Entamoeba histolytica
STRCSYFYQYFSLEKQPTIELNKET

SEQ ID NO: 2727554 - protein, 20 aa, Entamoeba histolytica
STREYVLLKEKPFHHTHLHS

SEQ ID NO: 2727555 - protein, 17 aa, Entamoeba histolytica
STRIPKVVQLLQDFFNG

SEQ ID NO: 2727556 - protein, 18 aa, Entamoeba histolytica
STRKFKLIDFGSATFEPE

SEQ ID NO: 2727557 - protein, 23 aa, Entamoeba histolytica
STRWFGCYDCWIQATPNGTSTIY

SEQ ID NO: 2727558 - protein, 34 aa, Entamoeba histolytica
STSFFKQYIEVLTLFYSKLVIFLKLNNEHKQTII

SEQ ID NO: 2727559 - protein, 19 aa, Entamoeba histolytica
STSKRLILTCLIKMAKELN

SEQ ID NO: 2727560 - protein, 29 aa, Entamoeba histolytica
STTAQEFFYLILIETFPVPLQLVCMPEIL

SEQ ID NO: 2727561 - protein, 26 aa, Entamoeba histolytica
STTHKGCLVLLRQGIFSILQDTIVLT

SEQ ID NO: 2727562 - protein, 23 aa, Entamoeba histolytica
STTIIPLYKLYYYFTDEVLISFL

SEQ ID NO: 2727563 - protein, 26 aa, Entamoeba histolytica
STTIKDPYAYLVPIDKLDIDEEIKRV

SEQ ID NO: 2727564 - protein, 25 aa, Entamoeba histolytica
STTLYYGIEVLYKMLICSPPDSLHF

SEQ ID NO: 2727565 - protein, 28 aa, Entamoeba histolytica
STTPKFFERMYCMFYPLDEQARCVLEEV

SEQ ID NO: 2727566 - protein, 32 aa, Entamoeba histolytica
STTSFESFILPFGKFFVIPKNINGPLSSFQIL

SEQ ID NO: 2727567 - protein, 25 aa, Entamoeba histolytica
STVEWRTLLQDKIKFLKSSGKRTVI

SEQ ID NO: 2727568 - protein, 24 aa, Entamoeba histolytica
STVIGLLEPLLKDPNDFVKQGAAI

SEQ ID NO: 2727569 - protein, 30 aa, Entamoeba histolytica
STVIRNTSSSPLIFYQKRQNTNNTFEVMIY

SEQ ID NO: 2727570 - protein, 20 aa, Entamoeba histolytica
STVLHYFIELAVKIANGPSL

SEQ ID NO: 2727571 - protein, 24 aa, Entamoeba histolytica
STVNDDWFLETYCGFIISGNEVMF

SEQ ID NO: 2727572 - protein, 38 aa, Entamoeba histolytica
STVPHPYLEFAKQKSIPIIYLISLYNPSKRIQKFKFNS

SEQ ID NO: 2727573 - protein, 25 aa, Entamoeba histolytica
STVVNLFFFEDCDSFIGSFSSIATT

SEQ ID NO: 2727574 - protein, 19 aa, Entamoeba histolytica
STWQPFIDSLLSPSKNQKN

SEQ ID NO: 2727575 - protein, 23 aa, Entamoeba histolytica
STWSFGVILYRMITGYIPQHDEN

SEQ ID NO: 2727576 - protein, 27 aa, Entamoeba histolytica
STYANSFIRQLFHFSIYSIFEGIVDSH

SEQ ID NO: 2727577 - protein, 20 aa, Entamoeba histolytica
STYDLYCFLLTTNCVIYIKK

SEQ ID NO: 2727578 - protein, 20 aa, Entamoeba histolytica
STYIWGYCDAHFKKNMTFEE

SEQ ID NO: 2727579 - protein, 17 aa, Entamoeba histolytica
SVAIPRMINMEKIIAAT

SEQ ID NO: 2727580 - protein, 17 aa, Entamoeba histolytica
SVCFWSEHWRPSSYYPK

SEQ ID NO: 2727581 - protein, 29 aa, Entamoeba histolytica
SVCTFKPIETFPFFIPQRMNSYYHLRTFI

SEQ ID NO: 2727582 - protein, 20 aa, Entamoeba histolytica
SVCVNPTWVPLCAELLKGTG

SEQ ID NO: 2727583 - protein, 25 aa, Entamoeba histolytica
SVDFYEYLVFCWMKILVVDKKKTFH

SEQ ID NO: 2727584 - protein, 24 aa, Entamoeba histolytica
SVDKWYNKLRNIVSDPIPVLIIGN

SEQ ID NO: 2727585 - protein, 20 aa, Entamoeba histolytica
SVDLLFTAVFVFASSMTQQQ

SEQ ID NO: 2727586 - protein, 18 aa, Entamoeba histolytica
SVDNLIDLVWSNDGFFKD

SEQ ID NO: 2727587 - protein, 17 aa, Entamoeba histolytica
SVDQYVQMKLALEKIEQ

SEQ ID NO: 2727588 - protein, 30 aa, Entamoeba histolytica
SVDRFDMCLKVVFRLICVHVALCTKMEEFK

SEQ ID NO: 2727589 - protein, 17 aa, Entamoeba histolytica
SVDTRIIPFDDNKFKRY

SEQ ID NO: 2727590 - protein, 25 aa, Entamoeba histolytica
SVELIIEIFNLWKQFFHCFNCKGKA

SEQ ID NO: 2727591 - protein, 25 aa, Entamoeba histolytica
SVELSALKNLIFLRTINSALVHSQS

SEQ ID NO: 2727592 - protein, 25 aa, Entamoeba histolytica
SVEQSFTRRILFNGAMYTVKCQIIV

SEQ ID NO: 2727593 - protein, 26 aa, Entamoeba histolytica
SVEQSSMILKELFGTQITKIDETLII

SEQ ID NO: 2727594 - protein, 32 aa, Entamoeba histolytica; identical to SEQ ID NO: 2540570

SEQ ID NO: 2727595 - protein, 26 aa, Entamoeba histolytica
SVEYFYPLCVMLLSYADGRSFVWSLD

SEQ ID NO: 2727596 - protein, 32 aa, Entamoeba histolytica
SVFDMCCTSLALLWVFYIRQSFIGSYDFEETH

SEQ ID NO: 2727597 - protein, 18 aa, Entamoeba histolytica
SVFILPSQPALKPKKKRG

SEQ ID NO: 2727598 - protein, 19 aa, Entamoeba histolytica
SVFPKWSIVDPCHSMSLPD

SEQ ID NO: 2727599 - protein, 19 aa, Entamoeba histolytica
SVFQWTLYESYASNEEKRY

SEQ ID NO: 2727600 - protein, 30 aa, Entamoeba histolytica
SVFSQEYPGIPILMLTATATERVKNDILLS

SEQ ID NO: 2727601 - protein, 20 aa, Entamoeba histolytica
SVGATIRVYFDKYSKDYKAD

SEQ ID NO: 2727602 - protein, 25 aa, Entamoeba histolytica
SVGKSALCLLFVKGEFNIEYNPTIE

SEQ ID NO: 2727603 - protein, 19 aa, Entamoeba histolytica
SVGKTCIIGRFTSKNFDMS

SEQ ID NO: 2727604 - protein, 25 aa, Entamoeba histolytica
SVGSILYRYCIGIGTLIIISQNYLN

SEQ ID NO: 2727605 - protein, 26 aa, Entamoeba histolytica
SVGVIPLDFSNPLRYELQKGLIGAFA

SEQ ID NO: 2727606 - protein, 30 aa, Entamoeba histolytica
SVHNTIGILPIQIANFLNIHYELFGIIINK

SEQ ID NO: 2727607 - protein, 45 aa, Entamoeba histolytica
SVHTFSRLIYPFTWQHVLIPILPPDLLSLAFAPMPFIIGCTYSTF

SEQ ID NO: 2727608 - protein, 27 aa, Entamoeba histolytica
SVIAIETVINWLYENPFTSIKKVIFDV

SEQ ID NO: 2727609 - protein, 19 aa, Entamoeba histolytica
SVIARQLALFDQKLIKRVE

SEQ ID NO: 2727610 - protein, 26 aa, Entamoeba histolytica
SVIEKYIYLLIVQFINELVKSKQLSL

SEQ ID NO: 2727611 - protein, 18 aa, Entamoeba histolytica
SVIFEPPTSFSIINYCDD

SEQ ID NO: 2727612 - protein, 18 aa, Entamoeba histolytica
SVIKTLLKQSLLNDKLGS

SEQ ID NO: 2727613 - protein, 33 aa, Entamoeba histolytica
SVIKYSFVFEFFIKDYEIIYKLFNFRQKKDIER

SEQ ID NO: 2727614 - protein, 23 aa, Entamoeba histolytica
SVIYPGIIKYFKDIKENIVTKCV

SEQ ID NO: 2727615 - protein, 45 aa, Entamoeba histolytica
SVKGCSNVMFIFRTIDQHIFGCFNKLIIPFEFTKPGDVDTGIGFD

SEQ ID NO: 2727616 - protein, 17 aa, Entamoeba histolytica
SVKIKYLTLINIFSYST

SEQ ID NO: 2727617 - protein, 28 aa, Entamoeba histolytica
SVKTWKKRWFVLKDNRLWYFASKTAEEA

SEQ ID NO: 2727618 - protein, 31 aa, Entamoeba histolytica
SVKVRRPKDYNPVLPFISGLSQLMEPGTTNP

SEQ ID NO: 2727619 - protein, 33 aa, Entamoeba histolytica
SVKYETILLVSRMGYIYGFYSGDGTLFFQGRVI

SEQ ID NO: 2727620 - protein, 22 aa, Entamoeba histolytica
SVLAMVHGYKPYFYISVEKEYT

SEQ ID NO: 2727621 - protein, 23 aa, Entamoeba histolytica
SVLIMSPFLEKGMVRRFKNVLQL

SEQ ID NO: 2727622 - protein, 22 aa, Entamoeba histolytica
SVLKAYLQKLKTYQAKEEALEK

SEQ ID NO: 2727623 - protein, 30 aa, Entamoeba histolytica
SVLKRMIITRLYPYLWQPSISVLEGTIINS

SEQ ID NO: 2727624 - protein, 20 aa, Entamoeba histolytica
SVLLALYKNTVQIYSQNIEY

SEQ ID NO: 2727625 - protein, 19 aa, Entamoeba histolytica
SVLLNHYLSHTLHINTSPQ

SEQ ID NO: 2727626 - protein, 20 aa, Entamoeba histolytica
SVLNLMKFNGGYSWWRRNSL

SEQ ID NO: 2727627 - protein, 29 aa, Entamoeba histolytica
SVLNSYEYFYEVNIPLLVKPNLFESVGEL

SEQ ID NO: 2727628 - protein, 17 aa, Entamoeba histolytica
SVLPFYEKCGLSKKGHF

SEQ ID NO: 2727629 - protein, 24 aa, Entamoeba histolytica
SVLRTEVIFRMFKSMELKATVLHS

SEQ ID NO: 2727630 - protein, 23 aa, Entamoeba histolytica
SVLSTYIVYYNGSQVKVLCIGYC

SEQ ID NO: 2727631 - protein, 34 aa, Entamoeba histolytica
SVLYDCCLELPLNLILPVLYFAFNNMLNHEKVWD

SEQ ID NO: 2727632 - protein, 24 aa, Entamoeba histolytica
SVMETIELFLYISEKFIKQETYTN

SEQ ID NO: 2727633 - protein, 24 aa, Entamoeba histolytica
SVMRTSVLAVPYFWDEERVKENAK

SEQ ID NO: 2727634 - protein, 26 aa, Entamoeba histolytica
SVMTCLTFISDIFYITEQQLFSLLCI

SEQ ID NO: 2727635 - protein, 18 aa, Entamoeba histolytica
SVMTYVAALYKVFSSNDQ

SEQ ID NO: 2727636 - protein, 22 aa, Entamoeba histolytica
SVPGLCWITNAFKPSLVYRNFS

SEQ ID NO: 2727637 - protein, 18 aa, Entamoeba histolytica
SVPHNYFTAFIRSLKCGY

SEQ ID NO: 2727638 - protein, 31 aa, Entamoeba histolytica
SVPNIIFKQNRWFPKYSIYPVDEITIFFNYA

SEQ ID NO: 2727639 - protein, 20 aa, Entamoeba histolytica
SVPSQFFCNYILKTCQVSSE

SEQ ID NO: 2727640 - protein, 34 aa, Entamoeba histolytica
SVPVSIFIEIDYEKVFFLTLTKQPDIIPTMGIVF

SEQ ID NO: 2727641 - protein, 25 aa, Entamoeba histolytica
SVQEKLLHYTSFKYNVDVLPQVNSL

SEQ ID NO: 2727642 - protein, 25 aa, Entamoeba histolytica
SVQEKLMNFLFFISQSQSGCLIQMN

SEQ ID NO: 2727643 - protein, 18 aa, Entamoeba histolytica
SVQILLFIRQIYVTYHDS

SEQ ID NO: 2727644 - protein, 23 aa, Entamoeba histolytica
SVQPTRFYPLKLGNSVYIFQNDY

SEQ ID NO: 2727645 - protein, 23 aa, Entamoeba histolytica
SVRCQACGEYIYKGKKFNSKKET

SEQ ID NO: 2727646 - protein, 22 aa, Entamoeba histolytica
SVRQWAQQWIKPGMSDLFVAEN

SEQ ID NO: 2727647 - protein, 24 aa, Entamoeba histolytica
SVSCHAYFILHFPDKLMARPETVQ

SEQ ID NO: 2727648 - protein, 19 aa, Entamoeba histolytica
SVSIPWFFDNFDAKEYCVY

SEQ ID NO: 2727649 - protein, 25 aa, Entamoeba histolytica
SVSKINKLFYIQKINRIKDWILSKH

SEQ ID NO: 2727650 - protein, 29 aa, Entamoeba histolytica
SVSKQAIELVFVLCAFDGFFSFMCAAKNY

SEQ ID NO: 2727651 - protein, 25 aa, Entamoeba histolytica
SVSLPLPITLLKFFKQPTQMTFSSL

SEQ ID NO: 2727652 - protein, 24 aa, Entamoeba histolytica
SVSRKYIYQIISTNTKKIKSIVGQ

SEQ ID NO: 2727653 - protein, 23 aa, Entamoeba histolytica
SVSTFLLFLNSGLTDLFEGLWSS

SEQ ID NO: 2727654 - protein, 20 aa, Entamoeba histolytica
SVSYKNILDIILERIQQQKS

SEQ ID NO: 2727655 - protein, 21 aa, Entamoeba histolytica
SVTILLPHVWPAQQVITPQDQ

SEQ ID NO: 2727656 - protein, 28 aa, Entamoeba histolytica
SVTVEALTTFFSFTGNVTQVRLSDCPDG

SEQ ID NO: 2727657 - protein, 28 aa, Entamoeba histolytica
SVVFLKGFINSIFYRKSNPKRKYIIVTH

SEQ ID NO: 2727658 - protein, 33 aa, Entamoeba histolytica
SVVHKWRVQGYFYDFIGYVLFPVKEINGKKYVS

SEQ ID NO: 2727659 - protein, 22 aa, Entamoeba histolytica
SVVIAYLIRKYQMSLKAAFQYV

SEQ ID NO: 2727660 - protein, 30 aa, Entamoeba histolytica
SVVQRMFIFENEWEYWINVLYECCTIINLN

SEQ ID NO: 2727661 - protein, 24 aa, Entamoeba histolytica
SVVQVANALFYFSKDKPTAISQSI

SEQ ID NO: 2727662 - protein, 32 aa, Entamoeba histolytica
SVVSEKLFVSPIPPILVAFEQLSQIKPKPSSA

SEQ ID NO: 2727663 - protein, 25 aa, Entamoeba histolytica
SVVSKFVVNCLQPFYDNGKIQDRDR

SEQ ID NO: 2727664 - protein, 25 aa, Entamoeba histolytica
SVVWRWLLGCMASDFPLYTTIETIH

SEQ ID NO: 2727665 - protein, 23 aa, Entamoeba histolytica
SVYGAFWITNSFILKLSTIINTV

SEQ ID NO: 2727666 - protein, 28 aa, Entamoeba histolytica
SVYHCKVILRFVFNLIQIAFTSQHKLLT

SEQ ID NO: 2727667 - protein, 19 aa, Entamoeba histolytica
SVYLLRCQIINTCISFMEE

SEQ ID NO: 2727668 - protein, 24 aa, Entamoeba histolytica
SVYQCLIHILRIPNAKSIFLRENG

SEQ ID NO: 2727669 - protein, 24 aa, Entamoeba histolytica
SVYQRALKYFSRDLSLWNALSQEI

SEQ ID NO: 2727670 - protein, 17 aa, Entamoeba histolytica
SVYSYPQGLIELLNSVL

SEQ ID NO: 2727671 - protein, 20 aa, Entamoeba histolytica
SVYTIVYLQKHGISIDCLLH

SEQ ID NO: 2727672 - protein, 24 aa, Entamoeba histolytica
SWEEFYMMLHGNVVCLFVSGESAA

SEQ ID NO: 2727673 - protein, 25 aa, Entamoeba histolytica
SWKSWKKRYFVLDNDTLYYYKEQDK

SEQ ID NO: 2727674 - protein, 28 aa, Entamoeba histolytica
SWKSWKRRWFVIKDRKMWYFAGKNDTEA

SEQ ID NO: 2727675 - protein, 17 aa, Entamoeba histolytica
SWLADLIYLNISGCTRI

SEQ ID NO: 2727676 - protein, 18 aa, Entamoeba histolytica
SWMPCICNSFQLVCYEMT

SEQ ID NO: 2727677 - protein, 24 aa, Entamoeba histolytica
SWMSDIINHIGYNVPFVAVANKSD

SEQ ID NO: 2727678 - protein, 25 aa, Entamoeba histolytica
SWRLRIGQFITFPNYQRKKLGRYLL

SEQ ID NO: 2727679 - protein, 27 aa, Entamoeba histolytica
SWRRKEGEAFVPRKAPTEFREHELREP

SEQ ID NO: 2727680 - protein, 26 aa, Entamoeba histolytica
SWRRKEGEAFVPRKAPTEFREHEQRE

SEQ ID NO: 2727681 - protein, 18 aa, Entamoeba histolytica
SWVIPVINGIVYNNISQK

SEQ ID NO: 2727682 - protein, 19 aa, Entamoeba histolytica
SYALFFASFCDFQNNVRCN

SEQ ID NO: 2727683 - protein, 25 aa, Entamoeba histolytica
SYCTPRVMEILSKRLNIPMTAVAKN

SEQ ID NO: 2727684 - protein, 20 aa, Entamoeba histolytica
SYCYDSLFNVKRIICIQMLC

SEQ ID NO: 2727685 - protein, 19 aa, Entamoeba histolytica
SYCYSACSLVTKGLKEWGG

SEQ ID NO: 2727686 - protein, 29 aa, Entamoeba histolytica
SYDDPHTKVFLLLSAYFGENTLPIVDFVL

SEQ ID NO: 2727687 - protein, 24 aa, Entamoeba histolytica
SYDFKLLFLDHYTLSLPDSLLFSN

SEQ ID NO: 2727688 - protein, 42 aa, Entamoeba histolytica
SYDFSINFIKEQKKWFPEKTCPFILSYLFTEQNNFVGFLTDH

SEQ ID NO: 2727689 - protein, 26 aa, Entamoeba histolytica
SYDYFNSVFGPFKRFVLKGIQTLENQ

SEQ ID NO: 2727690 - protein, 23 aa, Entamoeba histolytica
SYEELYFPSLIIVDYLNVINLEW

SEQ ID NO: 2727691 - protein, 25 aa, Entamoeba histolytica
SYEIAFIDFLFPRTTIMTDPVIPSL

SEQ ID NO: 2727692 - protein, 18 aa, Entamoeba histolytica
SYELIRGLAYLHSLNIIH

SEQ ID NO: 2727693 - protein, 24 aa, Entamoeba histolytica
SYELPFELELMYKDGWERSCDVCL

SEQ ID NO: 2727694 - protein, 20 aa, Entamoeba histolytica
SYEQFPRRRLFPSEINPQKE

SEQ ID NO: 2727695 - protein, 27 aa, Entamoeba histolytica
SYFNGDISSLAWYFNQLTPNGVPSLLL

SEQ ID NO: 2727696 - protein, 26 aa, Entamoeba histolytica
SYGNTLLHYISYSPFTDMILLLCKKL

SEQ ID NO: 2727697 - protein, 20 aa, Entamoeba histolytica
SYHLNYLLYISFKLSSNNSC

SEQ ID NO: 2727698 - protein, 23 aa, Entamoeba histolytica
SYHLRQFPHPFACSNGISVVHRT

SEQ ID NO: 2727699 - protein, 21 aa, Entamoeba histolytica
SYIIQLRLKLFEVLRYIFKSL

SEQ ID NO: 2727700 - protein, 21 aa, Entamoeba histolytica
SYIIQYTYIKWNNEYHILYFW

SEQ ID NO: 2727701 - protein, 17 aa, Entamoeba histolytica
SYIKRWCEMNEKYVMIF

SEQ ID NO: 2727702 - protein, 17 aa, Entamoeba histolytica
SYILPRFGDVGIPVTVS

SEQ ID NO: 2727703 - protein, 18 aa, Entamoeba histolytica
SYIPPHFKTILRKIYHRV

SEQ ID NO: 2727704 - protein, 35 aa, Entamoeba histolytica
SYIVQNIILSFVKLKYRIFAIEFFIKVAEYLKKLN

SEQ ID NO: 2727705 - protein, 18 aa, Entamoeba histolytica
SYKGNLSEMLLFICGLNK

SEQ ID NO: 2727706 - protein, 24 aa, Entamoeba histolytica
SYKKFKNILDVIKKLAPTVHATNL

SEQ ID NO: 2727707 - protein, 18 aa, Entamoeba histolytica
SYKLRHLLFIINQIDRPD

SEQ ID NO: 2727708 - protein, 19 aa, Entamoeba histolytica
SYLALYYYEQALSVLPNDQ

SEQ ID NO: 2727709 - protein, 20 aa, Entamoeba histolytica
SYLIAIYEIIKNISAYENIL

SEQ ID NO: 2727710 - protein, 20 aa, Entamoeba histolytica
SYLLVLDSYTFTLKKTLYLC

SEQ ID NO: 2727711 - protein, 20 aa, Entamoeba histolytica
SYLNFVYPNGGYEKEQEHIL

SEQ ID NO: 2727712 - protein, 25 aa, Entamoeba histolytica
SYLPNTRFTVTRIVFRDGTSKFMID

SEQ ID NO: 2727713 - protein, 17 aa, Entamoeba histolytica
SYLTFKKKNFYGTHKVS

SEQ ID NO: 2727714 - protein, 27 aa, Entamoeba histolytica
SYNDLTQYPIFPWVLSNYSSSSIDLND

SEQ ID NO: 2727715 - protein, 22 aa, Entamoeba histolytica
SYNGKFLKLKYVLSVRIMSKSH

SEQ ID NO: 2727716 - protein, 30 aa, Entamoeba histolytica
SYNIPLIAMDYFFSILPPSLSSPTLIKEIT

SEQ ID NO: 2727717 - protein, 24 aa, Entamoeba histolytica
SYNQLYASSLFSWLADLIYLNISG

SEQ ID NO: 2727718 - protein, 23 aa, Entamoeba histolytica
SYNYLFKILLVGDPNVGKSSLLL

SEQ ID NO: 2727719 - protein, 22 aa, Entamoeba histolytica
SYPDFFLNDWFSLKEFQNFEGQ

SEQ ID NO: 2727720 - protein, 20 aa, Entamoeba histolytica
SYPGIHVMMIQRVAHILYMN

SEQ ID NO: 2727721 - protein, 28 aa, Entamoeba histolytica
SYPKNLKQYFILFDALASIGPQACYSLS

SEQ ID NO: 2727722 - protein, 18 aa, Entamoeba histolytica
SYPPLMLHSSHSLSMNTL

SEQ ID NO: 2727723 - protein, 18 aa, Entamoeba histolytica
SYQNIILETNRPLSYYNF

SEQ ID NO: 2727724 - protein, 30 aa, Entamoeba histolytica; identical to SEQ ID NO: 2540730

SEQ ID NO: 2727725 - protein, 26 aa, Entamoeba histolytica
SYSGTYDILFYTLKIIIKILEVGEKE

SEQ ID NO: 2727726 - protein, 29 aa, Entamoeba histolytica
SYSIEVFTLLMLYKVMYPTRIALMRGNHE

SEQ ID NO: 2727727 - protein, 28 aa, Entamoeba histolytica
SYSIEVFTLLMLYKVMYPTRISLMRGNH

SEQ ID NO: 2727728 - protein, 23 aa, Entamoeba histolytica
SYSILIICKYFKTPEDFINIICV

SEQ ID NO: 2727729 - protein, 27 aa, Entamoeba histolytica
SYSPAMQIYFSYRFLALHSPEEKRVGI

SEQ ID NO: 2727730 - protein, 24 aa, Entamoeba histolytica
SYSSFIYQSKLPGASLHLSLDVAG

SEQ ID NO: 2727731 - protein, 17 aa, Entamoeba histolytica
SYSTLLPSSLTSLTVSC

SEQ ID NO: 2727732 - protein, 24 aa, Entamoeba histolytica
SYSYGMLCNVLLSDPLTLNGFYNL

SEQ ID NO: 2727733 - protein, 32 aa, Entamoeba histolytica
SYVEIRIQLKKKPTIIVKFPVTVGWGKSTVEG

SEQ ID NO: 2727734 - protein, 25 aa, Entamoeba histolytica
SYVGRGYFGLMYLNNNPKTIEGEIE

SEQ ID NO: 2727735 - protein, 19 aa, Entamoeba histolytica
SYVIWYHRKWSISKMEHPK

SEQ ID NO: 2727736 - protein, 18 aa, Entamoeba histolytica
SYVKLIDIGPRLKLHLLS

SEQ ID NO: 2727737 - protein, 30 aa, Entamoeba histolytica; identical to SEQ ID NO: 2540743

SEQ ID NO: 2727738 - protein, 18 aa, Entamoeba histolytica
SYYEGCNAVIVVFDISDR

SEQ ID NO: 2727739 - protein, 18 aa, Entamoeba histolytica
SYYLYAPIPYKNEKNVFL

SEQ ID NO: 2727740 - protein, 28 aa, Entamoeba histolytica
SYYPLSKFMEFLTIPYMIDNVILLITGT

SEQ ID NO: 2727741 - protein, 17 aa, Entamoeba histolytica
SYYTSLVGISYSVGSSL

SEQ ID NO: 2727742 - protein, 17 aa, Entamoeba histolytica
TAALRLLRNITSQVYCE

SEQ ID NO: 2727743 - protein, 27 aa, Entamoeba histolytica
TADILLPSFIYIVIRANTTHLASTLSY

SEQ ID NO: 2727744 - protein, 30 aa, Entamoeba histolytica
TADKKLHLFIPRVPPFSVTLTFLTSLPKKN

SEQ ID NO: 2727745 - protein, 28 aa, Entamoeba histolytica
TADPRFYELLKMYLPTRLEIQGGIRPDV

SEQ ID NO: 2727746 - protein, 17 aa, Entamoeba histolytica
TADSWRRKEGEAFVPRK

SEQ ID NO: 2727747 - protein, 18 aa, Entamoeba histolytica
TADSWRRKEGEAFVPRKG

SEQ ID NO: 2727748 - protein, 35 aa, Entamoeba histolytica
TAELIFTEFMFCARLQIFKTWFEDIIKKEIPLLKH

SEQ ID NO: 2727749 - protein, 17 aa, Entamoeba histolytica
TAGMLMNRLGCGKLLAG

SEQ ID NO: 2727750 - protein, 31 aa, Entamoeba histolytica
TAGNILRVMLLRNPHVLFAGYRQPHPLNYVI

SEQ ID NO: 2727751 - protein, 29 aa, Entamoeba histolytica
TAGPRGYRPRRFGPRRFTRKHFGKKTNGS

SEQ ID NO: 2727752 - protein, 32 aa, Entamoeba histolytica
TAHIIEVLKEKLLRIRQIKSKWVKVLQNTVNA

SEQ ID NO: 2727753 - protein, 26 aa, Entamoeba histolytica
TAICIVWVQCLVDLHFLMIQEILNVE

SEQ ID NO: 2727754 - protein, 26 aa, Entamoeba histolytica
TAIEPTDYFIFPFPLCLIVTKQLSVE

SEQ ID NO: 2727755 - protein, 18 aa, Entamoeba histolytica
TAIGIHVFPFCLQFDVMD

SEQ ID NO: 2727756 - protein, 22 aa, Entamoeba histolytica
TAIGLIFGKKFITQKWFSALQD

SEQ ID NO: 2727757 - protein, 22 aa, Entamoeba histolytica
TAIGTLKFIHPLQIPVCYTHQK

SEQ ID NO: 2727758 - protein, 26 aa, Entamoeba histolytica
TAIVLFQTYKLPKLMDSPFTLTDEIL

SEQ ID NO: 2727759 - protein, 37 aa, Entamoeba histolytica
TAIYTKEDLSEQLKLNKINALIYSYELQKAKHDIPIQ

SEQ ID NO: 2727760 - protein, 24 aa, Entamoeba histolytica
TAKGMVGSPYWMPPEVILDKVYNN

SEQ ID NO: 2727761 - protein, 30 aa, Entamoeba histolytica
TAKIENIDIRILKDYFLDMDCLKDFCDDLI

SEQ ID NO: 2727762 - protein, 25 aa, Entamoeba histolytica
TAKNYIALRLLFEMKVQRNFINNFS

SEQ ID NO: 2727763 - protein, 26 aa, Entamoeba histolytica
TAKPICIEPYELFPQLGRFTLRDAGK

SEQ ID NO: 2727764 - protein, 23 aa, Entamoeba histolytica
TAKSQLLKFVQMATPIGVYTSGK

SEQ ID NO: 2727765 - protein, 25 aa, Entamoeba histolytica
TAKSQLLRYVMSIAPLAVSTNGRGA

SEQ ID NO: 2727766 - protein, 24 aa, Entamoeba histolytica
TAKTWLIPYCVYRTLVKSVDTPLP

SEQ ID NO: 2727767 - protein, 31 aa, Entamoeba histolytica; identical to SEQ ID NO: 2540767

SEQ ID NO: 2727768 - protein, 17 aa, Entamoeba histolytica
TALILFKANDQSKETQA

SEQ ID NO: 2727769 - protein, 25 aa, Entamoeba histolytica
TALLITYRDGKFPRDYIPIMFDGVE

SEQ ID NO: 2727770 - protein, 17 aa, Entamoeba histolytica
TALMKLLKKFNSIKDLL

SEQ ID NO: 2727771 - protein, 21 aa, Entamoeba histolytica
TALPIHLRNFPNNPFYGQFIT

SEQ ID NO: 2727772 - protein, 21 aa, Entamoeba histolytica
TALQYILKYINIPELIEPVAI

SEQ ID NO: 2727773 - protein, 20 aa, Entamoeba histolytica
TALSIIPATHNGFRRGIVMN

SEQ ID NO: 2727774 - protein, 32 aa, Entamoeba histolytica
TALSNLINSLKLMFCRYLKLENPLVALINKTQ

SEQ ID NO: 2727775 - protein, 20 aa, Entamoeba histolytica
TALVKLITQLYGERTIIANA

SEQ ID NO: 2727776 - protein, 18 aa, Entamoeba histolytica
TAMALVLGIQHQVKYYLS

SEQ ID NO: 2727777 - protein, 20 aa, Entamoeba histolytica
TAMNHLFALIRKCNEYLSST

SEQ ID NO: 2727778 - protein, 24 aa, Entamoeba histolytica
TANFLFLNSVMKKGIIHPTLYDVM

SEQ ID NO: 2727779 - protein, 22 aa, Entamoeba histolytica
TANILYFNSKQILVVRNKTVIL

SEQ ID NO: 2727780 - protein, 31 aa, Entamoeba histolytica
TANSWRWCTEVFDYLNIAALIDGKIFCVHGG

SEQ ID NO: 2727781 - protein, 29 aa, Entamoeba histolytica
TAPPDVISLILPLLKTRTFFIPNRSESVT

SEQ ID NO: 2727782 - protein, 25 aa, Entamoeba histolytica
TAQLTLNINYLVVSKLNLLELYEIN

SEQ ID NO: 2727783 - protein, 20 aa, Entamoeba histolytica
TAQRVIQPIIKHNESKITFS

SEQ ID NO: 2727784 - protein, 20 aa, Entamoeba histolytica
TAQYFLSDGIIITGTSTGVK

SEQ ID NO: 2727785 - protein, 20 aa, Entamoeba histolytica
TARIQCLYQLSLIEQALSIG

SEQ ID NO: 2727786 - protein, 28 aa, Entamoeba histolytica
TASEDGLIKLWNLIDGHLIATLRGHSKG

SEQ ID NO: 2727787 - protein, 24 aa, Entamoeba histolytica
TASEKRVYWKEFTEAVVSLLMKGK

SEQ ID NO: 2727788 - protein, 18 aa, Entamoeba histolytica
TASQKYIFGNIINLFGKD

SEQ ID NO: 2727789 - protein, 24 aa, Entamoeba histolytica
TASQPKLLVNLKSSPTSSSPSNTN

SEQ ID NO: 2727790 - protein, 22 aa, Entamoeba histolytica
TASTLMRQIIEKYKKDGQPRAK

SEQ ID NO: 2727791 - protein, 35 aa, Entamoeba histolytica
TASVAWTILKLFLMSLPTPLLHPISSFLSINPINV

SEQ ID NO: 2727792 - protein, 25 aa, Entamoeba histolytica
TATENFFLSIGAKVRLSQWEKGKEF

SEQ ID NO: 2727793 - protein, 26 aa, Entamoeba histolytica
TATENFFLSIGAKVRLSQWEKGKEFF

SEQ ID NO: 2727794 - protein, 20 aa, Entamoeba histolytica
TATFLPGGRFIAIGTVGGSI

SEQ ID NO: 2727795 - protein, 24 aa, Entamoeba histolytica
TAVETPLLVALYKSYTSALMNKME

SEQ ID NO: 2727796 - protein, 18 aa, Entamoeba histolytica
TAVLMLIKVMQYTPEKRP

SEQ ID NO: 2727797 - protein, 24 aa, Entamoeba histolytica
TAVVKGAAYLAYSKGMNSICSKFI

SEQ ID NO: 2727798 - protein, 23 aa, Entamoeba histolytica
TAVVVMILDMKMYVAWAGDSRAV

SEQ ID NO: 2727799 - protein, 17 aa, Entamoeba histolytica
TCDFILPLFNSSNICCI

SEQ ID NO: 2727800 - protein, 30 aa, Entamoeba histolytica
TCDIYAFSMVIWQIFTQRLLYIKYESMDDL

SEQ ID NO: 2727801 - protein, 28 aa, Entamoeba histolytica
TCEEIIAYFLAMLNTKTLNLIMIMDIER

SEQ ID NO: 2727802 - protein, 24 aa, Entamoeba histolytica
TCEPLPDPIIFLRACLKINEMNKE

SEQ ID NO: 2727803 - protein, 25 aa, Entamoeba histolytica
TCEQWRLWQELLKKGELNLKWIRTN

SEQ ID NO: 2727804 - protein, 18 aa, Entamoeba histolytica
TCERIRPLDLAISFHDGK

SEQ ID NO: 2727805 - protein, 28 aa, Entamoeba histolytica
TCESRNRLIILLPWLEQRLSEGSPDVSL

SEQ ID NO: 2727806 - protein, 25 aa, Entamoeba histolytica
TCFTPLLPHLIQLTNLKQISLSNIS

SEQ ID NO: 2727807 - protein, 24 aa, Entamoeba histolytica
TCGDIILFSFKDPVPERVNALYKS

SEQ ID NO: 2727808 - protein, 20 aa, Entamoeba histolytica
TCGNSLVVAPLTLIPHWVSE

SEQ ID NO: 2727809 - protein, 24 aa, Entamoeba histolytica
TCHKRVYFNERLTFAGKDYHKIGC

SEQ ID NO: 2727810 - protein, 25 aa, Entamoeba histolytica
TCIELLMKCWIIYDLDKGYQQGMSD

SEQ ID NO: 2727811 - protein, 29 aa, Entamoeba histolytica
TCIGDLLSLLITYITPYLSFTTDYNIALN

SEQ ID NO: 2727812 - protein, 18 aa, Entamoeba histolytica
TCITPLEKRIPILKASRE

SEQ ID NO: 2727813 - protein, 26 aa, Entamoeba histolytica
TCKINEVILFYRTISYTIQFSDVSEK

SEQ ID NO: 2727814 - protein, 19 aa, Entamoeba histolytica
TCKLWDIEERLREASLAKG

SEQ ID NO: 2727815 - protein, 30 aa, Entamoeba histolytica
TCLAFSTHLLQLLPLSLITFFFSLVTDVPK

SEQ ID NO: 2727816 - protein, 35 aa, Entamoeba histolytica
TCLLKFVASELPLIRRIPPFHGLPKELEFNTFVIE

SEQ ID NO: 2727817 - protein, 31 aa, Entamoeba histolytica
TCLQFIVNEIYIRYLKIFNKQLSVTFEPNSQ

SEQ ID NO: 2727818 - protein, 23 aa, Entamoeba histolytica
TCMDNFLFEIVHNESLLAIDISG

SEQ ID NO: 2727819 - protein, 20 aa, Entamoeba histolytica
TCNDLTLIEKRQLMKFLNDI

SEQ ID NO: 2727820 - protein, 21 aa, Entamoeba histolytica
TCPKRWFIKSGKEGGIKLFSN

SEQ ID NO: 2727821 - protein, 19 aa, Entamoeba histolytica
TCPNPFQLPPMTPDSFRKA

SEQ ID NO: 2727822 - protein, 17 aa, Entamoeba histolytica
TCQCDIWSIGVITYLVL

SEQ ID NO: 2727823 - protein, 25 aa, Entamoeba histolytica
TCREDLLYGRYLEALYLGKQPEMTL

SEQ ID NO: 2727824 - protein, 25 aa, Entamoeba histolytica
TCSQGLMLMIPNMIKIAGEHLPCVF

SEQ ID NO: 2727825 - protein, 18 aa, Entamoeba histolytica
TCYETLLPDFGPNQKIKL

SEQ ID NO: 2727826 - protein, 23 aa, Entamoeba histolytica
TCYKILGKYLLKKEKDILYILAQ

SEQ ID NO: 2727827 - protein, 18 aa, Entamoeba histolytica
TCYLEEEFLVIHIQIFVN

SEQ ID NO: 2727828 - protein, 23 aa, Entamoeba histolytica
TDAEEIFVFRRSLARTRVLSSKI

SEQ ID NO: 2727829 - protein, 33 aa, Entamoeba histolytica
TDAGLIKKYPILKNSWKLVLSIFDFNSSNRQNS

SEQ ID NO: 2727830 - protein, 18 aa, Entamoeba histolytica
TDCAIAINPIFECQQLHG

SEQ ID NO: 2727831 - protein, 20 aa, Entamoeba histolytica
TDDCPVFEGLYPFVQTVVGS

SEQ ID NO: 2727832 - protein, 31 aa, Entamoeba histolytica; identical to SEQ ID NO: 2557118

SEQ ID NO: 2727833 - protein, 17 aa, Entamoeba histolytica
TDDGHIFLTTPVGLRAS

SEQ ID NO: 2727834 - protein, 23 aa, Entamoeba histolytica
TDDGKYLGIFEDFLRHVDSKEFN

SEQ ID NO: 2727835 - protein, 17 aa, Entamoeba histolytica
TDDIVLCIVGNKSDLEA

SEQ ID NO: 2727836 - protein, 22 aa, Entamoeba histolytica
TDDNKLILLENFFALICTSWDK

SEQ ID NO: 2727837 - protein, 26 aa, Entamoeba histolytica
TDDTPLEIELLLRCILQENPISRPNA

SEQ ID NO: 2727838 - protein, 28 aa, Entamoeba histolytica
TDEEHALFLEGLSLYHRDWKRIEQHVKT

SEQ ID NO: 2727839 - protein, 28 aa, Entamoeba histolytica
TDEEICRTLFDIPLIIIINKADLVSDET

SEQ ID NO: 2727840 - protein, 21 aa, Entamoeba histolytica
TDEFFWRRRPSPKIVQHENGE

SEQ ID NO: 2727841 - protein, 28 aa, Entamoeba histolytica
TDESYMTKLLRLHPLPTTALKQYQTFFN

SEQ ID NO: 2727842 - protein, 18 aa, Entamoeba histolytica
TDFICKKIRFLLKRNEEG

SEQ ID NO: 2727843 - protein, 19 aa, Entamoeba histolytica
TDFLLRRSIASPATVGYSL

SEQ ID NO: 2727844 - protein, 17 aa, Entamoeba histolytica
TDFTCLHLHFVVVQFDS

SEQ ID NO: 2727845 - protein, 22 aa, Entamoeba histolytica
TDGERFFFLCDLSVAMEYMVQT

SEQ ID NO: 2727846 - protein, 25 aa, Entamoeba histolytica
TDGESPIIMFLKAINQKIIGPATMR

SEQ ID NO: 2727847 - protein, 31 aa, Entamoeba histolytica
TDGKYQLVKKIPLILLKKISLKKATPGILTF

SEQ ID NO: 2727848 - protein, 20 aa, Entamoeba histolytica
TDGLLLLSSFVRIFTVLLHN

SEQ ID NO: 2727849 - protein, 33 aa, Entamoeba histolytica
TDGPFMAPVPFRGKPCHSGMIPWIIKEIARVKE

SEQ ID NO: 2727850 - protein, 30 aa, Entamoeba histolytica
TDGSYIMKIMGYITVRFKHLRSSPLEIVEA

SEQ ID NO: 2727851 - protein, 20 aa, Entamoeba histolytica
TDIDFDFYIKHQLISVSKHS

SEQ ID NO: 2727852 - protein, 24 aa, Entamoeba histolytica
TDILKEYIAYCKAYCIPRLTENAS

SEQ ID NO: 2727853 - protein, 20 aa, Entamoeba histolytica
TDILLHYELPEPLQLIITDN

SEQ ID NO: 2727854 - protein, 20 aa, Entamoeba histolytica
TDIRILLDPFALPAIQDFHS

SEQ ID NO: 2727855 - protein, 24 aa, Entamoeba histolytica
TDKDFQKYGKLLGLKGHSLYKEKS

SEQ ID NO: 2727856 - protein, 24 aa, Entamoeba histolytica
TDKDWKLLLNYSRSMFRVLNKLLP

SEQ ID NO: 2727857 - protein, 25 aa, Entamoeba histolytica
TDKEIEKFLAWARSLSPIKPIEKVM

SEQ ID NO: 2727858 - protein, 36 aa, Entamoeba histolytica
TDKIKSMMFNDLNVPFLKIVNPALMALYAEGKETGL

SEQ ID NO: 2727859 - protein, 25 aa, Entamoeba histolytica
TDKIYRLMMKYFNGSRIDDKPPEST

SEQ ID NO: 2727860 - protein, 21 aa, Entamoeba histolytica
TDKKHVIIRNAYDSRIKIQSD

SEQ ID NO: 2727861 - protein, 19 aa, Entamoeba histolytica
TDKKKELFFIPKELQNEGV

SEQ ID NO: 2727862 - protein, 22 aa, Entamoeba histolytica
TDKLLNYFAKLRSTAVSVSKLG

SEQ ID NO: 2727863 - protein, 20 aa, Entamoeba histolytica
TDKQLLWYKKQVHLEWKGKK

SEQ ID NO: 2727864 - protein, 24 aa, Entamoeba histolytica
TDLASYILEHGFAIPTGRYNVSSE

SEQ ID NO: 2727865 - protein, 25 aa, Entamoeba histolytica
TDLEKLRLCCLPKVPYFVEMHASEF

SEQ ID NO: 2727866 - protein, 17 aa, Entamoeba histolytica
TDLFVMPGGVDRPFHKK

SEQ ID NO: 2727867 - protein, 18 aa, Entamoeba histolytica
TDLIWRNQTNFLAGSYDG

SEQ ID NO: 2727868 - protein, 18 aa, Entamoeba histolytica
TDLKIHMLYHSDEKPFQC

SEQ ID NO: 2727869 - protein, 21 aa, Entamoeba histolytica
TDLKIHMLYHSDEKPFQCPFP

SEQ ID NO: 2727870 - protein, 23 aa, Entamoeba histolytica
TDLLNLFFTTYNINLKMSLSNYD

SEQ ID NO: 2727871 - protein, 33 aa, Entamoeba histolytica; identical to SEQ ID NO: 2540859

SEQ ID NO: 2727872 - protein, 37 aa, Entamoeba histolytica; identical to SEQ ID NO: 2518536

SEQ ID NO: 2727873 - protein, 25 aa, Entamoeba histolytica
TDLTHPIEIPKLPWGLGMANKTIRG

SEQ ID NO: 2727874 - protein, 20 aa, Entamoeba histolytica
TDLYLWFCCAPHGPSIKFFV

SEQ ID NO: 2727875 - protein, 34 aa, Entamoeba histolytica
TDNLLVCQFITKCNVIIQTLPVTPELFVCDEMNQ

SEQ ID NO: 2727876 - protein, 18 aa, Entamoeba histolytica
TDNPVLIKMVNRFKRIFV

SEQ ID NO: 2727877 - protein, 28 aa, Entamoeba histolytica
TDPAIHHQFLSHYFFAFTNLGNTGINQF

SEQ ID NO: 2727878 - protein, 19 aa, Entamoeba histolytica
TDPHLLQKSAMKLYGLIHA

SEQ ID NO: 2727879 - protein, 25 aa, Entamoeba histolytica
TDPKLFMESLPKMNQDTLWYLCSFL

SEQ ID NO: 2727880 - protein, 26 aa, Entamoeba histolytica
TDPLLKPRTFLMWQNSSYPSSAAKID

SEQ ID NO: 2727881 - protein, 35 aa, Entamoeba histolytica; identical to SEQ ID NO: 2540864

SEQ ID NO: 2727882 - protein, 23 aa, Entamoeba histolytica
TDPRHLIEYYRRYIPKQVGTSKL

SEQ ID NO: 2727883 - protein, 24 aa, Entamoeba histolytica
TDPTKYRNIFPRGAKIIKYSNIPQ

SEQ ID NO: 2727884 - protein, 25 aa, Entamoeba histolytica
TDPVYRYFMKSLLPSQKQPNGRYFD

SEQ ID NO: 2727885 - protein, 19 aa, Entamoeba histolytica
TDQMQLFELLQLRCEEITK

SEQ ID NO: 2727886 - protein, 18 aa, Entamoeba histolytica
TDQQIDIPFIEERKSPPI

SEQ ID NO: 2727887 - protein, 26 aa, Entamoeba histolytica
TDREKFMFHQMLLKGELPLSIGGGIG

SEQ ID NO: 2727888 - protein, 26 aa, Entamoeba histolytica
TDSKKMIKLLPYIKTFEFDRINVIVI

SEQ ID NO: 2727889 - protein, 26 aa, Entamoeba histolytica
TDSVAWLISFGILNRIKTYILCIVPS

SEQ ID NO: 2727890 - protein, 20 aa, Entamoeba histolytica
TDTLADCFAFLETKGYKKRE

SEQ ID NO: 2727891 - protein, 17 aa, Entamoeba histolytica
TDTLPFTGRDRRLYLKA

SEQ ID NO: 2727892 - protein, 24 aa, Entamoeba histolytica
TDVDDKIILKARKNLLISKYCTAT

SEQ ID NO: 2727893 - protein, 20 aa, Entamoeba histolytica
TDVFLICYAVDDQNSFENIE

SEQ ID NO: 2727894 - protein, 21 aa, Entamoeba histolytica
TDVFLVCFSVIAPASYENVEG

SEQ ID NO: 2727895 - protein, 27 aa, Entamoeba histolytica
TDVLYGEPLFGSEIWIMEIKKQIDDFY

SEQ ID NO: 2727896 - protein, 24 aa, Entamoeba histolytica
TDYADLFEFFAKDPKVTSILMYIE

SEQ ID NO: 2727897 - protein, 17 aa, Entamoeba histolytica
TDYILLSAIVKKYLRET

SEQ ID NO: 2727898 - protein, 33 aa, Entamoeba histolytica
TDYIVRFFGHFFVDKDLWIVMEICGAGSVCDIM

SEQ ID NO: 2727899 - protein, 27 aa, Entamoeba histolytica
TDYLYSKYLLYLFNSEGLFIHDKQQCL

SEQ ID NO: 2727900 - protein, 18 aa, Entamoeba histolytica
TEAIACIFTSLIDWAFSP

SEQ ID NO: 2727901 - protein, 20 aa, Entamoeba histolytica
TEAKGWIDLTPGTEVKDLTQ

SEQ ID NO: 2727902 - protein, 22 aa, Entamoeba histolytica
TEAKKWCRPVTLYSIHHMSPSD

SEQ ID NO: 2727903 - protein, 25 aa, Entamoeba histolytica
TEAPPPPVPAPRRGLMLGRRDTQQT

SEQ ID NO: 2727904 - protein, 25 aa, Entamoeba histolytica
TEAPPPPVPAPRRGLMLGRRGGINE

SEQ ID NO: 2727905 - protein, 26 aa, Entamoeba histolytica
TECVNPFIPISFRPPLLTKQDLSLIP

SEQ ID NO: 2727906 - protein, 31 aa, Entamoeba histolytica
TEDCINLGVFIIPNLPKRKVGDVKFRVTCRV

SEQ ID NO: 2727907 - protein, 27 aa, Entamoeba histolytica
TEDERRRFCFFLAAVIQGVDNHADVLR

SEQ ID NO: 2727908 - protein, 25 aa, Entamoeba histolytica
TEDIIKNFWLVRRNSALLIDILQLS

SEQ ID NO: 2727909 - protein, 26 aa, Entamoeba histolytica
TEDKEHIIFAFNFFKGIGLVELAKPL

SEQ ID NO: 2727910 - protein, 17 aa, Entamoeba histolytica
TEDLCMTAAPYIDFLKL

SEQ ID NO: 2727911 - protein, 29 aa, Entamoeba histolytica
TEDLLYDYYNRLYIYPLEISFGKEKKRNP

SEQ ID NO: 2727912 - protein, 25 aa, Entamoeba histolytica
TEEAAWKAIIPQVQTINSFFEYSRS

SEQ ID NO: 2727913 - protein, 19 aa, Entamoeba histolytica
TEEALVDSMMFLLNIMDNK

SEQ ID NO: 2727914 - protein, 24 aa, Entamoeba histolytica
TEEDPSVSFIWKYDKTQPKTERIM

SEQ ID NO: 2727915 - protein, 25 aa, Entamoeba histolytica
TEEEEYLWLLTERKFMKVKMLQDRD

SEQ ID NO: 2727916 - protein, 23 aa, Entamoeba histolytica
TEEEPFPYSFYTDGIQITDNIPN

SEQ ID NO: 2727917 - protein, 25 aa, Entamoeba histolytica
TEEIDSFAPTWTKSGLRELRFLKTK

SEQ ID NO: 2727918 - protein, 24 aa, Entamoeba histolytica
TEELIPPPVPAPRKSKQPRLSASL

SEQ ID NO: 2727919 - protein, 17 aa, Entamoeba histolytica
TEEQFLKYFETFGPIRK

SEQ ID NO: 2727920 - protein, 27 aa, Entamoeba histolytica
TEESVIPGIIVLINDADWELVGMLDSE

SEQ ID NO: 2727921 - protein, 20 aa, Entamoeba histolytica
TEFAVQEIFMKYNTFMLRGD

SEQ ID NO: 2727922 - protein, 26 aa, Entamoeba histolytica
TEFHEKLFDLGFNIGMRMLEVINIRE

SEQ ID NO: 2727923 - protein, 27 aa, Entamoeba histolytica
TEFSTYYPYWRFEIIYMSHNNSFHFFN

SEQ ID NO: 2727924 - protein, 22 aa, Entamoeba histolytica
TEFTPITLLNFLQSTLSKNDFD

SEQ ID NO: 2727925 - protein, 24 aa, Entamoeba histolytica
TEGLDIFQFHLGSHLKYLSIMRGK

SEQ ID NO: 2727926 - protein, 25 aa, Entamoeba histolytica
TEGSKITVIKLKTPTYLISKETQAK

SEQ ID NO: 2727927 - protein, 18 aa, Entamoeba histolytica
TEGVLLRMVLNDLMKQSQ

SEQ ID NO: 2727928 - protein, 26 aa, Entamoeba histolytica
TEHVEQIWCKLLCYCIGEIFNQHEDV

SEQ ID NO: 2727929 - protein, 26 aa, Entamoeba histolytica
TEHWKFLHNYILHRDCILDLACSPWD

SEQ ID NO: 2727930 - protein, 25 aa, Entamoeba histolytica
TEHWKSMWQELQGEFKISTIAKVDL

SEQ ID NO: 2727931 - protein, 27 aa, Entamoeba histolytica
TEIDLPTPAYLKPKKLWTGKQLYGLAL

SEQ ID NO: 2727932 - protein, 33 aa, Entamoeba histolytica
TEIILYLCACKINYPHRFFLLRGNHESRIMSEN

SEQ ID NO: 2727933 - protein, 26 aa, Entamoeba histolytica
TEIIQYIKNILPLKKGQLLYSSFLIG

SEQ ID NO: 2727934 - protein, 21 aa, Entamoeba histolytica
TEIKLFPSLIFKSSKCVFGGN

SEQ ID NO: 2727935 - protein, 28 aa, Entamoeba histolytica
TEINIQKYIILCVLLRSIHPVYIEMTNA

SEQ ID NO: 2727936 - protein, 21 aa, Entamoeba histolytica
TEIPACVFKLKNLEIFEMERN

SEQ ID NO: 2727937 - protein, 21 aa, Entamoeba histolytica
TEIPKFLVKVLVDFASTTFTI

SEQ ID NO: 2727938 - protein, 22 aa, Entamoeba histolytica
TEIRLSLIHFIEGMLQYDPMKR

SEQ ID NO: 2727939 - protein, 22 aa, Entamoeba histolytica
TEIYYNVWRIKERILCIGTSRQ

SEQ ID NO: 2727940 - protein, 24 aa, Entamoeba histolytica
TEKDKVNCAFFFKIGACRHGDSCT

SEQ ID NO: 2727941 - protein, 18 aa, Entamoeba histolytica
TEKDNVWIIMELCNAGSL

SEQ ID NO: 2727942 - protein, 28 aa, Entamoeba histolytica
TEKENYIFLFNDFGKFINWLTQLGLNMK

SEQ ID NO: 2727943 - protein, 22 aa, Entamoeba histolytica
TEKFFEAIEPYLISLENKRKPQ

SEQ ID NO: 2727944 - protein, 21 aa, Entamoeba histolytica
TEKFHYNPIENLKLFPNIQTQ

SEQ ID NO: 2727945 - protein, 27 aa, Entamoeba histolytica
TEKGNYQYIVFKFNVVNGLYVSEIEIN

SEQ ID NO: 2727946 - protein, 28 aa, Entamoeba histolytica
TEKGNYQYIVFKFNVVNGLYVSEIEINT

SEQ ID NO: 2727947 - protein, 28 aa, Entamoeba histolytica
TEKIRNPIFSFIFTIPFGYYEVKVIEAK

SEQ ID NO: 2727948 - protein, 27 aa, Entamoeba histolytica
TEKKTLPLSVFDNSSPVLGKRKEMTGI

SEQ ID NO: 2727949 - protein, 25 aa, Entamoeba histolytica
TEKLEELCFIFTSLSLLSEQAEKEN

SEQ ID NO: 2727950 - protein, 27 aa, Entamoeba histolytica
TEKNYKVNIPPFIYLSQPSHLVKHKTD

SEQ ID NO: 2727951 - protein, 23 aa, Entamoeba histolytica
TEKPETFTVFFGKKQQNQVSKSK

SEQ ID NO: 2727952 - protein, 25 aa, Entamoeba histolytica
TEKTKFWNNFLSKGIIEYVDADEEE

SEQ ID NO: 2727953 - protein, 38 aa, Entamoeba histolytica
TEKYVKIVTDFFPSLPLTIFQICNVYRELIIKHLPNLP

SEQ ID NO: 2727954 - protein, 28 aa, Entamoeba histolytica
TELIEIKLSFILLTLKNLNIKKVPKPYL

SEQ ID NO: 2727955 - protein, 24 aa, Entamoeba histolytica
TELKKSFYNIISLTSIKLSNNKIR

SEQ ID NO: 2727956 - protein, 27 aa, Entamoeba histolytica
TELLHLLQDLLREKGFIFISKFTDGKN

SEQ ID NO: 2727957 - protein, 29 aa, Entamoeba histolytica
TELQRAKVGIPLYFVYTPLCNEVNRYDIP

SEQ ID NO: 2727958 - protein, 18 aa, Entamoeba histolytica
TELQRYVLKYFLTLCEDF

SEQ ID NO: 2727959 - protein, 18 aa, Entamoeba histolytica
TELRKIMNIAIPPTIPFI

SEQ ID NO: 2727960 - protein, 26 aa, Entamoeba histolytica
TELTDRILSMFKIKPTYTFNMLNLEL

SEQ ID NO: 2727961 - protein, 30 aa, Entamoeba histolytica
TENCHKIYITYFLQLLRQSFPTKEIVIVFH

SEQ ID NO: 2727962 - protein, 25 aa, Entamoeba histolytica
TENGFSEYLVLIPPGIISGTKINSS

SEQ ID NO: 2727963 - protein, 30 aa, Entamoeba histolytica; identical to SEQ ID NO: 2540943

SEQ ID NO: 2727964 - protein, 24 aa, Entamoeba histolytica
TENILLAAHMLGYGAVWLGVYPEK

SEQ ID NO: 2727965 - protein, 28 aa, Entamoeba histolytica
TENNHCKFVWLFLLRNAFYKNCRMVLDL

SEQ ID NO: 2727966 - protein, 17 aa, Entamoeba histolytica
TENTFKYDLLESPIPEI

SEQ ID NO: 2727967 - protein, 18 aa, Entamoeba histolytica
TEPIYVKDPLKAVIPGVH

SEQ ID NO: 2727968 - protein, 34 aa, Entamoeba histolytica
TEPTLFFNSKYYIKEHTFLLLYNGAFDEAIIKNH

SEQ ID NO: 2727969 - protein, 18 aa, Entamoeba histolytica
TEQFIGFGYLSVENILSM

SEQ ID NO: 2727970 - protein, 22 aa, Entamoeba histolytica
TEQIWQFIPENIQQQLRSEFEF

SEQ ID NO: 2727971 - protein, 17 aa, Entamoeba histolytica
TEQLVKISSIILTSGET

SEQ ID NO: 2727972 - protein, 23 aa, Entamoeba histolytica
TEQQFELMLRELSFKNYQIDISL

SEQ ID NO: 2727973 - protein, 19 aa, Entamoeba histolytica
TEQVLLLSAFISGISGAVE

SEQ ID NO: 2727974 - protein, 31 aa, Entamoeba histolytica
TEQVMERFMKVMYLEKVLSEMLIINSHGSIS

SEQ ID NO: 2727975 - protein, 20 aa, Entamoeba histolytica
TERILIPSINECTVEWNIKG

SEQ ID NO: 2727976 - protein, 25 aa, Entamoeba histolytica
TERILIPSINECTVEWNIKGEITPK

SEQ ID NO: 2727977 - protein, 17 aa, Entamoeba histolytica
TERLIRILKLEYDGFVF

SEQ ID NO: 2727978 - protein, 23 aa, Entamoeba histolytica
TERLLKLMKHFKTLILDTTIQKY

SEQ ID NO: 2727979 - protein, 27 aa, Entamoeba histolytica
TESELRRLFRRFKKLGMKAKEGASEEY

SEQ ID NO: 2727980 - protein, 30 aa, Entamoeba histolytica
TESFSLIDSFILHPLLFHKIENAHIISSLG

SEQ ID NO: 2727981 - protein, 23 aa, Entamoeba histolytica
TESIPFEFLELYSDLKTLQISTG

SEQ ID NO: 2727982 - protein, 24 aa, Entamoeba histolytica
TESKAWPDYVFLKGTSFSSSNKDK

SEQ ID NO: 2727983 - protein, 31 aa, Entamoeba histolytica
TESKRMKGIYIRDLYLNLSTSAVPIYRFQCL

SEQ ID NO: 2727984 - protein, 23 aa, Entamoeba histolytica
TESLIKENLSIKEIIKQVELESD

SEQ ID NO: 2727985 - protein, 23 aa, Entamoeba histolytica
TESTNILISFLKKMGYNFQSRLT

SEQ ID NO: 2727986 - protein, 23 aa, Entamoeba histolytica
TESTSKIRWQSFNGKIYVDYNSK

SEQ ID NO: 2727987 - protein, 27 aa, Entamoeba histolytica
TETESTFKRILPYALLKYLEEEEEPPE

SEQ ID NO: 2727988 - protein, 32 aa, Entamoeba histolytica
TETKWKWRYDKYDLIFYISQVPCGDCCISSNG

SEQ ID NO: 2727989 - protein, 23 aa, Entamoeba histolytica
TETLHLIMDLLSEFGYFFQTRTT

SEQ ID NO: 2727990 - protein, 17 aa, Entamoeba histolytica
TETLSQPGSASAGVSST

SEQ ID NO: 2727991 - protein, 23 aa, Entamoeba histolytica
TETLTLIQIGILNAIKPIQNEMT

SEQ ID NO: 2727992 - protein, 24 aa, Entamoeba histolytica
TETVILLHFHMDPPVIIQNRPISD

SEQ ID NO: 2727993 - protein, 19 aa, Entamoeba histolytica
TETYVIINPILRIIKDLRE

SEQ ID NO: 2727994 - protein, 31 aa, Entamoeba histolytica
TEVKALLNIRIHLLLEYYTINKAISTSHDND

SEQ ID NO: 2727995 - protein, 22 aa, Entamoeba histolytica
TEVKIGIRIKINDKVLTTIEID

SEQ ID NO: 2727996 - protein, 24 aa, Entamoeba histolytica
TEVLDYFNIPIDNPCILLMQETSK

SEQ ID NO: 2727997 - protein, 29 aa, Entamoeba histolytica
TEVLKLYLRSLPFPLLHPSKEYLGSVNVD

SEQ ID NO: 2727998 - protein, 22 aa, Entamoeba histolytica
TEVPLLSLLRITVKMNLNQIEF

SEQ ID NO: 2727999 - protein, 28 aa, Entamoeba histolytica
TEVPPPVPAPRRGLTLGRRSTTNIPSED

SEQ ID NO: 2728000 - protein, 30 aa, Entamoeba histolytica
TEVRELVEYPLLHPEIYKHLGIEPPRGILL

SEQ ID NO: 2728001 - protein, 23 aa, Entamoeba histolytica
TEVTPFSILNLPNGTKKSIKAHM

SEQ ID NO: 2728002 - protein, 24 aa, Entamoeba histolytica
TEYDELSIRRIVEKNTIEDLDKYK

SEQ ID NO: 2728003 - protein, 21 aa, Entamoeba histolytica
TEYEIECDCLLLSVGLIPLPD

SEQ ID NO: 2728004 - protein, 25 aa, Entamoeba histolytica
TEYNKLWKFIDSNLVLLFSSEPTKI

SEQ ID NO: 2728005 - protein, 17 aa, Entamoeba histolytica
TEYVVLNSNLRVVGIEG

SEQ ID NO: 2728006 - protein, 17 aa, Entamoeba histolytica
TFAFKYTELENELCIGG

SEQ ID NO: 2728007 - protein, 17 aa, Entamoeba histolytica
TFASFVSPILYLINTTD

SEQ ID NO: 2728008 - protein, 19 aa, Entamoeba histolytica
TFCEFYPDYIDFGGKCLPI

SEQ ID NO: 2728009 - protein, 26 aa, Entamoeba histolytica
TFCYAATVALNMSLLCGVTLCGGAHA

SEQ ID NO: 2728010 - protein, 19 aa, Entamoeba histolytica
TFCYDLINGIIGLCGSSSP

SEQ ID NO: 2728011 - protein, 17 aa, Entamoeba histolytica
TFCYKECYYAISNDGII

SEQ ID NO: 2728012 - protein, 31 aa, Entamoeba histolytica; identical to SEQ ID NO: 2540981

SEQ ID NO: 2728013 - protein, 18 aa, Entamoeba histolytica
TFDIDVNGIVKVSALDKG

SEQ ID NO: 2728014 - protein, 21 aa, Entamoeba histolytica
TFDPSLIQRYDLWDSRNTIFN

SEQ ID NO: 2728015 - protein, 19 aa, Entamoeba histolytica
TFEEDFIMKLIGSKAPDNS

SEQ ID NO: 2728016 - protein, 27 aa, Entamoeba histolytica
TFELPKQSLAFLRRKSIETKPISETQT

SEQ ID NO: 2728017 - protein, 24 aa, Entamoeba histolytica
TFELQIQFLLQIIEKIPMPIIAND

SEQ ID NO: 2728018 - protein, 19 aa, Entamoeba histolytica
TFELVISLLPKYEEFIIPH

SEQ ID NO: 2728019 - protein, 30 aa, Entamoeba histolytica; identical to SEQ ID NO: 2540989

SEQ ID NO: 2728020 - protein, 20 aa, Entamoeba histolytica
TFEYHPPQHSIPIITPTVGS

SEQ ID NO: 2728021 - protein, 18 aa, Entamoeba histolytica
TFFIVKYDQVFYENRPLT

SEQ ID NO: 2728022 - protein, 38 aa, Entamoeba histolytica
TFFTPDSLFLQLYHAYAKEFLMNYLLASLKPSLEELVK

SEQ ID NO: 2728023 - protein, 17 aa, Entamoeba histolytica
TFFTYFYDKFQALDNGI

SEQ ID NO: 2728024 - protein, 21 aa, Entamoeba histolytica
TFFVALIDNYYELFPDFSDRK

SEQ ID NO: 2728025 - protein, 17 aa, Entamoeba histolytica
TFHFRLIDTSGDSQFNV

SEQ ID NO: 2728026 - protein, 18 aa, Entamoeba histolytica
TFIADKKSYSLLKQHDIF

SEQ ID NO: 2728027 - protein, 25 aa, Entamoeba histolytica
TFIENLHHKYIRPLNLHILCNQSIE

SEQ ID NO: 2728028 - protein, 26 aa, Entamoeba histolytica
TFIKGMYTFLKLMGREPTIINLDPAN

SEQ ID NO: 2728029 - protein, 20 aa, Entamoeba histolytica
TFILFEKLMTILGVFYEQKR

SEQ ID NO: 2728030 - protein, 18 aa, Entamoeba histolytica
TFINLRPFTDSKTVSHLH

SEQ ID NO: 2728031 - protein, 19 aa, Entamoeba histolytica
TFINYLLNYDYPGSHIGPE

SEQ ID NO: 2728032 - protein, 34 aa, Entamoeba histolytica
TFIRHLYDNYNIIGPFLVIVPLSTISNWSKEFNK

SEQ ID NO: 2728033 - protein, 27 aa, Entamoeba histolytica
TFITKLPKYIHLLVNIKTLVLLESYHP

SEQ ID NO: 2728034 - protein, 27 aa, Entamoeba histolytica
TFKNEFKIVLLPVENKYLFPKSIKRPS

SEQ ID NO: 2728035 - protein, 23 aa, Entamoeba histolytica
TFKPNPYLLYNTLTKKVTYLERH

SEQ ID NO: 2728036 - protein, 26 aa, Entamoeba histolytica
TFKSQVYTFVWCKQVSTFFNSPHPEE

SEQ ID NO: 2728037 - protein, 17 aa, Entamoeba histolytica
TFKTILLIKQPLYIIET

SEQ ID NO: 2728038 - protein, 30 aa, Entamoeba histolytica
TFKVIEGMIPFNMDQAIPLVALNCLVEYGS

SEQ ID NO: 2728039 - protein, 17 aa, Entamoeba histolytica
TFKVQLTPLINTIVHIN

SEQ ID NO: 2728040 - protein, 26 aa, Entamoeba histolytica
TFLKKIHIMEYLQFLIKNSRLIKEQF

SEQ ID NO: 2728041 - protein, 17 aa, Entamoeba histolytica
TFLKMREFPKYTVKSSG

SEQ ID NO: 2728042 - protein, 19 aa, Entamoeba histolytica
TFLMGYPQKNYTQEPLLPM

SEQ ID NO: 2728043 - protein, 25 aa, Entamoeba histolytica
TFLNTLLYEWYELRKLKAIDYRVLK

SEQ ID NO: 2728044 - protein, 18 aa, Entamoeba histolytica
TFLPAIESGTIILIGATT

SEQ ID NO: 2728045 - protein, 17 aa, Entamoeba histolytica
TFLSYMGKNQPFSQFFH

SEQ ID NO: 2728046 - protein, 38 aa, Entamoeba histolytica
TFMANMTYACSILYKTKLPLIIVFTKTDVIPCTKLNQW

SEQ ID NO: 2728047 - protein, 23 aa, Entamoeba histolytica
TFMKYYSLVIELLFINPQYQTIC

SEQ ID NO: 2728048 - protein, 17 aa, Entamoeba histolytica
TFNCFDWDNAFKFSSDD

SEQ ID NO: 2728049 - protein, 21 aa, Entamoeba histolytica
TFNEYPFFKMIRNWINALGDL

SEQ ID NO: 2728050 - protein, 27 aa, Entamoeba histolytica
TFNQIPLIDIIHFLPHILTSFLESKMV

SEQ ID NO: 2728051 - protein, 36 aa, Entamoeba histolytica
TFNSYVILPVQRIPRYRLLLQELLKTLPPQHSEYNS

SEQ ID NO: 2728052 - protein, 17 aa, Entamoeba histolytica
TFNTLIISPAYWPELNS

SEQ ID NO: 2728053 - protein, 17 aa, Entamoeba histolytica
TFPLLTIKFVHRCTPDG

SEQ ID NO: 2728054 - protein, 27 aa, Entamoeba histolytica
TFRGIPDWDWFYQFNAPPEITDLIQHC

SEQ ID NO: 2728055 - protein, 19 aa, Entamoeba histolytica
TFSCGHSFCLVCVRQIFRK

SEQ ID NO: 2728056 - protein, 27 aa, Entamoeba histolytica
TFSDLWDIFDIILINVEGEYKEIYEPY

SEQ ID NO: 2728057 - protein, 18 aa, Entamoeba histolytica
TFSINKKWCRSIKSTQEC

SEQ ID NO: 2728058 - protein, 19 aa, Entamoeba histolytica
TFSPSLLSEFVPLLYKVIA

SEQ ID NO: 2728059 - protein, 18 aa, Entamoeba histolytica
TFSQIIFTILISVGDTSD

SEQ ID NO: 2728060 - protein, 32 aa, Entamoeba histolytica
TFSSNLKVFLYNKLFRYLWPPSISQLENLDYT

SEQ ID NO: 2728061 - protein, 26 aa, Entamoeba histolytica
TFSYHHNFIYFNKLNYLNIFINDSIE

SEQ ID NO: 2728062 - protein, 18 aa, Entamoeba histolytica
TFTILLKGFKNKTPEEVC

SEQ ID NO: 2728063 - protein, 17 aa, Entamoeba histolytica
TFTLIYEPQIISEIIIF

SEQ ID NO: 2728064 - protein, 23 aa, Entamoeba histolytica
TFTSQPLVLSFMSSLRSIRFEDG

SEQ ID NO: 2728065 - protein, 25 aa, Entamoeba histolytica
TFTSSTFIMVIFSNPCLTFTNVAMN

SEQ ID NO: 2728066 - protein, 33 aa, Entamoeba histolytica
TFVEKEKFIPIYNKIILILVKLDLLSPENFPLL

SEQ ID NO: 2728067 - protein, 40 aa, Entamoeba histolytica
TFVKVICYLNRKTLPYIPQILSLYLKLFKTCTISVRPALI

SEQ ID NO: 2728068 - protein, 30 aa, Entamoeba histolytica
TFYQQTIDILLFSILILLSTNGHPNAIAEQ

SEQ ID NO: 2728069 - protein, 23 aa, Entamoeba histolytica
TGAQPYPAYNAQQPTLNLPNNNQ

SEQ ID NO: 2728070 - protein, 21 aa, Entamoeba histolytica
TGCLYSFIKKLLDSDYKVMDE

SEQ ID NO: 2728071 - protein, 23 aa, Entamoeba histolytica
TGDILWAILRIVNSVAFIIETTE

SEQ ID NO: 2728072 - protein, 23 aa, Entamoeba histolytica
TGDRSVFDLSPESKPFLGMAAAV

SEQ ID NO: 2728073 - protein, 19 aa, Entamoeba histolytica
TGDTTYYEPFWKRISEEPK

SEQ ID NO: 2728074 - protein, 25 aa, Entamoeba histolytica
TGEIPPPPPLHMDSSGNPILSSSPR

SEQ ID NO: 2728075 - protein, 22 aa, Entamoeba histolytica
TGETVYIFYTLNKKLTLNHLNS

SEQ ID NO: 2728076 - protein, 24 aa, Entamoeba histolytica
TGFDGSMIYYYEKVADAKFIEELS

SEQ ID NO: 2728077 - protein, 18 aa, Entamoeba histolytica
TGFLLAGIGSIDRMKRTN

SEQ ID NO: 2728078 - protein, 19 aa, Entamoeba histolytica
TGFSFTLKQLDGRELFIES

SEQ ID NO: 2728079 - protein, 30 aa, Entamoeba histolytica
TGFYQKLYEKKVLFLPLSCPKHIIKEIIKD

SEQ ID NO: 2728080 - protein, 17 aa, Entamoeba histolytica
TGGFFTAVFIKKGETPA

SEQ ID NO: 2728081 - protein, 35 aa, Entamoeba histolytica
TGGGKSLCYQLPSYFIKGITLVVSPLVSLIQDQVS

SEQ ID NO: 2728082 - protein, 19 aa, Entamoeba histolytica
TGGIVLFKWGQGKLRGEPI

SEQ ID NO: 2728083 - protein, 18 aa, Entamoeba histolytica
TGGLREKLAIYKKYGVEM

SEQ ID NO: 2728084 - protein, 22 aa, Entamoeba histolytica
TGHIVLSTLILKGYYHVCMDKF

SEQ ID NO: 2728085 - protein, 22 aa, Entamoeba histolytica
TGHWDVFLMKIGEIKPVALLDL

SEQ ID NO: 2728086 - protein, 20 aa, Entamoeba histolytica
TGHWDVFLMKIGEIKPVAVW

SEQ ID NO: 2728087 - protein, 21 aa, Entamoeba histolytica
TGHWDVFLMKIGEIKPVAVWR

SEQ ID NO: 2728088 - protein, 24 aa, Entamoeba histolytica
TGIKMILNMLISHPLHGIMIPIPQ

SEQ ID NO: 2728089 - protein, 35 aa, Entamoeba histolytica
TGITHYPLHTIAFKSSYCIPLILVRCFKIIDECEY

SEQ ID NO: 2728090 - protein, 19 aa, Entamoeba histolytica
TGITLSEYYRDMGYNVAMM

SEQ ID NO: 2728091 - protein, 18 aa, Entamoeba histolytica
TGIVFPSQRMRGGPLKKG

SEQ ID NO: 2728092 - protein, 27 aa, Entamoeba histolytica
TGKALHAYIFIGPVYYQKLKHMVLDKM

SEQ ID NO: 2728093 - protein, 23 aa, Entamoeba histolytica
TGKEDITFPMFFVDSQPDEGGDN

SEQ ID NO: 2728094 - protein, 27 aa, Entamoeba histolytica
TGKEFEGRAVYLEYANTKKKGYRHGDT

SEQ ID NO: 2728095 - protein, 21 aa, Entamoeba histolytica
TGKGLTFYISGVVTGICVIHT

SEQ ID NO: 2728096 - protein, 35 aa, Entamoeba histolytica
TGKIARVDGKFWHPQCFICSLCNKPIEGDFIEKGQ

SEQ ID NO: 2728097 - protein, 21 aa, Entamoeba histolytica
TGKIENLYWREKLAEIVIGMK

SEQ ID NO: 2728098 - protein, 20 aa, Entamoeba histolytica
TGKIYQYNFINQNQSYIEVS

SEQ ID NO: 2728099 - protein, 18 aa, Entamoeba histolytica
TGKKWTPKVAPAPEVPQP

SEQ ID NO: 2728100 - protein, 28 aa, Entamoeba histolytica
TGKMKRRFFYLLQFNRELIYYKQQQVRF

SEQ ID NO: 2728101 - protein, 25 aa, Entamoeba histolytica
TGKQVFTQILPTINFHRGNWSIKEL

SEQ ID NO: 2728102 - protein, 18 aa, Entamoeba histolytica
TGKSQLLKFASKLGPRHV

SEQ ID NO: 2728103 - protein, 30 aa, Entamoeba histolytica
TGKTMLCNLLFEYLDYYTPAAYIKEYIDYN

SEQ ID NO: 2728104 - protein, 20 aa, Entamoeba histolytica
TGLSNLLRKVEGKELHEPKK

SEQ ID NO: 2728105 - protein, 20 aa, Entamoeba histolytica
TGMYYDVALTNPFGIELEKI

SEQ ID NO: 2728106 - protein, 23 aa, Entamoeba histolytica
TGNDIIFFWVARMVMMSLELMDC

SEQ ID NO: 2728107 - protein, 24 aa, Entamoeba histolytica
TGNDIIFFWVARMVMMSLELMDCL

SEQ ID NO: 2728108 - protein, 30 aa, Entamoeba histolytica
TGNTKNIQTFWSLLKQTLIEQRLVYDDTKE

SEQ ID NO: 2728109 - protein, 28 aa, Entamoeba histolytica
TGNVIKMNLFKPPKFAYSMDYRYWTVEQ

SEQ ID NO: 2728110 - protein, 23 aa, Entamoeba histolytica
TGPLQKFLIRRITLLRAHESDSE

SEQ ID NO: 2728111 - protein, 20 aa, Entamoeba histolytica
TGQCLFYKCYHLTKIVLPEV

SEQ ID NO: 2728112 - protein, 19 aa, Entamoeba histolytica
TGQDPFEFAPLFIFGEQSH

SEQ ID NO: 2728113 - protein, 18 aa, Entamoeba histolytica
TGRIQPFNRMGLSRGRAG

SEQ ID NO: 2728114 - protein, 34 aa, Entamoeba histolytica
TGSFMIRGKKNYLPPVPLVFGIGIMFAVEKEDKE

SEQ ID NO: 2728115 - protein, 30 aa, Entamoeba histolytica; identical to SEQ ID NO: 2541077

SEQ ID NO: 2728116 - protein, 22 aa, Entamoeba histolytica
TGSNPFGNFTNTITSSATTPNT

SEQ ID NO: 2728117 - protein, 21 aa, Entamoeba histolytica
TGTDPVPHYKANQPFKCVPVK

SEQ ID NO: 2728118 - protein, 31 aa, Entamoeba histolytica; identical to SEQ ID NO: 2541078

SEQ ID NO: 2728119 - protein, 26 aa, Entamoeba histolytica
TGTLRVKKFLLFLRELIEEKQNNIER

SEQ ID NO: 2728120 - protein, 24 aa, Entamoeba histolytica
TGTPHIHCLVLFNAAKRNIIYEDG

SEQ ID NO: 2728121 - protein, 33 aa, Entamoeba histolytica
TGTPLQNTLHELWSLLQFLLPEIFNTKELDEIF

SEQ ID NO: 2728122 - protein, 22 aa, Entamoeba histolytica
TGTQFKCYPLYDFGVSIIDSIE

SEQ ID NO: 2728123 - protein, 25 aa, Entamoeba histolytica
TGTRTFVLSFIFRNIIQSISINSFD

SEQ ID NO: 2728124 - protein, 17 aa, Entamoeba histolytica
TGVAFIVKTLDGRELFI

SEQ ID NO: 2728125 - protein, 30 aa, Entamoeba histolytica
TGVGDTLTYILLSWIIKGIPLEHAVNRAIS

SEQ ID NO: 2728126 - protein, 19 aa, Entamoeba histolytica
TGVSPKSALFAKRLNGNES

SEQ ID NO: 2728127 - protein, 20 aa, Entamoeba histolytica
TGVSPKSALFAKRLNGNESE

SEQ ID NO: 2728128 - protein, 19 aa, Entamoeba histolytica
THCIWPVEKQILSSSLDGT

SEQ ID NO: 2728129 - protein, 20 aa, Entamoeba histolytica
THDGYLIFKMNPKDFTKSSI

SEQ ID NO: 2728130 - protein, 30 aa, Entamoeba histolytica
THDYSILDQLIFLQKLIKQYPFLIDGCDII

SEQ ID NO: 2728131 - protein, 27 aa, Entamoeba histolytica
THEETLEFIQWLYSLGISIISLHGRHH

SEQ ID NO: 2728132 - protein, 25 aa, Entamoeba histolytica
THEQFKIIYIAPMKSLVQEIVGTLQ

SEQ ID NO: 2728133 - protein, 43 aa, Entamoeba histolytica
THFHVDHVGMLPWLTKFMDVPIYLSEPTQALLSLIINDIHSGN

SEQ ID NO: 2728134 - protein, 22 aa, Entamoeba histolytica
THFPKLEWLDLSYNSISVLENI

SEQ ID NO: 2728135 - protein, 27 aa, Entamoeba histolytica
THGYIPISELPFITKIYLPSPKEEGSY

SEQ ID NO: 2728136 - protein, 18 aa, Entamoeba histolytica
THGYPFNTITFYDTQHWN

SEQ ID NO: 2728137 - protein, 19 aa, Entamoeba histolytica
THHKTNLSCFIKLFQRFGE

SEQ ID NO: 2728138 - protein, 30 aa, Entamoeba histolytica
THIMKINLTIPFWWKDDLFPYIVEHRSYSP

SEQ ID NO: 2728139 - protein, 25 aa, Entamoeba histolytica
THKFCSKMIEHISKLIGIMQFSSNK

SEQ ID NO: 2728140 - protein, 25 aa, Entamoeba histolytica
THKLKITILQYMKLLMDNDIKGPHL

SEQ ID NO: 2728141 - protein, 36 aa, Entamoeba histolytica
THKRIELKSFYLDKNMNIFLGDYYFSANKNYPLMNG

SEQ ID NO: 2728142 - protein, 18 aa, Entamoeba histolytica
THKYGHVTYFWNGNKSGY

SEQ ID NO: 2728143 - protein, 57 aa, Entamoeba histolytica; identical to SEQ ID NO: 2541103

SEQ ID NO: 2728144 - protein, 28 aa, Entamoeba histolytica
THLSKGYGFIYFYTSIIANIVIENCNEK

SEQ ID NO: 2728145 - protein, 19 aa, Entamoeba histolytica
THLTMYNILTKFQAIMHIN

SEQ ID NO: 2728146 - protein, 23 aa, Entamoeba histolytica
THNKLSMLPPGLGSLKSLDTLEL

SEQ ID NO: 2728147 - protein, 28 aa, Entamoeba histolytica
THNPITRLRKLFEALFGCLKRGTRAVFQ

SEQ ID NO: 2728148 - protein, 29 aa, Entamoeba histolytica
THQSCVSKLPFKFTLSFRSGNNIKIGAVV

SEQ ID NO: 2728149 - protein, 27 aa, Entamoeba histolytica
THSDAVSLLLYYLVFNLPINKRNDLLN

SEQ ID NO: 2728150 - protein, 23 aa, Entamoeba histolytica
THVIPEFHNFQAVIGPNGAGKSN

SEQ ID NO: 2728151 - protein, 26 aa, Entamoeba histolytica
THWKQTLFFLKNPLKCKLGDQIKGLY

SEQ ID NO: 2728152 - protein, 21 aa, Entamoeba histolytica
THYLAIQFRHPSTNDLHFCLV

SEQ ID NO: 2728153 - protein, 33 aa, Entamoeba histolytica
THYNPAFVMPLFRKTIIRLLTQLQFINDLKTDE

SEQ ID NO: 2728154 - protein, 17 aa, Entamoeba histolytica
THYSKKCHFVGMKPNEQ

SEQ ID NO: 2728155 - protein, 18 aa, Entamoeba histolytica
TIACNLNPYIHCQRFIQC

SEQ ID NO: 2728156 - protein, 17 aa, Entamoeba histolytica
TIAEYLKRYVEEKGINR

SEQ ID NO: 2728157 - protein, 25 aa, Entamoeba histolytica
TIAIDPWKLALKRKEQKRRNEEKDI

SEQ ID NO: 2728158 - protein, 23 aa, Entamoeba histolytica
TIAINVIAEFKFLLEVFQMEENG

SEQ ID NO: 2728159 - protein, 18 aa, Entamoeba histolytica
TIAIPVVSQIHQCLPKDF

SEQ ID NO: 2728160 - protein, 20 aa, Entamoeba histolytica
TIAIYSLLISKLTNIIPHVL

SEQ ID NO: 2728161 - protein, 24 aa, Entamoeba histolytica
TIALQFALEKISLIRPTKFSFVPV

SEQ ID NO: 2728162 - protein, 18 aa, Entamoeba histolytica
TIASIQDLVTSKIEACQK

SEQ ID NO: 2728163 - protein, 19 aa, Entamoeba histolytica
TICQKLYPNQWKKISTFIP

SEQ ID NO: 2728164 - protein, 20 aa, Entamoeba histolytica
TIDFFNALGVRIAELTLIHR

SEQ ID NO: 2728165 - protein, 18 aa, Entamoeba histolytica
TIDFIKIPTFYKVQYKWD

SEQ ID NO: 2728166 - protein, 24 aa, Entamoeba histolytica
TIDGFFQILHQLIMYHNNLEIVQT

SEQ ID NO: 2728167 - protein, 23 aa, Entamoeba histolytica
TIDGLTIIVKIPPSVPGQVSVNI

SEQ ID NO: 2728168 - protein, 17 aa, Entamoeba histolytica
TIDHPLVQLPSNSLTFY

SEQ ID NO: 2728169 - protein, 19 aa, Entamoeba histolytica
TIDILFPVEIGYDIKGPQL

SEQ ID NO: 2728170 - protein, 31 aa, Entamoeba histolytica; identical to SEQ ID NO: 2541128

SEQ ID NO: 2728171 - protein, 19 aa, Entamoeba histolytica
TIDVILVNGFLKRGDRIVV

SEQ ID NO: 2728172 - protein, 19 aa, Entamoeba histolytica
TIEGIYLPDEFFSRKDMHI

SEQ ID NO: 2728173 - protein, 36 aa, Entamoeba histolytica
TIEKEFEVIIPLDDLLPFAAMKMFPNGIYGNLTLEV

SEQ ID NO: 2728174 - protein, 24 aa, Entamoeba histolytica
TIERFLTSLIPIYGQYQEIRCYCN

SEQ ID NO: 2728175 - protein, 24 aa, Entamoeba histolytica
TIERQLICIYLANIFNKLNVSPNK

SEQ ID NO: 2728176 - protein, 26 aa, Entamoeba histolytica
TIETPMKGLLWWLSKIGFDGICQELA

SEQ ID NO: 2728177 - protein, 34 aa, Entamoeba histolytica
TIEYKPDWSRGYSRKAFALLKLERYEEAEEVCNS

SEQ ID NO: 2728178 - protein, 24 aa, Entamoeba histolytica
TIEYLKALHPPFVTFVASGNEITC

SEQ ID NO: 2728179 - protein, 18 aa, Entamoeba histolytica
TIEYQLFKALFKTRLIQN

SEQ ID NO: 2728180 - protein, 24 aa, Entamoeba histolytica
TIEYSNLNRQFLFRKKDVGRPKSE

SEQ ID NO: 2728181 - protein, 20 aa, Entamoeba histolytica
TIFDIPQCMGMIGGKPGYAH

SEQ ID NO: 2728182 - protein, 18 aa, Entamoeba histolytica
TIFPYEVYESLIKVLHDT

SEQ ID NO: 2728183 - protein, 22 aa, Entamoeba histolytica
TIFRYLPPQYYLSFIAINKRYQ

SEQ ID NO: 2728184 - protein, 19 aa, Entamoeba histolytica
TIGCFIRKPIESTNKCMSD

SEQ ID NO: 2728185 - protein, 28 aa, Entamoeba histolytica
TIGCTTNKIILLLKDFIKTFQESYFELK

SEQ ID NO: 2728186 - protein, 26 aa, Entamoeba histolytica
TIGDYDLNVWYFSPYPGEYGHAERLY

SEQ ID NO: 2728187 - protein, 23 aa, Entamoeba histolytica
TIGEDLMLLSKTQSFVHALESKR

SEQ ID NO: 2728188 - protein, 26 aa, Entamoeba histolytica
TIGELENKLMLQENNILQLKEEIVSK

SEQ ID NO: 2728189 - protein, 32 aa, Entamoeba histolytica
TIGSIQPLTFYLITPIQRIPRYELLIRDMLKD

SEQ ID NO: 2728190 - protein, 25 aa, Entamoeba histolytica
TIGSLYAMYQEEDGYLYFIVYRESV

SEQ ID NO: 2728191 - protein, 26 aa, Entamoeba histolytica
TIGSLYAMYQEEDGYLYFIVYRESVF

SEQ ID NO: 2728192 - protein, 28 aa, Entamoeba histolytica
TIGTRRPLYLQMFNNPKQRTPKCCFAND

SEQ ID NO: 2728193 - protein, 22 aa, Entamoeba histolytica
TIGVIHLVPIIIGNTYCITTLN

SEQ ID NO: 2728194 - protein, 23 aa, Entamoeba histolytica
TIGVIHLVPIIIGNTYCITTLNV

SEQ ID NO: 2728195 - protein, 25 aa, Entamoeba histolytica
TIGYEDILLFDSFTLLGRNYQKCFS

SEQ ID NO: 2728196 - protein, 18 aa, Entamoeba histolytica
TIGYWIKVDNIYQSLGDK

SEQ ID NO: 2728197 - protein, 28 aa, Entamoeba histolytica
TIHHSFDEIIPLFPNLQTFYVRRCPSRL

SEQ ID NO: 2728198 - protein, 29 aa, Entamoeba histolytica
TIHHSFDEIIPLFPNLQTFYVRRCPSRLY

SEQ ID NO: 2728199 - protein, 27 aa, Entamoeba histolytica
TIHHSFDEIIPLFPNLQTFYVRRCSER

SEQ ID NO: 2728200 - protein, 24 aa, Entamoeba histolytica
TIHLRPFIISTKYQQPLSPNESQS

SEQ ID NO: 2728201 - protein, 27 aa, Entamoeba histolytica
TIHLSLSNYIILLKLQQLCCLEIYDFR

SEQ ID NO: 2728202 - protein, 20 aa, Entamoeba histolytica
TIHSPLFQSLNSVIGRAIPL

SEQ ID NO: 2728203 - protein, 24 aa, Entamoeba histolytica
TIHTLLENFLLEYATTNDQEKIEI

SEQ ID NO: 2728204 - protein, 20 aa, Entamoeba histolytica
TIHYVFVVTLILANKKQYHL

SEQ ID NO: 2728205 - protein, 21 aa, Entamoeba histolytica
TIHYVFVVTLILANKKQYHLL

SEQ ID NO: 2728206 - protein, 17 aa, Entamoeba histolytica
TIIASPRKKPGKIYTVF

SEQ ID NO: 2728207 - protein, 18 aa, Entamoeba histolytica
TIIETPPMVVAGFVGYKK

SEQ ID NO: 2728208 - protein, 18 aa, Entamoeba histolytica
TIIGHFALPLNTLKIRVA

SEQ ID NO: 2728209 - protein, 19 aa, Entamoeba histolytica
TIIKLIYKLLSSQLQKPTY

SEQ ID NO: 2728210 - protein, 46 aa, Entamoeba histolytica
TIILQGKKNLFFKTGFDNKKLYYYKDLCCFCIEKDQLSSWMTIIKA

SEQ ID NO: 2728211 - protein, 20 aa, Entamoeba histolytica
TIIQDLVYQQVIYSFASFNI

SEQ ID NO: 2728212 - protein, 24 aa, Entamoeba histolytica
TIIQILNYILLGERIVFTSSDNAL

SEQ ID NO: 2728213 - protein, 20 aa, Entamoeba histolytica
TIITCRPVPLSTRPNLFMQN

SEQ ID NO: 2728214 - protein, 29 aa, Entamoeba histolytica
TIITDNHIFLITPFLKGGALCHRLFYQPF

SEQ ID NO: 2728215 - protein, 20 aa, Entamoeba histolytica
TIITSHNFLQMASGSNLLVE

SEQ ID NO: 2728216 - protein, 20 aa, Entamoeba histolytica
TIIVNLHIWKALNASFKTQI

SEQ ID NO: 2728217 - protein, 18 aa, Entamoeba histolytica
TIKEFIRFGFIEMSQRCE

SEQ ID NO: 2728218 - protein, 18 aa, Entamoeba histolytica
TIKEFMYQVLLKVGSDEE

SEQ ID NO: 2728219 - protein, 22 aa, Entamoeba histolytica
TIKEIKILFLQLIKAVNYIHSK

SEQ ID NO: 2728220 - protein, 21 aa, Entamoeba histolytica
TIKGLVVAIADKLSLHHAEAF

SEQ ID NO: 2728221 - protein, 22 aa, Entamoeba histolytica
TIKIFGMIRGEQRLTLTGHIGA

SEQ ID NO: 2728222 - protein, 23 aa, Entamoeba histolytica
TIKPMWDVIFAFSGRLSLVDHIC

SEQ ID NO: 2728223 - protein, 19 aa, Entamoeba histolytica
TIKQLLFYLTPSTKKRASN

SEQ ID NO: 2728224 - protein, 28 aa, Entamoeba histolytica
TIKQRVIGKCWLVFNKPKYIESVRVIDG

SEQ ID NO: 2728225 - protein, 32 aa, Entamoeba histolytica
TIKTCDFLANELFKYLQKNCYLSFFDDNMDVK

SEQ ID NO: 2728226 - protein, 36 aa, Entamoeba histolytica
TIKTGNLFINYLYLLLKEYTYIIEIPCTLIVISKGN

SEQ ID NO: 2728227 - protein, 18 aa, Entamoeba histolytica
TILAPPNLCGACVFMPLI

SEQ ID NO: 2728228 - protein, 19 aa, Entamoeba histolytica
TILEKKGEEFKFRAIGGDV

SEQ ID NO: 2728229 - protein, 18 aa, Entamoeba histolytica
TILEKKGEEFKFRATGGD

SEQ ID NO: 2728230 - protein, 31 aa, Entamoeba histolytica
TILERRGIELYEYYMKLILNIDQYVGLEETR

SEQ ID NO: 2728231 - protein, 24 aa, Entamoeba histolytica
TILKKESINILFDSLINSLVQFNE

SEQ ID NO: 2728232 - protein, 20 aa, Entamoeba histolytica
TILLIKQPLYIIETLTNFGH

SEQ ID NO: 2728233 - protein, 19 aa, Entamoeba histolytica
TILMIKKSIEYLIQKEYLK

SEQ ID NO: 2728234 - protein, 29 aa, Entamoeba histolytica
TILQKRLMYSFDLFPLNMLNGIKDFIFQK

SEQ ID NO: 2728235 - protein, 22 aa, Entamoeba histolytica
TILTMLIENFEYIFPNIQGEID

SEQ ID NO: 2728236 - protein, 28 aa, Entamoeba histolytica
TILYESQGLVPLLRLAWNHFDPNFIATF

SEQ ID NO: 2728237 - protein, 31 aa, Entamoeba histolytica; identical to SEQ ID NO: 2541199

SEQ ID NO: 2728238 - protein, 17 aa, Entamoeba histolytica
TIMKLLDERFDSFLAQS

SEQ ID NO: 2728239 - protein, 25 aa, Entamoeba histolytica
TIMTTIFEDFYSKQYFNFSIFNNQI

SEQ ID NO: 2728240 - protein, 18 aa, Entamoeba histolytica
TINEDTIILTFKKHSITS

SEQ ID NO: 2728241 - protein, 22 aa, Entamoeba histolytica
TINELHQLELLEDMKLTQKRNE

SEQ ID NO: 2728242 - protein, 30 aa, Entamoeba histolytica; identical to SEQ ID NO: 2541205

SEQ ID NO: 2728243 - protein, 22 aa, Entamoeba histolytica
TINGFYIFDINNPSKAIFHESI

SEQ ID NO: 2728244 - protein, 19 aa, Entamoeba histolytica
TINIGLRLNTVHPLYKLFK

SEQ ID NO: 2728245 - protein, 18 aa, Entamoeba histolytica
TINILDKKVSAISVKKEE

SEQ ID NO: 2728246 - protein, 23 aa, Entamoeba histolytica
TINILRVLNKWPVIATYFINETS

SEQ ID NO: 2728247 - protein, 26 aa, Entamoeba histolytica
TINIPSVIWYYVPFELVEKNKNISHD

SEQ ID NO: 2728248 - protein, 26 aa, Entamoeba histolytica
TINNINPLLLNKKLLIIGNPSIANQL

SEQ ID NO: 2728249 - protein, 26 aa, Entamoeba histolytica
TINNKFHVHFIDFTGKGPYVFASDLN

SEQ ID NO: 2728250 - protein, 28 aa, Entamoeba histolytica
TINNNFQLFNLNKFIKLIKIKIICNDIN

SEQ ID NO: 2728251 - protein, 30 aa, Entamoeba histolytica; identical to SEQ ID NO: 2541211

SEQ ID NO: 2728252 - protein, 19 aa, Entamoeba histolytica
TINQLINTLHLPVYLTAES

SEQ ID NO: 2728253 - protein, 24 aa, Entamoeba histolytica
TINQRPFIFMLNDIDTPFLLNNQK

SEQ ID NO: 2728254 - protein, 17 aa, Entamoeba histolytica
TIPGEQSKPIPPVPQKK

SEQ ID NO: 2728255 - protein, 17 aa, Entamoeba histolytica
TIPGKLILYPKDSNQLF

SEQ ID NO: 2728256 - protein, 19 aa, Entamoeba histolytica
TIPLKLSFIIYFIENINTQ

SEQ ID NO: 2728257 - protein, 27 aa, Entamoeba histolytica
TIPNSTKFVIILPQRQYILDATTKQEK

SEQ ID NO: 2728258 - protein, 22 aa, Entamoeba histolytica
TIPSSRLLVVKFPATHPGDFVL

SEQ ID NO: 2728259 - protein, 24 aa, Entamoeba histolytica
TIQARSIPLLLMGKDIMAKARTGS

SEQ ID NO: 2728260 - protein, 27 aa, Entamoeba histolytica
TIQDSYYFDPILFGYFFTANGIEVSDK

SEQ ID NO: 2728261 - protein, 21 aa, Entamoeba histolytica
TIQEKLRNISVWETSLKKSKG

SEQ ID NO: 2728262 - protein, 20 aa, Entamoeba histolytica
TIQFDVVCTCYFIDTAFDIV

SEQ ID NO: 2728263 - protein, 24 aa, Entamoeba histolytica
TIQKQIYWKLISLSSILPNELILE

SEQ ID NO: 2728264 - protein, 19 aa, Entamoeba histolytica
TIQLFEIEPWFINEKKYPL

SEQ ID NO: 2728265 - protein, 22 aa, Entamoeba histolytica
TIQQIFYKGFFMFSREQVELFG

SEQ ID NO: 2728266 - protein, 29 aa, Entamoeba histolytica
TIQYRAKTFLPYYIQPLLSLIPVDQSGLE

SEQ ID NO: 2728267 - protein, 38 aa, Entamoeba histolytica; identical to SEQ ID NO: 2541236

SEQ ID NO: 2728268 - protein, 19 aa, Entamoeba histolytica
TIREVIPPGLFPTSDHPSA

SEQ ID NO: 2728269 - protein, 28 aa, Entamoeba histolytica
TIREYIIQQLNDLLRWLFGEMIQNECIE

SEQ ID NO: 2728270 - protein, 20 aa, Entamoeba histolytica
TIRGLFTQPSDAKWFKPIEL

SEQ ID NO: 2728271 - protein, 17 aa, Entamoeba histolytica
TIRKWLKCAAGNKYRMG

SEQ ID NO: 2728272 - protein, 17 aa, Entamoeba histolytica
TIRKYCHGVFDQLYRAT

SEQ ID NO: 2728273 - protein, 23 aa, Entamoeba histolytica
TIRLAALHRIIQILSIYSNKYYL

SEQ ID NO: 2728274 - protein, 24 aa, Entamoeba histolytica
TIRNKLIDIFLVEGGYERIFEEFP

SEQ ID NO: 2728275 - protein, 26 aa, Entamoeba histolytica
TIRRDILFSLLHGIKLKNLDYPIPNN

SEQ ID NO: 2728276 - protein, 19 aa, Entamoeba histolytica
TIRSLFQINFNPRIIGIKK

SEQ ID NO: 2728277 - protein, 17 aa, Entamoeba histolytica
TISFFTLILPFESKYVS

SEQ ID NO: 2728278 - protein, 23 aa, Entamoeba histolytica
TISFSYNSQFLAIAGFGNLPGDV

SEQ ID NO: 2728279 - protein, 18 aa, Entamoeba histolytica
TISPKIPKPVAKPVLKRV

SEQ ID NO: 2728280 - protein, 17 aa, Entamoeba histolytica
TISPKKLFEGALDIYEV

SEQ ID NO: 2728281 - protein, 21 aa, Entamoeba histolytica
TISRKLGVSINLGKTKFSAKE

SEQ ID NO: 2728282 - protein, 17 aa, Entamoeba histolytica
TISSFLTEIGRDSFKMC

SEQ ID NO: 2728283 - protein, 25 aa, Entamoeba histolytica
TISTRRRWILLTSLKTIHNINEIVK

SEQ ID NO: 2728284 - protein, 19 aa, Entamoeba histolytica
TISVPYKFFKLFLSSHNFH

SEQ ID NO: 2728285 - protein, 23 aa, Entamoeba histolytica
TISYLSNKILFIGSLNGDNLIMN

SEQ ID NO: 2728286 - protein, 21 aa, Entamoeba histolytica
TITHHTGFINTIAFSPDGSIM

SEQ ID NO: 2728287 - protein, 25 aa, Entamoeba histolytica
TITHLIKAYPSSLTLKCSCDLYMHF

SEQ ID NO: 2728288 - protein, 25 aa, Entamoeba histolytica
TITKPFQFLHCHILRGYLQITLKVE

SEQ ID NO: 2728289 - protein, 20 aa, Entamoeba histolytica
TITLKDALLGFKKQIPHLDG

SEQ ID NO: 2728290 - protein, 27 aa, Entamoeba histolytica
TITMPIKIMFIKFLANSFITTPPEMYM

SEQ ID NO: 2728291 - protein, 17 aa, Entamoeba histolytica
TITPLDWVKGKDPRFKI

SEQ ID NO: 2728292 - protein, 26 aa, Entamoeba histolytica
TIVFNSPLTFINNLPLKVLITCIKNE

SEQ ID NO: 2728293 - protein, 21 aa, Entamoeba histolytica
TIYFVYARPRKINSKLLDLML

SEQ ID NO: 2728294 - protein, 29 aa, Entamoeba histolytica
TIYMDWVIEMLKVDRFIYPKDYLASKTAH

SEQ ID NO: 2728295 - protein, 20 aa, Entamoeba histolytica
TIYYVMTEGVNFRAALQFGN

SEQ ID NO: 2728296 - protein, 24 aa, Entamoeba histolytica
TKAFGDFKDFLVKMANARKDYAKS

SEQ ID NO: 2728297 - protein, 20 aa, Entamoeba histolytica
TKALPHLIYIKTGNVKKDIP

SEQ ID NO: 2728298 - protein, 41 aa, Entamoeba histolytica
TKASRALLPIISILVQRITHVFERLFNVALDVIEKVFGEKS

SEQ ID NO: 2728299 - protein, 27 aa, Entamoeba histolytica
TKDCSFDAWKILRRGTIVLYKMSAGEY

SEQ ID NO: 2728300 - protein, 23 aa, Entamoeba histolytica
TKDFFYSHFILLDKESLHFITLT

SEQ ID NO: 2728301 - protein, 21 aa, Entamoeba histolytica
TKDICYSLSWSYEGDVIVSMG

SEQ ID NO: 2728302 - protein, 23 aa, Entamoeba histolytica
TKDQMYLVFDLGGGTLDVTILEK

SEQ ID NO: 2728303 - protein, 23 aa, Entamoeba histolytica
TKDTFKFFDNYPPALALSTCMQF

SEQ ID NO: 2728304 - protein, 25 aa, Entamoeba histolytica
TKDVPFTIVPFLPIKFENITADYLI

SEQ ID NO: 2728305 - protein, 37 aa, Entamoeba histolytica
TKEEFQADMLLVFDNALLFNHPDSEVYHWAVKLKKQF

SEQ ID NO: 2728306 - protein, 25 aa, Entamoeba histolytica
TKEIKETMLISSHFIKTLSIEEINS

SEQ ID NO: 2728307 - protein, 22 aa, Entamoeba histolytica
TKEKPVCEFFYKIGACRHGDAC

SEQ ID NO: 2728308 - protein, 21 aa, Entamoeba histolytica
TKELLGEWIVALQSSTVIIQR

SEQ ID NO: 2728309 - protein, 24 aa, Entamoeba histolytica
TKEPWMTNSLPYVMSRGPALQAYL

SEQ ID NO: 2728310 - protein, 24 aa, Entamoeba histolytica
TKEQEYFVSLLKGKDEIIKLTEHY

SEQ ID NO: 2728311 - protein, 22 aa, Entamoeba histolytica
TKEQWEIIFYEPIKESIELFEF

SEQ ID NO: 2728312 - protein, 27 aa, Entamoeba histolytica
TKERAYQAIFNLTKYLRKGGLFVGTTV

SEQ ID NO: 2728313 - protein, 24 aa, Entamoeba histolytica
TKERTLELFCLFVEIGLTEEVLNT

SEQ ID NO: 2728314 - protein, 25 aa, Entamoeba histolytica
TKESDEFTFFGAAQYLPEAKELQKR

SEQ ID NO: 2728315 - protein, 32 aa, Entamoeba histolytica; identical to SEQ ID NO: 2541298

SEQ ID NO: 2728316 - protein, 23 aa, Entamoeba histolytica
TKEYYLPFVFLDGKADQQQIDFA

SEQ ID NO: 2728317 - protein, 26 aa, Entamoeba histolytica
TKFEEKKWYEFFSFKGKRIGGKISIE

SEQ ID NO: 2728318 - protein, 25 aa, Entamoeba histolytica
TKFGFKRIKTIPKAYPRLSHPSGYL

SEQ ID NO: 2728319 - protein, 29 aa, Entamoeba histolytica
TKFIKAITWLGCTSTRRLPVKLISKFVGT

SEQ ID NO: 2728320 - protein, 25 aa, Entamoeba histolytica
TKFKDLDFAKPTPTIARRVFNVLMG

SEQ ID NO: 2728321 - protein, 18 aa, Entamoeba histolytica
TKGILQFYILVDDSYNFG

SEQ ID NO: 2728322 - protein, 17 aa, Entamoeba histolytica
TKGTLIIPTVDGTIMVG

SEQ ID NO: 2728323 - protein, 22 aa, Entamoeba histolytica
TKGTLIIPTVDGTIMVGPNADI

SEQ ID NO: 2728324 - protein, 26 aa, Entamoeba histolytica
TKHEFDLFFNRIYLTDSIDSKNLIAT

SEQ ID NO: 2728325 - protein, 17 aa, Entamoeba histolytica
TKHFNKYLKRTHLTPEE

SEQ ID NO: 2728326 - protein, 23 aa, Entamoeba histolytica
TKHPIVFVCPATRISMCLLPKKT

SEQ ID NO: 2728327 - protein, 21 aa, Entamoeba histolytica
TKIALAFFSVIKALWSNDYVV

SEQ ID NO: 2728328 - protein, 18 aa, Entamoeba histolytica
TKIKIPYQYFLPGNVMPF

SEQ ID NO: 2728329 - protein, 22 aa, Entamoeba histolytica
TKINHCFICLLDNNSFHYLIKT

SEQ ID NO: 2728330 - protein, 25 aa, Entamoeba histolytica
TKIQKSLVVFLIPHNHSYLVRVITR

SEQ ID NO: 2728331 - protein, 20 aa, Entamoeba histolytica
TKIRFQLVIKFNSLENIKFD

SEQ ID NO: 2728332 - protein, 25 aa, Entamoeba histolytica
TKKASFSSISGWLREFQQNQNPSFT

SEQ ID NO: 2728333 - protein, 30 aa, Entamoeba histolytica
TKKAVLMAGFSLIRLLAEPSAAAYAYGLES

SEQ ID NO: 2728334 - protein, 33 aa, Entamoeba histolytica
TKKDIRLPKANKFVWLFPVHIGEALRYSPERNI

SEQ ID NO: 2728335 - protein, 26 aa, Entamoeba histolytica
TKKESNQWLDPLRVFYEQINSEDQLL

SEQ ID NO: 2728336 - protein, 17 aa, Entamoeba histolytica
TKKGPLAKVWIAAHWEG

SEQ ID NO: 2728337 - protein, 25 aa, Entamoeba histolytica
TKKLEEFCCFLLNDYFLMTKVKREE

SEQ ID NO: 2728338 - protein, 25 aa, Entamoeba histolytica
TKKMSVLQMLVYPYFRVRTYQAYVD

SEQ ID NO: 2728339 - protein, 27 aa, Entamoeba histolytica
TKKSKGCGFVKFVYRDDAVSCYNYHKY

SEQ ID NO: 2728340 - protein, 25 aa, Entamoeba histolytica
TKKSNKFVLQCLLSLLTELSTILVK

SEQ ID NO: 2728341 - protein, 31 aa, Entamoeba histolytica
TKKTQKLIKFKWIDPFNEYGFYAFGAAVIEI

SEQ ID NO: 2728342 - protein, 21 aa, Entamoeba histolytica
TKKYFAVPITFVKNIHDAAVA

SEQ ID NO: 2728343 - protein, 18 aa, Entamoeba histolytica
TKLFNYFSEFVMQKSLDK

SEQ ID NO: 2728344 - protein, 22 aa, Entamoeba histolytica
TKLIPADFIIPANSLNPIGKHH

SEQ ID NO: 2728345 - protein, 26 aa, Entamoeba histolytica
TKLLEYLSQFWIAMQGLGNCKLTHMD

SEQ ID NO: 2728346 - protein, 22 aa, Entamoeba histolytica
TKLLTPLLMRKESFDELLNLKT

SEQ ID NO: 2728347 - protein, 26 aa, Entamoeba histolytica
TKLNKSYLLIFDRTKIEQWNKAIVGL

SEQ ID NO: 2728348 - protein, 20 aa, Entamoeba histolytica
TKLPLYINSTIRFKVHHVIM

SEQ ID NO: 2728349 - protein, 24 aa, Entamoeba histolytica
TKMEEVPILPIRKSLNLAQENSEN

SEQ ID NO: 2728350 - protein, 24 aa, Entamoeba histolytica
TKMNELIFTGIYLSAKSNSTIRSN

SEQ ID NO: 2728351 - protein, 22 aa, Entamoeba histolytica
TKNDLIFKQIRDGEIMHMICNE

SEQ ID NO: 2728352 - protein, 23 aa, Entamoeba histolytica
TKNDTLNIFFNKFSIIIENDDIS

SEQ ID NO: 2728353 - protein, 25 aa, Entamoeba histolytica
TKNENAVVILLYMNNIDIINQISEH

SEQ ID NO: 2728354 - protein, 22 aa, Entamoeba histolytica
TKNFFHSLFYSLNPPQFTTTSN

SEQ ID NO: 2728355 - protein, 32 aa, Entamoeba histolytica
TKNFKTVYVILKDNFFFLYKSANESSPIQVLL

SEQ ID NO: 2728356 - protein, 17 aa, Entamoeba histolytica
TKNGFLLQYRWDKNIEL

SEQ ID NO: 2728357 - protein, 25 aa, Entamoeba histolytica
TKNIKFLFKIYSSIIPKIPKSSYEQ

SEQ ID NO: 2728358 - protein, 30 aa, Entamoeba histolytica
TKNKIPIEEILPLLPLDWELGEFKGVIKNA

SEQ ID NO: 2728359 - protein, 24 aa, Entamoeba histolytica
TKNLIIHNVFMKLNMVQCFICPSF

SEQ ID NO: 2728360 - protein, 29 aa, Entamoeba histolytica
TKNMLFDEAWFPYAHFHPFYASYHSMNKS

SEQ ID NO: 2728361 - protein, 31 aa, Entamoeba histolytica
TKNSYSYFLNYLFPNSFFTDMQKFIIKRIVV

SEQ ID NO: 2728362 - protein, 30 aa, Entamoeba histolytica; identical to SEQ ID NO: 2541354

SEQ ID NO: 2728363 - protein, 30 aa, Entamoeba histolytica
TKNYQVYQQSIFLLILSKYGDIYFDKPIKR

SEQ ID NO: 2728364 - protein, 20 aa, Entamoeba histolytica
TKNYQYYLGSIKNEVFEIKD

SEQ ID NO: 2728365 - protein, 21 aa, Entamoeba histolytica
TKPFLCIEFIEFEETDTILFW

SEQ ID NO: 2728366 - protein, 21 aa, Entamoeba histolytica
TKPLWKEYYTYSDGIIFVIDS

SEQ ID NO: 2728367 - protein, 25 aa, Entamoeba histolytica
TKPTNYILVIVIHSGVFNPLETGLY

SEQ ID NO: 2728368 - protein, 35 aa, Entamoeba histolytica
TKPVKFTPIIDECYPLWFYKSTPSLFCVQSFCHIS

SEQ ID NO: 2728369 - protein, 23 aa, Entamoeba histolytica
TKQANVFGIFFHSVKSLNEQTYV

SEQ ID NO: 2728370 - protein, 23 aa, Entamoeba histolytica
TKQLFVIESIWKEGINCFNIDLI

SEQ ID NO: 2728371 - protein, 27 aa, Entamoeba histolytica
TKQMSYLDIIPKCCGYPLPSLFEQQEY

SEQ ID NO: 2728372 - protein, 18 aa, Entamoeba histolytica
TKQPFPVDPYAQLEFAIC

SEQ ID NO: 2728373 - protein, 18 aa, Entamoeba histolytica
TKQYIKKQIRWINNKIIK

SEQ ID NO: 2728374 - protein, 17 aa, Entamoeba histolytica
TKQYQQIIQYTYHYQEC

SEQ ID NO: 2728375 - protein, 23 aa, Entamoeba histolytica
TKRAIYLGMLKNILELLNVRNKG

SEQ ID NO: 2728376 - protein, 28 aa, Entamoeba histolytica
TKRETFIEQLVFYNILQCLDNFDGTVPI

SEQ ID NO: 2728377 - protein, 22 aa, Entamoeba histolytica
TKRIGYLALGLLLDENQETLTL

SEQ ID NO: 2728378 - protein, 34 aa, Entamoeba histolytica; identical to SEQ ID NO: 2541367

SEQ ID NO: 2728379 - protein, 26 aa, Entamoeba histolytica
TKRYCNNFIYMYQWFKSFVNESERQG

SEQ ID NO: 2728380 - protein, 18 aa, Entamoeba histolytica
TKSDIWSLGITILELRER

SEQ ID NO: 2728381 - protein, 24 aa, Entamoeba histolytica
TKSFKLYYDIVSQSTIRSLFQINF

SEQ ID NO: 2728382 - protein, 29 aa, Entamoeba histolytica
TKSIIYKFHPFYKHLYPTIITGLQNLIHI

SEQ ID NO: 2728383 - protein, 22 aa, Entamoeba histolytica
TKSILYFRLIGKNSIDEITISM

SEQ ID NO: 2728384 - protein, 34 aa, Entamoeba histolytica
TKSKIEPNTFKSSLKRFSYCPVLFSNNDENIKEI

SEQ ID NO: 2728385 - protein, 20 aa, Entamoeba histolytica
TKSLITFLEKTKRPSQRVTT

SEQ ID NO: 2728386 - protein, 24 aa, Entamoeba histolytica
TKSNDIVMLFLHTFSLCSQETEAQ

SEQ ID NO: 2728387 - protein, 18 aa, Entamoeba histolytica
TKSPIKLSTIFQTMKQTT

SEQ ID NO: 2728388 - protein, 26 aa, Entamoeba histolytica
TKSVKLFTLDPLLVNSKRPEITKILW

SEQ ID NO: 2728389 - protein, 31 aa, Entamoeba histolytica
TKTDELVQIYDLWRDIILGGELNELVETIPL

SEQ ID NO: 2728390 - protein, 30 aa, Entamoeba histolytica
TKTGELSLIPISGMILSPCLHMLPSMHYGL

SEQ ID NO: 2728391 - protein, 22 aa, Entamoeba histolytica
TKTGKFKLQITALPYLAQYCSC

SEQ ID NO: 2728392 - protein, 22 aa, Entamoeba histolytica
TKTLIENILKQLDKIDGTCTKL

SEQ ID NO: 2728393 - protein, 18 aa, Entamoeba histolytica
TKTMELMRKYLMGKPKNS

SEQ ID NO: 2728394 - protein, 20 aa, Entamoeba histolytica
TKTMKTFLTKYLEFERKYGD

SEQ ID NO: 2728395 - protein, 21 aa, Entamoeba histolytica
TKTMKTFLTKYLEFERKYGDE

SEQ ID NO: 2728396 - protein, 22 aa, Entamoeba histolytica
TKTMKTFLTKYLEFERKYGDES

SEQ ID NO: 2728397 - protein, 23 aa, Entamoeba histolytica
TKTMKTFLTKYLEFERKYGDESR

SEQ ID NO: 2728398 - protein, 23 aa, Entamoeba histolytica
TKTQLWVIMLSIIGLIQRRISPF

SEQ ID NO: 2728399 - protein, 29 aa, Entamoeba histolytica
TKTSVAASLLAQGYILANDTFQKAVQFDR

SEQ ID NO: 2728400 - protein, 24 aa, Entamoeba histolytica
TKTVNIYIDPFKLTTLPAEQLDYL

SEQ ID NO: 2728401 - protein, 27 aa, Entamoeba histolytica
TKVDQYLYIVRFIPVLFGVTKQNVFDF

SEQ ID NO: 2728402 - protein, 29 aa, Entamoeba histolytica
TKVEIDLCPLCHLPKDLCPYGPNAAKCTK

SEQ ID NO: 2728403 - protein, 20 aa, Entamoeba histolytica
TKVFFEFCKAKEAILITTDI

SEQ ID NO: 2728404 - protein, 46 aa, Entamoeba histolytica
TKVIDESISLLYQFWLQLLPSDNLIWGVFSLFHKKWIRISEVATNW

SEQ ID NO: 2728405 - protein, 24 aa, Entamoeba histolytica
TKVKSLLMIISYLEKNQNNGKDEN

SEQ ID NO: 2728406 - protein, 20 aa, Entamoeba histolytica
TKYFLYTPQMVEQCIKLMFE

SEQ ID NO: 2728407 - protein, 31 aa, Entamoeba histolytica
TKYPNKHSFLLNFLGGLLGIKGIKFVNAVIS

SEQ ID NO: 2728408 - protein, 21 aa, Entamoeba histolytica
TLAEQFGMKPYLIDIGGGFSQ

SEQ ID NO: 2728409 - protein, 19 aa, Entamoeba histolytica
TLAIQFLLSHIALSLRALS

SEQ ID NO: 2728410 - protein, 19 aa, Entamoeba histolytica
TLAIVMIYDNTIYTANVGD

SEQ ID NO: 2728411 - protein, 17 aa, Entamoeba histolytica
TLALIYSNKITLVHCGD

SEQ ID NO: 2728412 - protein, 28 aa, Entamoeba histolytica
TLASAEILFALCKYYKELKKCQSELFQP

SEQ ID NO: 2728413 - protein, 25 aa, Entamoeba histolytica
TLAYRSPEMINLYDYKPIGRKADVW

SEQ ID NO: 2728414 - protein, 24 aa, Entamoeba histolytica
TLCCSFYITKYQMIDKILPIECEI

SEQ ID NO: 2728415 - protein, 18 aa, Entamoeba histolytica
TLCEKKMPLPPIDSNDES

SEQ ID NO: 2728416 - protein, 19 aa, Entamoeba histolytica
TLCSTLCNALLQVKARKVS

SEQ ID NO: 2728417 - protein, 18 aa, Entamoeba histolytica
TLDDFLELIYAFMKKNYH

SEQ ID NO: 2728418 - protein, 23 aa, Entamoeba histolytica
TLDDYVQTYLYLSRMEKKEERSV

SEQ ID NO: 2728419 - protein, 24 aa, Entamoeba histolytica
TLDESEVFWLFKSVMDMMEQFYKP

SEQ ID NO: 2728420 - protein, 28 aa, Entamoeba histolytica
TLDKIPIIHHDFWLQLKTTDFLGHPQVI

SEQ ID NO: 2728421 - protein, 19 aa, Entamoeba histolytica
TLDQTLVPAFQKYLNFIDD

SEQ ID NO: 2728422 - protein, 24 aa, Entamoeba histolytica
TLDRLFSLFGLVFQPIKMVLFNDK

SEQ ID NO: 2728423 - protein, 24 aa, Entamoeba histolytica
TLDSVLFQYKKFVKPAYDKWVYPQ

SEQ ID NO: 2728424 - protein, 26 aa, Entamoeba histolytica
TLEASLPFMHFFDGFRTSHEIQKIHQ

SEQ ID NO: 2728425 - protein, 19 aa, Entamoeba histolytica
TLEEIVHVVRLSTTTVRVR

SEQ ID NO: 2728426 - protein, 23 aa, Entamoeba histolytica
TLEGTILALYDYDDKMQLVKTSS

SEQ ID NO: 2728427 - protein, 21 aa, Entamoeba histolytica
TLELNIPISPLQLPTVIAPPF

SEQ ID NO: 2728428 - protein, 24 aa, Entamoeba histolytica
TLEQLLIQPVQRAMRYPMMIEGLM

SEQ ID NO: 2728429 - protein, 20 aa, Entamoeba histolytica
TLERTAELYLLLKENDKALE

SEQ ID NO: 2728430 - protein, 30 aa, Entamoeba histolytica
TLFDKKWKKRYLIWKGMVLYFYDKKGSKDI

SEQ ID NO: 2728431 - protein, 19 aa, Entamoeba histolytica
TLFFARLGAIKQQELRQYC

SEQ ID NO: 2728432 - protein, 20 aa, Entamoeba histolytica
TLFIILQVIVTNSLCKERLI

SEQ ID NO: 2728433 - protein, 35 aa, Entamoeba histolytica
TLFSKPQHYMYFYKMLWLLLEKFDHKIAFVDEWFL

SEQ ID NO: 2728434 - protein, 23 aa, Entamoeba histolytica
TLFTRAIMFCHIPLCSQLYELMA

SEQ ID NO: 2728435 - protein, 31 aa, Entamoeba histolytica
TLGNGTYSLVLKFLPNLFNPDVTSLSCRALE

SEQ ID NO: 2728436 - protein, 18 aa, Entamoeba histolytica
TLGSPYPVLLLTHKEKDS

SEQ ID NO: 2728437 - protein, 20 aa, Entamoeba histolytica
TLGVLKLLLSIPDNFDIIVD

SEQ ID NO: 2728438 - protein, 19 aa, Entamoeba histolytica
TLHFLDYLIHLEISKSENG

SEQ ID NO: 2728439 - protein, 17 aa, Entamoeba histolytica
TLHKFESKYWKFKDKRD

SEQ ID NO: 2728440 - protein, 29 aa, Entamoeba histolytica
TLHPSHLPILLPVIQLIPFNRIPNSTKSN

SEQ ID NO: 2728441 - protein, 17 aa, Entamoeba histolytica
TLIEKRQLMKFLNDIYT

SEQ ID NO: 2728442 - protein, 20 aa, Entamoeba histolytica
TLIFRVEQFIDAAPPAYLLA

SEQ ID NO: 2728443 - protein, 20 aa, Entamoeba histolytica
TLIHNLKRSLPKKERIFIKE

SEQ ID NO: 2728444 - protein, 26 aa, Entamoeba histolytica
TLIHNLKRSLPKKERIFIKEYIDFKP

SEQ ID NO: 2728445 - protein, 21 aa, Entamoeba histolytica
TLIISPAYWPELNSIKYTDLE

SEQ ID NO: 2728446 - protein, 19 aa, Entamoeba histolytica
TLIPLIYNNISLPTNGSLV

SEQ ID NO: 2728447 - protein, 34 aa, Entamoeba histolytica
TLISIDEIFLTIQSLIEEAVIERTNEMANKIIEL

SEQ ID NO: 2728448 - protein, 36 aa, Entamoeba histolytica; identical to SEQ ID NO: 2541441

SEQ ID NO: 2728449 - protein, 21 aa, Entamoeba histolytica
TLIVAIGIRNPSPEKLKLIAS

SEQ ID NO: 2728450 - protein, 25 aa, Entamoeba histolytica
TLIVNGLMSIPFLSIAHRIKSIKEI

SEQ ID NO: 2728451 - protein, 17 aa, Entamoeba histolytica
TLKFLNASSNPILFIPP

SEQ ID NO: 2728452 - protein, 21 aa, Entamoeba histolytica
TLKIIHNMYIRGYKAKEIAII

SEQ ID NO: 2728453 - protein, 32 aa, Entamoeba histolytica
TLKKNQEITISKNIPPVLQTETLEPIKQPEVK

SEQ ID NO: 2728454 - protein, 25 aa, Entamoeba histolytica
TLKKPNFWKLRRRDCPWIKQKRCNI

SEQ ID NO: 2728455 - protein, 18 aa, Entamoeba histolytica
TLKLGNIFQLSKLNLIDI

SEQ ID NO: 2728456 - protein, 17 aa, Entamoeba histolytica
TLKLLRAGSTVIGTTRY

SEQ ID NO: 2728457 - protein, 20 aa, Entamoeba histolytica
TLKLVLRYQPFLNASKVEEY

SEQ ID NO: 2728458 - protein, 17 aa, Entamoeba histolytica
TLKMLRLKYPSFQITIA

SEQ ID NO: 2728459 - protein, 18 aa, Entamoeba histolytica
TLKNFPPQDIIFTTYFRD

SEQ ID NO: 2728460 - protein, 33 aa, Entamoeba histolytica
TLKNQLMNIQYKFFIKCIQIASSKLNGFIELMI

SEQ ID NO: 2728461 - protein, 36 aa, Entamoeba histolytica
TLKTKPDELYLFEPSKWYELPSTRQLKRDVYLSIDK

SEQ ID NO: 2728462 - protein, 17 aa, Entamoeba histolytica
TLKTLLKNRMRPFQDAD

SEQ ID NO: 2728463 - protein, 18 aa, Entamoeba histolytica
TLKYVILLEEKTNDQVKT

SEQ ID NO: 2728464 - protein, 25 aa, Entamoeba histolytica
TLLAKLMIFIRYCLKSKQLNIVIST

SEQ ID NO: 2728465 - protein, 18 aa, Entamoeba histolytica
TLLEMYIGYQIFTGKSER

SEQ ID NO: 2728466 - protein, 25 aa, Entamoeba histolytica
TLLERSTYVVLILRVPTTNDNITCT

SEQ ID NO: 2728467 - protein, 17 aa, Entamoeba histolytica
TLLESFVFITNSLEVAG

SEQ ID NO: 2728468 - protein, 36 aa, Entamoeba histolytica
TLLILHRSFDCATPLLIQWTYQAMIHEFLGINSNLV

SEQ ID NO: 2728469 - protein, 26 aa, Entamoeba histolytica
TLLKRITIIKSYWRNIKENEKERFIR

SEQ ID NO: 2728470 - protein, 20 aa, Entamoeba histolytica
TLLLNAFYIEPNDQSAWIYY

SEQ ID NO: 2728471 - protein, 27 aa, Entamoeba histolytica
TLLNEINGFDIIKFLEKVSSVKYQTTR

SEQ ID NO: 2728472 - protein, 22 aa, Entamoeba histolytica
TLLNGYCFISLLSELIKSIIEP

SEQ ID NO: 2728473 - protein, 31 aa, Entamoeba histolytica
TLLNSFVNALYGIRITDDFRYIIINEDYLEQ

SEQ ID NO: 2728474 - protein, 21 aa, Entamoeba histolytica
TLLQFKKYFESVKTLPIYQQI

SEQ ID NO: 2728475 - protein, 26 aa, Entamoeba histolytica
TLLSETYLLTIYIIDKYLSLNKTVER

SEQ ID NO: 2728476 - protein, 27 aa, Entamoeba histolytica
TLLTFFDLIHFPLKKPNWIGCNNQLRP

SEQ ID NO: 2728477 - protein, 18 aa, Entamoeba histolytica
TLLVALSFTLIDEQQVTV

SEQ ID NO: 2728478 - protein, 17 aa, Entamoeba histolytica
TLLYCFCDSLLKHDVNV

SEQ ID NO: 2728479 - protein, 26 aa, Entamoeba histolytica
TLMSELIFEILIKKKAFDGKEDLLEA

SEQ ID NO: 2728480 - protein, 27 aa, Entamoeba histolytica
TLNEALTGIVFTLKQLDGRVLYVEGKD

SEQ ID NO: 2728481 - protein, 23 aa, Entamoeba histolytica
TLNETLYQLFKRVVSDSLCNNRI

SEQ ID NO: 2728482 - protein, 21 aa, Entamoeba histolytica
TLNFKVCFIKSISLQVSIDNG

SEQ ID NO: 2728483 - protein, 20 aa, Entamoeba histolytica
TLNGLKAWKLAKPLAEKGKE

SEQ ID NO: 2728484 - protein, 33 aa, Entamoeba histolytica
TLNIYLSLPQTQRIPQLLRFVSDLSPQESMVIN

SEQ ID NO: 2728485 - protein, 26 aa, Entamoeba histolytica
TLNKLWPTVKPLPGAMRILNYFKKHN

SEQ ID NO: 2728486 - protein, 17 aa, Entamoeba histolytica
TLNLKEFINLQKLFINI

SEQ ID NO: 2728487 - protein, 18 aa, Entamoeba histolytica
TLNLVRYKFKVENEYLYV

SEQ ID NO: 2728488 - protein, 25 aa, Entamoeba histolytica
TLNNYIIEFQIYQKLFKMFNKAMNN

SEQ ID NO: 2728489 - protein, 29 aa, Entamoeba histolytica
TLNPIWNTPVFLKDVVFGSVLFFEIIENN

SEQ ID NO: 2728490 - protein, 18 aa, Entamoeba histolytica
TLNQQLGYVLNKKKLVTT

SEQ ID NO: 2728491 - protein, 24 aa, Entamoeba histolytica
TLNVMKIFISFNDIQTILSFVDNL

SEQ ID NO: 2728492 - protein, 19 aa, Entamoeba histolytica
TLPCELCIGSKLKTYIFID

SEQ ID NO: 2728493 - protein, 18 aa, Entamoeba histolytica
TLPGVAVRTSGDPILCDC

SEQ ID NO: 2728494 - protein, 38 aa, Entamoeba histolytica
TLPISITIDKPLSILPCKFFFCFNLPISLGLVHSKLTN

SEQ ID NO: 2728495 - protein, 19 aa, Entamoeba histolytica
TLPLGVEITWKYYVQQENI

SEQ ID NO: 2728496 - protein, 21 aa, Entamoeba histolytica
TLPSYYFDSLLNPIEWKNDWY

SEQ ID NO: 2728497 - protein, 29 aa, Entamoeba histolytica
TLPVDSKVLFKIICFICSFITENEQIQKM

SEQ ID NO: 2728498 - protein, 17 aa, Entamoeba histolytica
TLQDAFRIPPKYLQQLL

SEQ ID NO: 2728499 - protein, 32 aa, Entamoeba histolytica
TLQDMIFMLQGIPPLYLLKNNKFPPLTLEVVP

SEQ ID NO: 2728500 - protein, 26 aa, Entamoeba histolytica
TLQDTLRLLTILFKYGKYQEVEEAIV

SEQ ID NO: 2728501 - protein, 18 aa, Entamoeba histolytica
TLQFIGRRAFYNCKKITH

SEQ ID NO: 2728502 - protein, 18 aa, Entamoeba histolytica
TLQKLLIQTSIKAAPNRV

SEQ ID NO: 2728503 - protein, 19 aa, Entamoeba histolytica
TLQMIRLMNTIWKNNGLDL

SEQ ID NO: 2728504 - protein, 24 aa, Entamoeba histolytica
TLQNSVPLLQLPGSIIREILKTLD

SEQ ID NO: 2728505 - protein, 35 aa, Entamoeba histolytica
TLQTKPGELYLFEPTKWYELPSTRQLKRDVYLSID

SEQ ID NO: 2728506 - protein, 19 aa, Entamoeba histolytica
TLQYLYILAQIGISSSPIQ

SEQ ID NO: 2728507 - protein, 26 aa, Entamoeba histolytica
TLRFHARFLLVCLLTDKLKMGENVLS

SEQ ID NO: 2728508 - protein, 20 aa, Entamoeba histolytica
TLRFQMLGVIPKVSSKQVIL

SEQ ID NO: 2728509 - protein, 18 aa, Entamoeba histolytica
TLRLFAILRHDYSNYLAS

SEQ ID NO: 2728510 - protein, 33 aa, Entamoeba histolytica
TLRQEYCFIPFKYRDGYLISILKETEGKTIIIF

SEQ ID NO: 2728511 - protein, 18 aa, Entamoeba histolytica
TLRSRMCILPQEATMFSG

SEQ ID NO: 2728512 - protein, 18 aa, Entamoeba histolytica
TLRVSFVLSFTFKPNPYL

SEQ ID NO: 2728513 - protein, 26 aa, Entamoeba histolytica
TLSEPRVTLFPCYWDKEEHIEMIEEK

SEQ ID NO: 2728514 - protein, 24 aa, Entamoeba histolytica
TLSGPTSFAPLIKKAIEIVKETKQ

SEQ ID NO: 2728515 - protein, 22 aa, Entamoeba histolytica
TLSHLTALTLWKCPKINELELP

SEQ ID NO: 2728516 - protein, 20 aa, Entamoeba histolytica
TLSIELIPDKSFYGYSVIFE

SEQ ID NO: 2728517 - protein, 31 aa, Entamoeba histolytica
TLSKGQTYAFRYLLQSFPRIQHFSNLIKLLT

SEQ ID NO: 2728518 - protein, 24 aa, Entamoeba histolytica
TLSLCTRPTLLKQKFFASIVDEAA

SEQ ID NO: 2728519 - protein, 26 aa, Entamoeba histolytica
TLSLIKKPEILPTKEYIKYTPIQRGK

SEQ ID NO: 2728520 - protein, 20 aa, Entamoeba histolytica
TLSLLKVLKYFPQANCIQCD

SEQ ID NO: 2728521 - protein, 24 aa, Entamoeba histolytica
TLSLNGCSLRILDITKLGSQIHNM

SEQ ID NO: 2728522 - protein, 20 aa, Entamoeba histolytica
TLSPAVHDLPFTPTAAHFSP

SEQ ID NO: 2728523 - protein, 34 aa, Entamoeba histolytica
TLSSRPINPAPLPPKPYHLPPKPDSPRSPRSKIS

SEQ ID NO: 2728524 - protein, 24 aa, Entamoeba histolytica
TLSTVKPYYLYYLRVRVEITSVMQ

SEQ ID NO: 2728525 - protein, 27 aa, Entamoeba histolytica
TLTGALFQLPPVIAAVKRSLRIRTIYN

SEQ ID NO: 2728526 - protein, 19 aa, Entamoeba histolytica
TLTICTRPTLLKQKFFASI

SEQ ID NO: 2728527 - protein, 24 aa, Entamoeba histolytica
TLTKLYQLSLFANKIRTLPYTLGS

SEQ ID NO: 2728528 - protein, 21 aa, Entamoeba histolytica
TLTLGSWEFKLKLGGTMEAIY

SEQ ID NO: 2728529 - protein, 27 aa, Entamoeba histolytica
TLTLKRPNFWKLRRKDCPWVKQKKSSL

SEQ ID NO: 2728530 - protein, 22 aa, Entamoeba histolytica
TLTSILRKVLNKVLPLVKSSQL

SEQ ID NO: 2728531 - protein, 33 aa, Entamoeba histolytica
TLTTQANWDIIKLQYKILFKEVKPGLFDCFVKA

SEQ ID NO: 2728532 - protein, 43 aa, Entamoeba histolytica
TLTYTSEGIPYMFPIPYKDESSYLIYFIRPGYSNDYITIQVIE

SEQ ID NO: 2728533 - protein, 28 aa, Entamoeba histolytica
TLVITEKHSSGWWFATNSQGQSGFVPEN

SEQ ID NO: 2728534 - protein, 18 aa, Entamoeba histolytica
TLVNIFDLIIVQLKLIPL

SEQ ID NO: 2728535 - protein, 24 aa, Entamoeba histolytica
TLVVRDYLSIRKFDLRKSDGPLSI

SEQ ID NO: 2728536 - protein, 19 aa, Entamoeba histolytica
TLYAVLNGTKPDFHKSMRA

SEQ ID NO: 2728537 - protein, 20 aa, Entamoeba histolytica
TLYHSIPIFNYNEWINKFTE

SEQ ID NO: 2728538 - protein, 37 aa, Entamoeba histolytica; identical to SEQ ID NO: 2541526

SEQ ID NO: 2728539 - protein, 49 aa, Entamoeba histolytica
TLYKLNYIHSSLPYHFKRYFIHTLNPLADWFILTSANLTYYAWGSKYSP

SEQ ID NO: 2728540 - protein, 17 aa, Entamoeba histolytica
TLYNIYSQLFKGITRAT

SEQ ID NO: 2728541 - protein, 24 aa, Entamoeba histolytica
TLYPNHYPLYLNSYSIQNLITLGL

SEQ ID NO: 2728542 - protein, 18 aa, Entamoeba histolytica
TLYSLFNKSFFGCTALSS

SEQ ID NO: 2728543 - protein, 34 aa, Entamoeba histolytica
TMATLIGLAIRTKLMRILPPRIKLDIYLTEGTHQ

SEQ ID NO: 2728544 - protein, 25 aa, Entamoeba histolytica
TMCDIIGFGSALIKFNQRFSYCPRC

SEQ ID NO: 2728545 - protein, 39 aa, Entamoeba histolytica; identical to SEQ ID NO: 2541534

SEQ ID NO: 2728546 - protein, 23 aa, Entamoeba histolytica
TMECENLLYLKGDKFKFIVIENT

SEQ ID NO: 2728547 - protein, 21 aa, Entamoeba histolytica
TMETGSEVCRFILFCTNPCSV

SEQ ID NO: 2728548 - protein, 24 aa, Entamoeba histolytica
TMEWNHLYLIFDANIDGTLTISSS

SEQ ID NO: 2728549 - protein, 24 aa, Entamoeba histolytica
TMGVIPQNLLALPSNSLMASIILT

SEQ ID NO: 2728550 - protein, 18 aa, Entamoeba histolytica
TMHKNCFRCSVCKKILNG

SEQ ID NO: 2728551 - protein, 20 aa, Entamoeba histolytica
TMHPTLLGDFYFKGKELYPN

SEQ ID NO: 2728552 - protein, 36 aa, Entamoeba histolytica
TMIHIIHDIFPLYEFWEHVCVVWTKCYYYTPQSVVD

SEQ ID NO: 2728553 - protein, 23 aa, Entamoeba histolytica
TMIQVINWKIYKSKELLMTAYEQ

SEQ ID NO: 2728554 - protein, 26 aa, Entamoeba histolytica
TMKAQYFLEKYFSILYYRNNDKTVQF

SEQ ID NO: 2728555 - protein, 30 aa, Entamoeba histolytica; identical to SEQ ID NO: 2541545

SEQ ID NO: 2728556 - protein, 30 aa, Entamoeba histolytica
TMKQLRNHIPLYTAPPPDGLTLKEFQQYHV

SEQ ID NO: 2728557 - protein, 28 aa, Entamoeba histolytica
TMKTIPPATMLIWVLTPTSESTKGITIT

SEQ ID NO: 2728558 - protein, 25 aa, Entamoeba histolytica
TMLKRHLFPYGGHIGAYLVVGGYDY

SEQ ID NO: 2728559 - protein, 24 aa, Entamoeba histolytica
TMMSRSYYEGCNAVIVVFDISDRT

SEQ ID NO: 2728560 - protein, 18 aa, Entamoeba histolytica
TMNAAMCALLFSGVDMKG

SEQ ID NO: 2728561 - protein, 24 aa, Entamoeba histolytica
TMNCPYLPILPYESQFLIDNCDMA

SEQ ID NO: 2728562 - protein, 24 aa, Entamoeba histolytica
TMNCPYLPILPYESQFLIDNCDMT

SEQ ID NO: 2728563 - protein, 25 aa, Entamoeba histolytica
TMNCPYLPILPYESQFLIDNCDMTI

SEQ ID NO: 2728564 - protein, 24 aa, Entamoeba histolytica
TMNKGMVKMSLPLAMFLSGISFDV

SEQ ID NO: 2728565 - protein, 24 aa, Entamoeba histolytica
TMNLPKYQLRCCFLRGFPGVQKFK

SEQ ID NO: 2728566 - protein, 28 aa, Entamoeba histolytica
TMPKDEYITFPWIEYFKTFDKLLSNSNE

SEQ ID NO: 2728567 - protein, 25 aa, Entamoeba histolytica
TMPKLLPHLILTILSGCRITVFQST

SEQ ID NO: 2728568 - protein, 31 aa, Entamoeba histolytica
TMPLLTQQFTFDQILSAFNFFQNKPTHCVKV

SEQ ID NO: 2728569 - protein, 23 aa, Entamoeba histolytica
TMQYCVPVLSIVDRELLEPGVQV

SEQ ID NO: 2728570 - protein, 24 aa, Entamoeba histolytica
TMRKRLIEILPKIPKSIDYFEQAN

SEQ ID NO: 2728571 - protein, 22 aa, Entamoeba histolytica
TMRYPILILELLKNTPIKNPDY

SEQ ID NO: 2728572 - protein, 25 aa, Entamoeba histolytica
TMSFVKIFLRHFLNKATLSPEIFQS

SEQ ID NO: 2728573 - protein, 22 aa, Entamoeba histolytica
TMSILPIIYKSEWIKYIQILLQ

SEQ ID NO: 2728574 - protein, 18 aa, Entamoeba histolytica
TMSIYMYSFRNRDSFYVG

SEQ ID NO: 2728575 - protein, 17 aa, Entamoeba histolytica
TMTGFTPKGLRISIVTH

SEQ ID NO: 2728576 - protein, 20 aa, Entamoeba histolytica
TMTKIGLPVPQGFVITTEMC

SEQ ID NO: 2728577 - protein, 20 aa, Entamoeba histolytica
TMTKRLILTCLIKLAKEFDC

SEQ ID NO: 2728578 - protein, 27 aa, Entamoeba histolytica
TMVEWCNLLLNKIALEKLENIWQMKPL

SEQ ID NO: 2728579 - protein, 27 aa, Entamoeba histolytica
TMWIPTPVCTLILNNLLSPGSWEVIER

SEQ ID NO: 2728580 - protein, 25 aa, Entamoeba histolytica
TMYEYYCQLFPVITMYIERANCVNP

SEQ ID NO: 2728581 - protein, 22 aa, Entamoeba histolytica
TNAHAHVFFKLKDRAKVHKKPV

SEQ ID NO: 2728582 - protein, 53 aa, Entamoeba histolytica
TNAILKVLNAKRILSLMAMLVTLMRELNGIYYMFYEIIFNTFVSLHHDQRYKD

SEQ ID NO: 2728583 - protein, 29 aa, Entamoeba histolytica
TNALSQILKDPKLVLVFKVNTPVDEKWGF

SEQ ID NO: 2728584 - protein, 18 aa, Entamoeba histolytica
TNAVYPYQPIHPSIFAHA

SEQ ID NO: 2728585 - protein, 31 aa, Entamoeba histolytica
TNDEKILIFLDYYHNVFGIYLPNGLVESDQS

SEQ ID NO: 2728586 - protein, 17 aa, Entamoeba histolytica
TNDFRIPFQGVHPPPPL

SEQ ID NO: 2728587 - protein, 24 aa, Entamoeba histolytica
TNDKCIFTLSFFTNQIPINAKTKC

SEQ ID NO: 2728588 - protein, 24 aa, Entamoeba histolytica
TNDNNFFVYSIMKDGYQNYGCYQK

SEQ ID NO: 2728589 - protein, 25 aa, Entamoeba histolytica
TNDNNFFVYSIMKDGYQNYGCYQKK

SEQ ID NO: 2728590 - protein, 20 aa, Entamoeba histolytica
TNDQLPFNSSLLKVPMEKKN

SEQ ID NO: 2728591 - protein, 38 aa, Entamoeba histolytica
TNDTKHFMFSIINPSKTEPLMFSMKLKVIDSLCIDSKD

SEQ ID NO: 2728592 - protein, 22 aa, Entamoeba histolytica
TNDWIDGRMIKLILGPEDPLGK

SEQ ID NO: 2728593 - protein, 20 aa, Entamoeba histolytica
TNDYRRFYRWTTTDDPETVN

SEQ ID NO: 2728594 - protein, 18 aa, Entamoeba histolytica
TNEFIKSDYYYLLHNRTG

SEQ ID NO: 2728595 - protein, 30 aa, Entamoeba histolytica; identical to SEQ ID NO: 2541573

SEQ ID NO: 2728596 - protein, 20 aa, Entamoeba histolytica
TNEHLTFNFLLPICSTNDPT

SEQ ID NO: 2728597 - protein, 23 aa, Entamoeba histolytica
TNEKLPLYCDFDLFLARIRKTQK

SEQ ID NO: 2728598 - protein, 20 aa, Entamoeba histolytica
TNELIPFLRRDSFGQYPTQR

SEQ ID NO: 2728599 - protein, 25 aa, Entamoeba histolytica
TNELYYIWDILFAHNNPLSLLNYLC

SEQ ID NO: 2728600 - protein, 27 aa, Entamoeba histolytica
TNENVSIPFYPWYFIGVETPNNNDNKS

SEQ ID NO: 2728601 - protein, 19 aa, Entamoeba histolytica
TNFFIFKKINNQLVPTVLP

SEQ ID NO: 2728602 - protein, 29 aa, Entamoeba histolytica
TNFGLSETVIFVRNLPFSMDSFELKQLFE

SEQ ID NO: 2728603 - protein, 19 aa, Entamoeba histolytica
TNFIIQPHERFLVSTGVSV

SEQ ID NO: 2728604 - protein, 17 aa, Entamoeba histolytica
TNFLELPPDVTAAVYKK

SEQ ID NO: 2728605 - protein, 23 aa, Entamoeba histolytica
TNGATVLTELINKSLKKLESESY

SEQ ID NO: 2728606 - protein, 31 aa, Entamoeba histolytica; identical to SEQ ID NO: 2541591

SEQ ID NO: 2728607 - protein, 24 aa, Entamoeba histolytica
TNGIDLIILLIEKIYKLEKKENYY

SEQ ID NO: 2728608 - protein, 24 aa, Entamoeba histolytica
TNGMLLREYLVDRDLPQYKVLILD

SEQ ID NO: 2728609 - protein, 23 aa, Entamoeba histolytica
TNIIPYFIDMLKEIPLSWYHRII

SEQ ID NO: 2728610 - protein, 19 aa, Entamoeba histolytica
TNILIICFAIDSKSSFVNI

SEQ ID NO: 2728611 - protein, 20 aa, Entamoeba histolytica
TNILNLLRKKHAEGGLWYGV

SEQ ID NO: 2728612 - protein, 20 aa, Entamoeba histolytica
TNKHAALICYIASGNVNKLI

SEQ ID NO: 2728613 - protein, 27 aa, Entamoeba histolytica
TNKNSFLHLPLYLNRIYELRKDHSKTI

SEQ ID NO: 2728614 - protein, 24 aa, Entamoeba histolytica
TNKTWKQYIEWLKEKDLIIEINEN

SEQ ID NO: 2728615 - protein, 30 aa, Entamoeba histolytica
TNKYLRQEGMFFEIIGYVIDTIRLEENNTP

SEQ ID NO: 2728616 - protein, 20 aa, Entamoeba histolytica
TNLCCKAIISRTLIGALGLV

SEQ ID NO: 2728617 - protein, 25 aa, Entamoeba histolytica
TNLIPAQYYNLYLVLQQCLSVLDMY

SEQ ID NO: 2728618 - protein, 25 aa, Entamoeba histolytica
TNLNIPGYHFTIGNRIYFNNAPLIT

SEQ ID NO: 2728619 - protein, 24 aa, Entamoeba histolytica
TNLSTIEAIYYFYRDYYTCMNGKY

SEQ ID NO: 2728620 - protein, 29 aa, Entamoeba histolytica
TNLTRLQLLYIQGIINLPKTLQVFIVKSS

SEQ ID NO: 2728621 - protein, 19 aa, Entamoeba histolytica
TNLTTVISLLPPTTRIGLI

SEQ ID NO: 2728622 - protein, 19 aa, Entamoeba histolytica
TNMFQSKLFVKTLSAVTNT

SEQ ID NO: 2728623 - protein, 30 aa, Entamoeba histolytica
TNMSQLIDKMKILYKNYVDVAYALNPAYKE

SEQ ID NO: 2728624 - protein, 24 aa, Entamoeba histolytica
TNNGENMFIQFPRLIFTSTSNNNF

SEQ ID NO: 2728625 - protein, 18 aa, Entamoeba histolytica
TNNIEDMLMLCCYDINQH

SEQ ID NO: 2728626 - protein, 26 aa, Entamoeba histolytica
TNNISYFLVLLQIITKIIANSGINNK

SEQ ID NO: 2728627 - protein, 20 aa, Entamoeba histolytica
TNNMLVIGFLKKGEILIQDF

SEQ ID NO: 2728628 - protein, 22 aa, Entamoeba histolytica
TNNPRGILLNCNLAICCRMTHH

SEQ ID NO: 2728629 - protein, 23 aa, Entamoeba histolytica
TNPFCCKSLMKKIPIDTLLAVQW

SEQ ID NO: 2728630 - protein, 26 aa, Entamoeba histolytica
TNPHYRPIRAYQYPQRQYFIDEATKP

SEQ ID NO: 2728631 - protein, 23 aa, Entamoeba histolytica
TNPIVITFNLHKAFLDEKVILID

SEQ ID NO: 2728632 - protein, 24 aa, Entamoeba histolytica
TNPKCFHWPYINVLPETYDCPLSY

SEQ ID NO: 2728633 - protein, 23 aa, Entamoeba histolytica
TNPLAIGIPSDEAFPYCFDGATS

SEQ ID NO: 2728634 - protein, 21 aa, Entamoeba histolytica
TNPLVLKWLQTSSAFVNILLI

SEQ ID NO: 2728635 - protein, 19 aa, Entamoeba histolytica
TNQLFSEYKTRTNKTFESG

SEQ ID NO: 2728636 - protein, 18 aa, Entamoeba histolytica
TNQMISTKPIITLGSRKI

SEQ ID NO: 2728637 - protein, 22 aa, Entamoeba histolytica
TNRFEFPLPIEIIIDCYTNNTN

SEQ ID NO: 2728638 - protein, 17 aa, Entamoeba histolytica
TNSAYFYTLTSKDTREM

SEQ ID NO: 2728639 - protein, 30 aa, Entamoeba histolytica
TNSFEWFKDCGDYFFNWFNMVLKDTNKTKR

SEQ ID NO: 2728640 - protein, 40 aa, Entamoeba histolytica
TNSIPGVDPMYYFQIFKLFFKKYINSYEPLLNMLKEMNSE

SEQ ID NO: 2728641 - protein, 24 aa, Entamoeba histolytica
TNSKVCQAILLSPTRELALQTQEV

SEQ ID NO: 2728642 - protein, 25 aa, Entamoeba histolytica
TNSLTSIPFKLDINSSPQIFGFEHC

SEQ ID NO: 2728643 - protein, 25 aa, Entamoeba histolytica
TNSQPIYAQPIASTLFYTNKGKDLF

SEQ ID NO: 2728644 - protein, 26 aa, Entamoeba histolytica
TNSSLIFFDFIDIVIDLRSDYSPLLE

SEQ ID NO: 2728645 - protein, 25 aa, Entamoeba histolytica
TNSVNLLYLMDKYPLLRKINCRLSC

SEQ ID NO: 2728646 - protein, 24 aa, Entamoeba histolytica
TNSYPFIIHQNKVVRILLSGDKKK

SEQ ID NO: 2728647 - protein, 27 aa, Entamoeba histolytica
TNTGGAFIKFVPFLKSYTQYATNQDNC

SEQ ID NO: 2728648 - protein, 26 aa, Entamoeba histolytica
TNTKGCLFPYLLDTKKFAATIYSACG

SEQ ID NO: 2728649 - protein, 17 aa, Entamoeba histolytica
TNTLIPPLNICSIETIC

SEQ ID NO: 2728650 - protein, 22 aa, Entamoeba histolytica
TNTLLKGFAPSSFWSSLTSQIP

SEQ ID NO: 2728651 - protein, 18 aa, Entamoeba histolytica
TNTPTPHLQPIIPSSLSA

SEQ ID NO: 2728652 - protein, 17 aa, Entamoeba histolytica
TNTSFFYIQEEVKQMTK

SEQ ID NO: 2728653 - protein, 27 aa, Entamoeba histolytica
TNTTILYLIRTLIFLNSPLIKAVDKTN

SEQ ID NO: 2728654 - protein, 24 aa, Entamoeba histolytica
TNVCYLPIINNRVGNFPIVLKLNP

SEQ ID NO: 2728655 - protein, 24 aa, Entamoeba histolytica
TNVILKDMPLLHICGRVCPHYCEK

SEQ ID NO: 2728656 - protein, 28 aa, Entamoeba histolytica
TNVPQACIPLRIQIINKMKAYHNKFLPS

SEQ ID NO: 2728657 - protein, 17 aa, Entamoeba histolytica
TNVSLIIKKGFINGMKN

SEQ ID NO: 2728658 - protein, 18 aa, Entamoeba histolytica
TNWARDITYYASPKCVVV

SEQ ID NO: 2728659 - protein, 19 aa, Entamoeba histolytica
TNWARDITYYASPKCVVVL

SEQ ID NO: 2728660 - protein, 24 aa, Entamoeba histolytica
TNYFSDFVQNIAGYFCPNSKPTQG

SEQ ID NO: 2728661 - protein, 23 aa, Entamoeba histolytica
TNYINHFNELFPRYADPINQQKV

SEQ ID NO: 2728662 - protein, 18 aa, Entamoeba histolytica
TNYLFLGDYVNFGMNGLE

SEQ ID NO: 2728663 - protein, 19 aa, Entamoeba histolytica
TNYLFLGDYVNFGMNGLEV

SEQ ID NO: 2728664 - protein, 22 aa, Entamoeba histolytica
TNYLGFPLLVIGSEQGIRLVKY

SEQ ID NO: 2728665 - protein, 21 aa, Entamoeba histolytica
TNYLSLFKHLNDHFTIDSLTR

SEQ ID NO: 2728666 - protein, 27 aa, Entamoeba histolytica
TNYLTTNIIPILQRYKIRTDPTTLQIK

SEQ ID NO: 2728667 - protein, 29 aa, Entamoeba histolytica
TNYMCLGCLKNIPLRNLCLLGNPLPQVDS

SEQ ID NO: 2728668 - protein, 21 aa, Entamoeba histolytica
TPAGILLYGPPGCGKTYCAKA

SEQ ID NO: 2728669 - protein, 25 aa, Entamoeba histolytica
TPAIKCALFAVISYLLNHAQKEIYP

SEQ ID NO: 2728670 - protein, 24 aa, Entamoeba histolytica
TPDEFIQMICQVVRFAIKECARIT

SEQ ID NO: 2728671 - protein, 23 aa, Entamoeba histolytica
TPDKFFLKLMERLDIPEDFEPEN

SEQ ID NO: 2728672 - protein, 25 aa, Entamoeba histolytica
TPEKNIVLIIQYIDKLPLYNKALLN

SEQ ID NO: 2728673 - protein, 29 aa, Entamoeba histolytica
TPERLSLFFIDFYRSQAIQQLLLAVSSME

SEQ ID NO: 2728674 - protein, 20 aa, Entamoeba histolytica
TPEYLAGQYILQSSSSWVSV

SEQ ID NO: 2728675 - protein, 20 aa, Entamoeba histolytica
TPEYLAPEILLGNGYGFAVD

SEQ ID NO: 2728676 - protein, 19 aa, Entamoeba histolytica
TPFIPSYEFLQKVIASHII

SEQ ID NO: 2728677 - protein, 27 aa, Entamoeba histolytica
TPFMRPQLVDWLFKTSEYLHLSKKIIF

SEQ ID NO: 2728678 - protein, 28 aa, Entamoeba histolytica
TPFMRPQLVDWLFKTSEYLHLSKKIIFQ

SEQ ID NO: 2728679 - protein, 20 aa, Entamoeba histolytica
TPGMTLFPGAFQQPLPLNEC

SEQ ID NO: 2728680 - protein, 40 aa, Entamoeba histolytica
TPILLTNLQYDSLVLFITSLQPCFPRHLSLLFPNDLPTTF

SEQ ID NO: 2728681 - protein, 17 aa, Entamoeba histolytica
TPINTHICHFQPIALPL

SEQ ID NO: 2728682 - protein, 20 aa, Entamoeba histolytica
TPIPRHKNFRLFANMNPPTD

SEQ ID NO: 2728683 - protein, 19 aa, Entamoeba histolytica
TPIPTGGYIFVTIIADLKK

SEQ ID NO: 2728684 - protein, 27 aa, Entamoeba histolytica
TPISNYPFNVSLLQYIYFSKNKIPCYN

SEQ ID NO: 2728685 - protein, 33 aa, Entamoeba histolytica
TPIVSSYIDLLIILFVQWKFGPDQWKILKDDLS

SEQ ID NO: 2728686 - protein, 26 aa, Entamoeba histolytica
TPKEYELFRFPSLQNELVLGGVYIRL

SEQ ID NO: 2728687 - protein, 19 aa, Entamoeba histolytica
TPKGLYISRKKVINASPKD

SEQ ID NO: 2728688 - protein, 24 aa, Entamoeba histolytica
TPKKIQPYVPVKINSFGPKTNTEN

SEQ ID NO: 2728689 - protein, 24 aa, Entamoeba histolytica
TPKVLLYFELIIQSWDCLMKIDSL

SEQ ID NO: 2728690 - protein, 23 aa, Entamoeba histolytica
TPLHLACAFGFLESVQKLIELGA

SEQ ID NO: 2728691 - protein, 23 aa, Entamoeba histolytica
TPLKNGFGLFKLTSGKQTTDIKT

SEQ ID NO: 2728692 - protein, 18 aa, Entamoeba histolytica
TPLKTQIPHFIRALIHNH

SEQ ID NO: 2728693 - protein, 33 aa, Entamoeba histolytica
TPLMYAARFHRNDFLIYLLKKGTNLKTTNPNGN

SEQ ID NO: 2728694 - protein, 19 aa, Entamoeba histolytica
TPLPGQSKLYLLIEGKNEE

SEQ ID NO: 2728695 - protein, 20 aa, Entamoeba histolytica
TPLSYYRDTSEWLDLLFGLV

SEQ ID NO: 2728696 - protein, 18 aa, Entamoeba histolytica
TPLVFHPIEVTDFKGWLK

SEQ ID NO: 2728697 - protein, 17 aa, Entamoeba histolytica
TPMRVGTLLLKKEVPLD

SEQ ID NO: 2728698 - protein, 18 aa, Entamoeba histolytica
TPNAEPLIALFQVNLRGD

SEQ ID NO: 2728699 - protein, 21 aa, Entamoeba histolytica
TPNCEELLSMLWRITSKSDDV

SEQ ID NO: 2728700 - protein, 18 aa, Entamoeba histolytica
TPNCIFLIKHRFAKSYRE

SEQ ID NO: 2728701 - protein, 22 aa, Entamoeba histolytica
TPNIIFFIHQFIHQNLIEYLPS

SEQ ID NO: 2728702 - protein, 21 aa, Entamoeba histolytica
TPNILAYLNILSKVADIVKPM

SEQ ID NO: 2728703 - protein, 21 aa, Entamoeba histolytica
TPNKIISFQWKKEDRITLLNI

SEQ ID NO: 2728704 - protein, 24 aa, Entamoeba histolytica
TPNRDLAAFILFRIVNLTLQNEVV

SEQ ID NO: 2728705 - protein, 35 aa, Entamoeba histolytica
TPPDNYLIRPIQRPPRYKLLLGAVRDNLPSWWNEE

SEQ ID NO: 2728706 - protein, 19 aa, Entamoeba histolytica
TPPGYWCIFTQSGKTMHCE

SEQ ID NO: 2728707 - protein, 27 aa, Entamoeba histolytica
TPPKLNKTISPIPLPPSVNGKSVLEQM

SEQ ID NO: 2728708 - protein, 20 aa, Entamoeba histolytica
TPPMIIYNIVARDSQLRKST

SEQ ID NO: 2728709 - protein, 19 aa, Entamoeba histolytica
TPPWLMQIPVNHKISLGSD

SEQ ID NO: 2728710 - protein, 26 aa, Entamoeba histolytica
TPQSSLMYLAIIYASFEFEKIHRRLP

SEQ ID NO: 2728711 - protein, 26 aa, Entamoeba histolytica
TPQSYIVLLPLLTKHLYCYPIDLQIN

SEQ ID NO: 2728712 - protein, 19 aa, Entamoeba histolytica
TPQYGDIYIEFLKLVILTK

SEQ ID NO: 2728713 - protein, 17 aa, Entamoeba histolytica
TPRDIIQVCLKACKFIA

SEQ ID NO: 2728714 - protein, 29 aa, Entamoeba histolytica
TPREHVLCICILYGLINRLIKYNSIHMMT

SEQ ID NO: 2728715 - protein, 23 aa, Entamoeba histolytica
TPRELYDYYLYWNKKDEQIEKLE

SEQ ID NO: 2728716 - protein, 21 aa, Entamoeba histolytica
TPRVFTIESIIPFFEKYKDNS

SEQ ID NO: 2728717 - protein, 23 aa, Entamoeba histolytica
TPSDVLFFYVPMKNKSIDVHEIH

SEQ ID NO: 2728718 - protein, 22 aa, Entamoeba histolytica
TPSLAILWLSLLSEPLFSTDFI

SEQ ID NO: 2728719 - protein, 26 aa, Entamoeba histolytica
TPSNQSQPIILQPSIQNLSKQEVKPL

SEQ ID NO: 2728720 - protein, 23 aa, Entamoeba histolytica
TPSVVKMYYAFQDTHNLFLVMEY

SEQ ID NO: 2728721 - protein, 17 aa, Entamoeba histolytica
TPSYRPPEIWFGAIIYG

SEQ ID NO: 2728722 - protein, 26 aa, Entamoeba histolytica
TPTDIINYTILFKQPLQMIDVRPNEQ

SEQ ID NO: 2728723 - protein, 25 aa, Entamoeba histolytica
TPTFSRFYLLIVQYVAQMQSHKLFK

SEQ ID NO: 2728724 - protein, 17 aa, Entamoeba histolytica
TPTKGNLFQLRYISKAT

SEQ ID NO: 2728725 - protein, 21 aa, Entamoeba histolytica
TPTLIESIIVFLKNEKWSSQF

SEQ ID NO: 2728726 - protein, 26 aa, Entamoeba histolytica
TPTNKSYFFYIKPSDTLPISITIDKP

SEQ ID NO: 2728727 - protein, 20 aa, Entamoeba histolytica
TPTTFIVKLFELVNDEKSKD

SEQ ID NO: 2728728 - protein, 20 aa, Entamoeba histolytica
TPVDVLVFDEIPDALNCTAE

SEQ ID NO: 2728729 - protein, 20 aa, Entamoeba histolytica
TPVINLWIDSNGIKLFIEEK

SEQ ID NO: 2728730 - protein, 27 aa, Entamoeba histolytica
TPVQRLPRYKLLLTDLLRHYNWEHPDY

SEQ ID NO: 2728731 - protein, 18 aa, Entamoeba histolytica
TPVVPGMHKIEVLVNDEP

SEQ ID NO: 2728732 - protein, 25 aa, Entamoeba histolytica
TPYAQLTPNCILPHLFLGSVESTTK

SEQ ID NO: 2728733 - protein, 20 aa, Entamoeba histolytica
TPYEMTILHLLVHSSSLSEE

SEQ ID NO: 2728734 - protein, 17 aa, Entamoeba histolytica
TPYLSFTTDYNIALNTW

SEQ ID NO: 2728735 - protein, 21 aa, Entamoeba histolytica
TPYVYDLLSKLLVYDHQERLS

SEQ ID NO: 2728736 - protein, 17 aa, Entamoeba histolytica
TQAVRRSVALRIKEETE

SEQ ID NO: 2728737 - protein, 29 aa, Entamoeba histolytica
TQCIIKYFIQRLNYFLFKASQRLGITKFI

SEQ ID NO: 2728738 - protein, 18 aa, Entamoeba histolytica
TQCKDPIFILKQTNQAFK

SEQ ID NO: 2728739 - protein, 31 aa, Entamoeba histolytica
TQDPNYLLIQIVFYFSLFYSTSSAVLKEYIS

SEQ ID NO: 2728740 - protein, 27 aa, Entamoeba histolytica
TQDSTEVFFKIKKNTPLKKLMEAFCNK

SEQ ID NO: 2728741 - protein, 24 aa, Entamoeba histolytica
TQEERLIIIKFLIDVANHCKILNN

SEQ ID NO: 2728742 - protein, 30 aa, Entamoeba histolytica
TQEQIPCYIPQYVNLQFKSLLKYIESNGLT

SEQ ID NO: 2728743 - protein, 24 aa, Entamoeba histolytica
TQEYLTILIHTMAKDPTRLQTYLD

SEQ ID NO: 2728744 - protein, 30 aa, Entamoeba histolytica
TQFDTFPPSFRQYKLLESFLEIMKIGKNES

SEQ ID NO: 2728745 - protein, 22 aa, Entamoeba histolytica
TQFNVILPKIDPLPEGITLGCT

SEQ ID NO: 2728746 - protein, 31 aa, Entamoeba histolytica; identical to SEQ ID NO: 2541738

SEQ ID NO: 2728747 - protein, 20 aa, Entamoeba histolytica
TQFSLIMKFLDSTNGKIEND

SEQ ID NO: 2728748 - protein, 50 aa, Entamoeba histolytica
TQGLYDFLRNKLVIQLMKFFERELLTIRSLYTFNTSCAIFIQKPRGMTIT

SEQ ID NO: 2728749 - protein, 22 aa, Entamoeba histolytica
TQHFTILELFTTIFNVLDKDYK

SEQ ID NO: 2728750 - protein, 18 aa, Entamoeba histolytica
TQHKKLLMAYEEAIGFVI

SEQ ID NO: 2728751 - protein, 22 aa, Entamoeba histolytica
TQIFQLKNQFLIEKKQMMEKQQ

SEQ ID NO: 2728752 - protein, 25 aa, Entamoeba histolytica
TQIKKFPFQGKTKKYFVGYCIIVMK

SEQ ID NO: 2728753 - protein, 26 aa, Entamoeba histolytica
TQILISYKEQWYLISFNQNILESLER

SEQ ID NO: 2728754 - protein, 17 aa, Entamoeba histolytica
TQILKIIDQQKYGIFTD

SEQ ID NO: 2728755 - protein, 17 aa, Entamoeba histolytica
TQILLGIRISRCKILVD

SEQ ID NO: 2728756 - protein, 17 aa, Entamoeba histolytica
TQILLKLYDQCCPHSKD

SEQ ID NO: 2728757 - protein, 17 aa, Entamoeba histolytica
TQIPKYQKGLVSTRYCH

SEQ ID NO: 2728758 - protein, 26 aa, Entamoeba histolytica
TQITRAMMLLMERCKVIIEGAGAVAL

SEQ ID NO: 2728759 - protein, 24 aa, Entamoeba histolytica
TQKEIIPINIPWTQPLINSKQQDI

SEQ ID NO: 2728760 - protein, 41 aa, Entamoeba histolytica
TQKLLSLRGFPLTLTKLKAPKWFRDILDKTWAIDPTQRISM

SEQ ID NO: 2728761 - protein, 17 aa, Entamoeba histolytica
TQKRNWIIRTLTPIIVL

SEQ ID NO: 2728762 - protein, 25 aa, Entamoeba histolytica
TQLEIKGFIKPLVLLDVGSSHTFCQ

SEQ ID NO: 2728763 - protein, 24 aa, Entamoeba histolytica
TQLITEFPQLKIVWSYSPQMTTHI

SEQ ID NO: 2728764 - protein, 26 aa, Entamoeba histolytica
TQLKELFFVLFVKRKKYYLNKIDLPS

SEQ ID NO: 2728765 - protein, 22 aa, Entamoeba histolytica
TQLLHSLNTLKENRFAVGIDSR

SEQ ID NO: 2728766 - protein, 24 aa, Entamoeba histolytica
TQLNETLYFQLFNGTIITSQKTTP

SEQ ID NO: 2728767 - protein, 35 aa, Entamoeba histolytica
TQLQSFVIADILPLKLCVYLFSSISKLIALYETLG

SEQ ID NO: 2728768 - protein, 26 aa, Entamoeba histolytica
TQLSLFYAHYMKGPTLPKLYQNLRKL

SEQ ID NO: 2728769 - protein, 19 aa, Entamoeba histolytica
TQLTFLRMFHYKKSCIHLP

SEQ ID NO: 2728770 - protein, 22 aa, Entamoeba histolytica
TQLVKIIDYIYRKGLDTPCMLL

SEQ ID NO: 2728771 - protein, 18 aa, Entamoeba histolytica
TQMVSGIFKSLYEPTIED

SEQ ID NO: 2728772 - protein, 23 aa, Entamoeba histolytica
TQNKFQLEFVLKGLYLNANPVTS

SEQ ID NO: 2728773 - protein, 19 aa, Entamoeba histolytica
TQNLLAISNKENLIRFVFP

SEQ ID NO: 2728774 - protein, 35 aa, Entamoeba histolytica
TQNNSFIFWEIARMYDFYLLRLLIRHSSATVTEFW

SEQ ID NO: 2728775 - protein, 26 aa, Entamoeba histolytica
TQNRLKLYHVVPPNGLIIYCGSVYTE

SEQ ID NO: 2728776 - protein, 25 aa, Entamoeba histolytica
TQNVCSFAFPLIKSTHSVFVTSFPV

SEQ ID NO: 2728777 - protein, 17 aa, Entamoeba histolytica
TQNYFCFRSQYGKKLYV

SEQ ID NO: 2728778 - protein, 35 aa, Entamoeba histolytica
TQPTFNQELPYFYHTLLIDNLLKDVEMYLKDKLTE

SEQ ID NO: 2728779 - protein, 28 aa, Entamoeba histolytica
TQPVYNAIYMKYILHVLKCVCPICKRIY

SEQ ID NO: 2728780 - protein, 17 aa, Entamoeba histolytica
TQQDALKGITKPAIRRL

SEQ ID NO: 2728781 - protein, 18 aa, Entamoeba histolytica
TQQPVEKVQQRKGFLSRR

SEQ ID NO: 2728782 - protein, 22 aa, Entamoeba histolytica
TQQSLDNFLLLGLTNLSISVIQ

SEQ ID NO: 2728783 - protein, 25 aa, Entamoeba histolytica
TQQYEDMFFLFKEKSSVIARQLALF

SEQ ID NO: 2728784 - protein, 18 aa, Entamoeba histolytica
TQRELLTSQPKHIFPTTS

SEQ ID NO: 2728785 - protein, 22 aa, Entamoeba histolytica
TQRIPQLLRFVSDLSPQESMVI

SEQ ID NO: 2728786 - protein, 39 aa, Entamoeba histolytica
TQSCIVLPNFLILPVQRLPRYILLLETLLKSTPEIVQDE

SEQ ID NO: 2728787 - protein, 25 aa, Entamoeba histolytica
TQSGPFENKYYTPQKREFVSFEAPT

SEQ ID NO: 2728788 - protein, 25 aa, Entamoeba histolytica
TQSSKIQILILNSIKSYIYQLIQNN

SEQ ID NO: 2728789 - protein, 27 aa, Entamoeba histolytica
TQSYQEILGKMILIGFTHLLNLNQQSS

SEQ ID NO: 2728790 - protein, 26 aa, Entamoeba histolytica
TQTATSNFWKWLRKDWIESHGGLQAV

SEQ ID NO: 2728791 - protein, 24 aa, Entamoeba histolytica
TQTILYYIKSIDILHPLVVCGFDY

SEQ ID NO: 2728792 - protein, 24 aa, Entamoeba histolytica
TQTITEWVGLPKCKVIYDSLSERS

SEQ ID NO: 2728793 - protein, 31 aa, Entamoeba histolytica
TQTKTKLEGIFGNKPIMGGPAPIRPKPVEQK

SEQ ID NO: 2728794 - protein, 22 aa, Entamoeba histolytica
TQTQLELAVLLINLAQSIRKRL

SEQ ID NO: 2728795 - protein, 26 aa, Entamoeba histolytica
TQTVFNAFVNLLNNPRIVLSQSTFGQ

SEQ ID NO: 2728796 - protein, 28 aa, Entamoeba histolytica
TQYFLEKKQIWIERLITSIFKTSSSMCH

SEQ ID NO: 2728797 - protein, 18 aa, Entamoeba histolytica
TQYFLPKKIFNTDSDYEI

SEQ ID NO: 2728798 - protein, 32 aa, Entamoeba histolytica
TQYHRGSIIRIKMERFLTYDSVEVFPGKGLNV

SEQ ID NO: 2728799 - protein, 28 aa, Entamoeba histolytica
TQYIELISLLDMFFEYGMSTKYLKYRPQ

SEQ ID NO: 2728800 - protein, 18 aa, Entamoeba histolytica
TQYKCYLHTGPATAIDFF

SEQ ID NO: 2728801 - protein, 18 aa, Entamoeba histolytica
TQYLYFPTDERIPTIEFY

SEQ ID NO: 2728802 - protein, 19 aa, Entamoeba histolytica
TRATTLFCATIFREFKNPD

SEQ ID NO: 2728803 - protein, 18 aa, Entamoeba histolytica
TRCEFTGDVLTIPVSEDM

SEQ ID NO: 2728804 - protein, 26 aa, Entamoeba histolytica
TRCKIERLPIILPLVQEDVLSMQIDD

SEQ ID NO: 2728805 - protein, 23 aa, Entamoeba histolytica
TRDKVFKLMASSHIVNDMQKEVN

SEQ ID NO: 2728806 - protein, 19 aa, Entamoeba histolytica
TRDLPRVIENIHMCLMKNG

SEQ ID NO: 2728807 - protein, 30 aa, Entamoeba histolytica
TREVDFNDYLLPIFPLSSIQKGKLLHGYKI

SEQ ID NO: 2728808 - protein, 28 aa, Entamoeba histolytica
TRFMKVTRDGVVPVSFCVPRKSEIFQDD

SEQ ID NO: 2728809 - protein, 29 aa, Entamoeba histolytica
TRFMSAGNIMLPIIPRVITVSSKYLEIST

SEQ ID NO: 2728810 - protein, 32 aa, Entamoeba histolytica
TRFTYQPLHLFNWSLYILLNKEPYRTVFSKEI

SEQ ID NO: 2728811 - protein, 18 aa, Entamoeba histolytica
TRHIAIRLTYIGIDYNGI

SEQ ID NO: 2728812 - protein, 23 aa, Entamoeba histolytica
TRINALLSALTKFKVIKSSIESS

SEQ ID NO: 2728813 - protein, 33 aa, Entamoeba histolytica; identical to SEQ ID NO: 2541813

SEQ ID NO: 2728814 - protein, 25 aa, Entamoeba histolytica
TRLFPNIQIQFLYSNKDKLLPDIHY

SEQ ID NO: 2728815 - protein, 27 aa, Entamoeba histolytica
TRLNPVEIPFFIPINQHSDAIFKPLKA

SEQ ID NO: 2728816 - protein, 23 aa, Entamoeba histolytica
TRLSDLNGIYRGFQNLIWKYSDE

SEQ ID NO: 2728817 - protein, 18 aa, Entamoeba histolytica
TRLTFGNNPLKCFNLVIL

SEQ ID NO: 2728818 - protein, 18 aa, Entamoeba histolytica
TRLTLIRKNYRDTSLKLE

SEQ ID NO: 2728819 - protein, 25 aa, Entamoeba histolytica
TRLVHIYFALQPILNQTIESNETDE

SEQ ID NO: 2728820 - protein, 19 aa, Entamoeba histolytica
TRLYPKIEIFSLPQYKRTV

SEQ ID NO: 2728821 - protein, 23 aa, Entamoeba histolytica
TRNNSISSIHPLLSNLSDIQSLN

SEQ ID NO: 2728822 - protein, 25 aa, Entamoeba histolytica
TRNQRFVYVHPYPDSWYPEYHTVIK

SEQ ID NO: 2728823 - protein, 25 aa, Entamoeba histolytica
TRNYMACQQAILIGLLNEEFKVTIQ

SEQ ID NO: 2728824 - protein, 19 aa, Entamoeba histolytica
TRPTLLKQKFFASIVDEAA

SEQ ID NO: 2728825 - protein, 24 aa, Entamoeba histolytica
TRRHNEYFRFKFAKGITTSCLLSD

SEQ ID NO: 2728826 - protein, 21 aa, Entamoeba histolytica
TRSKKRLLHNCELAKILFSNE

SEQ ID NO: 2728827 - protein, 27 aa, Entamoeba histolytica
TRSTEQYLLKYLPLYTSLAASGTGKYP

SEQ ID NO: 2728828 - protein, 26 aa, Entamoeba histolytica
TRSVVKLYYAFQDSSNLFLVMEYCPG

SEQ ID NO: 2728829 - protein, 23 aa, Entamoeba histolytica
TRTDLFPWREEMPEVQTIRKWLK

SEQ ID NO: 2728830 - protein, 32 aa, Entamoeba histolytica
TRTFNEYVLYQPNIILILILDDCQFGVYQNQP

SEQ ID NO: 2728831 - protein, 18 aa, Entamoeba histolytica
TRVKKQVIRLLPEQVSAL

SEQ ID NO: 2728832 - protein, 18 aa, Entamoeba histolytica
TRVVLFEGLALTINQTIN

SEQ ID NO: 2728833 - protein, 26 aa, Entamoeba histolytica
TRYKKHQFPIQQFNLQQMSPIQQSPK

SEQ ID NO: 2728834 - protein, 27 aa, Entamoeba histolytica
TRYNLRTIAWKIWLGVLPLPVNSVWTS

SEQ ID NO: 2728835 - protein, 27 aa, Entamoeba histolytica
TSADEDVLFFVITKTGFMQLVQYNKKT

SEQ ID NO: 2728836 - protein, 28 aa, Entamoeba histolytica
TSAKDCSPAFWKFLDLIGNKIELNGWTG

SEQ ID NO: 2728837 - protein, 25 aa, Entamoeba histolytica
TSAKERINILESFQALVRDIKKWNA

SEQ ID NO: 2728838 - protein, 19 aa, Entamoeba histolytica
TSALLFDYLCEHPKERIDR

SEQ ID NO: 2728839 - protein, 20 aa, Entamoeba histolytica
TSALWLMSNLETEKFVDIDA

SEQ ID NO: 2728840 - protein, 21 aa, Entamoeba histolytica
TSALWREKILAAKTIMWNGPC

SEQ ID NO: 2728841 - protein, 23 aa, Entamoeba histolytica
TSAPRFLNLVYVTIPNSVTDYKH

SEQ ID NO: 2728842 - protein, 17 aa, Entamoeba histolytica
TSDFPLHTFMRKWLKSL

SEQ ID NO: 2728843 - protein, 26 aa, Entamoeba histolytica
TSDFPLHTFMRKWLKSLYEINVENDM

SEQ ID NO: 2728844 - protein, 20 aa, Entamoeba histolytica
TSDHYIFPSLGLLKQQNSEE

SEQ ID NO: 2728845 - protein, 27 aa, Entamoeba histolytica
TSDIALTLVPILHILPGSTDYLKEINH

SEQ ID NO: 2728846 - protein, 22 aa, Entamoeba histolytica
TSDSSFIQAKKWIDELRGSGNE

SEQ ID NO: 2728847 - protein, 26 aa, Entamoeba histolytica
TSEATFTWVLPRILDKTQFTFVSQKL

SEQ ID NO: 2728848 - protein, 37 aa, Entamoeba histolytica
TSEEVMFLTVLRLDSLNLFSKFPYIDLLALPDDIEMK

SEQ ID NO: 2728849 - protein, 21 aa, Entamoeba histolytica
TSEFIFKNLSFVCVGDSLQRG

SEQ ID NO: 2728850 - protein, 22 aa, Entamoeba histolytica
TSELLVLFEAIQYCQRTNQDDW

SEQ ID NO: 2728851 - protein, 23 aa, Entamoeba histolytica
TSEPSLWINPQFIQGLDSKKELG

SEQ ID NO: 2728852 - protein, 23 aa, Entamoeba histolytica
TSESQYLMKYICSLYNVGVERGM

SEQ ID NO: 2728853 - protein, 17 aa, Entamoeba histolytica
TSEYCLMIKKWFSSIKN

SEQ ID NO: 2728854 - protein, 34 aa, Entamoeba histolytica
TSFDDAFIFAKYYNLLEPLKWSKCLYYQCIINGN

SEQ ID NO: 2728855 - protein, 21 aa, Entamoeba histolytica
TSFGDGRIILALVDSFMGNQI

SEQ ID NO: 2728856 - protein, 19 aa, Entamoeba histolytica
TSFKTGYIYYFININNNNN

SEQ ID NO: 2728857 - protein, 19 aa, Entamoeba histolytica
TSFLIKLQTIWMSSKDQLE

SEQ ID NO: 2728858 - protein, 17 aa, Entamoeba histolytica
TSFQFEMPPFCGGTTRT

SEQ ID NO: 2728859 - protein, 24 aa, Entamoeba histolytica
TSFVKNLFHFLDTQIVYYENDYIM

SEQ ID NO: 2728860 - protein, 21 aa, Entamoeba histolytica
TSGILLFAKTKIFASSFQSIL

SEQ ID NO: 2728861 - protein, 27 aa, Entamoeba histolytica
TSGRDQFLHLFAMKKDKCFPIGDRLLD

SEQ ID NO: 2728862 - protein, 26 aa, Entamoeba histolytica
TSGYSFEEFFRLYSLLMSMSSSSSSE

SEQ ID NO: 2728863 - protein, 26 aa, Entamoeba histolytica
TSHDGIIKKIYILNDTIITIANDKKI

SEQ ID NO: 2728864 - protein, 18 aa, Entamoeba histolytica
TSHKFEFRYFKNCSSIAN

SEQ ID NO: 2728865 - protein, 23 aa, Entamoeba histolytica
TSHLYRSEFLYFCKRDRNCGKTR

SEQ ID NO: 2728866 - protein, 23 aa, Entamoeba histolytica
TSIDTVLADKLLKASTALYNFEE

SEQ ID NO: 2728867 - protein, 22 aa, Entamoeba histolytica
TSIGEWSFCECPRLSIIEYNSQ

SEQ ID NO: 2728868 - protein, 34 aa, Entamoeba histolytica
TSIIGKMFLIEYSPILFKLVFRADLVVEYITIFN

SEQ ID NO: 2728869 - protein, 17 aa, Entamoeba histolytica
TSILLPQSFQYISLEQL

SEQ ID NO: 2728870 - protein, 17 aa, Entamoeba histolytica
TSISLKFKLTFSTVVIN

SEQ ID NO: 2728871 - protein, 19 aa, Entamoeba histolytica
TSISMKFGRGRRQKGKLLR

SEQ ID NO: 2728872 - protein, 28 aa, Entamoeba histolytica
TSKALLPSLLLYPKIYHHLKSSLLLKYS

SEQ ID NO: 2728873 - protein, 29 aa, Entamoeba histolytica
TSKEFMTCVFIFVKALLFISDNQLMEELY

SEQ ID NO: 2728874 - protein, 24 aa, Entamoeba histolytica
TSKHIEQGYYKYPYTSPDGQVKLQ

SEQ ID NO: 2728875 - protein, 27 aa, Entamoeba histolytica
TSKIENYWGYFPLKEGFGTPQLFDING

SEQ ID NO: 2728876 - protein, 17 aa, Entamoeba histolytica
TSKIKIRKLPKKTITEL

SEQ ID NO: 2728877 - protein, 17 aa, Entamoeba histolytica
TSKIKYIDIQPLSMEKI

SEQ ID NO: 2728878 - protein, 27 aa, Entamoeba histolytica
TSKRSKLTLPFLKINKIIFTSEDVIDL

SEQ ID NO: 2728879 - protein, 22 aa, Entamoeba histolytica
TSKTTSLLVCKMLSLLQPTSDQ

SEQ ID NO: 2728880 - protein, 35 aa, Entamoeba histolytica
TSLCITFHFDLRLSNLLFNSIYPKVQQNESYFSLT

SEQ ID NO: 2728881 - protein, 20 aa, Entamoeba histolytica
TSLFDLLFNNTNYKSFCNCF

SEQ ID NO: 2728882 - protein, 24 aa, Entamoeba histolytica
TSLFVALPPDQFNPYILPSLELAS

SEQ ID NO: 2728883 - protein, 17 aa, Entamoeba histolytica
TSLINPWKQYEDKIPSE

SEQ ID NO: 2728884 - protein, 22 aa, Entamoeba histolytica
TSLLTYCLIKYPIKEESKDVFV

SEQ ID NO: 2728885 - protein, 28 aa, Entamoeba histolytica
TSLNVVNPLLVFLSAVKLATDTVALILK

SEQ ID NO: 2728886 - protein, 21 aa, Entamoeba histolytica
TSLPDIPFLKECHLEELILNN

SEQ ID NO: 2728887 - protein, 19 aa, Entamoeba histolytica
TSLPILNNVKFRVLEKEDY

SEQ ID NO: 2728888 - protein, 17 aa, Entamoeba histolytica
TSLQILNYLSTKAQLLA

SEQ ID NO: 2728889 - protein, 25 aa, Entamoeba histolytica
TSLTSLFSIPKTDFSSFLSSDTKPQ

SEQ ID NO: 2728890 - protein, 20 aa, Entamoeba histolytica
TSMCGVLVDIDYKPAGVTPV

SEQ ID NO: 2728891 - protein, 22 aa, Entamoeba histolytica
TSMLPTLFVVALPRSGSTFTHT

SEQ ID NO: 2728892 - protein, 25 aa, Entamoeba histolytica
TSMRTILFSNYLPTQTRQLQVTIDV

SEQ ID NO: 2728893 - protein, 26 aa, Entamoeba histolytica
TSNEKIEYLLPYLQFRINQINCKITI

SEQ ID NO: 2728894 - protein, 22 aa, Entamoeba histolytica
TSNEWFGYWNKGLASKYKTLHK

SEQ ID NO: 2728895 - protein, 28 aa, Entamoeba histolytica
TSNFDHWDCLILLITIETIVFSLLHLEN

SEQ ID NO: 2728896 - protein, 30 aa, Entamoeba histolytica
TSNQHSKFTFIWIKDLFTYLDKKPFSEEDD

SEQ ID NO: 2728897 - protein, 22 aa, Entamoeba histolytica
TSNYFGLLMEYGDKIIQMGKAY

SEQ ID NO: 2728898 - protein, 26 aa, Entamoeba histolytica
TSPKGILAYQFPPPISAIKLTPFITP

SEQ ID NO: 2728899 - protein, 18 aa, Entamoeba histolytica
TSPLKKTMTFTKPTQRGN

SEQ ID NO: 2728900 - protein, 20 aa, Entamoeba histolytica
TSPLLIHLINLLNPTEEPYN

SEQ ID NO: 2728901 - protein, 18 aa, Entamoeba histolytica
TSPRRLRALSRESLRALS

SEQ ID NO: 2728902 - protein, 21 aa, Entamoeba histolytica
TSPSTPFLLTPYKKATSIESS

SEQ ID NO: 2728903 - protein, 27 aa, Entamoeba histolytica
TSQLFGKDYFYLCLLNEIPNKDIIPGT

SEQ ID NO: 2728904 - protein, 29 aa, Entamoeba histolytica
TSQLTSLAMIILDPYYRTVEGLLTLIEKE

SEQ ID NO: 2728905 - protein, 38 aa, Entamoeba histolytica
TSQRKNIRSLLKNLDEILWNDQKWRKLGMSDLCDFEGV

SEQ ID NO: 2728906 - protein, 20 aa, Entamoeba histolytica
TSREKWHRRTKYYAQGKTKE

SEQ ID NO: 2728907 - protein, 25 aa, Entamoeba histolytica
TSRHCVFLCRHGFRLDYTDLTWVPN

SEQ ID NO: 2728908 - protein, 24 aa, Entamoeba histolytica
TSRVILWEMFLGILKFSSTEEERN

SEQ ID NO: 2728909 - protein, 23 aa, Entamoeba histolytica
TSRWIVIYPAYIDSELTIAQGRK

SEQ ID NO: 2728910 - protein, 22 aa, Entamoeba histolytica
TSRYFSKLYLEKGILQKLVEIL

SEQ ID NO: 2728911 - protein, 24 aa, Entamoeba histolytica
TSSDILLIYHCLVSLFLQSKQSRL

SEQ ID NO: 2728912 - protein, 25 aa, Entamoeba histolytica
TSSFISHFISIYTSSLLFRNDGIKQ

SEQ ID NO: 2728913 - protein, 27 aa, Entamoeba histolytica
TSSIKKRIFILLRLLTLSKIDEDTKIT

SEQ ID NO: 2728914 - protein, 24 aa, Entamoeba histolytica
TSSKIFMDVLLKNGIQLKLNSQIK

SEQ ID NO: 2728915 - protein, 17 aa, Entamoeba histolytica
TSSLFLDSLHLTKLLFY

SEQ ID NO: 2728916 - protein, 19 aa, Entamoeba histolytica
TSSLLKQSLVEKILMTFNV

SEQ ID NO: 2728917 - protein, 24 aa, Entamoeba histolytica
TSSTLVLYDIFKAPAALLRPTFIK

SEQ ID NO: 2728918 - protein, 17 aa, Entamoeba histolytica
TSTDFTCLHLHFVVVQF

SEQ ID NO: 2728919 - protein, 26 aa, Entamoeba histolytica
TSTRGLMIPFLKALERHKPSLLFSTP

SEQ ID NO: 2728920 - protein, 22 aa, Entamoeba histolytica
TSTRMKGFISSPAQYIALMEQK

SEQ ID NO: 2728921 - protein, 25 aa, Entamoeba histolytica
TSTWDQCFYALYLTVKDINCYTQPS

SEQ ID NO: 2728922 - protein, 27 aa, Entamoeba histolytica
TSVFGEFYFLFRLESQTTLYFLSKNQL

SEQ ID NO: 2728923 - protein, 47 aa, Entamoeba histolytica
TSVLACALTKFKGTAIATNYPLYSPSYKEIIDEKLIIGSKGITVSMH

SEQ ID NO: 2728924 - protein, 26 aa, Entamoeba histolytica
TSVNGYLPVITPQGPMLMPTTQPPSL

SEQ ID NO: 2728925 - protein, 20 aa, Entamoeba histolytica
TSVPILGTSLLLYCINQQGA

SEQ ID NO: 2728926 - protein, 25 aa, Entamoeba histolytica
TSWDKEPLHKLIKPKTLQLFNDETD

SEQ ID NO: 2728927 - protein, 26 aa, Entamoeba histolytica
TSWEEAWEIIQKGFTLRHTSATLSND

SEQ ID NO: 2728928 - protein, 18 aa, Entamoeba histolytica
TSWTLWYDQPSNESIPYG

SEQ ID NO: 2728929 - protein, 33 aa, Entamoeba histolytica
TSYEEALVKFLDSWLCIFSSELFIGKSFKCEVF

SEQ ID NO: 2728930 - protein, 27 aa, Entamoeba histolytica
TTATYFRNRHCILFMFDVTNSESFTHI

SEQ ID NO: 2728931 - protein, 18 aa, Entamoeba histolytica
TTDFRGHLRLLLNKQDNS

SEQ ID NO: 2728932 - protein, 18 aa, Entamoeba histolytica
TTDPCRFMGCGPSSSTSS

SEQ ID NO: 2728933 - protein, 17 aa, Entamoeba histolytica
TTEAPKPSYLPPKPNRL

SEQ ID NO: 2728934 - protein, 31 aa, Entamoeba histolytica
TTEFISFCDYLSDKLKWYVENQLKRAKEVKE

SEQ ID NO: 2728935 - protein, 19 aa, Entamoeba histolytica
TTEFQPIAPMSWILEGKEP

SEQ ID NO: 2728936 - protein, 25 aa, Entamoeba histolytica
TTEIMNIFWVSFFNKIFHSVIVLNC

SEQ ID NO: 2728937 - protein, 18 aa, Entamoeba histolytica
TTEKKWKIIITKRNKIEE

SEQ ID NO: 2728938 - protein, 25 aa, Entamoeba histolytica
TTENETVIVPFLKSICLTPTITESK

SEQ ID NO: 2728939 - protein, 24 aa, Entamoeba histolytica
TTENHFIPINYPIIQSNKYEQSPY

SEQ ID NO: 2728940 - protein, 25 aa, Entamoeba histolytica
TTENPPIISLLFTTKSRLYISSHSG

SEQ ID NO: 2728941 - protein, 17 aa, Entamoeba histolytica
TTEQPPFVCDFLCLFIM

SEQ ID NO: 2728942 - protein, 17 aa, Entamoeba histolytica
TTERGMAFPCGLSVNSC

SEQ ID NO: 2728943 - protein, 39 aa, Entamoeba histolytica
TTESTLVKIFAKCGKVLRVTIPIWRNTNKRRGFAVVEFA

SEQ ID NO: 2728944 - protein, 19 aa, Entamoeba histolytica
TTEWYWTHDSKALVFCGCF

SEQ ID NO: 2728945 - protein, 26 aa, Entamoeba histolytica
TTFCGYRSLPYIVLDKISMAKTQDSY

SEQ ID NO: 2728946 - protein, 23 aa, Entamoeba histolytica
TTFNRVFNLYNTYNGNCTIINNK

SEQ ID NO: 2728947 - protein, 19 aa, Entamoeba histolytica
TTFPQIFLHYFNTTNKDTS

SEQ ID NO: 2728948 - protein, 35 aa, Entamoeba histolytica; identical to SEQ ID NO: 2541957

SEQ ID NO: 2728949 - protein, 23 aa, Entamoeba histolytica
TTGDAVLYFFRSMSQFINSTCSK

SEQ ID NO: 2728950 - protein, 24 aa, Entamoeba histolytica
TTGMTCQWNMPLSRVSVAVKMGAS

SEQ ID NO: 2728951 - protein, 28 aa, Entamoeba histolytica
TTGQKLHFYWMWWFYGRDEAFKLTQYNT

SEQ ID NO: 2728952 - protein, 25 aa, Entamoeba histolytica
TTGSLQFLHVKLLSLFDLKVQIDID

SEQ ID NO: 2728953 - protein, 25 aa, Entamoeba histolytica
TTGSNPFGNFTPSNSAPTTGNNTTG

SEQ ID NO: 2728954 - protein, 23 aa, Entamoeba histolytica
TTGTMFLDLALTTYKLTHPDLPF

SEQ ID NO: 2728955 - protein, 23 aa, Entamoeba histolytica
TTHEKAYAALKKTKGDLVSAFFE

SEQ ID NO: 2728956 - protein, 24 aa, Entamoeba histolytica
TTHFAQFINFIKKISTKESNIEVL

SEQ ID NO: 2728957 - protein, 22 aa, Entamoeba histolytica
TTHSMLLKIIQKLPICYQDELY

SEQ ID NO: 2728958 - protein, 35 aa, Entamoeba histolytica
TTIDFISQYFNIPRQYFYLIKNGKLKYEGHNGEVL

SEQ ID NO: 2728959 - protein, 18 aa, Entamoeba histolytica
TTIFPSVSTPIQQKIRDA

SEQ ID NO: 2728960 - protein, 18 aa, Entamoeba histolytica
TTIGLYNKIYEFIDDIKK

SEQ ID NO: 2728961 - protein, 18 aa, Entamoeba histolytica
TTILFKNIIRYVKIKGYG

SEQ ID NO: 2728962 - protein, 22 aa, Entamoeba histolytica
TTINQMQILREKQLLEESSRQN

SEQ ID NO: 2728963 - protein, 20 aa, Entamoeba histolytica
TTIPKFVQLVGVACLHLCVK

SEQ ID NO: 2728964 - protein, 31 aa, Entamoeba histolytica
TTIPSHYLYCGMLIYLLQFNKESYFSLVLDK

SEQ ID NO: 2728965 - protein, 32 aa, Entamoeba histolytica; identical to SEQ ID NO: 2541978

SEQ ID NO: 2728966 - protein, 27 aa, Entamoeba histolytica
TTKKAKKPLSAYILFTQAKREEIAATL

SEQ ID NO: 2728967 - protein, 32 aa, Entamoeba histolytica
TTKKISIIEEIKQRGFRLPQPGDKPGDKSDSP

SEQ ID NO: 2728968 - protein, 24 aa, Entamoeba histolytica
TTKLDLLIQFKNGVLRLPFTICYS

SEQ ID NO: 2728969 - protein, 28 aa, Entamoeba histolytica
TTKMEYIYYRILLLIDDRLTIKDLMSIL

SEQ ID NO: 2728970 - protein, 23 aa, Entamoeba histolytica
TTKNHHILIYDSSNNQLLGTLKG

SEQ ID NO: 2728971 - protein, 23 aa, Entamoeba histolytica
TTKNYQYYIGSIKNEVFEIKDNE

SEQ ID NO: 2728972 - protein, 25 aa, Entamoeba histolytica
TTKPYIPEHLLLLLSTSEACQVPLI

SEQ ID NO: 2728973 - protein, 24 aa, Entamoeba histolytica
TTKVIEDMLFYKRYYEYYRNPEIL

SEQ ID NO: 2728974 - protein, 22 aa, Entamoeba histolytica
TTKYLYMVIELVTGGELFDQIV

SEQ ID NO: 2728975 - protein, 39 aa, Entamoeba histolytica
TTKYPELPFGIFFIYNKNFFGFQIRFRDLARGGLRTVIN

SEQ ID NO: 2728976 - protein, 25 aa, Entamoeba histolytica
TTLELMMVKLNKLKWRLNANPTISK

SEQ ID NO: 2728977 - protein, 25 aa, Entamoeba histolytica
TTLINWDAIIFNKIKEMLGGQLDVI

SEQ ID NO: 2728978 - protein, 18 aa, Entamoeba histolytica
TTLKCLLNPTYPTDFRKF

SEQ ID NO: 2728979 - protein, 23 aa, Entamoeba histolytica
TTLLIIAIVPLETGSYNGVYCSI

SEQ ID NO: 2728980 - protein, 20 aa, Entamoeba histolytica
TTLNLIHFFTAGHDEVKCWT

SEQ ID NO: 2728981 - protein, 18 aa, Entamoeba histolytica
TTLNQWLVALNAVICFKP

SEQ ID NO: 2728982 - protein, 21 aa, Entamoeba histolytica
TTLVDFYSTDPGVLSFKKGEI

SEQ ID NO: 2728983 - protein, 24 aa, Entamoeba histolytica
TTLVPKVVLVKPPNQFLIISNEIL

SEQ ID NO: 2728984 - protein, 18 aa, Entamoeba histolytica
TTLVQRRKYLKDTDIVIF

SEQ ID NO: 2728985 - protein, 26 aa, Entamoeba histolytica
TTMFEEPFPIERKIANALAAVAIQMT

SEQ ID NO: 2728986 - protein, 20 aa, Entamoeba histolytica
TTMMLIRRLYEKKEKIELYH

SEQ ID NO: 2728987 - protein, 26 aa, Entamoeba histolytica
TTNEYLRLLCVIFIIIKHDSDNALLM

SEQ ID NO: 2728988 - protein, 27 aa, Entamoeba histolytica
TTNKIVFHVLFTLKQGLTGFIDELIVE

SEQ ID NO: 2728989 - protein, 25 aa, Entamoeba histolytica
TTNKSIFSFLPNDAPCNGFGHVLQR

SEQ ID NO: 2728990 - protein, 19 aa, Entamoeba histolytica
TTNSYFFSSQYKHFDKFDP

SEQ ID NO: 2728991 - protein, 17 aa, Entamoeba histolytica
TTPLVTGQRILDSLFPC

SEQ ID NO: 2728992 - protein, 22 aa, Entamoeba histolytica
TTPSIIPFIPSISEGKLPSVQQ

SEQ ID NO: 2728993 - protein, 22 aa, Entamoeba histolytica
TTPWKYEVIFGPSNDFLYKKNP

SEQ ID NO: 2728994 - protein, 18 aa, Entamoeba histolytica
TTQQFNYYLGKLQDYFLQ

SEQ ID NO: 2728995 - protein, 23 aa, Entamoeba histolytica
TTQRTSISPMIERTLFSPINTTS

SEQ ID NO: 2728996 - protein, 29 aa, Entamoeba histolytica
TTRLNQAVAPELPPKPSNPYFPKSKIRKD

SEQ ID NO: 2728997 - protein, 25 aa, Entamoeba histolytica
TTSFLEANGFREQLYRVLDKDVSEH

SEQ ID NO: 2728998 - protein, 27 aa, Entamoeba histolytica
TTSFLEANGFREQLYRVLDKDVSEHVS

SEQ ID NO: 2728999 - protein, 29 aa, Entamoeba histolytica
TTSIYYPQFSQIIPNSLLSPIDVFLPIFC

SEQ ID NO: 2729000 - protein, 22 aa, Entamoeba histolytica
TTSLFDLLFNNTNYKSFCNCFK

SEQ ID NO: 2729001 - protein, 28 aa, Entamoeba histolytica
TTSWYTSIFDITHTSIPIVLVGNKKDLS

SEQ ID NO: 2729002 - protein, 20 aa, Entamoeba histolytica
TTTFIKFYSIFDRRVNRLPR

SEQ ID NO: 2729003 - protein, 22 aa, Entamoeba histolytica
TTTGFSGTKFLLGKTLEPSEID

SEQ ID NO: 2729004 - protein, 23 aa, Entamoeba histolytica
TTTKPMPIAPPKPKSKIPSSSLG

SEQ ID NO: 2729005 - protein, 25 aa, Entamoeba histolytica
TTVIPVLRQTIIALNKKITDNKGSI

SEQ ID NO: 2729006 - protein, 28 aa, Entamoeba histolytica
TTVNPIYSIPIFPIYPTPTINNIKSLIK

SEQ ID NO: 2729007 - protein, 33 aa, Entamoeba histolytica
TTVQSLLSHLLSLRFRFPSTCDLRFVLLSENKR

SEQ ID NO: 2729008 - protein, 28 aa, Entamoeba histolytica
TTVTITLTFIIPFKKFDLLLCFVSQSED

SEQ ID NO: 2729009 - protein, 18 aa, Entamoeba histolytica
TTVVILAAELLKYGNELI

SEQ ID NO: 2729010 - protein, 23 aa, Entamoeba histolytica
TTVYDIFNLFPKLETIRVNSFHD

SEQ ID NO: 2729011 - protein, 34 aa, Entamoeba histolytica
TTYEFIRTHKDILSEYLWFCIVLDEGHKIKNPNA

SEQ ID NO: 2729012 - protein, 23 aa, Entamoeba histolytica
TTYFNFRQECLWKYTAQIYDEFM

SEQ ID NO: 2729013 - protein, 17 aa, Entamoeba histolytica
TTYLSLNEKVPSSCLIF

SEQ ID NO: 2729014 - protein, 18 aa, Entamoeba histolytica
TTYNYRVDMVKDGIPMEM

SEQ ID NO: 2729015 - protein, 25 aa, Entamoeba histolytica
TTYRNYFGIPLKKLLEDEGRVDAQI

SEQ ID NO: 2729016 - protein, 25 aa, Entamoeba histolytica
TVAAPPPPMHKVSIALAVPPPISSS

SEQ ID NO: 2729017 - protein, 21 aa, Entamoeba histolytica
TVAEEIWKFAQMFSEFEIENH

SEQ ID NO: 2729018 - protein, 21 aa, Entamoeba histolytica
TVAIIRKYIPNAPFNLLSLKV

SEQ ID NO: 2729019 - protein, 33 aa, Entamoeba histolytica
TVASYLILPVQRIPRYELFIKQLIKNMPNHHKE

SEQ ID NO: 2729020 - protein, 29 aa, Entamoeba histolytica
TVCACFITEDFLTFIDLKGNIFVKRVFNR

SEQ ID NO: 2729021 - protein, 24 aa, Entamoeba histolytica
TVCDFFSRLILRHPTSSVIIKENI

SEQ ID NO: 2729022 - protein, 23 aa, Entamoeba histolytica
TVCGYWLYEDRAFISDWFHSNYQ

SEQ ID NO: 2729023 - protein, 29 aa, Entamoeba histolytica
TVDGFIKKLRIFFPNIIDLKYVTNQISQT

SEQ ID NO: 2729024 - protein, 25 aa, Entamoeba histolytica
TVDIFCYSLTIFEIFIERSLIYTEE

SEQ ID NO: 2729025 - protein, 28 aa, Entamoeba histolytica
TVDIQPINTILPHYLLLLGNKEYKVNTL

SEQ ID NO: 2729026 - protein, 28 aa, Entamoeba histolytica
TVDNKDMLVWVIYPPHFDSTKKYPTLLY

SEQ ID NO: 2729027 - protein, 18 aa, Entamoeba histolytica
TVDPCRFMGCGPSSSTTS

SEQ ID NO: 2729028 - protein, 24 aa, Entamoeba histolytica
TVEDYLNIILINSKFKEIPAMFHY

SEQ ID NO: 2729029 - protein, 17 aa, Entamoeba histolytica
TVEELKGINIYETKPEE

SEQ ID NO: 2729030 - protein, 26 aa, Entamoeba histolytica
TVELIKKIPCFWGRIMNVADLNYNNL

SEQ ID NO: 2729031 - protein, 25 aa, Entamoeba histolytica
TVEMLLRIRDVTVPWMLIGNKIDLK

SEQ ID NO: 2729032 - protein, 24 aa, Entamoeba histolytica
TVENIFYTSFLIKEGTAFIVVKNR

SEQ ID NO: 2729033 - protein, 24 aa, Entamoeba histolytica
TVESFSIWMKNRSLPYKDSEHYLY

SEQ ID NO: 2729034 - protein, 26 aa, Entamoeba histolytica
TVESLCNILLPYLDSPKILAQAITTV

SEQ ID NO: 2729035 - protein, 20 aa, Entamoeba histolytica
TVFDAKRLIGRRFSDPAIQN

SEQ ID NO: 2729036 - protein, 18 aa, Entamoeba histolytica
TVFFSKFPSKLLGIRYVV

SEQ ID NO: 2729037 - protein, 29 aa, Entamoeba histolytica
TVFIGFITKFLYPTNPIFLTKRVTEPPIK

SEQ ID NO: 2729038 - protein, 21 aa, Entamoeba histolytica
TVFSKFNFPLSKPLSPNDHCF

SEQ ID NO: 2729039 - protein, 23 aa, Entamoeba histolytica
TVGKTCLLISYTKNSFPKKYLPT

SEQ ID NO: 2729040 - protein, 17 aa, Entamoeba histolytica
TVGLEQEFFLIDENLAR

SEQ ID NO: 2729041 - protein, 32 aa, Entamoeba histolytica
TVGRPLKGTNILFKGRSKLVIGGALVAGGYSD

SEQ ID NO: 2729042 - protein, 19 aa, Entamoeba histolytica
TVGYLPKDLLLLQNDVEAQ

SEQ ID NO: 2729043 - protein, 23 aa, Entamoeba histolytica
TVHGLYCDLFVVILTQLSEFIWY

SEQ ID NO: 2729044 - protein, 42 aa, Entamoeba histolytica
TVHIELRSGFIFIYEMIKSSNMKLIDKLSLYKCYMSEYEPDK

SEQ ID NO: 2729045 - protein, 20 aa, Entamoeba histolytica
TVHLRKVLYIDRSDWRDEDK

SEQ ID NO: 2729046 - protein, 26 aa, Entamoeba histolytica
TVHPDQIIIAMLRSFKSSFADGVYGF

SEQ ID NO: 2729047 - protein, 24 aa, Entamoeba histolytica
TVHYVFLSATIPNAFEFASWIANI

SEQ ID NO: 2729048 - protein, 26 aa, Entamoeba histolytica
TVIEELKILLPCDFFAVHYAEPKLFD

SEQ ID NO: 2729049 - protein, 26 aa, Entamoeba histolytica
TVIKSPNYIFFLYNTRTTIDPEVQIP

SEQ ID NO: 2729050 - protein, 17 aa, Entamoeba histolytica
TVILTEEVYPLTSFLQS

SEQ ID NO: 2729051 - protein, 35 aa, Entamoeba histolytica; identical to SEQ ID NO: 2542070

SEQ ID NO: 2729052 - protein, 18 aa, Entamoeba histolytica
TVKALMNEAILTGFANLL

SEQ ID NO: 2729053 - protein, 27 aa, Entamoeba histolytica
TVKKKKYFKFLVILSTIHELILSNKQF

SEQ ID NO: 2729054 - protein, 19 aa, Entamoeba histolytica
TVKLCKVSILIDPMDIVRG

SEQ ID NO: 2729055 - protein, 44 aa, Entamoeba histolytica
TVKPLISLSYEIPIITITFSIYDKKVYLIVVTNNQLLKIQTDLH

SEQ ID NO: 2729056 - protein, 17 aa, Entamoeba histolytica
TVKWQVPDTFAFKYKEL

SEQ ID NO: 2729057 - protein, 18 aa, Entamoeba histolytica
TVLFHPSGTILFSGSFDG

SEQ ID NO: 2729058 - protein, 23 aa, Entamoeba histolytica
TVLIPGCGLARLPYELQKRGNKC

SEQ ID NO: 2729059 - protein, 23 aa, Entamoeba histolytica
TVLLEYYNILLSFNLLEEKIAKD

SEQ ID NO: 2729060 - protein, 19 aa, Entamoeba histolytica
TVLMQQYTLPDGRVIKLGP

SEQ ID NO: 2729061 - protein, 19 aa, Entamoeba histolytica
TVLNRWLEIEISNNRFSMP

SEQ ID NO: 2729062 - protein, 17 aa, Entamoeba histolytica
TVLRCCCSILANVGPYI

SEQ ID NO: 2729063 - protein, 28 aa, Entamoeba histolytica
TVLRSINRNALFRLDIRGLALTRQDAGQ

SEQ ID NO: 2729064 - protein, 19 aa, Entamoeba histolytica
TVMIEIFYRGLGVSFVEGE

SEQ ID NO: 2729065 - protein, 24 aa, Entamoeba histolytica
TVNDLYHYILIDTPLGNYLSDCLS

SEQ ID NO: 2729066 - protein, 34 aa, Entamoeba histolytica
TVNFIIQHPYIFHSHLPSTLLLTLFDTNKTQLII

SEQ ID NO: 2729067 - protein, 26 aa, Entamoeba histolytica
TVNGKPYPLLYLWGEFFGTYEDVQTG

SEQ ID NO: 2729068 - protein, 28 aa, Entamoeba histolytica
TVNLIANLFELGLVNERLPLTCLQELSK

SEQ ID NO: 2729069 - protein, 19 aa, Entamoeba histolytica
TVNSWILTRGFTVGVGDIV

SEQ ID NO: 2729070 - protein, 22 aa, Entamoeba histolytica
TVNTKMLLLSWGKCGIEVGEAN

SEQ ID NO: 2729071 - protein, 22 aa, Entamoeba histolytica
TVNVECKLAVLSSQHEDLLFRV

SEQ ID NO: 2729072 - protein, 26 aa, Entamoeba histolytica
TVNVPFPFFVNVLQTSVWPLEPQQFM

SEQ ID NO: 2729073 - protein, 23 aa, Entamoeba histolytica
TVPDSVKVFSKAAGIFVACIELA

SEQ ID NO: 2729074 - protein, 31 aa, Entamoeba histolytica
TVPESFYQKYLLYLSLPLVPRPPPYSFSTFL

SEQ ID NO: 2729075 - protein, 18 aa, Entamoeba histolytica
TVPLLYNNIELPQSLLES

SEQ ID NO: 2729076 - protein, 17 aa, Entamoeba histolytica
TVPYWDKTLIKYSTYTE

SEQ ID NO: 2729077 - protein, 22 aa, Entamoeba histolytica
TVQKKCILFGGVTGYIGGICEI

SEQ ID NO: 2729078 - protein, 23 aa, Entamoeba histolytica
TVQKKCILFGGVTGYIGGICEIP

SEQ ID NO: 2729079 - protein, 26 aa, Entamoeba histolytica
TVQKVVISPLLELKKMYNILSARHAI

SEQ ID NO: 2729080 - protein, 21 aa, Entamoeba histolytica
TVQYYVNQLINTLLIEKQVTE

SEQ ID NO: 2729081 - protein, 17 aa, Entamoeba histolytica
TVRDIYVTIKQSLKLRT

SEQ ID NO: 2729082 - protein, 23 aa, Entamoeba histolytica
TVRLFDHFLYYNHVCIVTELLGI

SEQ ID NO: 2729083 - protein, 27 aa, Entamoeba histolytica
TVRMLDHFLYCNHLCIVFELLGTNLYQ

SEQ ID NO: 2729084 - protein, 24 aa, Entamoeba histolytica
TVRPVLMLFDAIIVDGINISKKKY

SEQ ID NO: 2729085 - protein, 21 aa, Entamoeba histolytica
TVRSLLVVLIFKIMSSGYNGN

SEQ ID NO: 2729086 - protein, 35 aa, Entamoeba histolytica
TVSIYMNEHILRRIKLLYPHLWYDDICCVHTVCNN

SEQ ID NO: 2729087 - protein, 24 aa, Entamoeba histolytica
TVSQYYQIIPSMKKKISADISIQP

SEQ ID NO: 2729088 - protein, 28 aa, Entamoeba histolytica
TVSVQLKDFLFSCFKRNPNQRASSRELL

SEQ ID NO: 2729089 - protein, 19 aa, Entamoeba histolytica
TVTFFVSPQEHIYYMLRVG

SEQ ID NO: 2729090 - protein, 25 aa, Entamoeba histolytica
TVTGCLQCDLPIKKLSDIKAVFPGE

SEQ ID NO: 2729091 - protein, 30 aa, Entamoeba histolytica
TVTSAPTFFKYFMAFIRKIVIENSDYLFVQ

SEQ ID NO: 2729092 - protein, 26 aa, Entamoeba histolytica
TVVNLITKVIFLLNAEPNLIQIESES

SEQ ID NO: 2729093 - protein, 22 aa, Entamoeba histolytica
TVWRQCCYLCPSPLNKCKIDDV

SEQ ID NO: 2729094 - protein, 17 aa, Entamoeba histolytica
TVYFTWRDTYPYNPNSV

SEQ ID NO: 2729095 - protein, 17 aa, Entamoeba histolytica
TVYSNHLAKFPLIVLCK

SEQ ID NO: 2729096 - protein, 22 aa, Entamoeba histolytica
TVYYQIVDFLYDYFIDMISTKD

SEQ ID NO: 2729097 - protein, 19 aa, Entamoeba histolytica
TVYYQWEWEEVKGVFFSSR

SEQ ID NO: 2729098 - protein, 17 aa, Entamoeba histolytica
TWGIGRLEKKQIDYAAK

SEQ ID NO: 2729099 - protein, 22 aa, Entamoeba histolytica
TWIEKFIKYYSLLIVQNANCIP

SEQ ID NO: 2729100 - protein, 23 aa, Entamoeba histolytica
TWQKMVYEGLQWAFANRPEQIQN

SEQ ID NO: 2729101 - protein, 29 aa, Entamoeba histolytica
TYDDDQNYRFIIFDDINYDKNLLRLIKAI

SEQ ID NO: 2729102 - protein, 23 aa, Entamoeba histolytica
TYDFFNKLLNLNSNLRPSIDTCA

SEQ ID NO: 2729103 - protein, 26 aa, Entamoeba histolytica
TYDGQYFYSYFIKLIKFQEERMNEGM

SEQ ID NO: 2729104 - protein, 18 aa, Entamoeba histolytica
TYDRDWYYPYISRDYSKI

SEQ ID NO: 2729105 - protein, 18 aa, Entamoeba histolytica
TYELYSCSYDRSVKVWNI

SEQ ID NO: 2729106 - protein, 19 aa, Entamoeba histolytica
TYELYSCSYDRSVKVWNIE

SEQ ID NO: 2729107 - protein, 19 aa, Entamoeba histolytica
TYERVVFPPFKFDLKEYVS

SEQ ID NO: 2729108 - protein, 17 aa, Entamoeba histolytica
TYFQLNLSTLPTLFAFA

SEQ ID NO: 2729109 - protein, 26 aa, Entamoeba histolytica
TYGCYESALFIIRRNGMKEYIPKVSK

SEQ ID NO: 2729110 - protein, 26 aa, Entamoeba histolytica
TYGCYESALFIIRRNGMKEYVPKVSK

SEQ ID NO: 2729111 - protein, 28 aa, Entamoeba histolytica
TYIESEFFFFFIFTNNGEKFKFKRKATS

SEQ ID NO: 2729112 - protein, 25 aa, Entamoeba histolytica
TYITSGIIEFLISNAKRLFDYKDIF

SEQ ID NO: 2729113 - protein, 25 aa, Entamoeba histolytica
TYKEELTNFIFEKYITSLPQNEDLE

SEQ ID NO: 2729114 - protein, 17 aa, Entamoeba histolytica
TYKFHYYQTPTNLRFVL

SEQ ID NO: 2729115 - protein, 28 aa, Entamoeba histolytica
TYKGKMLFMSPFFLNKLQSYFSLQEYQL

SEQ ID NO: 2729116 - protein, 30 aa, Entamoeba histolytica
TYKISEGLHLLIDLLFELGYIFVSRITKGA

SEQ ID NO: 2729117 - protein, 25 aa, Entamoeba histolytica
TYKVSSLFIGEKPIIIGKKASDVTE

SEQ ID NO: 2729118 - protein, 18 aa, Entamoeba histolytica
TYLFSSEQQSKLFSEQNI

SEQ ID NO: 2729119 - protein, 24 aa, Entamoeba histolytica
TYLHFPISRLEEYVKFFAATIKQS

SEQ ID NO: 2729120 - protein, 18 aa, Entamoeba histolytica
TYLIVQCQPPMLYSNISF

SEQ ID NO: 2729121 - protein, 27 aa, Entamoeba histolytica
TYMNNLFKPLFDASLYPEKYPQLAEFL

SEQ ID NO: 2729122 - protein, 19 aa, Entamoeba histolytica
TYMYVRHNGLYFMAFTDQN

SEQ ID NO: 2729123 - protein, 20 aa, Entamoeba histolytica
TYMYVRHNGLYFMAFTDQNI

SEQ ID NO: 2729124 - protein, 31 aa, Entamoeba histolytica
TYNQLGYFSQTLFNIGYYYKLNAVKNKSWNY

SEQ ID NO: 2729125 - protein, 25 aa, Entamoeba histolytica
TYNVGIFLNILLKQLKEWNSQEKYN

SEQ ID NO: 2729126 - protein, 20 aa, Entamoeba histolytica
TYPLVETLNIYLSLPQTQRI

SEQ ID NO: 2729127 - protein, 37 aa, Entamoeba histolytica
TYPPKKIYFAVHQYYKFIFSDLQILTKLKTIPGGDMI

SEQ ID NO: 2729128 - protein, 20 aa, Entamoeba histolytica
TYQCAVARLYLMCIVGSAAV

SEQ ID NO: 2729129 - protein, 20 aa, Entamoeba histolytica
TYQIPFELPPPIHEALTGML

SEQ ID NO: 2729130 - protein, 27 aa, Entamoeba histolytica
TYQIQLMNYIPLIFLQTFSTEQKMFIS

SEQ ID NO: 2729131 - protein, 23 aa, Entamoeba histolytica
TYSFTSFLIERMIGLGLLSDNIV

SEQ ID NO: 2729132 - protein, 35 aa, Entamoeba histolytica
TYSKEVLLCSLLDLYQYILRTIKTSQIYLIGNCEG

SEQ ID NO: 2729133 - protein, 29 aa, Entamoeba histolytica
TYSKVLLSYFFYRGKIVDLLFKLASTEIE

SEQ ID NO: 2729134 - protein, 21 aa, Entamoeba histolytica
TYTFPLSTLMSWGTDSSKTFK

SEQ ID NO: 2729135 - protein, 24 aa, Entamoeba histolytica
TYTKIGCVRSLLLNKCENIEFEIY

SEQ ID NO: 2729136 - protein, 31 aa, Entamoeba histolytica
TYTVVYSDGFLFFYKIKRKPSLILNIGYYQL

SEQ ID NO: 2729137 - protein, 27 aa, Entamoeba histolytica
TYVNNLIILKDFYLQKLLDFNKDELLK

SEQ ID NO: 2729138 - protein, 18 aa, Entamoeba histolytica
TYVPRYYVPALKDKNGNA

SEQ ID NO: 2729139 - protein, 24 aa, Entamoeba histolytica
TYYNLNERIKWETPLLFSNIFHAF

SEQ ID NO: 2729140 - protein, 17 aa, Entamoeba histolytica
TYYTILPSLIGKGCSVG

SEQ ID NO: 2729141 - protein, 19 aa, Entamoeba histolytica
VAAELFLGIPLFPGENEYN

SEQ ID NO: 2729142 - protein, 27 aa, Entamoeba histolytica
VAAGIIKLYLRSLPDSLIPVEFSDKFM

SEQ ID NO: 2729143 - protein, 27 aa, Entamoeba histolytica
VAAGLIKLYLRELPDSLIPKSMYNTFL

SEQ ID NO: 2729144 - protein, 34 aa, Entamoeba histolytica
VACAKYKLYNDPRLLNILLYLYNNGYVIKSAMKE

SEQ ID NO: 2729145 - protein, 18 aa, Entamoeba histolytica
VADILKTSLGPKGMDKMM

SEQ ID NO: 2729146 - protein, 26 aa, Entamoeba histolytica
VAEIVTLLYRSRNKMVPVYCVAFGAV

SEQ ID NO: 2729147 - protein, 19 aa, Entamoeba histolytica
VAEKIFLGRRERTKEVRRA

SEQ ID NO: 2729148 - protein, 24 aa, Entamoeba histolytica
VAEKLKVLVYNYFVMPIDANDNGI

SEQ ID NO: 2729149 - protein, 19 aa, Entamoeba histolytica
VAEKSIFPLISQIKKTMID

SEQ ID NO: 2729150 - protein, 23 aa, Entamoeba histolytica
VAETVLRVLVKQAGLQWDPSKIQ

SEQ ID NO: 2729151 - protein, 25 aa, Entamoeba histolytica
VAFDPLNILLFSQCSNAAIIWNVAK

SEQ ID NO: 2729152 - protein, 36 aa, Entamoeba histolytica; identical to SEQ ID NO: 2542169

SEQ ID NO: 2729153 - protein, 17 aa, Entamoeba histolytica
VAHDISLLIPEIWSRMR

SEQ ID NO: 2729154 - protein, 33 aa, Entamoeba histolytica
VAIEKGGWYVPLPLYRLIPYLEESNYYITPKIM

SEQ ID NO: 2729155 - protein, 28 aa, Entamoeba histolytica
VAIHFSVNLILLIPPTALRTSIYVNCLQ

SEQ ID NO: 2729156 - protein, 21 aa, Entamoeba histolytica
VAKDAFITPGVFLIGDVEVES

SEQ ID NO: 2729157 - protein, 25 aa, Entamoeba histolytica
VAKEIPVIRRVAKPLHYCIKTIEGG

SEQ ID NO: 2729158 - protein, 25 aa, Entamoeba histolytica
VAKIKKYRRALLFNYDKETDMVELR

SEQ ID NO: 2729159 - protein, 20 aa, Entamoeba histolytica
VAKKKIIMCASGLSSVNSPL

SEQ ID NO: 2729160 - protein, 23 aa, Entamoeba histolytica
VAKLEHYVLAFKLSLYCGIGACE

SEQ ID NO: 2729161 - protein, 23 aa, Entamoeba histolytica
VAKYLIPYNLVGFTDEFVTCGYT

SEQ ID NO: 2729162 - protein, 27 aa, Entamoeba histolytica
VALKTEIRTLLSILSLLCITQKDINET

SEQ ID NO: 2729163 - protein, 32 aa, Entamoeba histolytica
VALKVLRNRLAYFRQGMLEIAVLQLLNEKFDI

SEQ ID NO: 2729164 - protein, 22 aa, Entamoeba histolytica
VALNKIFELIALSKPALKAVHY

SEQ ID NO: 2729165 - protein, 27 aa, Entamoeba histolytica
VALQVPTYFSVIKRPMDLGTIKHNLSD

SEQ ID NO: 2729166 - protein, 23 aa, Entamoeba histolytica
VALVIQKWRSWQLKSWNKLSDNI

SEQ ID NO: 2729167 - protein, 19 aa, Entamoeba histolytica
VAMKLMTLYDTQSLDFITS

SEQ ID NO: 2729168 - protein, 18 aa, Entamoeba histolytica
VAPHLVPRGSVCDFTFIP

SEQ ID NO: 2729169 - protein, 17 aa, Entamoeba histolytica
VAPLFTTLEFIVDHLQI

SEQ ID NO: 2729170 - protein, 28 aa, Entamoeba histolytica
VAPRAAEIIWLLCFMNYVSKQSVSTTRD

SEQ ID NO: 2729171 - protein, 30 aa, Entamoeba histolytica
VAQEFLEKITPLLKMFIVGASSVIIKSIKL

SEQ ID NO: 2729172 - protein, 18 aa, Entamoeba histolytica
VAQSMKPMLGKTSEIKAE

SEQ ID NO: 2729173 - protein, 17 aa, Entamoeba histolytica
VARNFFKQLLSGVKYCH

SEQ ID NO: 2729174 - protein, 38 aa, Entamoeba histolytica; identical to SEQ ID NO: 2542195

SEQ ID NO: 2729175 - protein, 24 aa, Entamoeba histolytica
VASMQHVFIVHLILCQLHSIALKN

SEQ ID NO: 2729176 - protein, 17 aa, Entamoeba histolytica
VASWVSLSQLTTGGFMT

SEQ ID NO: 2729177 - protein, 28 aa, Entamoeba histolytica
VATSIKEGMFIRPTPRRLNVTIVPPPTS

SEQ ID NO: 2729178 - protein, 17 aa, Entamoeba histolytica
VAVFLCGLYYMKVIDEK

SEQ ID NO: 2729179 - protein, 18 aa, Entamoeba histolytica
VAVFLIDEDWQFEDLPFK

SEQ ID NO: 2729180 - protein, 23 aa, Entamoeba histolytica
VAVQLIFYAHFDENWEGNITTDI

SEQ ID NO: 2729181 - protein, 28 aa, Entamoeba histolytica
VAVSSETVLFLLSLVPGVFFGKPANEEV

SEQ ID NO: 2729182 - protein, 17 aa, Entamoeba histolytica
VCAFYDTIVSLPFICQS

SEQ ID NO: 2729183 - protein, 28 aa, Entamoeba histolytica
VCAIFKLRNLISGIYLWISNEWSQCDWM

SEQ ID NO: 2729184 - protein, 19 aa, Entamoeba histolytica
VCALKIIFKTKLQESRIGI

SEQ ID NO: 2729185 - protein, 30 aa, Entamoeba histolytica
VCCLLYSIVPFTLLLPFYQAETLHGKAIRS

SEQ ID NO: 2729186 - protein, 27 aa, Entamoeba histolytica
VCDTTPPPMIYPIFSTESIAYTSLSTY

SEQ ID NO: 2729187 - protein, 31 aa, Entamoeba histolytica
VCETLSFVVRLLLLLDILIPGIVRERILIFV

SEQ ID NO: 2729188 - protein, 19 aa, Entamoeba histolytica
VCFEFIKFWQHALSPNEIS

SEQ ID NO: 2729189 - protein, 25 aa, Entamoeba histolytica
VCFPTPLYQANKFCKMLNDCGYVEG

SEQ ID NO: 2729190 - protein, 19 aa, Entamoeba histolytica
VCFTQRKIEFRSQWKYTIC

SEQ ID NO: 2729191 - protein, 22 aa, Entamoeba histolytica
VCGCRLDGYLIKNHELCCVDCY

SEQ ID NO: 2729192 - protein, 18 aa, Entamoeba histolytica
VCGYLMKQSYIFGTWTER

SEQ ID NO: 2729193 - protein, 25 aa, Entamoeba histolytica
VCHGGYAIRHACELIRKGELKVDVV

SEQ ID NO: 2729194 - protein, 20 aa, Entamoeba histolytica
VCKKIYKPLLTLSKNNRLLV

SEQ ID NO: 2729195 - protein, 22 aa, Entamoeba histolytica
VCKSPLTVALLIDLCHKEAIPN

SEQ ID NO: 2729196 - protein, 22 aa, Entamoeba histolytica
VCLIKIIPYLIKLYPEEEEYFL

SEQ ID NO: 2729197 - protein, 26 aa, Entamoeba histolytica
VCMPQVLKILIPYLPTQIESFNICRD

SEQ ID NO: 2729198 - protein, 31 aa, Entamoeba histolytica
VCNCLYRGLYPYTIVQFDYFFIAFDELVRER

SEQ ID NO: 2729199 - protein, 22 aa, Entamoeba histolytica
VCPTYYVISPQDGLLQPGEEQN

SEQ ID NO: 2729200 - protein, 24 aa, Entamoeba histolytica
VCQIQIPPLFPTVLNITAFGKCEL

SEQ ID NO: 2729201 - protein, 26 aa, Entamoeba histolytica
VCQKHNLCPYYYARWATVRSKLILCP

SEQ ID NO: 2729202 - protein, 19 aa, Entamoeba histolytica
VCQMALQSLYIFSKINFVC

SEQ ID NO: 2729203 - protein, 20 aa, Entamoeba histolytica
VCQMIFMRMDGTAQYKGIFE

SEQ ID NO: 2729204 - protein, 25 aa, Entamoeba histolytica
VCREWKMFLNYFPLQCSIYSKSQIF

SEQ ID NO: 2729205 - protein, 17 aa, Entamoeba histolytica
VCRKIIPPQFKCCLCSI

SEQ ID NO: 2729206 - protein, 26 aa, Entamoeba histolytica
VCSLLKHYLRSLPTPLLTYQIGDEIA

SEQ ID NO: 2729207 - protein, 23 aa, Entamoeba histolytica
VCTIDSYRNAFIIIIPLENEHSF

SEQ ID NO: 2729208 - protein, 20 aa, Entamoeba histolytica
VCTLEYEMWKEMVDAVSPNF

SEQ ID NO: 2729209 - protein, 18 aa, Entamoeba histolytica
VCVEAGMIALRREAIEIR

SEQ ID NO: 2729210 - protein, 18 aa, Entamoeba histolytica
VCVGVCALFNLAITPSVR

SEQ ID NO: 2729211 - protein, 18 aa, Entamoeba histolytica
VCYANIPLFVSKQLIKQG

SEQ ID NO: 2729212 - protein, 26 aa, Entamoeba histolytica
VDAFIHANVDNYIWYKLSSSQDIIKT

SEQ ID NO: 2729213 - protein, 30 aa, Entamoeba histolytica
VDAIAATLYIYVLDIPLLDKTYLTCQGVDS

SEQ ID NO: 2729214 - protein, 24 aa, Entamoeba histolytica
VDANIRRILIHELSLDEKTPENIL

SEQ ID NO: 2729215 - protein, 28 aa, Entamoeba histolytica
VDAVELVPIIYYPISKKPTSLVFIREFR

SEQ ID NO: 2729216 - protein, 25 aa, Entamoeba histolytica
VDCRRTLVLQYFGEVFNSKLCNRTC

SEQ ID NO: 2729217 - protein, 18 aa, Entamoeba histolytica
VDCYCRLYRKLNIDNSQM

SEQ ID NO: 2729218 - protein, 22 aa, Entamoeba histolytica
VDDIFYQGYLKMSLKMFEKYVG

SEQ ID NO: 2729219 - protein, 20 aa, Entamoeba histolytica
VDDWIFAMKSYGLSPDKINE

SEQ ID NO: 2729220 - protein, 17 aa, Entamoeba histolytica
VDEIIKFMKKPGDVKIV

SEQ ID NO: 2729221 - protein, 26 aa, Entamoeba histolytica
VDEIYTLFPTLSNEIIYKLLSNFHTD

SEQ ID NO: 2729222 - protein, 26 aa, Entamoeba histolytica
VDEMHSKLCTWLRLLGFDSKGSKDYE

SEQ ID NO: 2729223 - protein, 19 aa, Entamoeba histolytica
VDEMLFTPLLVSVAGASMN

SEQ ID NO: 2729224 - protein, 19 aa, Entamoeba histolytica
VDENKLYRTLFKQLNEESQ

SEQ ID NO: 2729225 - protein, 26 aa, Entamoeba histolytica
VDENYHITEYLALGATLAVSYVENIN

SEQ ID NO: 2729226 - protein, 21 aa, Entamoeba histolytica
VDERMLLNLQKKKWTDSLEVE

SEQ ID NO: 2729227 - protein, 20 aa, Entamoeba histolytica
VDETSIRTFLWTVENLFATL

SEQ ID NO: 2729228 - protein, 23 aa, Entamoeba histolytica
VDFDACSLYPSAVARQFLPSGAP

SEQ ID NO: 2729229 - protein, 30 aa, Entamoeba histolytica; identical to SEQ ID NO: 2542256

SEQ ID NO: 2729230 - protein, 29 aa, Entamoeba histolytica
VDFKTGIVLINFFELISKKILRERYNHAP

SEQ ID NO: 2729231 - protein, 17 aa, Entamoeba histolytica
VDFSRIKPTIFSTLQIP

SEQ ID NO: 2729232 - protein, 29 aa, Entamoeba histolytica
VDGEDVLLTCRWFFYIREKDSSISSSFSS

SEQ ID NO: 2729233 - protein, 41 aa, Entamoeba histolytica
VDGKAMLRIGMVNPPYIIKYFNEIVNILLRPCCFKFLHIPI

SEQ ID NO: 2729234 - protein, 17 aa, Entamoeba histolytica
VDGLKVPVLLSDWGYEV

SEQ ID NO: 2729235 - protein, 28 aa, Entamoeba histolytica
VDGNRTYILGMVWTMILKYKINANQQKN

SEQ ID NO: 2729236 - protein, 30 aa, Entamoeba histolytica
VDGNRTYILGMVWTMILKYKINANQQKNVN

SEQ ID NO: 2729237 - protein, 34 aa, Entamoeba histolytica; identical to SEQ ID NO: 2518594

SEQ ID NO: 2729238 - protein, 22 aa, Entamoeba histolytica
VDGRFMQYPLQGPPPPSMFQSR

SEQ ID NO: 2729239 - protein, 24 aa, Entamoeba histolytica
VDGSFLINQPFAVAKAFFDPKESV

SEQ ID NO: 2729240 - protein, 29 aa, Entamoeba histolytica
VDGSLLVNNPFYLTYPLIIGENGLNIAKE

SEQ ID NO: 2729241 - protein, 20 aa, Entamoeba histolytica
VDHDVVYFMDFIEHEEYKEK

SEQ ID NO: 2729242 - protein, 25 aa, Entamoeba histolytica
VDHHKYFMKGLFKVGMWERTEPNPI

SEQ ID NO: 2729243 - protein, 26 aa, Entamoeba histolytica
VDHVKDMLIEILKEQVIFLNEEIVRK

SEQ ID NO: 2729244 - protein, 19 aa, Entamoeba histolytica
VDIFGFIFEIAKEGTIHLK

SEQ ID NO: 2729245 - protein, 29 aa, Entamoeba histolytica
VDIKPKIYKRRVDGILPTLCLWSNENQEN

SEQ ID NO: 2729246 - protein, 23 aa, Entamoeba histolytica
VDINQFFVKSLLPPPQALINAQK

SEQ ID NO: 2729247 - protein, 26 aa, Entamoeba histolytica
VDKDFNELLLFTRDYFRIKNIPHYNK

SEQ ID NO: 2729248 - protein, 22 aa, Entamoeba histolytica
VDKENWIYQKPSLYSTPEMVIV

SEQ ID NO: 2729249 - protein, 22 aa, Entamoeba histolytica
VDKFKVYKIPLPPTMEMPSQST

SEQ ID NO: 2729250 - protein, 31 aa, Entamoeba histolytica
VDKQEALLPLQLRFIQIFVICEPTVSLESPL

SEQ ID NO: 2729251 - protein, 19 aa, Entamoeba histolytica
VDLIIQFITLLQSNKFLLN

SEQ ID NO: 2729252 - protein, 17 aa, Entamoeba histolytica
VDLPFRVVIIGAGGCTL

SEQ ID NO: 2729253 - protein, 23 aa, Entamoeba histolytica
VDLTRIPFPVCITQARSFLQNFT

SEQ ID NO: 2729254 - protein, 25 aa, Entamoeba histolytica
VDMKKFLSFFSLFSKSKSEKFKHAS

SEQ ID NO: 2729255 - protein, 29 aa, Entamoeba histolytica
VDMWSLGCMLFQFLTGEFPFRGKSDKLTF

SEQ ID NO: 2729256 - protein, 21 aa, Entamoeba histolytica
VDNCIGFIIISPKYSSKNLYL

SEQ ID NO: 2729257 - protein, 26 aa, Entamoeba histolytica
VDNIIHIPLQPNDKGLFICRAFSNNN

SEQ ID NO: 2729258 - protein, 24 aa, Entamoeba histolytica
VDNKPFRLAIWDTAGQEKYRSMVS

SEQ ID NO: 2729259 - protein, 23 aa, Entamoeba histolytica
VDNLYWVGVFDFDLRTFDVIVPT

SEQ ID NO: 2729260 - protein, 25 aa, Entamoeba histolytica
VDNTKEFEWFVQRLGWIVKVADGSY

SEQ ID NO: 2729261 - protein, 23 aa, Entamoeba histolytica
VDPHSSFVFLFDIVNPDTNPLDS

SEQ ID NO: 2729262 - protein, 20 aa, Entamoeba histolytica
VDPIVITQLGPRQNIHMVCY

SEQ ID NO: 2729263 - protein, 21 aa, Entamoeba histolytica
VDPLDVPKFRYKKVAPRQVSE

SEQ ID NO: 2729264 - protein, 17 aa, Entamoeba histolytica
VDPLPLLRERIIKLKNR

SEQ ID NO: 2729265 - protein, 20 aa, Entamoeba histolytica
VDPSGSFWTWKATALGKNMT

SEQ ID NO: 2729266 - protein, 27 aa, Entamoeba histolytica
VDPSRILIERVLLTGTPIKIGKRKATI

SEQ ID NO: 2729267 - protein, 17 aa, Entamoeba histolytica
VDPYNMILTILKSSNEK

SEQ ID NO: 2729268 - protein, 18 aa, Entamoeba histolytica
VDQATLFELLQAANFMDV

SEQ ID NO: 2729269 - protein, 25 aa, Entamoeba histolytica
VDQMIIPHIFYKFIIMLVNRSEVQP

SEQ ID NO: 2729270 - protein, 26 aa, Entamoeba histolytica
VDQQLHPIQPLLNKKIVITAGPTIEP

SEQ ID NO: 2729271 - protein, 27 aa, Entamoeba histolytica
VDQQLHPIQPLLNKKIVITAGPTIEPI

SEQ ID NO: 2729272 - protein, 25 aa, Entamoeba histolytica
VDQRSLLLLHRLEWILKDTSNDNDA

SEQ ID NO: 2729273 - protein, 37 aa, Entamoeba histolytica; identical to SEQ ID NO: 2542295

SEQ ID NO: 2729274 - protein, 31 aa, Entamoeba histolytica
VDRGFNSVETFLLLVALKVKYPDKIYLIRGN

SEQ ID NO: 2729275 - protein, 34 aa, Entamoeba histolytica; identical to SEQ ID NO: 2542297

SEQ ID NO: 2729276 - protein, 30 aa, Entamoeba histolytica
VDRLKKRPSFILFIKYYFNHVLQLEINETS

SEQ ID NO: 2729277 - protein, 18 aa, Entamoeba histolytica
VDRYYQIKAFTKETFYKI

SEQ ID NO: 2729278 - protein, 20 aa, Entamoeba histolytica
VDSDGLFIVPKKCAKVFTLA

SEQ ID NO: 2729279 - protein, 35 aa, Entamoeba histolytica
VDSHFPCDFVTTYLATYLLLQPIDFAIVLKDLFNF

SEQ ID NO: 2729280 - protein, 24 aa, Entamoeba histolytica
VDSLYNGAVLRYFVIQKYLEENKE

SEQ ID NO: 2729281 - protein, 18 aa, Entamoeba histolytica
VDSMMFLLNIMDNKQYDN

SEQ ID NO: 2729282 - protein, 24 aa, Entamoeba histolytica
VDSRTYEYIFPSYAIQKIDSEHPE

SEQ ID NO: 2729283 - protein, 18 aa, Entamoeba histolytica
VDTIILFRSINDMNQLTY

SEQ ID NO: 2729284 - protein, 28 aa, Entamoeba histolytica
VDVEGVPVYINHLWRKCYGDESCKNYLN

SEQ ID NO: 2729285 - protein, 18 aa, Entamoeba histolytica
VDVLLKAVAYIQTELING

SEQ ID NO: 2729286 - protein, 25 aa, Entamoeba histolytica
VDVSMEEFLLNWVNKALEEEGVDKR

SEQ ID NO: 2729287 - protein, 31 aa, Entamoeba histolytica; identical to SEQ ID NO: 2542308

SEQ ID NO: 2729288 - protein, 37 aa, Entamoeba histolytica
VDVYALAITMWELFYERLPFEEFLKDPDKFRTFISNK

SEQ ID NO: 2729289 - protein, 17 aa, Entamoeba histolytica
VDYIETIQIIFKLIRDE

SEQ ID NO: 2729290 - protein, 18 aa, Entamoeba histolytica
VEAAFRDLVTKIVQSENL

SEQ ID NO: 2729291 - protein, 26 aa, Entamoeba histolytica
VEARWVIYQVVSALYYLHSHCIAHRD

SEQ ID NO: 2729292 - protein, 23 aa, Entamoeba histolytica
VEDALMLMKNKPADLIKPVVRIH

SEQ ID NO: 2729293 - protein, 25 aa, Entamoeba histolytica
VEDIDHFLYYFDRMDRAVLGSFNVK

SEQ ID NO: 2729294 - protein, 24 aa, Entamoeba histolytica
VEDYKFRYNRAIERMSDLEKNDNS

SEQ ID NO: 2729295 - protein, 26 aa, Entamoeba histolytica
VEECDNPLFSFIIASLPKLETINGQK

SEQ ID NO: 2729296 - protein, 17 aa, Entamoeba histolytica
VEEFPQQETLEDVLLKL

SEQ ID NO: 2729297 - protein, 24 aa, Entamoeba histolytica
VEEFRKLLPRLSKKVDIKSYEENT

SEQ ID NO: 2729298 - protein, 17 aa, Entamoeba histolytica
VEEFWSVYSSMSSLQVM

SEQ ID NO: 2729299 - protein, 25 aa, Entamoeba histolytica
VEEKNNIMILVITKEGYSFGCFNRK

SEQ ID NO: 2729300 - protein, 27 aa, Entamoeba histolytica
VEEMAQALFIYWKSKELMRSKDIQYEE

SEQ ID NO: 2729301 - protein, 24 aa, Entamoeba histolytica
VEESHIMILLFSLLPTEKLLTYES

SEQ ID NO: 2729302 - protein, 23 aa, Entamoeba histolytica
VEEWKFVLYAICIHANVALKPVL

SEQ ID NO: 2729303 - protein, 26 aa, Entamoeba histolytica
VEEYLREIFFITFPKSDYIAQIYGYC

SEQ ID NO: 2729304 - protein, 20 aa, Entamoeba histolytica
VEFFNTIVLLYAIGQMAING

SEQ ID NO: 2729305 - protein, 17 aa, Entamoeba histolytica
VEFILYTDYVYGACCVD

SEQ ID NO: 2729306 - protein, 17 aa, Entamoeba histolytica
VEFIWNYSPVSLVNIGK

SEQ ID NO: 2729307 - protein, 26 aa, Entamoeba histolytica
VEFMKLKHMIILQNKIDLVKTKEDAQ

SEQ ID NO: 2729308 - protein, 27 aa, Entamoeba histolytica
VEFPSALLILQLLINVLLNQLVHNNFN

SEQ ID NO: 2729309 - protein, 24 aa, Entamoeba histolytica
VEFTNPCFFLPPHAFDTIKSLTKI

SEQ ID NO: 2729310 - protein, 17 aa, Entamoeba histolytica
VEFWKYWMDSTPQSDAL

SEQ ID NO: 2729311 - protein, 23 aa, Entamoeba histolytica
VEGDLSYLPLTKEYLNTQISITW

SEQ ID NO: 2729312 - protein, 18 aa, Entamoeba histolytica
VEGEPSYILFRTETRDDI

SEQ ID NO: 2729313 - protein, 26 aa, Entamoeba histolytica
VEGGFTFIIIDYFSLGQLSDYVNMFV

SEQ ID NO: 2729314 - protein, 23 aa, Entamoeba histolytica
VEGILEHTLFRATFFPTWEGLFW

SEQ ID NO: 2729315 - protein, 40 aa, Entamoeba histolytica
VEGLNWVFSYYYEGCQSWDWYYPYYYAPFAKDIGKLLDPE

SEQ ID NO: 2729316 - protein, 25 aa, Entamoeba histolytica
VEGLQGIILTINFHNHRFTDNIKQI

SEQ ID NO: 2729317 - protein, 24 aa, Entamoeba histolytica
VEGNHDFIISFSKEKIVTSSINEG

SEQ ID NO: 2729318 - protein, 34 aa, Entamoeba histolytica; identical to SEQ ID NO: 2542336

SEQ ID NO: 2729319 - protein, 24 aa, Entamoeba histolytica
VEHDDYIYIMKRVTKFPPVENLHN

SEQ ID NO: 2729320 - protein, 17 aa, Entamoeba histolytica
VEHLLRSFGYKLLERIL

SEQ ID NO: 2729321 - protein, 17 aa, Entamoeba histolytica
VEHLPFYRTGFAEAMKL

SEQ ID NO: 2729322 - protein, 27 aa, Entamoeba histolytica
VEHPKLFWRYILELLLLCELKVVKVYC

SEQ ID NO: 2729323 - protein, 28 aa, Entamoeba histolytica
VEHYTKPNYFKYAPAYPLVLYECKYDGV

SEQ ID NO: 2729324 - protein, 25 aa, Entamoeba histolytica
VEIEGKPFKFYQSKRAQWASAEDFV

SEQ ID NO: 2729325 - protein, 29 aa, Entamoeba histolytica
VEIGRITMLMFYLGAYKILFPEQPINKVI

SEQ ID NO: 2729326 - protein, 25 aa, Entamoeba histolytica
VEIKEYFMIYGNIPTQIIDLNERYD

SEQ ID NO: 2729327 - protein, 17 aa, Entamoeba histolytica
VEIKTIGYWIKVDNIYQ

SEQ ID NO: 2729328 - protein, 25 aa, Entamoeba histolytica
VEILFQEGLIKCLFATETFAMGLNM

SEQ ID NO: 2729329 - protein, 25 aa, Entamoeba histolytica
VEIMNTVLFEWAEVLQQIIDTPVQP

SEQ ID NO: 2729330 - protein, 26 aa, Entamoeba histolytica
VEIPLHSFLNQFRMLSRRDCELEERR

SEQ ID NO: 2729331 - protein, 23 aa, Entamoeba histolytica
VEISTLIPLRFGAERCILIGDPQ

SEQ ID NO: 2729332 - protein, 27 aa, Entamoeba histolytica
VEITKNLDLLVPLLQSLEKEKQRYLED

SEQ ID NO: 2729333 - protein, 19 aa, Entamoeba histolytica
VEIWRIPVLTRPVSFTLVR

SEQ ID NO: 2729334 - protein, 27 aa, Entamoeba histolytica
VEKAFSDLLIQIYKKKNATLKNDSVPS

SEQ ID NO: 2729335 - protein, 17 aa, Entamoeba histolytica
VEKIIHLPLLEGEIIKN

SEQ ID NO: 2729336 - protein, 18 aa, Entamoeba histolytica
VEKIKGCNFIRCDLKKGG

SEQ ID NO: 2729337 - protein, 27 aa, Entamoeba histolytica
VEKIKSFLPDGIKLFQFNALTQKEDIQ

SEQ ID NO: 2729338 - protein, 17 aa, Entamoeba histolytica
VEKILVSPLDNLKPPRF

SEQ ID NO: 2729339 - protein, 26 aa, Entamoeba histolytica
VEKKNVGMIKMFNPRLHEVDLQKEVR

SEQ ID NO: 2729340 - protein, 23 aa, Entamoeba histolytica
VEKLIVWENLPTIRIELKHPQTD

SEQ ID NO: 2729341 - protein, 29 aa, Entamoeba histolytica
VEKPATKPKINYLDLYLSDDFSQNTSVQE

SEQ ID NO: 2729342 - protein, 26 aa, Entamoeba histolytica
VEKQNVDIIIPPHLKSLIINSCKASI

SEQ ID NO: 2729343 - protein, 25 aa, Entamoeba histolytica
VEKQPKFKKILFGAGYWIKRKCYVD

SEQ ID NO: 2729344 - protein, 27 aa, Entamoeba histolytica
VEKSDIPLFAYKLIKETSPTFQLENLT

SEQ ID NO: 2729345 - protein, 24 aa, Entamoeba histolytica
VEKSKTLFFGEALQFKLVINIGDA

SEQ ID NO: 2729346 - protein, 26 aa, Entamoeba histolytica
VEKVRPICMGAVLRGITFTEESYKSF

SEQ ID NO: 2729347 - protein, 22 aa, Entamoeba histolytica
VELCALLEIIGETTIKCVTNPK

SEQ ID NO: 2729348 - protein, 28 aa, Entamoeba histolytica
VELEGRRNIFLALQYKRLFTQEEFLKYL

SEQ ID NO: 2729349 - protein, 22 aa, Entamoeba histolytica
VELELILYLQLQKNTKLIHYTI

SEQ ID NO: 2729350 - protein, 20 aa, Entamoeba histolytica
VELLHLLIDLLNEKGFTFRS

SEQ ID NO: 2729351 - protein, 24 aa, Entamoeba histolytica
VELNITYIHLVSYTKQIKLIDFGS

SEQ ID NO: 2729352 - protein, 17 aa, Entamoeba histolytica
VELVIPFERFTVVDWVD

SEQ ID NO: 2729353 - protein, 23 aa, Entamoeba histolytica
VELVLNKCFIEHLPLSISKLTNL

SEQ ID NO: 2729354 - protein, 27 aa, Entamoeba histolytica
VELYCSYIHSLLIKPTFDWINEAVQRD

SEQ ID NO: 2729355 - protein, 23 aa, Entamoeba histolytica
VEMFSKIFSFFIHKLCKHQQLTF

SEQ ID NO: 2729356 - protein, 22 aa, Entamoeba histolytica
VEMISICFFFVLKNMDDKTLKS

SEQ ID NO: 2729357 - protein, 26 aa, Entamoeba histolytica
VEMRKSSIPIFSKAPVMNKSGYFMVP

SEQ ID NO: 2729358 - protein, 33 aa, Entamoeba histolytica
VENFKKVGMLHFLTYYYGMDWHKVANAPQGDNT

SEQ ID NO: 2729359 - protein, 22 aa, Entamoeba histolytica
VENHKFFIIAQASKTGFMRIST

SEQ ID NO: 2729360 - protein, 23 aa, Entamoeba histolytica
VENIRNYIFDRFVFSTTGNDTNK

SEQ ID NO: 2729361 - protein, 20 aa, Entamoeba histolytica
VENMLEWFNKMISSIELLKE

SEQ ID NO: 2729362 - protein, 30 aa, Entamoeba histolytica
VENVISPFVFTCAVLPYLKPSGKIIFVTSN

SEQ ID NO: 2729363 - protein, 30 aa, Entamoeba histolytica
VENVMKYSWILFTILFKGIVMMTNSGKKLD

SEQ ID NO: 2729364 - protein, 24 aa, Entamoeba histolytica
VEPPHTLNKLPIKTIVPIDKQNIK

SEQ ID NO: 2729365 - protein, 29 aa, Entamoeba histolytica
VEPQLFLLRWVRILFCQMFNTNELYYIWD

SEQ ID NO: 2729366 - protein, 25 aa, Entamoeba histolytica
VEPVLYTNRFLYNALFSTGETLNDV

SEQ ID NO: 2729367 - protein, 24 aa, Entamoeba histolytica
VEPYNCVLSIHKLLESSAITFCFD

SEQ ID NO: 2729368 - protein, 27 aa, Entamoeba histolytica
VEQFNNTYVLWKPMTEKIAFSYTERYG

SEQ ID NO: 2729369 - protein, 25 aa, Entamoeba histolytica
VEQINLFVNPIGCGDSFTAGLSASL

SEQ ID NO: 2729370 - protein, 28 aa, Entamoeba histolytica
VEQLCSILYLLYNELFQITLNQVYKLEA

SEQ ID NO: 2729371 - protein, 31 aa, Entamoeba histolytica
VEQNKLQVYQQIISLLFPNENSKKAICRLKK

SEQ ID NO: 2729372 - protein, 24 aa, Entamoeba histolytica
VEQNTLFIIMPFIPNNLEKEIKKK

SEQ ID NO: 2729373 - protein, 30 aa, Entamoeba histolytica; identical to SEQ ID NO: 2542387

SEQ ID NO: 2729374 - protein, 27 aa, Entamoeba histolytica
VERQRQFLMKVIDWKIQMDLMINKQST

SEQ ID NO: 2729375 - protein, 27 aa, Entamoeba histolytica
VERRRALCFTPLFTTAAHFQIDAIFAA

SEQ ID NO: 2729376 - protein, 18 aa, Entamoeba histolytica
VESILLQALYSKYQMFIK

SEQ ID NO: 2729377 - protein, 18 aa, Entamoeba histolytica
VESLRRRAIFNMNARIVA

SEQ ID NO: 2729378 - protein, 25 aa, Entamoeba histolytica
VESNINSIFPRITKVTRLSTGRVET

SEQ ID NO: 2729379 - protein, 32 aa, Entamoeba histolytica
VETIYSNKMILDKFAFCLYEEPSFEEFMKEQI

SEQ ID NO: 2729380 - protein, 27 aa, Entamoeba histolytica
VETQDSLPILRYVNIPLSDKTLELSTI

SEQ ID NO: 2729381 - protein, 18 aa, Entamoeba histolytica
VETSIIEQIPFLAHLASE

SEQ ID NO: 2729382 - protein, 29 aa, Entamoeba histolytica
VETTLPLRWKVFLSFLPPTPELWKKIDEE

SEQ ID NO: 2729383 - protein, 26 aa, Entamoeba histolytica
VEVMGNAMLIIPKTLIENSGYDVIER

SEQ ID NO: 2729384 - protein, 20 aa, Entamoeba histolytica
VEVQIIQRICLYWLRYDEST

SEQ ID NO: 2729385 - protein, 25 aa, Entamoeba histolytica
VEVQKGYFLFSFNPMVRGVIQVCLV

SEQ ID NO: 2729386 - protein, 18 aa, Entamoeba histolytica
VEVSIGKMLLLGCAFGIA

SEQ ID NO: 2729387 - protein, 25 aa, Entamoeba histolytica
VEYHYTFYINLFLPHMLNGDLNISK

SEQ ID NO: 2729388 - protein, 23 aa, Entamoeba histolytica
VEYIDYIICCVLVKSLNSFDQRM

SEQ ID NO: 2729389 - protein, 19 aa, Entamoeba histolytica
VEYNGLKFLIFDSPTDDNV

SEQ ID NO: 2729390 - protein, 27 aa, Entamoeba histolytica
VEYPETYFHYYLKYFAIRDKVSARKIV

SEQ ID NO: 2729391 - protein, 24 aa, Entamoeba histolytica
VEYPQWMDDDPLFINIFEAENHLV

SEQ ID NO: 2729392 - protein, 21 aa, Entamoeba histolytica
VEYSLPLYSTNNPRGILLNCN

SEQ ID NO: 2729393 - protein, 26 aa, Entamoeba histolytica
VEYVKYIGIIDFQLTDYILLSAIVKK

SEQ ID NO: 2729394 - protein, 31 aa, Entamoeba histolytica
VFADSVSSLVLMLVALQEKNKPPRPEMQMSI

SEQ ID NO: 2729395 - protein, 19 aa, Entamoeba histolytica
VFCIYLNMDTKDKIFKCVF

SEQ ID NO: 2729396 - protein, 17 aa, Entamoeba histolytica
VFCKESTEGFLFKTYHA

SEQ ID NO: 2729397 - protein, 17 aa, Entamoeba histolytica
VFCNVPISHYVTGYQEV

SEQ ID NO: 2729398 - protein, 17 aa, Entamoeba histolytica
VFCSIFGLSLDAKTPLL

SEQ ID NO: 2729399 - protein, 17 aa, Entamoeba histolytica
VFDAKRMIGRRFSDPTI

SEQ ID NO: 2729400 - protein, 23 aa, Entamoeba histolytica
VFDDGKEVPLTWTEGHYWVGNYN

SEQ ID NO: 2729401 - protein, 19 aa, Entamoeba histolytica
VFDFNIKFGLYLKEIEEEE

SEQ ID NO: 2729402 - protein, 26 aa, Entamoeba histolytica
VFDLNAICFVTLPNHVKITAGQKYLF

SEQ ID NO: 2729403 - protein, 18 aa, Entamoeba histolytica
VFDLSPENKPFLGMAAAI

SEQ ID NO: 2729404 - protein, 17 aa, Entamoeba histolytica
VFDVMAFVYQHIRMLHD

SEQ ID NO: 2729405 - protein, 19 aa, Entamoeba histolytica
VFDYFPKNRVEILTKLKTI

SEQ ID NO: 2729406 - protein, 17 aa, Entamoeba histolytica
VFEDGSRIIFRLSGTGS

SEQ ID NO: 2729407 - protein, 26 aa, Entamoeba histolytica
VFEDYGEIWLGFYSHLIVSFILTIDE

SEQ ID NO: 2729408 - protein, 17 aa, Entamoeba histolytica
VFEGVYNSMKCAIKRIN

SEQ ID NO: 2729409 - protein, 20 aa, Entamoeba histolytica
VFEKCGRVLAITLSKTKDKK

SEQ ID NO: 2729410 - protein, 27 aa, Entamoeba histolytica
VFEKSVPFKRFYLEALDLLQPVEKVTC

SEQ ID NO: 2729411 - protein, 24 aa, Entamoeba histolytica
VFEKYMKLLEKKGYLKDVPEEEKE

SEQ ID NO: 2729412 - protein, 19 aa, Entamoeba histolytica
VFEMSETCIMVNIQRISLD

SEQ ID NO: 2729413 - protein, 20 aa, Entamoeba histolytica
VFESKKYPLLHQKGMYDESF

SEQ ID NO: 2729414 - protein, 27 aa, Entamoeba histolytica
VFETCQKIPYSLIWLIRCISSKVHDEK

SEQ ID NO: 2729415 - protein, 19 aa, Entamoeba histolytica
VFGFSFKGPVRGIFKDIFS

SEQ ID NO: 2729416 - protein, 17 aa, Entamoeba histolytica
VFGNFKYHQCPCKGNEC

SEQ ID NO: 2729417 - protein, 33 aa, Entamoeba histolytica
VFGYELPTDPVFPGTIPIFLSRQHYKILHNIRF

SEQ ID NO: 2729418 - protein, 18 aa, Entamoeba histolytica
VFGYYSPLGITKIGEYNY

SEQ ID NO: 2729419 - protein, 24 aa, Entamoeba histolytica
VFHKYAIIKRLRRKPIGLMRGKTD

SEQ ID NO: 2729420 - protein, 21 aa, Entamoeba histolytica
VFHPNIVLFLGASTEKKIMIV

SEQ ID NO: 2729421 - protein, 24 aa, Entamoeba histolytica
VFIQDIVELLLFNKPARLRMTSLQ

SEQ ID NO: 2729422 - protein, 20 aa, Entamoeba histolytica
VFIQSPCTRILFINGTPGTG

SEQ ID NO: 2729423 - protein, 37 aa, Entamoeba histolytica
VFISKGFKTYLFSTLCPTPWTAFAVGYLKTACGVMVT

SEQ ID NO: 2729424 - protein, 21 aa, Entamoeba histolytica
VFKEYTQLKGINIYDGIKGEK

SEQ ID NO: 2729425 - protein, 27 aa, Entamoeba histolytica
VFKHCMSLFWCDFLRANATNIVENTMN

SEQ ID NO: 2729426 - protein, 18 aa, Entamoeba histolytica
VFKIDYTIELIVSSLLEE

SEQ ID NO: 2729427 - protein, 18 aa, Entamoeba histolytica
VFKRWKKRYCVLASNVIA

SEQ ID NO: 2729428 - protein, 17 aa, Entamoeba histolytica
VFKYLKKVQIKSLYNKR

SEQ ID NO: 2729429 - protein, 30 aa, Entamoeba histolytica
VFLDAIEHAFPPTGGWGLGIDRLAMLLADV

SEQ ID NO: 2729430 - protein, 17 aa, Entamoeba histolytica
VFLIGKVKGDNGFISCS

SEQ ID NO: 2729431 - protein, 17 aa, Entamoeba histolytica
VFLIKRNSEKKIEKVTI

SEQ ID NO: 2729432 - protein, 25 aa, Entamoeba histolytica
VFLRNVLFYFPNLYEIMKFESVSKS

SEQ ID NO: 2729433 - protein, 18 aa, Entamoeba histolytica
VFLTGKLAEPYLMKYFPG

SEQ ID NO: 2729434 - protein, 18 aa, Entamoeba histolytica
VFNCIWNKFIFKASPHIV

SEQ ID NO: 2729435 - protein, 18 aa, Entamoeba histolytica
VFNMKRKAVLMEPVSLQK

SEQ ID NO: 2729436 - protein, 18 aa, Entamoeba histolytica
VFNNYLIPFIALYPSQIE

SEQ ID NO: 2729437 - protein, 19 aa, Entamoeba histolytica
VFNTKWFCSKIRKIRIDGY

SEQ ID NO: 2729438 - protein, 17 aa, Entamoeba histolytica
VFNYYLDEHWQPLEYIL

SEQ ID NO: 2729439 - protein, 17 aa, Entamoeba histolytica
VFPKWSIVDPCHSMSLP

SEQ ID NO: 2729440 - protein, 17 aa, Entamoeba histolytica
VFPQNIQFSPNGRFIAI

SEQ ID NO: 2729441 - protein, 17 aa, Entamoeba histolytica
VFPSLSVSLISKTLRSF

SEQ ID NO: 2729442 - protein, 18 aa, Entamoeba histolytica
VFQLLDDATLQQVDPKVI

SEQ ID NO: 2729443 - protein, 17 aa, Entamoeba histolytica
VFRSITASYFRNRHVMC

SEQ ID NO: 2729444 - protein, 18 aa, Entamoeba histolytica
VFSFIEEQTTRLNEVLLK

SEQ ID NO: 2729445 - protein, 26 aa, Entamoeba histolytica
VFSIGVLMVYLLQYDGNQSHLNLNNT

SEQ ID NO: 2729446 - protein, 18 aa, Entamoeba histolytica
VFSLESKGRMKGMKKFDI

SEQ ID NO: 2729447 - protein, 28 aa, Entamoeba histolytica
VFSNVNRKWYFAPRKISNIAYNETYDNL

SEQ ID NO: 2729448 - protein, 17 aa, Entamoeba histolytica
VFSPMKIGEIKREKIPI

SEQ ID NO: 2729449 - protein, 30 aa, Entamoeba histolytica
VFTKEEFLKSLPLPRTVLTDGSIPSKCVLT

SEQ ID NO: 2729450 - protein, 25 aa, Entamoeba histolytica
VFTQLTGFIPDYPYRSFRSFGGTLI

SEQ ID NO: 2729451 - protein, 32 aa, Entamoeba histolytica
VFTYNEFEYFLPYLYIVCYYSHLSIPPLSHKG

SEQ ID NO: 2729452 - protein, 17 aa, Entamoeba histolytica
VFVLKGCSPIPGAIIYD

SEQ ID NO: 2729453 - protein, 34 aa, Entamoeba histolytica
VFVLLTRYIDYMVDIVRPRKLLYIAIDGVAPRAK

SEQ ID NO: 2729454 - protein, 17 aa, Entamoeba histolytica
VFVYAWKISNCNPEVQF

SEQ ID NO: 2729455 - protein, 18 aa, Entamoeba histolytica
VFYHSSSCPSCRSIEPFF

SEQ ID NO: 2729456 - protein, 17 aa, Entamoeba histolytica
VFYIETFIDKNNPSFWG

SEQ ID NO: 2729457 - protein, 26 aa, Entamoeba histolytica
VGADPNFFVYSFQNPFNTEPLKILKK

SEQ ID NO: 2729458 - protein, 21 aa, Entamoeba histolytica
VGCILFEMLAGYPPFVSDDSV

SEQ ID NO: 2729459 - protein, 37 aa, Entamoeba histolytica
VGCYNFIKLCKIEYYLHCIIYRVIKDYAIQFGDTTMG

SEQ ID NO: 2729460 - protein, 17 aa, Entamoeba histolytica
VGDFIHLIFLEERTKNS

SEQ ID NO: 2729461 - protein, 18 aa, Entamoeba histolytica
VGDGLQPGFLWMECPTIK

SEQ ID NO: 2729462 - protein, 18 aa, Entamoeba histolytica
VGDIVFVESIIASWAVVH

SEQ ID NO: 2729463 - protein, 24 aa, Entamoeba histolytica
VGDKTISFWLMDKEMYTGMSCLWQ

SEQ ID NO: 2729464 - protein, 31 aa, Entamoeba histolytica
VGDNDQYLILTGKYLALFNNVMDAYKKTSPI

SEQ ID NO: 2729465 - protein, 30 aa, Entamoeba histolytica
VGDNTFDNALYMLLTFANLSNNYIVKKVER

SEQ ID NO: 2729466 - protein, 22 aa, Entamoeba histolytica
VGDPERVPKIAELVFDKSKDIF

SEQ ID NO: 2729467 - protein, 24 aa, Entamoeba histolytica
VGDQQFEDRYDLLNYCMNTNSEPT

SEQ ID NO: 2729468 - protein, 22 aa, Entamoeba histolytica
VGDSPILICTLVCDKEANVVIE

SEQ ID NO: 2729469 - protein, 26 aa, Entamoeba histolytica
VGEALPPMYIILAHLNPIVHCSRYVQ

SEQ ID NO: 2729470 - protein, 19 aa, Entamoeba histolytica
VGEFRLIFAGRVLKDDEVL

SEQ ID NO: 2729471 - protein, 24 aa, Entamoeba histolytica
VGFDKFMKGISLYLKKYMYGNAIS

SEQ ID NO: 2729472 - protein, 19 aa, Entamoeba histolytica
VGFLNTLGMPFKIGEIAFY

SEQ ID NO: 2729473 - protein, 17 aa, Entamoeba histolytica
VGFQFNVVESTIGTRRP

SEQ ID NO: 2729474 - protein, 17 aa, Entamoeba histolytica
VGGHEVHIPSFLKKKQL

SEQ ID NO: 2729475 - protein, 33 aa, Entamoeba histolytica
VGGKKYLNFKTFPKYFIMSVKLFEMGYYGCVKK

SEQ ID NO: 2729476 - protein, 18 aa, Entamoeba histolytica
VGGKYFLNPGSATGAYSP

SEQ ID NO: 2729477 - protein, 24 aa, Entamoeba histolytica
VGGSCMIPFVREKISKLFSSTKLA

SEQ ID NO: 2729478 - protein, 36 aa, Entamoeba histolytica; identical to SEQ ID NO: 2542477

SEQ ID NO: 2729479 - protein, 20 aa, Entamoeba histolytica
VGGTYFCEFLKKTRFDQVEE

SEQ ID NO: 2729480 - protein, 27 aa, Entamoeba histolytica
VGGYDYLLSMKIWTLTYEKAKKLMEDC

SEQ ID NO: 2729481 - protein, 29 aa, Entamoeba histolytica
VGIMVGGYKMYHKYFIEGSLGFEIEGHNT

SEQ ID NO: 2729482 - protein, 17 aa, Entamoeba histolytica
VGIPIFPGNSEYNMLFK

SEQ ID NO: 2729483 - protein, 27 aa, Entamoeba histolytica
VGISLDRWMYVWDPIKKVPISKTYLHG

SEQ ID NO: 2729484 - protein, 23 aa, Entamoeba histolytica
VGKSNLLLRFTRDEFDPEKKSTI

SEQ ID NO: 2729485 - protein, 26 aa, Entamoeba histolytica
VGKTCLLTRYRLNTFPEDYVPTVFEN

SEQ ID NO: 2729486 - protein, 19 aa, Entamoeba histolytica
VGKTIWFIEQPLVGSFEKY

SEQ ID NO: 2729487 - protein, 21 aa, Entamoeba histolytica
VGLIYICVIVKERIEKRELRL

SEQ ID NO: 2729488 - protein, 20 aa, Entamoeba histolytica
VGLTLELRHILKWDQADIQA

SEQ ID NO: 2729489 - protein, 22 aa, Entamoeba histolytica
VGMLRINPWFTPQGNYIQWHDA

SEQ ID NO: 2729490 - protein, 25 aa, Entamoeba histolytica
VGNEKEILRIFFPKDYVTGERRDYC

SEQ ID NO: 2729491 - protein, 28 aa, Entamoeba histolytica
VGNGIERNYTLQKFILQCYEEQLKNNKN

SEQ ID NO: 2729492 - protein, 29 aa, Entamoeba histolytica
VGNGIERNYTLQKFILQCYEEQLKNNKNK

SEQ ID NO: 2729493 - protein, 24 aa, Entamoeba histolytica
VGNISFHLSIYNKALYKQNNDCEP

SEQ ID NO: 2729494 - protein, 24 aa, Entamoeba histolytica
VGNPPSAIFQFWASTDDLQIHFLQ

SEQ ID NO: 2729495 - protein, 26 aa, Entamoeba histolytica
VGNSLQMLLPYIAPYLNFTTDYQISL

SEQ ID NO: 2729496 - protein, 18 aa, Entamoeba histolytica
VGNYLYPMLSKSMAPEAT

SEQ ID NO: 2729497 - protein, 18 aa, Entamoeba histolytica
VGPLLNLLVKHYSGLEAY

SEQ ID NO: 2729498 - protein, 24 aa, Entamoeba histolytica
VGQYEYIIQFSISKKSGSLLDDLF

SEQ ID NO: 2729499 - protein, 28 aa, Entamoeba histolytica
VGREELYSQPILVEKYRRSKKEVEKMIE

SEQ ID NO: 2729500 - protein, 29 aa, Entamoeba histolytica
VGREELYSQPILVEKYRRSKKEVEKMIEG

SEQ ID NO: 2729501 - protein, 24 aa, Entamoeba histolytica
VGSFITSIYIPTSVTYIISGAFSD

SEQ ID NO: 2729502 - protein, 24 aa, Entamoeba histolytica
VGSIKALWVAWKLGAKDYKINENG

SEQ ID NO: 2729503 - protein, 33 aa, Entamoeba histolytica; identical to SEQ ID NO: 2542512

SEQ ID NO: 2729504 - protein, 17 aa, Entamoeba histolytica
VGSNKILLQPLGNGEIL

SEQ ID NO: 2729505 - protein, 23 aa, Entamoeba histolytica
VGSQYYMTKPKKNNFMDQEIIEH

SEQ ID NO: 2729506 - protein, 23 aa, Entamoeba histolytica
VGTKDLIRIFGIDKKTAPWNIIK

SEQ ID NO: 2729507 - protein, 49 aa, Entamoeba histolytica
VGTKQLLNFIKICENKPVCFDLLFSFMTDYIYFPRVLSEIDKFFQNPKQ

SEQ ID NO: 2729508 - protein, 28 aa, Entamoeba histolytica
VGVKKSGWRFPLPIYRCLEYLEKNDGLK

SEQ ID NO: 2729509 - protein, 26 aa, Entamoeba histolytica
VGVLELMRILLDIEGLEWNQAWEIVV

SEQ ID NO: 2729510 - protein, 17 aa, Entamoeba histolytica
VGWFPKQVQEFKQILKL

SEQ ID NO: 2729511 - protein, 22 aa, Entamoeba histolytica
VGWVHYDIFKPEPNVLLFRRKR

SEQ ID NO: 2729512 - protein, 25 aa, Entamoeba histolytica
VGYEQFLAPELFFNPEIFSSDFTTP

SEQ ID NO: 2729513 - protein, 24 aa, Entamoeba histolytica
VGYKLIIPLCYFQQIQVSSLLIPL

SEQ ID NO: 2729514 - protein, 28 aa, Entamoeba histolytica
VGYQPNPLLDRIFWKKPTNAMIVYQEPN

SEQ ID NO: 2729515 - protein, 18 aa, Entamoeba histolytica
VGYTPVVPGMHKIEVLVN

SEQ ID NO: 2729516 - protein, 24 aa, Entamoeba histolytica
VHDEKILTSFLPLTIRLLTIPEDK

SEQ ID NO: 2729517 - protein, 27 aa, Entamoeba histolytica
VHELRDLLIYLLVHSSPIFPEIYNNNA

SEQ ID NO: 2729518 - protein, 32 aa, Entamoeba histolytica
VHFIVSLGIEINFFRTIDYYCFDKIIIEFLND

SEQ ID NO: 2729519 - protein, 18 aa, Entamoeba histolytica
VHGYISYNKDIGLFVFMN

SEQ ID NO: 2729520 - protein, 24 aa, Entamoeba histolytica
VHGYPLSQAVLINNPIRVLTSSIE

SEQ ID NO: 2729521 - protein, 17 aa, Entamoeba histolytica
VHHISLAHSASLFLIAP

SEQ ID NO: 2729522 - protein, 17 aa, Entamoeba histolytica
VHIIFQNKIKLCSLLTC

SEQ ID NO: 2729523 - protein, 20 aa, Entamoeba histolytica
VHIILRLRSSIPKKFILHTL

SEQ ID NO: 2729524 - protein, 26 aa, Entamoeba histolytica
VHINSIWFSFVFPQIDPKNYITDPFV

SEQ ID NO: 2729525 - protein, 26 aa, Entamoeba histolytica
VHKKTKLHYKLLIQTLLTLRHYNESQ

SEQ ID NO: 2729526 - protein, 25 aa, Entamoeba histolytica
VHKVLSCMTLFYYVSKDKLFKDVID

SEQ ID NO: 2729527 - protein, 35 aa, Entamoeba histolytica
VHLPPSLDAIFQPFKQFYLEKFPSRRISIEPEHSL

SEQ ID NO: 2729528 - protein, 22 aa, Entamoeba histolytica
VHLSKAFKYFVPSTELFFENYP

SEQ ID NO: 2729529 - protein, 25 aa, Entamoeba histolytica
VHMLDLECFSFLNNAIEQEMTPTIV

SEQ ID NO: 2729530 - protein, 18 aa, Entamoeba histolytica
VHPNGYLDHLFVLKRGTT

SEQ ID NO: 2729531 - protein, 22 aa, Entamoeba histolytica
VHPNIVCICERWSLIFSHHEKV

SEQ ID NO: 2729532 - protein, 28 aa, Entamoeba histolytica
VHPNNDPYFVFTVCSAFWILQDGTVSFH

SEQ ID NO: 2729533 - protein, 17 aa, Entamoeba histolytica
VHPPPPLNIPFANGIEE

SEQ ID NO: 2729534 - protein, 23 aa, Entamoeba histolytica
VHRDIKIENILFSSTRKFKLIDF

SEQ ID NO: 2729535 - protein, 18 aa, Entamoeba histolytica
VHRDLKLGNLLLQESRRS

SEQ ID NO: 2729536 - protein, 29 aa, Entamoeba histolytica
VHSEKIGTSVYFWGFPSEEFVNKKVENER

SEQ ID NO: 2729537 - protein, 29 aa, Entamoeba histolytica
VHSSIIFNEIPYFALIPSNSQVSLSPEPL

SEQ ID NO: 2729538 - protein, 26 aa, Entamoeba histolytica
VHTNKLQMRIIPLIKYATVDINLYNK

SEQ ID NO: 2729539 - protein, 17 aa, Entamoeba histolytica
VHVVITYKLHENNLVMT

SEQ ID NO: 2729540 - protein, 24 aa, Entamoeba histolytica
VIAFGMKEWAEELGASCFAHWFQP

SEQ ID NO: 2729541 - protein, 32 aa, Entamoeba histolytica
VIAGATKGYFLSPRIFTLYSKDKTLRVIEYPD

SEQ ID NO: 2729542 - protein, 29 aa, Entamoeba histolytica
VIAGSVDGAIWLWNGDSGKLITTLNSGIP

SEQ ID NO: 2729543 - protein, 17 aa, Entamoeba histolytica
VIAMIKPQEKCFGCGKE

SEQ ID NO: 2729544 - protein, 18 aa, Entamoeba histolytica
VIANSSWIFAHLLEKYQI

SEQ ID NO: 2729545 - protein, 26 aa, Entamoeba histolytica
VIANTTIISLLKWVTDDFLPTMTRIG

SEQ ID NO: 2729546 - protein, 24 aa, Entamoeba histolytica
VIAQICHDALQGLKYLHELHKIHR

SEQ ID NO: 2729547 - protein, 18 aa, Entamoeba histolytica
VIARLKYLRVLDISHCDG

SEQ ID NO: 2729548 - protein, 32 aa, Entamoeba histolytica
VIARREVICLPFYSFIVRYLYVRHENITQLLA

SEQ ID NO: 2729549 - protein, 27 aa, Entamoeba histolytica
VIASFGGLLLMLYGKPEKLSAYNMKDQ

SEQ ID NO: 2729550 - protein, 25 aa, Entamoeba histolytica
VICEDYIIIYNVKSGFFERRKYSNY

SEQ ID NO: 2729551 - protein, 26 aa, Entamoeba histolytica
VICKTIDFRFLRPLSIDFLRRFDKAA

SEQ ID NO: 2729552 - protein, 25 aa, Entamoeba histolytica
VIDAYLSERLPFTITVLTANNIAYR

SEQ ID NO: 2729553 - protein, 27 aa, Entamoeba histolytica
VIDEEQVFSLILYKTGNVIITKSVIYT

SEQ ID NO: 2729554 - protein, 18 aa, Entamoeba histolytica
VIDENLVIELKNQGYDEE

SEQ ID NO: 2729555 - protein, 18 aa, Entamoeba histolytica
VIDLAKQKTMDWWSCVII

SEQ ID NO: 2729556 - protein, 37 aa, Entamoeba histolytica
VIDLIELWRCIIKYSLFQLIPWLGICVKSVSLNPNKS

SEQ ID NO: 2729557 - protein, 17 aa, Entamoeba histolytica
VIDLIESKIPAGILAML

SEQ ID NO: 2729558 - protein, 18 aa, Entamoeba histolytica
VIDLIISYQPTHACTKFL

SEQ ID NO: 2729559 - protein, 17 aa, Entamoeba histolytica
VIDMWYGNRRDSAVVRT

SEQ ID NO: 2729560 - protein, 23 aa, Entamoeba histolytica
VIDSGEVMLLYNIVYSICASQDD

SEQ ID NO: 2729561 - protein, 17 aa, Entamoeba histolytica
VIEATSISMKFGRGRRQ

SEQ ID NO: 2729562 - protein, 24 aa, Entamoeba histolytica
VIEHLWDILSPKGIGYIVIIQDND

SEQ ID NO: 2729563 - protein, 30 aa, Entamoeba histolytica; identical to SEQ ID NO: 2542573

SEQ ID NO: 2729564 - protein, 28 aa, Entamoeba histolytica
VIEKYKSWLIRFPTIQDLAKANLADVLE

SEQ ID NO: 2729565 - protein, 31 aa, Entamoeba histolytica
VIELLIKEMAIILIKLSYYIKTFLIDCKSIK

SEQ ID NO: 2729566 - protein, 25 aa, Entamoeba histolytica
VIENIKLLIDFYSLSTPNYPTEHSL

SEQ ID NO: 2729567 - protein, 25 aa, Entamoeba histolytica
VIERARSVFSLPAQLRSAAANRDDD

SEQ ID NO: 2729568 - protein, 18 aa, Entamoeba histolytica
VIERSTCPFPFSLPSTIT

SEQ ID NO: 2729569 - protein, 19 aa, Entamoeba histolytica
VIFDFCNTGILFKTIQQTT

SEQ ID NO: 2729570 - protein, 21 aa, Entamoeba histolytica
VIFDFGKFNNGEIIKFYTSEG

SEQ ID NO: 2729571 - protein, 18 aa, Entamoeba histolytica
VIFLIMENLFYGKEPTKT

SEQ ID NO: 2729572 - protein, 24 aa, Entamoeba histolytica
VIFRQFSKIWPHKFINVTNGVTPR

SEQ ID NO: 2729573 - protein, 21 aa, Entamoeba histolytica
VIFSVITRYLPEHAIKFLISI

SEQ ID NO: 2729574 - protein, 32 aa, Entamoeba histolytica
VIGEWKDIIIPFKLKVFFYSKQTQEAKMGILF

SEQ ID NO: 2729575 - protein, 25 aa, Entamoeba histolytica
VIGKLQQKLFVQKKSTRGYGYDLAD

SEQ ID NO: 2729576 - protein, 34 aa, Entamoeba histolytica
VIGNFISMTLSFFPPYPFAKQIIINRLSSVKSLQ

SEQ ID NO: 2729577 - protein, 24 aa, Entamoeba histolytica
VIGRSAFKYIMPSQLILPNSITRI

SEQ ID NO: 2729578 - protein, 17 aa, Entamoeba histolytica
VIGYLMKEYEYSFEKAL

SEQ ID NO: 2729579 - protein, 18 aa, Entamoeba histolytica
VIHYLVKNKFVDAIVVTA

SEQ ID NO: 2729580 - protein, 17 aa, Entamoeba histolytica
VIIGPNGAGKSSIVCAI

SEQ ID NO: 2729581 - protein, 17 aa, Entamoeba histolytica
VIILMNSNKMLYIECTY

SEQ ID NO: 2729582 - protein, 19 aa, Entamoeba histolytica
VIILVDHFVCIYQSGTSLR

SEQ ID NO: 2729583 - protein, 18 aa, Entamoeba histolytica
VIIPIYYQNNEKVELYYN

SEQ ID NO: 2729584 - protein, 29 aa, Entamoeba histolytica
VIISNTRSFICPLTKKPFVNPVKAQVCGH

SEQ ID NO: 2729585 - protein, 20 aa, Entamoeba histolytica
VIISPRPLDWIYDPNKSFFH

SEQ ID NO: 2729586 - protein, 27 aa, Entamoeba histolytica
VIKDKKKLKIVIIIRLIIEIVEKETDL

SEQ ID NO: 2729587 - protein, 23 aa, Entamoeba histolytica
VIKEFLHIFQMPPASNIKGYVKE

SEQ ID NO: 2729588 - protein, 20 aa, Entamoeba histolytica
VIKEVIKKYPMSKLEEACDK

SEQ ID NO: 2729589 - protein, 35 aa, Entamoeba histolytica
VIKIINNVLKIKDIWKYVCIVWTKCYNSLSPKKIE

SEQ ID NO: 2729590 - protein, 23 aa, Entamoeba histolytica
VIKKYEFAFCPLFCVGLTEEIDT

SEQ ID NO: 2729591 - protein, 28 aa, Entamoeba histolytica
VIKNEKLLIRYPDWRLLTPQEADQETET

SEQ ID NO: 2729592 - protein, 24 aa, Entamoeba histolytica
VIKQTLKIFIINKEFKLLLNDSFS

SEQ ID NO: 2729593 - protein, 17 aa, Entamoeba histolytica
VIKRSYVDILLPKIRDI

SEQ ID NO: 2729594 - protein, 25 aa, Entamoeba histolytica
VIKSEEFILFVFDSYGNTALLQKTS

SEQ ID NO: 2729595 - protein, 48 aa, Entamoeba histolytica
VIKYTRICQFIDAFIFKYKTFTVAHIAAIVFLLLDPSKNLKVKRSDTS

SEQ ID NO: 2729596 - protein, 17 aa, Entamoeba histolytica
VILDNIKGPKYSEIVNI

SEQ ID NO: 2729597 - protein, 24 aa, Entamoeba histolytica
VILENELKPFFNKAMEIVLVIIEE

SEQ ID NO: 2729598 - protein, 19 aa, Entamoeba histolytica
VILEVLCDTLSPLNKQEAL

SEQ ID NO: 2729599 - protein, 17 aa, Entamoeba histolytica
VILGEYIEYYYNKSLKD

SEQ ID NO: 2729600 - protein, 18 aa, Entamoeba histolytica
VILIHFVVSPKSSSYQWF

SEQ ID NO: 2729601 - protein, 17 aa, Entamoeba histolytica
VILLKRYGINEMFRSSF

SEQ ID NO: 2729602 - protein, 17 aa, Entamoeba histolytica
VILMLHKENIDDPFVKF

SEQ ID NO: 2729603 - protein, 26 aa, Entamoeba histolytica
VILQLFQCGHLCPCAPSTFPCFPASS

SEQ ID NO: 2729604 - protein, 31 aa, Entamoeba histolytica
VILTLKGMGIDKVINFPFPSQINIERLKEAN

SEQ ID NO: 2729605 - protein, 20 aa, Entamoeba histolytica
VILTSLFPDISKKQKSSYLT

SEQ ID NO: 2729606 - protein, 18 aa, Entamoeba histolytica
VILWDAIFAFGHQLKLVD

SEQ ID NO: 2729607 - protein, 18 aa, Entamoeba histolytica
VINELLYKLLTANFPKTS

SEQ ID NO: 2729608 - protein, 17 aa, Entamoeba histolytica
VINSLFKSFDNIFLEDD

SEQ ID NO: 2729609 - protein, 19 aa, Entamoeba histolytica
VINVQPGWKDGTKLRYEGY

SEQ ID NO: 2729610 - protein, 20 aa, Entamoeba histolytica
VINYKKRRLMRKDEIQFLID

SEQ ID NO: 2729611 - protein, 24 aa, Entamoeba histolytica
VINYKLEYRWFNQLSEKQKLLFSG

SEQ ID NO: 2729612 - protein, 29 aa, Entamoeba histolytica
VIPALKVCTVLFKYIRILYNDIKDLPENE

SEQ ID NO: 2729613 - protein, 17 aa, Entamoeba histolytica
VIPIFSEAATQATLLLY

SEQ ID NO: 2729614 - protein, 17 aa, Entamoeba histolytica
VIPINCSVSQLINQVNY

SEQ ID NO: 2729615 - protein, 21 aa, Entamoeba histolytica
VIPMEQPIPQMLSPHRYDSPR

SEQ ID NO: 2729616 - protein, 17 aa, Entamoeba histolytica
VIPSCSLFYSISFVVHF

SEQ ID NO: 2729617 - protein, 33 aa, Entamoeba histolytica
VIQEKRQINPIQMEKIIQVKQKSPSETKQKTES

SEQ ID NO: 2729618 - protein, 23 aa, Entamoeba histolytica
VIQELFNFICTFIAHPFNEKIDC

SEQ ID NO: 2729619 - protein, 19 aa, Entamoeba histolytica
VIQKIIENYWGCIEKILSA

SEQ ID NO: 2729620 - protein, 27 aa, Entamoeba histolytica
VIQNPPTLMKILIFMKNCLTAKDPEKA

SEQ ID NO: 2729621 - protein, 26 aa, Entamoeba histolytica
VIQQGKESEWFFSTRKGKFEVSEELG

SEQ ID NO: 2729622 - protein, 26 aa, Entamoeba histolytica
VIQRIDRIPFIKFLSNLVFSNHEIRS

SEQ ID NO: 2729623 - protein, 19 aa, Entamoeba histolytica
VIQTLLKIFNEKNSNFFYG

SEQ ID NO: 2729624 - protein, 27 aa, Entamoeba histolytica
VIQTTINLLFHILPNLHLSMNVLINYP

SEQ ID NO: 2729625 - protein, 25 aa, Entamoeba histolytica
VIRDQLTKEWVLEGGALVLADMGIC

SEQ ID NO: 2729626 - protein, 24 aa, Entamoeba histolytica
VIRGGNILFIGKYLRIEKDGEVLN

SEQ ID NO: 2729627 - protein, 17 aa, Entamoeba histolytica
VIRGQMCGAFQDVAFNA

SEQ ID NO: 2729628 - protein, 17 aa, Entamoeba histolytica
VIRIYFNNKLLFSKDEI

SEQ ID NO: 2729629 - protein, 32 aa, Entamoeba histolytica
VIRKFLRSLNTPIWPQRLLQPMLSITMSNSTN

SEQ ID NO: 2729630 - protein, 31 aa, Entamoeba histolytica
VIRKQYPFEDLIYRPFLRLTYKEAIEMLRAS

SEQ ID NO: 2729631 - protein, 17 aa, Entamoeba histolytica
VIRMLRHSDTVRDWVIS

SEQ ID NO: 2729632 - protein, 22 aa, Entamoeba histolytica
VISELFFGMLLKRTLCDCGNYS

SEQ ID NO: 2729633 - protein, 17 aa, Entamoeba histolytica
VISELNDIKLQNEGMKK

SEQ ID NO: 2729634 - protein, 18 aa, Entamoeba histolytica
VISLLPPTTRIGLITFGQ

SEQ ID NO: 2729635 - protein, 17 aa, Entamoeba histolytica
VISLLSLSTLDLAIIYL

SEQ ID NO: 2729636 - protein, 18 aa, Entamoeba histolytica
VISLPDWVRKHSNKWKDD

SEQ ID NO: 2729637 - protein, 27 aa, Entamoeba histolytica
VISLYSMPIYLIVTLKRFIQNGDKWIK

SEQ ID NO: 2729638 - protein, 17 aa, Entamoeba histolytica
VISPIKRKSLLSEVENP

SEQ ID NO: 2729639 - protein, 30 aa, Entamoeba histolytica
VISPLRLKIMNFVRIWIKNAWRDFEGQTEL

SEQ ID NO: 2729640 - protein, 25 aa, Entamoeba histolytica
VISREFFNSRFIYGFNYLSIENVEL

SEQ ID NO: 2729641 - protein, 20 aa, Entamoeba histolytica
VISTLVPNVLRPNKKYITKE

SEQ ID NO: 2729642 - protein, 25 aa, Entamoeba histolytica
VISVPYTFGFLERKQINEAMSLIGF

SEQ ID NO: 2729643 - protein, 20 aa, Entamoeba histolytica
VITCQPEIKELDRLLDQFYL

SEQ ID NO: 2729644 - protein, 18 aa, Entamoeba histolytica
VITDNAHFLFSFRNKINT

SEQ ID NO: 2729645 - protein, 22 aa, Entamoeba histolytica
VITKVNFLLNNTIIFVQNASNQ

SEQ ID NO: 2729646 - protein, 18 aa, Entamoeba histolytica
VITNFLGIGFHLLSLFDG

SEQ ID NO: 2729647 - protein, 18 aa, Entamoeba histolytica
VITPIILPPVTAKVINFF

SEQ ID NO: 2729648 - protein, 18 aa, Entamoeba histolytica
VIVFIHSQGYIFGSYTSV

SEQ ID NO: 2729649 - protein, 18 aa, Entamoeba histolytica
VIVNVIEWKNGVKVIFAD

SEQ ID NO: 2729650 - protein, 20 aa, Entamoeba histolytica
VIVRKKALLVLKQMFKFFPS

SEQ ID NO: 2729651 - protein, 29 aa, Entamoeba histolytica
VIVVKFKTIVPFLKAYKQFVSYNEKAFNI

SEQ ID NO: 2729652 - protein, 18 aa, Entamoeba histolytica
VIYLRKKALKKAAASFTG

SEQ ID NO: 2729653 - protein, 18 aa, Entamoeba histolytica
VIYMLNNDWRQLKDYLSP

SEQ ID NO: 2729654 - protein, 17 aa, Entamoeba histolytica
VIYTLPLKSTKIIQIPK

SEQ ID NO: 2729655 - protein, 18 aa, Entamoeba histolytica
VKAAKKAQHFPARKFFVL

SEQ ID NO: 2729656 - protein, 21 aa, Entamoeba histolytica
VKAATIYVYGSYRLNVYGNNS

SEQ ID NO: 2729657 - protein, 41 aa, Entamoeba histolytica; identical to SEQ ID NO: 2542657

SEQ ID NO: 2729658 - protein, 19 aa, Entamoeba histolytica
VKAKLYNETIDFLDSAIIA

SEQ ID NO: 2729659 - protein, 23 aa, Entamoeba histolytica
VKALSTKPILPPNWKQTPKGNNL

SEQ ID NO: 2729660 - protein, 29 aa, Entamoeba histolytica
VKANIDEEFARRLTVRKVSTGFSEEKKET

SEQ ID NO: 2729661 - protein, 23 aa, Entamoeba histolytica
VKANLLPIKYFGFDFHKICANKK

SEQ ID NO: 2729662 - protein, 24 aa, Entamoeba histolytica
VKAPKGVLLYGPPGTGKTLLARAL

SEQ ID NO: 2729663 - protein, 25 aa, Entamoeba histolytica
VKAPKGVLLYGPPGTGKTLLARALA

SEQ ID NO: 2729664 - protein, 29 aa, Entamoeba histolytica
VKAQSIIRGFLYHKRYLTYKAFSATKFQQ

SEQ ID NO: 2729665 - protein, 22 aa, Entamoeba histolytica
VKDHFILPTKRIRPTKPKEQLK

SEQ ID NO: 2729666 - protein, 19 aa, Entamoeba histolytica
VKDLILEPKFEGCILPRIP

SEQ ID NO: 2729667 - protein, 31 aa, Entamoeba histolytica
VKEAILLYKYMLHYLIFRKVSNDTIKLILIE

SEQ ID NO: 2729668 - protein, 27 aa, Entamoeba histolytica
VKEEGKGYIFIFPKNTWGYVNEYCSTE

SEQ ID NO: 2729669 - protein, 22 aa, Entamoeba histolytica
VKEGYWFLLEDVDTAPPDVISL

SEQ ID NO: 2729670 - protein, 24 aa, Entamoeba histolytica
VKEINPVPTHRLISTNTKEIPGIL

SEQ ID NO: 2729671 - protein, 26 aa, Entamoeba histolytica
VKEIRMWIKKALERREKRVPILFVVG

SEQ ID NO: 2729672 - protein, 21 aa, Entamoeba histolytica
VKEMYYSITGTKPSIRVGEKA

SEQ ID NO: 2729673 - protein, 28 aa, Entamoeba histolytica
VKENGPKLYYWCIFKPKNKDPKPGILEV

SEQ ID NO: 2729674 - protein, 19 aa, Entamoeba histolytica
VKENPYKIPMVEPLSTFLN

SEQ ID NO: 2729675 - protein, 31 aa, Entamoeba histolytica
VKENWIGIYQPIVSQLKLNIRMNPSKKLIQL

SEQ ID NO: 2729676 - protein, 23 aa, Entamoeba histolytica
VKERYFYLFNDATVIYGEQQGKK

SEQ ID NO: 2729677 - protein, 17 aa, Entamoeba histolytica
VKETFIQLFEAINFDES

SEQ ID NO: 2729678 - protein, 18 aa, Entamoeba histolytica
VKEYEEISIMLNELNGLL

SEQ ID NO: 2729679 - protein, 19 aa, Entamoeba histolytica
VKFLSTLSLILIQNNIHYE

SEQ ID NO: 2729680 - protein, 24 aa, Entamoeba histolytica
VKFSPDYPLFALGFEKKVEIWRIP

SEQ ID NO: 2729681 - protein, 24 aa, Entamoeba histolytica
VKGDLEAFLARENRFALLGRKDKE

SEQ ID NO: 2729682 - protein, 26 aa, Entamoeba histolytica
VKGFCIMHYLAQTNYLLEWYKKYKLK

SEQ ID NO: 2729683 - protein, 22 aa, Entamoeba histolytica
VKGHLIKMMLYKIKQKKDLLKE

SEQ ID NO: 2729684 - protein, 25 aa, Entamoeba histolytica
VKGITHFPVVLHFIQILNSVVSEKL

SEQ ID NO: 2729685 - protein, 23 aa, Entamoeba histolytica
VKGQLLKIFITFPDPHFKNSVKR

SEQ ID NO: 2729686 - protein, 27 aa, Entamoeba histolytica
VKGWLQKDLFCDVFGWVVQKIFIELKT

SEQ ID NO: 2729687 - protein, 21 aa, Entamoeba histolytica
VKHFDPRLFTSHFNHIFVIVQ

SEQ ID NO: 2729688 - protein, 27 aa, Entamoeba histolytica
VKHKRKILKRNISPLFSLKLQDNINNN

SEQ ID NO: 2729689 - protein, 24 aa, Entamoeba histolytica
VKHLGEGKYFIRYSLPAEKGEYHI

SEQ ID NO: 2729690 - protein, 24 aa, Entamoeba histolytica
VKIIAMQYILLIEALTNAHIVYNK

SEQ ID NO: 2729691 - protein, 22 aa, Entamoeba histolytica
VKKAFIITTHGSKECTGNGYAI

SEQ ID NO: 2729692 - protein, 17 aa, Entamoeba histolytica
VKKGLLCQLFGGSAKTL

SEQ ID NO: 2729693 - protein, 23 aa, Entamoeba histolytica
VKKHFIAMLTFCDGKKPKVINAL

SEQ ID NO: 2729694 - protein, 23 aa, Entamoeba histolytica
VKKIHIIGEWKGILDERAMGIVI

SEQ ID NO: 2729695 - protein, 17 aa, Entamoeba histolytica
VKKILIDIFQIDKVIVP

SEQ ID NO: 2729696 - protein, 24 aa, Entamoeba histolytica
VKKLELKYLFCSPISKGIELAEKN

SEQ ID NO: 2729697 - protein, 18 aa, Entamoeba histolytica
VKKLLKYCSKIVPSLLLE

SEQ ID NO: 2729698 - protein, 26 aa, Entamoeba histolytica
VKKMCNHLLLFTLPLREEYAKSMIDQ

SEQ ID NO: 2729699 - protein, 23 aa, Entamoeba histolytica
VKKNFIAMFTFCDGEKPHVINAL

SEQ ID NO: 2729700 - protein, 22 aa, Entamoeba histolytica
VKKNFIAMLTFCDGKKPQVINA

SEQ ID NO: 2729701 - protein, 22 aa, Entamoeba histolytica
VKKNFIAMLTFCDGKTPQIINA

SEQ ID NO: 2729702 - protein, 19 aa, Entamoeba histolytica
VKKNFVAMLTFCDGEKPQV

SEQ ID NO: 2729703 - protein, 28 aa, Entamoeba histolytica
VKKNGLSKEFLWTFILNNDTEYDETRCI

SEQ ID NO: 2729704 - protein, 27 aa, Entamoeba histolytica
VKKNVMKVFSLIIYKTFADLGKDAESI

SEQ ID NO: 2729705 - protein, 25 aa, Entamoeba histolytica
VKKQIPQFILFTTPKNCREVTQDEF

SEQ ID NO: 2729706 - protein, 22 aa, Entamoeba histolytica
VKKRLAEVMSRDIEQLRAEAEK

SEQ ID NO: 2729707 - protein, 29 aa, Entamoeba histolytica
VKKSKPQPPPTAFQLHKADTELGNKPWKE

SEQ ID NO: 2729708 - protein, 26 aa, Entamoeba histolytica
VKKTSLFRIYFLTNDKGNPFIRTLDV

SEQ ID NO: 2729709 - protein, 24 aa, Entamoeba histolytica
VKKTVTFKLSLKRPIPLVGFCTYF

SEQ ID NO: 2729710 - protein, 25 aa, Entamoeba histolytica
VKKWKKRYVVWKDDKLFFFEKNYGK

SEQ ID NO: 2729711 - protein, 24 aa, Entamoeba histolytica
VKLFLITQPPLRPIIKGHYEEIVQ

SEQ ID NO: 2729712 - protein, 21 aa, Entamoeba histolytica
VKLMELIDFAVQFDNKKLANP

SEQ ID NO: 2729713 - protein, 20 aa, Entamoeba histolytica
VKLQISILTFYKAYIVSSLW

SEQ ID NO: 2729714 - protein, 39 aa, Entamoeba histolytica
VKLVSVFVKNIPYGWATNDMYQYFASSGPVKTRVITNKE

SEQ ID NO: 2729715 - protein, 28 aa, Entamoeba histolytica
VKMDGTRILFLPQLPETLQIFLGPNLHP

SEQ ID NO: 2729716 - protein, 17 aa, Entamoeba histolytica
VKMIGPFYCNFGRYISI

SEQ ID NO: 2729717 - protein, 33 aa, Entamoeba histolytica
VKMIRTNPPKVLLYAPFLFNNIPNINTLKLDAV

SEQ ID NO: 2729718 - protein, 25 aa, Entamoeba histolytica
VKNDPNFFVFTLSNPKKTSPIQFFL

SEQ ID NO: 2729719 - protein, 23 aa, Entamoeba histolytica
VKNFKGIHYLGGRFIPLELKDKL

SEQ ID NO: 2729720 - protein, 18 aa, Entamoeba histolytica
VKNHFFGRLKKLNCIEKE

SEQ ID NO: 2729721 - protein, 26 aa, Entamoeba histolytica
VKNTSLFRIYFLTNDKGNPFTRTLDV

SEQ ID NO: 2729722 - protein, 28 aa, Entamoeba histolytica
VKPFPKALEILKFLKQKGLKVAIATSSA

SEQ ID NO: 2729723 - protein, 21 aa, Entamoeba histolytica
VKPHPQFMLFATQNPPNTYGG

SEQ ID NO: 2729724 - protein, 28 aa, Entamoeba histolytica
VKPKSPFKKEINWTLLEKLDLKEFDKEV

SEQ ID NO: 2729725 - protein, 24 aa, Entamoeba histolytica
VKQEEFYIVLNYMQQLNLTHKKSH

SEQ ID NO: 2729726 - protein, 17 aa, Entamoeba histolytica
VKQIAMYIYTRNGIQVR

SEQ ID NO: 2729727 - protein, 26 aa, Entamoeba histolytica
VKQNLLKLITPDNCHLLLKTNDLQKF

SEQ ID NO: 2729728 - protein, 24 aa, Entamoeba histolytica
VKQNTFFTCQRFKEPTLLTCEKGI

SEQ ID NO: 2729729 - protein, 31 aa, Entamoeba histolytica
VKQRRNVKVLTLPFFQIKKLQFNNSEDGVID

SEQ ID NO: 2729730 - protein, 22 aa, Entamoeba histolytica
VKQYHTVVLPAFYKRFDDQFQS

SEQ ID NO: 2729731 - protein, 25 aa, Entamoeba histolytica
VKRFKQQFIYIISDKYKKPTIVINS

SEQ ID NO: 2729732 - protein, 18 aa, Entamoeba histolytica
VKRFPYVWGQDFIHSYWP

SEQ ID NO: 2729733 - protein, 20 aa, Entamoeba histolytica
VKRKLFHLDPIYLHDFGYKQ

SEQ ID NO: 2729734 - protein, 24 aa, Entamoeba histolytica
VKRKPTIMCTQPVFRPTINSSHEN

SEQ ID NO: 2729735 - protein, 19 aa, Entamoeba histolytica
VKRTLGYHYLFKDNYVMGK

SEQ ID NO: 2729736 - protein, 18 aa, Entamoeba histolytica
VKSAFIDIKSISGLKGKQ

SEQ ID NO: 2729737 - protein, 26 aa, Entamoeba histolytica
VKSGLIKIFCRIINGININCGYYEAH

SEQ ID NO: 2729738 - protein, 26 aa, Entamoeba histolytica
VKSIPKPIPRRRPLFQDAFNSEPKMF

SEQ ID NO: 2729739 - protein, 19 aa, Entamoeba histolytica
VKSLFGSEALPFLKDIFPG

SEQ ID NO: 2729740 - protein, 20 aa, Entamoeba histolytica
VKSRTVVYLKKGKLYLKHNS

SEQ ID NO: 2729741 - protein, 23 aa, Entamoeba histolytica
VKSYIYWHNLISQWVAYEICRHE

SEQ ID NO: 2729742 - protein, 48 aa, Entamoeba histolytica
VKTIEMFKILLFPLEWVCISITLLPRILINQLTSPFPYIIGVPSEYFK

SEQ ID NO: 2729743 - protein, 24 aa, Entamoeba histolytica
VKTIFDMHLYGPAMLACFPLQDIL

SEQ ID NO: 2729744 - protein, 19 aa, Entamoeba histolytica
VKTKFPGHPIWIPSEHVHG

SEQ ID NO: 2729745 - protein, 27 aa, Entamoeba histolytica
VKTLCQSCIFWFRLKASVTNALGITTA

SEQ ID NO: 2729746 - protein, 22 aa, Entamoeba histolytica
VKTLFEILDTLSGIPNSSHLLI

SEQ ID NO: 2729747 - protein, 17 aa, Entamoeba histolytica
VKTLPINASFHGICLTP

SEQ ID NO: 2729748 - protein, 25 aa, Entamoeba histolytica
VKVFSKLYSKYLKNCDTKRSDLVRD

SEQ ID NO: 2729749 - protein, 19 aa, Entamoeba histolytica
VKVSVIHCIIKRSELPNLT

SEQ ID NO: 2729750 - protein, 18 aa, Entamoeba histolytica
VKWNYKAEEFSLPITFTC

SEQ ID NO: 2729751 - protein, 36 aa, Entamoeba histolytica
VKYCMVMKKIPLINPLSLFSLRKLYASSKYTLDSIT

SEQ ID NO: 2729752 - protein, 32 aa, Entamoeba histolytica
VKYETILLVSRMGYIYGFYSGDGTLFFQGRVI

SEQ ID NO: 2729753 - protein, 25 aa, Entamoeba histolytica
VKYGHLDVITVPTIIVLNPGSFKEL

SEQ ID NO: 2729754 - protein, 24 aa, Entamoeba histolytica
VKYKKYRFMTIEPIKKNGYNHCIG

SEQ ID NO: 2729755 - protein, 17 aa, Entamoeba histolytica
VLADYIFYIINSVITKH

SEQ ID NO: 2729756 - protein, 25 aa, Entamoeba histolytica
VLAEASLVFPLIVSKTFAVTKRFDG

SEQ ID NO: 2729757 - protein, 21 aa, Entamoeba histolytica
VLAGMYQIYINPKTPINKIAD

SEQ ID NO: 2729758 - protein, 18 aa, Entamoeba histolytica
VLALRGILTARRQDTNIS

SEQ ID NO: 2729759 - protein, 18 aa, Entamoeba histolytica
VLASEPPTDYVWKCVCIH

SEQ ID NO: 2729760 - protein, 19 aa, Entamoeba histolytica
VLCNSPSFRRQVTDIDFIA

SEQ ID NO: 2729761 - protein, 18 aa, Entamoeba histolytica
VLCYYDGNNLYLPNGVSL

SEQ ID NO: 2729762 - protein, 17 aa, Entamoeba histolytica
VLDDIVPCCSVPVRLPS

SEQ ID NO: 2729763 - protein, 21 aa, Entamoeba histolytica
VLDGIVYNLQRKKVQFIRIDG

SEQ ID NO: 2729764 - protein, 24 aa, Entamoeba histolytica
VLDKKEVFDILQSIDPNITIQDIN

SEQ ID NO: 2729765 - protein, 17 aa, Entamoeba histolytica
VLDPALLRSGRFDRKIE

SEQ ID NO: 2729766 - protein, 23 aa, Entamoeba histolytica
VLEGFVWVDRVLFLKEFCSSVSC

SEQ ID NO: 2729767 - protein, 17 aa, Entamoeba histolytica
VLEMTIYRLGGVIGLMS

SEQ ID NO: 2729768 - protein, 21 aa, Entamoeba histolytica
VLEMVYYYKRPQQYYSFCDIM

SEQ ID NO: 2729769 - protein, 18 aa, Entamoeba histolytica
VLEPIELSAKYLPRFFKH

SEQ ID NO: 2729770 - protein, 33 aa, Entamoeba histolytica
VLEPVARFTNIVGPGIRGKYGRLAVGAINGAAK

SEQ ID NO: 2729771 - protein, 17 aa, Entamoeba histolytica
VLERRPIICPNSSFMKQ

SEQ ID NO: 2729772 - protein, 23 aa, Entamoeba histolytica
VLEWQEYFLKQFGVKTLYVKTNQ

SEQ ID NO: 2729773 - protein, 24 aa, Entamoeba histolytica
VLEYPNELLIALKALFNSITVKYP

SEQ ID NO: 2729774 - protein, 23 aa, Entamoeba histolytica
VLFDFIEHFTITSLIPIKERVEL

SEQ ID NO: 2729775 - protein, 22 aa, Entamoeba histolytica
VLFETGTFPKNFPFILGVIVKK

SEQ ID NO: 2729776 - protein, 24 aa, Entamoeba histolytica
VLFGSQTILLLKDSKDGYEIVTRY

SEQ ID NO: 2729777 - protein, 19 aa, Entamoeba histolytica
VLGFFQEDFVPLSPKFQCS

SEQ ID NO: 2729778 - protein, 17 aa, Entamoeba histolytica
VLGIQHQVKYYLSKVHV

SEQ ID NO: 2729779 - protein, 23 aa, Entamoeba histolytica
VLGKFIMLPTTQDKLIRLKSCQV

SEQ ID NO: 2729780 - protein, 17 aa, Entamoeba histolytica
VLGKYFIEVFKACGIQE

SEQ ID NO: 2729781 - protein, 23 aa, Entamoeba histolytica
VLGRIQQRLFVGKSKKGFGYITD

SEQ ID NO: 2729782 - protein, 19 aa, Entamoeba histolytica
VLGVYEILPKISGLQRNVV

SEQ ID NO: 2729783 - protein, 21 aa, Entamoeba histolytica
VLGYQEVITPNIFLSTLWETS

SEQ ID NO: 2729784 - protein, 20 aa, Entamoeba histolytica
VLHINPFHFKPLKCGLPTKN

SEQ ID NO: 2729785 - protein, 17 aa, Entamoeba histolytica
VLHLITNIPISNLDTLK

SEQ ID NO: 2729786 - protein, 19 aa, Entamoeba histolytica
VLHRELIPKGIEALKELLL

SEQ ID NO: 2729787 - protein, 20 aa, Entamoeba histolytica
VLIEGYAITFPFKNKKMIAA

SEQ ID NO: 2729788 - protein, 26 aa, Entamoeba histolytica
VLIHLKVTKTLLLFDETFRTMKAFEG

SEQ ID NO: 2729789 - protein, 18 aa, Entamoeba histolytica
VLIPMLPIEESYAGFAGC

SEQ ID NO: 2729790 - protein, 19 aa, Entamoeba histolytica
VLITPQRYFIANVGDSRCI

SEQ ID NO: 2729791 - protein, 21 aa, Entamoeba histolytica
VLIYNKYFTTFPAPMNCYFEK

SEQ ID NO: 2729792 - protein, 18 aa, Entamoeba histolytica
VLKESLNALCKIVGLFNQ

SEQ ID NO: 2729793 - protein, 24 aa, Entamoeba histolytica
VLKESLNALCKIVGLFNQTKKETE

SEQ ID NO: 2729794 - protein, 24 aa, Entamoeba histolytica
VLKETFGEQMLYKGLGYYNDKAAL

SEQ ID NO: 2729795 - protein, 17 aa, Entamoeba histolytica
VLKFLQGTELKKFLPEY

SEQ ID NO: 2729796 - protein, 28 aa, Entamoeba histolytica
VLKFYNIAVEWLRQSLFSERILPDSEKA

SEQ ID NO: 2729797 - protein, 24 aa, Entamoeba histolytica
VLKHQHTMFVPTKKLSFDDIDDEV

SEQ ID NO: 2729798 - protein, 17 aa, Entamoeba histolytica
VLKISKYVKTRTSVQVR

SEQ ID NO: 2729799 - protein, 17 aa, Entamoeba histolytica
VLKQFLEQVIRDSVTYT

SEQ ID NO: 2729800 - protein, 29 aa, Entamoeba histolytica
VLKQMKLMNLLRNYSFLYKSAAFLYVYPA

SEQ ID NO: 2729801 - protein, 17 aa, Entamoeba histolytica
VLKRKWGSYGSIHNNQY

SEQ ID NO: 2729802 - protein, 17 aa, Entamoeba histolytica
VLKRKWGSYGSITNEYF

SEQ ID NO: 2729803 - protein, 27 aa, Entamoeba histolytica
VLLHYYDSHNLLPHLLLSLASFEIKST

SEQ ID NO: 2729804 - protein, 19 aa, Entamoeba histolytica
VLLIRNNGIQLDLSTQLYS

SEQ ID NO: 2729805 - protein, 18 aa, Entamoeba histolytica
VLLKDPYAMEYIGLKGQH

SEQ ID NO: 2729806 - protein, 18 aa, Entamoeba histolytica
VLLKMILIGDSGVGKSSL

SEQ ID NO: 2729807 - protein, 17 aa, Entamoeba histolytica
VLLKPRKIKQKNSKSLA

SEQ ID NO: 2729808 - protein, 17 aa, Entamoeba histolytica
VLLNIAVGPLHKQKELE

SEQ ID NO: 2729809 - protein, 18 aa, Entamoeba histolytica
VLLPGHLYQTVIKEEIQN

SEQ ID NO: 2729810 - protein, 22 aa, Entamoeba histolytica
VLLTVLLKIIPINNIIEIILFH

SEQ ID NO: 2729811 - protein, 26 aa, Entamoeba histolytica
VLMGRVYPLKLGYIGVVNRSQQDINN

SEQ ID NO: 2729812 - protein, 29 aa, Entamoeba histolytica
VLNELPIELILKVFFYCFSHHPSIYALQV

SEQ ID NO: 2729813 - protein, 26 aa, Entamoeba histolytica
VLNGTSVLFNWCKKGHILLATTSTDF

SEQ ID NO: 2729814 - protein, 27 aa, Entamoeba histolytica
VLNHSNIVILVFDSLGNIFGGYMKKPI

SEQ ID NO: 2729815 - protein, 17 aa, Entamoeba histolytica
VLNKFLNYQVIYCVRHI

SEQ ID NO: 2729816 - protein, 25 aa, Entamoeba histolytica
VLNKGMLPLCFLIESIHLKGGLEHL

SEQ ID NO: 2729817 - protein, 26 aa, Entamoeba histolytica
VLNLQQLLNIKIEGFEYTFLNEGFGY

SEQ ID NO: 2729818 - protein, 19 aa, Entamoeba histolytica
VLNQVHVPINISVVNELQT

SEQ ID NO: 2729819 - protein, 17 aa, Entamoeba histolytica
VLNRFLELYQKNKDQRN

SEQ ID NO: 2729820 - protein, 27 aa, Entamoeba histolytica
VLNTFTELILFEAPFLSNALELLMRTF

SEQ ID NO: 2729821 - protein, 17 aa, Entamoeba histolytica
VLPFMHDPTFISLSHPS

SEQ ID NO: 2729822 - protein, 25 aa, Entamoeba histolytica
VLPQINSLRKVPYAKHILVLLQNYG

SEQ ID NO: 2729823 - protein, 17 aa, Entamoeba histolytica
VLPVITNKKSYFIFGSC

SEQ ID NO: 2729824 - protein, 18 aa, Entamoeba histolytica
VLQINPPEPIIQPPPQQY

SEQ ID NO: 2729825 - protein, 21 aa, Entamoeba histolytica
VLQLNGWFCNGTEIRFNLPQW

SEQ ID NO: 2729826 - protein, 27 aa, Entamoeba histolytica
VLQLRSEIQWYFRKYYHDNHFTEIQPP

SEQ ID NO: 2729827 - protein, 17 aa, Entamoeba histolytica
VLQPTLERIFTDYKKLT

SEQ ID NO: 2729828 - protein, 21 aa, Entamoeba histolytica
VLQQCLSVLDMYLRTDYIADG

SEQ ID NO: 2729829 - protein, 32 aa, Entamoeba histolytica
VLQQRIQMSFILYNDYLYSEAMYFIGNIMSMA

SEQ ID NO: 2729830 - protein, 27 aa, Entamoeba histolytica
VLQRSTELLLRKAPFQALVREIAQVSK

SEQ ID NO: 2729831 - protein, 24 aa, Entamoeba histolytica
VLQSFTHLSFSPMGDMLLATSNDS

SEQ ID NO: 2729832 - protein, 35 aa, Entamoeba histolytica
VLQVAEPWIQKGIHPTIIISGFLDALEDALESLHE

SEQ ID NO: 2729833 - protein, 23 aa, Entamoeba histolytica
VLREFRCCFILYYGDSTIVSKRT

SEQ ID NO: 2729834 - protein, 27 aa, Entamoeba histolytica
VLREYHPLCFDLLYYSNINKNNSIPYC

SEQ ID NO: 2729835 - protein, 19 aa, Entamoeba histolytica
VLRSPYIIRYYTSVLRQEE

SEQ ID NO: 2729836 - protein, 20 aa, Entamoeba histolytica
VLRTYALYNWRIGYGQGMND

SEQ ID NO: 2729837 - protein, 17 aa, Entamoeba histolytica
VLRYKNAFISCIADGCG

SEQ ID NO: 2729838 - protein, 20 aa, Entamoeba histolytica
VLRYQFNGKPLWIKSNDIPQ

SEQ ID NO: 2729839 - protein, 44 aa, Entamoeba histolytica; identical to SEQ ID NO: 2542844

SEQ ID NO: 2729840 - protein, 20 aa, Entamoeba histolytica
VLSKARLFILKDLKDVKKGS

SEQ ID NO: 2729841 - protein, 29 aa, Entamoeba histolytica
VLSKSPTKIIIILPPLTVGLVTIRIENEF

SEQ ID NO: 2729842 - protein, 18 aa, Entamoeba histolytica
VLSMNPFYHPDLPSTIEL

SEQ ID NO: 2729843 - protein, 32 aa, Entamoeba histolytica; identical to SEQ ID NO: 2542847

SEQ ID NO: 2729844 - protein, 25 aa, Entamoeba histolytica
VLSQNYHLYFYLTTDEFSFPVIDVS

SEQ ID NO: 2729845 - protein, 24 aa, Entamoeba histolytica
VLSRAELFLPMFKESNKYVKQGEC

SEQ ID NO: 2729846 - protein, 18 aa, Entamoeba histolytica
VLTDPIFHFPKVSTGSKA

SEQ ID NO: 2729847 - protein, 22 aa, Entamoeba histolytica
VLTIVFRTLLKFLQFTKVLNTI

SEQ ID NO: 2729848 - protein, 17 aa, Entamoeba histolytica
VLTTPIYSFGKKKESKK

SEQ ID NO: 2729849 - protein, 17 aa, Entamoeba histolytica
VLVNAEHTILLSGTALL

SEQ ID NO: 2729850 - protein, 19 aa, Entamoeba histolytica
VLVSLIKNVLLKTELIEAV

SEQ ID NO: 2729851 - protein, 17 aa, Entamoeba histolytica
VLWCYKKDLAFSSNQKK

SEQ ID NO: 2729852 - protein, 32 aa, Entamoeba histolytica; identical to SEQ ID NO: 2542859

SEQ ID NO: 2729853 - protein, 19 aa, Entamoeba histolytica
VLYGPRGLLNFLEKNDLIC

SEQ ID NO: 2729854 - protein, 19 aa, Entamoeba histolytica
VLYIARYVKELYLKKNIHD

SEQ ID NO: 2729855 - protein, 19 aa, Entamoeba histolytica
VLYIPAVFCSIFGLSLDTK

SEQ ID NO: 2729856 - protein, 18 aa, Entamoeba histolytica
VLYNVIEIGLRVLHPFMP

SEQ ID NO: 2729857 - protein, 19 aa, Entamoeba histolytica
VLYNVIEIGLRVLHPFMPF

SEQ ID NO: 2729858 - protein, 19 aa, Entamoeba histolytica
VLYQLVSAITYLHKNNIAH

SEQ ID NO: 2729859 - protein, 21 aa, Entamoeba histolytica
VLYYDLILLVNLSSSFPCLQI

SEQ ID NO: 2729860 - protein, 18 aa, Entamoeba histolytica
VMAATNRPFDLDDAVLRR

SEQ ID NO: 2729861 - protein, 18 aa, Entamoeba histolytica
VMDLKIVAGAKTGTRPDK

SEQ ID NO: 2729862 - protein, 19 aa, Entamoeba histolytica
VMELLLQLHKEGMTLLMVT

SEQ ID NO: 2729863 - protein, 25 aa, Entamoeba histolytica
VMELNNIFLITKKDYKMIIYEKTLN

SEQ ID NO: 2729864 - protein, 18 aa, Entamoeba histolytica
VMFGLNVLINLCSNKETR

SEQ ID NO: 2729865 - protein, 28 aa, Entamoeba histolytica
VMFKETLLSYYTLSKVLYIIQPKQNFET

SEQ ID NO: 2729866 - protein, 19 aa, Entamoeba histolytica
VMFSCKNEWLFTFGYSVHW

SEQ ID NO: 2729867 - protein, 21 aa, Entamoeba histolytica
VMGNYLLKLIGVAWKETIKKN

SEQ ID NO: 2729868 - protein, 25 aa, Entamoeba histolytica
VMGQFDRVLVDAPCTGLGIISRDAA

SEQ ID NO: 2729869 - protein, 29 aa, Entamoeba histolytica
VMHEKTYGLDIFKVRIRKVGKAKEIPKIF

SEQ ID NO: 2729870 - protein, 25 aa, Entamoeba histolytica
VMHKMCLTLIVLLRIAINHSTYEEI

SEQ ID NO: 2729871 - protein, 22 aa, Entamoeba histolytica
VMIDKLLLKLNLLKEIYEKEGY

SEQ ID NO: 2729872 - protein, 26 aa, Entamoeba histolytica
VMISEHSHHYWLESIKKLKAEFPNKV

SEQ ID NO: 2729873 - protein, 24 aa, Entamoeba histolytica
VMIYSLPQYFQTKTLLSILNESDI

SEQ ID NO: 2729874 - protein, 27 aa, Entamoeba histolytica
VMKKYMKHILTYLPLYPKRAKNINQKL

SEQ ID NO: 2729875 - protein, 25 aa, Entamoeba histolytica
VMKNLNPTWGDSFEFYNVTPGTMAT

SEQ ID NO: 2729876 - protein, 17 aa, Entamoeba histolytica
VMKPYEYALKLKKKHLE

SEQ ID NO: 2729877 - protein, 25 aa, Entamoeba histolytica
VMKTYLLLIKLLPHSQEQLLKVYEN

SEQ ID NO: 2729878 - protein, 37 aa, Entamoeba histolytica
VMLKEQELQIWKSETINTYLKNVFGKSIGKKGVKEVI

SEQ ID NO: 2729879 - protein, 18 aa, Entamoeba histolytica
VMLLYQSQDAPDLMKLSW

SEQ ID NO: 2729880 - protein, 20 aa, Entamoeba histolytica
VMNIELLHYTLTLYYNILTQ

SEQ ID NO: 2729881 - protein, 26 aa, Entamoeba histolytica
VMNKNNLIFLLFIKEKVFGISLNKPI

SEQ ID NO: 2729882 - protein, 26 aa, Entamoeba histolytica
VMNKRNLYFINFDEFGYVFGAFVSVP

SEQ ID NO: 2729883 - protein, 25 aa, Entamoeba histolytica
VMNKSGYFMVPSISELRELEEDKLN

SEQ ID NO: 2729884 - protein, 17 aa, Entamoeba histolytica
VMNLILELNQKIGTTII

SEQ ID NO: 2729885 - protein, 21 aa, Entamoeba histolytica
VMNLILELNQKIGTTIIMMDI

SEQ ID NO: 2729886 - protein, 25 aa, Entamoeba histolytica
VMNNQWLRRRRATAVSVIPKYQDYS

SEQ ID NO: 2729887 - protein, 43 aa, Entamoeba histolytica
VMNSNFALPIPIKISSHYLLPKGIPFITFLRNDIIITITSIKI

SEQ ID NO: 2729888 - protein, 19 aa, Entamoeba histolytica
VMNTCCFSPLTPNLLATGH

SEQ ID NO: 2729889 - protein, 19 aa, Entamoeba histolytica
VMQAYNWLQEHKGLFEEEV

SEQ ID NO: 2729890 - protein, 17 aa, Entamoeba histolytica
VMQLSLEIYDLISPLCK

SEQ ID NO: 2729891 - protein, 21 aa, Entamoeba histolytica
VMRRIFSFAPFPFHPAVPLFQ

SEQ ID NO: 2729892 - protein, 17 aa, Entamoeba histolytica
VMSLLACRYIDNVIIGA

SEQ ID NO: 2729893 - protein, 20 aa, Entamoeba histolytica
VMTALIPRNSTIPAKKSQVF

SEQ ID NO: 2729894 - protein, 19 aa, Entamoeba histolytica
VMVRALEQLYYLNALDDKT

SEQ ID NO: 2729895 - protein, 19 aa, Entamoeba histolytica
VMVTIYLSQLVKSVLAVHD

SEQ ID NO: 2729896 - protein, 24 aa, Entamoeba histolytica
VNAPSSYLVFLNGQLLGIHQNPIH

SEQ ID NO: 2729897 - protein, 25 aa, Entamoeba histolytica
VNAVFLHFQSVLSINKELLKNMTEL

SEQ ID NO: 2729898 - protein, 20 aa, Entamoeba histolytica
VNCFPLRVKALQLINSVMGK

SEQ ID NO: 2729899 - protein, 25 aa, Entamoeba histolytica
VNCICKYIELWPKAWGISVEEMLQI

SEQ ID NO: 2729900 - protein, 18 aa, Entamoeba histolytica
VNDIMRKVLAYQVSKKIL

SEQ ID NO: 2729901 - protein, 22 aa, Entamoeba histolytica
VNDLLLMWDVTKPKISTLKHSK

SEQ ID NO: 2729902 - protein, 32 aa, Entamoeba histolytica; identical to SEQ ID NO: 2542908

SEQ ID NO: 2729903 - protein, 24 aa, Entamoeba histolytica
VNEADANLALLPRDIKPEDAVMLS

SEQ ID NO: 2729904 - protein, 20 aa, Entamoeba histolytica
VNEFIYCSLHLKYFQTYLNE

SEQ ID NO: 2729905 - protein, 24 aa, Entamoeba histolytica
VNEGYKWCFDKKLVTVWSAPNYCY

SEQ ID NO: 2729906 - protein, 23 aa, Entamoeba histolytica
VNEKIITLYHSLSTTTSLTITKM

SEQ ID NO: 2729907 - protein, 24 aa, Entamoeba histolytica
VNELTNEVKKWKDIAVLKDVQQTQ

SEQ ID NO: 2729908 - protein, 20 aa, Entamoeba histolytica
VNELYPMHLMNDQNLSMTQT

SEQ ID NO: 2729909 - protein, 17 aa, Entamoeba histolytica
VNENLEFLSLYIAGKIT

SEQ ID NO: 2729910 - protein, 22 aa, Entamoeba histolytica
VNFSDYFSYRDSLKARHLNSLS

SEQ ID NO: 2729911 - protein, 26 aa, Entamoeba histolytica
VNFVQRMDPRWELVKAELIRRKEERE

SEQ ID NO: 2729912 - protein, 38 aa, Entamoeba histolytica
VNGEKTRFPYINVPKDDSGLTAYDILCLDDKELNQMLS

SEQ ID NO: 2729913 - protein, 27 aa, Entamoeba histolytica
VNGLKEHMYYMAPMPKFPGMDFGDLIG

SEQ ID NO: 2729914 - protein, 28 aa, Entamoeba histolytica
VNGRQLKISMINLFKFISSQIKDVQEED

SEQ ID NO: 2729915 - protein, 23 aa, Entamoeba histolytica
VNGYDVILKWKGVSDGKSYCFGD

SEQ ID NO: 2729916 - protein, 24 aa, Entamoeba histolytica
VNHAIEILFRLCKLNYVDAIVTVG

SEQ ID NO: 2729917 - protein, 25 aa, Entamoeba histolytica
VNHANGIWYTPITGIWQTVWVEPVH

SEQ ID NO: 2729918 - protein, 23 aa, Entamoeba histolytica
VNHTKGLIKLTPKLQKLLQSSST

SEQ ID NO: 2729919 - protein, 17 aa, Entamoeba histolytica
VNHYSMKWLLEDIDINK

SEQ ID NO: 2729920 - protein, 22 aa, Entamoeba histolytica
VNITKWCALVPTQYLDYFTRFE

SEQ ID NO: 2729921 - protein, 29 aa, Entamoeba histolytica
VNKDIIREFIYILPPPNIYRGRKIDVVQL

SEQ ID NO: 2729922 - protein, 25 aa, Entamoeba histolytica
VNKDTYLILEKLPQQYDGRVKSMEV

SEQ ID NO: 2729923 - protein, 24 aa, Entamoeba histolytica
VNKIILGCHSVFANGGLVATSGAY

SEQ ID NO: 2729924 - protein, 24 aa, Entamoeba histolytica
VNKLSSVFGLHRLSLDKKVPEQLS

SEQ ID NO: 2729925 - protein, 29 aa, Entamoeba histolytica
VNKQTILPTKLEAVIPLIFHDASVTKSVG

SEQ ID NO: 2729926 - protein, 22 aa, Entamoeba histolytica
VNKSFILPNLLTSSFRRDLSLS

SEQ ID NO: 2729927 - protein, 25 aa, Entamoeba histolytica
VNKTQNWKLMPITGIFKVCLSTYYG

SEQ ID NO: 2729928 - protein, 21 aa, Entamoeba histolytica
VNKVLKMKLWDSEDGKRWSKS

SEQ ID NO: 2729929 - protein, 31 aa, Entamoeba histolytica
VNLEHLILHFNYLCFLPPAIGSLTKLKLLGL

SEQ ID NO: 2729930 - protein, 23 aa, Entamoeba histolytica
VNLHYVIDYCPGGELYSLMKKEQ

SEQ ID NO: 2729931 - protein, 25 aa, Entamoeba histolytica
VNLIANLFELGLVNERLPLTCLQEL

SEQ ID NO: 2729932 - protein, 25 aa, Entamoeba histolytica
VNLKDMFVLLSRFFNDIVPRDGSTI

SEQ ID NO: 2729933 - protein, 20 aa, Entamoeba histolytica
VNLKPKIFVIPLGTGNDMSI

SEQ ID NO: 2729934 - protein, 19 aa, Entamoeba histolytica
VNLLKLPDSLAKEFYCRDY

SEQ ID NO: 2729935 - protein, 23 aa, Entamoeba histolytica
VNLLTLLKPMHQIDFLILINVHS

SEQ ID NO: 2729936 - protein, 19 aa, Entamoeba histolytica
VNLPLHLVRFGTESQSCIC

SEQ ID NO: 2729937 - protein, 31 aa, Entamoeba histolytica
VNLRVSFLEGLFFVFAYFMDVTHAEECISIT

SEQ ID NO: 2729938 - protein, 26 aa, Entamoeba histolytica
VNLVCIDGILHIPYGIIKSGIISEAQ

SEQ ID NO: 2729939 - protein, 21 aa, Entamoeba histolytica
VNMDLIKLVSKAGGRMEDTEL

SEQ ID NO: 2729940 - protein, 26 aa, Entamoeba histolytica
VNNDAFSHFFLRCNKITIGKGVITEL

SEQ ID NO: 2729941 - protein, 21 aa, Entamoeba histolytica
VNNFPGAMPVNFGRTSFEIIQ

SEQ ID NO: 2729942 - protein, 21 aa, Entamoeba histolytica
VNNNIFYLKTLGFDEYMFDDV

SEQ ID NO: 2729943 - protein, 18 aa, Entamoeba histolytica
VNNNIIDLRTQNSYLIVS

SEQ ID NO: 2729944 - protein, 20 aa, Entamoeba histolytica
VNPQPLLRANLYQILAKIIP

SEQ ID NO: 2729945 - protein, 19 aa, Entamoeba histolytica
VNQCLQQLFQCCRVIPDAQ

SEQ ID NO: 2729946 - protein, 27 aa, Entamoeba histolytica
VNQNVLYQLIEALLKLVKDINNLKEIR

SEQ ID NO: 2729947 - protein, 17 aa, Entamoeba histolytica
VNQSVIFCNSKNRVEWI

SEQ ID NO: 2729948 - protein, 28 aa, Entamoeba histolytica
VNRDRLSQILIYFINNKLQDASNLLDDK

SEQ ID NO: 2729949 - protein, 23 aa, Entamoeba histolytica
VNRFDPLMCLKLIKYIIVECSTF

SEQ ID NO: 2729950 - protein, 25 aa, Entamoeba histolytica
VNRKAPIILSHHMLMGLKGPKAGKM

SEQ ID NO: 2729951 - protein, 18 aa, Entamoeba histolytica
VNRLFKKIADYDKKKYCM

SEQ ID NO: 2729952 - protein, 18 aa, Entamoeba histolytica
VNRRLYVIKLSKTDCKEF

SEQ ID NO: 2729953 - protein, 19 aa, Entamoeba histolytica
VNRYGLVIFDYNGDSRFHL

SEQ ID NO: 2729954 - protein, 31 aa, Entamoeba histolytica
VNSCLELAWSQIQNFLIKVLNNRIFESEHSK

SEQ ID NO: 2729955 - protein, 22 aa, Entamoeba histolytica
VNSHLSHLISSPLAIQCPNSVT

SEQ ID NO: 2729956 - protein, 18 aa, Entamoeba histolytica
VNSISFYNETIFLTAGSD

SEQ ID NO: 2729957 - protein, 23 aa, Entamoeba histolytica
VNSLWLHTSAKIFGVLKGKKKQL

SEQ ID NO: 2729958 - protein, 30 aa, Entamoeba histolytica
VNSNILLKVKLPPLLLKLNSITLSSYNNNN

SEQ ID NO: 2729959 - protein, 17 aa, Entamoeba histolytica
VNTFEYHPPQHSIPIIT

SEQ ID NO: 2729960 - protein, 17 aa, Entamoeba histolytica
VNTIRRKVFKKGYLTMV

SEQ ID NO: 2729961 - protein, 25 aa, Entamoeba histolytica
VNTLNNKLLIFYYNNDHKLQSSQSQ

SEQ ID NO: 2729962 - protein, 27 aa, Entamoeba histolytica
VNTNKPLHFTSKYAYLTLWGDEIQNQT

SEQ ID NO: 2729963 - protein, 25 aa, Entamoeba histolytica
VNVADWVILYLLEGNLYPDSPLLRG

SEQ ID NO: 2729964 - protein, 24 aa, Entamoeba histolytica
VNVKFFQLYPFEIVVQFDSLGIFE

SEQ ID NO: 2729965 - protein, 33 aa, Entamoeba histolytica; identical to SEQ ID NO: 2542973

SEQ ID NO: 2729966 - protein, 33 aa, Entamoeba histolytica
VNYKLLLNRSLWLKEWFVFLNFFHNKCVHQIEN

SEQ ID NO: 2729967 - protein, 21 aa, Entamoeba histolytica
VNYSKFPKSYLIRCFVTALSE

SEQ ID NO: 2729968 - protein, 25 aa, Entamoeba histolytica
VPAAPADIPPPPPPTAPMMDNIPPP

SEQ ID NO: 2729969 - protein, 17 aa, Entamoeba histolytica
VPAIIINILKITGFNRT

SEQ ID NO: 2729970 - protein, 22 aa, Entamoeba histolytica
VPCGVAWPYLIGAKGIGIDPKD

SEQ ID NO: 2729971 - protein, 28 aa, Entamoeba histolytica
VPDGKMEGLYPLKRTRFLTWNERVQIVT

SEQ ID NO: 2729972 - protein, 37 aa, Entamoeba histolytica
VPEEELFFMEILACTYIFGTAMPRWEQYRKSCFERDF

SEQ ID NO: 2729973 - protein, 23 aa, Entamoeba histolytica
VPEEKIVLFKAIVKLCHKIMVHS

SEQ ID NO: 2729974 - protein, 27 aa, Entamoeba histolytica
VPEEVTWNFILLIQQNIELQGYAVHKL

SEQ ID NO: 2729975 - protein, 28 aa, Entamoeba histolytica
VPELAIRFGCHRIGFICNSPVLNDKREV

SEQ ID NO: 2729976 - protein, 19 aa, Entamoeba histolytica
VPELYLNDIIIRSVLEISG

SEQ ID NO: 2729977 - protein, 24 aa, Entamoeba histolytica
VPESALVVHKILVPPTVMGTVTWV

SEQ ID NO: 2729978 - protein, 29 aa, Entamoeba histolytica
VPEVLRPYVGGVEKIPFIAPKPVWAKEEK

SEQ ID NO: 2729979 - protein, 30 aa, Entamoeba histolytica; identical to SEQ ID NO: 2542985

SEQ ID NO: 2729980 - protein, 20 aa, Entamoeba histolytica
VPFELYTKFYLENKPNKPAI

SEQ ID NO: 2729981 - protein, 17 aa, Entamoeba histolytica
VPFLLRCCSDCANALLY

SEQ ID NO: 2729982 - protein, 27 aa, Entamoeba histolytica
VPFSRLLSFFSFIRLKQPIICVSVRVN

SEQ ID NO: 2729983 - protein, 18 aa, Entamoeba histolytica
VPGIYDVQVLLKNPENPE

SEQ ID NO: 2729984 - protein, 26 aa, Entamoeba histolytica
VPGKFELQQYQKQLIYLSIQTSVTLV

SEQ ID NO: 2729985 - protein, 20 aa, Entamoeba histolytica
VPGYYPSWFVGIRQKDSHEL

SEQ ID NO: 2729986 - protein, 24 aa, Entamoeba histolytica
VPHREIIKFFSNILPIIEAYRDTT

SEQ ID NO: 2729987 - protein, 26 aa, Entamoeba histolytica
VPIAKTILRCAVLHLPSPLEAQPKRI

SEQ ID NO: 2729988 - protein, 28 aa, Entamoeba histolytica
VPIDYNIFEQILFNYWSFILYDDTDDSL

SEQ ID NO: 2729989 - protein, 26 aa, Entamoeba histolytica
VPIELGQFFMAINIESFRPLADFEKQ

SEQ ID NO: 2729990 - protein, 17 aa, Entamoeba histolytica
VPIFRNKVLMVVGGGDA

SEQ ID NO: 2729991 - protein, 19 aa, Entamoeba histolytica
VPIGLFLHFLLSGVSHPKP

SEQ ID NO: 2729992 - protein, 20 aa, Entamoeba histolytica
VPILSISPNFYYDLALRVLS

SEQ ID NO: 2729993 - protein, 20 aa, Entamoeba histolytica
VPIMTLLMHYARTQFTDPNL

SEQ ID NO: 2729994 - protein, 18 aa, Entamoeba histolytica
VPIQCFFCGSTEHLAKDC

SEQ ID NO: 2729995 - protein, 24 aa, Entamoeba histolytica
VPIQNLDFFYIDLVSVTTMKGCVF

SEQ ID NO: 2729996 - protein, 18 aa, Entamoeba histolytica
VPISLNLDHGANFQICKE

SEQ ID NO: 2729997 - protein, 28 aa, Entamoeba histolytica
VPISSYKLYQLTTQSPYVIFGERIVDLA

SEQ ID NO: 2729998 - protein, 21 aa, Entamoeba histolytica
VPIVIETIYKRGVECKCFFFI

SEQ ID NO: 2729999 - protein, 25 aa, Entamoeba histolytica
VPKDSIPIIYFQENSWIIKPCHGFE

SEQ ID NO: 2730000 - protein, 27 aa, Entamoeba histolytica
VPKETICFVYNGDVIDPLLSLNDLSLK

SEQ ID NO: 2730001 - protein, 23 aa, Entamoeba histolytica
VPKKIFTIKIFAKPLREIVTFKT

SEQ ID NO: 2730002 - protein, 17 aa, Entamoeba histolytica
VPKLKGLVLIPTFVEEK

SEQ ID NO: 2730003 - protein, 30 aa, Entamoeba histolytica; identical to SEQ ID NO: 2517687

SEQ ID NO: 2730004 - protein, 31 aa, Entamoeba histolytica
VPLDLINPPVLRIKVFEPLFIVGKESYAKLD

SEQ ID NO: 2730005 - protein, 19 aa, Entamoeba histolytica
VPLKPLLTPHNRTIRRVKC

SEQ ID NO: 2730006 - protein, 18 aa, Entamoeba histolytica
VPLLHYLIQYSRKEKQFK

SEQ ID NO: 2730007 - protein, 21 aa, Entamoeba histolytica
VPLLTIPVISSIPFGDSFVSN

SEQ ID NO: 2730008 - protein, 18 aa, Entamoeba histolytica
VPLNCDLEDLYNGKTFKR

SEQ ID NO: 2730009 - protein, 32 aa, Entamoeba histolytica
VPLPDFLINKFVALAVRLYVRLMKKAGLVYGK

SEQ ID NO: 2730010 - protein, 23 aa, Entamoeba histolytica
VPLPEPELIFLQQFYEQYTSSSQ

SEQ ID NO: 2730011 - protein, 30 aa, Entamoeba histolytica
VPLVCFHIDFYVRMFILVKSSVALSGELPL

SEQ ID NO: 2730012 - protein, 27 aa, Entamoeba histolytica
VPNDIPENIFWCKYFRFLYTKCGKEKQ

SEQ ID NO: 2730013 - protein, 27 aa, Entamoeba histolytica
VPPKKELYGMYILVKGTPKNLGSSIAE

SEQ ID NO: 2730014 - protein, 33 aa, Entamoeba histolytica; identical to SEQ ID NO: 2543009

SEQ ID NO: 2730015 - protein, 21 aa, Entamoeba histolytica
VPQIYSYPLLMSLERLYILRM

SEQ ID NO: 2730016 - protein, 18 aa, Entamoeba histolytica
VPQQPALAPFDFAKEEQK

SEQ ID NO: 2730017 - protein, 22 aa, Entamoeba histolytica
VPQTDFDFLWKKINTFIKSNMS

SEQ ID NO: 2730018 - protein, 17 aa, Entamoeba histolytica
VPRLLDVEDFVLLEKPE

SEQ ID NO: 2730019 - protein, 26 aa, Entamoeba histolytica
VPRTVTVILERYLVVGLTAGQRICIE

SEQ ID NO: 2730020 - protein, 24 aa, Entamoeba histolytica
VPRYELFIRGVLKVLPRTHKEYKG

SEQ ID NO: 2730021 - protein, 19 aa, Entamoeba histolytica
VPSFMLLEINDSELTIYEY

SEQ ID NO: 2730022 - protein, 19 aa, Entamoeba histolytica
VPSILSVTVPLLLSSGNTL

SEQ ID NO: 2730023 - protein, 18 aa, Entamoeba histolytica
VPSVYFSIQPILSLFASE

SEQ ID NO: 2730024 - protein, 29 aa, Entamoeba histolytica
VPTEFSDNLIFVKNLAYAIKDEDLKEIFK

SEQ ID NO: 2730025 - protein, 18 aa, Entamoeba histolytica
VPTNDKCIMYAVGKDFAQ

SEQ ID NO: 2730026 - protein, 18 aa, Entamoeba histolytica
VPVFGWICVEKTPAPYVA

SEQ ID NO: 2730027 - protein, 25 aa, Entamoeba histolytica
VPVKVDNHIWIYTRSAKHAAAAPAE

SEQ ID NO: 2730028 - protein, 17 aa, Entamoeba histolytica
VPYFVFTASRYLENCAT

SEQ ID NO: 2730029 - protein, 26 aa, Entamoeba histolytica
VQCPQSNWWLVYKQKSFGYVPAAYLN

SEQ ID NO: 2730030 - protein, 24 aa, Entamoeba histolytica
VQDLALHYCDRAGIIVIRVGSTFD

SEQ ID NO: 2730031 - protein, 17 aa, Entamoeba histolytica
VQDWIRKLLKSKKTLEG

SEQ ID NO: 2730032 - protein, 30 aa, Entamoeba histolytica
VQEDCSCRLLRLGFFLFDCTNALRHFFDIC

SEQ ID NO: 2730033 - protein, 24 aa, Entamoeba histolytica
VQEFKQILKLLKSGSIRAVRVKTN

SEQ ID NO: 2730034 - protein, 17 aa, Entamoeba histolytica
VQETLVRAHSGWAIKIA

SEQ ID NO: 2730035 - protein, 25 aa, Entamoeba histolytica
VQGARAWIHTLETTDIKRPPALVIV

SEQ ID NO: 2730036 - protein, 22 aa, Entamoeba histolytica
VQGLKLCIKYYYEPLNENKGII

SEQ ID NO: 2730037 - protein, 17 aa, Entamoeba histolytica
VQGMSDLCGFLILILQE

SEQ ID NO: 2730038 - protein, 22 aa, Entamoeba histolytica
VQHVVFCSLTPLQKKIYTALCN

SEQ ID NO: 2730039 - protein, 48 aa, Entamoeba histolytica
VQIMRAFDYFFRSTSQKLFIMKIHLIDALIRFIRKKELQYSFYCMSRA

SEQ ID NO: 2730040 - protein, 19 aa, Entamoeba histolytica
VQIVKPFNSLFLSGSADRT

SEQ ID NO: 2730041 - protein, 27 aa, Entamoeba histolytica
VQKCYETYLSTPIYQMAYGTFENFVKQ

SEQ ID NO: 2730042 - protein, 28 aa, Entamoeba histolytica
VQKCYETYLSTPIYQMVYGTFENFVKQT

SEQ ID NO: 2730043 - protein, 24 aa, Entamoeba histolytica
VQKIFYGIKPLAYSLPAILHNFVN

SEQ ID NO: 2730044 - protein, 29 aa, Entamoeba histolytica
VQKRRKLLYYGLLIPINDEFPKKGPRLCF

SEQ ID NO: 2730045 - protein, 22 aa, Entamoeba histolytica
VQLFDFTIMDSRFLPFRELQSF

SEQ ID NO: 2730046 - protein, 20 aa, Entamoeba histolytica
VQLKKYEEIPWIKELRKEHR

SEQ ID NO: 2730047 - protein, 24 aa, Entamoeba histolytica
VQLKLRLMLNQMKLHQLKEIHAQE

SEQ ID NO: 2730048 - protein, 17 aa, Entamoeba histolytica
VQLLYSQQRYESLLNIK

SEQ ID NO: 2730049 - protein, 26 aa, Entamoeba histolytica
VQMRCGNIFGIFFNNTTKSLFKIISP

SEQ ID NO: 2730050 - protein, 27 aa, Entamoeba histolytica
VQNEEFYNLFFSKKYVCLLKGKDRVII

SEQ ID NO: 2730051 - protein, 22 aa, Entamoeba histolytica
VQNMKFLWTLTSDKSSFFFHVL

SEQ ID NO: 2730052 - protein, 25 aa, Entamoeba histolytica
VQNVYDFLWDVFLYCPNEIQNAPFD

SEQ ID NO: 2730053 - protein, 22 aa, Entamoeba histolytica
VQNYIRMRCNELVLLENKKGIS

SEQ ID NO: 2730054 - protein, 32 aa, Entamoeba histolytica
VQPNDFTILQLFKKYVMKTFNKLSAFTPVKSE

SEQ ID NO: 2730055 - protein, 22 aa, Entamoeba histolytica
VQPNPIFPQQQPIQPINPGNPI

SEQ ID NO: 2730056 - protein, 20 aa, Entamoeba histolytica
VQPNTPHEIIYEYGRILMND

SEQ ID NO: 2730057 - protein, 18 aa, Entamoeba histolytica
VQPYYDYPELLGLLIELA

SEQ ID NO: 2730058 - protein, 23 aa, Entamoeba histolytica
VQQLNILQKHPFSFKGHSLSSIK

SEQ ID NO: 2730059 - protein, 24 aa, Entamoeba histolytica
VQQRLFFLNKPIKVLDLFCCVGGD

SEQ ID NO: 2730060 - protein, 27 aa, Entamoeba histolytica
VQQSDGSWFSSWWKTDKDEVNMMKKVV

SEQ ID NO: 2730061 - protein, 24 aa, Entamoeba histolytica
VQRETTLYILTKLKEQNPGYFKAY

SEQ ID NO: 2730062 - protein, 28 aa, Entamoeba histolytica
VQRGEWKVPLPIYRAIQYLLEGDNLQTD

SEQ ID NO: 2730063 - protein, 20 aa, Entamoeba histolytica
VQRIIIYHFHGKLLSFSSIN

SEQ ID NO: 2730064 - protein, 27 aa, Entamoeba histolytica
VQRYQYLMEFVPVWSKGWEKLSPNKIE

SEQ ID NO: 2730065 - protein, 34 aa, Entamoeba histolytica
VQSKRLILMNIKENMLYCCFIHWIGHLFVQQKLD

SEQ ID NO: 2730066 - protein, 21 aa, Entamoeba histolytica
VQTKSIIPSVPVWNHFMAFDC

SEQ ID NO: 2730067 - protein, 30 aa, Entamoeba histolytica; identical to SEQ ID NO: 2543062

SEQ ID NO: 2730068 - protein, 18 aa, Entamoeba histolytica
VQTYLYLSKIEKKEERNV

SEQ ID NO: 2730069 - protein, 25 aa, Entamoeba histolytica
VQVIPLLLQQTLQFFYPPFIDNIHQ

SEQ ID NO: 2730070 - protein, 23 aa, Entamoeba histolytica
VQYPSLYKKFGVDTPAGILLYGP

SEQ ID NO: 2730071 - protein, 26 aa, Entamoeba histolytica
VQYQAIRLLHILKKHDRVALIRCVVT

SEQ ID NO: 2730072 - protein, 26 aa, Entamoeba histolytica
VQYWIPEIKKYRPELPLILCASHCGE

SEQ ID NO: 2730073 - protein, 26 aa, Entamoeba histolytica
VRAALMKLLQRIFLKEYTAPELIKMC

SEQ ID NO: 2730074 - protein, 19 aa, Entamoeba histolytica
VRCHPCLPLTIVLQQQSSK

SEQ ID NO: 2730075 - protein, 17 aa, Entamoeba histolytica
VRCHYPEITLIKKHLLK

SEQ ID NO: 2730076 - protein, 17 aa, Entamoeba histolytica
VRCQCALRRISAQQKKY

SEQ ID NO: 2730077 - protein, 24 aa, Entamoeba histolytica
VRDKDLFICGSSQKLVICDFTENV

SEQ ID NO: 2730078 - protein, 20 aa, Entamoeba histolytica
VRDLYALLCKRTGKSCNIIS

SEQ ID NO: 2730079 - protein, 23 aa, Entamoeba histolytica
VREDFNVFLFTDNSLQVFFTGTN

SEQ ID NO: 2730080 - protein, 18 aa, Entamoeba histolytica
VRERFDIIICDWMGINLY

SEQ ID NO: 2730081 - protein, 23 aa, Entamoeba histolytica
VRERFKFHYEKFSQYLPDFWGKK

SEQ ID NO: 2730082 - protein, 21 aa, Entamoeba histolytica
VREYTTFMKQLNCPSIMAGEV

SEQ ID NO: 2730083 - protein, 18 aa, Entamoeba histolytica
VRFILSKENPYNFTFFVF

SEQ ID NO: 2730084 - protein, 27 aa, Entamoeba histolytica
VRGKGNMVFLFLRKGIYTCQALVMKSE

SEQ ID NO: 2730085 - protein, 20 aa, Entamoeba histolytica
VRGKVTIPKVFCGEEQQEKP

SEQ ID NO: 2730086 - protein, 25 aa, Entamoeba histolytica
VRGLMDCWSTLRLCVEHQFGGVNSQ

SEQ ID NO: 2730087 - protein, 25 aa, Entamoeba histolytica
VRILDLILMEGWEIVFSIFSAILHY

SEQ ID NO: 2730088 - protein, 18 aa, Entamoeba histolytica
VRIQIKPTEQFWTQIEDS

SEQ ID NO: 2730089 - protein, 18 aa, Entamoeba histolytica
VRKFLKRIGLEQLTEQFI

SEQ ID NO: 2730090 - protein, 20 aa, Entamoeba histolytica
VRKQGIRYIIGEKMKIGIME

SEQ ID NO: 2730091 - protein, 20 aa, Entamoeba histolytica
VRKSSLLQDTKKPVIKTEKE

SEQ ID NO: 2730092 - protein, 30 aa, Entamoeba histolytica
VRLLEKFFQVYSSWDWLRTPVMLGTNDDFN

SEQ ID NO: 2730093 - protein, 24 aa, Entamoeba histolytica
VRLTLSQQYIFGNIINLFGKDVKK

SEQ ID NO: 2730094 - protein, 18 aa, Entamoeba histolytica
VRLVLKEYKILNADVYCD

SEQ ID NO: 2730095 - protein, 19 aa, Entamoeba histolytica
VRLYKFFKSPISVKFNFFS

SEQ ID NO: 2730096 - protein, 36 aa, Entamoeba histolytica
VRNGLTFLDIIILQLKALYREYGVVVPLVLMNSFST

SEQ ID NO: 2730097 - protein, 22 aa, Entamoeba histolytica
VRNNSIRMLLVSKLLERGVDVN

SEQ ID NO: 2730098 - protein, 33 aa, Entamoeba histolytica
VRNRILYIYRVIRPFRLIEIDVIPNIFAIALLS

SEQ ID NO: 2730099 - protein, 20 aa, Entamoeba histolytica
VRNRYKALSIRNKLSCFIEA

SEQ ID NO: 2730100 - protein, 22 aa, Entamoeba histolytica
VRQQDFCFIMILSLLGESELPC

SEQ ID NO: 2730101 - protein, 25 aa, Entamoeba histolytica
VRRGQELFILPSKYDPTISNAADKI

SEQ ID NO: 2730102 - protein, 30 aa, Entamoeba histolytica
VRSCIGTTFMNTWNDILCKLAIEAVTICAG

SEQ ID NO: 2730103 - protein, 18 aa, Entamoeba histolytica
VRSMPTFVLVKDGIEQKR

SEQ ID NO: 2730104 - protein, 20 aa, Entamoeba histolytica
VRSRALFYLNIINSQITTTL

SEQ ID NO: 2730105 - protein, 28 aa, Entamoeba histolytica
VRTIENFKLLIFPLQWVCVCVPILPRIL

SEQ ID NO: 2730106 - protein, 23 aa, Entamoeba histolytica
VRTLVQLIILKRIVENFPHFLDN

SEQ ID NO: 2730107 - protein, 26 aa, Entamoeba histolytica
VRTYGDYLFKENLDFSYKLLRGIINY

SEQ ID NO: 2730108 - protein, 26 aa, Entamoeba histolytica
VRVAKYLIPYNLVSYTEVFVRLGYTT

SEQ ID NO: 2730109 - protein, 24 aa, Entamoeba histolytica
VRVRIHPYHVLRINKMLSCAGADR

SEQ ID NO: 2730110 - protein, 23 aa, Entamoeba histolytica
VRVSRIIDNSLWPKLFSVTPSPI

SEQ ID NO: 2730111 - protein, 24 aa, Entamoeba histolytica
VRYKYEKIVFEALFKPGCALKVRE

SEQ ID NO: 2730112 - protein, 28 aa, Entamoeba histolytica
VSALEQPKKWWKFAFIATRDYLREREEE

SEQ ID NO: 2730113 - protein, 20 aa, Entamoeba histolytica
VSALMRCNKLQRIILHGKNE

SEQ ID NO: 2730114 - protein, 18 aa, Entamoeba histolytica
VSARGHHIAGVPQIPLVV

SEQ ID NO: 2730115 - protein, 21 aa, Entamoeba histolytica
VSAVLCCLSVMTSLEIPHLNV

SEQ ID NO: 2730116 - protein, 25 aa, Entamoeba histolytica
VSCFNYGLNEKFWMNYRKKHDLLKK

SEQ ID NO: 2730117 - protein, 20 aa, Entamoeba histolytica
VSCIVRILRIKQMRCKNQLN

SEQ ID NO: 2730118 - protein, 31 aa, Entamoeba histolytica
VSCYNYHKYKKIYIVEWARSPIHRASQADRY

SEQ ID NO: 2730119 - protein, 25 aa, Entamoeba histolytica
VSDEYEIWVLLMKQINDYVQVQLSC

SEQ ID NO: 2730120 - protein, 29 aa, Entamoeba histolytica
VSDGRKRALRLFGNYLGNSLYDTDYVRTL

SEQ ID NO: 2730121 - protein, 22 aa, Entamoeba histolytica
VSDLSFFGLEKFIRVCGDEVVP

SEQ ID NO: 2730122 - protein, 28 aa, Entamoeba histolytica
VSDMEMLGLLYVWVLKNLNKEMLKEWIE

SEQ ID NO: 2730123 - protein, 23 aa, Entamoeba histolytica
VSDNKWYFAPRKCSNERYDDIKD

SEQ ID NO: 2730124 - protein, 31 aa, Entamoeba histolytica
VSDPKFKKIAFIEFLLYKYNQTIKELMARPQ

SEQ ID NO: 2730125 - protein, 20 aa, Entamoeba histolytica
VSDTLYPPINNYINVRANVT

SEQ ID NO: 2730126 - protein, 27 aa, Entamoeba histolytica
VSDYKDWCLYWLGLNDQKPPIIGESPE

SEQ ID NO: 2730127 - protein, 26 aa, Entamoeba histolytica
VSEDMMRIIKNMRRRGYKAKEISILT

SEQ ID NO: 2730128 - protein, 20 aa, Entamoeba histolytica
VSEIPSFKPSLRYNKSRGSY

SEQ ID NO: 2730129 - protein, 18 aa, Entamoeba histolytica
VSERCKCQWILELVSFSI

SEQ ID NO: 2730130 - protein, 24 aa, Entamoeba histolytica
VSFAVPTHIFVIEKMPLNSFGKVY

SEQ ID NO: 2730131 - protein, 37 aa, Entamoeba histolytica
VSFCLDVFSILFRLSIFPFHFNFYNYCVISLESITSP

SEQ ID NO: 2730132 - protein, 25 aa, Entamoeba histolytica
VSFDVPLLRGYLTRRDPKGTHSWSK

SEQ ID NO: 2730133 - protein, 18 aa, Entamoeba histolytica
VSFFGSYLEEGYVWVVME

SEQ ID NO: 2730134 - protein, 19 aa, Entamoeba histolytica
VSFKGLMYNAVQDGLSIPK

SEQ ID NO: 2730135 - protein, 19 aa, Entamoeba histolytica
VSFLWAYERDRRKQIEIWE

SEQ ID NO: 2730136 - protein, 20 aa, Entamoeba histolytica
VSFQYSRCSDYFSLGSMIFE

SEQ ID NO: 2730137 - protein, 21 aa, Entamoeba histolytica
VSFYSRMTTLMADLGYDEDFL

SEQ ID NO: 2730138 - protein, 20 aa, Entamoeba histolytica
VSFYTLIMPIYLASISEGVP

SEQ ID NO: 2730139 - protein, 28 aa, Entamoeba histolytica
VSGDKSILLDEIYAKHYGKLDKKHDQVE

SEQ ID NO: 2730140 - protein, 23 aa, Entamoeba histolytica
VSGFDKFLFIKYVKKNRIPPSQV

SEQ ID NO: 2730141 - protein, 26 aa, Entamoeba histolytica
VSGITHPFLQTKLIQLLGILGHDDKA

SEQ ID NO: 2730142 - protein, 29 aa, Entamoeba histolytica
VSGLTEYMSRLLRACGYIYTTSAQMELVR

SEQ ID NO: 2730143 - protein, 29 aa, Entamoeba histolytica
VSGWKRRWVVLCRGFLFYYNNPKDEIPIG

SEQ ID NO: 2730144 - protein, 25 aa, Entamoeba histolytica
VSGYRRDFIDAFKKLQLDNSQVEHA

SEQ ID NO: 2730145 - protein, 27 aa, Entamoeba histolytica
VSIAQYLIYNKRRFYKINRGEKKLLVC

SEQ ID NO: 2730146 - protein, 30 aa, Entamoeba histolytica
VSIAQYLIYNKYRFYNINRGEKKLLVCASS

SEQ ID NO: 2730147 - protein, 26 aa, Entamoeba histolytica
VSIEKLILQLIVVKGTFKLFIKIAMK

SEQ ID NO: 2730148 - protein, 34 aa, Entamoeba histolytica
VSIENQYIYFIKFYNSIYKGFLYQLNSLEESNFY

SEQ ID NO: 2730149 - protein, 22 aa, Entamoeba histolytica
VSIMYHIAPYLPWSDNNPQQLD

SEQ ID NO: 2730150 - protein, 22 aa, Entamoeba histolytica
VSIPIAFLLMKDTIIALGGNKL

SEQ ID NO: 2730151 - protein, 20 aa, Entamoeba histolytica
VSIPYIAIQLPPILVQLSQQ

SEQ ID NO: 2730152 - protein, 30 aa, Entamoeba histolytica
VSITVLSYPLILDLPLPGVEMLYPHYIRYM

SEQ ID NO: 2730153 - protein, 17 aa, Entamoeba histolytica
VSIVPFKMKECMNSLVV

SEQ ID NO: 2730154 - protein, 28 aa, Entamoeba histolytica
VSKAQVHDWWFYPWLTEIVEDPSEKELK

SEQ ID NO: 2730155 - protein, 25 aa, Entamoeba histolytica
VSKDENIIITPKISLRDKIKKFEQP

SEQ ID NO: 2730156 - protein, 25 aa, Entamoeba histolytica
VSKERLLSFMFKRKTNEKTTVSESP

SEQ ID NO: 2730157 - protein, 29 aa, Entamoeba histolytica
VSKGDSYIPFRSSPLTRILQDALGGASIT

SEQ ID NO: 2730158 - protein, 18 aa, Entamoeba histolytica
VSKIMNFIELLVSAKEIL

SEQ ID NO: 2730159 - protein, 30 aa, Entamoeba histolytica
VSKKRAIKNEQLLQLIFKSIDADGNGEIDQ

SEQ ID NO: 2730160 - protein, 17 aa, Entamoeba histolytica
VSKNWIINGMKKDEFKY

SEQ ID NO: 2730161 - protein, 18 aa, Entamoeba histolytica
VSKPFFPIETIQFNDSDK

SEQ ID NO: 2730162 - protein, 27 aa, Entamoeba histolytica
VSKQFNYFIDLYQPLLVYKQIQENFIN

SEQ ID NO: 2730163 - protein, 24 aa, Entamoeba histolytica
VSKTFGVFGYPLSCAVKKSSWRFP

SEQ ID NO: 2730164 - protein, 30 aa, Entamoeba histolytica
VSLKRYYKIFFELHLIFAKAPKSEQTRVIP

SEQ ID NO: 2730165 - protein, 17 aa, Entamoeba histolytica
VSLLNVPSIFYRPKEQE

SEQ ID NO: 2730166 - protein, 18 aa, Entamoeba histolytica
VSLLTKMWYPTGKNITVI

SEQ ID NO: 2730167 - protein, 24 aa, Entamoeba histolytica
VSLPKHILFVIHAKKFKPIYELVK

SEQ ID NO: 2730168 - protein, 29 aa, Entamoeba histolytica
VSLQACICCNILDLLKKIYTKKYIFDIED

SEQ ID NO: 2730169 - protein, 24 aa, Entamoeba histolytica
VSLSGFSFLFAEYVRREFRKDNKQ

SEQ ID NO: 2730170 - protein, 22 aa, Entamoeba histolytica
VSLVEKYLKPVIGAKVAGYSEF

SEQ ID NO: 2730171 - protein, 25 aa, Entamoeba histolytica
VSMEELYTMFGWPLAKKYGTLHDAF

SEQ ID NO: 2730172 - protein, 17 aa, Entamoeba histolytica
VSMIIRKDFDMSQELIK

SEQ ID NO: 2730173 - protein, 40 aa, Entamoeba histolytica
VSMLTLTFKILINELKNKPIKRIWGKISTKPFVKVCEENP

SEQ ID NO: 2730174 - protein, 19 aa, Entamoeba histolytica
VSNILALHNSLYIALNTKD

SEQ ID NO: 2730175 - protein, 25 aa, Entamoeba histolytica
VSNKNIYIYDIYKSKWDTIPSPINL

SEQ ID NO: 2730176 - protein, 23 aa, Entamoeba histolytica
VSPKVFLIKNVMEAKIPLVSSMG

SEQ ID NO: 2730177 - protein, 21 aa, Entamoeba histolytica
VSPLNKEVMVLTWGNLKGEFR

SEQ ID NO: 2730178 - protein, 29 aa, Entamoeba histolytica
VSPNKLHFLPNYLFIPSPTKDLDGKILTL

SEQ ID NO: 2730179 - protein, 25 aa, Entamoeba histolytica
VSPRKTHPQFATPSPFITSSSPRSS

SEQ ID NO: 2730180 - protein, 28 aa, Entamoeba histolytica
VSPSGRYITVWQLIPLQYTQGVNGSGPV

SEQ ID NO: 2730181 - protein, 28 aa, Entamoeba histolytica
VSPSSLITLQFQPLIEWSINNDQHYYPI

SEQ ID NO: 2730182 - protein, 24 aa, Entamoeba histolytica
VSQLLNEFFIPPNPFINPISSQQT

SEQ ID NO: 2730183 - protein, 33 aa, Entamoeba histolytica
VSRNQFIENVFPFILQILINCQINFSSKSDKFR

SEQ ID NO: 2730184 - protein, 23 aa, Entamoeba histolytica
VSRNQIALIPQILTVLKDLQDLN

SEQ ID NO: 2730185 - protein, 24 aa, Entamoeba histolytica
VSRSVLLSFLFLITCFINNGNDEN

SEQ ID NO: 2730186 - protein, 19 aa, Entamoeba histolytica
VSRVSMNWLIKLRLMHINS

SEQ ID NO: 2730187 - protein, 23 aa, Entamoeba histolytica
VSRYLIDIALKRQSFDNITVTIC

SEQ ID NO: 2730188 - protein, 28 aa, Entamoeba histolytica
VSSKDKVPYLFLANSYKISYWNTDIENY

SEQ ID NO: 2730189 - protein, 29 aa, Entamoeba histolytica
VSSKDKVPYLFLANSYRISYWKTDIENYD

SEQ ID NO: 2730190 - protein, 26 aa, Entamoeba histolytica
VSSKQPFVPFIGIPLHHISSIRCGLD

SEQ ID NO: 2730191 - protein, 22 aa, Entamoeba histolytica
VSSLLKERLFLASDKYQIYVCD

SEQ ID NO: 2730192 - protein, 18 aa, Entamoeba histolytica
VSSLPLSFTTLTNLRHLD

SEQ ID NO: 2730193 - protein, 27 aa, Entamoeba histolytica
VSSNFTGMLSLLRPDRSFIGKVLGMKD

SEQ ID NO: 2730194 - protein, 34 aa, Entamoeba histolytica; identical to SEQ ID NO: 2543190

SEQ ID NO: 2730195 - protein, 23 aa, Entamoeba histolytica
VSSTKVAFSMLLDKLIDDAHSQN

SEQ ID NO: 2730196 - protein, 25 aa, Entamoeba histolytica
VSSVELYPLPTIPSNLAIISSSLDY

SEQ ID NO: 2730197 - protein, 33 aa, Entamoeba histolytica
VSSVYLQRYPTTPLFPMLLNHEISLIRWKVEDG

SEQ ID NO: 2730198 - protein, 25 aa, Entamoeba histolytica
VSTLNHVVCGLLSLFLEPNPDDPLN

SEQ ID NO: 2730199 - protein, 20 aa, Entamoeba histolytica
VSTPPDALLIVIDLTQSTSL

SEQ ID NO: 2730200 - protein, 17 aa, Entamoeba histolytica
VSTRWFGKLSLFDCSRS

SEQ ID NO: 2730201 - protein, 32 aa, Entamoeba histolytica
VSTTTFGILPIPFIVNYSFIIEIIGHKFEKGE

SEQ ID NO: 2730202 - protein, 21 aa, Entamoeba histolytica
VSTVFSDWYPAIQPSGFTQFT

SEQ ID NO: 2730203 - protein, 24 aa, Entamoeba histolytica
VSVSEFYYLVFKNSGILDYCSKKS

SEQ ID NO: 2730204 - protein, 20 aa, Entamoeba histolytica
VSVTPTFLPVAVRPIYEHSN

SEQ ID NO: 2730205 - protein, 18 aa, Entamoeba histolytica
VSYKLYKVNNITTSIYVN

SEQ ID NO: 2730206 - protein, 26 aa, Entamoeba histolytica
VSYQGKYLLTILSASDLSLMGQKKFY

SEQ ID NO: 2730207 - protein, 28 aa, Entamoeba histolytica
VSYQKRLDVIILLIKKLITDQSSLQYFI

SEQ ID NO: 2730208 - protein, 25 aa, Entamoeba histolytica
VSYSKLLLSSFSKPIKFIISTQVQN

SEQ ID NO: 2730209 - protein, 19 aa, Entamoeba histolytica
VSYYPTVPFDYCDIGEIRE

SEQ ID NO: 2730210 - protein, 27 aa, Entamoeba histolytica
VTADLLFPLCLFLTIKAQLPYFDSTIY

SEQ ID NO: 2730211 - protein, 17 aa, Entamoeba histolytica
VTATLRKNLRNTAKSIT

SEQ ID NO: 2730212 - protein, 21 aa, Entamoeba histolytica
VTCYSFRWVSMLFIDDFSIKD

SEQ ID NO: 2730213 - protein, 22 aa, Entamoeba histolytica
VTDGLRRQLKNSVGKKKQQFVL

SEQ ID NO: 2730214 - protein, 17 aa, Entamoeba histolytica
VTDPFQIVLLENEPILD

SEQ ID NO: 2730215 - protein, 24 aa, Entamoeba histolytica
VTDQSHFIFIVTQNGLNTFSLKKN

SEQ ID NO: 2730216 - protein, 24 aa, Entamoeba histolytica
VTDRFFITDELPSFRKEQFNVTWD

SEQ ID NO: 2730217 - protein, 21 aa, Entamoeba histolytica
VTEFGIPYKAPLQLTFDGTNF

SEQ ID NO: 2730218 - protein, 29 aa, Entamoeba histolytica
VTEIPQKWMYCFLFNDRLVETMPISIDNK

SEQ ID NO: 2730219 - protein, 17 aa, Entamoeba histolytica
VTEKAMRILQTWGPLYP

SEQ ID NO: 2730220 - protein, 24 aa, Entamoeba histolytica
VTEKIYLQRALSSAAKSFGTRIKS

SEQ ID NO: 2730221 - protein, 19 aa, Entamoeba histolytica
VTFAGYDIFTGKRLDDSCP

SEQ ID NO: 2730222 - protein, 21 aa, Entamoeba histolytica
VTFDLLHLINSFKSKDKLFIT

SEQ ID NO: 2730223 - protein, 17 aa, Entamoeba histolytica
VTFFRQTIKVQGRAGNT

SEQ ID NO: 2730224 - protein, 19 aa, Entamoeba histolytica
VTFKGWAYHIRKARKTLIF

SEQ ID NO: 2730225 - protein, 19 aa, Entamoeba histolytica
VTFPLILESLFEKAKKEIS

SEQ ID NO: 2730226 - protein, 34 aa, Entamoeba histolytica
VTIGKYKYEMILAGIYYIILDLINQYQTEWKCKC

SEQ ID NO: 2730227 - protein, 31 aa, Entamoeba histolytica
VTILCYQKILFLQFIIVFNNKGIHRVLLTND

SEQ ID NO: 2730228 - protein, 26 aa, Entamoeba histolytica
VTISFNMNLFNPCKLIDLVKKNLTNK

SEQ ID NO: 2730229 - protein, 28 aa, Entamoeba histolytica
VTITPENVFIFIKFIFTNDKFIQTRQEY

SEQ ID NO: 2730230 - protein, 35 aa, Entamoeba histolytica
VTIYSFFTQLLNLFDIILPPSFNSTIIFPYVYATL

SEQ ID NO: 2730231 - protein, 24 aa, Entamoeba histolytica
VTKERDIYRLITEQLRQIIQKKTE

SEQ ID NO: 2730232 - protein, 23 aa, Entamoeba histolytica
VTKKYFDWFWKEENQVIIEQIVY

SEQ ID NO: 2730233 - protein, 31 aa, Entamoeba histolytica
VTKMIHLNYLPIFTSYLLPLMNYINNENRPQ

SEQ ID NO: 2730234 - protein, 23 aa, Entamoeba histolytica
VTKPPVRMDSQCKYMAIASGRAD

SEQ ID NO: 2730235 - protein, 24 aa, Entamoeba histolytica
VTKQANVFGIFFHSVKSLNEQTYV

SEQ ID NO: 2730236 - protein, 22 aa, Entamoeba histolytica
VTLLNGFVRMNFVGPFNLEVEG

SEQ ID NO: 2730237 - protein, 25 aa, Entamoeba histolytica
VTLMDAVMAILLIESSYNGASNKRE

SEQ ID NO: 2730238 - protein, 19 aa, Entamoeba histolytica
VTLPYSINALGRRVFSDCC

SEQ ID NO: 2730239 - protein, 31 aa, Entamoeba histolytica
VTLTTFVFDLQWLFDELPILTKIPVQFIHNG

SEQ ID NO: 2730240 - protein, 26 aa, Entamoeba histolytica
VTLYSINNWKILYKFESPSPIIDAKF

SEQ ID NO: 2730241 - protein, 19 aa, Entamoeba histolytica
VTMPYACKLLFQEMQSMNV

SEQ ID NO: 2730242 - protein, 24 aa, Entamoeba histolytica
VTNDKYYIYINALAPMIQDACQTP

SEQ ID NO: 2730243 - protein, 30 aa, Entamoeba histolytica
VTNLEEALQWFQYTYLYVCLKRSPGGITSD

SEQ ID NO: 2730244 - protein, 27 aa, Entamoeba histolytica
VTNLIYERTKLMDFITIIIKNESIRTK

SEQ ID NO: 2730245 - protein, 22 aa, Entamoeba histolytica
VTNPITFPFGVSFRPFECEPPF

SEQ ID NO: 2730246 - protein, 24 aa, Entamoeba histolytica
VTNSPQLLIPFARDIYLVLVQKLI

SEQ ID NO: 2730247 - protein, 25 aa, Entamoeba histolytica
VTNSYIKELFNFRGLLKAQLDMAYR

SEQ ID NO: 2730248 - protein, 20 aa, Entamoeba histolytica
VTPIYVMDFTKKLQLPILSS

SEQ ID NO: 2730249 - protein, 26 aa, Entamoeba histolytica
VTPLKEECVWFYQSNFRLLEKYGNFY

SEQ ID NO: 2730250 - protein, 25 aa, Entamoeba histolytica
VTPQSPFHFYNLFSLYGSIIKVNVL

SEQ ID NO: 2730251 - protein, 31 aa, Entamoeba histolytica
VTQFFKFEHFILIEIFTQIGAPLKIFIPVTI

SEQ ID NO: 2730252 - protein, 28 aa, Entamoeba histolytica
VTQFRSPLRKYFDVLVLKQLVCAMEHES

SEQ ID NO: 2730253 - protein, 23 aa, Entamoeba histolytica
VTQICIGLLMELTNKISKFDQYV

SEQ ID NO: 2730254 - protein, 39 aa, Entamoeba histolytica
VTQNIRFICLVLHALQIIRPTPIIILKKFEDTSVLAGIY

SEQ ID NO: 2730255 - protein, 25 aa, Entamoeba histolytica
VTQQKPVSPLKQRRLRNLTFASRDE

SEQ ID NO: 2730256 - protein, 21 aa, Entamoeba histolytica
VTQQYLNIRLIQRKNDVIEID

SEQ ID NO: 2730257 - protein, 23 aa, Entamoeba histolytica
VTRDGIFFHIDFGHFLGNFKSKF

SEQ ID NO: 2730258 - protein, 27 aa, Entamoeba histolytica
VTSDFPLHTFMRKWLKSLYEINVENDM

SEQ ID NO: 2730259 - protein, 30 aa, Entamoeba histolytica
VTSKVWNMLIHHFYLKKALFELKEHKFVQY

SEQ ID NO: 2730260 - protein, 34 aa, Entamoeba histolytica
VTSKVWNMLIHHFYLKKALFELKGHKFVQYNVEN

SEQ ID NO: 2730261 - protein, 29 aa, Entamoeba histolytica
VTSKVWNMLIHQFYLRDALFELKEHDFVQ

SEQ ID NO: 2730262 - protein, 26 aa, Entamoeba histolytica
VTSLRVFQFMPFIDKMKYLQELKLDK

SEQ ID NO: 2730263 - protein, 19 aa, Entamoeba histolytica
VTSLSRCTFLILDEADRML

SEQ ID NO: 2730264 - protein, 19 aa, Entamoeba histolytica
VTSLSYCSSFLFAGIANQS

SEQ ID NO: 2730265 - protein, 25 aa, Entamoeba histolytica
VTTIRGWFVELAHPFPLCLISRKEP

SEQ ID NO: 2730266 - protein, 26 aa, Entamoeba histolytica
VTTLSDHIFMFLLNKGGATVIETYDY

SEQ ID NO: 2730267 - protein, 21 aa, Entamoeba histolytica
VTTNWLYLSRLSAQKEFAFMK

SEQ ID NO: 2730268 - protein, 25 aa, Entamoeba histolytica
VTTPEKLLELLSILFDPSIPDGMEW

SEQ ID NO: 2730269 - protein, 26 aa, Entamoeba histolytica
VTTPERLLELLGILFDPTIPEGMLWE

SEQ ID NO: 2730270 - protein, 27 aa, Entamoeba histolytica
VTTSTLNIVQVFWGLDKKLAQRKHFPA

SEQ ID NO: 2730271 - protein, 23 aa, Entamoeba histolytica
VTTWIERITEWKCLNYTNDWIDG

SEQ ID NO: 2730272 - protein, 21 aa, Entamoeba histolytica
VTVCFNYWYSGIDSRIIVLPI

SEQ ID NO: 2730273 - protein, 36 aa, Entamoeba histolytica
VVAFGMKEWAEELGAVCFAHWFQPLTSKSAKKFDCF

SEQ ID NO: 2730274 - protein, 25 aa, Entamoeba histolytica
VVAKYVQKIFKLRIANFYSVYVYKG

SEQ ID NO: 2730275 - protein, 26 aa, Entamoeba histolytica
VVALYEHLYAGYPLSFDLSKYGPHFV

SEQ ID NO: 2730276 - protein, 19 aa, Entamoeba histolytica
VVAPLTLIPHWVSEAHRFV

SEQ ID NO: 2730277 - protein, 32 aa, Entamoeba histolytica
VVCFQRSLMNKPSLYIILFDEKGNIFGGYNRK

SEQ ID NO: 2730278 - protein, 26 aa, Entamoeba histolytica
VVDCFKRFIPYLKVYKMFIGNNEICL

SEQ ID NO: 2730279 - protein, 33 aa, Entamoeba histolytica
VVDDFFIEIFGKYIFRYPVPPLLKQLSILNCRC

SEQ ID NO: 2730280 - protein, 26 aa, Entamoeba histolytica
VVDGIVWWCTPYDFVKSFNIDYVVHG

SEQ ID NO: 2730281 - protein, 19 aa, Entamoeba histolytica
VVDLLITRYLVPDNIPKDK

SEQ ID NO: 2730282 - protein, 26 aa, Entamoeba histolytica
VVDLMAVFPSYMRIKRFIIVKDNITD

SEQ ID NO: 2730283 - protein, 30 aa, Entamoeba histolytica
VVDLYDIYLEDKFLYLVFEFCDEDLYQFMS

SEQ ID NO: 2730284 - protein, 31 aa, Entamoeba histolytica; identical to SEQ ID NO: 2402912

SEQ ID NO: 2730285 - protein, 23 aa, Entamoeba histolytica
VVDVFNFILGRRAQQKTAITKAV

SEQ ID NO: 2730286 - protein, 41 aa, Entamoeba histolytica
VVEEQLRYFIELPIPIPLFKEYLIFVFNVVSLLLSNNLHEE

SEQ ID NO: 2730287 - protein, 17 aa, Entamoeba histolytica
VVEILNELYYNCLNNEQ

SEQ ID NO: 2730288 - protein, 31 aa, Entamoeba histolytica
VVEQTEWVYLYLQLLRKIFKYNPRIGFDFAC

SEQ ID NO: 2730289 - protein, 19 aa, Entamoeba histolytica
VVETLYFDIYNQCFQLIPL

SEQ ID NO: 2730290 - protein, 17 aa, Entamoeba histolytica
VVFGTSVELIIAAPKGI

SEQ ID NO: 2730291 - protein, 19 aa, Entamoeba histolytica
VVFISRLLFSIYSPSMQNK

SEQ ID NO: 2730292 - protein, 18 aa, Entamoeba histolytica
VVFKYIEACARSGQFQEL

SEQ ID NO: 2730293 - protein, 24 aa, Entamoeba histolytica
VVFSCKSFIFKRTAHFKYGIIDIQ

SEQ ID NO: 2730294 - protein, 17 aa, Entamoeba histolytica
VVFVIGTKIIYGVNLQN

SEQ ID NO: 2730295 - protein, 18 aa, Entamoeba histolytica
VVGDKMFIKYRPVDFNEN

SEQ ID NO: 2730296 - protein, 27 aa, Entamoeba histolytica
VVGIVTRVTAIFPQLKAVKYICSVCQA

SEQ ID NO: 2730297 - protein, 23 aa, Entamoeba histolytica
VVGRPLELNILLSDSFGNVIKEF

SEQ ID NO: 2730298 - protein, 20 aa, Entamoeba histolytica
VVGTPYWMAPELIRGHDYGV

SEQ ID NO: 2730299 - protein, 18 aa, Entamoeba histolytica
VVHGGIPPMYISLDDIKK

SEQ ID NO: 2730300 - protein, 17 aa, Entamoeba histolytica
VVHQLMVFIYHQSTNKL

SEQ ID NO: 2730301 - protein, 25 aa, Entamoeba histolytica
VVHSKIIHSILPLFKDIENGIFPNE

SEQ ID NO: 2730302 - protein, 29 aa, Entamoeba histolytica
VVHVNDKKYVFPSLYLHIFNSEVEMKISE

SEQ ID NO: 2730303 - protein, 18 aa, Entamoeba histolytica
VVIDMWYGNRRDSAVVRT

SEQ ID NO: 2730304 - protein, 17 aa, Entamoeba histolytica
VVILIIDNTIYCGNAGD

SEQ ID NO: 2730305 - protein, 29 aa, Entamoeba histolytica
VVIVTNQRIYFFKPQKYNVPKYHSHLFDI

SEQ ID NO: 2730306 - protein, 24 aa, Entamoeba histolytica
VVKKIIILGDYFVGKSTLFQYLTQ

SEQ ID NO: 2730307 - protein, 18 aa, Entamoeba histolytica
VVKNSCVWLNSALSGKTK

SEQ ID NO: 2730308 - protein, 32 aa, Entamoeba histolytica; identical to SEQ ID NO: 2543309

SEQ ID NO: 2730309 - protein, 18 aa, Entamoeba histolytica
VVKYDELFQSYTKYKKAY

SEQ ID NO: 2730310 - protein, 17 aa, Entamoeba histolytica
VVLLFVALGYENDQKIV

SEQ ID NO: 2730311 - protein, 19 aa, Entamoeba histolytica
VVLNCYCAFWMNDMGLIQF

SEQ ID NO: 2730312 - protein, 25 aa, Entamoeba histolytica
VVLTFIDQEKLLHYVKPIEKKLKGD

SEQ ID NO: 2730313 - protein, 22 aa, Entamoeba histolytica
VVLTNPNFLFRSGTSFDIIFVD

SEQ ID NO: 2730314 - protein, 26 aa, Entamoeba histolytica
VVMMEPSNFYMWQFAGEIALQLNAVK

SEQ ID NO: 2730315 - protein, 25 aa, Entamoeba histolytica
VVNLIQLNPVFLAEQLVLFDLTEFQ

SEQ ID NO: 2730316 - protein, 30 aa, Entamoeba histolytica
VVNNPIYEYLRYIIVPYLQKVTLCGKEYTL

SEQ ID NO: 2730317 - protein, 17 aa, Entamoeba histolytica
VVNPLPSSNYRIEVWLR

SEQ ID NO: 2730318 - protein, 29 aa, Entamoeba histolytica
VVNQFQLATNLLWSLWGFVDASLSSIEWD

SEQ ID NO: 2730319 - protein, 25 aa, Entamoeba histolytica
VVPDRRPPPTPIARSSPRTAAPTTP

SEQ ID NO: 2730320 - protein, 21 aa, Entamoeba histolytica
VVPPELWKRIEDVAFEPNVVR

SEQ ID NO: 2730321 - protein, 18 aa, Entamoeba histolytica
VVPPPYGLYPELFVDTKL

SEQ ID NO: 2730322 - protein, 29 aa, Entamoeba histolytica
VVQCEPEFIPIMKYVFGNVLIAEDAETAK

SEQ ID NO: 2730323 - protein, 19 aa, Entamoeba histolytica
VVQTVIDTLDSLEGKYKEV

SEQ ID NO: 2730324 - protein, 19 aa, Entamoeba histolytica
VVQYGGFELSLWDIGGTDS

SEQ ID NO: 2730325 - protein, 33 aa, Entamoeba histolytica
VVRKGKVIVVYPRKLKYLILLQHSVWNNQQSKY

SEQ ID NO: 2730326 - protein, 17 aa, Entamoeba histolytica
VVRKYLVGPLGMKTLDP

SEQ ID NO: 2730327 - protein, 21 aa, Entamoeba histolytica
VVRNWLEVNPLWEGKIIFCCY

SEQ ID NO: 2730328 - protein, 29 aa, Entamoeba histolytica
VVRPMFENLSLLFKIFCTPKDQVILIANA

SEQ ID NO: 2730329 - protein, 18 aa, Entamoeba histolytica
VVSKERIVILKSSDLGVL

SEQ ID NO: 2730330 - protein, 29 aa, Entamoeba histolytica
VVSLLVKMFPFKFDLIYKWLRREGKSILK

SEQ ID NO: 2730331 - protein, 26 aa, Entamoeba histolytica
VVSLQKTFKYFVPSKELFFKNYPEQP

SEQ ID NO: 2730332 - protein, 23 aa, Entamoeba histolytica
VVSTIKFIPLHHGLLTIDKLNYT

SEQ ID NO: 2730333 - protein, 19 aa, Entamoeba histolytica
VVSVGWRRYQTIATFSMED

SEQ ID NO: 2730334 - protein, 18 aa, Entamoeba histolytica
VVSWWQQRSPMRLEKLIG

SEQ ID NO: 2730335 - protein, 30 aa, Entamoeba histolytica
VVTVTVSLLSDYWIRYESKNQITFSIIGKK

SEQ ID NO: 2730336 - protein, 19 aa, Entamoeba histolytica
VVVDFKRYHKGNLYVEIIS

SEQ ID NO: 2730337 - protein, 17 aa, Entamoeba histolytica
VVVEIPNLAPITVVSID

SEQ ID NO: 2730338 - protein, 18 aa, Entamoeba histolytica
VVVFERLSRSLTLKNFDM

SEQ ID NO: 2730339 - protein, 27 aa, Entamoeba histolytica
VVVGKILLPAFFIDANYIYSMGIDKLQ

SEQ ID NO: 2730340 - protein, 18 aa, Entamoeba histolytica
VVVIDFGGGTLDVACCKI

SEQ ID NO: 2730341 - protein, 19 aa, Entamoeba histolytica
VVVIDFGGGTLDVACCRIG

SEQ ID NO: 2730342 - protein, 18 aa, Entamoeba histolytica
VVVLLFNILPTVSQYPMS

SEQ ID NO: 2730343 - protein, 25 aa, Entamoeba histolytica
VVVPQIRKVLINMLKYIKPGTGNGK

SEQ ID NO: 2730344 - protein, 21 aa, Entamoeba histolytica
VVWEESIILLPDTVHYVFLSA

SEQ ID NO: 2730345 - protein, 21 aa, Entamoeba histolytica
VVWKQLQYLTISNAGIRSIDD

SEQ ID NO: 2730346 - protein, 18 aa, Entamoeba histolytica
VVYAMWDLYLLISNLQND

SEQ ID NO: 2730347 - protein, 18 aa, Entamoeba histolytica
VVYVLTSLKLKEFKYKTL

SEQ ID NO: 2730348 - protein, 17 aa, Entamoeba histolytica
VWAILYESSVQLPAALT

SEQ ID NO: 2730349 - protein, 18 aa, Entamoeba histolytica
VWATLYPEWVCASVGNQI

SEQ ID NO: 2730350 - protein, 24 aa, Entamoeba histolytica
VWEHPLFKYLTDPGWRQVLEPVFK

SEQ ID NO: 2730351 - protein, 18 aa, Entamoeba histolytica
VWFGLLHENANITPLFTL

SEQ ID NO: 2730352 - protein, 17 aa, Entamoeba histolytica
VWNNAFKYNAPNSEVWN

SEQ ID NO: 2730353 - protein, 18 aa, Entamoeba histolytica
VWQNSWGLSTRSIGVTIM

SEQ ID NO: 2730354 - protein, 19 aa, Entamoeba histolytica
VWSLGMILYFIITGDHVFR

SEQ ID NO: 2730355 - protein, 25 aa, Entamoeba histolytica
VWSSGVLLFVMVCGYPPFSRTNNQY

SEQ ID NO: 2730356 - protein, 26 aa, Entamoeba histolytica
VWSTGVVLYVMACGFPPFVEGENDGN

SEQ ID NO: 2730357 - protein, 20 aa, Entamoeba histolytica
VYASAWDFYGLHASPIISGM

SEQ ID NO: 2730358 - protein, 25 aa, Entamoeba histolytica
VYAYLIKNGLKKTAKSFLKEKKIEI

SEQ ID NO: 2730359 - protein, 25 aa, Entamoeba histolytica
VYCGYNKIYILADKELKVFDSSFLL

SEQ ID NO: 2730360 - protein, 17 aa, Entamoeba histolytica
VYDDSLCYLYSPDIQRT

SEQ ID NO: 2730361 - protein, 17 aa, Entamoeba histolytica
VYDFIILKKVSIKDYLP

SEQ ID NO: 2730362 - protein, 28 aa, Entamoeba histolytica
VYDHLYNKKVIYSPPLPSQIISVEYFYP

SEQ ID NO: 2730363 - protein, 23 aa, Entamoeba histolytica
VYDKQFCEIFKKNVLNLVNDLKT

SEQ ID NO: 2730364 - protein, 27 aa, Entamoeba histolytica
VYDKRFRKDLLLLLKEKTSIDTHTLLQ

SEQ ID NO: 2730365 - protein, 18 aa, Entamoeba histolytica
VYDPYLIDNTFFSPSMSP

SEQ ID NO: 2730366 - protein, 24 aa, Entamoeba histolytica
VYDTINHWFGINQMITIGSSYWND

SEQ ID NO: 2730367 - protein, 21 aa, Entamoeba histolytica
VYEGLYWILFKNQSNDFIEKQ

SEQ ID NO: 2730368 - protein, 24 aa, Entamoeba histolytica
VYEISLFLGMLSKWCNITIERFSK

SEQ ID NO: 2730369 - protein, 27 aa, Entamoeba histolytica
VYETTRYLFLVMELLEGGELFDYISSK

SEQ ID NO: 2730370 - protein, 20 aa, Entamoeba histolytica
VYEYLPIGCKSDVWAFGCLI

SEQ ID NO: 2730371 - protein, 17 aa, Entamoeba histolytica
VYFDWSYFNNDDALIIT

SEQ ID NO: 2730372 - protein, 20 aa, Entamoeba histolytica
VYFKPMLVHKKKGVFEAVND

SEQ ID NO: 2730373 - protein, 20 aa, Entamoeba histolytica
VYHKLCIALYASEHFFPKLP

SEQ ID NO: 2730374 - protein, 25 aa, Entamoeba histolytica
VYIDKLEGLIPQKEWPYPSYETLWN

SEQ ID NO: 2730375 - protein, 17 aa, Entamoeba histolytica
VYIPYHTQFKLIEQSHS

SEQ ID NO: 2730376 - protein, 26 aa, Entamoeba histolytica
VYLASILICLPLLPPHRRVVLRIAKN

SEQ ID NO: 2730377 - protein, 24 aa, Entamoeba histolytica
VYLEQYIYMVITIILSINGETQFK

SEQ ID NO: 2730378 - protein, 18 aa, Entamoeba histolytica
VYLRVYEMMGFIDELSFN

SEQ ID NO: 2730379 - protein, 26 aa, Entamoeba histolytica
VYLVTRKMEFFIVDFPEMVKAYGENG

SEQ ID NO: 2730380 - protein, 28 aa, Entamoeba histolytica
VYNQIPGYPLLIPYFVQHLKSLSSDLLL

SEQ ID NO: 2730381 - protein, 21 aa, Entamoeba histolytica
VYPELINLLPYTLRHETHRFV

SEQ ID NO: 2730382 - protein, 26 aa, Entamoeba histolytica
VYPINDTYLFILKQPQSLVLFDSISS

SEQ ID NO: 2730383 - protein, 28 aa, Entamoeba histolytica
VYQNPLIKLLTKCWKDFGDYAQPMCLVA

SEQ ID NO: 2730384 - protein, 48 aa, Entamoeba histolytica
VYQPYKIEIPPVSPPIYLYFKDFQLQPMKFVITFKLGSGLDVLPSNGI

SEQ ID NO: 2730385 - protein, 25 aa, Entamoeba histolytica
VYQVEFKLKKLNNLLVDDLYIEMEL

SEQ ID NO: 2730386 - protein, 26 aa, Entamoeba histolytica
VYRPSTTFYLYPKLINKIEFAKEIIG

SEQ ID NO: 2730387 - protein, 24 aa, Entamoeba histolytica
VYSFIQIHYMGWPDFGVPLNPKDA

SEQ ID NO: 2730388 - protein, 24 aa, Entamoeba histolytica
VYSLFIDEIGFPKIYHYGTEGDYN

SEQ ID NO: 2730389 - protein, 18 aa, Entamoeba histolytica
VYSYEWYSLLTSGELKRI

SEQ ID NO: 2730390 - protein, 24 aa, Entamoeba histolytica
VYTTSLFNLLFNNTNYKSFCNCFK

SEQ ID NO: 2730391 - protein, 17 aa, Entamoeba histolytica
VYVLITTNLDEINQVAC

SEQ ID NO: 2730392 - protein, 20 aa, Entamoeba histolytica
VYYHVLMMVPKHDKFFNSMK

SEQ ID NO: 2730393 - protein, 26 aa, Entamoeba histolytica
VYYSFEKYLFIKYKTNNPEAVICLIN

SEQ ID NO: 2730394 - protein, 21 aa, Entamoeba histolytica
WAAGIMMYFLATGKHPFEQLV

SEQ ID NO: 2730395 - protein, 39 aa, Entamoeba histolytica; identical to SEQ ID NO: 2543410

SEQ ID NO: 2730396 - protein, 19 aa, Entamoeba histolytica
WAPNIPWFRDYIPTVIQAK

SEQ ID NO: 2730397 - protein, 17 aa, Entamoeba histolytica
WARDRFEGFFKTEIEPV

SEQ ID NO: 2730398 - protein, 18 aa, Entamoeba histolytica
WASLLFTGKQGYIDATRG

SEQ ID NO: 2730399 - protein, 18 aa, Entamoeba histolytica
WATIPILGKLSKCQEHPL

SEQ ID NO: 2730400 - protein, 27 aa, Entamoeba histolytica
WAVKLKKQFETLWKNAFKEKKPVDTKT

SEQ ID NO: 2730401 - protein, 34 aa, Entamoeba histolytica
WAVVVVDQEQFIFPSSFICLLSESDKKIKQETAI

SEQ ID NO: 2730402 - protein, 33 aa, Entamoeba histolytica
WCFDLNHFVFTIKNLFNIPPTKYKRIIKEKVFC

SEQ ID NO: 2730403 - protein, 20 aa, Entamoeba histolytica
WCGLVCHQCCVRKAPIQCSY

SEQ ID NO: 2730404 - protein, 17 aa, Entamoeba histolytica
WCHANKFCIIYNSENQE

SEQ ID NO: 2730405 - protein, 17 aa, Entamoeba histolytica
WCVVTDKDNNQIKSGKS

SEQ ID NO: 2730406 - protein, 18 aa, Entamoeba histolytica
WCYRDLTFKMAHPSSHIS

SEQ ID NO: 2730407 - protein, 20 aa, Entamoeba histolytica
WDAIFAYGNNLEFVDYLFLA

SEQ ID NO: 2730408 - protein, 34 aa, Entamoeba histolytica
WDFIDSFIKVVPLTNWFVYCKSSLVPKVKQIISL

SEQ ID NO: 2730409 - protein, 36 aa, Entamoeba histolytica
WDINCQNIKTFWKRMKRYGFKKRRIGGIDYFINEMF

SEQ ID NO: 2730410 - protein, 17 aa, Entamoeba histolytica
WDKRYLIESLSDSTIYM

SEQ ID NO: 2730411 - protein, 17 aa, Entamoeba histolytica
WDLLEDTCCFCQSTLDY

SEQ ID NO: 2730412 - protein, 26 aa, Entamoeba histolytica
WDNNDIIWDCPLNQLEQFKPQVTEEN

SEQ ID NO: 2730413 - protein, 19 aa, Entamoeba histolytica
WDQFFLKQKKQKIFLPIQY

SEQ ID NO: 2730414 - protein, 29 aa, Entamoeba histolytica
WDTHRIRELWLLLFKFIDHPLKLNNIEII

SEQ ID NO: 2730415 - protein, 24 aa, Entamoeba histolytica
WDVQYCPLEYYMLSSSYDKTARLW

SEQ ID NO: 2730416 - protein, 27 aa, Entamoeba histolytica
WEAIQQSILMYLLIENGYIVTIDRPDK

SEQ ID NO: 2730417 - protein, 19 aa, Entamoeba histolytica
WEDIAPLLEKYQVYIRNTI

SEQ ID NO: 2730418 - protein, 19 aa, Entamoeba histolytica
WEDSMIWIQLYYQQINESK

SEQ ID NO: 2730419 - protein, 23 aa, Entamoeba histolytica
WEEGRIYITNLPFNCTEDDIRKE

SEQ ID NO: 2730420 - protein, 39 aa, Entamoeba histolytica
WEGKIIFCCYNLTDYNIYLKFLPYYFPTTKLDDNEPKNI

SEQ ID NO: 2730421 - protein, 17 aa, Entamoeba histolytica
WEGKLTKQQILAIDLKE

SEQ ID NO: 2730422 - protein, 26 aa, Entamoeba histolytica
WEIDNEINYELLQRLALSLHSFSKSF

SEQ ID NO: 2730423 - protein, 17 aa, Entamoeba histolytica
WEILFDKMKITTNINRK

SEQ ID NO: 2730424 - protein, 18 aa, Entamoeba histolytica
WEILTFKHPFESFTFMTS

SEQ ID NO: 2730425 - protein, 20 aa, Entamoeba histolytica
WEPPCELLDCGKSYLLKFEV

SEQ ID NO: 2730426 - protein, 29 aa, Entamoeba histolytica
WEQHEVCVQLIVFKYLLSFEINGDDLIYT

SEQ ID NO: 2730427 - protein, 20 aa, Entamoeba histolytica
WESPNTIILCKMLLKKKYDN

SEQ ID NO: 2730428 - protein, 25 aa, Entamoeba histolytica
WEVLYKQWETILPKTINLFNQLIEL

SEQ ID NO: 2730429 - protein, 19 aa, Entamoeba histolytica
WFAERADMIVLVFDAHKLD

SEQ ID NO: 2730430 - protein, 17 aa, Entamoeba histolytica
WFCMSGIVDYCRMAPQG

SEQ ID NO: 2730431 - protein, 17 aa, Entamoeba histolytica
WFEINKLEWYKYNQLAY

SEQ ID NO: 2730432 - protein, 17 aa, Entamoeba histolytica
WFGFGYQVPELSEEAIN

SEQ ID NO: 2730433 - protein, 30 aa, Entamoeba histolytica
WFKELQDITLTRTIQFYLVGNKIDLSSQES

SEQ ID NO: 2730434 - protein, 27 aa, Entamoeba histolytica
WFKNQPIYEDILMYNAIDIDDCIYLFK

SEQ ID NO: 2730435 - protein, 20 aa, Entamoeba histolytica
WFKPIELFTKQGVCGNILCS

SEQ ID NO: 2730436 - protein, 17 aa, Entamoeba histolytica
WFKSIGMKTRLSEWGKG

SEQ ID NO: 2730437 - protein, 25 aa, Entamoeba histolytica
WFNCCLIREFPINLSLILWDGYISE

SEQ ID NO: 2730438 - protein, 22 aa, Entamoeba histolytica
WFNKLIGQFWGGNDYYLVAHDF

SEQ ID NO: 2730439 - protein, 17 aa, Entamoeba histolytica
WFYGCSSLKSINIPTSV

SEQ ID NO: 2730440 - protein, 28 aa, Entamoeba histolytica
WGCTLRSIQMLFLNSLIRLQEPNPGFGD

SEQ ID NO: 2730441 - protein, 25 aa, Entamoeba histolytica
WGDIEFSKYFKKYHPIIGQVVKRKR

SEQ ID NO: 2730442 - protein, 27 aa, Entamoeba histolytica
WGDLMTTYVMLKYRKWQIKDRRTMSLH

SEQ ID NO: 2730443 - protein, 35 aa, Entamoeba histolytica
WGELEYIRVLPIRNIAFIRYKLRGSAEFAKVAMAD

SEQ ID NO: 2730444 - protein, 17 aa, Entamoeba histolytica
WGILFPQEFKVYTEMYM

SEQ ID NO: 2730445 - protein, 17 aa, Entamoeba histolytica
WGKWNIMRGINLHKTQC

SEQ ID NO: 2730446 - protein, 25 aa, Entamoeba histolytica
WGYDQSLLNYLYYSGQFNSLNITVA

SEQ ID NO: 2730447 - protein, 18 aa, Entamoeba histolytica
WGYGIRYQYGMFKQGIVG

SEQ ID NO: 2730448 - protein, 18 aa, Entamoeba histolytica
WGYGIRYQYGMFKQQISH

SEQ ID NO: 2730449 - protein, 26 aa, Entamoeba histolytica
WHDREHIRFLVCIKFLKATKCSGLPV

SEQ ID NO: 2730450 - protein, 18 aa, Entamoeba histolytica
WICGGVPLTIMMNMEQRN

SEQ ID NO: 2730451 - protein, 24 aa, Entamoeba histolytica
WIDGDTIYLLPLRELKSQLGDLLS

SEQ ID NO: 2730452 - protein, 17 aa, Entamoeba histolytica
WIDLTPGTEVKDLTQPG

SEQ ID NO: 2730453 - protein, 18 aa, Entamoeba histolytica
WIDRKRVLYWKNKIFHLI

SEQ ID NO: 2730454 - protein, 18 aa, Entamoeba histolytica
WIDTFDQFEIKFKLPRTP

SEQ ID NO: 2730455 - protein, 21 aa, Entamoeba histolytica
WIEERKKRFPTKAKREKCLSE

SEQ ID NO: 2730456 - protein, 17 aa, Entamoeba histolytica
WIEKKIPECGPLDALVR

SEQ ID NO: 2730457 - protein, 19 aa, Entamoeba histolytica
WIELLSRLKPLYDVDMLSV

SEQ ID NO: 2730458 - protein, 25 aa, Entamoeba histolytica
WIEVQHLLIIILNIIKVDYKKELLK

SEQ ID NO: 2730459 - protein, 18 aa, Entamoeba histolytica
WIKCAQGDRYRMGNLFIV

SEQ ID NO: 2730460 - protein, 17 aa, Entamoeba histolytica
WILFKNQSNDFIEKQIK

SEQ ID NO: 2730461 - protein, 20 aa, Entamoeba histolytica
WINCCLLREFKLGTALRLWD

SEQ ID NO: 2730462 - protein, 19 aa, Entamoeba histolytica
WINDPIGLCEKIWRDGGCQ

SEQ ID NO: 2730463 - protein, 17 aa, Entamoeba histolytica
WINNGLLYLLKKCGYNF

SEQ ID NO: 2730464 - protein, 17 aa, Entamoeba histolytica
WIPGMKDLLQKALAKIL

SEQ ID NO: 2730465 - protein, 17 aa, Entamoeba histolytica
WIPSEPFKENYSSTLDL

SEQ ID NO: 2730466 - protein, 19 aa, Entamoeba histolytica
WISCSETSFILLARGIHKV

SEQ ID NO: 2730467 - protein, 17 aa, Entamoeba histolytica
WISHFPVNIFNSSLNFL

SEQ ID NO: 2730468 - protein, 24 aa, Entamoeba histolytica
WITCDNVIYLWHHFPENYIDTTGF

SEQ ID NO: 2730469 - protein, 19 aa, Entamoeba histolytica
WITVISTDGEWWEGESKGK

SEQ ID NO: 2730470 - protein, 19 aa, Entamoeba histolytica
WKGIRKEVKEIRRGLDELI

SEQ ID NO: 2730471 - protein, 19 aa, Entamoeba histolytica
WKHFIFTLNNPKHQIIKIE

SEQ ID NO: 2730472 - protein, 20 aa, Entamoeba histolytica
WKHRGNKTMWIPTPVCTLIL

SEQ ID NO: 2730473 - protein, 17 aa, Entamoeba histolytica
WKIICKDFQVIPLGRGD

SEQ ID NO: 2730474 - protein, 25 aa, Entamoeba histolytica
WKKENILNYLPFYANAKQIGVLACT

SEQ ID NO: 2730475 - protein, 18 aa, Entamoeba histolytica
WKLVVKKAENWLSSKPRL

SEQ ID NO: 2730476 - protein, 29 aa, Entamoeba histolytica
WKNEESLTVALQLKLALAIDELEKSAQVI

SEQ ID NO: 2730477 - protein, 18 aa, Entamoeba histolytica
WKQLEDFEIKYFEYSKSS

SEQ ID NO: 2730478 - protein, 18 aa, Entamoeba histolytica
WKRAEERKGRRENPYTSV

SEQ ID NO: 2730479 - protein, 27 aa, Entamoeba histolytica
WKRFNATFAYLPILALINKKILCVHGG

SEQ ID NO: 2730480 - protein, 17 aa, Entamoeba histolytica
WKRVCIVWTKCPNSFGK

SEQ ID NO: 2730481 - protein, 19 aa, Entamoeba histolytica
WKSQPIDTLSLPVANTTRV

SEQ ID NO: 2730482 - protein, 24 aa, Entamoeba histolytica
WKTKKLINERLLTPEKAKAKATSK

SEQ ID NO: 2730483 - protein, 26 aa, Entamoeba histolytica
WKTYMLEYFMLWFCRCFHPEFEVRIL

SEQ ID NO: 2730484 - protein, 17 aa, Entamoeba histolytica
WLDVESRMSWIICGITG

SEQ ID NO: 2730485 - protein, 28 aa, Entamoeba histolytica
WLENQQFQPIPFPPSNYKYDTKLLVLAL

SEQ ID NO: 2730486 - protein, 17 aa, Entamoeba histolytica
WLKCAAGNKYRMGNLFI

SEQ ID NO: 2730487 - protein, 17 aa, Entamoeba histolytica
WLKCASGNKYRMGNLFI

SEQ ID NO: 2730488 - protein, 18 aa, Entamoeba histolytica
WLKEQAVVSLNRLMKTHR

SEQ ID NO: 2730489 - protein, 17 aa, Entamoeba histolytica
WLNSALSGKSKRIKTLV

SEQ ID NO: 2730490 - protein, 21 aa, Entamoeba histolytica
WLNVLPLTRFDDEIIFIMFTL

SEQ ID NO: 2730491 - protein, 17 aa, Entamoeba histolytica
WLRVCSGAIILQGYGLT

SEQ ID NO: 2730492 - protein, 25 aa, Entamoeba histolytica
WLRVQDYRHYCKNKMLLPSQLHTGL

SEQ ID NO: 2730493 - protein, 17 aa, Entamoeba histolytica
WLSIQKTTIPKSVCCSL

SEQ ID NO: 2730494 - protein, 17 aa, Entamoeba histolytica
WLVGYAEQNGYTVHKRS

SEQ ID NO: 2730495 - protein, 17 aa, Entamoeba histolytica
WMGYNLMFESMLASVIY

SEQ ID NO: 2730496 - protein, 17 aa, Entamoeba histolytica
WMPPEVILDKVYNNKID

SEQ ID NO: 2730497 - protein, 17 aa, Entamoeba histolytica
WMSPERFLKKKYGKPAD

SEQ ID NO: 2730498 - protein, 18 aa, Entamoeba histolytica
WNGLKFVDSDGLFIVPKK

SEQ ID NO: 2730499 - protein, 20 aa, Entamoeba histolytica
WNILTSVFDQRIINKEHIII

SEQ ID NO: 2730500 - protein, 18 aa, Entamoeba histolytica
WNKELYANEYFEGKWNGE

SEQ ID NO: 2730501 - protein, 27 aa, Entamoeba histolytica
WNLVTKQLVFFVITVNMAALFSVDQTK

SEQ ID NO: 2730502 - protein, 24 aa, Entamoeba histolytica
WNNRNPLLIDLIKRMLVVDVNQRI

SEQ ID NO: 2730503 - protein, 23 aa, Entamoeba histolytica
WNQETHSWVPRFGMGSAKQIKKK

SEQ ID NO: 2730504 - protein, 17 aa, Entamoeba histolytica
WNQIKKDLKFVSKGAQG

SEQ ID NO: 2730505 - protein, 19 aa, Entamoeba histolytica
WNRDFDLSIFCLRSKKLQT

SEQ ID NO: 2730506 - protein, 27 aa, Entamoeba histolytica
WNRMCLFYTHYLYSFNITKTKIFCIYC

SEQ ID NO: 2730507 - protein, 17 aa, Entamoeba histolytica
WNSNDIELFKKGCKKFP

SEQ ID NO: 2730508 - protein, 29 aa, Entamoeba histolytica
WNSSTDLLLLLERLLAFFGSIPPVRKNAQ

SEQ ID NO: 2730509 - protein, 23 aa, Entamoeba histolytica
WNTALIGLMMYFREATIHTQELL

SEQ ID NO: 2730510 - protein, 27 aa, Entamoeba histolytica
WNYFSKDTILFAKYLCKPNPLCDQCPL

SEQ ID NO: 2730511 - protein, 24 aa, Entamoeba histolytica
WPDDMLCVTLDKLCVNTLLTSDQI

SEQ ID NO: 2730512 - protein, 28 aa, Entamoeba histolytica
WPDYQLRPNFLITLVEAPSLFVGHEEEV

SEQ ID NO: 2730513 - protein, 18 aa, Entamoeba histolytica
WPIYPVDGGVCILSRFPI

SEQ ID NO: 2730514 - protein, 18 aa, Entamoeba histolytica
WPNYTQRIKMVRKVFDNY

SEQ ID NO: 2730515 - protein, 24 aa, Entamoeba histolytica
WQCYQNYYHCLSLFNQNKLKESYT

SEQ ID NO: 2730516 - protein, 17 aa, Entamoeba histolytica
WQDDAIAAFWWDDFCDG

SEQ ID NO: 2730517 - protein, 19 aa, Entamoeba histolytica
WQHDHFIVHTSKAGYLAQS

SEQ ID NO: 2730518 - protein, 17 aa, Entamoeba histolytica
WQKFPIFAKIRESQILQ

SEQ ID NO: 2730519 - protein, 17 aa, Entamoeba histolytica
WQNFYNLYFSISSFNQK

SEQ ID NO: 2730520 - protein, 19 aa, Entamoeba histolytica
WQPSLVIDRGIALHKMIRL

SEQ ID NO: 2730521 - protein, 23 aa, Entamoeba histolytica
WQQSDFLWSGRCLVTRSPEHCII

SEQ ID NO: 2730522 - protein, 32 aa, Entamoeba histolytica
WQSPIHTPKGRPISIISSPLSLPSTPIADKGI

SEQ ID NO: 2730523 - protein, 30 aa, Entamoeba histolytica
WRPINEFCTYILFFLKAVRLVPEVAGLAVL

SEQ ID NO: 2730524 - protein, 18 aa, Entamoeba histolytica
WRRKEGEAFVPRKGGEAN

SEQ ID NO: 2730525 - protein, 17 aa, Entamoeba histolytica
WRRMCFCFVINRVNYYL

SEQ ID NO: 2730526 - protein, 18 aa, Entamoeba histolytica
WRRMCFCFVINRVNYYLT

SEQ ID NO: 2730527 - protein, 20 aa, Entamoeba histolytica
WRRMHFCFVINRVNYYLTRE

SEQ ID NO: 2730528 - protein, 18 aa, Entamoeba histolytica
WSCGVVLYSLLCGTFPFA

SEQ ID NO: 2730529 - protein, 27 aa, Entamoeba histolytica
WSDLATLYIMLKYRKWQLKDRRTQPLK

SEQ ID NO: 2730530 - protein, 20 aa, Entamoeba histolytica
WSDQIPLNIYDHSLTLIAPI

SEQ ID NO: 2730531 - protein, 20 aa, Entamoeba histolytica
WSGCYFLRLNLMKKAEFMFR

SEQ ID NO: 2730532 - protein, 20 aa, Entamoeba histolytica
WSHACMIFELLTGDFLFAPK

SEQ ID NO: 2730533 - protein, 25 aa, Entamoeba histolytica
WSIEQLLEVLYQKMQLRFVQDGIEA

SEQ ID NO: 2730534 - protein, 25 aa, Entamoeba histolytica
WSKRSILTPFYAPINYIRVKNDDCI

SEQ ID NO: 2730535 - protein, 28 aa, Entamoeba histolytica
WSVGCVLYCLITGNFYKLSYNKAIFDEI

SEQ ID NO: 2730536 - protein, 17 aa, Entamoeba histolytica
WSYFYTSKRLLFTSLLS

SEQ ID NO: 2730537 - protein, 19 aa, Entamoeba histolytica
WTALMFAQFLMYNKVNKKQ

SEQ ID NO: 2730538 - protein, 19 aa, Entamoeba histolytica
WTCVIFGPDDTIWESGIFQ

SEQ ID NO: 2730539 - protein, 27 aa, Entamoeba histolytica
WTDIYLFDYRKLMISGNYSQAIMLPPV

SEQ ID NO: 2730540 - protein, 18 aa, Entamoeba histolytica
WTDLYWRDVMSDEAIVVK

SEQ ID NO: 2730541 - protein, 17 aa, Entamoeba histolytica
WTIFMDVFDYFNVAAVI

SEQ ID NO: 2730542 - protein, 19 aa, Entamoeba histolytica
WTLHMPDLQIESRKSFIEF

SEQ ID NO: 2730543 - protein, 23 aa, Entamoeba histolytica
WTLTQYIIYIIRCLPYSTKTSLL

SEQ ID NO: 2730544 - protein, 19 aa, Entamoeba histolytica
WTNPVLTTPIYSFGKKKES

SEQ ID NO: 2730545 - protein, 20 aa, Entamoeba histolytica
WTPKVAPAPEVPQPTYQRPT

SEQ ID NO: 2730546 - protein, 17 aa, Entamoeba histolytica
WTSLLTHNKLTQPEVVI

SEQ ID NO: 2730547 - protein, 18 aa, Entamoeba histolytica
WTVSQIYALIKKETNINE

SEQ ID NO: 2730548 - protein, 25 aa, Entamoeba histolytica
WVFWDVCGQAKFRGLWKSYYTNVIA

SEQ ID NO: 2730549 - protein, 17 aa, Entamoeba histolytica
WVGLSLKSKRTKKHITT

SEQ ID NO: 2730550 - protein, 28 aa, Entamoeba histolytica
WVKEDWFQKKFIFIPQYQGDGKSGHWYL

SEQ ID NO: 2730551 - protein, 17 aa, Entamoeba histolytica
WVLIKDLLNNRQMKGVS

SEQ ID NO: 2730552 - protein, 19 aa, Entamoeba histolytica
WVMEVIGCGFTLPVDDHKT

SEQ ID NO: 2730553 - protein, 17 aa, Entamoeba histolytica
WVPLCAELLKGTGVKVC

SEQ ID NO: 2730554 - protein, 18 aa, Entamoeba histolytica
WVSYFYSNFNILFDKDIE

SEQ ID NO: 2730555 - protein, 18 aa, Entamoeba histolytica
WVTRNSRLSRSSIYLIFL

SEQ ID NO: 2730556 - protein, 19 aa, Entamoeba histolytica
WVTRNSRLSRSSIYLIFLG

SEQ ID NO: 2730557 - protein, 27 aa, Entamoeba histolytica
WVVFEHKLFFFHFFLDTENDQSVSTFL

SEQ ID NO: 2730558 - protein, 17 aa, Entamoeba histolytica
WVVKLYYSFQDNDYLYL

SEQ ID NO: 2730559 - protein, 25 aa, Entamoeba histolytica
WVYHMLSEIIRLCERSKWVNNFVQE

SEQ ID NO: 2730560 - protein, 17 aa, Entamoeba histolytica
WVYPQRKRADIIVPWGE

SEQ ID NO: 2730561 - protein, 25 aa, Entamoeba histolytica
WWKRNSLTVFLNKKIYKDPNETENQ

SEQ ID NO: 2730562 - protein, 27 aa, Entamoeba histolytica
WWSLGILIYEMIVGIPPFYDDDVSLMY

SEQ ID NO: 2730563 - protein, 29 aa, Entamoeba histolytica
WYESSNHIILIMKLLPLVLPSLSNNILES

SEQ ID NO: 2730564 - protein, 26 aa, Entamoeba histolytica
WYHSHPGFGCWLSSIDISTQQSFEKL

SEQ ID NO: 2730565 - protein, 17 aa, Entamoeba histolytica
WYSARGSKHQGGINYVP

SEQ ID NO: 2730566 - protein, 21 aa, Entamoeba histolytica
WYSKAIIYMHEYFKQFFTEYS

SEQ ID NO: 2730567 - protein, 25 aa, Entamoeba histolytica
  misc_feature (1)..(2): Xaa can be any naturally occurring amino acid
XXKECLFLLCVSFKGFIGVSGRICK

SEQ ID NO: 2730568 - protein, 17 aa, Entamoeba histolytica
  misc_feature (1)..(2): Xaa can be any naturally occurring amino acid
XXLKNGIIYKLGKYKLK

SEQ ID NO: 2730569 - protein, 35 aa, Entamoeba histolytica
YAAFRYIELRTESIWKFLIPFTSRILDCLEDEDEG

SEQ ID NO: 2730570 - protein, 31 aa, Entamoeba histolytica
YAAVKDALTTKPYFKYLISCREVAPTTGHEH

SEQ ID NO: 2730571 - protein, 26 aa, Entamoeba histolytica
YACEFEVFIIIKCTTKIKDKIMIISK

SEQ ID NO: 2730572 - protein, 21 aa, Entamoeba histolytica
YACEFEVFITIKCTTKIKDKI

SEQ ID NO: 2730573 - protein, 23 aa, Entamoeba histolytica
YACEFEVFITIKCTTKIKDKIMI

SEQ ID NO: 2730574 - protein, 22 aa, Entamoeba histolytica
YAEAFEIIPYTLAENAGLNPME

SEQ ID NO: 2730575 - protein, 25 aa, Entamoeba histolytica
YAEGEHIVMIVMKKPTKANITESSN

SEQ ID NO: 2730576 - protein, 27 aa, Entamoeba histolytica
YAEKSDLLIFMLQKLFALVHGEIDEEG

SEQ ID NO: 2730577 - protein, 20 aa, Entamoeba histolytica
YAELITKPRPFGVDKSILET

SEQ ID NO: 2730578 - protein, 18 aa, Entamoeba histolytica
YAEVFICFGYISQDDLFS

SEQ ID NO: 2730579 - protein, 20 aa, Entamoeba histolytica
YAEYPMLFGVTLDNGERRVY

SEQ ID NO: 2730580 - protein, 19 aa, Entamoeba histolytica
YAFLPPQNKYSINAFEICH

SEQ ID NO: 2730581 - protein, 26 aa, Entamoeba histolytica
YAGQRIIDDLLKREWGFIIFDEVHGS

SEQ ID NO: 2730582 - protein, 20 aa, Entamoeba histolytica
YAIHLALYAAFYPNYFTTEC

SEQ ID NO: 2730583 - protein, 25 aa, Entamoeba histolytica
YAIKKKLTLVVPLNPPPLSVEFLAS

SEQ ID NO: 2730584 - protein, 17 aa, Entamoeba histolytica
YAKLFGKVGLLKDHIQV

SEQ ID NO: 2730585 - protein, 20 aa, Entamoeba histolytica
YALCVKYRSSPLLHLSWLNN

SEQ ID NO: 2730586 - protein, 20 aa, Entamoeba histolytica
YALIVDTILRMIRVLERQFS

SEQ ID NO: 2730587 - protein, 17 aa, Entamoeba histolytica
YALKARYPQQFFIIRGN

SEQ ID NO: 2730588 - protein, 20 aa, Entamoeba histolytica
YALSKLFFRITLNLLSNEKY

SEQ ID NO: 2730589 - protein, 22 aa, Entamoeba histolytica
YAMTVIGLLLNILRDNNLVSGH

SEQ ID NO: 2730590 - protein, 25 aa, Entamoeba histolytica
YAPMMQFIEIIFPTCLRILITAIQN

SEQ ID NO: 2730591 - protein, 27 aa, Entamoeba histolytica
YAQLEFAICAVFRSWMGKRAVDYRREF

SEQ ID NO: 2730592 - protein, 33 aa, Entamoeba histolytica
YAQLREVIKTIPKFWYYALKNSGYLDIVFANQN

SEQ ID NO: 2730593 - protein, 30 aa, Entamoeba histolytica
YAQTAYPINFFNFFQMFNPNVIVPQHPQNQ

SEQ ID NO: 2730594 - protein, 26 aa, Entamoeba histolytica
YARGDTHYLLYIIDQLRNECIDAGVL

SEQ ID NO: 2730595 - protein, 17 aa, Entamoeba histolytica
YARILQRLGYNVKFNHF

SEQ ID NO: 2730596 - protein, 25 aa, Entamoeba histolytica
YASLVYRLMNDLEFTIYIGTNLPPE

SEQ ID NO: 2730597 - protein, 25 aa, Entamoeba histolytica
YASVYEDLLAVPVIRGKKSKGETFP

SEQ ID NO: 2730598 - protein, 17 aa, Entamoeba histolytica
YATFFIKLYLNSLTKKE

SEQ ID NO: 2730599 - protein, 18 aa, Entamoeba histolytica
YATNLIPVVIRYSRSIND

SEQ ID NO: 2730600 - protein, 27 aa, Entamoeba histolytica
YAVGERLQGFLLINVTKRVIVNQLHFN

SEQ ID NO: 2730601 - protein, 24 aa, Entamoeba histolytica
YCAFWMNDMGLIQFNPLMKSSYTQ

SEQ ID NO: 2730602 - protein, 17 aa, Entamoeba histolytica
YCDIAIFEYSNLIPREW

SEQ ID NO: 2730603 - protein, 17 aa, Entamoeba histolytica
YCDVYPDGIQKPRFGEK

SEQ ID NO: 2730604 - protein, 22 aa, Entamoeba histolytica
YCEFEDWMDPLLLECLKEQNEH

SEQ ID NO: 2730605 - protein, 17 aa, Entamoeba histolytica
YCEFESDLKLPLWHLFP

SEQ ID NO: 2730606 - protein, 17 aa, Entamoeba histolytica
YCEKTCVKAKRGGELQI

SEQ ID NO: 2730607 - protein, 20 aa, Entamoeba histolytica
YCFCDSLLKHDVNVSYIGCL

SEQ ID NO: 2730608 - protein, 17 aa, Entamoeba histolytica
YCFYGCEKLKLKSKNIP

SEQ ID NO: 2730609 - protein, 27 aa, Entamoeba histolytica
YCIDQIRQFGYFKGLFGDLDEITTTNV

SEQ ID NO: 2730610 - protein, 17 aa, Entamoeba histolytica
YCIIVMKTLYRCCKLKE

SEQ ID NO: 2730611 - protein, 18 aa, Entamoeba histolytica
YCILFDSHLLLSRMKGSK

SEQ ID NO: 2730612 - protein, 21 aa, Entamoeba histolytica
YCIRTMEIIGIIFINNKKQPN

SEQ ID NO: 2730613 - protein, 17 aa, Entamoeba histolytica
YCKKMGVILPEMRNRMK

SEQ ID NO: 2730614 - protein, 23 aa, Entamoeba histolytica
YCKYGRIIRYINLLSNGTIGSQE

SEQ ID NO: 2730615 - protein, 28 aa, Entamoeba histolytica
YCLDMKMFKKRWELPRSGILTMKNGIGI

SEQ ID NO: 2730616 - protein, 20 aa, Entamoeba histolytica
YCLEYFLDNIEWFEEQLGDY

SEQ ID NO: 2730617 - protein, 17 aa, Entamoeba histolytica
YCLKCLNGYKIENNKCV

SEQ ID NO: 2730618 - protein, 23 aa, Entamoeba histolytica
YCLTPPIDQLIIGTITVLENDKD

SEQ ID NO: 2730619 - protein, 24 aa, Entamoeba histolytica
YCMLRNIEVPKYIPLPVANEEYDI

SEQ ID NO: 2730620 - protein, 26 aa, Entamoeba histolytica
YCNATCFYPFLNSDVIRFIRNIPEDF

SEQ ID NO: 2730621 - protein, 21 aa, Entamoeba histolytica
YCNEFLQLIISPIQEIIKEVK

SEQ ID NO: 2730622 - protein, 18 aa, Entamoeba histolytica
YCNFFSLDKYWQGNQIQQ

SEQ ID NO: 2730623 - protein, 27 aa, Entamoeba histolytica
YCNGKQSAFIRFEGLKRGKYCVRVFLD

SEQ ID NO: 2730624 - protein, 23 aa, Entamoeba histolytica
YCNQLRTLIIPKGLKKFQIECCD

SEQ ID NO: 2730625 - protein, 22 aa, Entamoeba histolytica
YCNVCKCHYKHHASSPYRFDYV

SEQ ID NO: 2730626 - protein, 18 aa, Entamoeba histolytica
YCNVLFAPYIIPNDVGFD

SEQ ID NO: 2730627 - protein, 26 aa, Entamoeba histolytica
YCPETLKCIFFMKTDKVLLSDEKLCE

SEQ ID NO: 2730628 - protein, 18 aa, Entamoeba histolytica
YCPLLKKIHIPSSLNKLS

SEQ ID NO: 2730629 - protein, 24 aa, Entamoeba histolytica
YCPQCHKFIQLPFGSPEILPTPYK

SEQ ID NO: 2730630 - protein, 18 aa, Entamoeba histolytica
YCPSPHYPIYSNTKYEMA

SEQ ID NO: 2730631 - protein, 25 aa, Entamoeba histolytica
YCQGKLCIYCVARFSFRIGERYYSQ

SEQ ID NO: 2730632 - protein, 26 aa, Entamoeba histolytica
YCQKPMLFMLQLYAPLEMVQSYHRVF

SEQ ID NO: 2730633 - protein, 21 aa, Entamoeba histolytica
YCRDGFDLIQTLYFSKEYEGH

SEQ ID NO: 2730634 - protein, 18 aa, Entamoeba histolytica
YCRRLINSIKRGDDITTK

SEQ ID NO: 2730635 - protein, 26 aa, Entamoeba histolytica
YCSEEVINPMIQPTTFLPNEITKLLP

SEQ ID NO: 2730636 - protein, 23 aa, Entamoeba histolytica
YCSKIYVETLLNTDAFKAGNYQQ

SEQ ID NO: 2730637 - protein, 19 aa, Entamoeba histolytica
YCSTLILYPLSTREERAKS

SEQ ID NO: 2730638 - protein, 22 aa, Entamoeba histolytica
YCTSLKTITLPSSLLSLHDFCF

SEQ ID NO: 2730639 - protein, 18 aa, Entamoeba histolytica
YCVKYYHKLKKGYTILLS

SEQ ID NO: 2730640 - protein, 20 aa, Entamoeba histolytica
YCVRHIPLISEFLNELKPDE

SEQ ID NO: 2730641 - protein, 18 aa, Entamoeba histolytica
YCWVKTGEKIKFELIFKE

SEQ ID NO: 2730642 - protein, 19 aa, Entamoeba histolytica
YCYHSFGWDENGIVCYCRV

SEQ ID NO: 2730643 - protein, 18 aa, Entamoeba histolytica
YCYPLQHILFPIEGVKQA

SEQ ID NO: 2730644 - protein, 26 aa, Entamoeba histolytica
YDAVKKIVLFLRKFLRQLEGVVSNYA

SEQ ID NO: 2730645 - protein, 27 aa, Entamoeba histolytica
YDDEQHYRFILLDDINYDKNTVRLIKA

SEQ ID NO: 2730646 - protein, 27 aa, Entamoeba histolytica
YDDEQNYKFILFDDINYDKNLIRLIKA

SEQ ID NO: 2730647 - protein, 25 aa, Entamoeba histolytica
YDDIKEAVLCLMLGGSGKALPDGTH

SEQ ID NO: 2730648 - protein, 18 aa, Entamoeba histolytica
YDDRYLFCGCSSGELMLF

SEQ ID NO: 2730649 - protein, 26 aa, Entamoeba histolytica
YDEDPDFFWKYLFKCYDAYDQITNSF

SEQ ID NO: 2730650 - protein, 28 aa, Entamoeba histolytica
YDEDQQYKFILFDDINYDKNLLRLIKAV

SEQ ID NO: 2730651 - protein, 19 aa, Entamoeba histolytica
YDEFIIKQQIYKILVCFFA

SEQ ID NO: 2730652 - protein, 26 aa, Entamoeba histolytica
YDEIDFDYFPLLYKLCLDFDGVSFDF

SEQ ID NO: 2730653 - protein, 22 aa, Entamoeba histolytica
YDEMERVLLLSPLQRSEIINEE

SEQ ID NO: 2730654 - protein, 21 aa, Entamoeba histolytica
YDEPIYIKIEKLEIMLMLVNE

SEQ ID NO: 2730655 - protein, 20 aa, Entamoeba histolytica
YDFLHHYIIYDCVMVTLDAL

SEQ ID NO: 2730656 - protein, 19 aa, Entamoeba histolytica
YDFVVKDIPFHLIDVGGQR

SEQ ID NO: 2730657 - protein, 29 aa, Entamoeba histolytica
YDHFHIANARFFLFYDYMMKHRSEIDRVL

SEQ ID NO: 2730658 - protein, 19 aa, Entamoeba histolytica
YDHIVVHTLIRYCSTTTNE

SEQ ID NO: 2730659 - protein, 23 aa, Entamoeba histolytica
YDHSLYIKQIVVLEWELVGSVPE

SEQ ID NO: 2730660 - protein, 19 aa, Entamoeba histolytica
YDIDLLPLNLEPYYYCSEN

SEQ ID NO: 2730661 - protein, 28 aa, Entamoeba histolytica
YDIIYNQIPGWPALLIPFIQQLSSLKKE

SEQ ID NO: 2730662 - protein, 41 aa, Entamoeba histolytica
YDIKKQNYLTLLNVITISSPVIFNILIDHINIDTIAVANTF

SEQ ID NO: 2730663 - protein, 17 aa, Entamoeba histolytica
YDIQKYIQLPSEKEIKL

SEQ ID NO: 2730664 - protein, 30 aa, Entamoeba histolytica
YDKCLNSYHFILISYFDLRDAKTVHRILQN

SEQ ID NO: 2730665 - protein, 25 aa, Entamoeba histolytica
YDKDWVCNLIMTWPAFSNKAQFPDL

SEQ ID NO: 2730666 - protein, 43 aa, Entamoeba histolytica
YDKLYQFICPNYIEYSTWLNIIPLKMRCNEVFGVPLSVGVKKS

SEQ ID NO: 2730667 - protein, 23 aa, Entamoeba histolytica
YDKYISKGVLFPLLDFDDPEDVA

SEQ ID NO: 2730668 - protein, 27 aa, Entamoeba histolytica
YDLKCAQIILRLLTKYISYIKKDDQHV

SEQ ID NO: 2730669 - protein, 17 aa, Entamoeba histolytica
YDLLLGEITLNKKIILF

SEQ ID NO: 2730670 - protein, 31 aa, Entamoeba histolytica; identical to SEQ ID NO: 2543678

SEQ ID NO: 2730671 - protein, 22 aa, Entamoeba histolytica
YDLPALFHFILLGHQIGIGKTN

SEQ ID NO: 2730672 - protein, 34 aa, Entamoeba histolytica; identical to SEQ ID NO: 2543680

SEQ ID NO: 2730673 - protein, 18 aa, Entamoeba histolytica
YDLVVKRFKELYAEDKIQ

SEQ ID NO: 2730674 - protein, 18 aa, Entamoeba histolytica
YDMVFLFQNRLVGIDFRK

SEQ ID NO: 2730675 - protein, 17 aa, Entamoeba histolytica
YDNIWKRKIYQTVLIHL

SEQ ID NO: 2730676 - protein, 26 aa, Entamoeba histolytica
YDNKRIIEILWQAIVTSPLATKIVCL

SEQ ID NO: 2730677 - protein, 21 aa, Entamoeba histolytica
YDNLYEFVLGKQPVEKVKEFK

SEQ ID NO: 2730678 - protein, 27 aa, Entamoeba histolytica
YDNVTDFEWYLKLLSRLSTQQLEQSVF

SEQ ID NO: 2730679 - protein, 18 aa, Entamoeba histolytica
YDNYDCMFHVAPLIPRNK

SEQ ID NO: 2730680 - protein, 24 aa, Entamoeba histolytica
YDNYYYLNYIYLLEENNIEMDFID

SEQ ID NO: 2730681 - protein, 25 aa, Entamoeba histolytica
YDPNVACIWGWWGTLMSNHELKRYL

SEQ ID NO: 2730682 - protein, 20 aa, Entamoeba histolytica
YDRRKCVLKMAYIEVLGYEV

SEQ ID NO: 2730683 - protein, 21 aa, Entamoeba histolytica
YDRSLFERLYKCGVFVDMLKI

SEQ ID NO: 2730684 - protein, 17 aa, Entamoeba histolytica
YDSIALQLLTLLAQNSL

SEQ ID NO: 2730685 - protein, 47 aa, Entamoeba histolytica
YDSLYPHLLEYYALWFSRLFTGDLGIWILDIIIVEGWQLTLSVASTI

SEQ ID NO: 2730686 - protein, 29 aa, Entamoeba histolytica
YDSSLFGLAELLLFFLHCKVDKEVVEVFQ

SEQ ID NO: 2730687 - protein, 27 aa, Entamoeba histolytica
YDVDYVLNLYSLLQRTLFTCKRGLTIH

SEQ ID NO: 2730688 - protein, 34 aa, Entamoeba histolytica
YDVFLVEIRVCHLISILFLGRIRSKNLFIPVFCG

SEQ ID NO: 2730689 - protein, 18 aa, Entamoeba histolytica
YDVIAIPGGLPGADNLAG

SEQ ID NO: 2730690 - protein, 17 aa, Entamoeba histolytica
YDVIKYTRICQFIDAFI

SEQ ID NO: 2730691 - protein, 22 aa, Entamoeba histolytica
YDVIPLSPMSGLIGWVPHSITI

SEQ ID NO: 2730692 - protein, 20 aa, Entamoeba histolytica
YDYYYLKTMVRYSLVTDRYL

SEQ ID NO: 2730693 - protein, 25 aa, Entamoeba histolytica
YEDALKYYFKSITIIGYIDAEMSEE

SEQ ID NO: 2730694 - protein, 28 aa, Entamoeba histolytica
YEDDCVYGLFRILQLLHKEKDGFTLAIQ

SEQ ID NO: 2730695 - protein, 37 aa, Entamoeba histolytica
YEDILKEDWTTIKLYQFLIPIIFHYQEMYWFERMDMP

SEQ ID NO: 2730696 - protein, 19 aa, Entamoeba histolytica
YEDIMYTRDFLPGTIEPGD

SEQ ID NO: 2730697 - protein, 23 aa, Entamoeba histolytica
YEDPIDVYCLKGCNVKPVLDKGP

SEQ ID NO: 2730698 - protein, 18 aa, Entamoeba histolytica
YEDTNFLTSLSISPLPTM

SEQ ID NO: 2730699 - protein, 18 aa, Entamoeba histolytica
YEEDFYCWVKTGEKIKFE

SEQ ID NO: 2730700 - protein, 24 aa, Entamoeba histolytica
YEEDIYVGYRYYTTFNQKCSYPFG

SEQ ID NO: 2730701 - protein, 44 aa, Entamoeba histolytica
YEEGIKYSIPLWLAIHFKQIGLCKIVIPHWLSLEQLKETLEEEQ

SEQ ID NO: 2730702 - protein, 20 aa, Entamoeba histolytica
YEEKLIKLSLTKFKDDKKKK

SEQ ID NO: 2730703 - protein, 25 aa, Entamoeba histolytica
YEETILNCIDLFDSNNYPIQVIFPK

SEQ ID NO: 2730704 - protein, 18 aa, Entamoeba histolytica
YEETIPKEYHRFLMFVHS

SEQ ID NO: 2730705 - protein, 38 aa, Entamoeba histolytica
YEFDLPDIPLSFQTLTDFPLTKDFLLSNPNDLIKHQIE

SEQ ID NO: 2730706 - protein, 19 aa, Entamoeba histolytica
YEFGKKMMLFMSLGKDILF

SEQ ID NO: 2730707 - protein, 17 aa, Entamoeba histolytica
YEFLYDVAVNCQVYQIV

SEQ ID NO: 2730708 - protein, 20 aa, Entamoeba histolytica
YEFVLAPTKLLQVGATLPSK

SEQ ID NO: 2730709 - protein, 25 aa, Entamoeba histolytica
YEGCTKAFEYPSHLFKHCAAQHQKN

SEQ ID NO: 2730710 - protein, 25 aa, Entamoeba histolytica
YEGKDVLYIIAINYLKYLKSDLMKA

SEQ ID NO: 2730711 - protein, 20 aa, Entamoeba histolytica
YEHKIFVQGCIWNVNSFDQW

SEQ ID NO: 2730712 - protein, 24 aa, Entamoeba histolytica
YEHSPIPLMIGFEGIITNIQINLN

SEQ ID NO: 2730713 - protein, 27 aa, Entamoeba histolytica
YEIAAIYPYVLPLLKTVPVDDPNYNMA

SEQ ID NO: 2730714 - protein, 19 aa, Entamoeba histolytica
YEIIGRHKIEPKYDAIPVA

SEQ ID NO: 2730715 - protein, 19 aa, Entamoeba histolytica
YEIMGRHKIEPKYDAIPIA

SEQ ID NO: 2730716 - protein, 20 aa, Entamoeba histolytica
YEINTYCLLYLFSHSFHFIY

SEQ ID NO: 2730717 - protein, 20 aa, Entamoeba histolytica
YEIVLFFLSQTLITNDIINI

SEQ ID NO: 2730718 - protein, 19 aa, Entamoeba histolytica
YEKDHPKVLFLESSAIHDM

SEQ ID NO: 2730719 - protein, 23 aa, Entamoeba histolytica
YEKILVYLLELFPKKIETKNVIG

SEQ ID NO: 2730720 - protein, 30 aa, Entamoeba histolytica
YEKMISGIYMGWLARLAIRELIEKKVIFER

SEQ ID NO: 2730721 - protein, 18 aa, Entamoeba histolytica
YEKNFDFLRTNASMLLYL

SEQ ID NO: 2730722 - protein, 25 aa, Entamoeba histolytica
YEKSVPFKRFYLEAIRLLQPKENFT

SEQ ID NO: 2730723 - protein, 23 aa, Entamoeba histolytica
YEKVKRIILHPYSFDIERDLITP

SEQ ID NO: 2730724 - protein, 21 aa, Entamoeba histolytica
YEKWYKEARGRIKERVKKYYD

SEQ ID NO: 2730725 - protein, 18 aa, Entamoeba histolytica
YELLSWNIFESTFIPVIM

SEQ ID NO: 2730726 - protein, 37 aa, Entamoeba histolytica
YELPIFKRCIWRYPPQYFYILLNPRFVAQKLTEAHVG

SEQ ID NO: 2730727 - protein, 25 aa, Entamoeba histolytica
YELYDPVTVMFFYRKKHIQVDLGTG

SEQ ID NO: 2730728 - protein, 24 aa, Entamoeba histolytica
YELYNQHLLLSLQQRNIKLNNQKY

SEQ ID NO: 2730729 - protein, 25 aa, Entamoeba histolytica
YENEELIKYALPNDLWFHVDSESSA

SEQ ID NO: 2730730 - protein, 32 aa, Entamoeba histolytica
YENGFITPTPSPTPDILMDPYLRGVREIPECC

SEQ ID NO: 2730731 - protein, 26 aa, Entamoeba histolytica
YENKPIPHKKLPPLPPPKPNTNSTNP

SEQ ID NO: 2730732 - protein, 27 aa, Entamoeba histolytica
YENTFDHNYLQQLSIQPKLFFCNQQPN

SEQ ID NO: 2730733 - protein, 30 aa, Entamoeba histolytica; identical to SEQ ID NO: 2543757

SEQ ID NO: 2730734 - protein, 26 aa, Entamoeba histolytica
YEPTKNLILLYPNYTKAIYVSLTSFY

SEQ ID NO: 2730735 - protein, 17 aa, Entamoeba histolytica
YEQFKIPILMDVKDLVC

SEQ ID NO: 2730736 - protein, 19 aa, Entamoeba histolytica
YEQIIKEKNSLIGKIQLEC

SEQ ID NO: 2730737 - protein, 23 aa, Entamoeba histolytica
YEQLSSLVPFLLSKSLRSKTGIL

SEQ ID NO: 2730738 - protein, 27 aa, Entamoeba histolytica
YEQNFYFTDPILLKLFRFEELKQMYLF

SEQ ID NO: 2730739 - protein, 27 aa, Entamoeba histolytica
YEQVAFLIFYHFAVINDIFILDDETVK

SEQ ID NO: 2730740 - protein, 24 aa, Entamoeba histolytica
YEQVQYIYYAVPRLYLMCCVGAAA

SEQ ID NO: 2730741 - protein, 36 aa, Entamoeba histolytica
YEREDGVVSLFLFEFLRVFQCQLVIPIHVVCNEISR

SEQ ID NO: 2730742 - protein, 28 aa, Entamoeba histolytica
YERGARSLWIWRKCKSYLFDDFKDILSL

SEQ ID NO: 2730743 - protein, 26 aa, Entamoeba histolytica
YERNQLISNYFIPPVDLFLSQDMCSP

SEQ ID NO: 2730744 - protein, 21 aa, Entamoeba histolytica
YERPFKFIKNYGSNFVAVICG

SEQ ID NO: 2730745 - protein, 18 aa, Entamoeba histolytica
YESSIEGILYNPTPTKTD

SEQ ID NO: 2730746 - protein, 27 aa, Entamoeba histolytica
YESVKGWLKDVGYYAPKDIIKYLVGNK

SEQ ID NO: 2730747 - protein, 24 aa, Entamoeba histolytica
YETENICYILLTSVPFFEIHYHLL

SEQ ID NO: 2730748 - protein, 17 aa, Entamoeba histolytica
YETFLMGYPQKNYTQEP

SEQ ID NO: 2730749 - protein, 23 aa, Entamoeba histolytica
YETHFIDIYLPDVLEFDKNLHKC

SEQ ID NO: 2730750 - protein, 20 aa, Entamoeba histolytica
YETPFQPDLFHRYQSMVSRS

SEQ ID NO: 2730751 - protein, 25 aa, Entamoeba histolytica
YETYIKDIIKSPTLLAKLMIFIRYC

SEQ ID NO: 2730752 - protein, 22 aa, Entamoeba histolytica
YEVDGIKLLKIRNPWGCCEWKG

SEQ ID NO: 2730753 - protein, 21 aa, Entamoeba histolytica
YEVHNLLQWLSSISNDFVALY

SEQ ID NO: 2730754 - protein, 22 aa, Entamoeba histolytica
YEVHNLLQWLSSISNDFVALYA

SEQ ID NO: 2730755 - protein, 17 aa, Entamoeba histolytica
YEVIFDKIKKKPNIYVI

SEQ ID NO: 2730756 - protein, 26 aa, Entamoeba histolytica
YEWSLTCELSFLESLYQYGNNMEQIL

SEQ ID NO: 2730757 - protein, 33 aa, Entamoeba histolytica
YEYGFTITDPLYTYLFDLCYLPVIGNPGEDSYQ

SEQ ID NO: 2730758 - protein, 32 aa, Entamoeba histolytica
YEYKRKIFVGKQAILPDVRKKGKNLSKRQAKR

SEQ ID NO: 2730759 - protein, 28 aa, Entamoeba histolytica
YEYKSLNAIILLIRIFQQIGDFPFNSFF

SEQ ID NO: 2730760 - protein, 28 aa, Entamoeba histolytica
YEYLNNPIISYYLMYQFGAVDKQKQIEI

SEQ ID NO: 2730761 - protein, 26 aa, Entamoeba histolytica
YEYYRNPEILAFIRKIEIRCLTMGEK

SEQ ID NO: 2730762 - protein, 18 aa, Entamoeba histolytica
YFANCLQWILPSMGDDIY

SEQ ID NO: 2730763 - protein, 19 aa, Entamoeba histolytica
YFCPISKIYRTPPIPSKRI

SEQ ID NO: 2730764 - protein, 17 aa, Entamoeba histolytica
YFCTKAITTDLFVKYSV

SEQ ID NO: 2730765 - protein, 29 aa, Entamoeba histolytica
YFDENYICIIKQIYVKIPYIKSVCLINET

SEQ ID NO: 2730766 - protein, 17 aa, Entamoeba histolytica
YFDFPQQFQQISFQHYF

SEQ ID NO: 2730767 - protein, 17 aa, Entamoeba histolytica
YFDMFDLKIFIESDNDT

SEQ ID NO: 2730768 - protein, 24 aa, Entamoeba histolytica
YFDNKDIPLPKEFDWISSPFHTVF

SEQ ID NO: 2730769 - protein, 31 aa, Entamoeba histolytica
YFEHTFLTIDRPLPLCFTIFSAPNYCDQYNN

SEQ ID NO: 2730770 - protein, 27 aa, Entamoeba histolytica
YFEIVHKKPYFYSLNTFRGEKPQSGLG

SEQ ID NO: 2730771 - protein, 26 aa, Entamoeba histolytica
YFESLIDIIYDVTPCLIHFGIPPEGC

SEQ ID NO: 2730772 - protein, 19 aa, Entamoeba histolytica
YFEVGRSSIILRFVLDKFV

SEQ ID NO: 2730773 - protein, 26 aa, Entamoeba histolytica
YFFQQKENFIPTLQLAMTYPEMMKQV

SEQ ID NO: 2730774 - protein, 24 aa, Entamoeba histolytica
YFGNWMQKVLQLLLKKPKEKSITI

SEQ ID NO: 2730775 - protein, 17 aa, Entamoeba histolytica
YFGRKISSFILFPNQII

SEQ ID NO: 2730776 - protein, 25 aa, Entamoeba histolytica
YFHDDIFRDFILRKLINGERTAMFS

SEQ ID NO: 2730777 - protein, 19 aa, Entamoeba histolytica
YFHNLGYDGRFLAQYGIIG

SEQ ID NO: 2730778 - protein, 18 aa, Entamoeba histolytica
YFHNLGYDGRFLARFGII

SEQ ID NO: 2730779 - protein, 22 aa, Entamoeba histolytica
YFHSTVLYKGALYIYGGRTNSK

SEQ ID NO: 2730780 - protein, 19 aa, Entamoeba histolytica
YFIGIPIIEKSFFHKFYEP

SEQ ID NO: 2730781 - protein, 21 aa, Entamoeba histolytica
YFINIFSLEIQQNIIIDCLKK

SEQ ID NO: 2730782 - protein, 19 aa, Entamoeba histolytica
YFINLLISSNQQIKLCCMV

SEQ ID NO: 2730783 - protein, 19 aa, Entamoeba histolytica
YFINVLASEPPTDYVWKCV

SEQ ID NO: 2730784 - protein, 17 aa, Entamoeba histolytica
YFKKEIEIITKHIYFFF

SEQ ID NO: 2730785 - protein, 20 aa, Entamoeba histolytica
YFKTAEIMIWRPIELEMKSV

SEQ ID NO: 2730786 - protein, 18 aa, Entamoeba histolytica
YFKTLYNYYLPQISINNS

SEQ ID NO: 2730787 - protein, 19 aa, Entamoeba histolytica
YFLIPYIKEREDIDKVVVI

SEQ ID NO: 2730788 - protein, 22 aa, Entamoeba histolytica
YFMFIGGCWCIIITDEKIGVDS

SEQ ID NO: 2730789 - protein, 18 aa, Entamoeba histolytica
YFMHIKLYQRAMALKQND

SEQ ID NO: 2730790 - protein, 18 aa, Entamoeba histolytica
YFMINRINNPLISKNSCI

SEQ ID NO: 2730791 - protein, 34 aa, Entamoeba histolytica; identical to SEQ ID NO: 2543811

SEQ ID NO: 2730792 - protein, 27 aa, Entamoeba histolytica
YFNDDPYTFFIIYKRAPKLLKKVIYSI

SEQ ID NO: 2730793 - protein, 27 aa, Entamoeba histolytica
YFNHDRLYLIATPNQLQCRSSCAYETV

SEQ ID NO: 2730794 - protein, 34 aa, Entamoeba histolytica
YFNMKKIGYSFMYKWLILLFRRDFVSEKCIRLWD

SEQ ID NO: 2730795 - protein, 19 aa, Entamoeba histolytica
YFNNAPLITMVIPSSVKTI

SEQ ID NO: 2730796 - protein, 21 aa, Entamoeba histolytica
YFNNILIFLKNCCKMDDDLIQ

SEQ ID NO: 2730797 - protein, 22 aa, Entamoeba histolytica
YFNRYIPMIYQEDYHRIWVQLF

SEQ ID NO: 2730798 - protein, 17 aa, Entamoeba histolytica
YFPLLNSFQTEIAIRKI

SEQ ID NO: 2730799 - protein, 17 aa, Entamoeba histolytica
YFQIIQIDNFKLKNRKV

SEQ ID NO: 2730800 - protein, 22 aa, Entamoeba histolytica
YFQQPLVPPQSKTPPMYERVRV

SEQ ID NO: 2730801 - protein, 17 aa, Entamoeba histolytica
YFQQVYDIKWNKIGELK

SEQ ID NO: 2730802 - protein, 29 aa, Entamoeba histolytica
YFSFQQLDYIKLLLVNAYKKLNDSSVLEK

SEQ ID NO: 2730803 - protein, 18 aa, Entamoeba histolytica
YFSIQPILSLFASEKTDG

SEQ ID NO: 2730804 - protein, 32 aa, Entamoeba histolytica
YFSLKYDVHWFIVDHWYLFSQLDQFRTNPNKW

SEQ ID NO: 2730805 - protein, 33 aa, Entamoeba histolytica; identical to SEQ ID NO: 2543824

SEQ ID NO: 2730806 - protein, 25 aa, Entamoeba histolytica
YFTQHLCYEIMFHVSTLLPEQPGDL

SEQ ID NO: 2730807 - protein, 18 aa, Entamoeba histolytica
YFTWSFYQINNSLNIPLT

SEQ ID NO: 2730808 - protein, 19 aa, Entamoeba histolytica
YFVICYSVYNKESFIAVTQ

SEQ ID NO: 2730809 - protein, 18 aa, Entamoeba histolytica
YFVQIEYFCLRSFNEELK

SEQ ID NO: 2730810 - protein, 21 aa, Entamoeba histolytica
YFVQTTYLLQTLSIGPLPDQG

SEQ ID NO: 2730811 - protein, 19 aa, Entamoeba histolytica
YFWKIITGCWCNEPSQRIS

SEQ ID NO: 2730812 - protein, 23 aa, Entamoeba histolytica
YGAKLMVPGLLRYSKGITMNEIV

SEQ ID NO: 2730813 - protein, 21 aa, Entamoeba histolytica
YGDVYTRIFWLHRAGGICVCS

SEQ ID NO: 2730814 - protein, 23 aa, Entamoeba histolytica
YGDYKTLSYWLQAINFVIQDLVQ

SEQ ID NO: 2730815 - protein, 25 aa, Entamoeba histolytica
YGEHQCKYIFAIKKLVYNEVAKGMC

SEQ ID NO: 2730816 - protein, 18 aa, Entamoeba histolytica
YGEIIKIIPNIKTLHNLQ

SEQ ID NO: 2730817 - protein, 18 aa, Entamoeba histolytica
YGEKLYRFFDDTVLNFIS

SEQ ID NO: 2730818 - protein, 24 aa, Entamoeba histolytica
YGELFDYKLLIDKRIGYICYNEYD

SEQ ID NO: 2730819 - protein, 18 aa, Entamoeba histolytica
YGEPLFGSDIWIVEVKKQ

SEQ ID NO: 2730820 - protein, 34 aa, Entamoeba histolytica
YGFAVDWWSYGTLIYEMLLGLPPFFDNDVQTMYQ

SEQ ID NO: 2730821 - protein, 22 aa, Entamoeba histolytica
YGFKGNPFVFPIPNEEPSVPYS

SEQ ID NO: 2730822 - protein, 17 aa, Entamoeba histolytica
YGFRNSISLLPYSKRKT

SEQ ID NO: 2730823 - protein, 23 aa, Entamoeba histolytica
YGGGVWTTWFDRDLGICGRVVVE

SEQ ID NO: 2730824 - protein, 20 aa, Entamoeba histolytica
YGGLIAYGSTFFVFSDYCRP

SEQ ID NO: 2730825 - protein, 18 aa, Entamoeba histolytica
YGGLKIRDYMIKKWIEQI

SEQ ID NO: 2730826 - protein, 21 aa, Entamoeba histolytica
YGGWTISFEYIQSLGNIIAIY

SEQ ID NO: 2730827 - protein, 19 aa, Entamoeba histolytica
YGHFFSKEAFLIQYTFYPE

SEQ ID NO: 2730828 - protein, 17 aa, Entamoeba histolytica
YGHVTYFWNGNKSGYFD

SEQ ID NO: 2730829 - protein, 18 aa, Entamoeba histolytica
YGIGYLKERITLKIISSF

SEQ ID NO: 2730830 - protein, 17 aa, Entamoeba histolytica
YGIIQKELTNEEKGKVC

SEQ ID NO: 2730831 - protein, 18 aa, Entamoeba histolytica
YGIPYNWNELESNEYSLF

SEQ ID NO: 2730832 - protein, 23 aa, Entamoeba histolytica
YGKENSLYWGRHKAALAFLATYT

SEQ ID NO: 2730833 - protein, 24 aa, Entamoeba histolytica
YGKISEVKRILKMNKQSIGIVGAT

SEQ ID NO: 2730834 - protein, 22 aa, Entamoeba histolytica
YGKKIEILESCRRPTIGFSDDL

SEQ ID NO: 2730835 - protein, 25 aa, Entamoeba histolytica
YGKKMFTCLKCIKIIGDIMYWEAAL

SEQ ID NO: 2730836 - protein, 25 aa, Entamoeba histolytica
YGKMQDLFIWAFEKEYLEKRNARDE

SEQ ID NO: 2730837 - protein, 22 aa, Entamoeba histolytica
YGKNRKIFFSSFDPDTVVLLNK

SEQ ID NO: 2730838 - protein, 25 aa, Entamoeba histolytica
YGKPAIPYLKFFLKEMCQIFEEEEE

SEQ ID NO: 2730839 - protein, 35 aa, Entamoeba histolytica
YGKQIKHLLLQISKFPRINVFIKPINNIHLDDKVF

SEQ ID NO: 2730840 - protein, 32 aa, Entamoeba histolytica
YGKRTTVLCYLLFRLRTISYPKPQLIICDETS

SEQ ID NO: 2730841 - protein, 19 aa, Entamoeba histolytica
YGKTIILIKAQLTFEEFDL

SEQ ID NO: 2730842 - protein, 22 aa, Entamoeba histolytica
YGLIAIAFNSIIYIINPLSCNM

SEQ ID NO: 2730843 - protein, 26 aa, Entamoeba histolytica
YGNEGFLMMILYYLGCTIKMKRIIKE

SEQ ID NO: 2730844 - protein, 29 aa, Entamoeba histolytica
YGNNLEFVDYLFLAMMVQIREPILESSQY

SEQ ID NO: 2730845 - protein, 26 aa, Entamoeba histolytica
YGPDEHSFFPQLPITALKKICEYLDE

SEQ ID NO: 2730846 - protein, 25 aa, Entamoeba histolytica
YGPGCFYGCFSLPPRLDLPPISLRK

SEQ ID NO: 2730847 - protein, 17 aa, Entamoeba histolytica
YGPYGIPVKTPIIAPVV

SEQ ID NO: 2730848 - protein, 30 aa, Entamoeba histolytica
YGQDDINIILLKLKAFINGLNKMSLISDWK

SEQ ID NO: 2730849 - protein, 29 aa, Entamoeba histolytica
YGQYQGIRGWGCIFARALSSKAKEDEDRI

SEQ ID NO: 2730850 - protein, 17 aa, Entamoeba histolytica
YGRMQLQLFYPNLYLRL

SEQ ID NO: 2730851 - protein, 28 aa, Entamoeba histolytica
YGRVTLHSSLMFMYGICIGADVIDEGYR

SEQ ID NO: 2730852 - protein, 23 aa, Entamoeba histolytica
YGSKVIILHRRDAFRASKTMQER

SEQ ID NO: 2730853 - protein, 25 aa, Entamoeba histolytica
YGSRCRFIHVLPGELSPAPDCVDIS

SEQ ID NO: 2730854 - protein, 22 aa, Entamoeba histolytica
YGTIIKIRYNGKFYALKQTDCS

SEQ ID NO: 2730855 - protein, 24 aa, Entamoeba histolytica
YGTKRAIYFYTKTICLLIESINEN

SEQ ID NO: 2730856 - protein, 27 aa, Entamoeba histolytica
YGTKVFELHFYPLLQQYLYSTHEYLVY

SEQ ID NO: 2730857 - protein, 26 aa, Entamoeba histolytica
YGTLNSLYLLPKYSEKLRFLGAPKVT

SEQ ID NO: 2730858 - protein, 21 aa, Entamoeba histolytica
YGTVPPPLSPYGTVPAPATPY

SEQ ID NO: 2730859 - protein, 19 aa, Entamoeba histolytica
YGVSAWAYLNGVQKIKLLK

SEQ ID NO: 2730860 - protein, 28 aa, Entamoeba histolytica
YGVSFLYAGWDRYFGYQLYMCDPSGNYG

SEQ ID NO: 2730861 - protein, 22 aa, Entamoeba histolytica
YGYNPLFVDLSLSTNIITLPGC

SEQ ID NO: 2730862 - protein, 17 aa, Entamoeba histolytica
YHALLSHIPFEPSSYQM

SEQ ID NO: 2730863 - protein, 18 aa, Entamoeba histolytica
YHCFSGCISLKELPKEIK

SEQ ID NO: 2730864 - protein, 26 aa, Entamoeba histolytica
YHEDIHFLSYLIPHMSKFLSVEYIPT

SEQ ID NO: 2730865 - protein, 19 aa, Entamoeba histolytica
YHEFLYEKMFTTPKPPTTL

SEQ ID NO: 2730866 - protein, 18 aa, Entamoeba histolytica
YHELNTMSIYMYSFRNRD

SEQ ID NO: 2730867 - protein, 33 aa, Entamoeba histolytica
YHFNIIISPFFPPYPLHFFSLPILPSITHTPSL

SEQ ID NO: 2730868 - protein, 23 aa, Entamoeba histolytica
YHGCNNSFFMKSELIAHVKEKHQ

SEQ ID NO: 2730869 - protein, 26 aa, Entamoeba histolytica
YHGSRLTNFVGILSTGLRIAPPEAPC

SEQ ID NO: 2730870 - protein, 18 aa, Entamoeba histolytica
YHILPIDYTKKVLMISND

SEQ ID NO: 2730871 - protein, 19 aa, Entamoeba histolytica
YHIPYHYYNLIISSSPLNL

SEQ ID NO: 2730872 - protein, 17 aa, Entamoeba histolytica
YHKILLTGTPIQNNIDE

SEQ ID NO: 2730873 - protein, 19 aa, Entamoeba histolytica
YHLMVVCKYLQTVEDYLNI

SEQ ID NO: 2730874 - protein, 17 aa, Entamoeba histolytica
YHLSRLISRLIIKCKNI

SEQ ID NO: 2730875 - protein, 32 aa, Entamoeba histolytica
YHNECFKCHICGQKLFSFAKFYNDNGEIMCHP

SEQ ID NO: 2730876 - protein, 17 aa, Entamoeba histolytica
YHNILYNQVTFLEHTEI

SEQ ID NO: 2730877 - protein, 21 aa, Entamoeba histolytica
YHPFNHQTSFFQPRSVNYDQS

SEQ ID NO: 2730878 - protein, 17 aa, Entamoeba histolytica
YHQIRTRKGDIHKIGKK

SEQ ID NO: 2730879 - protein, 17 aa, Entamoeba histolytica
YHQLDISYLALYYYEQA

SEQ ID NO: 2730880 - protein, 32 aa, Entamoeba histolytica
YHRRNIFAVTYNYLLQLAINLYNGSLRFEVKK

SEQ ID NO: 2730881 - protein, 26 aa, Entamoeba histolytica
YHRVLEFLLIFLVNLNDSIIPSSLYE

SEQ ID NO: 2730882 - protein, 24 aa, Entamoeba histolytica
YHSEPYFLSLTFKNDIAKDGTEKA

SEQ ID NO: 2730883 - protein, 31 aa, Entamoeba histolytica
YHSKYHLKYCFFNKLGFLIEIPSFSTSLNSN

SEQ ID NO: 2730884 - protein, 17 aa, Entamoeba histolytica
YHTLIKPSHYNTSFERA

SEQ ID NO: 2730885 - protein, 18 aa, Entamoeba histolytica
YHYLFKDNYVMGKRELFL

SEQ ID NO: 2730886 - protein, 22 aa, Entamoeba histolytica
YIAIHVIELLIENDKLVNCAKG

SEQ ID NO: 2730887 - protein, 18 aa, Entamoeba histolytica
YICGFDEMLKIIKIETFV

SEQ ID NO: 2730888 - protein, 19 aa, Entamoeba histolytica
YICSRYYRAPELIFGATRY

SEQ ID NO: 2730889 - protein, 23 aa, Entamoeba histolytica
YIDKLEGLIPQKEWPYPSYETLW

SEQ ID NO: 2730890 - protein, 31 aa, Entamoeba histolytica
YIDKLPLYNKALLNRLMKLCYRISLNHEDTQ

SEQ ID NO: 2730891 - protein, 25 aa, Entamoeba histolytica
YIDKYSNLPLIINTAGWKSGFGLEL

SEQ ID NO: 2730892 - protein, 19 aa, Entamoeba histolytica
YIDNLIELFPSIKLLFNDI

SEQ ID NO: 2730893 - protein, 26 aa, Entamoeba histolytica
YIDPPVPIQYVNLFLEVYFNKNQKLN

SEQ ID NO: 2730894 - protein, 24 aa, Entamoeba histolytica
YIDVLTLNCSYFRTFKTHQIMEQV

SEQ ID NO: 2730895 - protein, 32 aa, Entamoeba histolytica
YIEDAVYPIIPINIIFNKVLELILFKNQNLTT

SEQ ID NO: 2730896 - protein, 31 aa, Entamoeba histolytica
YIEDAVYPIIPINIIFNKVLELILFKNQSLT

SEQ ID NO: 2730897 - protein, 19 aa, Entamoeba histolytica
YIEELRIFCKNTFNLEYLS

SEQ ID NO: 2730898 - protein, 24 aa, Entamoeba histolytica
YIEEQFFISNYGSKRIWNLISFII

SEQ ID NO: 2730899 - protein, 25 aa, Entamoeba histolytica
YIEFRQTYIHLIPQNIFLGRNPSSP

SEQ ID NO: 2730900 - protein, 23 aa, Entamoeba histolytica
YIEIHRVINDILYPMVITLSSKQ

SEQ ID NO: 2730901 - protein, 23 aa, Entamoeba histolytica
YIEKTTLLLFPSPDAQPLDKIEH

SEQ ID NO: 2730902 - protein, 24 aa, Entamoeba histolytica
YIELGYYQLCGVVLYVFFDERLKN

SEQ ID NO: 2730903 - protein, 19 aa, Entamoeba histolytica
YIELYIKYHRPLLIHMKDS

SEQ ID NO: 2730904 - protein, 22 aa, Entamoeba histolytica
YIEQFFIQRPYKKISSMNNFQI

SEQ ID NO: 2730905 - protein, 17 aa, Entamoeba histolytica
YIETFIPPLVKSLSQPI

SEQ ID NO: 2730906 - protein, 21 aa, Entamoeba histolytica
YIETIQIIFKLIRDEKQYIMK

SEQ ID NO: 2730907 - protein, 26 aa, Entamoeba histolytica
YIFDGIKHVLIWTIGKHDPKIIPTIS

SEQ ID NO: 2730908 - protein, 18 aa, Entamoeba histolytica
YIFQFMFMINTDTDPPKK

SEQ ID NO: 2730909 - protein, 20 aa, Entamoeba histolytica
YIGCLINYYASRGKVIELLE

SEQ ID NO: 2730910 - protein, 41 aa, Entamoeba histolytica
YIGEWKEMELVLTNDLMIITYQKQIEYISLYVDYNITEYNI

SEQ ID NO: 2730911 - protein, 19 aa, Entamoeba histolytica
YIGEYIWLKNKEVLEMTDS

SEQ ID NO: 2730912 - protein, 20 aa, Entamoeba histolytica
YIGTEYLQMLKKAMPIIFEA

SEQ ID NO: 2730913 - protein, 17 aa, Entamoeba histolytica
YIHEKKFKYVVVHASIV

SEQ ID NO: 2730914 - protein, 17 aa, Entamoeba histolytica
YIHSFYNGSLMDVYVLL

SEQ ID NO: 2730915 - protein, 20 aa, Entamoeba histolytica
YIIDGITFDFIPTPNTEAPA

SEQ ID NO: 2730916 - protein, 17 aa, Entamoeba histolytica
YIIIGLYAHKRKDDKNY

SEQ ID NO: 2730917 - protein, 18 aa, Entamoeba histolytica
YIIRYYTSVLRQEEFWIV

SEQ ID NO: 2730918 - protein, 17 aa, Entamoeba histolytica
YIIWMGDLNYRIEMEDS

SEQ ID NO: 2730919 - protein, 36 aa, Entamoeba histolytica; identical to SEQ ID NO: 2543949

SEQ ID NO: 2730920 - protein, 18 aa, Entamoeba histolytica
YIIYTTLAWRNVKYGNCS

SEQ ID NO: 2730921 - protein, 19 aa, Entamoeba histolytica
YIKAIPYNYFVTMNTLRSK

SEQ ID NO: 2730922 - protein, 18 aa, Entamoeba histolytica
YIKDLGMNALWMTPIFNS

SEQ ID NO: 2730923 - protein, 26 aa, Entamoeba histolytica
YIKEAIIIRIFQILVEKKSINLVDIK

SEQ ID NO: 2730924 - protein, 32 aa, Entamoeba histolytica
YIKHREHCPYHFPPGLLIYKDDERHLAFFEVD

SEQ ID NO: 2730925 - protein, 19 aa, Entamoeba histolytica
YIKITELLKYPQLNEFWKL

SEQ ID NO: 2730926 - protein, 18 aa, Entamoeba histolytica
YIKKLIEKVIKHSTGFLD

SEQ ID NO: 2730927 - protein, 22 aa, Entamoeba histolytica
YIKKVIVHPLVLLSISDHQTRA

SEQ ID NO: 2730928 - protein, 26 aa, Entamoeba histolytica
YIKNPRKIILYFDLLKVLLDNNNQNE

SEQ ID NO: 2730929 - protein, 17 aa, Entamoeba histolytica
YIKQSDGFILIYSITSK

SEQ ID NO: 2730930 - protein, 17 aa, Entamoeba histolytica
YIKSLSLVGILQGKIIG

SEQ ID NO: 2730931 - protein, 25 aa, Entamoeba histolytica
YIKTLLTEFPLARTLSLFIKFLLFQ

SEQ ID NO: 2730932 - protein, 19 aa, Entamoeba histolytica
YIKVKTISKYSYLKKSFEQ

SEQ ID NO: 2730933 - protein, 30 aa, Entamoeba histolytica; identical to SEQ ID NO: 2543957

SEQ ID NO: 2730934 - protein, 18 aa, Entamoeba histolytica
YILAKVLVRSLLQNGGYP

SEQ ID NO: 2730935 - protein, 20 aa, Entamoeba histolytica
YILFIHSHSFYRYSTSKISE

SEQ ID NO: 2730936 - protein, 17 aa, Entamoeba histolytica
YILFRTETRDDITNGYK

SEQ ID NO: 2730937 - protein, 22 aa, Entamoeba histolytica
YILSRYPLIRTIEHIKHLLYQF

SEQ ID NO: 2730938 - protein, 20 aa, Entamoeba histolytica
YIMKGGCSILTLCFCKSPLT

SEQ ID NO: 2730939 - protein, 35 aa, Entamoeba histolytica
YINATKRIRIGKFPKYLLIKLERQIALSYEDVRKV

SEQ ID NO: 2730940 - protein, 26 aa, Entamoeba histolytica
YINESFPIIFAFIRNEEVILVEIFYN

SEQ ID NO: 2730941 - protein, 27 aa, Entamoeba histolytica
YINHQSIFLFMNFLFNVSNPETIKKVF

SEQ ID NO: 2730942 - protein, 18 aa, Entamoeba histolytica
YINIKKYISSYSKAVIEL

SEQ ID NO: 2730943 - protein, 24 aa, Entamoeba histolytica
YINPAPLNFFPSPDFITAKYLVGW

SEQ ID NO: 2730944 - protein, 24 aa, Entamoeba histolytica
YINQRTSLLLHRLFARGMAFCDLN

SEQ ID NO: 2730945 - protein, 19 aa, Entamoeba histolytica
YIPETFYESLFDESIFAGS

SEQ ID NO: 2730946 - protein, 17 aa, Entamoeba histolytica
YIPVLKNFTGKTDFSLL

SEQ ID NO: 2730947 - protein, 30 aa, Entamoeba histolytica
YIQENPQTLIPRFYGMFRIKPQKDEEYRYV

SEQ ID NO: 2730948 - protein, 17 aa, Entamoeba histolytica
YIQFNKGFNGFLINTPN

SEQ ID NO: 2730949 - protein, 18 aa, Entamoeba histolytica
YIQGLNSFYQLTPVDLTV

SEQ ID NO: 2730950 - protein, 22 aa, Entamoeba histolytica
YIQHREFIIKVYGLEIKQVELS

SEQ ID NO: 2730951 - protein, 26 aa, Entamoeba histolytica
YIQINSVFYPFKLSNCVLNITIFIYI

SEQ ID NO: 2730952 - protein, 26 aa, Entamoeba histolytica
YIRALTLKFILTISEKELIQPLTHAV

SEQ ID NO: 2730953 - protein, 18 aa, Entamoeba histolytica
YISEITMALKYLHSLNII

SEQ ID NO: 2730954 - protein, 17 aa, Entamoeba histolytica
YISELHCYDFIQRRKHK

SEQ ID NO: 2730955 - protein, 32 aa, Entamoeba histolytica; identical to SEQ ID NO: 2543985

SEQ ID NO: 2730956 - protein, 18 aa, Entamoeba histolytica
YISTQILISYKEQWYLIS

SEQ ID NO: 2730957 - protein, 29 aa, Entamoeba histolytica
YISVCVQGIPKQWNTRKFREEFGDYNIAK

SEQ ID NO: 2730958 - protein, 19 aa, Entamoeba histolytica
YITALTLPGNFPKIDKSIF

SEQ ID NO: 2730959 - protein, 24 aa, Entamoeba histolytica
YITKRDEMIQSLKQLDGLLVSEEI

SEQ ID NO: 2730960 - protein, 32 aa, Entamoeba histolytica; identical to SEQ ID NO: 2543989

SEQ ID NO: 2730961 - protein, 41 aa, Entamoeba histolytica
YITRSDYITFRLLTLTLQSLLHITFYMKKLESEKLINSKPS

SEQ ID NO: 2730962 - protein, 17 aa, Entamoeba histolytica
YITSAVGNITFPIDRRL

SEQ ID NO: 2730963 - protein, 21 aa, Entamoeba histolytica
YITTFLTYSSVPFLTESLARL

SEQ ID NO: 2730964 - protein, 26 aa, Entamoeba histolytica
YIVKNSWGSFWGMDGYILMSRNKNNQ

SEQ ID NO: 2730965 - protein, 19 aa, Entamoeba histolytica
YIVLGCDGLWDTLNGNQIK

SEQ ID NO: 2730966 - protein, 18 aa, Entamoeba histolytica
YIVNMLTPDFVISQTYQG

SEQ ID NO: 2730967 - protein, 17 aa, Entamoeba histolytica
YIVNPVLDYRTVTSVNG

SEQ ID NO: 2730968 - protein, 26 aa, Entamoeba histolytica
YIVPRSRFLPVKACNDLFIIQSTLFG

SEQ ID NO: 2730969 - protein, 18 aa, Entamoeba histolytica
YIVRMLYKFLTCFTLLDN

SEQ ID NO: 2730970 - protein, 21 aa, Entamoeba histolytica
YIYEVLEFAPGGNLFQRITKK

SEQ ID NO: 2730971 - protein, 20 aa, Entamoeba histolytica
YIYFCDAHSLFYSSSHFVHW

SEQ ID NO: 2730972 - protein, 18 aa, Entamoeba histolytica
YIYFTILKKYQLPMENED

SEQ ID NO: 2730973 - protein, 17 aa, Entamoeba histolytica
YIYGRNEMILIPKQMRN

SEQ ID NO: 2730974 - protein, 29 aa, Entamoeba histolytica
YIYNDDTVLLFYWYYVSGTNLRTILSDYT

SEQ ID NO: 2730975 - protein, 25 aa, Entamoeba histolytica
YKANKKFCFIQLPNPVHDTVSYFIF

SEQ ID NO: 2730976 - protein, 17 aa, Entamoeba histolytica
YKCYHLTKIVLPEVSCI

SEQ ID NO: 2730977 - protein, 17 aa, Entamoeba histolytica
YKDAYIYLYDFSTKSKE

SEQ ID NO: 2730978 - protein, 23 aa, Entamoeba histolytica
YKDKRYISYILKKSDRYAVELYC

SEQ ID NO: 2730979 - protein, 26 aa, Entamoeba histolytica
YKDPKEEVKFFYWQGKHTSIKSKGKT

SEQ ID NO: 2730980 - protein, 25 aa, Entamoeba histolytica
YKDSTLIMQLLRDNLTLWTSDMGDD

SEQ ID NO: 2730981 - protein, 25 aa, Entamoeba histolytica
YKDSTLIMQLLRDNLTLWTSDTADE

SEQ ID NO: 2730982 - protein, 23 aa, Entamoeba histolytica
YKEKCVFMIKYSLELRQWKEMKN

SEQ ID NO: 2730983 - protein, 29 aa, Entamoeba histolytica
YKEKFPLIPQTYYPSWSSMSFNTGFPLVA

SEQ ID NO: 2730984 - protein, 24 aa, Entamoeba histolytica
YKEKLVYSYFLLNEGLGEDEKQER

SEQ ID NO: 2730985 - protein, 17 aa, Entamoeba histolytica
YKELFTDVKNRKREVDE

SEQ ID NO: 2730986 - protein, 31 aa, Entamoeba histolytica
YKELNKLFEINYSKKIILIAYCEFSKTRAPN

SEQ ID NO: 2730987 - protein, 20 aa, Entamoeba histolytica
YKEMKRMVDPLVFGNLKSET

SEQ ID NO: 2730988 - protein, 30 aa, Entamoeba histolytica
YKESINFVVDLLIELGYCITFFETSGRNKT

SEQ ID NO: 2730989 - protein, 24 aa, Entamoeba histolytica
YKESTILIKAGTRIILEIISMELK

SEQ ID NO: 2730990 - protein, 17 aa, Entamoeba histolytica
YKFLTCFTLLDNQIDYL

SEQ ID NO: 2730991 - protein, 27 aa, Entamoeba histolytica
YKFPISYNEYLLFKSLGIHCNNIVLTQ

SEQ ID NO: 2730992 - protein, 23 aa, Entamoeba histolytica
YKGIIPMNVVLLKNLNYSCHLFS

SEQ ID NO: 2730993 - protein, 25 aa, Entamoeba histolytica
YKGYPSVLTLSLFKEFNKLIELGYF

SEQ ID NO: 2730994 - protein, 20 aa, Entamoeba histolytica
YKHFPIINLNDFYSSSGSGE

SEQ ID NO: 2730995 - protein, 26 aa, Entamoeba histolytica
YKHRVKALTLIIFTDVLILCKKEKKG

SEQ ID NO: 2730996 - protein, 21 aa, Entamoeba histolytica
YKHSLSRFIPAYKCIKLLQES

SEQ ID NO: 2730997 - protein, 23 aa, Entamoeba histolytica
YKITFPFREIIAFSYIQTKTTTT

SEQ ID NO: 2730998 - protein, 33 aa, Entamoeba histolytica; identical to SEQ ID NO: 2544024

SEQ ID NO: 2730999 - protein, 20 aa, Entamoeba histolytica
YKKGGLKEGLKQGGKTLAKN

SEQ ID NO: 2731000 - protein, 20 aa, Entamoeba histolytica
YKKGNVQLVLFIGGTSKMPR

SEQ ID NO: 2731001 - protein, 23 aa, Entamoeba histolytica
YKKIIGIVWKKYGVTKGFELSVG

SEQ ID NO: 2731002 - protein, 23 aa, Entamoeba histolytica
YKKKNMFFLVFVEGMKPIGFYVN

SEQ ID NO: 2731003 - protein, 25 aa, Entamoeba histolytica
YKKMSPLLKELFVEGLKFIKNENDM

SEQ ID NO: 2731004 - protein, 29 aa, Entamoeba histolytica
YKKYKPIMFNGFWEFLEEFKRRGGIICIC

SEQ ID NO: 2731005 - protein, 20 aa, Entamoeba histolytica
YKKYLFYKQIQFDRKHWKEN

SEQ ID NO: 2731006 - protein, 17 aa, Entamoeba histolytica
YKLIKALHLINGNIRIV

SEQ ID NO: 2731007 - protein, 17 aa, Entamoeba histolytica
YKLKNLLVLKDNLIIIK

SEQ ID NO: 2731008 - protein, 18 aa, Entamoeba histolytica
YKLLCELVGDISITIQKE

SEQ ID NO: 2731009 - protein, 21 aa, Entamoeba histolytica
YKLNLLRRPMNNDQFLIIKNA

SEQ ID NO: 2731010 - protein, 28 aa, Entamoeba histolytica
YKNLMKVYLDAVFLPRVRNDIYPFYQEG

SEQ ID NO: 2731011 - protein, 23 aa, Entamoeba histolytica
YKNRPFIQIDKRPRIDLTKAIVS

SEQ ID NO: 2731012 - protein, 26 aa, Entamoeba histolytica
YKNVIEGCKWYQFLHSILVGAVSIVN

SEQ ID NO: 2731013 - protein, 17 aa, Entamoeba histolytica
YKNVVGSRRASWRIISS

SEQ ID NO: 2731014 - protein, 17 aa, Entamoeba histolytica
YKQIQFDRKHWKENLIS

SEQ ID NO: 2731015 - protein, 19 aa, Entamoeba histolytica
YKQMIYKVESIIDILEKFL

SEQ ID NO: 2731016 - protein, 18 aa, Entamoeba histolytica
YKQMMLTIPHFECPEQPK

SEQ ID NO: 2731017 - protein, 40 aa, Entamoeba histolytica
YKQPLTIITSKDPFIPPLLKIQLPLMVKISRYFTKEDITA

SEQ ID NO: 2731018 - protein, 27 aa, Entamoeba histolytica
YKSDAWSVGCVLYCMIVGKKEGPFNQQ

SEQ ID NO: 2731019 - protein, 26 aa, Entamoeba histolytica
YKSDIFSYGIILWEMTYRTIHQKYQR

SEQ ID NO: 2731020 - protein, 26 aa, Entamoeba histolytica
YKSFYLCEILHFIKTNKDLLFSQLQN

SEQ ID NO: 2731021 - protein, 24 aa, Entamoeba histolytica
YKSIPIDFFIKHATKFINLQCISG

SEQ ID NO: 2731022 - protein, 34 aa, Entamoeba histolytica
YKSLFENIYLYAAVSKFCYVLLNEAFKSEDSLNL

SEQ ID NO: 2731023 - protein, 20 aa, Entamoeba histolytica
YKSLSIYLYCFKLDSFICSF

SEQ ID NO: 2731024 - protein, 24 aa, Entamoeba histolytica
YKSRKQYIYSISDLLSFKSSAVPY

SEQ ID NO: 2731025 - protein, 28 aa, Entamoeba histolytica
YKTRNVMKLIYLDLLGYNTQFAQIECLA

SEQ ID NO: 2731026 - protein, 31 aa, Entamoeba histolytica
YKVQLSFFTQYLYFNYLPVRITATETILQVL

SEQ ID NO: 2731027 - protein, 30 aa, Entamoeba histolytica
YKVYEQSIFLALLNQYFDITLRLPIKQAKV

SEQ ID NO: 2731028 - protein, 21 aa, Entamoeba histolytica
YKYCSVVPLLERRFISLFMKK

SEQ ID NO: 2731029 - protein, 24 aa, Entamoeba histolytica
YKYGKDIIILALRDNNLYIHQLSK

SEQ ID NO: 2731030 - protein, 25 aa, Entamoeba histolytica
YKYTKKKMEFLWTGDMKLNTVHVHD

SEQ ID NO: 2731031 - protein, 19 aa, Entamoeba histolytica
YLALAHVIILFNQLTEKYE

SEQ ID NO: 2731032 - protein, 28 aa, Entamoeba histolytica
YLAQYSMFHLASPKVLMLKIKLAKELDQ

SEQ ID NO: 2731033 - protein, 29 aa, Entamoeba histolytica
YLASYFIDLIQFIPYKFGQLRSIILTSTP

SEQ ID NO: 2731034 - protein, 18 aa, Entamoeba histolytica
YLAYQQAVLIALLNKKYD

SEQ ID NO: 2731035 - protein, 26 aa, Entamoeba histolytica
YLCDELLRQSILIGKYPFDKYHNYKF

SEQ ID NO: 2731036 - protein, 30 aa, Entamoeba histolytica
YLCEFCDDFKYFEPTFIYILHALHENEVVS

SEQ ID NO: 2731037 - protein, 19 aa, Entamoeba histolytica
YLCGVAKQCWKLLDSNFCL

SEQ ID NO: 2731038 - protein, 30 aa, Entamoeba histolytica
YLCQELLNLLFKFKYTIKALIFECIGKFLE

SEQ ID NO: 2731039 - protein, 18 aa, Entamoeba histolytica
YLCTTPVKIITFDLRHMS

SEQ ID NO: 2731040 - protein, 18 aa, Entamoeba histolytica
YLCYFKIELNYIHKIKQT

SEQ ID NO: 2731041 - protein, 18 aa, Entamoeba histolytica
YLDAITNNYLIELLNKCG

SEQ ID NO: 2731042 - protein, 28 aa, Entamoeba histolytica
YLDEFDYLLRNSILFRKETFDSASDDIM

SEQ ID NO: 2731043 - protein, 17 aa, Entamoeba histolytica
YLDLIDYGNLLLNENEK

SEQ ID NO: 2731044 - protein, 17 aa, Entamoeba histolytica
YLEEFVPTFISIGRTEK

SEQ ID NO: 2731045 - protein, 20 aa, Entamoeba histolytica
YLEEVVPLTQSLFSVTTGLQ

SEQ ID NO: 2731046 - protein, 31 aa, Entamoeba histolytica
YLEHDTKLPAVFFIFSRKLVMDYAKKLAKAT

SEQ ID NO: 2731047 - protein, 25 aa, Entamoeba histolytica
YLEIKNFLLHSPLKYTGINLRTLTD

SEQ ID NO: 2731048 - protein, 34 aa, Entamoeba histolytica
YLEILNKCLKQLPLRYFIIPTILSKNNKAIRMSK

SEQ ID NO: 2731049 - protein, 25 aa, Entamoeba histolytica
YLEIPQFYQIISLLNFHMSPSMFSH

SEQ ID NO: 2731050 - protein, 31 aa, Entamoeba histolytica
YLEKQKFVDLIELCRLFCLAGASKEKTKEKY

SEQ ID NO: 2731051 - protein, 19 aa, Entamoeba histolytica
YLERTNVSLIIKKGFINGM

SEQ ID NO: 2731052 - protein, 17 aa, Entamoeba histolytica
YLFCIIHHYQDALTLIL

SEQ ID NO: 2731053 - protein, 19 aa, Entamoeba histolytica
YLFNVNFGDIFVVRSAGGV

SEQ ID NO: 2731054 - protein, 24 aa, Entamoeba histolytica
YLGFRHFYVFCREYDLLSKEDISP

SEQ ID NO: 2731055 - protein, 17 aa, Entamoeba histolytica
YLGMLLNSTTEVCLLNN

SEQ ID NO: 2731056 - protein, 20 aa, Entamoeba histolytica
YLHFRGFNYQRLDGAMGREA

SEQ ID NO: 2731057 - protein, 26 aa, Entamoeba histolytica
YLHLPESIILPRGLTFFDCLSIQKSW

SEQ ID NO: 2731058 - protein, 20 aa, Entamoeba histolytica
YLICYLSSYGPYLCCFENWL

SEQ ID NO: 2731059 - protein, 17 aa, Entamoeba histolytica
YLIEKGVIQYLIRYIYR

SEQ ID NO: 2731060 - protein, 17 aa, Entamoeba histolytica
YLIKIFNAFIKSNCDEI

SEQ ID NO: 2731061 - protein, 24 aa, Entamoeba histolytica
YLIKKIKEIYQIKSLLIIKDNKIT

SEQ ID NO: 2731062 - protein, 17 aa, Entamoeba histolytica
YLIQTHAVLFLPQANVL

SEQ ID NO: 2731063 - protein, 20 aa, Entamoeba histolytica
YLIRAGVINLTLYYPEINND

SEQ ID NO: 2731064 - protein, 25 aa, Entamoeba histolytica
YLISKKGFWNILKKEKCVFKIGFFL

SEQ ID NO: 2731065 - protein, 21 aa, Entamoeba histolytica
YLKALDSLVKLASLQTAFLTL

SEQ ID NO: 2731066 - protein, 20 aa, Entamoeba histolytica
YLKKQVTLSLPKISKSLFVF

SEQ ID NO: 2731067 - protein, 18 aa, Entamoeba histolytica
YLKKYTKEIYLYSFGDSI

SEQ ID NO: 2731068 - protein, 18 aa, Entamoeba histolytica
YLKLMWKGTKDIKEKENM

SEQ ID NO: 2731069 - protein, 19 aa, Entamoeba histolytica
YLKMSLKMFEKYVGGIVSF

SEQ ID NO: 2731070 - protein, 18 aa, Entamoeba histolytica
YLLGDYFFKSNDKNVIRK

SEQ ID NO: 2731071 - protein, 22 aa, Entamoeba histolytica
YLLKFLIIGDTAVGKTAMLLRY

SEQ ID NO: 2731072 - protein, 22 aa, Entamoeba histolytica
YLLLHGLMCPLLAPRISKKLCS

SEQ ID NO: 2731073 - protein, 17 aa, Entamoeba histolytica
YLLLLGNKEYKVNTLTG

SEQ ID NO: 2731074 - protein, 20 aa, Entamoeba histolytica
YLLNVVLYLDYMNARKFAQI

SEQ ID NO: 2731075 - protein, 17 aa, Entamoeba histolytica
YLLPVVPISFSAIKQNE

SEQ ID NO: 2731076 - protein, 26 aa, Entamoeba histolytica
YLLTAQWCKPFFDNPTLKYVELNKTY

SEQ ID NO: 2731077 - protein, 22 aa, Entamoeba histolytica
YLMKQSYIFGTWTERYVIIKDN

SEQ ID NO: 2731078 - protein, 26 aa, Entamoeba histolytica
YLNADFGLFINDLIRIYSHTIGFEAM

SEQ ID NO: 2731079 - protein, 28 aa, Entamoeba histolytica
YLNCGKTTFLKPLQSLPFDKQYNPSSDK

SEQ ID NO: 2731080 - protein, 31 aa, Entamoeba histolytica
YLNEACPMEMTFAEVILVLKANYEWSYPQYV

SEQ ID NO: 2731081 - protein, 17 aa, Entamoeba histolytica
YLNEMVMIAQTPKPTIS

SEQ ID NO: 2731082 - protein, 18 aa, Entamoeba histolytica
YLNGKIVSKPFSWPSTDF

SEQ ID NO: 2731083 - protein, 17 aa, Entamoeba histolytica
YLNGLKKKYKDMPEIRR

SEQ ID NO: 2731084 - protein, 19 aa, Entamoeba histolytica
YLNIVRKSIEDFVPKAIMH

SEQ ID NO: 2731085 - protein, 20 aa, Entamoeba histolytica
YLNIVRKSIEDFVPKAIMHF

SEQ ID NO: 2731086 - protein, 25 aa, Entamoeba histolytica
YLNKLRCFGYKIGVLRPAFISGNSV

SEQ ID NO: 2731087 - protein, 34 aa, Entamoeba histolytica
YLNKYNITFEFIVKWLLMLFKREFWSKEVLRLWD

SEQ ID NO: 2731088 - protein, 18 aa, Entamoeba histolytica
YLNLIESEVFLVKDIASS

SEQ ID NO: 2731089 - protein, 23 aa, Entamoeba histolytica
YLNNYLFGPFQLDSLVQSINNKM

SEQ ID NO: 2731090 - protein, 23 aa, Entamoeba histolytica
YLNRILQDIFTYGKNRKIFFSSF

SEQ ID NO: 2731091 - protein, 17 aa, Entamoeba histolytica
YLNTPFPSLTTYQLYII

SEQ ID NO: 2731092 - protein, 28 aa, Entamoeba histolytica
YLNYHDCKQYYHTYYPLIRLEAEADRQK

SEQ ID NO: 2731093 - protein, 18 aa, Entamoeba histolytica
YLPDLKGSVLLLIKSEIG

SEQ ID NO: 2731094 - protein, 23 aa, Entamoeba histolytica
YLQHCMIHCYGFSPLPNAEDLKK

SEQ ID NO: 2731095 - protein, 18 aa, Entamoeba histolytica
YLQKFKRKYVEKEKKEQL

SEQ ID NO: 2731096 - protein, 21 aa, Entamoeba histolytica
YLQNIWNLFVTSYKSIHTDRK

SEQ ID NO: 2731097 - protein, 18 aa, Entamoeba histolytica
YLQRCVIKMLESLHVEYD

SEQ ID NO: 2731098 - protein, 17 aa, Entamoeba histolytica
YLQVVNYNSLFIKLNER

SEQ ID NO: 2731099 - protein, 23 aa, Entamoeba histolytica
YLRDTLILNTLYQRSIDQWDNED

SEQ ID NO: 2731100 - protein, 19 aa, Entamoeba histolytica
YLREFLKRIFDAIHAQQQL

SEQ ID NO: 2731101 - protein, 23 aa, Entamoeba histolytica
YLRELWNEFSGIRNKKMELSQKL

SEQ ID NO: 2731102 - protein, 19 aa, Entamoeba histolytica
YLRFKTPFPSLEHLIIHIC

SEQ ID NO: 2731103 - protein, 18 aa, Entamoeba histolytica
YLRQVGINVIMALLGCGV

SEQ ID NO: 2731104 - protein, 19 aa, Entamoeba histolytica
YLSCLLELQGIRKEGKRVI

SEQ ID NO: 2731105 - protein, 17 aa, Entamoeba histolytica
YLSFFYDGIVDYSGNLI

SEQ ID NO: 2731106 - protein, 18 aa, Entamoeba histolytica
YLSIERFIEKESIEIGNV

SEQ ID NO: 2731107 - protein, 32 aa, Entamoeba histolytica
YLSKSFELQVYYLRDYFSNILLDAPSKPYYIK

SEQ ID NO: 2731108 - protein, 18 aa, Entamoeba histolytica
YLSYEIMFHVSTLLPEQP

SEQ ID NO: 2731109 - protein, 17 aa, Entamoeba histolytica
YLTFTYPTYDVPVLMDA

SEQ ID NO: 2731110 - protein, 25 aa, Entamoeba histolytica
YLTINEVYYNGLPLRFGYSIEDFCE

SEQ ID NO: 2731111 - protein, 18 aa, Entamoeba histolytica
YLVLYIQKPENGKAVKYF

SEQ ID NO: 2731112 - protein, 20 aa, Entamoeba histolytica
YLVSQRWPPIQNKDSLWICI

SEQ ID NO: 2731113 - protein, 35 aa, Entamoeba histolytica
YMDAISLITSWKHKPWICCFCKQVCYWEDVELNIR

SEQ ID NO: 2731114 - protein, 17 aa, Entamoeba histolytica
YMDANFFVICYSIDKPD

SEQ ID NO: 2731115 - protein, 29 aa, Entamoeba histolytica
YMDKLTFEDWYYIFHRVYFKILESIGYYH

SEQ ID NO: 2731116 - protein, 17 aa, Entamoeba histolytica
YMDSLTSITLSKQLMKL

SEQ ID NO: 2731117 - protein, 27 aa, Entamoeba histolytica
YMEEYATLNLFINRLMLNLKPKKEDVK

SEQ ID NO: 2731118 - protein, 17 aa, Entamoeba histolytica
YMFINQLNFFAGYSYND

SEQ ID NO: 2731119 - protein, 18 aa, Entamoeba histolytica
YMIALKNLCLLHCNLHFG

SEQ ID NO: 2731120 - protein, 19 aa, Entamoeba histolytica
YMIDILSKRIGFYLDMELV

SEQ ID NO: 2731121 - protein, 25 aa, Entamoeba histolytica
YMIQDYIIPDKLFSPTFDDFPSGNS

SEQ ID NO: 2731122 - protein, 40 aa, Entamoeba histolytica
YMIQYINWYNWLERDVYKYSLYFNILKEKTAKELFSIYFE

SEQ ID NO: 2731123 - protein, 20 aa, Entamoeba histolytica
YMKTLPPSAHLLFPNYICPA

SEQ ID NO: 2731124 - protein, 17 aa, Entamoeba histolytica
YMLQTRNGKMNATATVR

SEQ ID NO: 2731125 - protein, 26 aa, Entamoeba histolytica
YMQRVDLLSILLLYGADINIPNKQGE

SEQ ID NO: 2731126 - protein, 17 aa, Entamoeba histolytica
YMRSHFHFLNPAFEGLF

SEQ ID NO: 2731127 - protein, 20 aa, Entamoeba histolytica
YMVKSIYFGTAFCTVPLAIQ

SEQ ID NO: 2731128 - protein, 26 aa, Entamoeba histolytica
YMVNRLNVLLLQHIQKCLPGLKQQIN

SEQ ID NO: 2731129 - protein, 21 aa, Entamoeba histolytica
YMVSPECVIKMFASLKSIFPI

SEQ ID NO: 2731130 - protein, 18 aa, Entamoeba histolytica
YMYFFQIDESIDAEFSAT

SEQ ID NO: 2731131 - protein, 23 aa, Entamoeba histolytica
YNAAILKLFNQFLQKEFLEMLDN

SEQ ID NO: 2731132 - protein, 27 aa, Entamoeba histolytica
YNAYGHIIYLILIKLNKEITNEPFVLR

SEQ ID NO: 2731133 - protein, 25 aa, Entamoeba histolytica
YNCLPIQFCMMLYSLLSVKYAVIRG

SEQ ID NO: 2731134 - protein, 23 aa, Entamoeba histolytica
YNDEQYIIFVKKIEGIKKIKHGI

SEQ ID NO: 2731135 - protein, 21 aa, Entamoeba histolytica
YNDFRMVVWGFDQNIREIFKK

SEQ ID NO: 2731136 - protein, 23 aa, Entamoeba histolytica
YNDIAEISGVLSGSIWGMANNED

SEQ ID NO: 2731137 - protein, 20 aa, Entamoeba histolytica
YNDKLQILKSFDFDDVVFII

SEQ ID NO: 2731138 - protein, 28 aa, Entamoeba histolytica
YNDSIRFLFLLELAHWYYMDNWTKKLNY

SEQ ID NO: 2731139 - protein, 24 aa, Entamoeba histolytica
YNDWTFFFNESSLDSLFSCFKYTQ

SEQ ID NO: 2731140 - protein, 18 aa, Entamoeba histolytica
YNEITPSVRLSGPTNFAP

SEQ ID NO: 2731141 - protein, 29 aa, Entamoeba histolytica
YNENVYLAFSDVFMQLPYCHVIDSKVFVV

SEQ ID NO: 2731142 - protein, 24 aa, Entamoeba histolytica
YNEQSSLLMKFFDELQLTIDKATD

SEQ ID NO: 2731143 - protein, 21 aa, Entamoeba histolytica
YNEVICLLVQRIIEITQKRIN

SEQ ID NO: 2731144 - protein, 18 aa, Entamoeba histolytica
YNEWPLISMWISVSDLFE

SEQ ID NO: 2731145 - protein, 19 aa, Entamoeba histolytica
YNFEKYKDILLRISILIKT

SEQ ID NO: 2731146 - protein, 19 aa, Entamoeba histolytica
YNFIEESLRLKVKYALKLS

SEQ ID NO: 2731147 - protein, 20 aa, Entamoeba histolytica
YNFTFFVFHSAEKDIKEIEE

SEQ ID NO: 2731148 - protein, 18 aa, Entamoeba histolytica
YNFVRYWLDGDSPCLDDT

SEQ ID NO: 2731149 - protein, 25 aa, Entamoeba histolytica
YNGGYNWWKRNSLTVFIDKKLYKDP

SEQ ID NO: 2731150 - protein, 25 aa, Entamoeba histolytica
YNGGYNWWKRNSLTVFINKKLYKDP

SEQ ID NO: 2731151 - protein, 27 aa, Entamoeba histolytica
YNGITEPFIWYYYCVGFYGEKAFEKDH

SEQ ID NO: 2731152 - protein, 33 aa, Entamoeba histolytica
YNGTGIPGFPVNFLQYFQLFPSVFNTSMNRQPK

SEQ ID NO: 2731153 - protein, 17 aa, Entamoeba histolytica
YNGYRLTYLGYDYLALR

SEQ ID NO: 2731154 - protein, 19 aa, Entamoeba histolytica
YNHCIGSVYFTKFEKMSPS

SEQ ID NO: 2731155 - protein, 18 aa, Entamoeba histolytica
YNHLLSNLDLFSELLKCE

SEQ ID NO: 2731156 - protein, 17 aa, Entamoeba histolytica
YNHLYAEFLTKVKEKDI

SEQ ID NO: 2731157 - protein, 26 aa, Entamoeba histolytica
YNIKKYKMTVFIPMHFPRFSTMQGNR

SEQ ID NO: 2731158 - protein, 18 aa, Entamoeba histolytica
YNILLRTKAKEKKERELN

SEQ ID NO: 2731159 - protein, 28 aa, Entamoeba histolytica
YNKALKAIGLHKCYCACWGVMSEKSRAK

SEQ ID NO: 2731160 - protein, 35 aa, Entamoeba histolytica
YNKENHGFFLYDKQLFVDYILPKHFPNVKQESFIR

SEQ ID NO: 2731161 - protein, 24 aa, Entamoeba histolytica
YNKETILYKLLDLVNKKFDNKAVP

SEQ ID NO: 2731162 - protein, 17 aa, Entamoeba histolytica
YNKFIVSRVLQDFKREN

SEQ ID NO: 2731163 - protein, 34 aa, Entamoeba histolytica
YNKFKYQEVGLNRLYHLIANNLDLMIQVQHTRID

SEQ ID NO: 2731164 - protein, 36 aa, Entamoeba histolytica
YNKIETPRKRASVSRITLLDDPIKHQKTEFNGIKED

SEQ ID NO: 2731165 - protein, 21 aa, Entamoeba histolytica
YNKIKFLMKIKGKGDIKIIEI

SEQ ID NO: 2731166 - protein, 18 aa, Entamoeba histolytica
YNKKGIIPLFSALRNNHL

SEQ ID NO: 2731167 - protein, 23 aa, Entamoeba histolytica
YNKLFQVRWFYVSCSRVQSRGPE

SEQ ID NO: 2731168 - protein, 26 aa, Entamoeba histolytica
YNKQEINYYWNPIDTFIHLMINDAFE

SEQ ID NO: 2731169 - protein, 29 aa, Entamoeba histolytica
YNKTQGTMFLFNDIFIFTKPERNEYIFGS

SEQ ID NO: 2731170 - protein, 21 aa, Entamoeba histolytica
YNLFHQFNHVSPFDALTPDND

SEQ ID NO: 2731171 - protein, 18 aa, Entamoeba histolytica
YNLKLYYDDSIIDLWQFL

SEQ ID NO: 2731172 - protein, 30 aa, Entamoeba histolytica; identical to SEQ ID NO: 2544216

SEQ ID NO: 2731173 - protein, 18 aa, Entamoeba histolytica
YNLNRVPQRVFDYLFEHP

SEQ ID NO: 2731174 - protein, 17 aa, Entamoeba histolytica
YNLQRKKVQFIRIDGET

SEQ ID NO: 2731175 - protein, 18 aa, Entamoeba histolytica
YNLRLVQHSTISLGGPLV

SEQ ID NO: 2731176 - protein, 19 aa, Entamoeba histolytica
YNLTTQILKIIDQQKYGIF

SEQ ID NO: 2731177 - protein, 18 aa, Entamoeba histolytica
YNLVKRPSLGRYFTPEVS

SEQ ID NO: 2731178 - protein, 17 aa, Entamoeba histolytica
YNNYEKVKFTQNPTKYF

SEQ ID NO: 2731179 - protein, 23 aa, Entamoeba histolytica
YNPEHPYIPTSPKPKIPSALKIY

SEQ ID NO: 2731180 - protein, 24 aa, Entamoeba histolytica
YNPHFFVEHLYSPSPYRSTFLHLL

SEQ ID NO: 2731181 - protein, 21 aa, Entamoeba histolytica
YNPIQLSFPVSLRSLSFSCFN

SEQ ID NO: 2731182 - protein, 19 aa, Entamoeba histolytica
YNPISISNLRLFPKIQTQC

SEQ ID NO: 2731183 - protein, 27 aa, Entamoeba histolytica
YNPKEDGLFEVIIFCSDKSCSFIAVYN

SEQ ID NO: 2731184 - protein, 18 aa, Entamoeba histolytica
YNPVRLIYGKGSLDEIEK

SEQ ID NO: 2731185 - protein, 25 aa, Entamoeba histolytica
YNQKKVFLFEVAPLKLQGATPVSTS

SEQ ID NO: 2731186 - protein, 19 aa, Entamoeba histolytica
YNRIYYVIKNVNPGRFRIT

SEQ ID NO: 2731187 - protein, 32 aa, Entamoeba histolytica
YNRLTNTIQNIHNNIHLIAETTTTEQALKEGA

SEQ ID NO: 2731188 - protein, 30 aa, Entamoeba histolytica; identical to SEQ ID NO: 2544228

SEQ ID NO: 2731189 - protein, 19 aa, Entamoeba histolytica
YNRYPHFVWMLNFKGKKMT

SEQ ID NO: 2731190 - protein, 26 aa, Entamoeba histolytica
YNSDINQLYYAFPKLQRIDIEKTYQL

SEQ ID NO: 2731191 - protein, 31 aa, Entamoeba histolytica
YNSIHMMTLKNFAMILGPLVIHPLPGTNAVN

SEQ ID NO: 2731192 - protein, 22 aa, Entamoeba histolytica
YNSIKLLTYPFSTSTLTQPLNN

SEQ ID NO: 2731193 - protein, 21 aa, Entamoeba histolytica
YNSILTLRRLITECQSVVVFD

SEQ ID NO: 2731194 - protein, 24 aa, Entamoeba histolytica
YNSKDEEFVPLRDKIKEILQMEEG

SEQ ID NO: 2731195 - protein, 19 aa, Entamoeba histolytica
YNSLERLEDCCFLFCLGLE

SEQ ID NO: 2731196 - protein, 17 aa, Entamoeba histolytica
YNSLPIVKTQTLCYYNV

SEQ ID NO: 2731197 - protein, 29 aa, Entamoeba histolytica
YNSRGLYKCPILIPNADLLYEYTVAYFSK

SEQ ID NO: 2731198 - protein, 25 aa, Entamoeba histolytica
YNSYHIRILLKFFKSRGKLTHLITN

SEQ ID NO: 2731199 - protein, 25 aa, Entamoeba histolytica
YNTIHLFHHFFPCANVFVISSSEIK

SEQ ID NO: 2731200 - protein, 18 aa, Entamoeba histolytica
YNTKYYFCPISKIYRTPP

SEQ ID NO: 2731201 - protein, 21 aa, Entamoeba histolytica
YNTSLLFNFFIKLSFDEEYEN

SEQ ID NO: 2731202 - protein, 17 aa, Entamoeba histolytica
YNTTWEHYFMTYCLKSE

SEQ ID NO: 2731203 - protein, 34 aa, Entamoeba histolytica
YNVSLNEYLFFKLCDFITILKSLRKSILLKDNLN

SEQ ID NO: 2731204 - protein, 23 aa, Entamoeba histolytica
YNYSFPMNFICKVLLHINRNIKT

SEQ ID NO: 2731205 - protein, 19 aa, Entamoeba histolytica
YPAISRFLKYISGDCLYGI

SEQ ID NO: 2731206 - protein, 20 aa, Entamoeba histolytica
YPALTSLIYFVYRSNFSALP

SEQ ID NO: 2731207 - protein, 25 aa, Entamoeba histolytica
YPASTLQILGAEKALFRAIKTRGNT

SEQ ID NO: 2731208 - protein, 17 aa, Entamoeba histolytica
YPCISISFGLQVYSMNE

SEQ ID NO: 2731209 - protein, 21 aa, Entamoeba histolytica
YPCLSPITQALIKSECKGLGV

SEQ ID NO: 2731210 - protein, 26 aa, Entamoeba histolytica
YPDVSVPIIFLLMRDTVIALKGETTE

SEQ ID NO: 2731211 - protein, 20 aa, Entamoeba histolytica
YPEIKISYGLVKKVLEQQGL

SEQ ID NO: 2731212 - protein, 17 aa, Entamoeba histolytica
YPELIPVIKIREMQIFK

SEQ ID NO: 2731213 - protein, 24 aa, Entamoeba histolytica
YPENKLYFFIAASLLIQHKEIIMK

SEQ ID NO: 2731214 - protein, 17 aa, Entamoeba histolytica
YPHCILFDENELIVIDN

SEQ ID NO: 2731215 - protein, 18 aa, Entamoeba histolytica
YPHKKVFTELQKLRKIFF

SEQ ID NO: 2731216 - protein, 20 aa, Entamoeba histolytica
YPHLTWEIPSLTVSSDEIKQ

SEQ ID NO: 2731217 - protein, 21 aa, Entamoeba histolytica
YPHLYFQFKSVFESVTIYKPE

SEQ ID NO: 2731218 - protein, 33 aa, Entamoeba histolytica
YPIEIDSITVGNKLFYCSYLPSGQARLSKKFTE

SEQ ID NO: 2731219 - protein, 18 aa, Entamoeba histolytica
YPILIVRVSRIIDNSLWP

SEQ ID NO: 2731220 - protein, 19 aa, Entamoeba histolytica
YPIQVIFPKNGGGLVKLAQ

SEQ ID NO: 2731221 - protein, 25 aa, Entamoeba histolytica
YPKLHHVYRYKVDYSFYLKHREDNC

SEQ ID NO: 2731222 - protein, 31 aa, Entamoeba histolytica
YPKNTITYIIHRSFELFYYNIVDDIITSSCI

SEQ ID NO: 2731223 - protein, 24 aa, Entamoeba histolytica
YPLHPRLGKILYLSQQKGIEEIGL

SEQ ID NO: 2731224 - protein, 17 aa, Entamoeba histolytica
YPLLKIADYGFSRGIDG

SEQ ID NO: 2731225 - protein, 17 aa, Entamoeba histolytica
YPLLMSLERLYILRMTL

SEQ ID NO: 2731226 - protein, 19 aa, Entamoeba histolytica
YPLLNIYSCYFTYCYSIMK

SEQ ID NO: 2731227 - protein, 20 aa, Entamoeba histolytica
YPMVNYPMTVVDYNQYPLVK

SEQ ID NO: 2731228 - protein, 17 aa, Entamoeba histolytica
YPNIIIPQQIIGKTSIE

SEQ ID NO: 2731229 - protein, 24 aa, Entamoeba histolytica
YPNKKILPILPFQLRQQLITTLCL

SEQ ID NO: 2731230 - protein, 21 aa, Entamoeba histolytica
YPPPTFKPQFIMPGHYINGYL

SEQ ID NO: 2731231 - protein, 17 aa, Entamoeba histolytica
YPPYMDDPPLRALFQIS

SEQ ID NO: 2731232 - protein, 23 aa, Entamoeba histolytica
YPSEAVVPIILRSFDKTTFISEL

SEQ ID NO: 2731233 - protein, 21 aa, Entamoeba histolytica
YPSIFDSLIPNKKRVSSLPKA

SEQ ID NO: 2731234 - protein, 21 aa, Entamoeba histolytica
YPSPNIQCPFLLNSSKINQTL

SEQ ID NO: 2731235 - protein, 23 aa, Entamoeba histolytica
YPYEYFHQILTLFLNTRPLSNTF

SEQ ID NO: 2731236 - protein, 23 aa, Entamoeba histolytica
YQADLQAILIALLTQFSTVSVGR

SEQ ID NO: 2731237 - protein, 22 aa, Entamoeba histolytica
YQALTPIYYRDSQGAILVYDIT

SEQ ID NO: 2731238 - protein, 28 aa, Entamoeba histolytica
YQCDCVCFYFVPRIIKMMKPKVLEYLRA

SEQ ID NO: 2731239 - protein, 21 aa, Entamoeba histolytica
YQDGSIRIWSPKTQESIKMSI

SEQ ID NO: 2731240 - protein, 17 aa, Entamoeba histolytica
YQDIKTTYFEKINIEMP

SEQ ID NO: 2731241 - protein, 35 aa, Entamoeba histolytica
YQEANPFIVIILLKYFFLSLPQSFFCDKLIIELLS

SEQ ID NO: 2731242 - protein, 29 aa, Entamoeba histolytica
YQEARNIIFDYFRGKLFYVYHNNIYLNEP

SEQ ID NO: 2731243 - protein, 26 aa, Entamoeba histolytica
YQELNKYLRSLQQTYLMAMQQPTQYH

SEQ ID NO: 2731244 - protein, 19 aa, Entamoeba histolytica
YQFCWLCMQEYTSSHFKNG

SEQ ID NO: 2731245 - protein, 19 aa, Entamoeba histolytica
YQFGIISRINEIERKMREV

SEQ ID NO: 2731246 - protein, 23 aa, Entamoeba histolytica
YQGGKWSFLFECPRDYPNNPPKV

SEQ ID NO: 2731247 - protein, 26 aa, Entamoeba histolytica
YQIGEYIIIVMEYLPGGSLQSILKRC

SEQ ID NO: 2731248 - protein, 35 aa, Entamoeba histolytica
YQIKNIYLMSTTTKLYDLFKLWSNSDPDKLGGTVI

SEQ ID NO: 2731249 - protein, 32 aa, Entamoeba histolytica; identical to SEQ ID NO: 2544308

SEQ ID NO: 2731250 - protein, 24 aa, Entamoeba histolytica
YQKAGFLKWAPRTLDLFQYARRNM

SEQ ID NO: 2731251 - protein, 19 aa, Entamoeba histolytica
YQKEFVIIYINKMNQIPYG

SEQ ID NO: 2731252 - protein, 18 aa, Entamoeba histolytica
YQKLEAMLYKIMSSYEKS

SEQ ID NO: 2731253 - protein, 17 aa, Entamoeba histolytica
YQKLSVFSQEYPGIPIL

SEQ ID NO: 2731254 - protein, 34 aa, Entamoeba histolytica
YQKPYPIVGPMLVPPPIYYPPQPFFPQQNPKYYK

SEQ ID NO: 2731255 - protein, 31 aa, Entamoeba histolytica
YQLAFITTRSLHLFYPVPISKVIHPSSNSIE

SEQ ID NO: 2731256 - protein, 21 aa, Entamoeba histolytica
YQLFDEKIITPTIFQKSIDFY

SEQ ID NO: 2731257 - protein, 21 aa, Entamoeba histolytica
YQLKFVGAIPIEPKICLAGET

SEQ ID NO: 2731258 - protein, 17 aa, Entamoeba histolytica
YQLNKSAVYYEMKQWRF

SEQ ID NO: 2731259 - protein, 23 aa, Entamoeba histolytica
YQLSHRDIIMPSLPKEFSNAIDE

SEQ ID NO: 2731260 - protein, 20 aa, Entamoeba histolytica
YQLYLGWYDGNPAHLNELPP

SEQ ID NO: 2731261 - protein, 22 aa, Entamoeba histolytica
YQMEYWYYYLKACQKGRRKYYT

SEQ ID NO: 2731262 - protein, 26 aa, Entamoeba histolytica
YQMKSVFLNGLTLFLIQVIKHKYTHN

SEQ ID NO: 2731263 - protein, 25 aa, Entamoeba histolytica
YQNEWCFINLFNNQISYVDPRPPQQ

SEQ ID NO: 2731264 - protein, 23 aa, Entamoeba histolytica
YQNLDSFSYFIYLREFVNCQNFI

SEQ ID NO: 2731265 - protein, 23 aa, Entamoeba histolytica
YQNSMIVNQSIEWYISGDYPMYV

SEQ ID NO: 2731266 - protein, 19 aa, Entamoeba histolytica
YQNVSYFCKLYLLKKEYLS

SEQ ID NO: 2731267 - protein, 25 aa, Entamoeba histolytica
YQPIQTHPLFKLLAQILHIVSVSAL

SEQ ID NO: 2731268 - protein, 33 aa, Entamoeba histolytica
YQQDHPPFKEIPYYLLHPFHSLLIREYPSSNCS

SEQ ID NO: 2731269 - protein, 19 aa, Entamoeba histolytica
YQQIIQYTYHYQECREIMD

SEQ ID NO: 2731270 - protein, 31 aa, Entamoeba histolytica; identical to SEQ ID NO: 2544326

SEQ ID NO: 2731271 - protein, 21 aa, Entamoeba histolytica
YQQYTLPYISTIPSSTLQWIN

SEQ ID NO: 2731272 - protein, 19 aa, Entamoeba histolytica
YQRGLLLGQTYAGFIYSAM

SEQ ID NO: 2731273 - protein, 21 aa, Entamoeba histolytica
YQSCYCSCWNPLSSQLISGYG

SEQ ID NO: 2731274 - protein, 26 aa, Entamoeba histolytica
YQSDDYYLMPINMDYLQILTLNECGN

SEQ ID NO: 2731275 - protein, 18 aa, Entamoeba histolytica
YQSQYLKFGFHGLSYEYV

SEQ ID NO: 2731276 - protein, 18 aa, Entamoeba histolytica
YQTLRKLVTGFEKVGAVA

SEQ ID NO: 2731277 - protein, 24 aa, Entamoeba histolytica
YQTTPLTYSYLLSQQYIPPNEGEL

SEQ ID NO: 2731278 - protein, 18 aa, Entamoeba histolytica
YQVAQQSIFLALLNDYFE

SEQ ID NO: 2731279 - protein, 17 aa, Entamoeba histolytica
YQVRSHAQKFFKKKGMT

SEQ ID NO: 2731280 - protein, 18 aa, Entamoeba histolytica
YQVSQQAVLLALINRHFS

SEQ ID NO: 2731281 - protein, 26 aa, Entamoeba histolytica
YQVYQESILIKLLLPYCDIVFGKPSK

SEQ ID NO: 2731282 - protein, 18 aa, Entamoeba histolytica
YQYCQLVMHEKTYGLDIF

SEQ ID NO: 2731283 - protein, 23 aa, Entamoeba histolytica
YQYMSCVPGLLRNKILLVPNNNK

SEQ ID NO: 2731284 - protein, 22 aa, Entamoeba histolytica
YQYPPRAPQLYQQRPPQQSSTE

SEQ ID NO: 2731285 - protein, 19 aa, Entamoeba histolytica
YRALRSICWSSIQSPRPSL

SEQ ID NO: 2731286 - protein, 23 aa, Entamoeba histolytica
YRCHNYFASYIIFSTLQKVLDEI

SEQ ID NO: 2731287 - protein, 17 aa, Entamoeba histolytica
YRCYSGILNITGTEIFN

SEQ ID NO: 2731288 - protein, 18 aa, Entamoeba histolytica
YRDELYLLGEKKGSWDEA

SEQ ID NO: 2731289 - protein, 31 aa, Entamoeba histolytica
YRDLQTGIWEPCYLMLIGSILYIYKNTVDIF

SEQ ID NO: 2731290 - protein, 18 aa, Entamoeba histolytica
YREDGIVKLLFRTVTNGA

SEQ ID NO: 2731291 - protein, 18 aa, Entamoeba histolytica
YREIPTYALWNAFVSSGF

SEQ ID NO: 2731292 - protein, 25 aa, Entamoeba histolytica
YRETQGALIVYDITNRESFDYLQDW

SEQ ID NO: 2731293 - protein, 26 aa, Entamoeba histolytica
YREVTPEIFPYLLVNVGSGVSILKVT

SEQ ID NO: 2731294 - protein, 20 aa, Entamoeba histolytica
YRFYHYPDSWRLRIGQFITF

SEQ ID NO: 2731295 - protein, 18 aa, Entamoeba histolytica
YRIQCQCGCYINSWCSRD

SEQ ID NO: 2731296 - protein, 18 aa, Entamoeba histolytica
YRISKVIGYGAFGIVFLA

SEQ ID NO: 2731297 - protein, 19 aa, Entamoeba histolytica
YRISQLIKEYGLIPLVELV

SEQ ID NO: 2731298 - protein, 29 aa, Entamoeba histolytica
YRKIIGEKNIMFYFETLQGDIFGSYNELA

SEQ ID NO: 2731299 - protein, 26 aa, Entamoeba histolytica
YRLADPKMVLLIFASGKIVFTGGKEI

SEQ ID NO: 2731300 - protein, 19 aa, Entamoeba histolytica
YRLQATLQIVPLKIKEDSE

SEQ ID NO: 2731301 - protein, 21 aa, Entamoeba histolytica
YRMGNLFIVGPTKTGKTEFAI

SEQ ID NO: 2731302 - protein, 18 aa, Entamoeba histolytica
YRMYTCYAIPKRVHDIRA

SEQ ID NO: 2731303 - protein, 27 aa, Entamoeba histolytica
YRNDKLKYILEYIFKEIKIKDIQCKYL

SEQ ID NO: 2731304 - protein, 17 aa, Entamoeba histolytica
YRNPFPDVMNFLDTFHG

SEQ ID NO: 2731305 - protein, 18 aa, Entamoeba histolytica
YRPPEVMVGYPFDGSFDN

SEQ ID NO: 2731306 - protein, 24 aa, Entamoeba histolytica
YRPQAFFKGLIFPLCQEKDVTLKE

SEQ ID NO: 2731307 - protein, 17 aa, Entamoeba histolytica
YRQKDILPHTIHITPYP

SEQ ID NO: 2731308 - protein, 17 aa, Entamoeba histolytica
YRQTIIYSRYQTPLLNS

SEQ ID NO: 2731309 - protein, 24 aa, Entamoeba histolytica
YRRRLPIGYTRLFSYELARALGYI

SEQ ID NO: 2731310 - protein, 20 aa, Entamoeba histolytica
YRSALLKSISVAVPIPFKPG

SEQ ID NO: 2731311 - protein, 24 aa, Entamoeba histolytica
YRSIKLIMAPLKKGKGIFDQVINK

SEQ ID NO: 2731312 - protein, 19 aa, Entamoeba histolytica
YRSPFSNKYFPAFPEGGLP

SEQ ID NO: 2731313 - protein, 17 aa, Entamoeba histolytica
YRSTLKMIIYLESLIDI

SEQ ID NO: 2731314 - protein, 30 aa, Entamoeba histolytica; identical to SEQ ID NO: 2544366

SEQ ID NO: 2731315 - protein, 26 aa, Entamoeba histolytica
YRVSEQLHILMNLLRDVGFEIESKKT

SEQ ID NO: 2731316 - protein, 18 aa, Entamoeba histolytica
YSAVYKNITGEKVKFAFP

SEQ ID NO: 2731317 - protein, 19 aa, Entamoeba histolytica
YSAVYKNITGEKVKFAFPV

SEQ ID NO: 2731318 - protein, 23 aa, Entamoeba histolytica
YSCSGFGMTETCGIVYKMPAKST

SEQ ID NO: 2731319 - protein, 18 aa, Entamoeba histolytica
YSCYFGNFLFNCVEPINP

SEQ ID NO: 2731320 - protein, 17 aa, Entamoeba histolytica
YSDLLRKNVISKEALEA

SEQ ID NO: 2731321 - protein, 25 aa, Entamoeba histolytica
YSDNIKWFFIDFDPAKSNIKPINLN

SEQ ID NO: 2731322 - protein, 20 aa, Entamoeba histolytica
YSDQGLIPPKILIGGTDVLN

SEQ ID NO: 2731323 - protein, 23 aa, Entamoeba histolytica
YSEFEVFYLFQGILELVKEFYGE

SEQ ID NO: 2731324 - protein, 28 aa, Entamoeba histolytica
YSEFKRLTLLLTKLPRKRLRDVSARLEY

SEQ ID NO: 2731325 - protein, 18 aa, Entamoeba histolytica
YSEIITLTFYINTTRYRN

SEQ ID NO: 2731326 - protein, 18 aa, Entamoeba histolytica
YSETLWIDTFDQFEIKFK

SEQ ID NO: 2731327 - protein, 34 aa, Entamoeba histolytica
YSFAVTMLHILMWNAPYQGSLFKYPWSIANFVAD

SEQ ID NO: 2731328 - protein, 18 aa, Entamoeba histolytica
YSFIIPQELLCKYFYSIQ

SEQ ID NO: 2731329 - protein, 17 aa, Entamoeba histolytica
YSFLRNEPKTPRLTPRK

SEQ ID NO: 2731330 - protein, 17 aa, Entamoeba histolytica
YSFLTNQLLNSLALHIF

SEQ ID NO: 2731331 - protein, 24 aa, Entamoeba histolytica
YSFNIDCILPIYNILFGKFEEQEQ

SEQ ID NO: 2731332 - protein, 26 aa, Entamoeba histolytica
YSFQTPDKLYFILDYVNGGELFAHLQ

SEQ ID NO: 2731333 - protein, 26 aa, Entamoeba histolytica
YSFSITMLQIITWQDPFPKSEFKFPW

SEQ ID NO: 2731334 - protein, 25 aa, Entamoeba histolytica
YSFSITMLQIITWQDPFPKSEYPHP

SEQ ID NO: 2731335 - protein, 37 aa, Entamoeba histolytica
YSFSITMLQIITWQDPFPKTLYPHPWDIADTITIGKR

SEQ ID NO: 2731336 - protein, 36 aa, Entamoeba histolytica
YSFSVTMLQTITWQDPFPKTLYPHPWDIADTITTGK

SEQ ID NO: 2731337 - protein, 31 aa, Entamoeba histolytica; identical to SEQ ID NO: 2544390

SEQ ID NO: 2731338 - protein, 21 aa, Entamoeba histolytica
YSHINPSLFILLNNDLVQSII

SEQ ID NO: 2731339 - protein, 25 aa, Entamoeba histolytica
YSHQYSVKKILLKSTYLLTLDVFNQ

SEQ ID NO: 2731340 - protein, 29 aa, Entamoeba histolytica
YSIENLKSLLFPFEWCNICIDSLPYSLID

SEQ ID NO: 2731341 - protein, 24 aa, Entamoeba histolytica
YSIHFRFLMYYSEENCVLLRNNHM

SEQ ID NO: 2731342 - protein, 32 aa, Entamoeba histolytica
YSIKDFSKYVINLSYLCIMACCGNDTIGCFIR

SEQ ID NO: 2731343 - protein, 18 aa, Entamoeba histolytica
YSIPLVLQITPFAEKEVP

SEQ ID NO: 2731344 - protein, 24 aa, Entamoeba histolytica
YSIRSVYNFAPFIKHYFIVTMGQT

SEQ ID NO: 2731345 - protein, 28 aa, Entamoeba histolytica
YSIVAKFILITYGDLKKYDFHFIGGCPV

SEQ ID NO: 2731346 - protein, 18 aa, Entamoeba histolytica
YSKDKTLRVIEYPDPSIL

SEQ ID NO: 2731347 - protein, 24 aa, Entamoeba histolytica
YSKNLIDYHIVLDLLPCIAQAVSN

SEQ ID NO: 2731348 - protein, 19 aa, Entamoeba histolytica
YSKYRIATKKEFGLLPTST

SEQ ID NO: 2731349 - protein, 31 aa, Entamoeba histolytica
YSLEKKVLGWLRIIFYPRNYHRTKYYDNLLY

SEQ ID NO: 2731350 - protein, 37 aa, Entamoeba histolytica
YSLFKERIKLMKTLFPIIKFDSISFFFRTWEVEENGT

SEQ ID NO: 2731351 - protein, 21 aa, Entamoeba histolytica
YSLKEIIFPPQVIKLKDNVCM

SEQ ID NO: 2731352 - protein, 21 aa, Entamoeba histolytica
YSLLICCNYFHSVRDIVHLVM

SEQ ID NO: 2731353 - protein, 17 aa, Entamoeba histolytica
YSLLIHCRNGWDSTCQL

SEQ ID NO: 2731354 - protein, 23 aa, Entamoeba histolytica
YSLRRLMKYPPVEDIKLLIELAV

SEQ ID NO: 2731355 - protein, 30 aa, Entamoeba histolytica
YSLSKMGLIKSFWYYFLNKNEFTEKNISTI

SEQ ID NO: 2731356 - protein, 20 aa, Entamoeba histolytica
YSMLIVMKYLEYESDFINVI

SEQ ID NO: 2731357 - protein, 19 aa, Entamoeba histolytica
YSMMIISKYFATIDEFKNI

SEQ ID NO: 2731358 - protein, 22 aa, Entamoeba histolytica
YSNEGQRLVQVKAMGGIVEDQE

SEQ ID NO: 2731359 - protein, 26 aa, Entamoeba histolytica
YSNEIFIGLALLRFGIHLEDVINYLK

SEQ ID NO: 2731360 - protein, 35 aa, Entamoeba histolytica
YSNHLIPIYPLINNIIWYIDIFINVKLTIKTVFVV

SEQ ID NO: 2731361 - protein, 25 aa, Entamoeba histolytica
YSNLYEDMLPSLKYLLPLLKINENQ

SEQ ID NO: 2731362 - protein, 30 aa, Entamoeba histolytica
YSNYLSIGLERWFYCYQPYDIVISDNDDYV

SEQ ID NO: 2731363 - protein, 18 aa, Entamoeba histolytica
YSPELIVHPFFKEDYDTN

SEQ ID NO: 2731364 - protein, 19 aa, Entamoeba histolytica
YSPFEKREFAYRSDDRRGD

SEQ ID NO: 2731365 - protein, 26 aa, Entamoeba histolytica
YSPFTDMILLLCKKLIEEYPVFIGMK

SEQ ID NO: 2731366 - protein, 19 aa, Entamoeba histolytica
YSPFTICDIVIQPSIQLGD

SEQ ID NO: 2731367 - protein, 26 aa, Entamoeba histolytica
YSPHQIEVLMIPLNHYKMFSSNFFSN

SEQ ID NO: 2731368 - protein, 17 aa, Entamoeba histolytica
YSPINDVFYFNNCLITT

SEQ ID NO: 2731369 - protein, 25 aa, Entamoeba histolytica
YSPLSFTPIIGIKPFSFSISLPEND

SEQ ID NO: 2731370 - protein, 24 aa, Entamoeba histolytica
YSPSEISSFILKKLKKDAEAKLGK

SEQ ID NO: 2731371 - protein, 26 aa, Entamoeba histolytica
YSPVKSLFIHHFMLDLISICEKKTDR

SEQ ID NO: 2731372 - protein, 18 aa, Entamoeba histolytica
YSQIYKWIPEHYSIDDSS

SEQ ID NO: 2731373 - protein, 18 aa, Entamoeba histolytica
YSQIYKWIPEHYSLDDAS

SEQ ID NO: 2731374 - protein, 31 aa, Entamoeba histolytica
YSSAATFFRISNLFWMTYRSGYEKLPNSSLT

SEQ ID NO: 2731375 - protein, 24 aa, Entamoeba histolytica
YSSCFPNILFSLLSGLQCIVYSSE

SEQ ID NO: 2731376 - protein, 23 aa, Entamoeba histolytica
YSSKFIKILATKIFQDKKLCDLK

SEQ ID NO: 2731377 - protein, 18 aa, Entamoeba histolytica
YSSMPIEKFISNSGLPEV

SEQ ID NO: 2731378 - protein, 25 aa, Entamoeba histolytica
YSSQYFDRIYDCAIELIKRGKAYVC

SEQ ID NO: 2731379 - protein, 29 aa, Entamoeba histolytica
YSSSLLYVYLHQYLWINTPIIYQLEQKFQ

SEQ ID NO: 2731380 - protein, 27 aa, Entamoeba histolytica
YSSTENFPMFFTSALTRLTNFHCTMND

SEQ ID NO: 2731381 - protein, 27 aa, Entamoeba histolytica
YSSTYNSYLLFINYYTKKGTLRQLFIE

SEQ ID NO: 2731382 - protein, 17 aa, Entamoeba histolytica
YSTKQIDSYSGWNKFCN

SEQ ID NO: 2731383 - protein, 24 aa, Entamoeba histolytica
YSTNPTLQKLLIQTSIKAAPNRVM

SEQ ID NO: 2731384 - protein, 42 aa, Entamoeba histolytica
YSTSHKALFVILYGHALYLLLHLNVFPFKLLQGIASNNNSVT

SEQ ID NO: 2731385 - protein, 31 aa, Entamoeba histolytica
YSTSNLYQLIPFIPVDYFSSSLRSLIDHCNE

SEQ ID NO: 2731386 - protein, 22 aa, Entamoeba histolytica
YSTTMMLFMKYPDIKDIHDVIN

SEQ ID NO: 2731387 - protein, 24 aa, Entamoeba histolytica
YSTWKYFMWAKWDRKEHKIFYWQE

SEQ ID NO: 2731388 - protein, 27 aa, Entamoeba histolytica
YSYDSQLSFFLYFPNKKQLPSNPMNQW

SEQ ID NO: 2731389 - protein, 40 aa, Entamoeba histolytica
YSYNKPIIFSFLIRSTYSYTFELWFIFKNEDNSLRMSFVS

SEQ ID NO: 2731390 - protein, 24 aa, Entamoeba histolytica
YSYQKWEKLLYSNFHKYFYIPKEM

SEQ ID NO: 2731391 - protein, 17 aa, Entamoeba histolytica
YSYTHKLFPNIQISFEQ

SEQ ID NO: 2731392 - protein, 22 aa, Entamoeba histolytica
YTAHDTTIYGLLALLGEETTQP

SEQ ID NO: 2731393 - protein, 25 aa, Entamoeba histolytica
YTANNIIKLVTYNGTIYYISEINDS

SEQ ID NO: 2731394 - protein, 18 aa, Entamoeba histolytica
YTCDMHVLVILTDMSSYA

SEQ ID NO: 2731395 - protein, 20 aa, Entamoeba histolytica
YTCKKLTWTSGHIWKGTITL

SEQ ID NO: 2731396 - protein, 26 aa, Entamoeba histolytica
YTCSSLALFLLKRALKNRGDMGQLFY

SEQ ID NO: 2731397 - protein, 55 aa, Entamoeba histolytica
YTDIKRMDEAIWNEIYLHELDKCGFIGLYYNQLHQWTGLTAPRVIYSCSNFRRIE

SEQ ID NO: 2731398 - protein, 29 aa, Entamoeba histolytica
YTDKDAIIRLRFVPNFFGSGNFVSILSIK

SEQ ID NO: 2731399 - protein, 25 aa, Entamoeba histolytica
YTDNYIISLHYLSVPIIISYGKRIP

SEQ ID NO: 2731400 - protein, 26 aa, Entamoeba histolytica
YTEAVSVILKRLPFPNICGRVCPHYC

SEQ ID NO: 2731401 - protein, 26 aa, Entamoeba histolytica
YTEFKRLALLLTNLPTKRLRDISLRL

SEQ ID NO: 2731402 - protein, 27 aa, Entamoeba histolytica
YTEQYLFDENIFYSFLLELYQHIEICT

SEQ ID NO: 2731403 - protein, 28 aa, Entamoeba histolytica
YTFLNNPIIITKWYPFLHSLEKRGDEYI

SEQ ID NO: 2731404 - protein, 19 aa, Entamoeba histolytica
YTFVLVGPISSGKSSLLNC

SEQ ID NO: 2731405 - protein, 18 aa, Entamoeba histolytica
YTFYFKDCQIITLSAYEP

SEQ ID NO: 2731406 - protein, 17 aa, Entamoeba histolytica
YTFYKYCELLISSFIER

SEQ ID NO: 2731407 - protein, 27 aa, Entamoeba histolytica
YTGFMHPYSYGLFYPKQFENAKVIEQE

SEQ ID NO: 2731408 - protein, 28 aa, Entamoeba histolytica
YTHLPQNTLAIIWTLSVPPKKPMEIPQF

SEQ ID NO: 2731409 - protein, 28 aa, Entamoeba histolytica
YTHQKIITKLLRKALLDHQIVLSTSTNE

SEQ ID NO: 2731410 - protein, 24 aa, Entamoeba histolytica
YTIDGVIVDFIFTPGAEAPTEMMM

SEQ ID NO: 2731411 - protein, 19 aa, Entamoeba histolytica
YTIHCLLNNRDIKGSPWVQ

SEQ ID NO: 2731412 - protein, 19 aa, Entamoeba histolytica
YTILEECNCSVNSALKECQ

SEQ ID NO: 2731413 - protein, 26 aa, Entamoeba histolytica
YTILQTPIFYYEVTILPTPSTHEVEE

SEQ ID NO: 2731414 - protein, 27 aa, Entamoeba histolytica
YTISKGCMKLLHLLWNDQEEGYYDMLF

SEQ ID NO: 2731415 - protein, 24 aa, Entamoeba histolytica
YTKDRIFFKIAKDWDLLYVVGEGK

SEQ ID NO: 2731416 - protein, 17 aa, Entamoeba histolytica
YTKLFEIIKKDLQKLME

SEQ ID NO: 2731417 - protein, 25 aa, Entamoeba histolytica
YTKSTELILIIQPLKRINGTVLPDI

SEQ ID NO: 2731418 - protein, 18 aa, Entamoeba histolytica
YTLAVGRNPFEFNGHFEQ

SEQ ID NO: 2731419 - protein, 32 aa, Entamoeba histolytica
YTLIGFPNQIGLLTWKIGYKNNLFTFQLIKSS

SEQ ID NO: 2731420 - protein, 17 aa, Entamoeba histolytica
YTLRILPHQQNTGGFFT

SEQ ID NO: 2731421 - protein, 20 aa, Entamoeba histolytica
YTMLSLFSIGSRRGKSATLV

SEQ ID NO: 2731422 - protein, 26 aa, Entamoeba histolytica
YTNIGPVLIVINPFKDLGLTTDEYVH

SEQ ID NO: 2731423 - protein, 25 aa, Entamoeba histolytica
YTNSLPPQQLDLLFSTPTSARHISQ

SEQ ID NO: 2731424 - protein, 22 aa, Entamoeba histolytica
YTNTYSIMFHVAPLLPNQEGDA

SEQ ID NO: 2731425 - protein, 46 aa, Entamoeba histolytica
YTNVWNCPICLMKSYYYDLFIDSRLKYYLSFVPESIKKVLFIGNEI

SEQ ID NO: 2731426 - protein, 20 aa, Entamoeba histolytica
YTPSPKFFTFSPSSLTSNSN

SEQ ID NO: 2731427 - protein, 25 aa, Entamoeba histolytica
YTQECLAWKYIYATGAFELRRKQNK

SEQ ID NO: 2731428 - protein, 23 aa, Entamoeba histolytica
YTQECLVWKYSYATAALELREHQ

SEQ ID NO: 2731429 - protein, 17 aa, Entamoeba histolytica
YTQKLSLYNPIDIQLKE

SEQ ID NO: 2731430 - protein, 20 aa, Entamoeba histolytica
YTQNIGMPVIVYPLRYDNGC

SEQ ID NO: 2731431 - protein, 26 aa, Entamoeba histolytica
YTQSAPFLTYFLRNGGVIFTSYIKNS

SEQ ID NO: 2731432 - protein, 30 aa, Entamoeba histolytica
YTRKDAMAVFHFLFRYDTGSHPPFIVSWGK

SEQ ID NO: 2731433 - protein, 17 aa, Entamoeba histolytica
YTRNDLFMTINFVNTKL

SEQ ID NO: 2731434 - protein, 30 aa, Entamoeba histolytica
YTSDGYADILWIFQWHFVELQSTGFIKLTD

SEQ ID NO: 2731435 - protein, 18 aa, Entamoeba histolytica
YTSELCLALIHLHSLGIV

SEQ ID NO: 2731436 - protein, 21 aa, Entamoeba histolytica
YTTSLFDLLFNNTNYKSFCNY

SEQ ID NO: 2731437 - protein, 23 aa, Entamoeba histolytica
YTYMTFKAIQLFRKISDEEPLYT

SEQ ID NO: 2731438 - protein, 19 aa, Entamoeba histolytica
YVALEYLQYLLEFVGTSIQ

SEQ ID NO: 2731439 - protein, 31 aa, Entamoeba histolytica; identical to SEQ ID NO: 2544506

SEQ ID NO: 2731440 - protein, 24 aa, Entamoeba histolytica
YVCAGILRTIIGKGEFPIPVMYVI

SEQ ID NO: 2731441 - protein, 26 aa, Entamoeba histolytica
YVCTKKKHIFIPKYTISLLKAGITSN

SEQ ID NO: 2731442 - protein, 18 aa, Entamoeba histolytica
YVCYVNPTLPTYRFESIV

SEQ ID NO: 2731443 - protein, 24 aa, Entamoeba histolytica
YVDKNIFDILQLNSIELIRHFNID

SEQ ID NO: 2731444 - protein, 25 aa, Entamoeba histolytica
YVDNMFDKHRYFLGFYRCSDDPIQV

SEQ ID NO: 2731445 - protein, 30 aa, Entamoeba histolytica
YVDYALRTPYLFMPLVKLVDAMIFKPLCRS

SEQ ID NO: 2731446 - protein, 23 aa, Entamoeba histolytica
YVEDILPPFFKALVKYVHKGKYS

SEQ ID NO: 2731447 - protein, 18 aa, Entamoeba histolytica
YVERLNWMYEAPIGFEEQ

SEQ ID NO: 2731448 - protein, 18 aa, Entamoeba histolytica
YVETSDVLIRIIDTLSSY

SEQ ID NO: 2731449 - protein, 19 aa, Entamoeba histolytica
YVEYYLFCCEKHLSGTRVV

SEQ ID NO: 2731450 - protein, 17 aa, Entamoeba histolytica
YVFLYSKINSSLLRSFC

SEQ ID NO: 2731451 - protein, 34 aa, Entamoeba histolytica
YVFSIVNDPFIPHPYYIKPFNKTMMIKEDRIAIF

SEQ ID NO: 2731452 - protein, 17 aa, Entamoeba histolytica
YVFTQHINTLFLDTTYC

SEQ ID NO: 2731453 - protein, 18 aa, Entamoeba histolytica
YVGAKQPIFRDLQFGIYL

SEQ ID NO: 2731454 - protein, 19 aa, Entamoeba histolytica
YVGDFACRYPNLLEGWIKY

SEQ ID NO: 2731455 - protein, 17 aa, Entamoeba histolytica
YVGKILKEQKREFQIKS

SEQ ID NO: 2731456 - protein, 19 aa, Entamoeba histolytica
YVHFVIVQTLHRMKFINSD

SEQ ID NO: 2731457 - protein, 19 aa, Entamoeba histolytica
YVHLEARDAYRRFIQNYNT

SEQ ID NO: 2731458 - protein, 34 aa, Entamoeba histolytica
YVHNPYCPNTRLERWWFIITDVRNQFVLNATHGY

SEQ ID NO: 2731459 - protein, 17 aa, Entamoeba histolytica
YVIFAIKIKENRLFQDI

SEQ ID NO: 2731460 - protein, 17 aa, Entamoeba histolytica
YVIFNLIIQYHCPELIK

SEQ ID NO: 2731461 - protein, 19 aa, Entamoeba histolytica
YVIGCDCCFYIRSNCPCHV

SEQ ID NO: 2731462 - protein, 18 aa, Entamoeba histolytica
YVIIPTNLNRISSINPEP

SEQ ID NO: 2731463 - protein, 25 aa, Entamoeba histolytica
YVIKNSLPVVILNLHKFIPSKQFYN

SEQ ID NO: 2731464 - protein, 25 aa, Entamoeba histolytica
YVIPSPYRRTTWQGLPLAQLPKRIE

SEQ ID NO: 2731465 - protein, 28 aa, Entamoeba histolytica
YVIQKLFEFGVFWQKSQLIKRLTGSFVE

SEQ ID NO: 2731466 - protein, 30 aa, Entamoeba histolytica; identical to SEQ ID NO: 2544530

SEQ ID NO: 2731467 - protein, 19 aa, Entamoeba histolytica
YVKIILNPFYELQTPIESE

SEQ ID NO: 2731468 - protein, 22 aa, Entamoeba histolytica
YVKKFGLPMILVGGGGYTVSNT

SEQ ID NO: 2731469 - protein, 17 aa, Entamoeba histolytica
YVKLGDGFIIVYSIIEQ

SEQ ID NO: 2731470 - protein, 23 aa, Entamoeba histolytica
YVKLYSFNLSQIIQAALMNVSIW

SEQ ID NO: 2731471 - protein, 17 aa, Entamoeba histolytica
YVKSPMLNPMLGRMINK

SEQ ID NO: 2731472 - protein, 23 aa, Entamoeba histolytica
YVLKCCGGFFASPYNTLEYWMIC

SEQ ID NO: 2731473 - protein, 18 aa, Entamoeba histolytica
YVLLLKQQPEHCLSIIRQ

SEQ ID NO: 2731474 - protein, 21 aa, Entamoeba histolytica
YVLPVLITKSVFYFDSCCWGW

SEQ ID NO: 2731475 - protein, 19 aa, Entamoeba histolytica
YVMDDIFSILIQMYKDYYP

SEQ ID NO: 2731476 - protein, 25 aa, Entamoeba histolytica
YVMGKRELFLILRALSQEIPEVGYT

SEQ ID NO: 2731477 - protein, 20 aa, Entamoeba histolytica
YVMSAFFHPKANIPLVVSAS

SEQ ID NO: 2731478 - protein, 17 aa, Entamoeba histolytica
YVMYYYQNEWCFINLFN

SEQ ID NO: 2731479 - protein, 27 aa, Entamoeba histolytica
YVNDPMINYTFLSHGFYPKGGINPFCY

SEQ ID NO: 2731480 - protein, 26 aa, Entamoeba histolytica
YVNKLQQFLDLYLKTALTIYPTDKIL

SEQ ID NO: 2731481 - protein, 19 aa, Entamoeba histolytica
YVPDTFFDMIFDESVMAGG

SEQ ID NO: 2731482 - protein, 28 aa, Entamoeba histolytica
YVPVPGIDTVFITLLNQGIKGNPYQCKV

SEQ ID NO: 2731483 - protein, 17 aa, Entamoeba histolytica
YVRKAAALAIPKIYNLD

SEQ ID NO: 2731484 - protein, 18 aa, Entamoeba histolytica
YVRKTAVLCVLKLYCMDP

SEQ ID NO: 2731485 - protein, 20 aa, Entamoeba histolytica
YVRLHESVLSGLKYFEKNPI

SEQ ID NO: 2731486 - protein, 18 aa, Entamoeba histolytica
YVSFTPTGILVGEAAKRM

SEQ ID NO: 2731487 - protein, 28 aa, Entamoeba histolytica
YVSKEASKLPLWFSHYDHKANFDDYNSG

SEQ ID NO: 2731488 - protein, 18 aa, Entamoeba histolytica
YVSLGKAFVLSDYETLKK

SEQ ID NO: 2731489 - protein, 17 aa, Entamoeba histolytica
YVSSFYSMFYPSPSIHL

SEQ ID NO: 2731490 - protein, 28 aa, Entamoeba histolytica
YVSYALSDVSFIFPITPSSPMAENADVW

SEQ ID NO: 2731491 - protein, 19 aa, Entamoeba histolytica
YVSYVRRGEKWYFCNDENI

SEQ ID NO: 2731492 - protein, 21 aa, Entamoeba histolytica
YVTFIYSPIPHYYFLLRILRE

SEQ ID NO: 2731493 - protein, 17 aa, Entamoeba histolytica
YVTVPDQVLFVVFDDGK

SEQ ID NO: 2731494 - protein, 25 aa, Entamoeba histolytica
YVVDRAIEIYPSFRIPAELAKPSGK

SEQ ID NO: 2731495 - protein, 17 aa, Entamoeba histolytica
YVVFKRCFSLQNIIIEN

SEQ ID NO: 2731496 - protein, 21 aa, Entamoeba histolytica
YVVGYLRNKGLPEIALQCVRD

SEQ ID NO: 2731497 - protein, 21 aa, Entamoeba histolytica
YVVYGEPRNEYMDEKTKRILE

SEQ ID NO: 2731498 - protein, 26 aa, Entamoeba histolytica
YVYKKLFIRIKPVELLYYLDKTKKDQ

SEQ ID NO: 2731499 - protein, 30 aa, Entamoeba histolytica
YVYSYITSILHKPTSRLILCGKGVGAAVSL

SEQ ID NO: 2731500 - protein, 18 aa, Entamoeba histolytica
YVYVLITTNLDEINQVAC

SEQ ID NO: 2731501 - protein, 20 aa, Entamoeba histolytica
YWDTELFMMKDLHIDYVVHG

SEQ ID NO: 2731502 - protein, 17 aa, Entamoeba histolytica
YWHLHKAHEFIGMKALP

SEQ ID NO: 2731503 - protein, 17 aa, Entamoeba histolytica
YWICPNGLIIIERDNKN

SEQ ID NO: 2731504 - protein, 17 aa, Entamoeba histolytica
YWIGELKKENVDGIIFL

SEQ ID NO: 2731505 - protein, 18 aa, Entamoeba histolytica
YWPLVTVTKKRYFGMKYE

SEQ ID NO: 2731506 - protein, 18 aa, Entamoeba histolytica
YWSFEQKMFAVEKVRLIG

SEQ ID NO: 2731507 - protein, 25 aa, Entamoeba histolytica
YWTKEECLSFEKIIKFLNINCGQAL

SEQ ID NO: 2731508 - protein, 26 aa, Entamoeba histolytica
YWVAESWYGRFIYAFNKREGLRLIRN

SEQ ID NO: 2731509 - protein, 18 aa, Entamoeba histolytica
YYAFIEYDRPEDAAKALR

SEQ ID NO: 2731510 - protein, 18 aa, Entamoeba histolytica
YYCLCFMDYAVKRNSNFR

SEQ ID NO: 2731511 - protein, 19 aa, Entamoeba histolytica
YYDGFFGHRINPVVNMAIT

SEQ ID NO: 2731512 - protein, 26 aa, Entamoeba histolytica
YYDKFNFEIVYHVAPLLPYYNGEEQL

SEQ ID NO: 2731513 - protein, 26 aa, Entamoeba histolytica
YYDNKINFWRNVYGFNMTPMRAEVLK

SEQ ID NO: 2731514 - protein, 19 aa, Entamoeba histolytica
YYDTLFTDPKPESPDWEKL

SEQ ID NO: 2731515 - protein, 17 aa, Entamoeba histolytica
YYEGCNAVIVVFDISDR

SEQ ID NO: 2731516 - protein, 18 aa, Entamoeba histolytica
YYELISTYNIFYNNKDRN

SEQ ID NO: 2731517 - protein, 27 aa, Entamoeba histolytica
YYENCMVNAYYRMDWLLCNYHIKDNSG

SEQ ID NO: 2731518 - protein, 29 aa, Entamoeba histolytica
YYENDSPFILTVFSAFWILSDGTCSIHQG

SEQ ID NO: 2731519 - protein, 32 aa, Entamoeba histolytica
YYEQRFDVIDPCILLYMKLVIGLTGEKIGSFK

SEQ ID NO: 2731520 - protein, 19 aa, Entamoeba histolytica
YYEVLSDLLYLILNCKSQT

SEQ ID NO: 2731521 - protein, 17 aa, Entamoeba histolytica
YYFGDIKEKEYLSIKKK

SEQ ID NO: 2731522 - protein, 27 aa, Entamoeba histolytica
YYFVHKKKLIIQILVNEHLSIHVVVRF

SEQ ID NO: 2731523 - protein, 19 aa, Entamoeba histolytica
YYGKRIPERYYGIADGCFS

SEQ ID NO: 2731524 - protein, 17 aa, Entamoeba histolytica
YYGNIYHILVDRFSGEN

SEQ ID NO: 2731525 - protein, 28 aa, Entamoeba histolytica
YYGTIKIDENTLWILMDMCGVGSVKDLM

SEQ ID NO: 2731526 - protein, 19 aa, Entamoeba histolytica
YYGTQQYPGYNQMGGMPPS

SEQ ID NO: 2731527 - protein, 19 aa, Entamoeba histolytica
YYIAKIEPLHSYLTNLPCF

SEQ ID NO: 2731528 - protein, 20 aa, Entamoeba histolytica
YYITPKIMLQQVAPLDLCRY

SEQ ID NO: 2731529 - protein, 18 aa, Entamoeba histolytica
YYKEKHILPFEVIRFQVY

SEQ ID NO: 2731530 - protein, 25 aa, Entamoeba histolytica
YYKHTNFCGFSRQLSLYGFKKFDNE

SEQ ID NO: 2731531 - protein, 25 aa, Entamoeba histolytica
YYKTDWPLLVICPSSLRTNWKNEIV

SEQ ID NO: 2731532 - protein, 18 aa, Entamoeba histolytica
YYLCQQIRTILLSSCSHL

SEQ ID NO: 2731533 - protein, 20 aa, Entamoeba histolytica
YYNEKSAFKWVSPASRSIQQ

SEQ ID NO: 2731534 - protein, 25 aa, Entamoeba histolytica
YYNSSHFHFLNPAFEGFFRSINESI

SEQ ID NO: 2731535 - protein, 19 aa, Entamoeba histolytica
YYPYISRDYSKIDSYQVLD

SEQ ID NO: 2731536 - protein, 20 aa, Entamoeba histolytica
YYQEGILYVKLLKVSNSNWV

SEQ ID NO: 2731537 - protein, 17 aa, Entamoeba histolytica
YYQTFQEESKSRIEFIQ

SEQ ID NO: 2731538 - protein, 35 aa, Entamoeba histolytica
YYRDICLSYGFFNSFLRLCDRFLSLRTDPTMPTAL

SEQ ID NO: 2731539 - protein, 20 aa, Entamoeba histolytica
YYRIDLMDFIEPTYGNLRPT

SEQ ID NO: 2731540 - protein, 20 aa, Entamoeba histolytica
YYRKFGYTLDGPYMAKSLNE

SEQ ID NO: 2731541 - protein, 26 aa, Entamoeba histolytica
YYRKSNAVIMVYDISRKETFEQLEYW

SEQ ID NO: 2731542 - protein, 18 aa, Entamoeba histolytica
YYRLIQEKSFCESRTQFY

SEQ ID NO: 2731543 - protein, 34 aa, Entamoeba histolytica
YYRTMSNWCNFVTPRVLYFTNSFERFDLKEFNQS

SEQ ID NO: 2731544 - protein, 33 aa, Entamoeba histolytica
YYTETFHFPFYFEYLSKWPEMCFIARDCNGRVE

SEQ ID NO: 2731545 - protein, 18 aa, Entamoeba histolytica
YYTNFMVGYVSYGALFCI

SEQ ID NO: 2731546 - protein, 24 aa, Entamoeba histolytica
YYTPEYIVDFFLKGIESIQYYERC

SEQ ID NO: 2731547 - protein, 26 aa, Entamoeba histolytica
YYVDKRIVNKLLISYITKPHQRMEIV

SEQ ID NO: 2731548 - protein, 19 aa, Entamoeba histolytica
YYVQAHCAIIMFDVTSRDT

SEQ ID NO: 2731549 - protein, 30 aa, Entamoeba histolytica; identical to SEQ ID NO: 2544625

SEQ ID NO: 2731550 - protein, 18 aa, Entamoeba histolytica
YYWKLDNVSKYSPYSTIL

SEQ ID NO: 2731551 - protein, 19 aa, Entamoeba histolytica
YYYLFNKESFFNAKALNCT

SEQ ID NO: 2731552 - protein, 19 aa, Entamoeba histolytica
YYYPVNSISFYNETIFLTA

SEQ ID NO: 2731553 - protein, 18 aa, Entamoeba histolytica
YYYSTECIIPIPTSFLKT

SEQ ID NO: 2731554 - protein, 24 aa, Entamoeba histolytica
VKESKIPIILFIDEIHTVLGAGAT

SEQ ID NO: 2731555 - protein, 22 aa, Entamoeba histolytica
TCRKIITIPYISGFLGFREVEV

SEQ ID NO: 2731556 - protein, 24 aa, Entamoeba histolytica
KQTKIIILIPPPLQYCTFDSWKST

SEQ ID NO: 2731557 - protein, 20 aa, Entamoeba histolytica
IAAALAKKRAERAKKFAISD

SEQ ID NO: 2731558 - protein, 24 aa, Entamoeba histolytica
KECLPLILILRNRLNYALNGREVT

SEQ ID NO: 2731559 - protein, 20 aa, Entamoeba histolytica
STLYAAWNPDFLLSVLLGNQ

SEQ ID NO: 2731560 - protein, 23 aa, Entamoeba histolytica
VEPLEMVVYLPYLCKKLQVPYCI

SEQ ID NO: 2731561 - protein, 20 aa, Entamoeba histolytica
YVVLLFYPLDWTFVCPTEMI

SEQ ID NO: 2731562 - protein, 26 aa, Entamoeba histolytica
AGEKALLVPILFANAINWGSIFFIAS

SEQ ID NO: 2731563 - protein, 22 aa, Entamoeba histolytica
DCLMIFHGLKLTTDKLRSIVKK

SEQ ID NO: 2731564 - protein, 23 aa, Entamoeba histolytica
ECPKIAFLRMLKAAFYGAPDDHL

SEQ ID NO: 2731565 - protein, 24 aa, Entamoeba histolytica
ERTIKIFLIRWKNNFHYVPDEKVP

SEQ ID NO: 2731566 - protein, 17 aa, Entamoeba histolytica
HMNFLLHRDLKPANILI

SEQ ID NO: 2731567 - protein, 28 aa, Entamoeba histolytica
IEIDPAPFRLWFLKFYGKDIASTDYYKS

SEQ ID NO: 2731568 - protein, 25 aa, Entamoeba histolytica
KELLKTVMKLWLPAGVTLLEMIVLH

SEQ ID NO: 2731569 - protein, 18 aa, Entamoeba histolytica
NEKIYGIGFLFLINDKKT

SEQ ID NO: 2731570 - protein, 22 aa, Entamoeba histolytica
NNAYMKLLVRLYGFLARRTQSK

SEQ ID NO: 2731571 - protein, 23 aa, Entamoeba histolytica
RRNNLQWFRVPPKIFFEPHSIRY

SEQ ID NO: 2731572 - protein, 20 aa, Entamoeba histolytica
AGFSLIRLLAEPSAAAYAYG

SEQ ID NO: 2731573 - protein, 26 aa, Entamoeba histolytica
ATCQTLVFNLTWSWVVSLRGLRKSTL

SEQ ID NO: 2731574 - protein, 23 aa, Entamoeba histolytica
DESYRFYQLLLFNFSHFVADEDF

SEQ ID NO: 2731575 - protein, 26 aa, Entamoeba histolytica
DLGNYHLKFLIQPFLHWPDTMMTVIE

SEQ ID NO: 2731576 - protein, 19 aa, Entamoeba histolytica
DVFTQMFWKLGMKSFDDFI

SEQ ID NO: 2731577 - protein, 20 aa, Entamoeba histolytica
EEYFRFLWELRLVFNKEMTQ

SEQ ID NO: 2731578 - protein, 19 aa, Entamoeba histolytica
EFGWLFIKVLSLSDHFPYN

SEQ ID NO: 2731579 - protein, 23 aa, Entamoeba histolytica
ELHRLLNKWPLLEPTHALELLDF

SEQ ID NO: 2731580 - protein, 20 aa, Entamoeba histolytica
EQSWLMMYVYKGLGASENKE

SEQ ID NO: 2731581 - protein, 18 aa, Entamoeba histolytica
EVILLRRFVSFLQQRAEN

SEQ ID NO: 2731582 - protein, 19 aa, Entamoeba histolytica
FFSYIFPTIQFTLTKIPPK

SEQ ID NO: 2731583 - protein, 18 aa, Entamoeba histolytica
FMIFAGILIRNSPQQSPF

SEQ ID NO: 2731584 - protein, 22 aa, Entamoeba histolytica
FNLCWWIYTYGYLVEGIFRVSG

SEQ ID NO: 2731585 - protein, 17 aa, Entamoeba histolytica
FPHYIILHDLNTLPNVL

SEQ ID NO: 2731586 - protein, 17 aa, Entamoeba histolytica
FVMLNYNDLAILQNGLI

SEQ ID NO: 2731587 - protein, 22 aa, Entamoeba histolytica
FVTISLFKILSSMILKLNLQMM

SEQ ID NO: 2731588 - protein, 17 aa, Entamoeba histolytica
GLEFIPLNLPLEEMEKQ

SEQ ID NO: 2731589 - protein, 23 aa, Entamoeba histolytica
HKTCHYPCHVPFFISAFTNRFCT

SEQ ID NO: 2731590 - protein, 19 aa, Entamoeba histolytica
IEFTALLFVPQRAPFDMFE

SEQ ID NO: 2731591 - protein, 23 aa, Entamoeba histolytica
IHCNDFRLTPMWKYLTQLQIKEQ

SEQ ID NO: 2731592 - protein, 29 aa, Entamoeba histolytica
IKALRNMLQLFLRQLPLNSKFQIISFGST

SEQ ID NO: 2731593 - protein, 22 aa, Entamoeba histolytica
IKNKWIIELRKYAPTVPVIVVG

SEQ ID NO: 2731594 - protein, 18 aa, Entamoeba histolytica
INDSFYFFFTHWSDIVRQ

SEQ ID NO: 2731595 - protein, 23 aa, Entamoeba histolytica
IVPPAQIMFKWFNAIYKVGGDGC

SEQ ID NO: 2731596 - protein, 18 aa, Entamoeba histolytica
IYNKYRFYNINRGEKKLL

SEQ ID NO: 2731597 - protein, 18 aa, Entamoeba histolytica
IYQSFLCTPILIAAHRTL

SEQ ID NO: 2731598 - protein, 21 aa, Entamoeba histolytica
KIKLFNIIWELIKLFGRIDFG

SEQ ID NO: 2731599 - protein, 23 aa, Entamoeba histolytica
KQTKIIILIPPPLQYCTIDSWKS

SEQ ID NO: 2731600 - protein, 25 aa, Entamoeba histolytica
KSDIYSLGIVFWEIFRRVVFGSYTK

SEQ ID NO: 2731601 - protein, 19 aa, Entamoeba histolytica
KVPYLFLANSYKISYWKTD

SEQ ID NO: 2731602 - protein, 21 aa, Entamoeba histolytica
KYVVLLFYPLDWTFVCPTEMI

SEQ ID NO: 2731603 - protein, 18 aa, Entamoeba histolytica
LAYFLLRRALRNKNIIGH

SEQ ID NO: 2731604 - protein, 17 aa, Entamoeba histolytica
LEQWMIKDLLEGIDVKA

SEQ ID NO: 2731605 - protein, 19 aa, Entamoeba histolytica
LFLKEGFRILKPNGLMIIA

SEQ ID NO: 2731606 - protein, 17 aa, Entamoeba histolytica
LLARRLLQKLGMDKQFV

SEQ ID NO: 2731607 - protein, 24 aa, Entamoeba histolytica
LNIYEFIAIYRYLEICYALFNAYN

SEQ ID NO: 2731608 - protein, 18 aa, Entamoeba histolytica
LNPDWIYIRAAAIARKVY

SEQ ID NO: 2731609 - protein, 17 aa, Entamoeba histolytica
LSMDNMYSAWNPQLLIA

SEQ ID NO: 2731610 - protein, 17 aa, Entamoeba histolytica
LVYIILSLVLSGFQQVY

SEQ ID NO: 2731611 - protein, 23 aa, Entamoeba histolytica
MDNMYSAWNPQLLIAIKTPQAVN

SEQ ID NO: 2731612 - protein, 24 aa, Entamoeba histolytica
NDLPSLLLLPIKFLPQFYSLIKEY

SEQ ID NO: 2731613 - protein, 17 aa, Entamoeba histolytica
NEKIYGIGFLFLINDKK

SEQ ID NO: 2731614 - protein, 19 aa, Entamoeba histolytica
NLPLFYFSPININPPKFKK

SEQ ID NO: 2731615 - protein, 22 aa, Entamoeba histolytica
NTSLFRIYFLTNDKGNPFIRTL

SEQ ID NO: 2731616 - protein, 20 aa, Entamoeba histolytica
NYQYIVFKFNVVNGLYVSEI

SEQ ID NO: 2731617 - protein, 24 aa, Entamoeba histolytica
PQKTLWIIRMRVLRRLLLKYRTTG

SEQ ID NO: 2731618 - protein, 17 aa, Entamoeba histolytica
PYWSLVYRIARKKRINV

SEQ ID NO: 2731619 - protein, 24 aa, Entamoeba histolytica
QIFKLACDHYILPYIKIKEFPNNR

SEQ ID NO: 2731620 - protein, 23 aa, Entamoeba histolytica
RQHFHYFILYRSTLCWIKDIYNN

SEQ ID NO: 2731621 - protein, 26 aa, Entamoeba histolytica
RYGESDYVLMFWNPSQPLEQWMIKDL

SEQ ID NO: 2731622 - protein, 24 aa, Entamoeba histolytica
SELNFIPLLRTVFYKFFGERNLTG

SEQ ID NO: 2731623 - protein, 24 aa, Entamoeba histolytica
SRLSIGLMWWMLTREILRYQGKLA

SEQ ID NO: 2731624 - protein, 20 aa, Entamoeba histolytica
SRVILIRDQIFKLACDHYIL

SEQ ID NO: 2731625 - protein, 26 aa, Entamoeba histolytica
TAQPKFYLTGVFYFALMYSGSNLKEI

SEQ ID NO: 2731626 - protein, 27 aa, Entamoeba histolytica
TATCQTLVFNLTWSWVVSLRGLRKSTL

SEQ ID NO: 2731627 - protein, 18 aa, Entamoeba histolytica
TCLLLAFSKGEIPTAYVP

SEQ ID NO: 2731628 - protein, 18 aa, Entamoeba histolytica
TGLLMTELFFIDGLAISS

SEQ ID NO: 2731629 - protein, 19 aa, Entamoeba histolytica
TITFLLLHKVKYPDRIHLL

SEQ ID NO: 2731630 - protein, 22 aa, Entamoeba histolytica
TLAGFNWFNAYYTPGVSRISTN

SEQ ID NO: 2731631 - protein, 24 aa, Entamoeba histolytica
TLDELHFWPSFYLHAVLFNKTDPS

SEQ ID NO: 2731632 - protein, 25 aa, Entamoeba histolytica
TLLTKVLIPLLKKSTIRPYIIFVHA

SEQ ID NO: 2731633 - protein, 23 aa, Entamoeba histolytica
TVAKLIMIIKLIKDIIIMADIGI

SEQ ID NO: 2731634 - protein, 17 aa, Entamoeba histolytica
VLRTLYNILIKRIGNRK

SEQ ID NO: 2731635 - protein, 26 aa, Entamoeba histolytica
VLSMDNMYSAWNPQLLIAIKTPQAVN

SEQ ID NO: 2731636 - protein, 27 aa, Entamoeba histolytica
VMGPGKRLRPLSLLLFFIGGGGKIEEQ

SEQ ID NO: 2731637 - protein, 23 aa, Entamoeba histolytica
YDRLRPLSYPQTDVFLICFSVVS

SEQ ID NO: 2731638 - protein, 23 aa, Entamoeba histolytica
YESQGLVPLLRLQWNKFDPNFIA

SEQ ID NO: 2731639 - protein, 24 aa, Entamoeba histolytica
YNESDWVLMFYNPTAPLEQWMVKD

SEQ ID NO: 2731640 - protein, 21 aa, Entamoeba histolytica
YQYKMRVVYAHFPVTLVIADD

SEQ ID NO: 2731641 - protein, 25 aa, Entamoeba histolytica
YRKAFYDFLRRILVWNPHQRLRPIQ

SEQ ID NO: 2731642 - protein, 20 aa, Entamoeba histolytica
AAALLWVFYIRQSFIKQHSF

SEQ ID NO: 2731643 - protein, 19 aa, Entamoeba histolytica
AAFNMKLFPRIMIYFGQTD

SEQ ID NO: 2731644 - protein, 17 aa, Entamoeba histolytica
AAPADIPPPPPPTAPMM

SEQ ID NO: 2731645 - protein, 25 aa, Entamoeba histolytica
AARIFRALFELLLIKRWARPALKAL

SEQ ID NO: 2731646 - protein, 29 aa, Entamoeba histolytica
AATASQVLGLLWQLIDYDLRKTLGSMDCE

SEQ ID NO: 2731647 - protein, 20 aa, Entamoeba histolytica
ACKINYPHRFFLLRGNHENV

SEQ ID NO: 2731648 - protein, 18 aa, Entamoeba histolytica
ADEDVLFFVITKTGFMQL

SEQ ID NO: 2731649 - protein, 22 aa, Entamoeba histolytica
ADEQYWIFQLVAAILHLGNVYF

SEQ ID NO: 2731650 - protein, 20 aa, Entamoeba histolytica
ADFIIYRGFGKYVSSLGVER

SEQ ID NO: 2731651 - protein, 23 aa, Entamoeba histolytica
ADGKKFYRFLYDEKYEKNKGFVN

SEQ ID NO: 2731652 - protein, 18 aa, Entamoeba histolytica
AEKLIRIPKEVFLILHDC

SEQ ID NO: 2731653 - protein, 18 aa, Entamoeba histolytica
AFFSQPCLNLLFIQNKLL

SEQ ID NO: 2731654 - protein, 17 aa, Entamoeba histolytica
AFIIIVGNKIDLPSKVT

SEQ ID NO: 2731655 - protein, 19 aa, Entamoeba histolytica
AFLKKFYYTMKEPSYIDWK

SEQ ID NO: 2731656 - protein, 18 aa, Entamoeba histolytica
AFLSLPRPTKLAPKPSFL

SEQ ID NO: 2731657 - protein, 18 aa, Entamoeba histolytica
AFSDLLIQIYKKKNATLK

SEQ ID NO: 2731658 - protein, 22 aa, Entamoeba histolytica
AFVFLRLINPVLLTPLKFSSKL

SEQ ID NO: 2731659 - protein, 20 aa, Entamoeba histolytica
AFVLFIKHFYIYVLQITPED

SEQ ID NO: 2731660 - protein, 24 aa, Entamoeba histolytica
AGCGMYWMFGLLLSAGFKQVGVIP

SEQ ID NO: 2731661 - protein, 24 aa, Entamoeba histolytica
AGKGTLFLWFAYTPLKNSRKEFTE

SEQ ID NO: 2731662 - protein, 30 aa, Entamoeba histolytica; identical to SEQ ID NO: 2544780

SEQ ID NO: 2731663 - protein, 23 aa, Entamoeba histolytica
AGSKFVINQPAVYKLPSSEHYVV

SEQ ID NO: 2731664 - protein, 17 aa, Entamoeba histolytica
AHNTLLPWNVYVYDGGN

SEQ ID NO: 2731665 - protein, 17 aa, Entamoeba histolytica
AIALPLIRKTVFPSLKT

SEQ ID NO: 2731666 - protein, 20 aa, Entamoeba histolytica
AILEQFGVALLKYAKKYPFQ

SEQ ID NO: 2731667 - protein, 19 aa, Entamoeba histolytica
AIYSFWLYDFCDVYLEASK

SEQ ID NO: 2731668 - protein, 24 aa, Entamoeba histolytica
AKKVEVIVGVPFIYIPKVQQILAG

SEQ ID NO: 2731669 - protein, 19 aa, Entamoeba histolytica
AKLFKPRHLFCGYYIFIEF

SEQ ID NO: 2731670 - protein, 22 aa, Entamoeba histolytica
AKSIFYYHYFVPELNLNDVKRF

SEQ ID NO: 2731671 - protein, 20 aa, Entamoeba histolytica
AKTCVFFRWTSDMKQPHIDR

SEQ ID NO: 2731672 - protein, 19 aa, Entamoeba histolytica
ALCLFYERYPEAVSEVMFP

SEQ ID NO: 2731673 - protein, 23 aa, Entamoeba histolytica
ALETWPVDLFGQLLPRHLQLAYQ

SEQ ID NO: 2731674 - protein, 17 aa, Entamoeba histolytica
ALEYIHRMYLKVGFYLT

SEQ ID NO: 2731675 - protein, 17 aa, Entamoeba histolytica
ALGYMFVYFMKGSLPWQ

SEQ ID NO: 2731676 - protein, 18 aa, Entamoeba histolytica
ALHFLAKLKIMVVKDIER

SEQ ID NO: 2731677 - protein, 22 aa, Entamoeba histolytica
ALHRIGLIPIPLYATLGVQSIN

SEQ ID NO: 2731678 - protein, 20 aa, Entamoeba histolytica
ALLCFRIISNKIYILKFDNC

SEQ ID NO: 2731679 - protein, 19 aa, Entamoeba histolytica
ALLNLFLPEPVLSTSIIIL

SEQ ID NO: 2731680 - protein, 17 aa, Entamoeba histolytica
ALLYFIPIEQREILYSL

SEQ ID NO: 2731681 - protein, 18 aa, Entamoeba histolytica
ALRTTAPYTLYFAAGTNA

SEQ ID NO: 2731682 - protein, 18 aa, Entamoeba histolytica
ALSFLPFLNYITLKHIIF

SEQ ID NO: 2731683 - protein, 17 aa, Entamoeba histolytica
ALTCWRRIVWHCVLPLA

SEQ ID NO: 2731684 - protein, 20 aa, Entamoeba histolytica
ALTTFFSFTGNVTQVRLSDC

SEQ ID NO: 2731685 - protein, 18 aa, Entamoeba histolytica
AMIYLVIKEGYKVTIRRN

SEQ ID NO: 2731686 - protein, 24 aa, Entamoeba histolytica
AMNKMLLTFYRYPQAWIICAQYFE

SEQ ID NO: 2731687 - protein, 25 aa, Entamoeba histolytica
AMNKMLLTFYRYPQAWIICAQYFQR

SEQ ID NO: 2731688 - protein, 22 aa, Entamoeba histolytica
AMWDWLDLLLPALSQLPYLKTS

SEQ ID NO: 2731689 - protein, 19 aa, Entamoeba histolytica
ANAFYYTLPLLIQQMNTIA

SEQ ID NO: 2731690 - protein, 24 aa, Entamoeba histolytica
ANIDYFFCYKWNALLFKRFFINED

SEQ ID NO: 2731691 - protein, 20 aa, Entamoeba histolytica
ANILFLLNYLSHGVVRFSPD

SEQ ID NO: 2731692 - protein, 24 aa, Entamoeba histolytica
ANLIKLWFRELPTLLLNGLTSTQI

SEQ ID NO: 2731693 - protein, 24 aa, Entamoeba histolytica
ANMTYACSILYKTKLPLIIVFTKT

SEQ ID NO: 2731694 - protein, 23 aa, Entamoeba histolytica
ANTTIISLLKWVTDDFLPTMTRI

SEQ ID NO: 2731695 - protein, 23 aa, Entamoeba histolytica
APHPQGYYTQPPLALYICCLMNN

SEQ ID NO: 2731696 - protein, 25 aa, Entamoeba histolytica
APPDVISLILPLLKTRTFFIPNRSE

SEQ ID NO: 2731697 - protein, 24 aa, Entamoeba histolytica
AQEFFYLILIETFPVPLQLVCMPE

SEQ ID NO: 2731698 - protein, 20 aa, Entamoeba histolytica
AQILHYTFLLPILSELHYQT

SEQ ID NO: 2731699 - protein, 17 aa, Entamoeba histolytica
AQKYLIQIWSEAVGWMV

SEQ ID NO: 2731700 - protein, 19 aa, Entamoeba histolytica
AQNGMLWQRTFFRWLRRWL

SEQ ID NO: 2731701 - protein, 21 aa, Entamoeba histolytica
AQQSFLFRILVDNGFTVCLKK

SEQ ID NO: 2731702 - protein, 24 aa, Entamoeba histolytica
ARDFLGIPIIMEPSLVASGFLDDE

SEQ ID NO: 2731703 - protein, 25 aa, Entamoeba histolytica
ARNTFLTLFFLRYCFRPFSKVPSVL

SEQ ID NO: 2731704 - protein, 23 aa, Entamoeba histolytica
ARNYLELILRIFKKPYLTFGDKT

SEQ ID NO: 2731705 - protein, 19 aa, Entamoeba histolytica
ARSLWIWRKCKSYLFDDFK

SEQ ID NO: 2731706 - protein, 24 aa, Entamoeba histolytica
ASAEILFALCKYYKELKKCQSELF

SEQ ID NO: 2731707 - protein, 23 aa, Entamoeba histolytica
ASGKTCLYNIWRGLNIPEEYIKT

SEQ ID NO: 2731708 - protein, 17 aa, Entamoeba histolytica
ASLPFMHFFDGFRTSHE

SEQ ID NO: 2731709 - protein, 20 aa, Entamoeba histolytica
ASVRDWWYYPELTYVTDTSD

SEQ ID NO: 2731710 - protein, 27 aa, Entamoeba histolytica
ATCQTLVFNLTWSWVVSLRELRKSTLG

SEQ ID NO: 2731711 - protein, 27 aa, Entamoeba histolytica
ATLKAIYHRLFVFIVNKVNEVMGKAGA

SEQ ID NO: 2731712 - protein, 25 aa, Entamoeba histolytica
ATLPQMMILLLFNTHNILKISEIAL

SEQ ID NO: 2731713 - protein, 24 aa, Entamoeba histolytica
ATLYIYVLDIPLLDKTYLTCQGVD

SEQ ID NO: 2731714 - protein, 86 aa, Entamoeba histolytica
ATPPPPPPTLSMPPPPPPTLSMPPPPPPTLSMPPPPPPTLSMPPPPPPTLSMPPPPPPTLSMPPPPPPTLSMPPPPPPTLNVTSSP

SEQ ID NO: 2731715 - protein, 24 aa, Entamoeba histolytica
AVCYDLRFPVWLRNTLENHYDILI

SEQ ID NO: 2731716 - protein, 18 aa, Entamoeba histolytica
AVLYCWCVSLLLEKLNNT

SEQ ID NO: 2731717 - protein, 25 aa, Entamoeba histolytica
AWTILKLFLMSLPTPLLHPISSFLS

SEQ ID NO: 2731718 - protein, 24 aa, Entamoeba histolytica
AYGELFYLLNLYSDNIKWFFIDFD

SEQ ID NO: 2731719 - protein, 26 aa, Entamoeba histolytica
AYLNSTLSWICIYLTKSLRNERNEKV

SEQ ID NO: 2731720 - protein, 23 aa, Entamoeba histolytica
AYNLDFFIYPFIYYQRIKNNPRS

SEQ ID NO: 2731721 - protein, 18 aa, Entamoeba histolytica
CAIKVGIHLLLERKTKKS

SEQ ID NO: 2731722 - protein, 20 aa, Entamoeba histolytica
CAYLRWIYITLNAGKHFYKK

SEQ ID NO: 2731723 - protein, 27 aa, Entamoeba histolytica
CCNKSFIYLLPLILKKFPLLMNFQDGC

SEQ ID NO: 2731724 - protein, 18 aa, Entamoeba histolytica
CDGLLLRAMKSGSWVLLD

SEQ ID NO: 2731725 - protein, 17 aa, Entamoeba histolytica
CDVLLFRKTLFDCYNEY

SEQ ID NO: 2731726 - protein, 24 aa, Entamoeba histolytica
CEPEFIPIMKYVFGNVLIAEDAET

SEQ ID NO: 2731727 - protein, 22 aa, Entamoeba histolytica
CFEDMHFWLNGMKFQQIFIEEA

SEQ ID NO: 2731728 - protein, 20 aa, Entamoeba histolytica
CFIKHWIIYIKDKEWFDVFQ

SEQ ID NO: 2731729 - protein, 18 aa, Entamoeba histolytica
CFYQCPLLKTLKIKNKTM

SEQ ID NO: 2731730 - protein, 20 aa, Entamoeba histolytica
CFYVKLFLDLFSIPSVVLNS

SEQ ID NO: 2731731 - protein, 19 aa, Entamoeba histolytica
CGALFYCSYLPSGIKRSKQ

SEQ ID NO: 2731732 - protein, 24 aa, Entamoeba histolytica
CGKVVELFLDTLKGYRIKFPHLKY

SEQ ID NO: 2731733 - protein, 20 aa, Entamoeba histolytica
CICIGLYYWTYDIPSFNTIN

SEQ ID NO: 2731734 - protein, 23 aa, Entamoeba histolytica
CIRKNFFLWLLENKPSSALSYLQ

SEQ ID NO: 2731735 - protein, 20 aa, Entamoeba histolytica
CISRQLWWGHRIPAYLIKSK

SEQ ID NO: 2731736 - protein, 21 aa, Entamoeba histolytica
CISRQLWWGHRIPAYLIKSKK

SEQ ID NO: 2731737 - protein, 21 aa, Entamoeba histolytica
CITMFFQLLIKLIQKKNFNSF

SEQ ID NO: 2731738 - protein, 25 aa, Entamoeba histolytica
CKNKLDRDLWLSTIETIRVLCIQSN

SEQ ID NO: 2731739 - protein, 22 aa, Entamoeba histolytica
CLKKRMTFIPLNKIAPQMPNLN

SEQ ID NO: 2731740 - protein, 18 aa, Entamoeba histolytica
CLLLLVALKLRFPQRISL

SEQ ID NO: 2731741 - protein, 23 aa, Entamoeba histolytica
CMTFPFFCLLKIKITEHNGVCYT

SEQ ID NO: 2731742 - protein, 18 aa, Entamoeba histolytica
CNTFGRGHPRFRKPRIGG

SEQ ID NO: 2731743 - protein, 18 aa, Entamoeba histolytica
CNVPLMNNGIIYNAFYNE

SEQ ID NO: 2731744 - protein, 19 aa, Entamoeba histolytica
CPETFFDSFIKFLPHNMKH

SEQ ID NO: 2731745 - protein, 22 aa, Entamoeba histolytica
CQNIKTFWKRMKRYGFKKRRIG

SEQ ID NO: 2731746 - protein, 18 aa, Entamoeba histolytica
CQSWDWYYPYYYAPFAKD

SEQ ID NO: 2731747 - protein, 18 aa, Entamoeba histolytica
CRHKNPIVIYTKKPMLFK

SEQ ID NO: 2731748 - protein, 27 aa, Entamoeba histolytica
CSLYTQPIVFPSVFFFNGAGLQKVLIK

SEQ ID NO: 2731749 - protein, 27 aa, Entamoeba histolytica
CSNKTVLKVFWFLGPRDLFVLPFVCRK

SEQ ID NO: 2731750 - protein, 18 aa, Entamoeba histolytica
CSPAFWKFLDLIGNKIEL

SEQ ID NO: 2731751 - protein, 23 aa, Entamoeba histolytica
CSYKFFLHQLYNILNYTPQIIVC

SEQ ID NO: 2731752 - protein, 24 aa, Entamoeba histolytica
CTLRSIQMLFLNSLIRLQEPNPGF

SEQ ID NO: 2731753 - protein, 23 aa, Entamoeba histolytica
CTTNKIILLLKDFIKTFQESYFE

SEQ ID NO: 2731754 - protein, 21 aa, Entamoeba histolytica
CTVSLFTHWLPRFGIEVDLID

SEQ ID NO: 2731755 - protein, 22 aa, Entamoeba histolytica
CTVSLFTHWLPRFGIEVDLIDT

SEQ ID NO: 2731756 - protein, 22 aa, Entamoeba histolytica
CVDDFIFFCFLVGNDFLPHIPS

SEQ ID NO: 2731757 - protein, 25 aa, Entamoeba histolytica
CVSHPFWLPKFANAFYYTLPLLIQQ

SEQ ID NO: 2731758 - protein, 17 aa, Entamoeba histolytica
CWNKVIPYCYYLTTVHR

SEQ ID NO: 2731759 - protein, 24 aa, Entamoeba histolytica
CYIGNILFGILIYLLDEFDKIKDV

SEQ ID NO: 2731760 - protein, 17 aa, Entamoeba histolytica
CYILYVKMHFFPEMTEE

SEQ ID NO: 2731761 - protein, 17 aa, Entamoeba histolytica
DAFLCIRGVKTLPMRMK

SEQ ID NO: 2731762 - protein, 24 aa, Entamoeba histolytica
DAHYTLKYFLKTWIRFIHLCGTPA

SEQ ID NO: 2731763 - protein, 21 aa, Entamoeba histolytica
DALFFFQYTKLPMNVLSKIWS

SEQ ID NO: 2731764 - protein, 19 aa, Entamoeba histolytica
DALLSILQFLLIRSKIQHP

SEQ ID NO: 2731765 - protein, 22 aa, Entamoeba histolytica
DANAWFVALAYTIKLSPRLNES

SEQ ID NO: 2731766 - protein, 27 aa, Entamoeba histolytica
DAVLRFCYLWFNFMPLTRGTAGCGMYW

SEQ ID NO: 2731767 - protein, 18 aa, Entamoeba histolytica
DAWKILRRGTIVLYKMSA

SEQ ID NO: 2731768 - protein, 17 aa, Entamoeba histolytica
DAYRRFIQNYNTLKLGN

SEQ ID NO: 2731769 - protein, 20 aa, Entamoeba histolytica
DCALLLIKNYNGNKWIVRKR

SEQ ID NO: 2731770 - protein, 23 aa, Entamoeba histolytica
DCFKRFIPYLKVYKMFIGNNEIC

SEQ ID NO: 2731771 - protein, 17 aa, Entamoeba histolytica
DCKRWFWELLQNAKDSI

SEQ ID NO: 2731772 - protein, 17 aa, Entamoeba histolytica
DCPLLQHVLLPTTLTLI

SEQ ID NO: 2731773 - protein, 24 aa, Entamoeba histolytica
DCTGYLYRMTLWEVPLLAIVSELY

SEQ ID NO: 2731774 - protein, 20 aa, Entamoeba histolytica
DDCIYLFKTAGYLVTKKFLK

SEQ ID NO: 2731775 - protein, 33 aa, Entamoeba histolytica
DDGKYWRHIYKSLLLIYYIIINGTPEAVERFKR

SEQ ID NO: 2731776 - protein, 26 aa, Entamoeba histolytica
DDGRPIPFWLYKLHGLGTEFKCEICG

SEQ ID NO: 2731777 - protein, 26 aa, Entamoeba histolytica
DDISPFGMLIIFKTSFRSSFCASLSN

SEQ ID NO: 2731778 - protein, 23 aa, Entamoeba histolytica
DDIYYYIFILKAIVWICNDKGVL

SEQ ID NO: 2731779 - protein, 20 aa, Entamoeba histolytica
DDLLSLLTFSLLHSTLKHPF

SEQ ID NO: 2731780 - protein, 22 aa, Entamoeba histolytica
DDQNYRFIIFDDINYDKNLLRL

SEQ ID NO: 2731781 - protein, 18 aa, Entamoeba histolytica
DDSYLYFINLLTNDLEIA

SEQ ID NO: 2731782 - protein, 24 aa, Entamoeba histolytica
DDYDSLIPVPILYDIIRTAIDHKR

SEQ ID NO: 2731783 - protein, 23 aa, Entamoeba histolytica
DEEQNYRFILFDDINYDKNLIRL

SEQ ID NO: 2731784 - protein, 22 aa, Entamoeba histolytica
DEQHYRFILLDDINYDKNTVRL

SEQ ID NO: 2731785 - protein, 17 aa, Entamoeba histolytica
DEQLLLLLLKTTLKLCN

SEQ ID NO: 2731786 - protein, 24 aa, Entamoeba histolytica
DEQPLFVIHVLWLRVLYNISLPDD

SEQ ID NO: 2731787 - protein, 17 aa, Entamoeba histolytica
DESAVIEPCKYSYEGEV

SEQ ID NO: 2731788 - protein, 28 aa, Entamoeba histolytica
DESISLLYQFWLQLLPSDNLIWGVFSLF

SEQ ID NO: 2731789 - protein, 22 aa, Entamoeba histolytica
DFDKGWYIIFGCTYQPAIERRY

SEQ ID NO: 2731790 - protein, 18 aa, Entamoeba histolytica
DFFYALSVILPRSTIGSF

SEQ ID NO: 2731791 - protein, 26 aa, Entamoeba histolytica
DFGYVRFYMITLPYFTTPETVLHFIC

SEQ ID NO: 2731792 - protein, 21 aa, Entamoeba histolytica
DFHSYIFNRFSADTYLACVRC

SEQ ID NO: 2731793 - protein, 17 aa, Entamoeba histolytica
DFINVIIFLILRSHVKN

SEQ ID NO: 2731794 - protein, 24 aa, Entamoeba histolytica
DFPSNIVYLFLFNDIIVETKVVRF

SEQ ID NO: 2731795 - protein, 17 aa, Entamoeba histolytica
DFSKWIKCILKINNPLF

SEQ ID NO: 2731796 - protein, 19 aa, Entamoeba histolytica
DFVYIIMEFISGGNLLRGV

SEQ ID NO: 2731797 - protein, 24 aa, Entamoeba histolytica
DFYSDPILLIDFKSLYPSIIMEFG

SEQ ID NO: 2731798 - protein, 20 aa, Entamoeba histolytica
DFYYLIMKLSRHVTAAYGSK

SEQ ID NO: 2731799 - protein, 24 aa, Entamoeba histolytica
DGAMEIFIEWMYLQRSPLLESQSI

SEQ ID NO: 2731800 - protein, 19 aa, Entamoeba histolytica
DGEKLFLHGLHLYSKKLQD

SEQ ID NO: 2731801 - protein, 26 aa, Entamoeba histolytica
DGLFIEDFFPELLLLDLSNNEIEVLE

SEQ ID NO: 2731802 - protein, 20 aa, Entamoeba histolytica
DGLIKLWNLIDGHLIATLRG

SEQ ID NO: 2731803 - protein, 24 aa, Entamoeba histolytica
DGNLTLILGLLWTLILKYQIAQNK

SEQ ID NO: 2731804 - protein, 26 aa, Entamoeba histolytica
DGNLTLILGLLWTLILKYQIAQNKMD

SEQ ID NO: 2731805 - protein, 17 aa, Entamoeba histolytica
DGSWFSSWWKTDKDEVN

SEQ ID NO: 2731806 - protein, 26 aa, Entamoeba histolytica
DGYFSIFFYVFALKYIPKFFQSIIHL

SEQ ID NO: 2731807 - protein, 20 aa, Entamoeba histolytica
DHFPLARDLFNYAFLSMWQD

SEQ ID NO: 2731808 - protein, 19 aa, Entamoeba histolytica
DHKMYIFQFMFMINTDTDS

SEQ ID NO: 2731809 - protein, 23 aa, Entamoeba histolytica
DHLKLLHFLLVKKKLTTKPENAE

SEQ ID NO: 2731810 - protein, 22 aa, Entamoeba histolytica
DHNPYFDSFIRWQFLKLKEMGK

SEQ ID NO: 2731811 - protein, 17 aa, Entamoeba histolytica
DHPTLISLFIKPTIEIL

SEQ ID NO: 2731812 - protein, 25 aa, Entamoeba histolytica
DICYQQAFLILLLNQYLAITLKKQS

SEQ ID NO: 2731813 - protein, 18 aa, Entamoeba histolytica
DIFNIINPLPFILSPIHL

SEQ ID NO: 2731814 - protein, 17 aa, Entamoeba histolytica
DIHLKFIYQPFLHWPDT

SEQ ID NO: 2731815 - protein, 22 aa, Entamoeba histolytica
DIIIELLQLLKYLHSIDIVHRD

SEQ ID NO: 2731816 - protein, 24 aa, Entamoeba histolytica
DIKVMYLCMFFVLKNISYSTMKSW

SEQ ID NO: 2731817 - protein, 17 aa, Entamoeba histolytica
DIKYLYKYIFPLIQIII

SEQ ID NO: 2731818 - protein, 24 aa, Entamoeba histolytica
DILPLKLCVYLFSSISKLIALYET

SEQ ID NO: 2731819 - protein, 25 aa, Entamoeba histolytica
DIQIRYIIYQLLKALKYLHSAGIVH

SEQ ID NO: 2731820 - protein, 18 aa, Entamoeba histolytica
DIQYFWKNYILQLTDIKD

SEQ ID NO: 2731821 - protein, 21 aa, Entamoeba histolytica
DITLFFYRLLGPDPSFKKGFE

SEQ ID NO: 2731822 - protein, 18 aa, Entamoeba histolytica
DIVFCYPPPPLFIAERGQ

SEQ ID NO: 2731823 - protein, 19 aa, Entamoeba histolytica
DIVPLRFFLKNLQLTPTLT

SEQ ID NO: 2731824 - protein, 28 aa, Entamoeba histolytica
DKAMKKLYPLFLWILSGLFPQFANISGV

SEQ ID NO: 2731825 - protein, 22 aa, Entamoeba histolytica
DKEFNLLFWKYLMKTKPLPSRE

SEQ ID NO: 2731826 - protein, 20 aa, Entamoeba histolytica
DKFRNEYIIQFYGAVFIPNK

SEQ ID NO: 2731827 - protein, 23 aa, Entamoeba histolytica
DKGHKIFFKLPLIKKVELKGELI

SEQ ID NO: 2731828 - protein, 23 aa, Entamoeba histolytica
DKIPITFFVLRNELFVPCSYHIA

SEQ ID NO: 2731829 - protein, 22 aa, Entamoeba histolytica
DKKLEWPTYKRHFYLPYRLDVD

SEQ ID NO: 2731830 - protein, 23 aa, Entamoeba histolytica
DKLARLFDYLWKKKCIVYADVIE

SEQ ID NO: 2731831 - protein, 17 aa, Entamoeba histolytica
DKNEHELFTSRLSLRKV

SEQ ID NO: 2731832 - protein, 24 aa, Entamoeba histolytica
DKQPDVMPPPPSGEAPVPEHRERK

SEQ ID NO: 2731833 - protein, 22 aa, Entamoeba histolytica
DKRKPWTGILLFGPPGTGKSFL

SEQ ID NO: 2731834 - protein, 17 aa, Entamoeba histolytica
DLALHFLAKLKIMVVKD

SEQ ID NO: 2731835 - protein, 17 aa, Entamoeba histolytica
DLFSLFFNVEFFERVWS

SEQ ID NO: 2731836 - protein, 18 aa, Entamoeba histolytica
DLHKLYLMLVEKANIQLQ

SEQ ID NO: 2731837 - protein, 22 aa, Entamoeba histolytica
DLITIPFNMFLKPLSLSPTTSS

SEQ ID NO: 2731838 - protein, 22 aa, Entamoeba histolytica
DLKDGLILIRFLTNLSGKEILK

SEQ ID NO: 2731839 - protein, 20 aa, Entamoeba histolytica
DLNIILFRILSSGTPLQVID

SEQ ID NO: 2731840 - protein, 22 aa, Entamoeba histolytica
DLQDGIIFRDLLRTLGIPCGNS

SEQ ID NO: 2731841 - protein, 19 aa, Entamoeba histolytica
DLRETILASLIKFSKVEQD

SEQ ID NO: 2731842 - protein, 22 aa, Entamoeba histolytica
DLRIKIFLWKTIQCDKALGTVR

SEQ ID NO: 2731843 - protein, 23 aa, Entamoeba histolytica
DLRSYLIMPVQRLPRYKLLLTDL

SEQ ID NO: 2731844 - protein, 19 aa, Entamoeba histolytica
DLSEYNLLWWKNKVYVIDV

SEQ ID NO: 2731845 - protein, 17 aa, Entamoeba histolytica
DLVIVLFIEIFRAIDSD

SEQ ID NO: 2731846 - protein, 24 aa, Entamoeba histolytica
DLVPIFLERLLAFPLDKLTISYKL

SEQ ID NO: 2731847 - protein, 18 aa, Entamoeba histolytica
DLWILLPQEYPYSFNSKI

SEQ ID NO: 2731848 - protein, 26 aa, Entamoeba histolytica
DMCCTSLALLWVFYIRQSFIGSYDFE

SEQ ID NO: 2731849 - protein, 19 aa, Entamoeba histolytica
DMLVWVIYPPHFDSTKKYP

SEQ ID NO: 2731850 - protein, 19 aa, Entamoeba histolytica
DNALYMLLTFANLSNNYIV

SEQ ID NO: 2731851 - protein, 22 aa, Entamoeba histolytica
DNMYSAWNPQLLISIKTPQAVN

SEQ ID NO: 2731852 - protein, 24 aa, Entamoeba histolytica
DNNNLFIVYLMRAFAHGYYRKPTF

SEQ ID NO: 2731853 - protein, 22 aa, Entamoeba histolytica
DNPLMDYLPLLPLSLMEVHENT

SEQ ID NO: 2731854 - protein, 23 aa, Entamoeba histolytica
DNRWLLVQHPIYGLGYVPLSYVQ

SEQ ID NO: 2731855 - protein, 20 aa, Entamoeba histolytica
DNSIYFILLLCSLDIIIHEN

SEQ ID NO: 2731856 - protein, 25 aa, Entamoeba histolytica
DNSLVLYLSYFIIKDNRFGPSDMKV

SEQ ID NO: 2731857 - protein, 23 aa, Entamoeba histolytica
DPFARMLILRFVFCRLVLLSLKL

SEQ ID NO: 2731858 - protein, 17 aa, Entamoeba histolytica
DPFIPPLLKIQLPLMVK

SEQ ID NO: 2731859 - protein, 24 aa, Entamoeba histolytica
DPLPPRLFRKYLAYARANIHPQLN

SEQ ID NO: 2731860 - protein, 22 aa, Entamoeba histolytica
DPPYMELPPLRALFLITTKGIP

SEQ ID NO: 2731861 - protein, 23 aa, Entamoeba histolytica
DPTIQFQWWYPLVQNLSANDFRE

SEQ ID NO: 2731862 - protein, 19 aa, Entamoeba histolytica
DQFLHLFAMKKDKCFPIGD

SEQ ID NO: 2731863 - protein, 19 aa, Entamoeba histolytica
DQLIFLQKLIKQYPFLIDG

SEQ ID NO: 2731864 - protein, 24 aa, Entamoeba histolytica
DQLYLFPPIFIIQLSFTIDGNNEI

SEQ ID NO: 2731865 - protein, 24 aa, Entamoeba histolytica
DQVLRLLWHEYWINTLAATAIISS

SEQ ID NO: 2731866 - protein, 17 aa, Entamoeba histolytica
DRAIEIYPSFRIPAELA

SEQ ID NO: 2731867 - protein, 18 aa, Entamoeba histolytica
DRLLDQFYLHHNFMLFLM

SEQ ID NO: 2731868 - protein, 31 aa, Entamoeba histolytica
DSELALTTLQHYLPLFKLADHLKRCYEDGTN

SEQ ID NO: 2731869 - protein, 20 aa, Entamoeba histolytica
DSFCYFSFNKEKYFLVGDHS

SEQ ID NO: 2731870 - protein, 17 aa, Entamoeba histolytica
DSIKPLHFVIVSKVPIA

SEQ ID NO: 2731871 - protein, 21 aa, Entamoeba histolytica
DSPFILTVFSAFWILSDGTCS

SEQ ID NO: 2731872 - protein, 23 aa, Entamoeba histolytica
DSSTPWILYWTLNPLRLFGYNVD

SEQ ID NO: 2731873 - protein, 23 aa, Entamoeba histolytica
DSTEVFFKIKKNTPLKKLMEAFC

SEQ ID NO: 2731874 - protein, 39 aa, Entamoeba histolytica
DTAGQERFATLSSNYFRNAMGGVIMFDVSNRQSFENVSN

SEQ ID NO: 2731875 - protein, 21 aa, Entamoeba histolytica
DTFISLYTKKLNLQGKINTLL

SEQ ID NO: 2731876 - protein, 19 aa, Entamoeba histolytica
DTHYLLYIIDQLRNECIDA

SEQ ID NO: 2731877 - protein, 18 aa, Entamoeba histolytica
DTLLCILLLFNTSSIHRL

SEQ ID NO: 2731878 - protein, 20 aa, Entamoeba histolytica
DTSTIDLFIPYLGNEGYFKI

SEQ ID NO: 2731879 - protein, 21 aa, Entamoeba histolytica
DTVLLFYWYYVSGTNLRTILS

SEQ ID NO: 2731880 - protein, 24 aa, Entamoeba histolytica
DVATIFWIAYLPIKVKSKFIELIN

SEQ ID NO: 2731881 - protein, 19 aa, Entamoeba histolytica
DVHWFIVDHWYLFSQLDQF

SEQ ID NO: 2731882 - protein, 25 aa, Entamoeba histolytica
DVIKRFDYLLQPPPLKKKKAIIPPD

SEQ ID NO: 2731883 - protein, 31 aa, Entamoeba histolytica; identical to SEQ ID NO: 2545033

SEQ ID NO: 2731884 - protein, 24 aa, Entamoeba histolytica
DVSSGLVYVFYNKILYFAQCGSIK

SEQ ID NO: 2731885 - protein, 19 aa, Entamoeba histolytica
DWRDGYAMKFIFADDHPFE

SEQ ID NO: 2731886 - protein, 23 aa, Entamoeba histolytica
DYKNIKPFAILNLLNITVKLSDH

SEQ ID NO: 2731887 - protein, 20 aa, Entamoeba histolytica
DYRPTPLCHYLFPAGGNGIY

SEQ ID NO: 2731888 - protein, 24 aa, Entamoeba histolytica
EADKLLVYLIFYIQSLLLKFNGHT

SEQ ID NO: 2731889 - protein, 24 aa, Entamoeba histolytica
EADKLLVYLIFYIQSLLLKFNGRT

SEQ ID NO: 2731890 - protein, 21 aa, Entamoeba histolytica
EALQWFQYTYLYVCLKRSPGG

SEQ ID NO: 2731891 - protein, 20 aa, Entamoeba histolytica
EAMFILYKITKDMQYLICAA

SEQ ID NO: 2731892 - protein, 24 aa, Entamoeba histolytica
EAVIWPMLRPDIFTGLRAPPKGLL

SEQ ID NO: 2731893 - protein, 19 aa, Entamoeba histolytica
EAYLYLLHHLNNNCSLEAL

SEQ ID NO: 2731894 - protein, 25 aa, Entamoeba histolytica
ECGEYLLYFVRIFLQYKPKTIKEFR

SEQ ID NO: 2731895 - protein, 19 aa, Entamoeba histolytica
ECLPLILILRNRLNYALNG

SEQ ID NO: 2731896 - protein, 25 aa, Entamoeba histolytica
ECYNLMHYLFQFPFALLDLNIYKHH

SEQ ID NO: 2731897 - protein, 17 aa, Entamoeba histolytica
EDEKLVLKLIWNDQLIV

SEQ ID NO: 2731898 - protein, 29 aa, Entamoeba histolytica
EDENKILRLFLFGLYKMKVLSPPVLHIVK

SEQ ID NO: 2731899 - protein, 22 aa, Entamoeba histolytica
EDEQLWYWNYDGTKLPLYINST

SEQ ID NO: 2731900 - protein, 24 aa, Entamoeba histolytica
EDFWLRQTFIEFLSWYVIVLLDEQ

SEQ ID NO: 2731901 - protein, 17 aa, Entamoeba histolytica
EDILYAGLRMRVLKVRT

SEQ ID NO: 2731902 - protein, 23 aa, Entamoeba histolytica
EDKKVLFNSLALGIKMVMPKEVL

SEQ ID NO: 2731903 - protein, 17 aa, Entamoeba histolytica
EDKPIFIDLSWRLDIVL

SEQ ID NO: 2731904 - protein, 20 aa, Entamoeba histolytica
EDQFFWVYKFLKGVQEREVF

SEQ ID NO: 2731905 - protein, 21 aa, Entamoeba histolytica
EDVLLTCRWFFYIREKDSSIS

SEQ ID NO: 2731906 - protein, 27 aa, Entamoeba histolytica
EDVNKFYTFWYSFKSWRDPPLDEMYNI

SEQ ID NO: 2731907 - protein, 23 aa, Entamoeba histolytica
EECFNLMYYMYKYPFSVLDLNIY

SEQ ID NO: 2731908 - protein, 23 aa, Entamoeba histolytica
EEGKGYIFIFPKNTWGYVNEYCS

SEQ ID NO: 2731909 - protein, 17 aa, Entamoeba histolytica
EEGYRIYTLEELGLDKN

SEQ ID NO: 2731910 - protein, 18 aa, Entamoeba histolytica
EEIAKFFRIVIVDALFIG

SEQ ID NO: 2731911 - protein, 22 aa, Entamoeba histolytica
EEIIIPMLGIFFNFSQTDSKEV

SEQ ID NO: 2731912 - protein, 18 aa, Entamoeba histolytica
EEIKLYLLFYEKSYEMIK

SEQ ID NO: 2731913 - protein, 24 aa, Entamoeba histolytica
EEKKPILPKYLIKKIERQEEIKKE

SEQ ID NO: 2731914 - protein, 25 aa, Entamoeba histolytica
EEKKRVLTAMKRLLAVLPAEERLAI

SEQ ID NO: 2731915 - protein, 17 aa, Entamoeba histolytica
EEKRIIGWLNNIYVIEK

SEQ ID NO: 2731916 - protein, 24 aa, Entamoeba histolytica
EEKSEEVIPFRLPPELVQVSVQQE

SEQ ID NO: 2731917 - protein, 25 aa, Entamoeba histolytica
EELIGIRRWLLVDSLLRAKSRTKEE

SEQ ID NO: 2731918 - protein, 18 aa, Entamoeba histolytica
EELWNYVELFASLDLENG

SEQ ID NO: 2731919 - protein, 26 aa, Entamoeba histolytica
EENNLYRLLCWTGKDIWACTKPTNNK

SEQ ID NO: 2731920 - protein, 26 aa, Entamoeba histolytica
EENSYELCIIFILINEGFPENIVREA

SEQ ID NO: 2731921 - protein, 30 aa, Entamoeba histolytica
EEQILHLKFDIGLLLRLILCLSKSLSYDGD

SEQ ID NO: 2731922 - protein, 22 aa, Entamoeba histolytica
EEQIWLHAWKYSFNSHDWIAEI

SEQ ID NO: 2731923 - protein, 24 aa, Entamoeba histolytica
EERSLFCYCPNIVAFPLASVSPRS

SEQ ID NO: 2731924 - protein, 18 aa, Entamoeba histolytica
EETIDLWKKLRERAGIIR

SEQ ID NO: 2731925 - protein, 23 aa, Entamoeba histolytica
EEVTWNFILLIQQNIELQGYAVH

SEQ ID NO: 2731926 - protein, 26 aa, Entamoeba histolytica
EFDSLMTPFIPILRFRILKDIKQLPG

SEQ ID NO: 2731927 - protein, 19 aa, Entamoeba histolytica
EFFDLFKQSSYFKDLTHRL

SEQ ID NO: 2731928 - protein, 23 aa, Entamoeba histolytica
EFGFQLWKLIHKIPIISLNDNAQ

SEQ ID NO: 2731929 - protein, 30 aa, Entamoeba histolytica; identical to SEQ ID NO: 2545096

SEQ ID NO: 2731930 - protein, 19 aa, Entamoeba histolytica
EFLPRRESYFWLLDALDMY

SEQ ID NO: 2731931 - protein, 18 aa, Entamoeba histolytica
EFMDIGCTCTLIYIWEED

SEQ ID NO: 2731932 - protein, 23 aa, Entamoeba histolytica
EFMKLKHMIILQNKIDLVKTKED

SEQ ID NO: 2731933 - protein, 24 aa, Entamoeba histolytica
EGDPPYMEFPPLRALFLITTKGIP

SEQ ID NO: 2731934 - protein, 17 aa, Entamoeba histolytica
EGEFLIFTKRQFKRTRD

SEQ ID NO: 2731935 - protein, 20 aa, Entamoeba histolytica
EGIFFTPRYYGKFKAADALS

SEQ ID NO: 2731936 - protein, 18 aa, Entamoeba histolytica
EGIIILPRRKVLKQLPHM

SEQ ID NO: 2731937 - protein, 22 aa, Entamoeba histolytica
EGKKLFVLEKYPKIVYLQNGSY

SEQ ID NO: 2731938 - protein, 17 aa, Entamoeba histolytica
EGLFKKKLTPPFVPVLK

SEQ ID NO: 2731939 - protein, 20 aa, Entamoeba histolytica
EGLNWLVFNWCRGKGCILAD

SEQ ID NO: 2731940 - protein, 25 aa, Entamoeba histolytica
EGRKFQIPLWLAITLQNYGYVRIIV

SEQ ID NO: 2731941 - protein, 21 aa, Entamoeba histolytica
EHETKWFLMVKTSFSLEVMNC

SEQ ID NO: 2731942 - protein, 20 aa, Entamoeba histolytica
EHLILHFNYLCFLPPAIGSL

SEQ ID NO: 2731943 - protein, 20 aa, Entamoeba histolytica
EHLTNLLTISLILNSYKTTS

SEQ ID NO: 2731944 - protein, 23 aa, Entamoeba histolytica
EHNKPLHFTSRYLYLTLWGDEVG

SEQ ID NO: 2731945 - protein, 21 aa, Entamoeba histolytica
EIDLWLAYSEYATMGLKLQVA

SEQ ID NO: 2731946 - protein, 26 aa, Entamoeba histolytica
EIDPAPFRLWFLKFYGKDIASTDYYK

SEQ ID NO: 2731947 - protein, 22 aa, Entamoeba histolytica
EIHFPYQFIYPEQYQFIKTVTS

SEQ ID NO: 2731948 - protein, 23 aa, Entamoeba histolytica
EIHFPYQFIYPEQYQFIKTVTSG

SEQ ID NO: 2731949 - protein, 22 aa, Entamoeba histolytica
EIICNIFPIYDFWKHVCVVWTM

SEQ ID NO: 2731950 - protein, 25 aa, Entamoeba histolytica
EIITKHIYFFFIKSPLPFISHKLFL

SEQ ID NO: 2731951 - protein, 17 aa, Entamoeba histolytica
EIIYCQVIEPMKIFIEE

SEQ ID NO: 2731952 - protein, 18 aa, Entamoeba histolytica
EILKSILFFIFKEKKEKI

SEQ ID NO: 2731953 - protein, 25 aa, Entamoeba histolytica
EINFFHIELILQYLKILLKHQYYKE

SEQ ID NO: 2731954 - protein, 17 aa, Entamoeba histolytica
EINFFRTIDYYCFDKII

SEQ ID NO: 2731955 - protein, 20 aa, Entamoeba histolytica
EINFVWLYEAYFIHMSFHTE

SEQ ID NO: 2731956 - protein, 19 aa, Entamoeba histolytica
EIRTLLSILSLLCITQKDI

SEQ ID NO: 2731957 - protein, 22 aa, Entamoeba histolytica
EKALKYLFLNGLNKEGLFRLSS

SEQ ID NO: 2731958 - protein, 22 aa, Entamoeba histolytica
EKFENYFIIKDYKFGVLYATEG

SEQ ID NO: 2731959 - protein, 20 aa, Entamoeba histolytica
EKFYIIFRSLLKCLVKNVLC

SEQ ID NO: 2731960 - protein, 26 aa, Entamoeba histolytica
EKGRREYWRIVNNKVRIWDRSGKIEE

SEQ ID NO: 2731961 - protein, 23 aa, Entamoeba histolytica
EKKPVFQLLLYFLVLDIDNENEE

SEQ ID NO: 2731962 - protein, 24 aa, Entamoeba histolytica
EKLPSTCFLGRLRKFILPARLVME

SEQ ID NO: 2731963 - protein, 21 aa, Entamoeba histolytica
EKMMLAFFTIIAQKYLKLKRT

SEQ ID NO: 2731964 - protein, 20 aa, Entamoeba histolytica
EKTCYILLSSYLFITLIKKI

SEQ ID NO: 2731965 - protein, 20 aa, Entamoeba histolytica
EKYFKIIYFINYDSGNYNIH

SEQ ID NO: 2731966 - protein, 18 aa, Entamoeba histolytica
EKYHLLITVLFISYDDFS

SEQ ID NO: 2731967 - protein, 20 aa, Entamoeba histolytica
EKYMKLLEKKGYLKDVPEEE

SEQ ID NO: 2731968 - protein, 31 aa, Entamoeba histolytica; identical to SEQ ID NO: 2545153

SEQ ID NO: 2731969 - protein, 18 aa, Entamoeba histolytica
ELEFPLCFTVFSASLYSL

SEQ ID NO: 2731970 - protein, 25 aa, Entamoeba histolytica
ELFCSYCLPFLFYKQTILVNRDLLM

SEQ ID NO: 2731971 - protein, 19 aa, Entamoeba histolytica
ELFQYCMLIKGTQLKNILV

SEQ ID NO: 2731972 - protein, 17 aa, Entamoeba histolytica
ELFVFLFDKSKTMKQLM

SEQ ID NO: 2731973 - protein, 25 aa, Entamoeba histolytica
ELGDPFYFISDALRFALVPFLDAAK

SEQ ID NO: 2731974 - protein, 21 aa, Entamoeba histolytica
ELHLIFSVFNLLFKIPQNDVN

SEQ ID NO: 2731975 - protein, 17 aa, Entamoeba histolytica
ELIKQICFFLIPSVSLG

SEQ ID NO: 2731976 - protein, 17 aa, Entamoeba histolytica
ELILRIFKKPYLTFGDK

SEQ ID NO: 2731977 - protein, 18 aa, Entamoeba histolytica
ELINGIMLLFLSFSNPEI

SEQ ID NO: 2731978 - protein, 17 aa, Entamoeba histolytica
ELKILHIFSSKGTFTCI

SEQ ID NO: 2731979 - protein, 23 aa, Entamoeba histolytica
ELLVRTLIPSLLYRVLCSPTPDI

SEQ ID NO: 2731980 - protein, 20 aa, Entamoeba histolytica
ELNLLLIDILNMLGYTFTTT

SEQ ID NO: 2731981 - protein, 23 aa, Entamoeba histolytica
ELPVFHIGFFRPIIQVLQCVCKN

SEQ ID NO: 2731982 - protein, 23 aa, Entamoeba histolytica
ELRDLLIYLLVHSSPIFPEIYNN

SEQ ID NO: 2731983 - protein, 25 aa, Entamoeba histolytica
ELRKKLLYLFYKIIKPTATENYVTV

SEQ ID NO: 2731984 - protein, 26 aa, Entamoeba histolytica
ELRTESIWKFLIPFTSRILDCLEDED

SEQ ID NO: 2731985 - protein, 18 aa, Entamoeba histolytica
EMERWYNYLIYRIEKMEI

SEQ ID NO: 2731986 - protein, 21 aa, Entamoeba histolytica
ENALFLFRWMSLLLTEELPIN

SEQ ID NO: 2731987 - protein, 23 aa, Entamoeba histolytica
ENDLIRLFYIYLLNSNESNVLQK

SEQ ID NO: 2731988 - protein, 17 aa, Entamoeba histolytica
ENFYRWFLPVKNVISGI

SEQ ID NO: 2731989 - protein, 25 aa, Entamoeba histolytica
ENGPKLYYWCIFKPKNKDPKPGILE

SEQ ID NO: 2731990 - protein, 23 aa, Entamoeba histolytica
ENKIEWKLLVKKAEKWLATKLPL

SEQ ID NO: 2731991 - protein, 25 aa, Entamoeba histolytica
ENLPSTWVAFFKKAGIRKKDLSDKE

SEQ ID NO: 2731992 - protein, 17 aa, Entamoeba histolytica
ENPPYFYYMYYTYANIA

SEQ ID NO: 2731993 - protein, 17 aa, Entamoeba histolytica
ENYHITEYLALGATLAV

SEQ ID NO: 2731994 - protein, 23 aa, Entamoeba histolytica
EPDKFIPNLYKLTPPLSLPIDTL

SEQ ID NO: 2731995 - protein, 21 aa, Entamoeba histolytica
EPFWLNIYHTMLLHGLIYMKH

SEQ ID NO: 2731996 - protein, 20 aa, Entamoeba histolytica
EPLVLQLKAFLEKHDLDVSV

SEQ ID NO: 2731997 - protein, 20 aa, Entamoeba histolytica
EPPFAYWIYYVYTNVHVLNN

SEQ ID NO: 2731998 - protein, 21 aa, Entamoeba histolytica
EPPFVYILLGWLTHLIVMNPS

SEQ ID NO: 2731999 - protein, 18 aa, Entamoeba histolytica
EPRFIFEGEIFLAAGEKA

SEQ ID NO: 2732000 - protein, 22 aa, Entamoeba histolytica
EQELFLMQYPTRLAWRPFDLSQ

SEQ ID NO: 2732001 - protein, 21 aa, Entamoeba histolytica
EQIWLHAWKYSFNSHDWIAEI

SEQ ID NO: 2732002 - protein, 19 aa, Entamoeba histolytica
EQKTKLRDLFRKHGANWKM

SEQ ID NO: 2732003 - protein, 24 aa, Entamoeba histolytica
EQTEWVYLYLQLLRKIFKYNPRIG

SEQ ID NO: 2732004 - protein, 27 aa, Entamoeba histolytica
EQYKAIIFIGPVWWWGLNAPIKNACNE

SEQ ID NO: 2732005 - protein, 17 aa, Entamoeba histolytica
EQYLLKYLPLYTSLAAS

SEQ ID NO: 2732006 - protein, 24 aa, Entamoeba histolytica
ERIIKIFLIRWENNFHYVPDEKVP

SEQ ID NO: 2732007 - protein, 26 aa, Entamoeba histolytica
ERRYIPELIGWIRKGYLIVKDSKRKK

SEQ ID NO: 2732008 - protein, 22 aa, Entamoeba histolytica
ERVMLFVIRILTNLLAFQQFQT

SEQ ID NO: 2732009 - protein, 23 aa, Entamoeba histolytica
ESALKLWYYFYSLLSDINEHPKD

SEQ ID NO: 2732010 - protein, 25 aa, Entamoeba histolytica
ESIIQLILLILFKASNEINLIKIHG

SEQ ID NO: 2732011 - protein, 24 aa, Entamoeba histolytica
ESIKYIYELILSPPLSDRFTTFME

SEQ ID NO: 2732012 - protein, 23 aa, Entamoeba histolytica
ESKIKDIFLLMKRMLINLDMDQI

SEQ ID NO: 2732013 - protein, 21 aa, Entamoeba histolytica
ESKLLLYHSFFLSLPPESIHY

SEQ ID NO: 2732014 - protein, 20 aa, Entamoeba histolytica
ESKWNIIRIIIYNKSLKSST

SEQ ID NO: 2732015 - protein, 22 aa, Entamoeba histolytica
ESLIILHILNYLLLWNKINNET

SEQ ID NO: 2732016 - protein, 26 aa, Entamoeba histolytica
ESNPLLQFRLYQLLFKLLSEKKYPID

SEQ ID NO: 2732017 - protein, 23 aa, Entamoeba histolytica
ESRGFGYLDFFNVNEAQRCIDEM

SEQ ID NO: 2732018 - protein, 24 aa, Entamoeba histolytica
ESRNRLIILLPWLEQRLSEGSPDV

SEQ ID NO: 2732019 - protein, 23 aa, Entamoeba histolytica
ESSNTLIPILPFISKTFSKTLSI

SEQ ID NO: 2732020 - protein, 22 aa, Entamoeba histolytica
ESTFKRILPYALLKYLEEEEEP

SEQ ID NO: 2732021 - protein, 22 aa, Entamoeba histolytica
ESTPLMIYLCKLKKILSELPIA

SEQ ID NO: 2732022 - protein, 26 aa, Entamoeba histolytica
ETKDEKKLWLPPRKRISTYITEDQKK

SEQ ID NO: 2732023 - protein, 31 aa, Entamoeba histolytica
ETKKHLYKIKWFLPSLRELFRKNNRRYSKKR

SEQ ID NO: 2732024 - protein, 23 aa, Entamoeba histolytica
ETKVWQYITLLKNIYLIDCPGVV

SEQ ID NO: 2732025 - protein, 18 aa, Entamoeba histolytica
ETLKLLIHYLRLIADASA

SEQ ID NO: 2732026 - protein, 17 aa, Entamoeba histolytica
ETLLKLIKFFSVENKYL

SEQ ID NO: 2732027 - protein, 18 aa, Entamoeba histolytica
ETLPFLIQFIPLFFERCL

SEQ ID NO: 2732028 - protein, 26 aa, Entamoeba histolytica
ETSAPWLQILLFRLLSTIDLETTTQK

SEQ ID NO: 2732029 - protein, 26 aa, Entamoeba histolytica
EVDFNDYLLPIFPLSSIQKGKLLHGY

SEQ ID NO: 2732030 - protein, 21 aa, Entamoeba histolytica
EVFIRFFPIIPLKNTKTQRDW

SEQ ID NO: 2732031 - protein, 25 aa, Entamoeba histolytica
EVGLNRLYHLIANNLDLMIQVQHTR

SEQ ID NO: 2732032 - protein, 20 aa, Entamoeba histolytica
EVIIFPYIHYYNLNDFLLIK

SEQ ID NO: 2732033 - protein, 17 aa, Entamoeba histolytica
EVIIPLDDLLPFAAMKM

SEQ ID NO: 2732034 - protein, 24 aa, Entamoeba histolytica
EVITLLLLYKLKYPQSIFLLRGNH

SEQ ID NO: 2732035 - protein, 18 aa, Entamoeba histolytica
EVLFYLLAQKLMNPKKFF

SEQ ID NO: 2732036 - protein, 22 aa, Entamoeba histolytica
EVPRIMVCVLYPKIIKIDAAFI

SEQ ID NO: 2732037 - protein, 18 aa, Entamoeba histolytica
EVQWLPWHNEHVLDKFIM

SEQ ID NO: 2732038 - protein, 25 aa, Entamoeba histolytica
EVTDNMLFIKNLPFAITEEKLKEMF

SEQ ID NO: 2732039 - protein, 20 aa, Entamoeba histolytica
EWKLCLLFNDILLIAKIDVT

SEQ ID NO: 2732040 - protein, 18 aa, Entamoeba histolytica
EWLYYRGIYQKRLKDREL

SEQ ID NO: 2732041 - protein, 20 aa, Entamoeba histolytica
EWVYYLFILIKNILKKYPSL

SEQ ID NO: 2732042 - protein, 25 aa, Entamoeba histolytica
EYDRLRPLSYPSTDIFLICYSIMSK

SEQ ID NO: 2732043 - protein, 23 aa, Entamoeba histolytica
EYERIRFLFLTSALLKAVDEHYD

SEQ ID NO: 2732044 - protein, 22 aa, Entamoeba histolytica
EYKTKILFIFETKSGVVGFYQE

SEQ ID NO: 2732045 - protein, 17 aa, Entamoeba histolytica
EYLKVQTPLFFVDYFRV

SEQ ID NO: 2732046 - protein, 22 aa, Entamoeba histolytica
EYSQYHFLTPDKAFHQKESQVV

SEQ ID NO: 2732047 - protein, 30 aa, Entamoeba histolytica
FAALFVPDEPIRFLPPVEKHWFPNYSGVSS

SEQ ID NO: 2732048 - protein, 17 aa, Entamoeba histolytica
FAFPIYYFNMPGPIKTL

SEQ ID NO: 2732049 - protein, 18 aa, Entamoeba histolytica
FAKQKSIPIIYLISLYNP

SEQ ID NO: 2732050 - protein, 17 aa, Entamoeba histolytica
FATPFFLLKKAFECCVI

SEQ ID NO: 2732051 - protein, 27 aa, Entamoeba histolytica
FAVTMLHILMWNAPYQGSLFKYPWSIA

SEQ ID NO: 2732052 - protein, 19 aa, Entamoeba histolytica
FCQQFPLLPPIFCVGTKSD

SEQ ID NO: 2732053 - protein, 27 aa, Entamoeba histolytica
FCSRNIITLLFIKYKVIEGLLQFVIQT

SEQ ID NO: 2732054 - protein, 17 aa, Entamoeba histolytica
FCYFIDSKTLFDVWNDE

SEQ ID NO: 2732055 - protein, 21 aa, Entamoeba histolytica
FDAIIISHWDADHYKGLLNTG

SEQ ID NO: 2732056 - protein, 19 aa, Entamoeba histolytica
FDCDSVVVELPYVRRIYGV

SEQ ID NO: 2732057 - protein, 24 aa, Entamoeba histolytica
FDCQIPVIHLLFPIALKYSLIQSS

SEQ ID NO: 2732058 - protein, 19 aa, Entamoeba histolytica
FDFSKFRVLLYITSSYQPL

SEQ ID NO: 2732059 - protein, 23 aa, Entamoeba histolytica
FDKLYLLLEALLSFIYPHFADQA

SEQ ID NO: 2732060 - protein, 17 aa, Entamoeba histolytica
FDKSQFLLLFPSDIKIT

SEQ ID NO: 2732061 - protein, 24 aa, Entamoeba histolytica
FDSLRPLSYPGTDIFLLCFAVIYE

SEQ ID NO: 2732062 - protein, 25 aa, Entamoeba histolytica
FEAENFEYILLFYKALNKCSNSNEL

SEQ ID NO: 2732063 - protein, 18 aa, Entamoeba histolytica
FEDRYDLLNYCMNTNSEP

SEQ ID NO: 2732064 - protein, 18 aa, Entamoeba histolytica
FEFFIKDYEIIYKLFNFR

SEQ ID NO: 2732065 - protein, 19 aa, Entamoeba histolytica
FEHKYDSLKLNMKKVPFID

SEQ ID NO: 2732066 - protein, 18 aa, Entamoeba histolytica
FEIPTLKLPIMFNSTDNR

SEQ ID NO: 2732067 - protein, 23 aa, Entamoeba histolytica
FETQDLYLCLIWILKNVNREVLK

SEQ ID NO: 2732068 - protein, 24 aa, Entamoeba histolytica
FETYVQYLPFIYKLNFIQKDNIFD

SEQ ID NO: 2732069 - protein, 19 aa, Entamoeba histolytica
FFERMYCMFYPLDEQARCV

SEQ ID NO: 2732070 - protein, 18 aa, Entamoeba histolytica
FFFHLKKLKIGYSTYFDF

SEQ ID NO: 2732071 - protein, 18 aa, Entamoeba histolytica
FFIVYRNFLINHNKAFTL

SEQ ID NO: 2732072 - protein, 20 aa, Entamoeba histolytica
FFKQFFYLQRLPSGLRRFIL

SEQ ID NO: 2732073 - protein, 17 aa, Entamoeba histolytica
FFKVFLYPIIRHSIHQN

SEQ ID NO: 2732074 - protein, 18 aa, Entamoeba histolytica
FFLFTYNNNTQQIIHRKK

SEQ ID NO: 2732075 - protein, 17 aa, Entamoeba histolytica
FFLLPDQSICYLLLQKI

SEQ ID NO: 2732076 - protein, 18 aa, Entamoeba histolytica
FFLVEVMLSYLYPNFAEE

SEQ ID NO: 2732077 - protein, 19 aa, Entamoeba histolytica
FFRISNLFWMTYRSGYEKL

SEQ ID NO: 2732078 - protein, 18 aa, Entamoeba histolytica
FFRQLYKNKVTFPSLFLF

SEQ ID NO: 2732079 - protein, 21 aa, Entamoeba histolytica
FFTLSFLILSYTIQVTPEHLN

SEQ ID NO: 2732080 - protein, 22 aa, Entamoeba histolytica
FFTQYLYFNYLPVRITATETIL

SEQ ID NO: 2732081 - protein, 24 aa, Entamoeba histolytica
FGATPTFWYSLYQEFLFETKGLKE

SEQ ID NO: 2732082 - protein, 21 aa, Entamoeba histolytica
FGDLWVEFLLRESGSLDAQQP

SEQ ID NO: 2732083 - protein, 21 aa, Entamoeba histolytica
FGFPLQFKIPLAFSLSIVANI

SEQ ID NO: 2732084 - protein, 18 aa, Entamoeba histolytica
FGIFMYEILYGRTPFFSR

SEQ ID NO: 2732085 - protein, 17 aa, Entamoeba histolytica
FGIWLKKLQIVLTEDSK

SEQ ID NO: 2732086 - protein, 17 aa, Entamoeba histolytica
FGKFCLWFSYVCDFLMI

SEQ ID NO: 2732087 - protein, 19 aa, Entamoeba histolytica
FHCWGYYLWVLEQGKISQE

SEQ ID NO: 2732088 - protein, 19 aa, Entamoeba histolytica
FHFDLFIRDWKKYYPMKTL

SEQ ID NO: 2732089 - protein, 22 aa, Entamoeba histolytica
FHIDFYVRMFILVKSSVALSGE

SEQ ID NO: 2732090 - protein, 17 aa, Entamoeba histolytica
FHNLSYYVLDTLIQEPE

SEQ ID NO: 2732091 - protein, 20 aa, Entamoeba histolytica
FHPRDLLMLIWDKLKEDGDR

SEQ ID NO: 2732092 - protein, 17 aa, Entamoeba histolytica
FHYLQPYSNFISLIDFG

SEQ ID NO: 2732093 - protein, 19 aa, Entamoeba histolytica
FIAYYTLFVKPVFEIYQKT

SEQ ID NO: 2732094 - protein, 18 aa, Entamoeba histolytica
FIENLWQFDISNLVWRKL

SEQ ID NO: 2732095 - protein, 17 aa, Entamoeba histolytica
FIFMIYRMIDLYSNQKN

SEQ ID NO: 2732096 - protein, 17 aa, Entamoeba histolytica
FIFSLKKSIFKPMKWNP

SEQ ID NO: 2732097 - protein, 18 aa, Entamoeba histolytica
FIIDMYFPSKIILTGITQ

SEQ ID NO: 2732098 - protein, 17 aa, Entamoeba histolytica
FIIGKLGYDLYIIDQHA

SEQ ID NO: 2732099 - protein, 19 aa, Entamoeba histolytica
FILFIKYYFNHVLQLEINE

SEQ ID NO: 2732100 - protein, 20 aa, Entamoeba histolytica
FINLLKFKIVLKREWLFDEI

SEQ ID NO: 2732101 - protein, 17 aa, Entamoeba histolytica
FIPLLLDENYRISGIVN

SEQ ID NO: 2732102 - protein, 19 aa, Entamoeba histolytica
FIRFYNFYLFFYCNEYLTK

SEQ ID NO: 2732103 - protein, 17 aa, Entamoeba histolytica
FIRQLFHFSIYSIFEGI

SEQ ID NO: 2732104 - protein, 19 aa, Entamoeba histolytica
FISFKILTLLYPQPIWNLT

SEQ ID NO: 2732105 - protein, 18 aa, Entamoeba histolytica
FISYEPWLNKLSKSKSNI

SEQ ID NO: 2732106 - protein, 18 aa, Entamoeba histolytica
FITSLQPCFPRHLSLLFP

SEQ ID NO: 2732107 - protein, 17 aa, Entamoeba histolytica
FIYMYQWFKSFVNESER

SEQ ID NO: 2732108 - protein, 21 aa, Entamoeba histolytica
FKGFDWEGLFKKKLTPPFVPV

SEQ ID NO: 2732109 - protein, 25 aa, Entamoeba histolytica
FKKIAFIEFLLYKYNQTIKELMARP

SEQ ID NO: 2732110 - protein, 17 aa, Entamoeba histolytica
FKLLLIGDSGVGKSCLL

SEQ ID NO: 2732111 - protein, 29 aa, Entamoeba histolytica
FKPYEEIKIQLFIESVRRKVYFTTTTLLM

SEQ ID NO: 2732112 - protein, 23 aa, Entamoeba histolytica
FKTVYVILKDNFFFLYKSANESS

SEQ ID NO: 2732113 - protein, 17 aa, Entamoeba histolytica
FKYFEPTFIYILHALHE

SEQ ID NO: 2732114 - protein, 17 aa, Entamoeba histolytica
FKYVIWYDVSYSRYLKE

SEQ ID NO: 2732115 - protein, 17 aa, Entamoeba histolytica
FLDYLLDKQFNSLAYFW

SEQ ID NO: 2732116 - protein, 22 aa, Entamoeba histolytica
FLFEWYMVWFCRILPCDFCYAI

SEQ ID NO: 2732117 - protein, 18 aa, Entamoeba histolytica
FLIGLLATFGYELKINKL

SEQ ID NO: 2732118 - protein, 18 aa, Entamoeba histolytica
FLIYLLKKGTNLKTTNPN

SEQ ID NO: 2732119 - protein, 21 aa, Entamoeba histolytica
FLLIHHQPFPLLKITDFGFGR

SEQ ID NO: 2732120 - protein, 20 aa, Entamoeba histolytica
FLMVFSKFLHLLSASYLHPN

SEQ ID NO: 2732121 - protein, 17 aa, Entamoeba histolytica
FLRFHCCLLLLDYFGYI

SEQ ID NO: 2732122 - protein, 18 aa, Entamoeba histolytica
FLTFLKICNYLLTSPLYS

SEQ ID NO: 2732123 - protein, 23 aa, Entamoeba histolytica
FMDNFMMPIYLHDSLLRAQKFSA

SEQ ID NO: 2732124 - protein, 17 aa, Entamoeba histolytica
FMEIWMDYKDIPYLVMC

SEQ ID NO: 2732125 - protein, 18 aa, Entamoeba histolytica
FMHFFDGFRTSHEIQKIH

SEQ ID NO: 2732126 - protein, 18 aa, Entamoeba histolytica
FMKYLRQQPNWNIKVETK

SEQ ID NO: 2732127 - protein, 18 aa, Entamoeba histolytica
FMLLYEFLSNLSPKQLDI

SEQ ID NO: 2732128 - protein, 23 aa, Entamoeba histolytica
FNTNRFFLITKELTYLVACESME

SEQ ID NO: 2732129 - protein, 19 aa, Entamoeba histolytica
FNVYFFLNVIIENGFTIVP

SEQ ID NO: 2732130 - protein, 17 aa, Entamoeba histolytica
FPFIMYGAKATLPTGAG

SEQ ID NO: 2732131 - protein, 19 aa, Entamoeba histolytica
FPIVIQENRFWYFKDSQGV

SEQ ID NO: 2732132 - protein, 19 aa, Entamoeba histolytica
FPKIPILSLWMHDIVNINE

SEQ ID NO: 2732133 - protein, 17 aa, Entamoeba histolytica
FPKYIHLLILLIRTRSR

SEQ ID NO: 2732134 - protein, 19 aa, Entamoeba histolytica
FPKYLLIKLERQIALSYED

SEQ ID NO: 2732135 - protein, 18 aa, Entamoeba histolytica
FPTAFHIAGLWKIDRLIA

SEQ ID NO: 2732136 - protein, 19 aa, Entamoeba histolytica
FPVFDFWKHVCIVWTKCFY

SEQ ID NO: 2732137 - protein, 26 aa, Entamoeba histolytica
FPVIIKWIYELTPWEILIFPQGVHRI

SEQ ID NO: 2732138 - protein, 26 aa, Entamoeba histolytica
FPYYLEASYPFWILRLVWKKQNKSFN

SEQ ID NO: 2732139 - protein, 17 aa, Entamoeba histolytica
FQDILKAFDQMFKKRVY

SEQ ID NO: 2732140 - protein, 24 aa, Entamoeba histolytica
FQEQAIWMLNAMWPKDQGANAEEL

SEQ ID NO: 2732141 - protein, 24 aa, Entamoeba histolytica
FQEQAIWMLNAMWPKDQGKSAEEL

SEQ ID NO: 2732142 - protein, 20 aa, Entamoeba histolytica
FQFKTLPVQVLLKLQQRKLD

SEQ ID NO: 2732143 - protein, 22 aa, Entamoeba histolytica
FQGFVIQFKFNNGLYLPACEYA

SEQ ID NO: 2732144 - protein, 17 aa, Entamoeba histolytica
FQKIWYRKVLMGDVTVI

SEQ ID NO: 2732145 - protein, 24 aa, Entamoeba histolytica
FQQNPHFFNAPSIPYLPTTAEKHL

SEQ ID NO: 2732146 - protein, 23 aa, Entamoeba histolytica
FQTKEFLIILPFLSSLNTITNIC

SEQ ID NO: 2732147 - protein, 20 aa, Entamoeba histolytica
FQTLQYWTGFNHIQIIYDSN

SEQ ID NO: 2732148 - protein, 18 aa, Entamoeba histolytica
FQTVVIPQSYRNKTFQCS

SEQ ID NO: 2732149 - protein, 18 aa, Entamoeba histolytica
FQYNCYGLYFAHCMALPQ

SEQ ID NO: 2732150 - protein, 21 aa, Entamoeba histolytica
FRGFRMLLTICYDTRFPMFVR

SEQ ID NO: 2732151 - protein, 21 aa, Entamoeba histolytica
FRIDIILNHILFTGTLGVLSS

SEQ ID NO: 2732152 - protein, 17 aa, Entamoeba histolytica
FRKVIFIDPNYGDAWIW

SEQ ID NO: 2732153 - protein, 17 aa, Entamoeba histolytica
FRQSVLELLLWCNEKNL

SEQ ID NO: 2732154 - protein, 30 aa, Entamoeba histolytica
FSEPFIMVVLKFIRLIYKSTPQFKSKYIEI

SEQ ID NO: 2732155 - protein, 18 aa, Entamoeba histolytica
FSILFRLSIFPFHFNFYN

SEQ ID NO: 2732156 - protein, 20 aa, Entamoeba histolytica
FSILPQFMYHLRRSHFLQVF

SEQ ID NO: 2732157 - protein, 30 aa, Entamoeba histolytica
FSKPIPHDFPFPPIFPLYQPSLRSQISAKY

SEQ ID NO: 2732158 - protein, 17 aa, Entamoeba histolytica
FSSLYQLIFHPIKFFTP

SEQ ID NO: 2732159 - protein, 19 aa, Entamoeba histolytica
FSTIYLFNFPEMDLSPFIL

SEQ ID NO: 2732160 - protein, 26 aa, Entamoeba histolytica
FSTLMFLRYLFVPFLKHPYILKSLQK

SEQ ID NO: 2732161 - protein, 19 aa, Entamoeba histolytica
FTCTYATRFLGFKPSAAPM

SEQ ID NO: 2732162 - protein, 24 aa, Entamoeba histolytica
FTETTICLLFPSPFFQLTPNQIDE

SEQ ID NO: 2732163 - protein, 18 aa, Entamoeba histolytica
FTICALLCSLFKFYHKLT

SEQ ID NO: 2732164 - protein, 29 aa, Entamoeba histolytica
FTPIIDECYPLWFYKSTPSLFCVQSFCHI

SEQ ID NO: 2732165 - protein, 29 aa, Entamoeba histolytica
FTTQYIEMILFYIQVFRTPTLTKFFKIVI

SEQ ID NO: 2732166 - protein, 18 aa, Entamoeba histolytica
FVCVAIAGWILSAKIPEI

SEQ ID NO: 2732167 - protein, 20 aa, Entamoeba histolytica
FVDPLHWLQYFPPLGVEDLK

SEQ ID NO: 2732168 - protein, 24 aa, Entamoeba histolytica
FVFVYQWLILLFKREFSLTNIFRI

SEQ ID NO: 2732169 - protein, 17 aa, Entamoeba histolytica
FVILSYDPLFLSNNRPN

SEQ ID NO: 2732170 - protein, 19 aa, Entamoeba histolytica
FVIQYYGLILDILLLGPRR

SEQ ID NO: 2732171 - protein, 18 aa, Entamoeba histolytica
FVQLTPFQKIWYRKVLMG

SEQ ID NO: 2732172 - protein, 18 aa, Entamoeba histolytica
FVSIFPFYNGTYIFNASD

SEQ ID NO: 2732173 - protein, 19 aa, Entamoeba histolytica
FWEIARMYDFYLLRLLIRH

SEQ ID NO: 2732174 - protein, 18 aa, Entamoeba histolytica
FYYFGWNSWNGWIPAWCV

SEQ ID NO: 2732175 - protein, 17 aa, Entamoeba histolytica
GAPLPIEFKWKIPITKK

SEQ ID NO: 2732176 - protein, 17 aa, Entamoeba histolytica
GCQKIFHFCSFDVILKV

SEQ ID NO: 2732177 - protein, 23 aa, Entamoeba histolytica
GDAKWKVEQLLNNQWKKLELEIN

SEQ ID NO: 2732178 - protein, 23 aa, Entamoeba histolytica
GDKLLINWFKIRSIGNLVKEIMV

SEQ ID NO: 2732179 - protein, 20 aa, Entamoeba histolytica
GDMIDLLRKDGLWWFGELNG

SEQ ID NO: 2732180 - protein, 21 aa, Entamoeba histolytica
GDQLYDYILSLGLYDEDLTGR

SEQ ID NO: 2732181 - protein, 23 aa, Entamoeba histolytica
GDTLTYILLSWIIKGIPLEHAVN

SEQ ID NO: 2732182 - protein, 22 aa, Entamoeba histolytica
GECCFFWCYSLRTINIPTSVNE

SEQ ID NO: 2732183 - protein, 20 aa, Entamoeba histolytica
GEEYPMITFILIAFKMVQCN

SEQ ID NO: 2732184 - protein, 20 aa, Entamoeba histolytica
GEIQQFLSLIFFIGQKSGTK

SEQ ID NO: 2732185 - protein, 25 aa, Entamoeba histolytica
GESKKFFGLIPYWIAQLIEIENNIQ

SEQ ID NO: 2732186 - protein, 17 aa, Entamoeba histolytica
GEWKDIIIPFKLKVFFY

SEQ ID NO: 2732187 - protein, 25 aa, Entamoeba histolytica
GFFGNLYQMIFHPIEYFTPKETKLG

SEQ ID NO: 2732188 - protein, 20 aa, Entamoeba histolytica
GFMHPYSYGLFYPKQFENAK

SEQ ID NO: 2732189 - protein, 20 aa, Entamoeba histolytica
GFNLDLCEFIFWGMVRYCTD

SEQ ID NO: 2732190 - protein, 18 aa, Entamoeba histolytica
GFSLIRLLAEPSAAAYAY

SEQ ID NO: 2732191 - protein, 19 aa, Entamoeba histolytica
GFVFLRLFCPALAAPEGSN

SEQ ID NO: 2732192 - protein, 31 aa, Entamoeba histolytica; identical to SEQ ID NO: 2545451

SEQ ID NO: 2732193 - protein, 20 aa, Entamoeba histolytica
GGLYFRLAIPILFNRNIFNN

SEQ ID NO: 2732194 - protein, 20 aa, Entamoeba histolytica
GHCELLYFGFLKPVDIEKFK

SEQ ID NO: 2732195 - protein, 24 aa, Entamoeba histolytica
GHVPKLMCPLFYLGFCPYGKKCKF

SEQ ID NO: 2732196 - protein, 19 aa, Entamoeba histolytica
GIIGWIISYFLPCKETLYN

SEQ ID NO: 2732197 - protein, 22 aa, Entamoeba histolytica
GIIIPIFLIRWNKSPHYIFNEK

SEQ ID NO: 2732198 - protein, 19 aa, Entamoeba histolytica
GIIKSFIPSLQQWTGMQKY

SEQ ID NO: 2732199 - protein, 19 aa, Entamoeba histolytica
GIILFRLYSLIIRMLFIQK

SEQ ID NO: 2732200 - protein, 19 aa, Entamoeba histolytica
GIITVRIFNIPFTWKEHDV

SEQ ID NO: 2732201 - protein, 18 aa, Entamoeba histolytica
GILLLLFGGVHKTTKEGI

SEQ ID NO: 2732202 - protein, 27 aa, Entamoeba histolytica
GIPGFPVNFLQYFQLFPSVFNTSMNRQ

SEQ ID NO: 2732203 - protein, 18 aa, Entamoeba histolytica
GIPVFWFQVLKNSMLFDS

SEQ ID NO: 2732204 - protein, 19 aa, Entamoeba histolytica
GIPYMFPIPYKDESSYLIY

SEQ ID NO: 2732205 - protein, 24 aa, Entamoeba histolytica
GITPILLKWDFPTPRVLPLIDSLE

SEQ ID NO: 2732206 - protein, 21 aa, Entamoeba histolytica
GIVLINFFELISKKILRERYN

SEQ ID NO: 2732207 - protein, 17 aa, Entamoeba histolytica
GIYAYELFNFYGVKRII

SEQ ID NO: 2732208 - protein, 19 aa, Entamoeba histolytica
GIYMGWLARLAIRELIEKK

SEQ ID NO: 2732209 - protein, 22 aa, Entamoeba histolytica
GKENLCFELFYDKVYTFCCPSQ

SEQ ID NO: 2732210 - protein, 28 aa, Entamoeba histolytica
GKEQYNFLNKILFKLNLNKQSKTFDAII

SEQ ID NO: 2732211 - protein, 23 aa, Entamoeba histolytica
GKIFKYVIWYKVSYSRYLEEKEE

SEQ ID NO: 2732212 - protein, 22 aa, Entamoeba histolytica
GKIFKYVIWYKVSYSRYLKEKE

SEQ ID NO: 2732213 - protein, 18 aa, Entamoeba histolytica
GKLVLLDKLLPKLYADHH

SEQ ID NO: 2732214 - protein, 25 aa, Entamoeba histolytica
GKMKRRFFYLLQFNRELIYYKQQQV

SEQ ID NO: 2732215 - protein, 23 aa, Entamoeba histolytica
GKTLAYTLPLLKLINPLFNHIQV

SEQ ID NO: 2732216 - protein, 23 aa, Entamoeba histolytica
GKYKYEMILAGIYYIILDLINQY

SEQ ID NO: 2732217 - protein, 18 aa, Entamoeba histolytica
GLFHVKFWIILTKTCFAI

SEQ ID NO: 2732218 - protein, 23 aa, Entamoeba histolytica
GLKKPYWSLVYRIARKKGLMWDK

SEQ ID NO: 2732219 - protein, 23 aa, Entamoeba histolytica
GLKSTIILITYMQSFQNFIPPHT

SEQ ID NO: 2732220 - protein, 20 aa, Entamoeba histolytica
GLLKRYFYLMKEPSYIDWKL

SEQ ID NO: 2732221 - protein, 24 aa, Entamoeba histolytica
GLRQKIIFYLWTPEGCKIREKMLY

SEQ ID NO: 2732222 - protein, 18 aa, Entamoeba histolytica
GMCFFWHSKVDLPFRVVI

SEQ ID NO: 2732223 - protein, 19 aa, Entamoeba histolytica
GMCQSLLLRIIFLTERISI

SEQ ID NO: 2732224 - protein, 18 aa, Entamoeba histolytica
GMDKAYWVGIYKSALTSV

SEQ ID NO: 2732225 - protein, 24 aa, Entamoeba histolytica
GMPMGGIRMGIPVGFNPASVQLKA

SEQ ID NO: 2732226 - protein, 24 aa, Entamoeba histolytica
GNEIRFILRILKGVFRIGFTDRSL

SEQ ID NO: 2732227 - protein, 19 aa, Entamoeba histolytica
GNELLLTELLFSGVFSTLN

SEQ ID NO: 2732228 - protein, 21 aa, Entamoeba histolytica
GNFDIIYSSPLHRALITAQKI

SEQ ID NO: 2732229 - protein, 23 aa, Entamoeba histolytica
GNFYLSLLFLKYAQLFTPQYGDI

SEQ ID NO: 2732230 - protein, 23 aa, Entamoeba histolytica
GNLISISPFWHWNFALDLHEVSI

SEQ ID NO: 2732231 - protein, 24 aa, Entamoeba histolytica
GNVLKKYLNLMPNKLPISLQTVDV

SEQ ID NO: 2732232 - protein, 28 aa, Entamoeba histolytica
GQIFKLFTPFFKVYFLYISHYDDSNQVL

SEQ ID NO: 2732233 - protein, 31 aa, Entamoeba histolytica; identical to SEQ ID NO: 2545505

SEQ ID NO: 2732234 - protein, 23 aa, Entamoeba histolytica
GQYTLNFFIQPFLHWPDTMMTVI

SEQ ID NO: 2732235 - protein, 20 aa, Entamoeba histolytica
GRELTLKEQWYKVKYDYINI

SEQ ID NO: 2732236 - protein, 23 aa, Entamoeba histolytica
GRIFKYVIWYKVSYSRYLEEKEK

SEQ ID NO: 2732237 - protein, 20 aa, Entamoeba histolytica
GRIIRIILPVEIDSIKKTIE

SEQ ID NO: 2732238 - protein, 20 aa, Entamoeba histolytica
GRKVNMFWSLRDYKLRTQSE

SEQ ID NO: 2732239 - protein, 24 aa, Entamoeba histolytica
GRSNILIIVLTTKGYVFGSFSSIQ

SEQ ID NO: 2732240 - protein, 21 aa, Entamoeba histolytica
GRTEAYFPYKIPTRTIYGGKN

SEQ ID NO: 2732241 - protein, 26 aa, Entamoeba histolytica
GSKVYWKWFLALDEIPRRSGAREAPS

SEQ ID NO: 2732242 - protein, 22 aa, Entamoeba histolytica
GSLFIYLFRLMLATGIPELKNE

SEQ ID NO: 2732243 - protein, 30 aa, Entamoeba histolytica
GSPLLLFKAWMLRWWKIMYLRLLDLQKWKV

SEQ ID NO: 2732244 - protein, 21 aa, Entamoeba histolytica
GTAFKNGFWYLLEKSGIIFDK

SEQ ID NO: 2732245 - protein, 19 aa, Entamoeba histolytica
GTILFNGKYYIASPTKLYL

SEQ ID NO: 2732246 - protein, 25 aa, Entamoeba histolytica
GTNCIKLLQIVYGATFKKLAAEQEK

SEQ ID NO: 2732247 - protein, 31 aa, Entamoeba histolytica; identical to SEQ ID NO: 2545523

SEQ ID NO: 2732248 - protein, 24 aa, Entamoeba histolytica
GTVPIPAILKPIPKWTGKQVFTQI

SEQ ID NO: 2732249 - protein, 25 aa, Entamoeba histolytica
GTYEFPFSFILPHDLPPASYFGPKG

SEQ ID NO: 2732250 - protein, 26 aa, Entamoeba histolytica
GVFKGKLLLVWKWTPSVILNIECKEE

SEQ ID NO: 2732251 - protein, 20 aa, Entamoeba histolytica
GVIPFLFEKLQKKKSFFLMS

SEQ ID NO: 2732252 - protein, 25 aa, Entamoeba histolytica
GVPGGQPLFGGFNPATFKLKKTTVK

SEQ ID NO: 2732253 - protein, 23 aa, Entamoeba histolytica
GVVHFLDLYYDYTKQLLGGVEAS

SEQ ID NO: 2732254 - protein, 20 aa, Entamoeba histolytica
GYPKTAPLMKYLVTLHVLFG

SEQ ID NO: 2732255 - protein, 19 aa, Entamoeba histolytica
GYQFCWLCGVKYSSDHWTN

SEQ ID NO: 2732256 - protein, 20 aa, Entamoeba histolytica
GYRIYTLEELGLDKNKFGGN

SEQ ID NO: 2732257 - protein, 25 aa, Entamoeba histolytica
GYSFMYKWLILLFRRDFVSEKCIRL

SEQ ID NO: 2732258 - protein, 23 aa, Entamoeba histolytica
GYTIKFYYSGMFMEGLMSEIIDN

SEQ ID NO: 2732259 - protein, 17 aa, Entamoeba histolytica
HAMRAIFLIPNRPPPTL

SEQ ID NO: 2732260 - protein, 17 aa, Entamoeba histolytica
HARFLLVCLLTDKLKMG

SEQ ID NO: 2732261 - protein, 25 aa, Entamoeba histolytica
HDDIIRVCFLFNTMFIITKIKTFQG

SEQ ID NO: 2732262 - protein, 32 aa, Entamoeba histolytica
HDLRSFLIMPVQRLPRYVLLLKELQKNTPKDH

SEQ ID NO: 2732263 - protein, 18 aa, Entamoeba histolytica
HDQIYYLMIKLEYSRLII

SEQ ID NO: 2732264 - protein, 18 aa, Entamoeba histolytica
HEEHTTFFGKDPGFFVFT

SEQ ID NO: 2732265 - protein, 21 aa, Entamoeba histolytica
HELHFFCWIVLLVQLKVINEE

SEQ ID NO: 2732266 - protein, 25 aa, Entamoeba histolytica
HENPYFLVPFLYPSQMMVLQNYFNI

SEQ ID NO: 2732267 - protein, 17 aa, Entamoeba histolytica
HFGILLVDAIFPITDIP

SEQ ID NO: 2732268 - protein, 22 aa, Entamoeba histolytica
HFNKFLWDLLYSHPSFIKFKET

SEQ ID NO: 2732269 - protein, 23 aa, Entamoeba histolytica
HFNSSLIKILWNYNIKYKTIILS

SEQ ID NO: 2732270 - protein, 17 aa, Entamoeba histolytica
HGKKYMFSLTWNAPLEA

SEQ ID NO: 2732271 - protein, 17 aa, Entamoeba histolytica
HHDILMPNIPLTTSYLD

SEQ ID NO: 2732272 - protein, 17 aa, Entamoeba histolytica
HIARYLVYWGKAKIIEA

SEQ ID NO: 2732273 - protein, 25 aa, Entamoeba histolytica
HIFNCAYFFVLKRKEGKFFDSFDKA

SEQ ID NO: 2732274 - protein, 20 aa, Entamoeba histolytica
HILGFFRIWAIPAIHRTGLL

SEQ ID NO: 2732275 - protein, 17 aa, Entamoeba histolytica
HIMLLHGLLYWRHRPNI

SEQ ID NO: 2732276 - protein, 25 aa, Entamoeba histolytica
HIVLAGIYLFLYKSTLDFVKQRKPL

SEQ ID NO: 2732277 - protein, 17 aa, Entamoeba histolytica
HIWDPNLPIPTIEKIRN

SEQ ID NO: 2732278 - protein, 17 aa, Entamoeba histolytica
HIYTKEQKTKLRDLFRK

SEQ ID NO: 2732279 - protein, 24 aa, Entamoeba histolytica
HKAIERLFYLRILMERCKPIEKKL

SEQ ID NO: 2732280 - protein, 18 aa, Entamoeba histolytica
HKEFLLPPKLKIKSNEYN

SEQ ID NO: 2732281 - protein, 24 aa, Entamoeba histolytica
HKKRSLLLLFLFKEDLTYPLNCRR

SEQ ID NO: 2732282 - protein, 17 aa, Entamoeba histolytica
HLEWYYLVKVHNKIQRI

SEQ ID NO: 2732283 - protein, 24 aa, Entamoeba histolytica
HLFCGYYIFIEFIVTSSSLEGLTT

SEQ ID NO: 2732284 - protein, 20 aa, Entamoeba histolytica
HLKFIYQPFLHWPDTMITLI

SEQ ID NO: 2732285 - protein, 21 aa, Entamoeba histolytica
HLPESIILPRGLTFFDCLSIQ

SEQ ID NO: 2732286 - protein, 25 aa, Entamoeba histolytica
HNEKMLLSFFISIATKFVPLGRVHM

SEQ ID NO: 2732287 - protein, 22 aa, Entamoeba histolytica
HNGPEWIWPYGYYVMAMLMYNP

SEQ ID NO: 2732288 - protein, 22 aa, Entamoeba histolytica
HNKYFQYYFFSQPILMVRMSIT

SEQ ID NO: 2732289 - protein, 18 aa, Entamoeba histolytica
HPFLVHLVWDFETPFYYI

SEQ ID NO: 2732290 - protein, 17 aa, Entamoeba histolytica
HPIEVFALIAALRILCP

SEQ ID NO: 2732291 - protein, 17 aa, Entamoeba histolytica
HPVPLLLLMTRHDICPT

SEQ ID NO: 2732292 - protein, 19 aa, Entamoeba histolytica
HQIFRYIGITHLRLLIQVS

SEQ ID NO: 2732293 - protein, 22 aa, Entamoeba histolytica
HQRLILIFQCVIRRVYLRFETE

SEQ ID NO: 2732294 - protein, 20 aa, Entamoeba histolytica
HQSFWSRAFLVIYPQPFGEV

SEQ ID NO: 2732295 - protein, 31 aa, Entamoeba histolytica
HQSYYLERIFSLYLPMLFGYQIYIPSKSVYQ

SEQ ID NO: 2732296 - protein, 22 aa, Entamoeba histolytica
HQTLLLLSLITPYLHHYLSPNV

SEQ ID NO: 2732297 - protein, 27 aa, Entamoeba histolytica
HQTNWLRPLIIPLLKLKPYELLQHMII

SEQ ID NO: 2732298 - protein, 21 aa, Entamoeba histolytica
HSELRPILPSLDTFQSTPSPI

SEQ ID NO: 2732299 - protein, 23 aa, Entamoeba histolytica
HSENILFILFDNGKIRVYRTNEL

SEQ ID NO: 2732300 - protein, 18 aa, Entamoeba histolytica
HSFLLNFLGGLLGIKGIK

SEQ ID NO: 2732301 - protein, 18 aa, Entamoeba histolytica
HSIFLFKTSKEWISCLTN

SEQ ID NO: 2732302 - protein, 21 aa, Entamoeba histolytica
HSLLFILLIINYWLNLERKGY

SEQ ID NO: 2732303 - protein, 17 aa, Entamoeba histolytica
HSNIVILVFDSLGNIFG

SEQ ID NO: 2732304 - protein, 19 aa, Entamoeba histolytica
HTTFFGKDPGFFVFTLRNP

SEQ ID NO: 2732305 - protein, 25 aa, Entamoeba histolytica
HTWKKRWFVMKDQYIWYFPKNTGSA

SEQ ID NO: 2732306 - protein, 18 aa, Entamoeba histolytica
HVCIVWTKCFYYTSEKKL

SEQ ID NO: 2732307 - protein, 25 aa, Entamoeba histolytica
HVSAPHCWSFMLGSLTWLKDAGDVV

SEQ ID NO: 2732308 - protein, 17 aa, Entamoeba histolytica
HVYAIADGAYRAMLDPA

SEQ ID NO: 2732309 - protein, 17 aa, Entamoeba histolytica
HYDDPFVMLNYNDLAIL

SEQ ID NO: 2732310 - protein, 19 aa, Entamoeba histolytica
HYNLFIYLLSFIKEILRQN

SEQ ID NO: 2732311 - protein, 23 aa, Entamoeba histolytica
HYTKPNYFKYAPAYPLVLYECKY

SEQ ID NO: 2732312 - protein, 24 aa, Entamoeba histolytica
IACLRLIIFLLRKDIKMFKFVYAK

SEQ ID NO: 2732313 - protein, 21 aa, Entamoeba histolytica
IAKFYTWINKWEKVIPDRRAV

SEQ ID NO: 2732314 - protein, 24 aa, Entamoeba histolytica
IALTILEHLLLYGYPFALKIVLIL

SEQ ID NO: 2732315 - protein, 23 aa, Entamoeba histolytica
IATWFELYSWWKDNEDAQTFTKI

SEQ ID NO: 2732316 - protein, 18 aa, Entamoeba histolytica
IAWLFSNFCRFKPSIPEQ

SEQ ID NO: 2732317 - protein, 17 aa, Entamoeba histolytica
ICLIYKNKEFKLLDKSK

SEQ ID NO: 2732318 - protein, 25 aa, Entamoeba histolytica
ICNKPNIMLIIVTKDGSIFGTFNSL

SEQ ID NO: 2732319 - protein, 17 aa, Entamoeba histolytica
IDALDRLGFEDYCLSLQ

SEQ ID NO: 2732320 - protein, 26 aa, Entamoeba histolytica
IDCHPKFMIFTLIPVPPPCVRPSIVS

SEQ ID NO: 2732321 - protein, 17 aa, Entamoeba histolytica
IDENIFCMSLLRKISFT

SEQ ID NO: 2732322 - protein, 22 aa, Entamoeba histolytica
IDFNLLPMDRGINSWFFLKEPE

SEQ ID NO: 2732323 - protein, 24 aa, Entamoeba histolytica
IDIKLPFLLKFLSIKNPLSLQIHP

SEQ ID NO: 2732324 - protein, 19 aa, Entamoeba histolytica
IDILLFSILILLSTNGHPN

SEQ ID NO: 2732325 - protein, 17 aa, Entamoeba histolytica
IDKFHFDLFIRDWKKYY

SEQ ID NO: 2732326 - protein, 22 aa, Entamoeba histolytica
IDPNYGDAWIWIYKIIYEKKGK

SEQ ID NO: 2732327 - protein, 23 aa, Entamoeba histolytica
IDQIYRNLICKILIRNVGKNELP

SEQ ID NO: 2732328 - protein, 26 aa, Entamoeba histolytica
IDQLLIFLYPLFFDLYRSPTLSSSMK

SEQ ID NO: 2732329 - protein, 23 aa, Entamoeba histolytica
IDSNHFLFSLKKKNYLQPLQVLP

SEQ ID NO: 2732330 - protein, 17 aa, Entamoeba histolytica
IDTLIHDTIFFYGEREY

SEQ ID NO: 2732331 - protein, 22 aa, Entamoeba histolytica
IDVLSRILALIPPWVRVHRIQR

SEQ ID NO: 2732332 - protein, 24 aa, Entamoeba histolytica
IEDDKLFEIALEKGLQMINGININ

SEQ ID NO: 2732333 - protein, 24 aa, Entamoeba histolytica
IEEAWWYYIDVYRLLYPELPRLEF

SEQ ID NO: 2732334 - protein, 24 aa, Entamoeba histolytica
IEELYDYFIFLLDSPLHHGEEIIM

SEQ ID NO: 2732335 - protein, 17 aa, Entamoeba histolytica
IEERKKRFPTKAKREKC

SEQ ID NO: 2732336 - protein, 18 aa, Entamoeba histolytica
IEFKWKIPITKKKTGLFS

SEQ ID NO: 2732337 - protein, 24 aa, Entamoeba histolytica
IEGLQSIIILTHLLYEVAKTWSKE

SEQ ID NO: 2732338 - protein, 26 aa, Entamoeba histolytica
IEIFLIHLRRALLFFIHFPCSINNPI

SEQ ID NO: 2732339 - protein, 17 aa, Entamoeba histolytica
IEISQVKLLINKFSQNQ

SEQ ID NO: 2732340 - protein, 29 aa, Entamoeba histolytica
IEKEFIIYNYLIYYILKLNTESPNTGIFR

SEQ ID NO: 2732341 - protein, 21 aa, Entamoeba histolytica
IEKEMVCHVLTFKYPFNSEIT

SEQ ID NO: 2732342 - protein, 26 aa, Entamoeba histolytica
IEKGGWYVPLPLYRLIPYLEESNYYI

SEQ ID NO: 2732343 - protein, 17 aa, Entamoeba histolytica
IEKKPMFHFLPQTMTYS

SEQ ID NO: 2732344 - protein, 29 aa, Entamoeba histolytica
IEKTFIIYNYLIYYILKLNTESPNTGLIR

SEQ ID NO: 2732345 - protein, 18 aa, Entamoeba histolytica
IELGQFFMAINIESFRPL

SEQ ID NO: 2732346 - protein, 19 aa, Entamoeba histolytica
IELLHLLIDLLIIRGGYEF

SEQ ID NO: 2732347 - protein, 18 aa, Entamoeba histolytica
IENYWGYFPLKEGFGTPQ

SEQ ID NO: 2732348 - protein, 24 aa, Entamoeba histolytica
IEPSDWILFYLFNCVDREQHVMNN

SEQ ID NO: 2732349 - protein, 17 aa, Entamoeba histolytica
IERYFYIIIASLNAYTG

SEQ ID NO: 2732350 - protein, 23 aa, Entamoeba histolytica
IESEFFFFFIFTNNGEKFKFKRK

SEQ ID NO: 2732351 - protein, 20 aa, Entamoeba histolytica
IETIYYWKYYLNLVLPQQMS

SEQ ID NO: 2732352 - protein, 19 aa, Entamoeba histolytica
IFHFCSFDVILKVKPSERW

SEQ ID NO: 2732353 - protein, 19 aa, Entamoeba histolytica
IFIDLSWRLDIVLAYKNVY

SEQ ID NO: 2732354 - protein, 18 aa, Entamoeba histolytica
IFIHNLLIDILIEKGYFF

SEQ ID NO: 2732355 - protein, 24 aa, Entamoeba histolytica
IFKKQEFFIPVVLLLRVYGGMSDR

SEQ ID NO: 2732356 - protein, 17 aa, Entamoeba histolytica
IFLPLTTSLTKFFSNYL

SEQ ID NO: 2732357 - protein, 18 aa, Entamoeba histolytica
IFNKGFILKIKHLLKSNF

SEQ ID NO: 2732358 - protein, 17 aa, Entamoeba histolytica
IFTCSLFESLWPPSYED

SEQ ID NO: 2732359 - protein, 18 aa, Entamoeba histolytica
IFTGLRAPPKGLLLFGPP

SEQ ID NO: 2732360 - protein, 17 aa, Entamoeba histolytica
IFTLYRSLGKKTIEAFL

SEQ ID NO: 2732361 - protein, 24 aa, Entamoeba histolytica
IFTQSLSLILFYYENNKLSDLEII

SEQ ID NO: 2732362 - protein, 24 aa, Entamoeba histolytica
IGAINCFFYPIIPFKWIADETVTS

SEQ ID NO: 2732363 - protein, 18 aa, Entamoeba histolytica
IGALPLFKLNFGNNLISI

SEQ ID NO: 2732364 - protein, 21 aa, Entamoeba histolytica
IGFKKLEYIFLLRQCGAKIVK

SEQ ID NO: 2732365 - protein, 22 aa, Entamoeba histolytica
IGHSLIFLGPLEKSFILLMEKK

SEQ ID NO: 2732366 - protein, 19 aa, Entamoeba histolytica
IGKLYIQGAVVFKLPLLCC

SEQ ID NO: 2732367 - protein, 25 aa, Entamoeba histolytica
IGMKELPFVILRPAIIYGPGDVTGI

SEQ ID NO: 2732368 - protein, 23 aa, Entamoeba histolytica
IGNSYLLLHLYNHLIKIVPLPRE

SEQ ID NO: 2732369 - protein, 17 aa, Entamoeba histolytica
IHELVKITFYDYPLQHC

SEQ ID NO: 2732370 - protein, 24 aa, Entamoeba histolytica
IHLNYLPIFTSYLLPLMNYINNEN

SEQ ID NO: 2732371 - protein, 17 aa, Entamoeba histolytica
IHYILLRGLSDPTHLIR

SEQ ID NO: 2732372 - protein, 19 aa, Entamoeba histolytica
IICKRTCRFVDAGKYFFDE

SEQ ID NO: 2732373 - protein, 26 aa, Entamoeba histolytica
IIDGMRWVVPYLYWFEVMVKERWIGK

SEQ ID NO: 2732374 - protein, 20 aa, Entamoeba histolytica
IIFDLLLFKEIIEKGYGMYE

SEQ ID NO: 2732375 - protein, 18 aa, Entamoeba histolytica
IIHMPCGPSFHFKLFNLM

SEQ ID NO: 2732376 - protein, 17 aa, Entamoeba histolytica
IIIFHRLITPALVSPAN

SEQ ID NO: 2732377 - protein, 18 aa, Entamoeba histolytica
IIITKWYPFLHSLEKRGD

SEQ ID NO: 2732378 - protein, 24 aa, Entamoeba histolytica
IIKNDFFILVRVYGIYGSCYNLDI

SEQ ID NO: 2732379 - protein, 19 aa, Entamoeba histolytica
IIKYVIWYKVSYSAYLEEK

SEQ ID NO: 2732380 - protein, 18 aa, Entamoeba histolytica
IIMIVRPRNLLYIAIDGV

SEQ ID NO: 2732381 - protein, 18 aa, Entamoeba histolytica
IIPFPYSLFIPKSYKEIA

SEQ ID NO: 2732382 - protein, 18 aa, Entamoeba histolytica
IIQPKIKAGLEIIERHLS

SEQ ID NO: 2732383 - protein, 17 aa, Entamoeba histolytica
IIREFIYILPPPNIYRG

SEQ ID NO: 2732384 - protein, 20 aa, Entamoeba histolytica
IIREFIYILPPPNIYRGRKI

SEQ ID NO: 2732385 - protein, 18 aa, Entamoeba histolytica
IIRIIIYNKSLKSSTVNT

SEQ ID NO: 2732386 - protein, 18 aa, Entamoeba histolytica
IIRLRFVPNFFGSGNFVS

SEQ ID NO: 2732387 - protein, 23 aa, Entamoeba histolytica
IISDLTWPAIYTLLQERIKVLEK

SEQ ID NO: 2732388 - protein, 17 aa, Entamoeba histolytica
IISLLFTTKSRLYISSH

SEQ ID NO: 2732389 - protein, 25 aa, Entamoeba histolytica
IITHLSYFRIPLPDILHWINIDISS

SEQ ID NO: 2732390 - protein, 18 aa, Entamoeba histolytica
IITIPYISGFLGFREVEV

SEQ ID NO: 2732391 - protein, 19 aa, Entamoeba histolytica
IITKLLRKALLDHQIVLST

SEQ ID NO: 2732392 - protein, 19 aa, Entamoeba histolytica
IITRLYPYLWQPSISVLEG

SEQ ID NO: 2732393 - protein, 23 aa, Entamoeba histolytica
IKDFFILEYVWVSTLIHLNPQHE

SEQ ID NO: 2732394 - protein, 22 aa, Entamoeba histolytica
IKESYWYLGLLYEYGAGVIQNS

SEQ ID NO: 2732395 - protein, 24 aa, Entamoeba histolytica
IKEYPRFLIPKYFTAFIKKVYNFI

SEQ ID NO: 2732396 - protein, 31 aa, Entamoeba histolytica
IKIIKEMFPELLQRILLANKISFEKSKEGGV

SEQ ID NO: 2732397 - protein, 17 aa, Entamoeba histolytica
IKIYRLYFKCTRCKTIF

SEQ ID NO: 2732398 - protein, 22 aa, Entamoeba histolytica
IKKIKLRFTVRYDLLLTIFCDK

SEQ ID NO: 2732399 - protein, 17 aa, Entamoeba histolytica
IKLKKIYSIPCVIANKT

SEQ ID NO: 2732400 - protein, 23 aa, Entamoeba histolytica
IKLLKISIIRFRKFMRINLGIIF

SEQ ID NO: 2732401 - protein, 25 aa, Entamoeba histolytica
IKLMKTLFPIIKFDSISFFFRTWEV

SEQ ID NO: 2732402 - protein, 17 aa, Entamoeba histolytica
IKMCMIEIFKKLHSSWV

SEQ ID NO: 2732403 - protein, 19 aa, Entamoeba histolytica
IKPSYLQIKLYKIMLKELE

SEQ ID NO: 2732404 - protein, 27 aa, Entamoeba histolytica
IKQKKLECPLLFLWGNLYGNLQFVKEQ

SEQ ID NO: 2732405 - protein, 18 aa, Entamoeba histolytica
IKRFWPGALTIIFPRNEA

SEQ ID NO: 2732406 - protein, 21 aa, Entamoeba histolytica
IKRLCRILIIPYYMVKSFFVR

SEQ ID NO: 2732407 - protein, 21 aa, Entamoeba histolytica
IKRSIRIFWSNKVPKGYFNKE

SEQ ID NO: 2732408 - protein, 17 aa, Entamoeba histolytica
IKSPVLLKMYLINRLRS

SEQ ID NO: 2732409 - protein, 18 aa, Entamoeba histolytica
IKYLFIRTKKTKLIINQQ

SEQ ID NO: 2732410 - protein, 17 aa, Entamoeba histolytica
IKYVIWYKVEYSRYLKE

SEQ ID NO: 2732411 - protein, 17 aa, Entamoeba histolytica
ILDGLNCFYYFATTMFF

SEQ ID NO: 2732412 - protein, 19 aa, Entamoeba histolytica
ILDNFFMPFFLLCVDDPVP

SEQ ID NO: 2732413 - protein, 24 aa, Entamoeba histolytica
ILEYKLLLGFIPLFSSLNTIQNLL

SEQ ID NO: 2732414 - protein, 17 aa, Entamoeba histolytica
ILFIRRFVELLKNNGCK

SEQ ID NO: 2732415 - protein, 19 aa, Entamoeba histolytica
ILFSRKYNYLQAHKLQIVL

SEQ ID NO: 2732416 - protein, 24 aa, Entamoeba histolytica
ILGKEKHFLLKKLTFNLIKDISEH

SEQ ID NO: 2732417 - protein, 17 aa, Entamoeba histolytica
ILHPLLFHKIENAHIIS

SEQ ID NO: 2732418 - protein, 25 aa, Entamoeba histolytica
ILHRGLKKFWWKAMDYLSFKTLNKR

SEQ ID NO: 2732419 - protein, 18 aa, Entamoeba histolytica
ILILLEYFQIIFVLRKSF

SEQ ID NO: 2732420 - protein, 17 aa, Entamoeba histolytica
ILIRRGVHWLKGKTLKE

SEQ ID NO: 2732421 - protein, 17 aa, Entamoeba histolytica
ILIYITKKITLLLLNKP

SEQ ID NO: 2732422 - protein, 19 aa, Entamoeba histolytica
ILIYQNLIFLLKPGSDTVL

SEQ ID NO: 2732423 - protein, 17 aa, Entamoeba histolytica
ILKLLKSGSIRAVRVKT

SEQ ID NO: 2732424 - protein, 20 aa, Entamoeba histolytica
ILKLPTFQRLLMTYSFCGNV

SEQ ID NO: 2732425 - protein, 22 aa, Entamoeba histolytica
ILKMRYLIVYKYYPDKSVILAL

SEQ ID NO: 2732426 - protein, 17 aa, Entamoeba histolytica
ILKTMFWYLMESKIDPK

SEQ ID NO: 2732427 - protein, 19 aa, Entamoeba histolytica
ILLDEIYAKHYGKLDKKHD

SEQ ID NO: 2732428 - protein, 17 aa, Entamoeba histolytica
ILLGLLNVYCTIPSSLQ

SEQ ID NO: 2732429 - protein, 17 aa, Entamoeba histolytica
ILLLDYYLMFELNFYYI

SEQ ID NO: 2732430 - protein, 17 aa, Entamoeba histolytica
ILLPAFFIDANYIYSMG

SEQ ID NO: 2732431 - protein, 24 aa, Entamoeba histolytica
ILLSDFYRSVVLLLFKPYDYTVIP

SEQ ID NO: 2732432 - protein, 20 aa, Entamoeba histolytica
ILMPILFEYFFKRKAFIEER

SEQ ID NO: 2732433 - protein, 18 aa, Entamoeba histolytica
ILNIPFSSSPILLRVNYK

SEQ ID NO: 2732434 - protein, 24 aa, Entamoeba histolytica
ILPCKFFFCFNLPISLGLVHSKLT

SEQ ID NO: 2732435 - protein, 19 aa, Entamoeba histolytica
ILPCRATVKQLYQPHSDKE

SEQ ID NO: 2732436 - protein, 17 aa, Entamoeba histolytica
ILRLFEEELLDSSLKDF

SEQ ID NO: 2732437 - protein, 17 aa, Entamoeba histolytica
ILRLLTKYISYIKKDDQ

SEQ ID NO: 2732438 - protein, 18 aa, Entamoeba histolytica
ILSFVKLKYRIFAIEFFI

SEQ ID NO: 2732439 - protein, 17 aa, Entamoeba histolytica
ILSPLYKLTVVQAETKL

SEQ ID NO: 2732440 - protein, 19 aa, Entamoeba histolytica
ILTFLQHKFPRIDAQTLLP

SEQ ID NO: 2732441 - protein, 18 aa, Entamoeba histolytica
ILVLFKPLDYAMGNGASI

SEQ ID NO: 2732442 - protein, 21 aa, Entamoeba histolytica
IMDDYKQCVWLLIGMKDLGGK

SEQ ID NO: 2732443 - protein, 17 aa, Entamoeba histolytica
IMFVNYYIYFFPLLDQI

SEQ ID NO: 2732444 - protein, 19 aa, Entamoeba histolytica
IMLYWSFVHLFTICLESHR

SEQ ID NO: 2732445 - protein, 17 aa, Entamoeba histolytica
INGPTHLEWYYLVKVHN

SEQ ID NO: 2732446 - protein, 18 aa, Entamoeba histolytica
INHLLQLPKVVPFDFIVG

SEQ ID NO: 2732447 - protein, 18 aa, Entamoeba histolytica
INIISFLLAIRNTETFIT

SEQ ID NO: 2732448 - protein, 23 aa, Entamoeba histolytica
INKEEIIRMVKSGEYKLVPIEQY

SEQ ID NO: 2732449 - protein, 24 aa, Entamoeba histolytica
INKNTLWLIMRFLSKVIQNTSVNQ

SEQ ID NO: 2732450 - protein, 27 aa, Entamoeba histolytica
INPPLIKSPLLFVTLRKWIINVPTEYV

SEQ ID NO: 2732451 - protein, 17 aa, Entamoeba histolytica
INPVLLTPLKFSSKLTK

SEQ ID NO: 2732452 - protein, 17 aa, Entamoeba histolytica
INPWYIWQIIPNINEND

SEQ ID NO: 2732453 - protein, 23 aa, Entamoeba histolytica
INTEKLLFTFKFPEKIVGIAQSP

SEQ ID NO: 2732454 - protein, 22 aa, Entamoeba histolytica
INVDIFCRCIRLIETIQKASCR

SEQ ID NO: 2732455 - protein, 17 aa, Entamoeba histolytica
INYSIVPFYIPKELYRL

SEQ ID NO: 2732456 - protein, 22 aa, Entamoeba histolytica
IPFSIRYIIWKYLLRYIPVEHK

SEQ ID NO: 2732457 - protein, 19 aa, Entamoeba histolytica
IPFYPWYFIGIETPNNNDN

SEQ ID NO: 2732458 - protein, 18 aa, Entamoeba histolytica
IPFYPWYFIGVETPNNND

SEQ ID NO: 2732459 - protein, 18 aa, Entamoeba histolytica
IPHLLLSPLAFVLPMTIL

SEQ ID NO: 2732460 - protein, 17 aa, Entamoeba histolytica
IPILFGLYLLKTGIRIE

SEQ ID NO: 2732461 - protein, 18 aa, Entamoeba histolytica
IPKFPIILNPYESFTIAF

SEQ ID NO: 2732462 - protein, 19 aa, Entamoeba histolytica
IPLELMRILRIVNLSIIES

SEQ ID NO: 2732463 - protein, 18 aa, Entamoeba histolytica
IPLLKYPVRIPFMAILPK

SEQ ID NO: 2732464 - protein, 23 aa, Entamoeba histolytica
IPMEDFLLSNLYLEKYYQIHNLY

SEQ ID NO: 2732465 - protein, 25 aa, Entamoeba histolytica
IPNSHYNLFIYLLSFIKEILRQNSS

SEQ ID NO: 2732466 - protein, 17 aa, Entamoeba histolytica
IPPVSPPIYLYFKDFQL

SEQ ID NO: 2732467 - protein, 23 aa, Entamoeba histolytica
IPRKVRGFVWYALLLRPKTTQEI

SEQ ID NO: 2732468 - protein, 26 aa, Entamoeba histolytica
IQEETNWIYYFFIKEFKKILVEMNNP

SEQ ID NO: 2732469 - protein, 17 aa, Entamoeba histolytica
IQHYLNCTLPYYCLPNP

SEQ ID NO: 2732470 - protein, 26 aa, Entamoeba histolytica
IQINNSILYLFYQLKHWSIQPTNLNA

SEQ ID NO: 2732471 - protein, 20 aa, Entamoeba histolytica
IQITVLPYIPISPKQPGLSS

SEQ ID NO: 2732472 - protein, 24 aa, Entamoeba histolytica
IQKLFEFGVFWQKSQLIKRLTGSF

SEQ ID NO: 2732473 - protein, 23 aa, Entamoeba histolytica
IQKVHAILRGLLKLKIIDANMRI

SEQ ID NO: 2732474 - protein, 17 aa, Entamoeba histolytica
IQLLLHECPITEKIKIV

SEQ ID NO: 2732475 - protein, 23 aa, Entamoeba histolytica
IQNPYFLYILFTLLTTTHCIENK

SEQ ID NO: 2732476 - protein, 17 aa, Entamoeba histolytica
IQRLPRYRLLLKDLLKH

SEQ ID NO: 2732477 - protein, 18 aa, Entamoeba histolytica
IQSVNYHYSLFSQLQFMD

SEQ ID NO: 2732478 - protein, 18 aa, Entamoeba histolytica
IQTFNDFFYALSVILPRS

SEQ ID NO: 2732479 - protein, 17 aa, Entamoeba histolytica
IQYLFFTSKIPSLIELV

SEQ ID NO: 2732480 - protein, 24 aa, Entamoeba histolytica
IRDALKFILQYYGINGIIIDNFTD

SEQ ID NO: 2732481 - protein, 19 aa, Entamoeba histolytica
IRFLFLLELAHWYYMDNWT

SEQ ID NO: 2732482 - protein, 18 aa, Entamoeba histolytica
IRKESCIILLNKQEFMFG

SEQ ID NO: 2732483 - protein, 17 aa, Entamoeba histolytica
IRLILVELLLKAGAEVD

SEQ ID NO: 2732484 - protein, 19 aa, Entamoeba histolytica
IRLLLMNIIQMMESGWTIS

SEQ ID NO: 2732485 - protein, 18 aa, Entamoeba histolytica
IRMWIKKALERREKRVPI

SEQ ID NO: 2732486 - protein, 23 aa, Entamoeba histolytica
IRQDICYACLPLEFLKKEEYLTL

SEQ ID NO: 2732487 - protein, 17 aa, Entamoeba histolytica
IRSIYNRLLLESPIIRA

SEQ ID NO: 2732488 - protein, 24 aa, Entamoeba histolytica
IRTWKKRYFVLKDRRIWYFSSCKD

SEQ ID NO: 2732489 - protein, 18 aa, Entamoeba histolytica
ISDGKWILSEDWIDAIIK

SEQ ID NO: 2732490 - protein, 22 aa, Entamoeba histolytica
ISDLLRYFFHFVKSTCPYIVEY

SEQ ID NO: 2732491 - protein, 23 aa, Entamoeba histolytica
ISGTKFILYCWSRPDLRGYLNSQ

SEQ ID NO: 2732492 - protein, 24 aa, Entamoeba histolytica
ISKEWKMCILFTDILIIARPFAFG

SEQ ID NO: 2732493 - protein, 25 aa, Entamoeba histolytica
ISLKKLWIILGWYYFYETMKENELE

SEQ ID NO: 2732494 - protein, 25 aa, Entamoeba histolytica
ISLRSYLFSIPMFHYLQPYSNFISL

SEQ ID NO: 2732495 - protein, 24 aa, Entamoeba histolytica
ISRFDLWLNKYYPFGQLKLKELFL

SEQ ID NO: 2732496 - protein, 17 aa, Entamoeba histolytica
ISYNEYLLFKSLGIHCN

SEQ ID NO: 2732497 - protein, 25 aa, Entamoeba histolytica
ITDPLYTYLFDLCYLPVIGNPGEDS

SEQ ID NO: 2732498 - protein, 17 aa, Entamoeba histolytica
ITDYLILESFRKYFRGI

SEQ ID NO: 2732499 - protein, 25 aa, Entamoeba histolytica
ITFKTIFFLRFLFPALNSAEKYVSI

SEQ ID NO: 2732500 - protein, 17 aa, Entamoeba histolytica
ITFRLLTLTLQSLLHIT

SEQ ID NO: 2732501 - protein, 20 aa, Entamoeba histolytica
ITHPILCGYYYILYEEKDST

SEQ ID NO: 2732502 - protein, 17 aa, Entamoeba histolytica
ITKIQMIPLKFRKQKSS

SEQ ID NO: 2732503 - protein, 17 aa, Entamoeba histolytica
ITKNLDLLVPLLQSLEK

SEQ ID NO: 2732504 - protein, 23 aa, Entamoeba histolytica
ITLQTPLVFWKWANEHILAIVTS

SEQ ID NO: 2732505 - protein, 17 aa, Entamoeba histolytica
ITPQKNIIIFPYRLNYN

SEQ ID NO: 2732506 - protein, 22 aa, Entamoeba histolytica
ITTLRKLIIILFLPIHTKSTKV

SEQ ID NO: 2732507 - protein, 17 aa, Entamoeba histolytica
IVAFPRLYYKTIPLPFD

SEQ ID NO: 2732508 - protein, 20 aa, Entamoeba histolytica
IVGGFLFLRLFCPAIASPEN

SEQ ID NO: 2732509 - protein, 18 aa, Entamoeba histolytica
IVGLLKLFNYLSINFDRL

SEQ ID NO: 2732510 - protein, 23 aa, Entamoeba histolytica
IVGSHNFFILKHGMCKITNPEQD

SEQ ID NO: 2732511 - protein, 18 aa, Entamoeba histolytica
IVITHYLELIWKIPDAHI

SEQ ID NO: 2732512 - protein, 22 aa, Entamoeba histolytica
IVKINIFPLYKWTTSIVNFSEN

SEQ ID NO: 2732513 - protein, 17 aa, Entamoeba histolytica
IVLALIQKLYPRVYPQI

SEQ ID NO: 2732514 - protein, 26 aa, Entamoeba histolytica
IVLEKYFPVYLLIRQYLLISQKSTIL

SEQ ID NO: 2732515 - protein, 17 aa, Entamoeba histolytica
IVLFKKPLEDAKGKILP

SEQ ID NO: 2732516 - protein, 17 aa, Entamoeba histolytica
IVLPTLKALYKFLQYVN

SEQ ID NO: 2732517 - protein, 17 aa, Entamoeba histolytica
IVNWHRKKPNKEFQEEW

SEQ ID NO: 2732518 - protein, 18 aa, Entamoeba histolytica
IVPFYIPKELYRLTNYII

SEQ ID NO: 2732519 - protein, 17 aa, Entamoeba histolytica
IVPPIIDMSFFNAGLKQ

SEQ ID NO: 2732520 - protein, 17 aa, Entamoeba histolytica
IVPSYHMFFVEVLPIPP

SEQ ID NO: 2732521 - protein, 18 aa, Entamoeba histolytica
IVPYFFLVERKAVIQYAS

SEQ ID NO: 2732522 - protein, 19 aa, Entamoeba histolytica
IVQIKPICALALLDGGETD

SEQ ID NO: 2732523 - protein, 24 aa, Entamoeba histolytica
IVVDVMCILPNGKQIWININKDDD

SEQ ID NO: 2732524 - protein, 19 aa, Entamoeba histolytica
IWILDIIIVEGWQLTLSVA

SEQ ID NO: 2732525 - protein, 20 aa, Entamoeba histolytica
IWNWYNRWLVLTKEQLYYYD

SEQ ID NO: 2732526 - protein, 20 aa, Entamoeba histolytica
IWRYPPQYFYILLNPRFVAQ

SEQ ID NO: 2732527 - protein, 21 aa, Entamoeba histolytica
IWRYPPQYFYILLNPRFVAQK

SEQ ID NO: 2732528 - protein, 17 aa, Entamoeba histolytica
IYDKITPNPLYTSVKEC

SEQ ID NO: 2732529 - protein, 17 aa, Entamoeba histolytica
IYIRDLYLNLSTSAVPI

SEQ ID NO: 2732530 - protein, 19 aa, Entamoeba histolytica
IYNLIIKYKLMNILLDIFF

SEQ ID NO: 2732531 - protein, 18 aa, Entamoeba histolytica
IYPQFMFHLRRSHFLKVF

SEQ ID NO: 2732532 - protein, 19 aa, Entamoeba histolytica
IYQSIPYWVWMIMKEDNNE

SEQ ID NO: 2732533 - protein, 18 aa, Entamoeba histolytica
IYRPFLRLTYKEAIEMLR

SEQ ID NO: 2732534 - protein, 17 aa, Entamoeba histolytica
IYSFWLYDFCDVYLEAS

SEQ ID NO: 2732535 - protein, 20 aa, Entamoeba histolytica
IYSIPFFFHLKKLKIGYSTY

SEQ ID NO: 2732536 - protein, 18 aa, Entamoeba histolytica
IYWLQRLIEMGENPKYIV

SEQ ID NO: 2732537 - protein, 19 aa, Entamoeba histolytica
IYYEFYEQTDHIGAEYKAQ

SEQ ID NO: 2732538 - protein, 18 aa, Entamoeba histolytica
IYYIKWQIPALCKHQVFV

SEQ ID NO: 2732539 - protein, 18 aa, Entamoeba histolytica
IYYLMIKLEYSRLIIKIR

SEQ ID NO: 2732540 - protein, 17 aa, Entamoeba histolytica
IYYSLRPIFKRLYLNYT

SEQ ID NO: 2732541 - protein, 16 aa, Entamoeba histolytica
KNLKILIIFMLLEKYG

SEQ ID NO: 2732542 - protein, 19 aa, Entamoeba histolytica
KAAPFFLYMREFIGNNSNA

SEQ ID NO: 2732543 - protein, 20 aa, Entamoeba histolytica
KALASVIIRIALAKTFCSKC

SEQ ID NO: 2732544 - protein, 17 aa, Entamoeba histolytica
KALEILKFLKQKGLKVA

SEQ ID NO: 2732545 - protein, 26 aa, Entamoeba histolytica
KALLNIRIHLLLEYYTINKAISTSHD

SEQ ID NO: 2732546 - protein, 26 aa, Entamoeba histolytica
KALLNIRIHLWLEYYTINKAISTSHD

SEQ ID NO: 2732547 - protein, 27 aa, Entamoeba histolytica
KALRNMLQLFLRQLPLNSKFQIISFGS

SEQ ID NO: 2732548 - protein, 20 aa, Entamoeba histolytica
KCAQIILRLLTKYISYIKKD

SEQ ID NO: 2732549 - protein, 19 aa, Entamoeba histolytica
KCHQSWFQKYIDKEQERLI

SEQ ID NO: 2732550 - protein, 23 aa, Entamoeba histolytica
KCKAIQWINPFATASLCCDLSKL

SEQ ID NO: 2732551 - protein, 23 aa, Entamoeba histolytica
KCLDPLLEFCRLLTMPMSLEIVQ

SEQ ID NO: 2732552 - protein, 24 aa, Entamoeba histolytica
KCLKQLPLRYFIIPTILSKNNKAI

SEQ ID NO: 2732553 - protein, 19 aa, Entamoeba histolytica
KCYFLQVIQLPIDILTLPK

SEQ ID NO: 2732554 - protein, 28 aa, Entamoeba histolytica
KDFVRYYPEYLWYPFLTLIISKLEEPNF

SEQ ID NO: 2732555 - protein, 23 aa, Entamoeba histolytica
KDFYLMFMLFFDDDNTKFITQLL

SEQ ID NO: 2732556 - protein, 22 aa, Entamoeba histolytica
KDGIVLALFKKKFVPCHCLLFS

SEQ ID NO: 2732557 - protein, 18 aa, Entamoeba histolytica
KDGLVLIRLLRNLSGCDI

SEQ ID NO: 2732558 - protein, 23 aa, Entamoeba histolytica
KDGTLFYCYTYLVKNKGGDEHPQ

SEQ ID NO: 2732559 - protein, 19 aa, Entamoeba histolytica
KDIPALWFKCSMKSSTSIE

SEQ ID NO: 2732560 - protein, 26 aa, Entamoeba histolytica
KDKLKDLYYFFLFKDIFVQTKVKKLH

SEQ ID NO: 2732561 - protein, 23 aa, Entamoeba histolytica
KDKVPYLFLANSYRISYWKTDIE

SEQ ID NO: 2732562 - protein, 21 aa, Entamoeba histolytica
KDLHKLYLMLVEKANIQLQVL

SEQ ID NO: 2732563 - protein, 18 aa, Entamoeba histolytica
KDLTVHFVFVSLNILCFR

SEQ ID NO: 2732564 - protein, 17 aa, Entamoeba histolytica
KDMKFYIYFVRAKNIIA

SEQ ID NO: 2732565 - protein, 25 aa, Entamoeba histolytica
KDNRERYFYLFNDLLVYGIGDENKI

SEQ ID NO: 2732566 - protein, 24 aa, Entamoeba histolytica
KDTHFAFVLLKYFFLCLPKPMIND

SEQ ID NO: 2732567 - protein, 21 aa, Entamoeba histolytica
KDYLRLLPNPLIPYNLYEEFI

SEQ ID NO: 2732568 - protein, 25 aa, Entamoeba histolytica
KEDQIYRTIFIQNLSFETSEEELKE

SEQ ID NO: 2732569 - protein, 21 aa, Entamoeba histolytica
KEDYMIFLTSFLLILHRVNPT

SEQ ID NO: 2732570 - protein, 18 aa, Entamoeba histolytica
KEFEGRAVYLEYANTKKK

SEQ ID NO: 2732571 - protein, 20 aa, Entamoeba histolytica
KEGMFIRPTPRRLNVTIVPP

SEQ ID NO: 2732572 - protein, 25 aa, Entamoeba histolytica
KEIKILFTCKWYNPIFQYFIYNNDY

SEQ ID NO: 2732573 - protein, 22 aa, Entamoeba histolytica
KEIRASLYDFLLRCFVYNPKDR

SEQ ID NO: 2732574 - protein, 20 aa, Entamoeba histolytica
KEKLFLDTFFFPIKMRVQNG

SEQ ID NO: 2732575 - protein, 17 aa, Entamoeba histolytica
KEKLLRLNKLCGASVVG

SEQ ID NO: 2732576 - protein, 17 aa, Entamoeba histolytica
KEKPFPPARIRKLTKIN

SEQ ID NO: 2732577 - protein, 18 aa, Entamoeba histolytica
KELFLFEQYLPSYLKLLK

SEQ ID NO: 2732578 - protein, 21 aa, Entamoeba histolytica
KELNQMLSLKRLAPYDERKIT

SEQ ID NO: 2732579 - protein, 17 aa, Entamoeba histolytica
KELRSMIYLLFSVSNEL

SEQ ID NO: 2732580 - protein, 18 aa, Entamoeba histolytica
KEMKPWFRGWTGQLRKNK

SEQ ID NO: 2732581 - protein, 20 aa, Entamoeba histolytica
KEPKKWWKYAFNVILEDVRK

SEQ ID NO: 2732582 - protein, 23 aa, Entamoeba histolytica
KEQAIWMLNALWPTYKDTMAEEV

SEQ ID NO: 2732583 - protein, 24 aa, Entamoeba histolytica
KEQVEFPCIPPRIKTPPLEHHMVE

SEQ ID NO: 2732584 - protein, 17 aa, Entamoeba histolytica
KERRVITIITPINAKDI

SEQ ID NO: 2732585 - protein, 18 aa, Entamoeba histolytica
KESLLPLMRNILGILLHI

SEQ ID NO: 2732586 - protein, 19 aa, Entamoeba histolytica
KESTIVCLRWLMGAEFIVE

SEQ ID NO: 2732587 - protein, 19 aa, Entamoeba histolytica
KFCKLYVRFIQTLRQQVGL

SEQ ID NO: 2732588 - protein, 18 aa, Entamoeba histolytica
KFIHLMEVILLMGNFLNS

SEQ ID NO: 2732589 - protein, 21 aa, Entamoeba histolytica
KFKIKSLPFFKVKTLYNVYES

SEQ ID NO: 2732590 - protein, 20 aa, Entamoeba histolytica
KFKLTFFFFQCFIKSCVVAD

SEQ ID NO: 2732591 - protein, 24 aa, Entamoeba histolytica
KFLTFTYYFRRLLKNPNYYGYDGK

SEQ ID NO: 2732592 - protein, 18 aa, Entamoeba histolytica
KFMFHQMLLKGELPLSIG

SEQ ID NO: 2732593 - protein, 17 aa, Entamoeba histolytica
KFRNEYIIHFYGAVFIP

SEQ ID NO: 2732594 - protein, 17 aa, Entamoeba histolytica
KFSLMIKYLLIGISLKL

SEQ ID NO: 2732595 - protein, 22 aa, Entamoeba histolytica
KFVDLIELCRLFCLAGASKEKT

SEQ ID NO: 2732596 - protein, 18 aa, Entamoeba histolytica
KFVYLIMSNLIYYNEQDL

SEQ ID NO: 2732597 - protein, 23 aa, Entamoeba histolytica
KGDLLLRVLKLLRLLIRNEGNLQ

SEQ ID NO: 2732598 - protein, 23 aa, Entamoeba histolytica
KGDSYIPFRSSPLTRILQDALGG

SEQ ID NO: 2732599 - protein, 22 aa, Entamoeba histolytica
KGEYLFVLCFNSVRNRILYIYR

SEQ ID NO: 2732600 - protein, 19 aa, Entamoeba histolytica
KGFFPKLLNFICNPNGVIV

SEQ ID NO: 2732601 - protein, 22 aa, Entamoeba histolytica
KGFMPIIYDIFKYLPIKRQIVL

SEQ ID NO: 2732602 - protein, 22 aa, Entamoeba histolytica
KGFQFKFFMTYMDMLSLDDEYK

SEQ ID NO: 2732603 - protein, 19 aa, Entamoeba histolytica
KGLFLRSYLLYVIKNYLPT

SEQ ID NO: 2732604 - protein, 26 aa, Entamoeba histolytica
KGLLINYFHTFWPSLLKIDNFLVEFI

SEQ ID NO: 2732605 - protein, 30 aa, Entamoeba histolytica
KGNENVMIFFFLKRNIIVGIYFNTPLQPDK

SEQ ID NO: 2732606 - protein, 21 aa, Entamoeba histolytica
KGQTYAFRYLLQSFPRIQHFS

SEQ ID NO: 2732607 - protein, 18 aa, Entamoeba histolytica
KGYIIFHLDNGKYVQDIT

SEQ ID NO: 2732608 - protein, 26 aa, Entamoeba histolytica
KGYPFTEWFWMIEFQDKYFGFQTIFT

SEQ ID NO: 2732609 - protein, 26 aa, Entamoeba histolytica
KHESRYRWFFRPLRKMSPYHMYLFKA

SEQ ID NO: 2732610 - protein, 18 aa, Entamoeba histolytica
KHFIMFYHPYCEWCKEMR

SEQ ID NO: 2732611 - protein, 18 aa, Entamoeba histolytica
KHIFIPKYTISLLKAGIT

SEQ ID NO: 2732612 - protein, 26 aa, Entamoeba histolytica
KHMHVPFPLILIWALNQWRKEKSQTG

SEQ ID NO: 2732613 - protein, 23 aa, Entamoeba histolytica
KHPDLAIPLWYSYGTVVILLEEI

SEQ ID NO: 2732614 - protein, 27 aa, Entamoeba histolytica
KHRNYVHYIILMLLKTISIKYNIEELA

SEQ ID NO: 2732615 - protein, 27 aa, Entamoeba histolytica
KHVLETLIFLRFILPPLAQTPQLLKKL

SEQ ID NO: 2732616 - protein, 20 aa, Entamoeba histolytica
KHYFDCIFGPYTSFVLKGIN

SEQ ID NO: 2732617 - protein, 18 aa, Entamoeba histolytica
KIFLPIQYLLIYSFDPLF

SEQ ID NO: 2732618 - protein, 19 aa, Entamoeba histolytica
KILLPFISRYYTLTSKLYQ

SEQ ID NO: 2732619 - protein, 25 aa, Entamoeba histolytica
KILVRLCSLFPLIKKYVLACEFFRE

SEQ ID NO: 2732620 - protein, 17 aa, Entamoeba histolytica
KIMGYITVRFKQLRSSP

SEQ ID NO: 2732621 - protein, 23 aa, Entamoeba histolytica
KIMTRFCLLYSYFPLQETIDVYE

SEQ ID NO: 2732622 - protein, 25 aa, Entamoeba histolytica
KINKPRFIYLFNDMLMYGIGDERKL

SEQ ID NO: 2732623 - protein, 23 aa, Entamoeba histolytica
KIPIEEILPLLPLDWELGEFKGV

SEQ ID NO: 2732624 - protein, 22 aa, Entamoeba histolytica
KISIIEEIKQRGFRLPQPGDKP

SEQ ID NO: 2732625 - protein, 24 aa, Entamoeba histolytica
KISNILPLSNFYGLERLWLANNQI

SEQ ID NO: 2732626 - protein, 25 aa, Entamoeba histolytica
KIWAKDMYLLYFWQGRSCAVIDKGT

SEQ ID NO: 2732627 - protein, 19 aa, Entamoeba histolytica
KIYITYFLQLLRQSFPTKE

SEQ ID NO: 2732628 - protein, 20 aa, Entamoeba histolytica
KIYQSFLCTPILIAAHRTLN

SEQ ID NO: 2732629 - protein, 17 aa, Entamoeba histolytica
KIYWYNQSKLTDITPEV

SEQ ID NO: 2732630 - protein, 24 aa, Entamoeba histolytica
KKENCQFILFRLTKSDGLFIYEME

SEQ ID NO: 2732631 - protein, 21 aa, Entamoeba histolytica
KKIILLTSCGLREIECKNKLD

SEQ ID NO: 2732632 - protein, 21 aa, Entamoeba histolytica
KKIPLILLKKISLKKATPGIL

SEQ ID NO: 2732633 - protein, 21 aa, Entamoeba histolytica
KKKLKIVIIIRLIIEIVEKET

SEQ ID NO: 2732634 - protein, 20 aa, Entamoeba histolytica
KKNFAMLLKSLIKANPKPSE

SEQ ID NO: 2732635 - protein, 21 aa, Entamoeba histolytica
KKPMFHFLPQTMTYSIATVGC

SEQ ID NO: 2732636 - protein, 18 aa, Entamoeba histolytica
KKRIFINNFLIDVCLELG

SEQ ID NO: 2732637 - protein, 19 aa, Entamoeba histolytica
KKRYLIWKGMVLYFYDKKG

SEQ ID NO: 2732638 - protein, 17 aa, Entamoeba histolytica
KKTKLHYKLLIQTLLTL

SEQ ID NO: 2732639 - protein, 26 aa, Entamoeba histolytica
KKVGMLHFLTYYYGMDWHKVANAPQG

SEQ ID NO: 2732640 - protein, 18 aa, Entamoeba histolytica
KKVTFIPLRLFIETPRTS

SEQ ID NO: 2732641 - protein, 18 aa, Entamoeba histolytica
KKWKFMQKYYHIGSFFRD

SEQ ID NO: 2732642 - protein, 22 aa, Entamoeba histolytica
KKYGGDYLLTLPTLVFLYGMNI

SEQ ID NO: 2732643 - protein, 18 aa, Entamoeba histolytica
KLDLTWINERPGIKILGC

SEQ ID NO: 2732644 - protein, 17 aa, Entamoeba histolytica
KLEAVIPLIFHDASVTK

SEQ ID NO: 2732645 - protein, 23 aa, Entamoeba histolytica
KLFDGQTWKSLFSNLFNFLHSIW

SEQ ID NO: 2732646 - protein, 17 aa, Entamoeba histolytica
KLFDVFPLLLKQTLSLL

SEQ ID NO: 2732647 - protein, 19 aa, Entamoeba histolytica
KLFLIDYLKHVLTPVLDLI

SEQ ID NO: 2732648 - protein, 25 aa, Entamoeba histolytica
KLGGMMILCIPPYRLPRDKLDEDID

SEQ ID NO: 2732649 - protein, 18 aa, Entamoeba histolytica
KLIIYDLIRDYTDLLLLL

SEQ ID NO: 2732650 - protein, 19 aa, Entamoeba histolytica
KLILEFIKSQNIKVTTTVQ

SEQ ID NO: 2732651 - protein, 17 aa, Entamoeba histolytica
KLKYYFAVAVFDSIETA

SEQ ID NO: 2732652 - protein, 19 aa, Entamoeba histolytica
KLPAVFFIFSRKLVMDYAK

SEQ ID NO: 2732653 - protein, 17 aa, Entamoeba histolytica
KLRTLYETNLKEIRCYL

SEQ ID NO: 2732654 - protein, 20 aa, Entamoeba histolytica
KLVIMTLYKVFLLENSNIQE

SEQ ID NO: 2732655 - protein, 17 aa, Entamoeba histolytica
KLWTKKRGIYGYVYCFL

SEQ ID NO: 2732656 - protein, 20 aa, Entamoeba histolytica
KMVGILIRRSFHNTGVDIVR

SEQ ID NO: 2732657 - protein, 23 aa, Entamoeba histolytica
KNEFIISIGNFYRGWIDIASIGE

SEQ ID NO: 2732658 - protein, 24 aa, Entamoeba histolytica
KNETVWRLIFNFLARNGCFMKYVN

SEQ ID NO: 2732659 - protein, 23 aa, Entamoeba histolytica
KNHKTYYMFTLKDFFLKLKINVH

SEQ ID NO: 2732660 - protein, 17 aa, Entamoeba histolytica
KNKDFYYLIMKLSRHVT

SEQ ID NO: 2732661 - protein, 17 aa, Entamoeba histolytica
KNKRFMDLLKKLSLQKE

SEQ ID NO: 2732662 - protein, 24 aa, Entamoeba histolytica
KNLFGIFYGYWLKVNKTYIIDSMI

SEQ ID NO: 2732663 - protein, 23 aa, Entamoeba histolytica
KNLFRHALFFWLGKNASILHRGK

SEQ ID NO: 2732664 - protein, 22 aa, Entamoeba histolytica
KNQHQLFYPLVSYIFSTYVNVF

SEQ ID NO: 2732665 - protein, 24 aa, Entamoeba histolytica
KNSYSYFLNYLFPNSFFTDMQKFI

SEQ ID NO: 2732666 - protein, 24 aa, Entamoeba histolytica
KNVLRPIFHFINDLNPEAINDQTY

SEQ ID NO: 2732667 - protein, 20 aa, Entamoeba histolytica
KNVMFIIITKTGYAFGCFCH

SEQ ID NO: 2732668 - protein, 21 aa, Entamoeba histolytica
KNYKYLFEWYWKGIWNEEKEQ

SEQ ID NO: 2732669 - protein, 17 aa, Entamoeba histolytica
KPICLIYKNKEFKLLDK

SEQ ID NO: 2732670 - protein, 24 aa, Entamoeba histolytica
KPNKLPFMPMILNISPDIITIPQE

SEQ ID NO: 2732671 - protein, 17 aa, Entamoeba histolytica
KPSLFLFSNANNQYFGA

SEQ ID NO: 2732672 - protein, 24 aa, Entamoeba histolytica
KPSSLPFLKLVLSIPPLLSQQINQ

SEQ ID NO: 2732673 - protein, 23 aa, Entamoeba histolytica
KPTIDYFFFVHGLLSLSINPKEH

SEQ ID NO: 2732674 - protein, 24 aa, Entamoeba histolytica
KPTKAFTMTLWLKAIFEQHLAYLM

SEQ ID NO: 2732675 - protein, 22 aa, Entamoeba histolytica
KQIGFEMWYFLSVIILDRNFVQ

SEQ ID NO: 2732676 - protein, 25 aa, Entamoeba histolytica
KQINRLFSFILRNILTIFPSSKRCF

SEQ ID NO: 2732677 - protein, 17 aa, Entamoeba histolytica
KQKIYWYNQSKLTDITP

SEQ ID NO: 2732678 - protein, 20 aa, Entamoeba histolytica
KQLVFFVITVNMAALFSVDQ

SEQ ID NO: 2732679 - protein, 23 aa, Entamoeba histolytica
KQMKFLLHRLNTLSSLPFVEDPL

SEQ ID NO: 2732680 - protein, 24 aa, Entamoeba histolytica
KQSFRRIIILLWKSIDWGKVPLDQ

SEQ ID NO: 2732681 - protein, 19 aa, Entamoeba histolytica
KQTCFYFDLPFDNAAPGDI

SEQ ID NO: 2732682 - protein, 20 aa, Entamoeba histolytica
KQYDCIWIQWSILYLRDDDL

SEQ ID NO: 2732683 - protein, 23 aa, Entamoeba histolytica
KQYDVLYIFYRNIKHFLFTQRKL

SEQ ID NO: 2732684 - protein, 23 aa, Entamoeba histolytica
KQYPFEDLIYRPFLRLTYKEAIE

SEQ ID NO: 2732685 - protein, 17 aa, Entamoeba histolytica
KREFMRELLLFPVIREL

SEQ ID NO: 2732686 - protein, 18 aa, Entamoeba histolytica
KREPFMCPALYLISPTKE

SEQ ID NO: 2732687 - protein, 20 aa, Entamoeba histolytica
KREYLIYSWIFINTLDEKPF

SEQ ID NO: 2732688 - protein, 17 aa, Entamoeba histolytica
KRFYELMFLIAEKIKLE

SEQ ID NO: 2732689 - protein, 20 aa, Entamoeba histolytica
KRIFDIAFYFKLNALRSNTT

SEQ ID NO: 2732690 - protein, 21 aa, Entamoeba histolytica
KRIGYLALMLLLDETQEVLTL

SEQ ID NO: 2732691 - protein, 19 aa, Entamoeba histolytica
KRIIGWLNNIYVIEKNKEG

SEQ ID NO: 2732692 - protein, 26 aa, Entamoeba histolytica
KRKYDKLIAYIYLLLSFFPSDNETTI

SEQ ID NO: 2732693 - protein, 21 aa, Entamoeba histolytica
KRMDEAIWNEIYLHELDKCGF

SEQ ID NO: 2732694 - protein, 19 aa, Entamoeba histolytica
KRPSFILFIKYYFNHVLQL

SEQ ID NO: 2732695 - protein, 17 aa, Entamoeba histolytica
KRQIKLRTLYETNLKEI

SEQ ID NO: 2732696 - protein, 25 aa, Entamoeba histolytica
KRQINPIQMEKIIQVKQKSPSETKQ

SEQ ID NO: 2732697 - protein, 20 aa, Entamoeba histolytica
KRRIFVIPYLMYSTMERAVH

SEQ ID NO: 2732698 - protein, 25 aa, Entamoeba histolytica
KRRKLLYYGLLIPINDEFPKKGPRL

SEQ ID NO: 2732699 - protein, 18 aa, Entamoeba histolytica
KRSKLTLPFLKINKIIFT

SEQ ID NO: 2732700 - protein, 20 aa, Entamoeba histolytica
KRSQIPLQLAWAISIHKSQG

SEQ ID NO: 2732701 - protein, 26 aa, Entamoeba histolytica
KRVDTLLYLLYYPQIPMVKTKTIDMI

SEQ ID NO: 2732702 - protein, 26 aa, Entamoeba histolytica
KRVGMLHFLTYYYGMDWHKVANAPQG

SEQ ID NO: 2732703 - protein, 24 aa, Entamoeba histolytica
KSGNCTAFIRGLPLKWGDIEFSKY

SEQ ID NO: 2732704 - protein, 23 aa, Entamoeba histolytica
KSHRTWFTLLLLSQAFQCFLSIN

SEQ ID NO: 2732705 - protein, 20 aa, Entamoeba histolytica
KSIIQFLKLMKPNSFKVFDV

SEQ ID NO: 2732706 - protein, 20 aa, Entamoeba histolytica
KSILFFIFKEKKEKIINFIC

SEQ ID NO: 2732707 - protein, 25 aa, Entamoeba histolytica
KSLRAYFFCILLKIFRVYMKIARYQ

SEQ ID NO: 2732708 - protein, 30 aa, Entamoeba histolytica
KSNVSKYYFFKRLPWILPIQLKRFTWDEKK

SEQ ID NO: 2732709 - protein, 17 aa, Entamoeba histolytica
KSQLNIPILLSAQAIGA

SEQ ID NO: 2732710 - protein, 21 aa, Entamoeba histolytica
KSSFLLHPIFNHPKNDFLSQD

SEQ ID NO: 2732711 - protein, 26 aa, Entamoeba histolytica
KSSKDFLILPYYLKLRMLYDTARGMS

SEQ ID NO: 2732712 - protein, 21 aa, Entamoeba histolytica
KSVLPLNINLLPQLTFLSLFE

SEQ ID NO: 2732713 - protein, 24 aa, Entamoeba histolytica
KSWKLVWVVIKYTFIFVFKSRDDT

SEQ ID NO: 2732714 - protein, 24 aa, Entamoeba histolytica
KSWKRRWFVIKDRKMWYFAGKNDT

SEQ ID NO: 2732715 - protein, 21 aa, Entamoeba histolytica
KTCHHPCHVPFFISAFTNRFC

SEQ ID NO: 2732716 - protein, 19 aa, Entamoeba histolytica
KTCLLLTYTTNSFPDSYVP

SEQ ID NO: 2732717 - protein, 24 aa, Entamoeba histolytica
KTKLEGIFGNKPIMGGPAPIRPKP

SEQ ID NO: 2732718 - protein, 24 aa, Entamoeba histolytica
KTKYRSVYLFLFNDTVILTKINSA

SEQ ID NO: 2732719 - protein, 25 aa, Entamoeba histolytica
KTPQLLVEIIWILSRFSYTKEEVLT

SEQ ID NO: 2732720 - protein, 27 aa, Entamoeba histolytica
KTQTHVFLIYPNFLFPTTATIDILIEQ

SEQ ID NO: 2732721 - protein, 22 aa, Entamoeba histolytica
KTSLFRIYFLTNDKGNPFIRTL

SEQ ID NO: 2732722 - protein, 23 aa, Entamoeba histolytica
KTSLFRIYFLTNDKGNPFIRTLD

SEQ ID NO: 2732723 - protein, 25 aa, Entamoeba histolytica
KTVINYILSFLFYFIQKNAIIDCAA

SEQ ID NO: 2732724 - protein, 18 aa, Entamoeba histolytica
KVCTVLFKYIRILYNDIK

SEQ ID NO: 2732725 - protein, 23 aa, Entamoeba histolytica
KVDQYLYIVRFIPVLFGVTKQNV

SEQ ID NO: 2732726 - protein, 17 aa, Entamoeba histolytica
KVFELHFYPLLQQYLYS

SEQ ID NO: 2732727 - protein, 18 aa, Entamoeba histolytica
KVIEKYFKIIYFINYDSG

SEQ ID NO: 2732728 - protein, 23 aa, Entamoeba histolytica
KVILQFFPVLFEKIIFRQIMVTP

SEQ ID NO: 2732729 - protein, 25 aa, Entamoeba histolytica
KVKEALNLLLIWQTRQILPVQIEAT

SEQ ID NO: 2732730 - protein, 24 aa, Entamoeba histolytica
KVLGWLRIIFYPRNYHRTKYYDNL

SEQ ID NO: 2732731 - protein, 17 aa, Entamoeba histolytica
KVPVGGVSLFGGFNPAK

SEQ ID NO: 2732732 - protein, 17 aa, Entamoeba histolytica
KVTATKTMLLFNQYLEK

SEQ ID NO: 2732733 - protein, 25 aa, Entamoeba histolytica
KVTHWIWYVFPVIQGLWGGRNNDLY

SEQ ID NO: 2732734 - protein, 22 aa, Entamoeba histolytica
KVVKLFLDTLKGYRIKFPHLQY

SEQ ID NO: 2732735 - protein, 25 aa, Entamoeba histolytica
KVWNMLIHHFYLKKALFELKEHKFV

SEQ ID NO: 2732736 - protein, 26 aa, Entamoeba histolytica
KVWNMLIHHFYLKKALFELKGHKFVQ

SEQ ID NO: 2732737 - protein, 23 aa, Entamoeba histolytica
KVYERLFDYFPSNKYRKFVDCKK

SEQ ID NO: 2732738 - protein, 20 aa, Entamoeba histolytica
KVYVSILIMFPLWEWNKLLV

SEQ ID NO: 2732739 - protein, 20 aa, Entamoeba histolytica
KWMYCFLFNDRLVETMPISI

SEQ ID NO: 2732740 - protein, 21 aa, Entamoeba histolytica
KYDVHWFIVDHWYLFSQLGQF

SEQ ID NO: 2732741 - protein, 20 aa, Entamoeba histolytica
KYDWALNFIKFLKEMVVYIK

SEQ ID NO: 2732742 - protein, 23 aa, Entamoeba histolytica
KYERLLQYFQLKSIIDLLGKVYF

SEQ ID NO: 2732743 - protein, 18 aa, Entamoeba histolytica
KYFIKKLLLIDFPSSFIS

SEQ ID NO: 2732744 - protein, 18 aa, Entamoeba histolytica
KYIEIQIKLLYPIAPHFC

SEQ ID NO: 2732745 - protein, 17 aa, Entamoeba histolytica
KYIHLLILLIRTRSRIT

SEQ ID NO: 2732746 - protein, 19 aa, Entamoeba histolytica
KYILKPCRFLRLREKEQVE

SEQ ID NO: 2732747 - protein, 17 aa, Entamoeba histolytica
KYKEKFLHFPSISYLIW

SEQ ID NO: 2732748 - protein, 23 aa, Entamoeba histolytica
KYKSWLIRFPTIQDLAKANLADV

SEQ ID NO: 2732749 - protein, 28 aa, Entamoeba histolytica
KYKTCYFTVWRYYGIFLIPMCCYISQGA

SEQ ID NO: 2732750 - protein, 18 aa, Entamoeba histolytica
KYSFVFEFFIKDYEIIYK

SEQ ID NO: 2732751 - protein, 17 aa, Entamoeba histolytica
KYSTLFFALLPESLYDV

SEQ ID NO: 2732752 - protein, 29 aa, Entamoeba histolytica
KYVPEFLFKFLLWLRKWLYPRNFLGGLFV

SEQ ID NO: 2732753 - protein, 24 aa, Entamoeba histolytica
LAIRTKLMRILPPRIKLDIYLTEG

SEQ ID NO: 2732754 - protein, 17 aa, Entamoeba histolytica
LANFLILPVQRLPRYVL

SEQ ID NO: 2732755 - protein, 20 aa, Entamoeba histolytica
LASQILANKLLMDSLPETTE

SEQ ID NO: 2732756 - protein, 26 aa, Entamoeba histolytica
LCFACQFHLLRLLYYKNLSIPIENAC

SEQ ID NO: 2732757 - protein, 17 aa, Entamoeba histolytica
LCFTVFSASLYSLNNKS

SEQ ID NO: 2732758 - protein, 18 aa, Entamoeba histolytica
LCFYYLNQKGYSLEFKKT

SEQ ID NO: 2732759 - protein, 18 aa, Entamoeba histolytica
LCLIFPYSPPHFSYSLDA

SEQ ID NO: 2732760 - protein, 24 aa, Entamoeba histolytica
LCNKFKIPFLFFKSQHPLYKIKEI

SEQ ID NO: 2732761 - protein, 19 aa, Entamoeba histolytica
LCQSCIFWFRLKASVTNAL

SEQ ID NO: 2732762 - protein, 24 aa, Entamoeba histolytica
LCSYGVFILLTPKTKFIWKGKFRN

SEQ ID NO: 2732763 - protein, 18 aa, Entamoeba histolytica
LCTGFDLFTTHEPCLMCG

SEQ ID NO: 2732764 - protein, 26 aa, Entamoeba histolytica
LCYQLPSYFIKGITLVVSPLVSLIQD

SEQ ID NO: 2732765 - protein, 20 aa, Entamoeba histolytica
LDCIISLFPPQKTFPMCTIA

SEQ ID NO: 2732766 - protein, 21 aa, Entamoeba histolytica
LDCPWYICYFMGRPQAHFVCT

SEQ ID NO: 2732767 - protein, 18 aa, Entamoeba histolytica
LDEKVDLLSLRKLSDQSS

SEQ ID NO: 2732768 - protein, 17 aa, Entamoeba histolytica
LDGLLREMMRTELETKL

SEQ ID NO: 2732769 - protein, 22 aa, Entamoeba histolytica
LDIQMYMRIAPELYLKELVVGG

SEQ ID NO: 2732770 - protein, 22 aa, Entamoeba histolytica
LDLAWSLLRTFPRDMLKRISNE

SEQ ID NO: 2732771 - protein, 19 aa, Entamoeba histolytica
LDLLVPLLQSLEKEKQRYL

SEQ ID NO: 2732772 - protein, 24 aa, Entamoeba histolytica
LDLRDYLIMPVQRLPRYSLLLTDL

SEQ ID NO: 2732773 - protein, 19 aa, Entamoeba histolytica
LDNQLYLHLKYEGIHLVIF

SEQ ID NO: 2732774 - protein, 22 aa, Entamoeba histolytica
LDQFYLHHNFMLFLMQVRQGLH

SEQ ID NO: 2732775 - protein, 24 aa, Entamoeba histolytica
LDSFQFVFLFLHLSFTFHHHISHP

SEQ ID NO: 2732776 - protein, 18 aa, Entamoeba histolytica
LDWWNNIEFPIPSWFRVN

SEQ ID NO: 2732777 - protein, 23 aa, Entamoeba histolytica
LEEKLIIDWFGRFGIEVGDFKTS

SEQ ID NO: 2732778 - protein, 19 aa, Entamoeba histolytica
LEELYIFYIHLRPLIPNEL

SEQ ID NO: 2732779 - protein, 20 aa, Entamoeba histolytica
LEFEKVFFPYLLISKKRYAG

SEQ ID NO: 2732780 - protein, 18 aa, Entamoeba histolytica
LEFIQWLYSLGISIISLH

SEQ ID NO: 2732781 - protein, 19 aa, Entamoeba histolytica
LEFLLIFLVNLNDSIIPSS

SEQ ID NO: 2732782 - protein, 21 aa, Entamoeba histolytica
LEGLFFVFAYFMDVTHAEECI

SEQ ID NO: 2732783 - protein, 23 aa, Entamoeba histolytica
LEGRRNIFLALQYKRLFTQEEFL

SEQ ID NO: 2732784 - protein, 19 aa, Entamoeba histolytica
LEINPIYQRLWFALGICCM

SEQ ID NO: 2732785 - protein, 25 aa, Entamoeba histolytica
LEKYDFLILVLLVLFCKVPKTPSIE

SEQ ID NO: 2732786 - protein, 26 aa, Entamoeba histolytica
LEKYDFLILVLLVLFCKVPKTPSIEK

SEQ ID NO: 2732787 - protein, 23 aa, Entamoeba histolytica
LELKIVLQRLLLKTKVLIKEICI

SEQ ID NO: 2732788 - protein, 17 aa, Entamoeba histolytica
LELPFVPFLSKADLLGG

SEQ ID NO: 2732789 - protein, 17 aa, Entamoeba histolytica
LENRWFTFPTLLHQYTI

SEQ ID NO: 2732790 - protein, 26 aa, Entamoeba histolytica
LESLAYMFIYFLKGKLPWQGFNRQNN

SEQ ID NO: 2732791 - protein, 24 aa, Entamoeba histolytica
LESLGYLFVYLLKGSLPWQDLSSS

SEQ ID NO: 2732792 - protein, 26 aa, Entamoeba histolytica
LETEIHPFMFYLNRPLVQTPKYESLI

SEQ ID NO: 2732793 - protein, 22 aa, Entamoeba histolytica
LEYIRVLPIRNIAFIRYKLRGS

SEQ ID NO: 2732794 - protein, 22 aa, Entamoeba histolytica
LEYYALWFSRLFTGDLGIWILD

SEQ ID NO: 2732795 - protein, 18 aa, Entamoeba histolytica
LFAFFKYYEFIISQSDNM

SEQ ID NO: 2732796 - protein, 17 aa, Entamoeba histolytica
LFARYRYLKEITALILD

SEQ ID NO: 2732797 - protein, 18 aa, Entamoeba histolytica
LFCEFFNTIPLAALFKCS

SEQ ID NO: 2732798 - protein, 18 aa, Entamoeba histolytica
LFCHQEDSFWPFEEPKKL

SEQ ID NO: 2732799 - protein, 19 aa, Entamoeba histolytica
LFELLNILTLKLLEIHIPP

SEQ ID NO: 2732800 - protein, 28 aa, Entamoeba histolytica
LFEMKQFPVIILKDNPVIFLLRSHRETL

SEQ ID NO: 2732801 - protein, 19 aa, Entamoeba histolytica
LFFMEILACTYIFGTAMPR

SEQ ID NO: 2732802 - protein, 19 aa, Entamoeba histolytica
LFFQNFLKKVLELLTTSTV

SEQ ID NO: 2732803 - protein, 17 aa, Entamoeba histolytica
LFFVITKTGFMQLVQYN

SEQ ID NO: 2732804 - protein, 18 aa, Entamoeba histolytica
LFFVLFVKRKKYYLNKID

SEQ ID NO: 2732805 - protein, 24 aa, Entamoeba histolytica
LFFYDLPSTLFKYLLYPIIFKDSF

SEQ ID NO: 2732806 - protein, 17 aa, Entamoeba histolytica
LFHRAVFFTAALLRFHI

SEQ ID NO: 2732807 - protein, 17 aa, Entamoeba histolytica
LFIALMESDIELSQKYI

SEQ ID NO: 2732808 - protein, 17 aa, Entamoeba histolytica
LFIKILCFFVKEWRYRN

SEQ ID NO: 2732809 - protein, 17 aa, Entamoeba histolytica
LFKIILKNTIHLSLSNY

SEQ ID NO: 2732810 - protein, 21 aa, Entamoeba histolytica
LFLKFSPFFIVYRNFLINHNK

SEQ ID NO: 2732811 - protein, 21 aa, Entamoeba histolytica
LFNHFYVLWPHKFINVTNGVT

SEQ ID NO: 2732812 - protein, 23 aa, Entamoeba histolytica
LFVEFLTKKWFFTLFTHWNYYVR

SEQ ID NO: 2732813 - protein, 17 aa, Entamoeba histolytica
LFVFKYLFMFLTKVMAE

SEQ ID NO: 2732814 - protein, 24 aa, Entamoeba histolytica
LFWMFKYVMDFLQPFYFCKGDIIM

SEQ ID NO: 2732815 - protein, 17 aa, Entamoeba histolytica
LFWRYILELLLLCELKV

SEQ ID NO: 2732816 - protein, 18 aa, Entamoeba histolytica
LGCMLYEFVVGYPPFNAS

SEQ ID NO: 2732817 - protein, 22 aa, Entamoeba histolytica
LGDFNMAFIIYSCIIRASYKHS

SEQ ID NO: 2732818 - protein, 17 aa, Entamoeba histolytica
LGEICNGLWYLHFTKKL

SEQ ID NO: 2732819 - protein, 18 aa, Entamoeba histolytica
LGFRMQWICPFNASQKTS

SEQ ID NO: 2732820 - protein, 23 aa, Entamoeba histolytica
LGGMMILCIPPYRLPRDKLDEDI

SEQ ID NO: 2732821 - protein, 31 aa, Entamoeba histolytica
LGPEFYYNLYLFPYLVFIGFTRCHLPISGVS

SEQ ID NO: 2732822 - protein, 18 aa, Entamoeba histolytica
LHELWSLLQFLLPEIFNT

SEQ ID NO: 2732823 - protein, 17 aa, Entamoeba histolytica
LHFIFYHYNSRVFKDFN

SEQ ID NO: 2732824 - protein, 19 aa, Entamoeba histolytica
LHHLPNSYYLERLFCFYIP

SEQ ID NO: 2732825 - protein, 21 aa, Entamoeba histolytica
LHLFIPRVPPFSVTLTFLTSL

SEQ ID NO: 2732826 - protein, 18 aa, Entamoeba histolytica
LHLHYKGVILGYIKELFN

SEQ ID NO: 2732827 - protein, 20 aa, Entamoeba histolytica
LHLYPFLEKIVPAKLLVPTK

SEQ ID NO: 2732828 - protein, 21 aa, Entamoeba histolytica
LHPEDLLPFLRKPILLIIDSD

SEQ ID NO: 2732829 - protein, 24 aa, Entamoeba histolytica
LHPYTFIRGYLTISLIGIICTYTE

SEQ ID NO: 2732830 - protein, 24 aa, Entamoeba histolytica
LHQKYPYLPFFFHCRKSWSDLCQL

SEQ ID NO: 2732831 - protein, 22 aa, Entamoeba histolytica
LHRSFDCATPLLIQWTYQAMIH

SEQ ID NO: 2732832 - protein, 18 aa, Entamoeba histolytica
LHYKLLIQTLLTLRHYNE

SEQ ID NO: 2732833 - protein, 17 aa, Entamoeba histolytica
LIDSFILHPLLFHKIEN

SEQ ID NO: 2732834 - protein, 18 aa, Entamoeba histolytica
LIEPYFLHQLLFSSKSKL

SEQ ID NO: 2732835 - protein, 18 aa, Entamoeba histolytica
LIFIQYQSFFAKFVEFLR

SEQ ID NO: 2732836 - protein, 17 aa, Entamoeba histolytica
LIKLWFRELPRPILNVL

SEQ ID NO: 2732837 - protein, 19 aa, Entamoeba histolytica
LILILRNRLNYALNGREVT

SEQ ID NO: 2732838 - protein, 32 aa, Entamoeba histolytica
LINENKHKRAYKEYKIYLKGEDISKVTEEPSN

SEQ ID NO: 2732839 - protein, 17 aa, Entamoeba histolytica
LINWFKIRGIGNLIKEL

SEQ ID NO: 2732840 - protein, 18 aa, Entamoeba histolytica
LINYLKPKKFPFVKIEKQ

SEQ ID NO: 2732841 - protein, 19 aa, Entamoeba histolytica
LIQKILILPLSLPKELFNE

SEQ ID NO: 2732842 - protein, 17 aa, Entamoeba histolytica
LIWPLLEKKLKISGETL

SEQ ID NO: 2732843 - protein, 25 aa, Entamoeba histolytica
LIYPFTWQHVLIPILPPDLLSLAFA

SEQ ID NO: 2732844 - protein, 17 aa, Entamoeba histolytica
LIYPFVWHHVLIPILPV

SEQ ID NO: 2732845 - protein, 18 aa, Entamoeba histolytica
LKDTLRFILMTKIKDWKC

SEQ ID NO: 2732846 - protein, 18 aa, Entamoeba histolytica
LKELFFVLFVKRKKYYLN

SEQ ID NO: 2732847 - protein, 22 aa, Entamoeba histolytica
LKELWSLLHFLHPKKFISFEEF

SEQ ID NO: 2732848 - protein, 17 aa, Entamoeba histolytica
LKGNVRVFCRVRPPLKN

SEQ ID NO: 2732849 - protein, 25 aa, Entamoeba histolytica
LKITPFSGGFIFMYDIRYLTDLIRS

SEQ ID NO: 2732850 - protein, 18 aa, Entamoeba histolytica
LKKDDLWILLPQEYPYSF

SEQ ID NO: 2732851 - protein, 35 aa, Entamoeba histolytica
LKKKYLPVYIVVSPPLLLIFQSQNDYKNIKPFAIL

SEQ ID NO: 2732852 - protein, 23 aa, Entamoeba histolytica
LKKLMVVVFPIYYEPFGCYINHP

SEQ ID NO: 2732853 - protein, 24 aa, Entamoeba histolytica
LKLKLYIPFILMKDKTLLVLSLEI

SEQ ID NO: 2732854 - protein, 24 aa, Entamoeba histolytica
LKNLDEILWNDQKWRKLGMSDLCD

SEQ ID NO: 2732855 - protein, 31 aa, Entamoeba histolytica; identical to SEQ ID NO: 2546225

SEQ ID NO: 2732856 - protein, 19 aa, Entamoeba histolytica
LKSLPLPRTVLTDGSIPSK

SEQ ID NO: 2732857 - protein, 30 aa, Entamoeba histolytica
LKTEFSDGILFARILNYYKPNIIAYNTLTR

SEQ ID NO: 2732858 - protein, 20 aa, Entamoeba histolytica
LKWEVILPFEIPYGFELLTK

SEQ ID NO: 2732859 - protein, 26 aa, Entamoeba histolytica
LLALSLILAILLYKPSPLYILDEVDA

SEQ ID NO: 2732860 - protein, 18 aa, Entamoeba histolytica
LLCLIINYSLYPVSKQFN

SEQ ID NO: 2732861 - protein, 39 aa, Entamoeba histolytica; identical to SEQ ID NO: 2532079

SEQ ID NO: 2732862 - protein, 17 aa, Entamoeba histolytica
LLFILTLIEKQPKDKIK

SEQ ID NO: 2732863 - protein, 19 aa, Entamoeba histolytica
LLGQFYPITFPISKFLVLQ

SEQ ID NO: 2732864 - protein, 20 aa, Entamoeba histolytica
LLHSTLKHPFAISILLECFL

SEQ ID NO: 2732865 - protein, 18 aa, Entamoeba histolytica
LLIFMLQKLFALVHGEID

SEQ ID NO: 2732866 - protein, 17 aa, Entamoeba histolytica
LLIIFRITQDRVGAKKC

SEQ ID NO: 2732867 - protein, 19 aa, Entamoeba histolytica
LLKLLIILFSPNKPIDMLW

SEQ ID NO: 2732868 - protein, 18 aa, Entamoeba histolytica
LLKLLRLLSSNEIKRIET

SEQ ID NO: 2732869 - protein, 20 aa, Entamoeba histolytica
LLLLNKIIPYSYDYYSNIIP

SEQ ID NO: 2732870 - protein, 18 aa, Entamoeba histolytica
LLLPKRKDIWYYFNKVIV

SEQ ID NO: 2732871 - protein, 28 aa, Entamoeba histolytica
LLRPGRLDQLLFIPLPDKASRISILQAK

SEQ ID NO: 2732872 - protein, 18 aa, Entamoeba histolytica
LLRSALYYIQKMLKVFGI

SEQ ID NO: 2732873 - protein, 17 aa, Entamoeba histolytica
LLRYKFLLAFEREMLHL

SEQ ID NO: 2732874 - protein, 18 aa, Entamoeba histolytica
LLRYKFLLAFEREMLHLE

SEQ ID NO: 2732875 - protein, 25 aa, Entamoeba histolytica
LLSLTHMILLYYFPDVTIHLDKMKL

SEQ ID NO: 2732876 - protein, 18 aa, Entamoeba histolytica
LLSRFDLIFIILDSSTEE

SEQ ID NO: 2732877 - protein, 20 aa, Entamoeba histolytica
LLSVLCILLASLNYKVLVCA

SEQ ID NO: 2732878 - protein, 17 aa, Entamoeba histolytica
LLTEAFPGLLVTSQERK

SEQ ID NO: 2732879 - protein, 24 aa, Entamoeba histolytica
LLTFFDLIHFPLKKPNWIGCNNQL

SEQ ID NO: 2732880 - protein, 17 aa, Entamoeba histolytica
LLTKHNFKYGYTGKLKP

SEQ ID NO: 2732881 - protein, 19 aa, Entamoeba histolytica
LLTNFFYFYVPNGSNLMDK

SEQ ID NO: 2732882 - protein, 17 aa, Entamoeba histolytica
LLVAIRKSGWRVPNPIY

SEQ ID NO: 2732883 - protein, 24 aa, Entamoeba histolytica
LLVEKFFFFLLETINRVKSFEYKK

SEQ ID NO: 2732884 - protein, 20 aa, Entamoeba histolytica
LLYIFDGIFPLNVGIAQLPP

SEQ ID NO: 2732885 - protein, 17 aa, Entamoeba histolytica
LLYRFICKLINRSYVRF

SEQ ID NO: 2732886 - protein, 17 aa, Entamoeba histolytica
LMKFPPVFALRPLIDMA

SEQ ID NO: 2732887 - protein, 25 aa, Entamoeba histolytica
LMKKYFGILFIKLPQEFIEFLEERD

SEQ ID NO: 2732888 - protein, 18 aa, Entamoeba histolytica
LMKYKFAELALLFVRDVH

SEQ ID NO: 2732889 - protein, 17 aa, Entamoeba histolytica
LMLLFSDIVLFIPATKP

SEQ ID NO: 2732890 - protein, 18 aa, Entamoeba histolytica
LMWNCFLALVLNIKGKIG

SEQ ID NO: 2732891 - protein, 18 aa, Entamoeba histolytica
LNCLFIRYFPRAICLNCV

SEQ ID NO: 2732892 - protein, 24 aa, Entamoeba histolytica
LNDPTLIRLFLQNGLFKEFFEKHP

SEQ ID NO: 2732893 - protein, 23 aa, Entamoeba histolytica
LNDQYHFFFLIQDVTFPEEQKKE

SEQ ID NO: 2732894 - protein, 20 aa, Entamoeba histolytica
LNDVWNLDIILTTGAAKPVE

SEQ ID NO: 2732895 - protein, 17 aa, Entamoeba histolytica
LNDYRFFSFESTGPEQK

SEQ ID NO: 2732896 - protein, 22 aa, Entamoeba histolytica
LNECLINKLWFNKLLDIDIKNT

SEQ ID NO: 2732897 - protein, 29 aa, Entamoeba histolytica
LNEIRHFYLYLLWILKNMDLRTLINLINK

SEQ ID NO: 2732898 - protein, 23 aa, Entamoeba histolytica
LNHYILFKKLPIKIPVYFISFLK

SEQ ID NO: 2732899 - protein, 19 aa, Entamoeba histolytica
LNIFPFRKWSDKEIPEFHE

SEQ ID NO: 2732900 - protein, 17 aa, Entamoeba histolytica
LNKGFMPIIYDIFKYLP

SEQ ID NO: 2732901 - protein, 20 aa, Entamoeba histolytica
LNLILPVLYFAFNNMLNHEK

SEQ ID NO: 2732902 - protein, 19 aa, Entamoeba histolytica
LNNCPLYQLLPLQAFCDLL

SEQ ID NO: 2732903 - protein, 24 aa, Entamoeba histolytica
LNQKLIILFILYTVYMTQPKDKSP

SEQ ID NO: 2732904 - protein, 18 aa, Entamoeba histolytica
LNSKFQIISFGSTYDFIF

SEQ ID NO: 2732905 - protein, 24 aa, Entamoeba histolytica
LNSNPFFLQPMTPPALIRINQQEE

SEQ ID NO: 2732906 - protein, 24 aa, Entamoeba histolytica
LNTRMHLWLEYYTINQAMSSNHDS

SEQ ID NO: 2732907 - protein, 35 aa, Entamoeba histolytica
LNVLQPFVWQHILIPILPLFLSSYLSSILPCIIGC

SEQ ID NO: 2732908 - protein, 18 aa, Entamoeba histolytica
LNYLYGIIVPQFIFLRKE

SEQ ID NO: 2732909 - protein, 17 aa, Entamoeba histolytica
LPFVPFLSKADLLGGYG

SEQ ID NO: 2732910 - protein, 19 aa, Entamoeba histolytica
LPGYLPTASAFPFFISLFS

SEQ ID NO: 2732911 - protein, 18 aa, Entamoeba histolytica
LPIKIPVYFISFLKKKFG

SEQ ID NO: 2732912 - protein, 20 aa, Entamoeba histolytica
LPIKSFPPNLQYLSLPSIKQ

SEQ ID NO: 2732913 - protein, 17 aa, Entamoeba histolytica
LPILMYRVKWLGKELFL

SEQ ID NO: 2732914 - protein, 24 aa, Entamoeba histolytica
LPKHFLCFRFIKTPDLIELHWSKK

SEQ ID NO: 2732915 - protein, 19 aa, Entamoeba histolytica
LPKLFYIWTEIRPNMKELK

SEQ ID NO: 2732916 - protein, 19 aa, Entamoeba histolytica
LPNNCSVLIYGFLPSLQLN

SEQ ID NO: 2732917 - protein, 21 aa, Entamoeba histolytica
LPPLKVLPKGLFYNCGFKEFD

SEQ ID NO: 2732918 - protein, 22 aa, Entamoeba histolytica
LPPVYTYFYLCVIVSSEGFVKI

SEQ ID NO: 2732919 - protein, 18 aa, Entamoeba histolytica
LPREVILWVLLPADEESY

SEQ ID NO: 2732920 - protein, 20 aa, Entamoeba histolytica
LPTEFLPYAFNWLLQFTSVP

SEQ ID NO: 2732921 - protein, 17 aa, Entamoeba histolytica
LPTVWKYFFLFSDILVV

SEQ ID NO: 2732922 - protein, 18 aa, Entamoeba histolytica
LQAMLFGLQLKPLPTVKR

SEQ ID NO: 2732923 - protein, 19 aa, Entamoeba histolytica
LQHLRLNFLLDYFPNIETI

SEQ ID NO: 2732924 - protein, 17 aa, Entamoeba histolytica
LQHVLLPTTLTLIGDNC

SEQ ID NO: 2732925 - protein, 20 aa, Entamoeba histolytica
LQKKWYFPIIQSIKPQQFSQ

SEQ ID NO: 2732926 - protein, 22 aa, Entamoeba histolytica
LQKKWYFPIIQSIKPQQFSQII

SEQ ID NO: 2732927 - protein, 17 aa, Entamoeba histolytica
LQLFKLYDFTERKCYYG

SEQ ID NO: 2732928 - protein, 18 aa, Entamoeba histolytica
LQLYGNLFYLLQSDPVYV

SEQ ID NO: 2732929 - protein, 23 aa, Entamoeba histolytica
LQQNTPRYILKLSVNYISEAKIE

SEQ ID NO: 2732930 - protein, 17 aa, Entamoeba histolytica
LQQTLLMLPTSNAILLL

SEQ ID NO: 2732931 - protein, 22 aa, Entamoeba histolytica
LQRQMMFLTRFFKTLVDLPSNI

SEQ ID NO: 2732932 - protein, 26 aa, Entamoeba histolytica
LQVIQNHFAIFNLLPGTYHVCSYSKE

SEQ ID NO: 2732933 - protein, 17 aa, Entamoeba histolytica
LQYLKILLKHQYYKEFQ

SEQ ID NO: 2732934 - protein, 20 aa, Entamoeba histolytica
LQYLRLNPPFKFLNPAYEGI

SEQ ID NO: 2732935 - protein, 18 aa, Entamoeba histolytica
LQYQFFEVLKYLHSLHIV

SEQ ID NO: 2732936 - protein, 18 aa, Entamoeba histolytica
LRCYLRALDYLDNDYRIP

SEQ ID NO: 2732937 - protein, 17 aa, Entamoeba histolytica
LRGLHGVLFCFDITKKE

SEQ ID NO: 2732938 - protein, 22 aa, Entamoeba histolytica
LRLKIMNFVRIWIKNAWRDFEG

SEQ ID NO: 2732939 - protein, 18 aa, Entamoeba histolytica
LRPLAWKIFLKIIKPQAS

SEQ ID NO: 2732940 - protein, 17 aa, Entamoeba histolytica
LSFFTYFFSVNSPIIRR

SEQ ID NO: 2732941 - protein, 18 aa, Entamoeba histolytica
LSFLILPFYHPAPEFLEA

SEQ ID NO: 2732942 - protein, 24 aa, Entamoeba histolytica
LSFNIIQWLFFGIPFTKDTIISFF

SEQ ID NO: 2732943 - protein, 19 aa, Entamoeba histolytica
LSHLLSLRFRFPSTCDLRF

SEQ ID NO: 2732944 - protein, 24 aa, Entamoeba histolytica
LSKGYGFIYFYTSIIANIVIENCN

SEQ ID NO: 2732945 - protein, 18 aa, Entamoeba histolytica
LSKYYFEHLLKNSYAQFL

SEQ ID NO: 2732946 - protein, 19 aa, Entamoeba histolytica
LSLDRQWLITFGSNIKNLL

SEQ ID NO: 2732947 - protein, 19 aa, Entamoeba histolytica
LSLEYFLKLQYEPIPFSSF

SEQ ID NO: 2732948 - protein, 18 aa, Entamoeba histolytica
LSLQEWYRMLWDYDYFEY

SEQ ID NO: 2732949 - protein, 23 aa, Entamoeba histolytica
LSQIIFMRYFLYNSLNSCDPLYV

SEQ ID NO: 2732950 - protein, 23 aa, Entamoeba histolytica
LSSLALIFALHHYKPTPIYVMDE

SEQ ID NO: 2732951 - protein, 22 aa, Entamoeba histolytica
LSTHYYWIAKQYQLLALIYERS

SEQ ID NO: 2732952 - protein, 23 aa, Entamoeba histolytica
LSYKHLLRLYGRMNLLLSQIDKK

SEQ ID NO: 2732953 - protein, 25 aa, Entamoeba histolytica
LTDYNIYLKFLPYYFPTTKLDDNEP

SEQ ID NO: 2732954 - protein, 20 aa, Entamoeba histolytica
LTFFSPLILCYIPTSVKRIY

SEQ ID NO: 2732955 - protein, 18 aa, Entamoeba histolytica
LTFSLLHSTLKHPFAISI

SEQ ID NO: 2732956 - protein, 18 aa, Entamoeba histolytica
LTGRYYAKKILTPNFCRV

SEQ ID NO: 2732957 - protein, 19 aa, Entamoeba histolytica
LTIKLLLLFGDHLFSTPKI

SEQ ID NO: 2732958 - protein, 25 aa, Entamoeba histolytica
LTIKQLYHFLAYYVLDTLFTQPEKI

SEQ ID NO: 2732959 - protein, 19 aa, Entamoeba histolytica
LTKFKGTAIATNYPLYSPS

SEQ ID NO: 2732960 - protein, 17 aa, Entamoeba histolytica
LTKLKAPKWFRDILDKT

SEQ ID NO: 2732961 - protein, 25 aa, Entamoeba histolytica
LTLGLVWTLILRFAISELSAEGLSA

SEQ ID NO: 2732962 - protein, 18 aa, Entamoeba histolytica
LTLLYPQPIWNLTPYQYI

SEQ ID NO: 2732963 - protein, 17 aa, Entamoeba histolytica
LTMKIKYMELQMSAPQK

SEQ ID NO: 2732964 - protein, 18 aa, Entamoeba histolytica
LTMYLVYYVLNDKNIRDD

SEQ ID NO: 2732965 - protein, 29 aa, Entamoeba histolytica
LTNTIQNIYNNIHLIAETLTEPAPANSQS

SEQ ID NO: 2732966 - protein, 22 aa, Entamoeba histolytica
LTRLNLPILDVFWLSQYPAVLL

SEQ ID NO: 2732967 - protein, 18 aa, Entamoeba histolytica
LTRPILLQLLRKVLYTEN

SEQ ID NO: 2732968 - protein, 21 aa, Entamoeba histolytica
LTSLCYFFIFLQPKYIVHSLP

SEQ ID NO: 2732969 - protein, 23 aa, Entamoeba histolytica
LTSRRPLLNHIILAGGSTLFPGL

SEQ ID NO: 2732970 - protein, 24 aa, Entamoeba histolytica
LTSRRPLLNHIILSGGSTLFPGLP

SEQ ID NO: 2732971 - protein, 25 aa, Entamoeba histolytica
LTYQEWFKMLWYKGLFTYYREDLHL

SEQ ID NO: 2732972 - protein, 17 aa, Entamoeba histolytica
LVFAFPSDEGFPFCLDC

SEQ ID NO: 2732973 - protein, 23 aa, Entamoeba histolytica
LVKFLDSWLCIFSSELFIGKSFK

SEQ ID NO: 2732974 - protein, 19 aa, Entamoeba histolytica
LVLNKLRGLPIAAVRAPGF

SEQ ID NO: 2732975 - protein, 17 aa, Entamoeba histolytica
LVPLLRLAWNHFDPNFI

SEQ ID NO: 2732976 - protein, 22 aa, Entamoeba histolytica
LVQSWRYCLYYGWLLINSPTTL

SEQ ID NO: 2732977 - protein, 18 aa, Entamoeba histolytica
LVTMKWWNDLWLNEGFAS

SEQ ID NO: 2732978 - protein, 17 aa, Entamoeba histolytica
LVYTLFDSFPIAVRVGT

SEQ ID NO: 2732979 - protein, 19 aa, Entamoeba histolytica
LWRCIIKYSLFQLIPWLGI

SEQ ID NO: 2732980 - protein, 18 aa, Entamoeba histolytica
LWSLGIILLRFWFGYKEA

SEQ ID NO: 2732981 - protein, 19 aa, Entamoeba histolytica
LYDEYIMMQIPSVLPIQKG

SEQ ID NO: 2732982 - protein, 20 aa, Entamoeba histolytica
LYDILRFWGIYSLYSSIDPS

SEQ ID NO: 2732983 - protein, 24 aa, Entamoeba histolytica
LYDKQLFVDYILPKHFPNVKQESF

SEQ ID NO: 2732984 - protein, 17 aa, Entamoeba histolytica
LYHYIKVDPLPLLRERI

SEQ ID NO: 2732985 - protein, 18 aa, Entamoeba histolytica
LYITPLYVNVLTSGIWPF

SEQ ID NO: 2732986 - protein, 18 aa, Entamoeba histolytica
LYLLPKYSEKLRFLGAPK

SEQ ID NO: 2732987 - protein, 17 aa, Entamoeba histolytica
LYMWVPLQSQKPVHRLV

SEQ ID NO: 2732988 - protein, 17 aa, Entamoeba histolytica
LYNKVEIPYLLEDNKTS

SEQ ID NO: 2732989 - protein, 18 aa, Entamoeba histolytica
LYPYLWQPSISVLEGTII

SEQ ID NO: 2732990 - protein, 20 aa, Entamoeba histolytica
LYQIETPLLHLIYKGKNLKN

SEQ ID NO: 2732991 - protein, 17 aa, Entamoeba histolytica
LYQLIEALLKLVKDINN

SEQ ID NO: 2732992 - protein, 24 aa, Entamoeba histolytica
LYRIKYYVPYYYYLENKKNWIQCD

SEQ ID NO: 2732993 - protein, 17 aa, Entamoeba histolytica
LYTLQLVDKILFPEKDN

SEQ ID NO: 2732994 - protein, 18 aa, Entamoeba histolytica
LYVLLKLNMIHGKVLIFV

SEQ ID NO: 2732995 - protein, 21 aa, Entamoeba histolytica
MAQALFIYWKSKELMRSKDIQ

SEQ ID NO: 2732996 - protein, 23 aa, Entamoeba histolytica
MCLLYLFKIQFPNQFFLLRGNHE

SEQ ID NO: 2732997 - protein, 19 aa, Entamoeba histolytica
MCLYNKCTVIKILVGWMKD

SEQ ID NO: 2732998 - protein, 23 aa, Entamoeba histolytica
MDKSMTFYGFKNKLGLLPKLWRN

SEQ ID NO: 2732999 - protein, 20 aa, Entamoeba histolytica
MDTFAYLPFFLTSFKDINSL

SEQ ID NO: 2733000 - protein, 23 aa, Entamoeba histolytica
MDVGYQCLFLIATSSLYCFDINT

SEQ ID NO: 2733001 - protein, 24 aa, Entamoeba histolytica
MEAEGIPICEWPMWINSQIEHTEI

SEQ ID NO: 2733002 - protein, 18 aa, Entamoeba histolytica
MEHWYVQLILLAPPNQRL

SEQ ID NO: 2733003 - protein, 17 aa, Entamoeba histolytica
MEMTFAEVILVLKANYE

SEQ ID NO: 2733004 - protein, 18 aa, Entamoeba histolytica
MERKEFFDLFKQSSYFKD

SEQ ID NO: 2733005 - protein, 19 aa, Entamoeba histolytica
MEVWHFIRLTGTTAFISDD

SEQ ID NO: 2733006 - protein, 23 aa, Entamoeba histolytica
MFEWNYLWFIHSLKFELAIRVFD

SEQ ID NO: 2733007 - protein, 17 aa, Entamoeba histolytica
MFNKNPRWILFYELVLT

SEQ ID NO: 2733008 - protein, 19 aa, Entamoeba histolytica
MFYYFGWNSWNGWIPAWCV

SEQ ID NO: 2733009 - protein, 24 aa, Entamoeba histolytica
MGDRAIFVFGFHALQFLYLDPHIV

SEQ ID NO: 2733010 - protein, 21 aa, Entamoeba histolytica
MGFLLLKNYLLNLPVPLLSSN

SEQ ID NO: 2733011 - protein, 25 aa, Entamoeba histolytica
MGFPDYICIFALRKYKWNVEESIPW

SEQ ID NO: 2733012 - protein, 18 aa, Entamoeba histolytica
MGYITVRFKHLRSSPLEI

SEQ ID NO: 2733013 - protein, 18 aa, Entamoeba histolytica
MHGYFMHIKLYQRAMALK

SEQ ID NO: 2733014 - protein, 18 aa, Entamoeba histolytica
MIALKILRIGFNKLSGNI

SEQ ID NO: 2733015 - protein, 24 aa, Entamoeba histolytica
MIEIICNIFPFYKFWEHVCVVWTN

SEQ ID NO: 2733016 - protein, 17 aa, Entamoeba histolytica
MIFTIVASKLSSPSFEL

SEQ ID NO: 2733017 - protein, 19 aa, Entamoeba histolytica
MIKCKLLQKTLFPSTLKRL

SEQ ID NO: 2733018 - protein, 17 aa, Entamoeba histolytica
MIMFPYDYPMKPPFFFT

SEQ ID NO: 2733019 - protein, 22 aa, Entamoeba histolytica
MISGIYMGWLARLAIRELIEKK

SEQ ID NO: 2733020 - protein, 18 aa, Entamoeba histolytica
MITFILIAFKMVQCNIER

SEQ ID NO: 2733021 - protein, 22 aa, Entamoeba histolytica
MIYRAFISLPYKTFPKYQLNLF

SEQ ID NO: 2733022 - protein, 21 aa, Entamoeba histolytica
MKAIFYFFVVNGKVLELMEWV

SEQ ID NO: 2733023 - protein, 23 aa, Entamoeba histolytica
MKIKLLPYHSLPFAWINPIKERK

SEQ ID NO: 2733024 - protein, 21 aa, Entamoeba histolytica
MKLCEPYLNEGIHPRLLVEGI

SEQ ID NO: 2733025 - protein, 22 aa, Entamoeba histolytica
MKNFTIITLLKTLGIKTKTEVC

SEQ ID NO: 2733026 - protein, 23 aa, Entamoeba histolytica
MKSHKTWFTRLLLSQAFQCFLSI

SEQ ID NO: 2733027 - protein, 21 aa, Entamoeba histolytica
MKYKWYKLKIPSFTTSACVLK

SEQ ID NO: 2733028 - protein, 25 aa, Entamoeba histolytica
MLCSYCLPFLFYKQTILFNRDLIIK

SEQ ID NO: 2733029 - protein, 18 aa, Entamoeba histolytica
MLDYFLFHGHVCIVTELL

SEQ ID NO: 2733030 - protein, 17 aa, Entamoeba histolytica
MLIWKLEETHRIVLEVI

SEQ ID NO: 2733031 - protein, 19 aa, Entamoeba histolytica
MLMGFFRALMVWETSLKKS

SEQ ID NO: 2733032 - protein, 18 aa, Entamoeba histolytica
MLPLCFLIESIHLKGGLE

SEQ ID NO: 2733033 - protein, 17 aa, Entamoeba histolytica
MLQIITWQDPFPKTLYP

SEQ ID NO: 2733034 - protein, 17 aa, Entamoeba histolytica
MLTEIPYFRDILLAHFQ

SEQ ID NO: 2733035 - protein, 23 aa, Entamoeba histolytica
MMDLMDYLLVIPLPIIQNYIGDN

SEQ ID NO: 2733036 - protein, 19 aa, Entamoeba histolytica
MMIICKYFINIKDIINIEL

SEQ ID NO: 2733037 - protein, 19 aa, Entamoeba histolytica
MMMNIEKQFKLLEQQKTLH

SEQ ID NO: 2733038 - protein, 23 aa, Entamoeba histolytica
MNDPEFFIFSLKGYNLYDSPKKF

SEQ ID NO: 2733039 - protein, 18 aa, Entamoeba histolytica
MNIFYGFELFFIISKQGV

SEQ ID NO: 2733040 - protein, 23 aa, Entamoeba histolytica
MNIQYKFFIKCIQIASSKLNGFI

SEQ ID NO: 2733041 - protein, 17 aa, Entamoeba histolytica
MNKLLKFMLVNKIVRAT

SEQ ID NO: 2733042 - protein, 23 aa, Entamoeba histolytica
MNKNNLIFLLFIKEKVFGISLNK

SEQ ID NO: 2733043 - protein, 20 aa, Entamoeba histolytica
MNMHILFKIILKNTIHLSLS

SEQ ID NO: 2733044 - protein, 23 aa, Entamoeba histolytica
MNNNYYILVLLIISNINGSYCDL

SEQ ID NO: 2733045 - protein, 20 aa, Entamoeba histolytica
MNQDTLWYLCSFLYEIQLNE

SEQ ID NO: 2733046 - protein, 23 aa, Entamoeba histolytica
MNRQGIIPIFLYATLGADALDYI

SEQ ID NO: 2733047 - protein, 17 aa, Entamoeba histolytica
MQIYFSYRFLALHSPEE

SEQ ID NO: 2733048 - protein, 27 aa, Entamoeba histolytica
MRGANKHLFIAYYTLFVKPVFEIYQKT

SEQ ID NO: 2733049 - protein, 17 aa, Entamoeba histolytica
MRLIIMSATLRVSEFTE

SEQ ID NO: 2733050 - protein, 18 aa, Entamoeba histolytica
MRNFIYFLPYVMKHRDVY

SEQ ID NO: 2733051 - protein, 20 aa, Entamoeba histolytica
MSEPFPFIPLLLDENYRISG

SEQ ID NO: 2733052 - protein, 18 aa, Entamoeba histolytica
MSFILYNDYLYSEAMYFI

SEQ ID NO: 2733053 - protein, 18 aa, Entamoeba histolytica
MSFLIWALNRKFSFSFQK

SEQ ID NO: 2733054 - protein, 24 aa, Entamoeba histolytica
MTELDAHLYFLIPISIYLGNLTSD

SEQ ID NO: 2733055 - protein, 19 aa, Entamoeba histolytica
MTFIPLLLLKYNKFEHCVI

SEQ ID NO: 2733056 - protein, 26 aa, Entamoeba histolytica
MTKDDGFFCFILKSPLIKKPIKVVRK

SEQ ID NO: 2733057 - protein, 17 aa, Entamoeba histolytica
MWFGDLVTMKWWNDLWL

SEQ ID NO: 2733058 - protein, 17 aa, Entamoeba histolytica
MYLLYYFCSALKERFSD

SEQ ID NO: 2733059 - protein, 21 aa, Entamoeba histolytica
NAAYVRFLMKLFRILGRSEVM

SEQ ID NO: 2733060 - protein, 17 aa, Entamoeba histolytica
NAEKLIRMAKSFGLEVT

SEQ ID NO: 2733061 - protein, 20 aa, Entamoeba histolytica
NAMIPKYYLLIKNILERIER

SEQ ID NO: 2733062 - protein, 21 aa, Entamoeba histolytica
NAMYKLLFFPMSVNDFNVVLD

SEQ ID NO: 2733063 - protein, 23 aa, Entamoeba histolytica
NAQQYFLVTPKLLSDLPFGENMT

SEQ ID NO: 2733064 - protein, 24 aa, Entamoeba histolytica
NATKRIRIGKFPKYLLIKLERQIA

SEQ ID NO: 2733065 - protein, 18 aa, Entamoeba histolytica
NCCILLDKILLPDSVYKI

SEQ ID NO: 2733066 - protein, 17 aa, Entamoeba histolytica
NCFYYFATTMFFTLSPT

SEQ ID NO: 2733067 - protein, 17 aa, Entamoeba histolytica
NCPMALSTPLPLPSNPL

SEQ ID NO: 2733068 - protein, 18 aa, Entamoeba histolytica
NDFILPITKLIISIITHP

SEQ ID NO: 2733069 - protein, 24 aa, Entamoeba histolytica
NDIPENIFWCKYFRFLYTKCGKEK

SEQ ID NO: 2733070 - protein, 19 aa, Entamoeba histolytica
NDQMILILIRHGASLNITN

SEQ ID NO: 2733071 - protein, 24 aa, Entamoeba histolytica
NDSVWLKYLVTLPYQFYKEGLEIN

SEQ ID NO: 2733072 - protein, 22 aa, Entamoeba histolytica
NEDILFTVWWVLQSIVQNNPIG

SEQ ID NO: 2733073 - protein, 17 aa, Entamoeba histolytica
NEDVFFYFTKYISFQAN

SEQ ID NO: 2733074 - protein, 23 aa, Entamoeba histolytica
NEFCTYILFFLKAVRLVPEVAGL

SEQ ID NO: 2733075 - protein, 24 aa, Entamoeba histolytica
NEFNHQYILFSYGKHDRYKHPSTS

SEQ ID NO: 2733076 - protein, 23 aa, Entamoeba histolytica
NEKEYCWCYKRKGTTRSSLVIFN

SEQ ID NO: 2733077 - protein, 29 aa, Entamoeba histolytica
NELESFIIFYLMMKLIRPFYLIQTNASAS

SEQ ID NO: 2733078 - protein, 21 aa, Entamoeba histolytica
NELFMTLEKRGLRYRMRVTHV

SEQ ID NO: 2733079 - protein, 17 aa, Entamoeba histolytica
NELLEETIDLWKKLRER

SEQ ID NO: 2733080 - protein, 24 aa, Entamoeba histolytica
NELRLRLCVLFLRTLYEELLKHKA

SEQ ID NO: 2733081 - protein, 24 aa, Entamoeba histolytica
NEQLSLIYIFAQLLEKLLVIDPTK

SEQ ID NO: 2733082 - protein, 25 aa, Entamoeba histolytica
NEQMKMKLIMIGESSVGKTCCMNRF

SEQ ID NO: 2733083 - protein, 25 aa, Entamoeba histolytica
NETSRFNFFILYHPLISFMSRNYQR

SEQ ID NO: 2733084 - protein, 17 aa, Entamoeba histolytica
NFFLSIGAKVRLSQWEK

SEQ ID NO: 2733085 - protein, 18 aa, Entamoeba histolytica
NFFLSIGAKVRLSQWEKG

SEQ ID NO: 2733086 - protein, 19 aa, Entamoeba histolytica
NFIFFVNLFQRSSLDMAKE

SEQ ID NO: 2733087 - protein, 21 aa, Entamoeba histolytica
NFKTFPKYFIMSVKLFEMGYY

SEQ ID NO: 2733088 - protein, 19 aa, Entamoeba histolytica
NFLFKKLLGLLYFELNRRD

SEQ ID NO: 2733089 - protein, 18 aa, Entamoeba histolytica
NFLNNWVLVLRKLYKTNT

SEQ ID NO: 2733090 - protein, 17 aa, Entamoeba histolytica
NFNTFYYILSFLRELLV

SEQ ID NO: 2733091 - protein, 24 aa, Entamoeba histolytica
NFPQKFYFFVLKSLQFIYQKEFVI

SEQ ID NO: 2733092 - protein, 17 aa, Entamoeba histolytica
NFSFRLIEILTLVALCR

SEQ ID NO: 2733093 - protein, 17 aa, Entamoeba histolytica
NFVEMCIPISVLKGFVV

SEQ ID NO: 2733094 - protein, 21 aa, Entamoeba histolytica
NFYTILFTWKQKKIWKTTPKR

SEQ ID NO: 2733095 - protein, 32 aa, Entamoeba histolytica; identical to SEQ ID NO: 2546500

SEQ ID NO: 2733096 - protein, 22 aa, Entamoeba histolytica
NGGYSWWRRNSLTVFIDDKINK

SEQ ID NO: 2733097 - protein, 23 aa, Entamoeba histolytica
NGGYSWWRRNSLTVFLDKKIYKD

SEQ ID NO: 2733098 - protein, 25 aa, Entamoeba histolytica
NGHELFWIYYCSLPLFTSKVPVVDF

SEQ ID NO: 2733099 - protein, 21 aa, Entamoeba histolytica
NGISYLEIIKIYSSFNVSTVP

SEQ ID NO: 2733100 - protein, 21 aa, Entamoeba histolytica
NGKQSAFIRFEGLKRGKYCVR

SEQ ID NO: 2733101 - protein, 19 aa, Entamoeba histolytica
NGLVWKKIIYMLLFERNLG

SEQ ID NO: 2733102 - protein, 21 aa, Entamoeba histolytica
NGNDWICILLLYIGKGTISQT

SEQ ID NO: 2733103 - protein, 17 aa, Entamoeba histolytica
NGRFFPFIMYGAKATLP

SEQ ID NO: 2733104 - protein, 22 aa, Entamoeba histolytica
NGSQLIRFPLLKNVYADTVLSS

SEQ ID NO: 2733105 - protein, 17 aa, Entamoeba histolytica
NGTIYHCYLPKSLPSSS

SEQ ID NO: 2733106 - protein, 23 aa, Entamoeba histolytica
NGTLNFLLFKLGRESFHILYDSK

SEQ ID NO: 2733107 - protein, 18 aa, Entamoeba histolytica
NHCPYLTSIVLPSSLKRL

SEQ ID NO: 2733108 - protein, 17 aa, Entamoeba histolytica
NHPFFERIRWNTLLSES

SEQ ID NO: 2733109 - protein, 20 aa, Entamoeba histolytica
NIAILFLLQQFYPFFDNFLD

SEQ ID NO: 2733110 - protein, 17 aa, Entamoeba histolytica
NIAPLQAMLFGLQLKPL

SEQ ID NO: 2733111 - protein, 19 aa, Entamoeba histolytica
NIFCMSLLRKISFTGVKQI

SEQ ID NO: 2733112 - protein, 18 aa, Entamoeba histolytica
NIFGWYNTKKIPSYGFIK

SEQ ID NO: 2733113 - protein, 20 aa, Entamoeba histolytica
NIFSSMLFEYIWPPCYDKFQ

SEQ ID NO: 2733114 - protein, 18 aa, Entamoeba histolytica
NIIGHQFFWFLKAEMHDN

SEQ ID NO: 2733115 - protein, 19 aa, Entamoeba histolytica
NIIGHQFFWFLKAEMHDNR

SEQ ID NO: 2733116 - protein, 21 aa, Entamoeba histolytica
NIILPFQFCNFVHLKQLIIEN

SEQ ID NO: 2733117 - protein, 19 aa, Entamoeba histolytica
NIIYSYRFLQVNSLSLTLT

SEQ ID NO: 2733118 - protein, 30 aa, Entamoeba histolytica; identical to SEQ ID NO: 2546528

SEQ ID NO: 2733119 - protein, 17 aa, Entamoeba histolytica
NIKWFPLLGVIKLKYLD

SEQ ID NO: 2733120 - protein, 17 aa, Entamoeba histolytica
NIKYYWYFVVKNSSWIS

SEQ ID NO: 2733121 - protein, 25 aa, Entamoeba histolytica
NILIYQNLIFLLKPGSDTVLAIIYI

SEQ ID NO: 2733122 - protein, 24 aa, Entamoeba histolytica
NIPFKNLLPFYYNLKHPFIPTSLT

SEQ ID NO: 2733123 - protein, 18 aa, Entamoeba histolytica
NIPLLRKTLQLIPPYLVQ

SEQ ID NO: 2733124 - protein, 22 aa, Entamoeba histolytica
NIQKYIILCVLLRSIHPVYIEM

SEQ ID NO: 2733125 - protein, 23 aa, Entamoeba histolytica
NITFEFIVKWLLMLFKREFWSKE

SEQ ID NO: 2733126 - protein, 18 aa, Entamoeba histolytica
NITPQKNIIIFPYRLNYN

SEQ ID NO: 2733127 - protein, 19 aa, Entamoeba histolytica
NITPQKNIIIFPYRLNYND

SEQ ID NO: 2733128 - protein, 21 aa, Entamoeba histolytica
NITWLLEMIVYIALAPNINKE

SEQ ID NO: 2733129 - protein, 19 aa, Entamoeba histolytica
NIVILVFDSLGNIFGGYMK

SEQ ID NO: 2733130 - protein, 20 aa, Entamoeba histolytica
NIYYELFLVKMLPFFKDLIN

SEQ ID NO: 2733131 - protein, 22 aa, Entamoeba histolytica
NKECVQIIQLLNAHRRALDWME

SEQ ID NO: 2733132 - protein, 21 aa, Entamoeba histolytica
NKEEVFLVDAGKLWLWFGSKA

SEQ ID NO: 2733133 - protein, 20 aa, Entamoeba histolytica
NKFSPFFIHLIKIVFKRIDQ

SEQ ID NO: 2733134 - protein, 26 aa, Entamoeba histolytica
NKIEDEFLMFLFYYAQGTELQLQAAE

SEQ ID NO: 2733135 - protein, 18 aa, Entamoeba histolytica
NKKWIITLLYELSVYKDQ

SEQ ID NO: 2733136 - protein, 18 aa, Entamoeba histolytica
NKKYLIQMIILEKEIIVV

SEQ ID NO: 2733137 - protein, 18 aa, Entamoeba histolytica
NKLYPQIYFHDKSSYYFP

SEQ ID NO: 2733138 - protein, 23 aa, Entamoeba histolytica
NKNIAPDYWLIGSLLMVALVNSV

SEQ ID NO: 2733139 - protein, 24 aa, Entamoeba histolytica
NKPVCFDLLFSFMTDYIYFPRVLS

SEQ ID NO: 2733140 - protein, 29 aa, Entamoeba histolytica
NKRIFTQNFLFDLCLEYGFWFESKPSRKS

SEQ ID NO: 2733141 - protein, 19 aa, Entamoeba histolytica
NKRIGFLNSFFFTKLSKNW

SEQ ID NO: 2733142 - protein, 20 aa, Entamoeba histolytica
NKYLNYIGIDKFKILASENI

SEQ ID NO: 2733143 - protein, 17 aa, Entamoeba histolytica
NLFFFEDCDSFIGSFSS

SEQ ID NO: 2733144 - protein, 21 aa, Entamoeba histolytica
NLFTIQFFFQVARILKLDGVF

SEQ ID NO: 2733145 - protein, 17 aa, Entamoeba histolytica
NLHIILFDILKNPVHFF

SEQ ID NO: 2733146 - protein, 21 aa, Entamoeba histolytica
NLKILIIFMLLEKYGQMLHLH

SEQ ID NO: 2733147 - protein, 20 aa, Entamoeba histolytica
NLLLIKKIVILTGIIRQISL

SEQ ID NO: 2733148 - protein, 20 aa, Entamoeba histolytica
NLLTIPLWTKYYLRYSFPKI

SEQ ID NO: 2733149 - protein, 17 aa, Entamoeba histolytica
NLPIEQFALLKSRMLGM

SEQ ID NO: 2733150 - protein, 21 aa, Entamoeba histolytica
NLQLMKWQLFRNLDLPAIQAT

SEQ ID NO: 2733151 - protein, 21 aa, Entamoeba histolytica
NLTIPFWWKDDLFPYIVEHRS

SEQ ID NO: 2733152 - protein, 17 aa, Entamoeba histolytica
NLVYFLCKYIHEKHPDL

SEQ ID NO: 2733153 - protein, 20 aa, Entamoeba histolytica
NLWQFDISNLVWRKLGDLEN

SEQ ID NO: 2733154 - protein, 18 aa, Entamoeba histolytica
NLWVNLYCAQYIPLTSKF

SEQ ID NO: 2733155 - protein, 24 aa, Entamoeba histolytica
NLYNHWYYFYLSLVRYPLSLDISM

SEQ ID NO: 2733156 - protein, 19 aa, Entamoeba histolytica
NMFPFFILASQINGLPLFL

SEQ ID NO: 2733157 - protein, 22 aa, Entamoeba histolytica
NNDPYFVFTVCSAFWILQDGTV

SEQ ID NO: 2733158 - protein, 27 aa, Entamoeba histolytica
NNENKLFRTFWFYCVVLKFVIKEEYNE

SEQ ID NO: 2733159 - protein, 25 aa, Entamoeba histolytica
NNHCKFVWLFLLRNAFYKNCRMVLD

SEQ ID NO: 2733160 - protein, 23 aa, Entamoeba histolytica
NNIPTIQLIKFYSLLLSSPSLNN

SEQ ID NO: 2733161 - protein, 26 aa, Entamoeba histolytica
NNKGVPFFWIRALNAVSLFLSYNTVE

SEQ ID NO: 2733162 - protein, 24 aa, Entamoeba histolytica
NNKPIFVFGYLDQGYWPDGLYTAP

SEQ ID NO: 2733163 - protein, 18 aa, Entamoeba histolytica
NNLKLILEFIKSQNIKVT

SEQ ID NO: 2733164 - protein, 24 aa, Entamoeba histolytica
NNLRIPFGFYKRTLPHYWKEDYGF

SEQ ID NO: 2733165 - protein, 20 aa, Entamoeba histolytica
NNPIIVHTPFRMTGTFDGVI

SEQ ID NO: 2733166 - protein, 18 aa, Entamoeba histolytica
NNPNWLIEFLIGSSLRKG

SEQ ID NO: 2733167 - protein, 17 aa, Entamoeba histolytica
NNYYYFLIKLSECVDKF

SEQ ID NO: 2733168 - protein, 28 aa, Entamoeba histolytica
NPDKPVEIEFFKPLTLITGPNGAGKTTI

SEQ ID NO: 2733169 - protein, 21 aa, Entamoeba histolytica
NPISTIIFLPLVNLQSFVMQF

SEQ ID NO: 2733170 - protein, 20 aa, Entamoeba histolytica
NPKRILLVGGVLRSEEQLTV

SEQ ID NO: 2733171 - protein, 24 aa, Entamoeba histolytica
NPLTFFFKIVYFISIASFGEVIQL

SEQ ID NO: 2733172 - protein, 20 aa, Entamoeba histolytica
NPPLFLYFATILESSSLNAL

SEQ ID NO: 2733173 - protein, 22 aa, Entamoeba histolytica
NPTKLLVFDFGGGTLDITCIEM

SEQ ID NO: 2733174 - protein, 25 aa, Entamoeba histolytica
NQELPYFYHTLLIDNLLKDVEMYLK

SEQ ID NO: 2733175 - protein, 18 aa, Entamoeba histolytica
NQFPQQQNPFSQFSKLAN

SEQ ID NO: 2733176 - protein, 23 aa, Entamoeba histolytica
NQLKWIVILNFFETPIEFILPID

SEQ ID NO: 2733177 - protein, 19 aa, Entamoeba histolytica
NQMEIWPRIVKLYHYIGNE

SEQ ID NO: 2733178 - protein, 24 aa, Entamoeba histolytica
NQNTLWYIFSFLRRVLEQQDINKM

SEQ ID NO: 2733179 - protein, 21 aa, Entamoeba histolytica
NQPFPLPLMYGKNLIFKTGGV

SEQ ID NO: 2733180 - protein, 23 aa, Entamoeba histolytica
NQPIKTIRRPLPPLPTQESKTRS

SEQ ID NO: 2733181 - protein, 27 aa, Entamoeba histolytica
NQSIKQIIWFILMRLPTIISIKNEVKL

SEQ ID NO: 2733182 - protein, 17 aa, Entamoeba histolytica
NRDQIISILIKLENSMQ

SEQ ID NO: 2733183 - protein, 23 aa, Entamoeba histolytica
NRIISLMKWYKIKKMTFLKNWKV

SEQ ID NO: 2733184 - protein, 19 aa, Entamoeba histolytica
NRINIIFGLSLIKELYAPF

SEQ ID NO: 2733185 - protein, 20 aa, Entamoeba histolytica
NRIPEFTIIPFSYCFYKPLP

SEQ ID NO: 2733186 - protein, 19 aa, Entamoeba histolytica
NRLEAFIFMIYRMIDLYSN

SEQ ID NO: 2733187 - protein, 22 aa, Entamoeba histolytica
NRTILFMVALWRMNGYKCSIRT

SEQ ID NO: 2733188 - protein, 18 aa, Entamoeba histolytica
NRWFTFPTLLHQYTILQT

SEQ ID NO: 2733189 - protein, 28 aa, Entamoeba histolytica
NSFCFFFVCLFLLYKTYPTQFEFNESLL

SEQ ID NO: 2733190 - protein, 23 aa, Entamoeba histolytica
NSFEQFIFLYLRHPYDIEEIDKI

SEQ ID NO: 2733191 - protein, 19 aa, Entamoeba histolytica
NSFKKLFLQAFTPTFSQVL

SEQ ID NO: 2733192 - protein, 22 aa, Entamoeba histolytica
NSFLHLPLYLNRIYELRKDHSK

SEQ ID NO: 2733193 - protein, 25 aa, Entamoeba histolytica
NSFNKFIYCPIVLPYFLRLLTHCLS

SEQ ID NO: 2733194 - protein, 22 aa, Entamoeba histolytica
NSGLHFLVLYRYYLRHVPKNIA

SEQ ID NO: 2733195 - protein, 19 aa, Entamoeba histolytica
NSGLPNLLFFGPPGSGKTT

SEQ ID NO: 2733196 - protein, 24 aa, Entamoeba histolytica
NSITEYIYNIFLYNDIRLTSNPVL

SEQ ID NO: 2733197 - protein, 25 aa, Entamoeba histolytica
NSPNIIWFFKFSLQTICPFTLAKLA

SEQ ID NO: 2733198 - protein, 24 aa, Entamoeba histolytica
NSQLLLLLLKLHPTPFIPITFHSQ

SEQ ID NO: 2733199 - protein, 22 aa, Entamoeba histolytica
NSYYLERLFCFYIPIITRCSVS

SEQ ID NO: 2733200 - protein, 19 aa, Entamoeba histolytica
NTAILLHKVLFGTSGYADV

SEQ ID NO: 2733201 - protein, 18 aa, Entamoeba histolytica
NTHKIIPIFVFDGATLPS

SEQ ID NO: 2733202 - protein, 24 aa, Entamoeba histolytica
NTLDYISLFLLTCVTTLIGESTKF

SEQ ID NO: 2733203 - protein, 24 aa, Entamoeba histolytica
NTLEPLMTFLINTLPSPLHTKILV

SEQ ID NO: 2733204 - protein, 21 aa, Entamoeba histolytica
NTLPPKPAAPAALPPKHHQSL

SEQ ID NO: 2733205 - protein, 20 aa, Entamoeba histolytica
NTLRKLIIILFLPIHTKSTK

SEQ ID NO: 2733206 - protein, 29 aa, Entamoeba histolytica
NTQLLDLEYFFFIKVIVASTMKLNGFLES

SEQ ID NO: 2733207 - protein, 22 aa, Entamoeba histolytica
NTSLFRIYFLTNDKGNPFTRTL

SEQ ID NO: 2733208 - protein, 28 aa, Entamoeba histolytica
NTVDDYCLYFYLTFFIMKENVFDDNEVM

SEQ ID NO: 2733209 - protein, 27 aa, Entamoeba histolytica
NTVDDYCLYFYLTFFIMKETHFEDNEM

SEQ ID NO: 2733210 - protein, 18 aa, Entamoeba histolytica
NVFKILIISSIKLGKDVM

SEQ ID NO: 2733211 - protein, 17 aa, Entamoeba histolytica
NVFYLTKTVWLFEGEKI

SEQ ID NO: 2733212 - protein, 17 aa, Entamoeba histolytica
NVGKTCLLLTYTTNSFP

SEQ ID NO: 2733213 - protein, 25 aa, Entamoeba histolytica
NVILYRRIIRLVKNIKLNNFIVPIE

SEQ ID NO: 2733214 - protein, 18 aa, Entamoeba histolytica
NVKSLYLQLFKLYDFTER

SEQ ID NO: 2733215 - protein, 24 aa, Entamoeba histolytica
NVLPRPLFYKLFRQDLLIASLYRN

SEQ ID NO: 2733216 - protein, 18 aa, Entamoeba histolytica
NVMKVFSLIIYKTFADLG

SEQ ID NO: 2733217 - protein, 17 aa, Entamoeba histolytica
NVNFYTILFTWKQKKIW

SEQ ID NO: 2733218 - protein, 22 aa, Entamoeba histolytica
NVNYLFCYRWIVLLFKRDFSSR

SEQ ID NO: 2733219 - protein, 23 aa, Entamoeba histolytica
NVPFPFFVNVLQTSVWPLEPQQF

SEQ ID NO: 2733220 - protein, 18 aa, Entamoeba histolytica
NWCIPPLVFALLKAGRIQ

SEQ ID NO: 2733221 - protein, 25 aa, Entamoeba histolytica
NWCNFVTPRVLYFTNSFERFDLKEF

SEQ ID NO: 2733222 - protein, 19 aa, Entamoeba histolytica
NWDIIKLQYKILFKEVKPG

SEQ ID NO: 2733223 - protein, 21 aa, Entamoeba histolytica
NWLIEFLIGSSLRKGSQERAI

SEQ ID NO: 2733224 - protein, 17 aa, Entamoeba histolytica
NYFITWFADLFIDVFPV

SEQ ID NO: 2733225 - protein, 18 aa, Entamoeba histolytica
NYHIFYQLLAGATAQQKS

SEQ ID NO: 2733226 - protein, 23 aa, Entamoeba histolytica
NYHQIRLFKFTFWVTSVDIEEIE

SEQ ID NO: 2733227 - protein, 17 aa, Entamoeba histolytica
NYIILIDDQLIKLNRDT

SEQ ID NO: 2733228 - protein, 25 aa, Entamoeba histolytica
NYKSINFMSQFKNKSLIEIRTEDYK

SEQ ID NO: 2733229 - protein, 23 aa, Entamoeba histolytica
NYLTLLNVITISSPVIFNILIDH

SEQ ID NO: 2733230 - protein, 23 aa, Entamoeba histolytica
NYPKLPILFVWMGDLFHTNELPV

SEQ ID NO: 2733231 - protein, 18 aa, Entamoeba histolytica
NYRINFIGTFYVSKDNVK

SEQ ID NO: 2733232 - protein, 22 aa, Entamoeba histolytica
NYTRFHRIIYYMIRKRGLDEMR

SEQ ID NO: 2733233 - protein, 17 aa, Entamoeba histolytica
PADIPPPPPPTAPMMDN

SEQ ID NO: 2733234 - protein, 21 aa, Entamoeba histolytica
PAFVMPLFRKTIIRLLTQLQF

SEQ ID NO: 2733235 - protein, 23 aa, Entamoeba histolytica
PATIQLYCYLYKDGQLKIEWNQS

SEQ ID NO: 2733236 - protein, 18 aa, Entamoeba histolytica
PCRFLRLREKEQVEFPCI

SEQ ID NO: 2733237 - protein, 17 aa, Entamoeba histolytica
PDELYLFEPSKWYELPS

SEQ ID NO: 2733238 - protein, 27 aa, Entamoeba histolytica
PDEYRRLFFYLISFLKKLIEMGEDKII

SEQ ID NO: 2733239 - protein, 18 aa, Entamoeba histolytica
PDIPFSNPFYFPMFNNRE

SEQ ID NO: 2733240 - protein, 20 aa, Entamoeba histolytica
PDYLQLRMLFWRIAKREGIE

SEQ ID NO: 2733241 - protein, 24 aa, Entamoeba histolytica
PEELKTLFIHLLRLCYKIAQNEKI

SEQ ID NO: 2733242 - protein, 23 aa, Entamoeba histolytica
PEIHHPIIMSLVDQLPVMFKETL

SEQ ID NO: 2733243 - protein, 35 aa, Entamoeba histolytica
PERPQGEFILWQPTRHTLFLPNQILAAAGYDSTET

SEQ ID NO: 2733244 - protein, 25 aa, Entamoeba histolytica
PEVHKKIVVMMYQSLIRDLNMTNEE

SEQ ID NO: 2733245 - protein, 17 aa, Entamoeba histolytica
PFILQNPFDLIPVRFDP

SEQ ID NO: 2733246 - protein, 22 aa, Entamoeba histolytica
PFIRLYSYYLFFYCSDFMNKTT

SEQ ID NO: 2733247 - protein, 17 aa, Entamoeba histolytica
PFIVQLYYAFQTPEKLY

SEQ ID NO: 2733248 - protein, 19 aa, Entamoeba histolytica
PFKKEINWTLLEKLDLKEF

SEQ ID NO: 2733249 - protein, 18 aa, Entamoeba histolytica
PFKKPICLIYKNKEFKLL

SEQ ID NO: 2733250 - protein, 18 aa, Entamoeba histolytica
PFNCRLYFEVILPNEQRK

SEQ ID NO: 2733251 - protein, 19 aa, Entamoeba histolytica
PFPHYIILHDLNTLPNVLA

SEQ ID NO: 2733252 - protein, 17 aa, Entamoeba histolytica
PFPIDFNLILQRLINDN

SEQ ID NO: 2733253 - protein, 21 aa, Entamoeba histolytica
PFWINVYHIMLLHGLLYWRHR

SEQ ID NO: 2733254 - protein, 17 aa, Entamoeba histolytica
PGESFLHFLQRKAKQQK

SEQ ID NO: 2733255 - protein, 25 aa, Entamoeba histolytica
PGQLPRFILIKIIPYLKNISNVLHF

SEQ ID NO: 2733256 - protein, 26 aa, Entamoeba histolytica
PGVDPMYYFQIFKLFFKKYINSYEPL

SEQ ID NO: 2733257 - protein, 18 aa, Entamoeba histolytica
PHPFWLPKFQNGISYSLP

SEQ ID NO: 2733258 - protein, 24 aa, Entamoeba histolytica
PHQHMLIVLKRPRSFKARPIITHS

SEQ ID NO: 2733259 - protein, 17 aa, Entamoeba histolytica
PIELILKVFFYCFSHHP

SEQ ID NO: 2733260 - protein, 17 aa, Entamoeba histolytica
PIEQFALLKSRMLGMLE

SEQ ID NO: 2733261 - protein, 21 aa, Entamoeba histolytica
PIIFSFLIRSTYSYTFELWFI

SEQ ID NO: 2733262 - protein, 17 aa, Entamoeba histolytica
PIIPLYWNILRNITYST

SEQ ID NO: 2733263 - protein, 23 aa, Entamoeba histolytica
PILCYHFYFQVYPIHPEYTYAHG

SEQ ID NO: 2733264 - protein, 20 aa, Entamoeba histolytica
PILQIYILQKLIQKFPMFIA

SEQ ID NO: 2733265 - protein, 17 aa, Entamoeba histolytica
PIQPSLTFILRKYNSFI

SEQ ID NO: 2733266 - protein, 23 aa, Entamoeba histolytica
PIQRLLRYVLLLKELIKATPEII

SEQ ID NO: 2733267 - protein, 26 aa, Entamoeba histolytica
PISKKVMGYLLLFPRLKINYHCFYNK

SEQ ID NO: 2733268 - protein, 17 aa, Entamoeba histolytica
PIVIYTKKPMLFKELTK

SEQ ID NO: 2733269 - protein, 17 aa, Entamoeba histolytica
PIYFEFLINPYGPSTYS

SEQ ID NO: 2733270 - protein, 23 aa, Entamoeba histolytica
PKEDWFFYAFSKFYFEAALKFSD

SEQ ID NO: 2733271 - protein, 20 aa, Entamoeba histolytica
PKFYFLVDLIDKLIPKKTQS

SEQ ID NO: 2733272 - protein, 23 aa, Entamoeba histolytica
PKIYRFRPFIIKLTINTSFGIEF

SEQ ID NO: 2733273 - protein, 24 aa, Entamoeba histolytica
PKKDFLRKFLFEPFPLESYFETVM

SEQ ID NO: 2733274 - protein, 22 aa, Entamoeba histolytica
PKKPKNAYLLFSSEKYPQYKKQ

SEQ ID NO: 2733275 - protein, 20 aa, Entamoeba histolytica
PKYYFPIIPTVLVNGADGIG

SEQ ID NO: 2733276 - protein, 19 aa, Entamoeba histolytica
PLDWSYSYCLPLFIVSYRN

SEQ ID NO: 2733277 - protein, 18 aa, Entamoeba histolytica
PLDYITILFYKSGPTYFQ

SEQ ID NO: 2733278 - protein, 17 aa, Entamoeba histolytica
PLFQQQFIKPIRYGSYT

SEQ ID NO: 2733279 - protein, 19 aa, Entamoeba histolytica
PLHFVIVSKVPIALLKAKS

SEQ ID NO: 2733280 - protein, 17 aa, Entamoeba histolytica
PLIDPLPFNYFVYCISD

SEQ ID NO: 2733281 - protein, 19 aa, Entamoeba histolytica
PLIRRIPPFHGLPKELEFN

SEQ ID NO: 2733282 - protein, 19 aa, Entamoeba histolytica
PLLIGFPYDYPLSPPEIIC

SEQ ID NO: 2733283 - protein, 20 aa, Entamoeba histolytica
PLMNNGIIYNAFYNEGYLVV

SEQ ID NO: 2733284 - protein, 21 aa, Entamoeba histolytica
PLNRMLMFISIFYLECFRCSQ

SEQ ID NO: 2733285 - protein, 24 aa, Entamoeba histolytica
PLPPSTVPSFVPPPPPLSEDAYTT

SEQ ID NO: 2733286 - protein, 21 aa, Entamoeba histolytica
PLRWKVFLSFLPPTPELWKKI

SEQ ID NO: 2733287 - protein, 23 aa, Entamoeba histolytica
PLVYRLIWICFVERKLRLVRHRK

SEQ ID NO: 2733288 - protein, 22 aa, Entamoeba histolytica
PLYRFFDWIFNKSPLMMLILIS

SEQ ID NO: 2733289 - protein, 20 aa, Entamoeba histolytica
PLYVKALLRRALISMHFKKY

SEQ ID NO: 2733290 - protein, 17 aa, Entamoeba histolytica
PMFYAFEPIITLFSRIL

SEQ ID NO: 2733291 - protein, 17 aa, Entamoeba histolytica
PMKGLLWWLSKIGFDGI

SEQ ID NO: 2733292 - protein, 25 aa, Entamoeba histolytica
PNCKLIPFYFIPTETFYTLLLPIQK

SEQ ID NO: 2733293 - protein, 23 aa, Entamoeba histolytica
PNEFFQFYYLFEYYVDENGEFDY

SEQ ID NO: 2733294 - protein, 20 aa, Entamoeba histolytica
PNEWLNIPLIILNNIETHCS

SEQ ID NO: 2733295 - protein, 18 aa, Entamoeba histolytica
PNKPAIFLPLTTSLTKFF

SEQ ID NO: 2733296 - protein, 32 aa, Entamoeba histolytica; identical to SEQ ID NO: 2723367

SEQ ID NO: 2733297 - protein, 17 aa, Entamoeba histolytica
PNQIFIYYIDSKTPFDI

SEQ ID NO: 2733298 - protein, 22 aa, Entamoeba histolytica
PPFKEIPYYLLHPFHSLLIREY

SEQ ID NO: 2733299 - protein, 19 aa, Entamoeba histolytica
PPIYLYFKDFQLQPMKFVI

SEQ ID NO: 2733300 - protein, 18 aa, Entamoeba histolytica
PPKGLLLFGPPGTGKTMI

SEQ ID NO: 2733301 - protein, 25 aa, Entamoeba histolytica
PPKKKTLQILPLTPIKPLKDTQRRN

SEQ ID NO: 2733302 - protein, 22 aa, Entamoeba histolytica
PPLLSRFDIILLLLDDRSKIWD

SEQ ID NO: 2733303 - protein, 28 aa, Entamoeba histolytica
PPLNQYMVPLMQPPYDPSPMRRPRRSPV

SEQ ID NO: 2733304 - protein, 22 aa, Entamoeba histolytica
PPPPPPLNAPPPPPPPAHGTGC

SEQ ID NO: 2733305 - protein, 23 aa, Entamoeba histolytica
PPSKLVYVFLFNDVLLETKPLKI

SEQ ID NO: 2733306 - protein, 20 aa, Entamoeba histolytica
PPVYTYFYLCVIVSSEGFVK

SEQ ID NO: 2733307 - protein, 21 aa, Entamoeba histolytica
PPYEYYLYYLYANITVLNGFR

SEQ ID NO: 2733308 - protein, 17 aa, Entamoeba histolytica
PPYFYYMYYTYANIASL

SEQ ID NO: 2733309 - protein, 17 aa, Entamoeba histolytica
PQFIKISGNIPGLLIRP

SEQ ID NO: 2733310 - protein, 18 aa, Entamoeba histolytica
PQFLIPPQKSYLPRKVRL

SEQ ID NO: 2733311 - protein, 20 aa, Entamoeba histolytica
PQGFAPLLFYGLTPGLSERI

SEQ ID NO: 2733312 - protein, 18 aa, Entamoeba histolytica
PQGIYYFQPIFSRTYFSI

SEQ ID NO: 2733313 - protein, 22 aa, Entamoeba histolytica
PQHYMYFYKMLWLLLEKFDHKI

SEQ ID NO: 2733314 - protein, 20 aa, Entamoeba histolytica
PQIGFLFYTLRLKIINGYPS

SEQ ID NO: 2733315 - protein, 25 aa, Entamoeba histolytica
PQIRYCYYFYYYLSVFPREVPFKPI

SEQ ID NO: 2733316 - protein, 17 aa, Entamoeba histolytica
PQKWMYCFLFNDRLVET

SEQ ID NO: 2733317 - protein, 24 aa, Entamoeba histolytica
PQNKYLIWLFNNFSFLSPKINFDL

SEQ ID NO: 2733318 - protein, 23 aa, Entamoeba histolytica
PQQLDLLFFTPTSARHISQSSSP

SEQ ID NO: 2733319 - protein, 17 aa, Entamoeba histolytica
PQQPPMQGFPQQPPMQG

SEQ ID NO: 2733320 - protein, 21 aa, Entamoeba histolytica
PQSNWWLVYKQKSFGYVPAAY

SEQ ID NO: 2733321 - protein, 19 aa, Entamoeba histolytica
PQVVFNLCWWIYTYGYLVE

SEQ ID NO: 2733322 - protein, 17 aa, Entamoeba histolytica
PRWILFYELVLTTKEYV

SEQ ID NO: 2733323 - protein, 20 aa, Entamoeba histolytica
PSALLILQLLINVLLNQLVH

SEQ ID NO: 2733324 - protein, 18 aa, Entamoeba histolytica
PSDIVFLKGWIPVKINKF

SEQ ID NO: 2733325 - protein, 17 aa, Entamoeba histolytica
PSFHFKLFNLMKPKDIK

SEQ ID NO: 2733326 - protein, 24 aa, Entamoeba histolytica
PSLFCRYKLLPFYIDLFRSNMPEA

SEQ ID NO: 2733327 - protein, 23 aa, Entamoeba histolytica
PSPVDTMLTLFTPLPPILQQYNT

SEQ ID NO: 2733328 - protein, 22 aa, Entamoeba histolytica
PSSKIYLIYLYKKIKIQHIESN

SEQ ID NO: 2733329 - protein, 20 aa, Entamoeba histolytica
PSTVLYLDNSVLFWGSKGGD

SEQ ID NO: 2733330 - protein, 23 aa, Entamoeba histolytica
PSYHMFFVEVLPIPPSRFRQLNK

SEQ ID NO: 2733331 - protein, 22 aa, Entamoeba histolytica
PTIQFQWWYPLVQNLSANDFRE

SEQ ID NO: 2733332 - protein, 25 aa, Entamoeba histolytica
PTNQKFYILLWRTFGLTEYCLDSNG

SEQ ID NO: 2733333 - protein, 17 aa, Entamoeba histolytica
PTNSIVPVVPEEAGATS

SEQ ID NO: 2733334 - protein, 21 aa, Entamoeba histolytica
PTPEAIFLDWFPYDLEAYVIE

SEQ ID NO: 2733335 - protein, 23 aa, Entamoeba histolytica
PTPKIPILPLWLGDIIHAHTAFS

SEQ ID NO: 2733336 - protein, 25 aa, Entamoeba histolytica
PVGKSYLLLMERLFRLLKMIDKNSG

SEQ ID NO: 2733337 - protein, 17 aa, Entamoeba histolytica
PVIWKLYIEWLIENGEI

SEQ ID NO: 2733338 - protein, 21 aa, Entamoeba histolytica
PVPFLFHRIVTSYSLILLSTH

SEQ ID NO: 2733339 - protein, 22 aa, Entamoeba histolytica
PVQRLPRYKLLLTDLIKHTDDD

SEQ ID NO: 2733340 - protein, 23 aa, Entamoeba histolytica
PVSWILICRVILYSLMELHKGTV

SEQ ID NO: 2733341 - protein, 18 aa, Entamoeba histolytica
PYHFPPGLLIYKDDERHL

SEQ ID NO: 2733342 - protein, 17 aa, Entamoeba histolytica
PYIPKILEYCKNKLIGC

SEQ ID NO: 2733343 - protein, 18 aa, Entamoeba histolytica
PYLFIDNYFYLFKKEIII

SEQ ID NO: 2733344 - protein, 18 aa, Entamoeba histolytica
PYLYFYNTDRMKLYKKVP

SEQ ID NO: 2733345 - protein, 24 aa, Entamoeba histolytica
PYSIVRFFLERLPLDKIYSIELTP

SEQ ID NO: 2733346 - protein, 24 aa, Entamoeba histolytica
PYYEKYFFLFLRCLKSFGRLESVE

SEQ ID NO: 2733347 - protein, 19 aa, Entamoeba histolytica
PYYKHIEWLCGFTGSNATI

SEQ ID NO: 2733348 - protein, 24 aa, Entamoeba histolytica
PYYLFNRFVLFNRELIGIKLPKSL

SEQ ID NO: 2733349 - protein, 25 aa, Entamoeba histolytica
QANNNLFIIFPKKYGFFIVPNPNYI

SEQ ID NO: 2733350 - protein, 19 aa, Entamoeba histolytica
QATQYPFLPNFLKLEEFST

SEQ ID NO: 2733351 - protein, 18 aa, Entamoeba histolytica
QCVEDCICIGLYYWTYDI

SEQ ID NO: 2733352 - protein, 20 aa, Entamoeba histolytica
QDAFIKAAPFFLYMREFIGN

SEQ ID NO: 2733353 - protein, 18 aa, Entamoeba histolytica
QDFLKHICIVWNKCYYYI

SEQ ID NO: 2733354 - protein, 26 aa, Entamoeba histolytica
QDPNYLLIQIVFYFSLFYSTSSAVLK

SEQ ID NO: 2733355 - protein, 23 aa, Entamoeba histolytica
QDTLRLLTILFKFGKYYEVEHAI

SEQ ID NO: 2733356 - protein, 28 aa, Entamoeba histolytica
QEANPFIVIILLKYFFLSLPQSFFCDKL

SEQ ID NO: 2733357 - protein, 24 aa, Entamoeba histolytica
QEATYFHWILPFPFKRCYVSSSIF

SEQ ID NO: 2733358 - protein, 23 aa, Entamoeba histolytica
QECALICLLIYEGFNMQFSVPRK

SEQ ID NO: 2733359 - protein, 24 aa, Entamoeba histolytica
QEETLEFHYYLWKVFEFEMKKMNL

SEQ ID NO: 2733360 - protein, 18 aa, Entamoeba histolytica
QEFKQILKLLKSGSIRAV

SEQ ID NO: 2733361 - protein, 22 aa, Entamoeba histolytica
QELVKVLLFYQLCSFCLKCFYK

SEQ ID NO: 2733362 - protein, 24 aa, Entamoeba histolytica
QELYNHHIGIKEWNKYVKALFDSI

SEQ ID NO: 2733363 - protein, 17 aa, Entamoeba histolytica
QENLIVLQLFKENVRCF

SEQ ID NO: 2733364 - protein, 25 aa, Entamoeba histolytica
QETSLLFGIAFDRRLEKLKEQYAEQ

SEQ ID NO: 2733365 - protein, 18 aa, Entamoeba histolytica
QFGYLRYEMDQTKKFLCV

SEQ ID NO: 2733366 - protein, 19 aa, Entamoeba histolytica
QFLLLFPSDIKITSTDFTC

SEQ ID NO: 2733367 - protein, 20 aa, Entamoeba histolytica
QFNKGFIIGKLGYDLYIIDQ

SEQ ID NO: 2733368 - protein, 21 aa, Entamoeba histolytica
QFPSLKYFWFKQNKPMMFIAA

SEQ ID NO: 2733369 - protein, 19 aa, Entamoeba histolytica
QFQLATNLLWSLWGFVDAS

SEQ ID NO: 2733370 - protein, 17 aa, Entamoeba histolytica
QFYCNCLFKKDSTLIFS

SEQ ID NO: 2733371 - protein, 23 aa, Entamoeba histolytica
QHFLIGIDIIYFLTPIFALTQVE

SEQ ID NO: 2733372 - protein, 20 aa, Entamoeba histolytica
QHGTIFYKVKLPKKIFNVND

SEQ ID NO: 2733373 - protein, 17 aa, Entamoeba histolytica
QHKTILKILFMLSKWMS

SEQ ID NO: 2733374 - protein, 17 aa, Entamoeba histolytica
QIDGLLGLLFCYLITLD

SEQ ID NO: 2733375 - protein, 19 aa, Entamoeba histolytica
QIEILKWIRGIAPEIIKKA

SEQ ID NO: 2733376 - protein, 19 aa, Entamoeba histolytica
QIFYEFNDFEDFKWILTET

SEQ ID NO: 2733377 - protein, 19 aa, Entamoeba histolytica
QIHLRLLFALNFKEGCDPL

SEQ ID NO: 2733378 - protein, 17 aa, Entamoeba histolytica
QIISFGSTYDFIFKEMT

SEQ ID NO: 2733379 - protein, 17 aa, Entamoeba histolytica
QIIWYKVNYSRYLLEKE

SEQ ID NO: 2733380 - protein, 22 aa, Entamoeba histolytica
QIKITLVFRHYATMGLTGQVQF

SEQ ID NO: 2733381 - protein, 23 aa, Entamoeba histolytica
QIKITLVFRHYATMGLTGQVQFS

SEQ ID NO: 2733382 - protein, 17 aa, Entamoeba histolytica
QILFPPFLEQLFCVSSS

SEQ ID NO: 2733383 - protein, 20 aa, Entamoeba histolytica
QILPPFTFINKLPLTLSIFI

SEQ ID NO: 2733384 - protein, 18 aa, Entamoeba histolytica
QILQLFNTLVRKYHYKEH

SEQ ID NO: 2733385 - protein, 21 aa, Entamoeba histolytica
QILSALFFHKIITPAIVTPSK

SEQ ID NO: 2733386 - protein, 17 aa, Entamoeba histolytica
QIPGWPALLIPFIQQLS

SEQ ID NO: 2733387 - protein, 18 aa, Entamoeba histolytica
QIPPLKWINPITGTGKIT

SEQ ID NO: 2733388 - protein, 18 aa, Entamoeba histolytica
QIQLLLPTVLLSLSIESP

SEQ ID NO: 2733389 - protein, 25 aa, Entamoeba histolytica
QIQTKFNFIILLKFLIVKEIIEDYK

SEQ ID NO: 2733390 - protein, 22 aa, Entamoeba histolytica
QITLKFIRMYRLFINFLGGDIV

SEQ ID NO: 2733391 - protein, 24 aa, Entamoeba histolytica
QITNLCPFGIFLQLRYLSIKNNLI

SEQ ID NO: 2733392 - protein, 23 aa, Entamoeba histolytica
QKCPPFLIGPLKKNILPIESVEM

SEQ ID NO: 2733393 - protein, 24 aa, Entamoeba histolytica
QKKFPFIPLILKYIEAMTFYSNDF

SEQ ID NO: 2733394 - protein, 18 aa, Entamoeba histolytica
QKKIALDNFLFLYSKELQ

SEQ ID NO: 2733395 - protein, 23 aa, Entamoeba histolytica
QKLHFYWMWWFYGRDEAFKLTQY

SEQ ID NO: 2733396 - protein, 24 aa, Entamoeba histolytica
QKNQNIILKINKYGWFLLLKNIND

SEQ ID NO: 2733397 - protein, 21 aa, Entamoeba histolytica
QKSIPIIYLISLYNPSKRIQK

SEQ ID NO: 2733398 - protein, 20 aa, Entamoeba histolytica
QKTYWKWFISLSEIPRPSYH

SEQ ID NO: 2733399 - protein, 23 aa, Entamoeba histolytica
QLDILIQSLILIPETLIKEETNS

SEQ ID NO: 2733400 - protein, 20 aa, Entamoeba histolytica
QLEFAICAVFRSWMGKRAVD

SEQ ID NO: 2733401 - protein, 23 aa, Entamoeba histolytica
QLEPHLPFFFKYPILFEPHSFVL

SEQ ID NO: 2733402 - protein, 18 aa, Entamoeba histolytica
QLFKKIIQFLPNKDKKSL

SEQ ID NO: 2733403 - protein, 18 aa, Entamoeba histolytica
QLHHPFIVKLYYAFQTTD

SEQ ID NO: 2733404 - protein, 17 aa, Entamoeba histolytica
QLIFHPIKFFTPTEKKV

SEQ ID NO: 2733405 - protein, 18 aa, Entamoeba histolytica
QLLKLHTLFYNKLTGRID

SEQ ID NO: 2733406 - protein, 17 aa, Entamoeba histolytica
QLLLLLLKTTLKLCNFD

SEQ ID NO: 2733407 - protein, 20 aa, Entamoeba histolytica
QLLVLTGFLPILFNGRKFGI

SEQ ID NO: 2733408 - protein, 19 aa, Entamoeba histolytica
QLMRIIMIVRPRNLLYIAI

SEQ ID NO: 2733409 - protein, 28 aa, Entamoeba histolytica
QLPGLYILMLLGYLFKYIEKYPSLLSLL

SEQ ID NO: 2733410 - protein, 17 aa, Entamoeba histolytica
QLPIYFEFLINPYGPST

SEQ ID NO: 2733411 - protein, 18 aa, Entamoeba histolytica
QLPPLYSYLLFKSKYPNV

SEQ ID NO: 2733412 - protein, 23 aa, Entamoeba histolytica
QLQKLYILFIDIHQFCIGFYFSI

SEQ ID NO: 2733413 - protein, 19 aa, Entamoeba histolytica
QLRILFLMQSWDAVINFSD

SEQ ID NO: 2733414 - protein, 18 aa, Entamoeba histolytica
QLVKKIPLILLKKISLKK

SEQ ID NO: 2733415 - protein, 23 aa, Entamoeba histolytica
QLVVLELPRPLLTPGYEAVIHIH

SEQ ID NO: 2733416 - protein, 21 aa, Entamoeba histolytica
QLYFLHLKFPRLVSHLFPFFN

SEQ ID NO: 2733417 - protein, 24 aa, Entamoeba histolytica
QMKKRLEMMFGKIKIGILGLEEMK

SEQ ID NO: 2733418 - protein, 18 aa, Entamoeba histolytica
QMKLSLYLNLALCYLKVD

SEQ ID NO: 2733419 - protein, 17 aa, Entamoeba histolytica
QMPIMPPNRQFPPYVIP

SEQ ID NO: 2733420 - protein, 20 aa, Entamoeba histolytica
QNLIHILLLYHDPILSIHLD

SEQ ID NO: 2733421 - protein, 25 aa, Entamoeba histolytica
QNSIKYNILYPLKKELIINKHQEHE

SEQ ID NO: 2733422 - protein, 18 aa, Entamoeba histolytica
QPCFPRHLSLLFPNDLPT

SEQ ID NO: 2733423 - protein, 17 aa, Entamoeba histolytica
QPIDFFIQPLPSVNDRL

SEQ ID NO: 2733424 - protein, 18 aa, Entamoeba histolytica
QPLKAPPLPPLPKGAKPK

SEQ ID NO: 2733425 - protein, 23 aa, Entamoeba histolytica
QPNIFDLLLPYLYPDYPPALLSS

SEQ ID NO: 2733426 - protein, 22 aa, Entamoeba histolytica
QPPILVFDILQLKFKGLLISTR

SEQ ID NO: 2733427 - protein, 17 aa, Entamoeba histolytica
QPRAFYLQDNESKSLCI

SEQ ID NO: 2733428 - protein, 22 aa, Entamoeba histolytica
QPYHALFLFKNPEEWINNLIES

SEQ ID NO: 2733429 - protein, 24 aa, Entamoeba histolytica
QQDLFFFHVLSPGSCFWLPHGTRI

SEQ ID NO: 2733430 - protein, 19 aa, Entamoeba histolytica
QQIFFIIDIKMIALHKTKP

SEQ ID NO: 2733431 - protein, 19 aa, Entamoeba histolytica
QQRPWCLRFEYWKQILPMS

SEQ ID NO: 2733432 - protein, 23 aa, Entamoeba histolytica
QQSDPILIVYFLEQIPLVGKVYG

SEQ ID NO: 2733433 - protein, 21 aa, Entamoeba histolytica
QQTKLIYEKFKPITPTPHSNQ

SEQ ID NO: 2733434 - protein, 23 aa, Entamoeba histolytica
QRAKVGIPLYFVYTPLCNEVNRY

SEQ ID NO: 2733435 - protein, 24 aa, Entamoeba histolytica
QRANALKWIIQLLLHECPITEKIK

SEQ ID NO: 2733436 - protein, 18 aa, Entamoeba histolytica
QRIRLLFVDLINTTLQSI

SEQ ID NO: 2733437 - protein, 19 aa, Entamoeba histolytica
QRIYFFKPQKYNVPKYHSH

SEQ ID NO: 2733438 - protein, 26 aa, Entamoeba histolytica
QRLIKHFWIMRELSLTSFINCKRSLY

SEQ ID NO: 2733439 - protein, 23 aa, Entamoeba histolytica
QRLPNLVYFLQSVPFVRLQSMFD

SEQ ID NO: 2733440 - protein, 21 aa, Entamoeba histolytica
QRQFLMKVIDWKIQMDLMINK

SEQ ID NO: 2733441 - protein, 23 aa, Entamoeba histolytica
QSFKHFFFFCREFNFLSKDDIAP

SEQ ID NO: 2733442 - protein, 17 aa, Entamoeba histolytica
QSHAHMMLPVWCALHGQ

SEQ ID NO: 2733443 - protein, 22 aa, Entamoeba histolytica
QSLKILPKEPLIWIAAARIEEI

SEQ ID NO: 2733444 - protein, 20 aa, Entamoeba histolytica
QSQHKFVYFFNFLLSNCLSR

SEQ ID NO: 2733445 - protein, 20 aa, Entamoeba histolytica
QSQPIILQPSIQNLSKQEVK

SEQ ID NO: 2733446 - protein, 23 aa, Entamoeba histolytica
QSQTLLHLFLQNFPFPFLELMQP

SEQ ID NO: 2733447 - protein, 18 aa, Entamoeba histolytica
QSWDWYYPYLYAPFAEDM

SEQ ID NO: 2733448 - protein, 24 aa, Entamoeba histolytica
QTISALKYLILMKLMQKKINEIDS

SEQ ID NO: 2733449 - protein, 24 aa, Entamoeba histolytica
QTKKKRWCILTKNKLFYFNCKPEN

SEQ ID NO: 2733450 - protein, 17 aa, Entamoeba histolytica
QTLLFILTLIEKQPKDK

SEQ ID NO: 2733451 - protein, 17 aa, Entamoeba histolytica
QTLLMLPTSNAILLLRW

SEQ ID NO: 2733452 - protein, 18 aa, Entamoeba histolytica
QTLPLLSHRFQPKVLAPL

SEQ ID NO: 2733453 - protein, 22 aa, Entamoeba histolytica
QVHDWWFYPWLTEIVEDPSEKE

SEQ ID NO: 2733454 - protein, 20 aa, Entamoeba histolytica
QVHKPISWLIGRKVKRGTDW

SEQ ID NO: 2733455 - protein, 23 aa, Entamoeba histolytica
QVLLIPYFCDIIDKLFPMQGKNI

SEQ ID NO: 2733456 - protein, 23 aa, Entamoeba histolytica
QVPKKWWKFAFDSLLIEVKKKNY

SEQ ID NO: 2733457 - protein, 18 aa, Entamoeba histolytica
QVPVLWRKYYLQYHKFHS

SEQ ID NO: 2733458 - protein, 17 aa, Entamoeba histolytica
QVRLIFMHWKGPAVKRM

SEQ ID NO: 2733459 - protein, 18 aa, Entamoeba histolytica
QVRLIFMHWKGPAVKRMV

SEQ ID NO: 2733460 - protein, 24 aa, Entamoeba histolytica
QVSDIMRMLPPTRQILLFSATLPR

SEQ ID NO: 2733461 - protein, 18 aa, Entamoeba histolytica
QVVFNLCWWIYTYGYLVE

SEQ ID NO: 2733462 - protein, 19 aa, Entamoeba histolytica
QVYQQIISLLFPNENSKKA

SEQ ID NO: 2733463 - protein, 20 aa, Entamoeba histolytica
QYFFDYLQTLLITTPLLLTH

SEQ ID NO: 2733464 - protein, 18 aa, Entamoeba histolytica
QYFYILLNPRFVAQKLTE

SEQ ID NO: 2733465 - protein, 20 aa, Entamoeba histolytica
QYIFPYKTLPLLRKLRNIIG

SEQ ID NO: 2733466 - protein, 24 aa, Entamoeba histolytica
QYKMPLSWIILKRVVQGRDWHYGR

SEQ ID NO: 2733467 - protein, 20 aa, Entamoeba histolytica
QYLDLKSKYDQLKSDNLMVL

SEQ ID NO: 2733468 - protein, 20 aa, Entamoeba histolytica
QYVLTFPRKVVKIYPLNVPF

SEQ ID NO: 2733469 - protein, 17 aa, Entamoeba histolytica
RAITNAYYRGALGAILV

SEQ ID NO: 2733470 - protein, 23 aa, Entamoeba histolytica
RAMKGFMIPLLKNIIKDFKTTDL

SEQ ID NO: 2733471 - protein, 18 aa, Entamoeba histolytica
RAMMLYISLFSQVFKTKE

SEQ ID NO: 2733472 - protein, 25 aa, Entamoeba histolytica
RATSLLPMVYKLWFKYVRLEETVEN

SEQ ID NO: 2733473 - protein, 23 aa, Entamoeba histolytica
RCLDDFIFFCFLVGNDFLPHIPS

SEQ ID NO: 2733474 - protein, 17 aa, Entamoeba histolytica
RCMSPIYDFFVPSEPKS

SEQ ID NO: 2733475 - protein, 23 aa, Entamoeba histolytica
RCVDDFIFFCFLVGNDFLPHIPS

SEQ ID NO: 2733476 - protein, 22 aa, Entamoeba histolytica
RDEYIIHFYGALFIPNKICMVT

SEQ ID NO: 2733477 - protein, 17 aa, Entamoeba histolytica
RDFLQDQFLLDGFNFLR

SEQ ID NO: 2733478 - protein, 23 aa, Entamoeba histolytica
RDGNLLCLILLLQTFPSIQESSV

SEQ ID NO: 2733479 - protein, 22 aa, Entamoeba histolytica
RDYPIPSFIPPPAKPFINYTNP

SEQ ID NO: 2733480 - protein, 24 aa, Entamoeba histolytica
RECFPTFLSFFALPLVSAIPYTAV

SEQ ID NO: 2733481 - protein, 23 aa, Entamoeba histolytica
REEKILCKIFPLYFSYIQENPQT

SEQ ID NO: 2733482 - protein, 18 aa, Entamoeba histolytica
REFIYILPPPNIYRGRKI

SEQ ID NO: 2733483 - protein, 17 aa, Entamoeba histolytica
REFLSALAFVEPTFDLS

SEQ ID NO: 2733484 - protein, 17 aa, Entamoeba histolytica
REIAIQNIELWKQNDEL

SEQ ID NO: 2733485 - protein, 20 aa, Entamoeba histolytica
REIIPNYIILIDDQLIKLNR

SEQ ID NO: 2733486 - protein, 22 aa, Entamoeba histolytica
REQKYYIFIAPLTQLNIDEYNF

SEQ ID NO: 2733487 - protein, 21 aa, Entamoeba histolytica
REVICLPFYSFIVRYLYVRHE

SEQ ID NO: 2733488 - protein, 25 aa, Entamoeba histolytica
REVIKTIPKFWYYALKNSGYLDIVF

SEQ ID NO: 2733489 - protein, 21 aa, Entamoeba histolytica
RFAFIDYMMFEYRKNIKDLFE

SEQ ID NO: 2733490 - protein, 21 aa, Entamoeba histolytica
RFAPPLSIIIIKPGTYEETEP

SEQ ID NO: 2733491 - protein, 20 aa, Entamoeba histolytica
RFATLTGNYFRNAMAAIIMF

SEQ ID NO: 2733492 - protein, 26 aa, Entamoeba histolytica
RFFFETFKKLRVGAVLYLLYGRQSQN

SEQ ID NO: 2733493 - protein, 21 aa, Entamoeba histolytica
RFHRNDFLIYLLKKGTNLKTT

SEQ ID NO: 2733494 - protein, 19 aa, Entamoeba histolytica
RFMNPPFTAVLMLIKVMQY

SEQ ID NO: 2733495 - protein, 18 aa, Entamoeba histolytica
RFQRDAILALHFIAEDFL

SEQ ID NO: 2733496 - protein, 18 aa, Entamoeba histolytica
RFVFTCFSAFWVLSDGTA

SEQ ID NO: 2733497 - protein, 18 aa, Entamoeba histolytica
RGDFGCEVLFYLLAQKLM

SEQ ID NO: 2733498 - protein, 17 aa, Entamoeba histolytica
RGHPRFRKPRIGGDGVY

SEQ ID NO: 2733499 - protein, 21 aa, Entamoeba histolytica
RGHYGLECLLLLVALKLRFPQ

SEQ ID NO: 2733500 - protein, 19 aa, Entamoeba histolytica
RGIELYEYYMKLILNIDQY

SEQ ID NO: 2733501 - protein, 18 aa, Entamoeba histolytica
RGIFIDWKGPKCKGIAKV

SEQ ID NO: 2733502 - protein, 24 aa, Entamoeba histolytica
RGKGNMVFLFLRKGIYTCQALVMK

SEQ ID NO: 2733503 - protein, 23 aa, Entamoeba histolytica
RGKKNYLPPVPLVFGIGIMFAVE

SEQ ID NO: 2733504 - protein, 24 aa, Entamoeba histolytica
RGKVAAFFLFIAPPSMEILEQRLR

SEQ ID NO: 2733505 - protein, 22 aa, Entamoeba histolytica
RGMLFLVELSPILFKLIWKTEN

SEQ ID NO: 2733506 - protein, 21 aa, Entamoeba histolytica
RGRLPYFVTPPLPEKNDTIDT

SEQ ID NO: 2733507 - protein, 17 aa, Entamoeba histolytica
RHIKALCFYYLNQKGYS

SEQ ID NO: 2733508 - protein, 21 aa, Entamoeba histolytica
RICPLELKSACGAILYASPYF

SEQ ID NO: 2733509 - protein, 18 aa, Entamoeba histolytica
RIEPKYYFPIIPTVLVNG

SEQ ID NO: 2733510 - protein, 19 aa, Entamoeba histolytica
RIFKYVIWYKVDYSRYLEE

SEQ ID NO: 2733511 - protein, 19 aa, Entamoeba histolytica
RIIISLPFRLKYVCSFENI

SEQ ID NO: 2733512 - protein, 22 aa, Entamoeba histolytica
RIIKWFDMVFPKAVQLRWKIPD

SEQ ID NO: 2733513 - protein, 17 aa, Entamoeba histolytica
RIILYFHDKRVDGSLTF

SEQ ID NO: 2733514 - protein, 21 aa, Entamoeba histolytica
RIISYVPWWTIVEMANNIFGD

SEQ ID NO: 2733515 - protein, 22 aa, Entamoeba histolytica
RIPRYRLLLQELLKTLPPQHSE

SEQ ID NO: 2733516 - protein, 20 aa, Entamoeba histolytica
RIRLLLMNIIQMMESGWTIS

SEQ ID NO: 2733517 - protein, 18 aa, Entamoeba histolytica
RIRVVYLCKWFIKNGSNQ

SEQ ID NO: 2733518 - protein, 17 aa, Entamoeba histolytica
RISTLWRICQTYDYFFV

SEQ ID NO: 2733519 - protein, 20 aa, Entamoeba histolytica
RITMLMFYLGAYKILFPEQP

SEQ ID NO: 2733520 - protein, 17 aa, Entamoeba histolytica
RITSILISLFLDKPSSA

SEQ ID NO: 2733521 - protein, 27 aa, Entamoeba histolytica
RIYYQVIKKYLDFLFKMKRINMITAQN

SEQ ID NO: 2733522 - protein, 17 aa, Entamoeba histolytica
RKECFLFIFYSIQQHYI

SEQ ID NO: 2733523 - protein, 17 aa, Entamoeba histolytica
RKFATPFFLLKKAFECC

SEQ ID NO: 2733524 - protein, 26 aa, Entamoeba histolytica
RKHGPLFIYLFRLMLATGIPELQSAK

SEQ ID NO: 2733525 - protein, 27 aa, Entamoeba histolytica
RKKLTPLELFWLLNEFADLLGPSPLIV

SEQ ID NO: 2733526 - protein, 17 aa, Entamoeba histolytica
RKLFYLCALKYPFDSVD

SEQ ID NO: 2733527 - protein, 26 aa, Entamoeba histolytica
RKMTMRTLHFFVWKKYILPNGKIVTS

SEQ ID NO: 2733528 - protein, 19 aa, Entamoeba histolytica
RKQRELENLRLQEQLRKQK

SEQ ID NO: 2733529 - protein, 21 aa, Entamoeba histolytica
RKQSCIFFLYCSDPLQQKRNI

SEQ ID NO: 2733530 - protein, 19 aa, Entamoeba histolytica
RKRMQVVNVLLPDGSTKKM

SEQ ID NO: 2733531 - protein, 22 aa, Entamoeba histolytica
RKVSTLRLGFVPLSPIEESFNK

SEQ ID NO: 2733532 - protein, 17 aa, Entamoeba histolytica
RLAYFRQGMLEIAVLQL

SEQ ID NO: 2733533 - protein, 22 aa, Entamoeba histolytica
RLERWWFIITDVRNQFVLNATH

SEQ ID NO: 2733534 - protein, 17 aa, Entamoeba histolytica
RLFEEELLDSSLKDFRD

SEQ ID NO: 2733535 - protein, 19 aa, Entamoeba histolytica
RLFKKWEVILFRKQDRKKK

SEQ ID NO: 2733536 - protein, 17 aa, Entamoeba histolytica
RLIELLLIRGYSFNRTA

SEQ ID NO: 2733537 - protein, 17 aa, Entamoeba histolytica
RLIPADIVICAFGFGPD

SEQ ID NO: 2733538 - protein, 18 aa, Entamoeba histolytica
RLIRRINLRYRFSLGTEL

SEQ ID NO: 2733539 - protein, 23 aa, Entamoeba histolytica
RLLINKLFKYLWPPMIALKEGQC

SEQ ID NO: 2733540 - protein, 22 aa, Entamoeba histolytica
RLLTVVSLLELYRSLNVLFIKG

SEQ ID NO: 2733541 - protein, 25 aa, Entamoeba histolytica
RLYQLPPYLPFSLRTLLINSNHLIC

SEQ ID NO: 2733542 - protein, 34 aa, Entamoeba histolytica; identical to SEQ ID NO: 2546991

SEQ ID NO: 2733543 - protein, 18 aa, Entamoeba histolytica
RMIGLCVIMAQIGMFIPC

SEQ ID NO: 2733544 - protein, 26 aa, Entamoeba histolytica
RMNKSVIFFILNYLLDLLREFGFFFD

SEQ ID NO: 2733545 - protein, 19 aa, Entamoeba histolytica
RNDGYISYWRLFRNGRWKP

SEQ ID NO: 2733546 - protein, 22 aa, Entamoeba histolytica
RNEYIIHFYGAVFIPNKICIVT

SEQ ID NO: 2733547 - protein, 23 aa, Entamoeba histolytica
RNKLVHHLIMEYGIYKRLNIYKP

SEQ ID NO: 2733548 - protein, 19 aa, Entamoeba histolytica
RNLIPKYKIVVERCILFDK

SEQ ID NO: 2733549 - protein, 19 aa, Entamoeba histolytica
RNLVFFKYPKWTGGLYCSP

SEQ ID NO: 2733550 - protein, 17 aa, Entamoeba histolytica
RNRHCILFMFDVTNSES

SEQ ID NO: 2733551 - protein, 19 aa, Entamoeba histolytica
RPELILPANKWYEIKHQNK

SEQ ID NO: 2733552 - protein, 23 aa, Entamoeba histolytica
RPKRPPTPYFIYLNEHRASIKEE

SEQ ID NO: 2733553 - protein, 24 aa, Entamoeba histolytica
RPKRPPTPYFLYLNEHRASIKEEH

SEQ ID NO: 2733554 - protein, 23 aa, Entamoeba histolytica
RPVSWILICRIIIYSLMEIHKGV

SEQ ID NO: 2733555 - protein, 22 aa, Entamoeba histolytica
RQIFHHFILYKFLFTRRSHLNW

SEQ ID NO: 2733556 - protein, 24 aa, Entamoeba histolytica
RQLKISMINLFKFISSQIKDVQEE

SEQ ID NO: 2733557 - protein, 17 aa, Entamoeba histolytica
RRAFMSRMFPSETIKKL

SEQ ID NO: 2733558 - protein, 18 aa, Entamoeba histolytica
RRAIIFLQNYNKFRDANE

SEQ ID NO: 2733559 - protein, 22 aa, Entamoeba histolytica
RRALVILLCWTLDIPYSKASEI

SEQ ID NO: 2733560 - protein, 18 aa, Entamoeba histolytica
RRFCFFLAAVIQGVDNHA

SEQ ID NO: 2733561 - protein, 22 aa, Entamoeba histolytica
RRIVWHCVLPLALKERKYLTYE

SEQ ID NO: 2733562 - protein, 18 aa, Entamoeba histolytica
RRLFRRFKKLGMKAKEGA

SEQ ID NO: 2733563 - protein, 20 aa, Entamoeba histolytica
RRLTRSIAPIKLKKPKKGNE

SEQ ID NO: 2733564 - protein, 20 aa, Entamoeba histolytica
RRPIQITCRFYQIGLLMLFN

SEQ ID NO: 2733565 - protein, 19 aa, Entamoeba histolytica
RRPSGICGVALYLAGRLHG

SEQ ID NO: 2733566 - protein, 24 aa, Entamoeba histolytica
RRTFIHNFLFDILLEKSYFFNSKL

SEQ ID NO: 2733567 - protein, 23 aa, Entamoeba histolytica
RSFRGKWPISYIKKILVFSTDEE

SEQ ID NO: 2733568 - protein, 25 aa, Entamoeba histolytica
RSKEEIPLIILYINKIFPFSFCENL

SEQ ID NO: 2733569 - protein, 28 aa, Entamoeba histolytica
RSLGYYVVPLLLILPFGKGSTTITLNGI

SEQ ID NO: 2733570 - protein, 21 aa, Entamoeba histolytica
RSLLLLSRYPLPLFKDLEPEV

SEQ ID NO: 2733571 - protein, 19 aa, Entamoeba histolytica
RSLLLTDLRFSPDGSYLSV

SEQ ID NO: 2733572 - protein, 24 aa, Entamoeba histolytica
RSMGVPSFFRWLSQKFPKIIDGCQ

SEQ ID NO: 2733573 - protein, 21 aa, Entamoeba histolytica
RSVKLFLLRWKKNNHYIIDDT

SEQ ID NO: 2733574 - protein, 25 aa, Entamoeba histolytica
RTEVPILPLFFLQYCAIEELQFEKL

SEQ ID NO: 2733575 - protein, 23 aa, Entamoeba histolytica
RTEYRMLYFNFNLRKIFFLRHAK

SEQ ID NO: 2733576 - protein, 19 aa, Entamoeba histolytica
RTHKDILSEYLWFCIVLDE

SEQ ID NO: 2733577 - protein, 28 aa, Entamoeba histolytica
RTISTLLYLRYLFIPFATYPSLLVEIQK

SEQ ID NO: 2733578 - protein, 24 aa, Entamoeba histolytica
RTKDYILLAWYYSPALAVGYYNRF

SEQ ID NO: 2733579 - protein, 19 aa, Entamoeba histolytica
RTLQYSYVKVFFLPKEDLS

SEQ ID NO: 2733580 - protein, 17 aa, Entamoeba histolytica
RTPYLFMPLVKLVDAMI

SEQ ID NO: 2733581 - protein, 18 aa, Entamoeba histolytica
RTSYTIMFLFYNKGFVNG

SEQ ID NO: 2733582 - protein, 22 aa, Entamoeba histolytica
RTTVLCYLLFRLRTISYPKPQL

SEQ ID NO: 2733583 - protein, 19 aa, Entamoeba histolytica
RVCIACKLCINILIITNQI

SEQ ID NO: 2733584 - protein, 17 aa, Entamoeba histolytica
RVLFLWALRHPASGYVQ

SEQ ID NO: 2733585 - protein, 17 aa, Entamoeba histolytica
RVMEILSKRLNIPMTAV

SEQ ID NO: 2733586 - protein, 19 aa, Entamoeba histolytica
RVTSIPTILVLNPGSWKAL

SEQ ID NO: 2733587 - protein, 25 aa, Entamoeba histolytica
RWQMARNYILWVPLTAIANNYSTST

SEQ ID NO: 2733588 - protein, 20 aa, Entamoeba histolytica
RYCNNFIYMYQWFKSFVNES

SEQ ID NO: 2733589 - protein, 18 aa, Entamoeba histolytica
RYFIELPIPIPLFKEYLI

SEQ ID NO: 2733590 - protein, 17 aa, Entamoeba histolytica
RYFKQCEFKLWRKQPQP

SEQ ID NO: 2733591 - protein, 18 aa, Entamoeba histolytica
RYFKQCEFKLWRKQPQPI

SEQ ID NO: 2733592 - protein, 19 aa, Entamoeba histolytica
RYFVLFNDILIYGEGNEHS

SEQ ID NO: 2733593 - protein, 18 aa, Entamoeba histolytica
RYFYLFNDILIYGIGDSN

SEQ ID NO: 2733594 - protein, 21 aa, Entamoeba histolytica
RYIEYYYYLLKYKKNFDRILI

SEQ ID NO: 2733595 - protein, 23 aa, Entamoeba histolytica
RYQYLMEFVPVWSKGWEKLSPNK

SEQ ID NO: 2733596 - protein, 22 aa, Entamoeba histolytica
SAITLIPLLLDIRLWRGIEYLF

SEQ ID NO: 2733597 - protein, 25 aa, Entamoeba histolytica
SAPTFFKYFMAFIRKIVIENSDYLF

SEQ ID NO: 2733598 - protein, 24 aa, Entamoeba histolytica
SARPNIHFFLYKPRLIGSKCVGFY

SEQ ID NO: 2733599 - protein, 17 aa, Entamoeba histolytica
SCGFIMFAIPKKGLEKK

SEQ ID NO: 2733600 - protein, 28 aa, Entamoeba histolytica
SCGVMLYNMLFLFPFKKPKNMYELQITD

SEQ ID NO: 2733601 - protein, 31 aa, Entamoeba histolytica
SCIVALLRGIWIMPIEWLFSKGDYFENEELY

SEQ ID NO: 2733602 - protein, 24 aa, Entamoeba histolytica
SCRKLLTIPFLQIQRLYFSDDNVI

SEQ ID NO: 2733603 - protein, 18 aa, Entamoeba histolytica
SCVEAVLYLFHQMKQWSV

SEQ ID NO: 2733604 - protein, 18 aa, Entamoeba histolytica
SCYIDCSVFIFLNLTQWK

SEQ ID NO: 2733605 - protein, 18 aa, Entamoeba histolytica
SDELLLNQMQLDEYIKVN

SEQ ID NO: 2733606 - protein, 22 aa, Entamoeba histolytica
SDIPLFAYKLIKETSPTFQLEN

SEQ ID NO: 2733607 - protein, 25 aa, Entamoeba histolytica
SDLKLPLWHLFPSHIELLFKSICSS

SEQ ID NO: 2733608 - protein, 25 aa, Entamoeba histolytica
SDVWSFGMLIFKLLVGRLPFELMQM

SEQ ID NO: 2733609 - protein, 24 aa, Entamoeba histolytica
SDYKDWCLYWLGLNDQKPPIIGES

SEQ ID NO: 2733610 - protein, 25 aa, Entamoeba histolytica
SDYKDWCLYWLGLNNFEPPLTGETP

SEQ ID NO: 2733611 - protein, 23 aa, Entamoeba histolytica
SEAKKKWLANRKPSLPLPKPGEV

SEQ ID NO: 2733612 - protein, 24 aa, Entamoeba histolytica
SEAKKKWLANRKPSLPLPKPGEVE

SEQ ID NO: 2733613 - protein, 18 aa, Entamoeba histolytica
SEALYFHQPLQPSYPQFL

SEQ ID NO: 2733614 - protein, 25 aa, Entamoeba histolytica
SEFKRLTLLLTKLPRKRLRDVSARL

SEQ ID NO: 2733615 - protein, 23 aa, Entamoeba histolytica
SEKIWIYPYIKDADFVYSTFLTT

SEQ ID NO: 2733616 - protein, 22 aa, Entamoeba histolytica
SEQMKIFQLFRQLERLSYDDIC

SEQ ID NO: 2733617 - protein, 20 aa, Entamoeba histolytica
SESALFLLFCSDPLMQKENI

SEQ ID NO: 2733618 - protein, 21 aa, Entamoeba histolytica
SFDVFIFKLKKFFDPIMCTVS

SEQ ID NO: 2733619 - protein, 18 aa, Entamoeba histolytica
SFEIVFDKEYYFICKDKC

SEQ ID NO: 2733620 - protein, 24 aa, Entamoeba histolytica
SFGRSWLSPRNLLQSPKFNTLCKI

SEQ ID NO: 2733621 - protein, 18 aa, Entamoeba histolytica
SFIQAFLFIFRNSIDTAN

SEQ ID NO: 2733622 - protein, 18 aa, Entamoeba histolytica
SFIYCYLSNLLYPFRKMN

SEQ ID NO: 2733623 - protein, 17 aa, Entamoeba histolytica
SFKLPFYSLKPFTTCTW

SEQ ID NO: 2733624 - protein, 20 aa, Entamoeba histolytica
SFLKKFFYTMREPSYIDWKL

SEQ ID NO: 2733625 - protein, 17 aa, Entamoeba histolytica
SFMIIYPNSVFLARGNH

SEQ ID NO: 2733626 - protein, 24 aa, Entamoeba histolytica
SFMYKWIILLFRRDFPHMACVRLW

SEQ ID NO: 2733627 - protein, 24 aa, Entamoeba histolytica
SFSAYFFRILLKIFRVYMKIARYQ

SEQ ID NO: 2733628 - protein, 18 aa, Entamoeba histolytica
SGCKYLHTIYFPTGLQKI

SEQ ID NO: 2733629 - protein, 18 aa, Entamoeba histolytica
SGGYNWWRRNSLTVFLDK

SEQ ID NO: 2733630 - protein, 23 aa, Entamoeba histolytica
SGKLFVWEWDNWEYPKNALKGHP

SEQ ID NO: 2733631 - protein, 24 aa, Entamoeba histolytica
SGKSTLLNYLFNTKFRILNEVMGR

SEQ ID NO: 2733632 - protein, 24 aa, Entamoeba histolytica
SGKTEAYFPYRLPSRAIYGGQNIE

SEQ ID NO: 2733633 - protein, 32 aa, Entamoeba histolytica; identical to SEQ ID NO: 2547111

SEQ ID NO: 2733634 - protein, 22 aa, Entamoeba histolytica
SGLWISILLAIRTGGDVLFCTD

SEQ ID NO: 2733635 - protein, 22 aa, Entamoeba histolytica
SGRYITVWQLIPLQYTQGVNGS

SEQ ID NO: 2733636 - protein, 24 aa, Entamoeba histolytica
SGTEWLLRVLSGMLFVPLIQRVFE

SEQ ID NO: 2733637 - protein, 23 aa, Entamoeba histolytica
SHDGYLIFYSFEGKVKSYDCFDR

SEQ ID NO: 2733638 - protein, 25 aa, Entamoeba histolytica
SHHSQYLLYLPLLLRHIVIQPRSEY

SEQ ID NO: 2733639 - protein, 23 aa, Entamoeba histolytica
SHQSFPCIPFFGVYLQDLTFIHE

SEQ ID NO: 2733640 - protein, 25 aa, Entamoeba histolytica
SHQTNCLCFLLPSYSHPSPSQIICN

SEQ ID NO: 2733641 - protein, 25 aa, Entamoeba histolytica
SHQTNCLCFLLPSYSHPSPSQIKFC

SEQ ID NO: 2733642 - protein, 24 aa, Entamoeba histolytica
SHQTNCLCFLLPSYSHPSPSQIVC

SEQ ID NO: 2733643 - protein, 25 aa, Entamoeba histolytica
SHQTNCLCFLLPSYSHPSPSQIVCN

SEQ ID NO: 2733644 - protein, 23 aa, Entamoeba histolytica
SHRIWLWIVNMPQIIHAMNALAP

SEQ ID NO: 2733645 - protein, 23 aa, Entamoeba histolytica
SHRTWFTLLLLSQSFRYFLSINS

SEQ ID NO: 2733646 - protein, 18 aa, Entamoeba histolytica
SIAIIIFHRLITPALVSP

SEQ ID NO: 2733647 - protein, 22 aa, Entamoeba histolytica
SIAIPFELWYIEATYTCIIFIK

SEQ ID NO: 2733648 - protein, 24 aa, Entamoeba histolytica
SIDQIYRNLICKILIRNVGKNELP

SEQ ID NO: 2733649 - protein, 17 aa, Entamoeba histolytica
SIEFLIYLHFHLLKLFK

SEQ ID NO: 2733650 - protein, 25 aa, Entamoeba histolytica
SIENQYIYFIKFYNSIYKGFLYQLN

SEQ ID NO: 2733651 - protein, 25 aa, Entamoeba histolytica
SIHDKKLYYLFNKDFLIGLIRHNGQ

SEQ ID NO: 2733652 - protein, 17 aa, Entamoeba histolytica
SIIIIKPGTYEETEPIV

SEQ ID NO: 2733653 - protein, 21 aa, Entamoeba histolytica
SIIRGFLYHKRYLTYKAFSAT

SEQ ID NO: 2733654 - protein, 17 aa, Entamoeba histolytica
SIKEGMFIRPTPRRLNV

SEQ ID NO: 2733655 - protein, 17 aa, Entamoeba histolytica
SIKSFHWQFLITKSKRS

SEQ ID NO: 2733656 - protein, 18 aa, Entamoeba histolytica
SIPIFPIYPTPTINNIKS

SEQ ID NO: 2733657 - protein, 21 aa, Entamoeba histolytica
SIPTILVLNPGSWKALPRTTK

SEQ ID NO: 2733658 - protein, 17 aa, Entamoeba histolytica
SIPYNVLMIKLKTLPSL

SEQ ID NO: 2733659 - protein, 24 aa, Entamoeba histolytica
SIQKEAELLFSRAKTLGLDDCIEE

SEQ ID NO: 2733660 - protein, 24 aa, Entamoeba histolytica
SIQSLTLFPFIQTLFLYSSFDPFI

SEQ ID NO: 2733661 - protein, 19 aa, Entamoeba histolytica
SITLPTIYSRAFYLCLEKL

SEQ ID NO: 2733662 - protein, 19 aa, Entamoeba histolytica
SIVPFTLLLPFYQAETLHG

SEQ ID NO: 2733663 - protein, 24 aa, Entamoeba histolytica
SKEYGPLIIFLLSDVLLVHRAKQE

SEQ ID NO: 2733664 - protein, 23 aa, Entamoeba histolytica
SKIQLFFVQLYMQILKTLRYNTS

SEQ ID NO: 2733665 - protein, 19 aa, Entamoeba histolytica
SKIVLPPLKVLPKGLFYNC

SEQ ID NO: 2733666 - protein, 20 aa, Entamoeba histolytica
SKKFLHYWKYILESLKGMKR

SEQ ID NO: 2733667 - protein, 23 aa, Entamoeba histolytica
SKKYPFMIYALRLFKILYEMNIA

SEQ ID NO: 2733668 - protein, 20 aa, Entamoeba histolytica
SKLGFPYELLLQINKEVAGL

SEQ ID NO: 2733669 - protein, 20 aa, Entamoeba histolytica
SKLQIYYIPSLGIAPSWCSF

SEQ ID NO: 2733670 - protein, 22 aa, Entamoeba histolytica
SKMGLIKSFWYYFLNKNEFTEK

SEQ ID NO: 2733671 - protein, 23 aa, Entamoeba histolytica
SKNTFLHWIIKVLRIVLIIGEKY

SEQ ID NO: 2733672 - protein, 23 aa, Entamoeba histolytica
SKPIPPVPQKKIAPPTPSKCAPP

SEQ ID NO: 2733673 - protein, 22 aa, Entamoeba histolytica
SKQAIELVFVLCAFDGFFSFMC

SEQ ID NO: 2733674 - protein, 20 aa, Entamoeba histolytica
SKRFLNTVLLIKIVPLIKRD

SEQ ID NO: 2733675 - protein, 27 aa, Entamoeba histolytica
SKVDKVDLLIFFTELRRFCLDIINWID

SEQ ID NO: 2733676 - protein, 27 aa, Entamoeba histolytica
SKVFSHIWFLFEVIIHSLIKYLDKQHA

SEQ ID NO: 2733677 - protein, 21 aa, Entamoeba histolytica
SKVLFKIICFICSFITENEQI

SEQ ID NO: 2733678 - protein, 21 aa, Entamoeba histolytica
SLAYMFIYFMKGNLPWQGIKG

SEQ ID NO: 2733679 - protein, 24 aa, Entamoeba histolytica
SLDQWYIIILCFLDFSLQDISKTT

SEQ ID NO: 2733680 - protein, 18 aa, Entamoeba histolytica
SLFQLIPWLGICVKSVSL

SEQ ID NO: 2733681 - protein, 20 aa, Entamoeba histolytica
SLFYTFTIPVKLSLLITSPP

SEQ ID NO: 2733682 - protein, 20 aa, Entamoeba histolytica
SLHIRLIPRIIPIITKLQSL

SEQ ID NO: 2733683 - protein, 25 aa, Entamoeba histolytica
SLIDKITWWAGRLFFNEFEMLMKVL

SEQ ID NO: 2733684 - protein, 17 aa, Entamoeba histolytica
SLIKLFLLEYRVLIIAS

SEQ ID NO: 2733685 - protein, 19 aa, Entamoeba histolytica
SLILFYYLPNNYPFEEIPR

SEQ ID NO: 2733686 - protein, 17 aa, Entamoeba histolytica
SLILYKTGNVIITKSVI

SEQ ID NO: 2733687 - protein, 24 aa, Entamoeba histolytica
SLKRALLFAHFQRRVITDGRMVSV

SEQ ID NO: 2733688 - protein, 23 aa, Entamoeba histolytica
SLKSLILALKYMKTLPPSAHLLF

SEQ ID NO: 2733689 - protein, 18 aa, Entamoeba histolytica
SLKWLCQCIYYNELIIPD

SEQ ID NO: 2733690 - protein, 24 aa, Entamoeba histolytica
SLLDNVLMDIPKWVKVYSSEIVIS

SEQ ID NO: 2733691 - protein, 26 aa, Entamoeba histolytica
SLLELFRIILMYRYSFYKESVKDIFL

SEQ ID NO: 2733692 - protein, 23 aa, Entamoeba histolytica
SLLFEYNMYLAYYCWIKSSGSNV

SEQ ID NO: 2733693 - protein, 19 aa, Entamoeba histolytica
SLLFLTDELAKPSSLPFLK

SEQ ID NO: 2733694 - protein, 22 aa, Entamoeba histolytica
SLLKWLFNPLSDGSIHIVFKLN

SEQ ID NO: 2733695 - protein, 18 aa, Entamoeba histolytica
SLLLYPKIYHHLKSSLLL

SEQ ID NO: 2733696 - protein, 24 aa, Entamoeba histolytica
SLLSHYIQLYFLPAVRSLVIDEIR

SEQ ID NO: 2733697 - protein, 23 aa, Entamoeba histolytica
SLLSRFDLIYLILDQPNPERDRK

SEQ ID NO: 2733698 - protein, 18 aa, Entamoeba histolytica
SLLYFPFIIPVDYKMKFL

SEQ ID NO: 2733699 - protein, 24 aa, Entamoeba histolytica
SLMQYLIFHKFTPTKYQPLPDIQI

SEQ ID NO: 2733700 - protein, 24 aa, Entamoeba histolytica
SLNTFIPLYTYKYLRPWKIVHYKN

SEQ ID NO: 2733701 - protein, 18 aa, Entamoeba histolytica
SLPILRYVNIPLSDKTLE

SEQ ID NO: 2733702 - protein, 19 aa, Entamoeba histolytica
SLRFRFPSTCDLRFVLLSE

SEQ ID NO: 2733703 - protein, 18 aa, Entamoeba histolytica
SLSFTLPLDSSLSQKKTD

SEQ ID NO: 2733704 - protein, 24 aa, Entamoeba histolytica
SLSKFVFVPLLYQEVFIFSCCEEY

SEQ ID NO: 2733705 - protein, 19 aa, Entamoeba histolytica
SLTLYYQFCSLFDSLPLVC

SEQ ID NO: 2733706 - protein, 18 aa, Entamoeba histolytica
SLVYIKFPTSITSIGNEC

SEQ ID NO: 2733707 - protein, 24 aa, Entamoeba histolytica
SLYILNPVLFFIQLETMKLLVWGE

SEQ ID NO: 2733708 - protein, 24 aa, Entamoeba histolytica
SMNLWLEYLLLCRNSNDFKLSQKI

SEQ ID NO: 2733709 - protein, 20 aa, Entamoeba histolytica
SMTLSFFPPYPFAKQIIINR

SEQ ID NO: 2733710 - protein, 25 aa, Entamoeba histolytica
SMTPKYLLLFYMKFMHLIGNICNIQ

SEQ ID NO: 2733711 - protein, 24 aa, Entamoeba histolytica
SNIKYIFRDILFLLISYSLKERCE

SEQ ID NO: 2733712 - protein, 24 aa, Entamoeba histolytica
SNKENLIRFVFPISRITLLPCNSK

SEQ ID NO: 2733713 - protein, 18 aa, Entamoeba histolytica
SNLLLLINKLLFAPTIGK

SEQ ID NO: 2733714 - protein, 24 aa, Entamoeba histolytica
SNLMKPYFGDLLKWLLSLLNSNQK

SEQ ID NO: 2733715 - protein, 24 aa, Entamoeba histolytica
SNLTLPKWFPTQPIPFDFKSNKIE

SEQ ID NO: 2733716 - protein, 23 aa, Entamoeba histolytica
SNNAEWLGVLKPTVSLISCGHGN

SEQ ID NO: 2733717 - protein, 23 aa, Entamoeba histolytica
SNNFEIMFHVAPLLPLLQNDEQA

SEQ ID NO: 2733718 - protein, 23 aa, Entamoeba histolytica
SNNTFLWDIFLDNLNLLFFEFQL

SEQ ID NO: 2733719 - protein, 20 aa, Entamoeba histolytica
SNPILFIPPLPELKSLCLVN

SEQ ID NO: 2733720 - protein, 24 aa, Entamoeba histolytica
SNQHSKFTFIWIKDLFTYLDKKPF

SEQ ID NO: 2733721 - protein, 25 aa, Entamoeba histolytica
SNTLYSHRFFPYYSFSLLAGINSKG

SEQ ID NO: 2733722 - protein, 17 aa, Entamoeba histolytica
SNTPPVPLILFPKLDQS

SEQ ID NO: 2733723 - protein, 23 aa, Entamoeba histolytica
SNTRSFICPLTKKPFVNPVKAQV

SEQ ID NO: 2733724 - protein, 24 aa, Entamoeba histolytica
SNVNRKWYFAPRKISNIAYNETYD

SEQ ID NO: 2733725 - protein, 22 aa, Entamoeba histolytica
SNYFILFLLCINFLYRQNNYAF

SEQ ID NO: 2733726 - protein, 20 aa, Entamoeba histolytica
SNYKNFLWKILKTLFDDYVD

SEQ ID NO: 2733727 - protein, 24 aa, Entamoeba histolytica
SNYNFERPFLWIARKLTGNPNLVF

SEQ ID NO: 2733728 - protein, 18 aa, Entamoeba histolytica
SPCRIVVILLFHYFNKMY

SEQ ID NO: 2733729 - protein, 26 aa, Entamoeba histolytica
SPDFSDLFFRRTFFYSFPSFAKAKEV

SEQ ID NO: 2733730 - protein, 17 aa, Entamoeba histolytica
SPDFTYFPQWILDYLHI

SEQ ID NO: 2733731 - protein, 26 aa, Entamoeba histolytica
SPEMYSWFPLFFPLISPIEVKRGDIL

SEQ ID NO: 2733732 - protein, 21 aa, Entamoeba histolytica
SPMRLALFKQPDFLNSPKVII

SEQ ID NO: 2733733 - protein, 31 aa, Entamoeba histolytica
SPNEMLNTLNYLSQFLLTCVTTLIGESVTFL

SEQ ID NO: 2733734 - protein, 19 aa, Entamoeba histolytica
SPRRHPFYGGSPMPCMMIA

SEQ ID NO: 2733735 - protein, 31 aa, Entamoeba histolytica
SPRSSSIIFPKNKMPFLSTQPIKPLANSDIT

SEQ ID NO: 2733736 - protein, 25 aa, Entamoeba histolytica
SQFWSYRWNFLLMASEGYIIIAPNR

SEQ ID NO: 2733737 - protein, 26 aa, Entamoeba histolytica
SQLPNNLFTFLPYLKILKLGINQLTT

SEQ ID NO: 2733738 - protein, 18 aa, Entamoeba histolytica
SQLYWLRHNLLATLGLSI

SEQ ID NO: 2733739 - protein, 25 aa, Entamoeba histolytica
SQYNTLHFILLMRSLIITPFNKQNG

SEQ ID NO: 2733740 - protein, 24 aa, Entamoeba histolytica
SRDIFESLFWKTLYGKIVSGKIKS

SEQ ID NO: 2733741 - protein, 20 aa, Entamoeba histolytica
SRFYPIIPLKFTEGEFKWLG

SEQ ID NO: 2733742 - protein, 21 aa, Entamoeba histolytica
SRSYSWLPLLYGLTKEDFFGA

SEQ ID NO: 2733743 - protein, 18 aa, Entamoeba histolytica
SRVILIRDQIFKLACDHF

SEQ ID NO: 2733744 - protein, 21 aa, Entamoeba histolytica
SSDFFPLFWQIASQFVNNPLP

SEQ ID NO: 2733745 - protein, 25 aa, Entamoeba histolytica
SSDNEWSLPAFLPKRIRSISKEEVI

SEQ ID NO: 2733746 - protein, 20 aa, Entamoeba histolytica
SSDNFLIYDLVICTVRLAKN

SEQ ID NO: 2733747 - protein, 24 aa, Entamoeba histolytica
SSEELFIIVFPLQNKFFLDADIPF

SEQ ID NO: 2733748 - protein, 21 aa, Entamoeba histolytica
SSFILYCSQFFIFDSKYQTLM

SEQ ID NO: 2733749 - protein, 20 aa, Entamoeba histolytica
SSIYTFIRSLVLQPIVLYFS

SEQ ID NO: 2733750 - protein, 20 aa, Entamoeba histolytica
SSKLILLYKPLREWGKELYE

SEQ ID NO: 2733751 - protein, 24 aa, Entamoeba histolytica
SSKLLAQWIVLCPSSVIPIFSEAA

SEQ ID NO: 2733752 - protein, 21 aa, Entamoeba histolytica
SSKSIRFIPLPGSALTLGTYI

SEQ ID NO: 2733753 - protein, 18 aa, Entamoeba histolytica
SSLALIHYILLRGLSDPT

SEQ ID NO: 2733754 - protein, 26 aa, Entamoeba histolytica
SSLFFLRYCFLPLVKYPSLLKILQKG

SEQ ID NO: 2733755 - protein, 19 aa, Entamoeba histolytica
SSLKPVMYEGFMAGGVAAG

SEQ ID NO: 2733756 - protein, 21 aa, Entamoeba histolytica
SSLKRFSYCPVLFSNNDENIK

SEQ ID NO: 2733757 - protein, 24 aa, Entamoeba histolytica
SSVPKLIKYLLFVPPISLPLNKKD

SEQ ID NO: 2733758 - protein, 21 aa, Entamoeba histolytica
SSYLFDLYELFFPLNDTSKKM

SEQ ID NO: 2733759 - protein, 24 aa, Entamoeba histolytica
STDLLLLLERLLAFFGSIPPVRKN

SEQ ID NO: 2733760 - protein, 24 aa, Entamoeba histolytica
STEFLSICQFLLPIELRYSSQLSI

SEQ ID NO: 2733761 - protein, 17 aa, Entamoeba histolytica
STHFLPPSIIDPLKEKG

SEQ ID NO: 2733762 - protein, 18 aa, Entamoeba histolytica
SVCSSLILSLPSHENNIS

SEQ ID NO: 2733763 - protein, 19 aa, Entamoeba histolytica
SVDDDFMAAYLGMQHNRIG

SEQ ID NO: 2733764 - protein, 21 aa, Entamoeba histolytica
SVDWWTLGVLMYEFLYGCNPF

SEQ ID NO: 2733765 - protein, 23 aa, Entamoeba histolytica
SVFHLAWLSFLLYKSFKDSSEKS

SEQ ID NO: 2733766 - protein, 23 aa, Entamoeba histolytica
SVFKKFLRNLPIHIFDRTTTKKI

SEQ ID NO: 2733767 - protein, 18 aa, Entamoeba histolytica
SVFQWKEEFLKWSTIKPD

SEQ ID NO: 2733768 - protein, 28 aa, Entamoeba histolytica
SVKNWKKRWFVLKPTRLWYFKAKNSTSA

SEQ ID NO: 2733769 - protein, 24 aa, Entamoeba histolytica
SVKPDEILLLDTYFYLVVFRGNAV

SEQ ID NO: 2733770 - protein, 23 aa, Entamoeba histolytica
SVMHLRWFNMHLLRVEYYPESKV

SEQ ID NO: 2733771 - protein, 27 aa, Entamoeba histolytica
SVMTPNFFLDFFKTFEIFFSLGNTFFS

SEQ ID NO: 2733772 - protein, 25 aa, Entamoeba histolytica
SVSSLVLMLVALQEKNKPPRPEMQM

SEQ ID NO: 2733773 - protein, 19 aa, Entamoeba histolytica
SWFSSWWKTDKDEVNMMKK

SEQ ID NO: 2733774 - protein, 23 aa, Entamoeba histolytica
SYFEYFYQFLFLNPITTYPIQIL

SEQ ID NO: 2733775 - protein, 20 aa, Entamoeba histolytica
SYGIILWELIYRVIYQKYQR

SEQ ID NO: 2733776 - protein, 17 aa, Entamoeba histolytica
SYIIFDLLLFKEIIEKG

SEQ ID NO: 2733777 - protein, 18 aa, Entamoeba histolytica
SYKLGPFLSTLFTVQDED

SEQ ID NO: 2733778 - protein, 19 aa, Entamoeba histolytica
SYRVIPSLHFPLLSSDWGA

SEQ ID NO: 2733779 - protein, 23 aa, Entamoeba histolytica
SYTGYFMFYRFVGNYIASSSNET

SEQ ID NO: 2733780 - protein, 23 aa, Entamoeba histolytica
TAFSSFFSILFSLSGKYLQTEIS

SEQ ID NO: 2733781 - protein, 21 aa, Entamoeba histolytica
TAIDLIPIFFTLQSNNYFTKV

SEQ ID NO: 2733782 - protein, 26 aa, Entamoeba histolytica
TALRNMLQLFLRQLPLNSKFQIISFG

SEQ ID NO: 2733783 - protein, 24 aa, Entamoeba histolytica
TANLPLFYFAPTNINIPKFKKVNL

SEQ ID NO: 2733784 - protein, 17 aa, Entamoeba histolytica
TANLPLFYFSPININPP

SEQ ID NO: 2733785 - protein, 20 aa, Entamoeba histolytica
TASSIQPEWLFEASPKYFAQ

SEQ ID NO: 2733786 - protein, 19 aa, Entamoeba histolytica
TAYFLLFIDIEFVKPYIRN

SEQ ID NO: 2733787 - protein, 18 aa, Entamoeba histolytica
TCLLLTYTTNSFPDTYVP

SEQ ID NO: 2733788 - protein, 19 aa, Entamoeba histolytica
TCVFIFVKALLFISDNQLM

SEQ ID NO: 2733789 - protein, 22 aa, Entamoeba histolytica
TDENVILLMFYAGNETLPLTEQ

SEQ ID NO: 2733790 - protein, 22 aa, Entamoeba histolytica
TDGLHLLMDLLNELGFEFNTKL

SEQ ID NO: 2733791 - protein, 21 aa, Entamoeba histolytica
TDIFLTLQFIKQFSFRLLEII

SEQ ID NO: 2733792 - protein, 20 aa, Entamoeba histolytica
TDIVFSLRNLFNSPPIIIKQ

SEQ ID NO: 2733793 - protein, 23 aa, Entamoeba histolytica
TDNHIFLITPFLKGGALCHRLFY

SEQ ID NO: 2733794 - protein, 18 aa, Entamoeba histolytica
TDYFIFPFPLCLIVTKQL

SEQ ID NO: 2733795 - protein, 24 aa, Entamoeba histolytica
TDYFQWINTIPLFCNFTGVFGYPL

SEQ ID NO: 2733796 - protein, 18 aa, Entamoeba histolytica
TEFMFCARLQIFKTWFED

SEQ ID NO: 2733797 - protein, 24 aa, Entamoeba histolytica
TEIIKFIMLLFESFILNKVKVQKS

SEQ ID NO: 2733798 - protein, 24 aa, Entamoeba histolytica
TEKPLFPLFLCDAGLIIISRFPIV

SEQ ID NO: 2733799 - protein, 23 aa, Entamoeba histolytica
TEKPLFPLFLCDAGLVIISRFPI

SEQ ID NO: 2733800 - protein, 23 aa, Entamoeba histolytica
TENKSVVFPLTALSFIHTESNNK

SEQ ID NO: 2733801 - protein, 18 aa, Entamoeba histolytica
TENPPIISLLFTTKSRLY

SEQ ID NO: 2733802 - protein, 22 aa, Entamoeba histolytica
TEQYCVMLYHQLLEKIKKGTPV

SEQ ID NO: 2733803 - protein, 25 aa, Entamoeba histolytica
TETRKLLFNYVALGVKLMNASNSNK

SEQ ID NO: 2733804 - protein, 21 aa, Entamoeba histolytica
TEYRMLWFRFDIRKLYFLRHG

SEQ ID NO: 2733805 - protein, 22 aa, Entamoeba histolytica
TFESVLHYFSFFGKVRAITQDG

SEQ ID NO: 2733806 - protein, 17 aa, Entamoeba histolytica
TFFIPLSNKGTYFLKYF

SEQ ID NO: 2733807 - protein, 24 aa, Entamoeba histolytica
TFFNFHYFNPPQTQFFFICFNTNN

SEQ ID NO: 2733808 - protein, 20 aa, Entamoeba histolytica
TFFTPFQYKLFPRVMIYFKQ

SEQ ID NO: 2733809 - protein, 25 aa, Entamoeba histolytica
TFGILPIPFIVNYSFIIEIIGHKFE

SEQ ID NO: 2733810 - protein, 19 aa, Entamoeba histolytica
TFKILINELKNKPIKRIWG

SEQ ID NO: 2733811 - protein, 25 aa, Entamoeba histolytica
TFSDWKLILYFINLLGKFGGETNYE

SEQ ID NO: 2733812 - protein, 17 aa, Entamoeba histolytica
TFYKITVGFNFLSNFII

SEQ ID NO: 2733813 - protein, 27 aa, Entamoeba histolytica
TGDLFDPFLRPYFAIGYIPVTQGDVIQ

SEQ ID NO: 2733814 - protein, 25 aa, Entamoeba histolytica
TGKTFAYLIPLIQFVLKLPKLTEET

SEQ ID NO: 2733815 - protein, 26 aa, Entamoeba histolytica
TGNLFINYLYLLLKEYTYIIEIPCTL

SEQ ID NO: 2733816 - protein, 18 aa, Entamoeba histolytica
TGSPFVLCYLQKGVVSIK

SEQ ID NO: 2733817 - protein, 20 aa, Entamoeba histolytica
THPFKFPGLILHDIILRFIP

SEQ ID NO: 2733818 - protein, 25 aa, Entamoeba histolytica
THRIRELWLLLFKFIDHPLKLNNIE

SEQ ID NO: 2733819 - protein, 29 aa, Entamoeba histolytica
TIAALALLFAVQSYYPSPFFILDEIDAAL

SEQ ID NO: 2733820 - protein, 17 aa, Entamoeba histolytica
TIARPIMSSLLVCYTKY

SEQ ID NO: 2733821 - protein, 26 aa, Entamoeba histolytica
TIAVVTIFFVLRYYNVLNGSIEKIIT

SEQ ID NO: 2733822 - protein, 24 aa, Entamoeba histolytica
TIFDYFHFSLIRIPFNSLSFTLSF

SEQ ID NO: 2733823 - protein, 17 aa, Entamoeba histolytica
TIGFFRLGKDYQSCISE

SEQ ID NO: 2733824 - protein, 24 aa, Entamoeba histolytica
TIIPIIIYLLLHSSIPNINLLICC

SEQ ID NO: 2733825 - protein, 27 aa, Entamoeba histolytica
TILLNAKIIFFIVKVLFRCDAVDPPES

SEQ ID NO: 2733826 - protein, 23 aa, Entamoeba histolytica
TIPSFFPLPIPLLRSNAGYIAST

SEQ ID NO: 2733827 - protein, 17 aa, Entamoeba histolytica
TIPYLLCIICQVPVILP

SEQ ID NO: 2733828 - protein, 24 aa, Entamoeba histolytica
TIQAVTLIWTLLRQGPNGEPTCKK

SEQ ID NO: 2733829 - protein, 21 aa, Entamoeba histolytica
TIQMYFSFRFLKQESAEEKRI

SEQ ID NO: 2733830 - protein, 19 aa, Entamoeba histolytica
TIQTYIVMIRTIQRNRDRA

SEQ ID NO: 2733831 - protein, 23 aa, Entamoeba histolytica
TITLTFIIPFKKFDLLLCFVSQS

SEQ ID NO: 2733832 - protein, 17 aa, Entamoeba histolytica
TIVLYVISLLDPSIRYS

SEQ ID NO: 2733833 - protein, 18 aa, Entamoeba histolytica
TIYHCYLPKSLPSSSQVY

SEQ ID NO: 2733834 - protein, 26 aa, Entamoeba histolytica
TKDPKHFIFSLLNPNGIQPRAFYLQD

SEQ ID NO: 2733835 - protein, 21 aa, Entamoeba histolytica
TKFNLFFSYHYYVDLLCESMA

SEQ ID NO: 2733836 - protein, 25 aa, Entamoeba histolytica
TKKVRGFFVFPYIKSMSLLQREMEG

SEQ ID NO: 2733837 - protein, 23 aa, Entamoeba histolytica
TKKYLLKITSLLFSIKLIPKEYN

SEQ ID NO: 2733838 - protein, 22 aa, Entamoeba histolytica
TKLEDCFYLYTKTFPFLKNITI

SEQ ID NO: 2733839 - protein, 22 aa, Entamoeba histolytica
TKNIQTFWSLLKQTLIEQRLVY

SEQ ID NO: 2733840 - protein, 27 aa, Entamoeba histolytica
TKRASFMNYLWRGYSVDGLPQNVSQDL

SEQ ID NO: 2733841 - protein, 19 aa, Entamoeba histolytica
TKTMLLFNQYLEKKPGCKG

SEQ ID NO: 2733842 - protein, 22 aa, Entamoeba histolytica
TKWVGIPWTGIGKVAVWPLEKS

SEQ ID NO: 2733843 - protein, 20 aa, Entamoeba histolytica
TKYFYEPYLDILKKWTKKEI

SEQ ID NO: 2733844 - protein, 18 aa, Entamoeba histolytica
TLAILYIGTIRPFCSIRN

SEQ ID NO: 2733845 - protein, 27 aa, Entamoeba histolytica
TLAKPARLPFLSLALNLPPELADIQQF

SEQ ID NO: 2733846 - protein, 19 aa, Entamoeba histolytica
TLAQIKLWREKLPIDCITL

SEQ ID NO: 2733847 - protein, 24 aa, Entamoeba histolytica
TLDTPFIVFPLLDILEVYENMKAD

SEQ ID NO: 2733848 - protein, 17 aa, Entamoeba histolytica
TLFFALLPESLYDVDAI

SEQ ID NO: 2733849 - protein, 18 aa, Entamoeba histolytica
TLGKYLILIATLDQKMIQ

SEQ ID NO: 2733850 - protein, 26 aa, Entamoeba histolytica
TLISIDEIFLTIQSLIEEAVIERTNE

SEQ ID NO: 2733851 - protein, 23 aa, Entamoeba histolytica
TLMFLRYLFVPFLKHPYILKSLQ

SEQ ID NO: 2733852 - protein, 19 aa, Entamoeba histolytica
TLMPSLLIIFRITQDRVGA

SEQ ID NO: 2733853 - protein, 30 aa, Entamoeba histolytica; identical to SEQ ID NO: 2547328

SEQ ID NO: 2733854 - protein, 17 aa, Entamoeba histolytica
TLNNKLLIFYYNNDHKL

SEQ ID NO: 2733855 - protein, 18 aa, Entamoeba histolytica
TLPFLKINKIIFTSEDVI

SEQ ID NO: 2733856 - protein, 22 aa, Entamoeba histolytica
TLPTTLPLIFRNIDSRFFQQFL

SEQ ID NO: 2733857 - protein, 19 aa, Entamoeba histolytica
TLQLFLIETLTLPSGKIIE

SEQ ID NO: 2733858 - protein, 17 aa, Entamoeba histolytica
TLQYFAYRPLFEQGKLI

SEQ ID NO: 2733859 - protein, 19 aa, Entamoeba histolytica
TLTFFIPLSNKGTYFLKYF

SEQ ID NO: 2733860 - protein, 21 aa, Entamoeba histolytica
TLTYRKIITIPYISGFLGFRE

SEQ ID NO: 2733861 - protein, 18 aa, Entamoeba histolytica
TLYAAWNPDFLLSVLLGN

SEQ ID NO: 2733862 - protein, 22 aa, Entamoeba histolytica
TLYKSIFLFYRDIVRVNLVFLQ

SEQ ID NO: 2733863 - protein, 22 aa, Entamoeba histolytica
TMDYFNLLLKKKPGCSGKIVLD

SEQ ID NO: 2733864 - protein, 18 aa, Entamoeba histolytica
TMFKFILEFLKLSLQNED

SEQ ID NO: 2733865 - protein, 23 aa, Entamoeba histolytica
TMIKMICKIFPRSNFWEHVCIVW

SEQ ID NO: 2733866 - protein, 22 aa, Entamoeba histolytica
TMKDFVLSKALRFPMGLQFEEL

SEQ ID NO: 2733867 - protein, 24 aa, Entamoeba histolytica
TMKYYYYHLLLWPSITYLAECVDG

SEQ ID NO: 2733868 - protein, 27 aa, Entamoeba histolytica
TMLMPFIRRVIFFLAPTTELRTITVSH

SEQ ID NO: 2733869 - protein, 23 aa, Entamoeba histolytica
TMPIKIMFIKFLANSFITTPPEM

SEQ ID NO: 2733870 - protein, 18 aa, Entamoeba histolytica
TMSNWCNFVTPRVLYFTN

SEQ ID NO: 2733871 - protein, 24 aa, Entamoeba histolytica
TMTNNLMILLLKQNNIFLKERSTR

SEQ ID NO: 2733872 - protein, 21 aa, Entamoeba histolytica
TNDYWLLPSFITLPEITFIHS

SEQ ID NO: 2733873 - protein, 26 aa, Entamoeba histolytica
TNFDLILNHPLILSPLYKLTVVQAET

SEQ ID NO: 2733874 - protein, 24 aa, Entamoeba histolytica
TNGYKWLLLAYIPDRAKVRMKMLY

SEQ ID NO: 2733875 - protein, 23 aa, Entamoeba histolytica
TNHLLLFYTFIGDNFIYSSPLND

SEQ ID NO: 2733876 - protein, 24 aa, Entamoeba histolytica
TNKPIGCILIFLPGIYEITTLQKE

SEQ ID NO: 2733877 - protein, 23 aa, Entamoeba histolytica
TNKYLLHSYYKLLWFVQKFNDER

SEQ ID NO: 2733878 - protein, 24 aa, Entamoeba histolytica
TNKYTLWYLCDFLVDVLNHQSVNQ

SEQ ID NO: 2733879 - protein, 18 aa, Entamoeba histolytica
TNPLVFAFPSDEGFPFCL

SEQ ID NO: 2733880 - protein, 27 aa, Entamoeba histolytica
TNWAIDKWLFTNLYDFIFEPMMYYIND

SEQ ID NO: 2733881 - protein, 19 aa, Entamoeba histolytica
TPIDFIILPPLKLKNQQSQ

SEQ ID NO: 2733882 - protein, 17 aa, Entamoeba histolytica
TPKPRYFILFNDQLIYG

SEQ ID NO: 2733883 - protein, 23 aa, Entamoeba histolytica
TPLKEECVWFYQSNFRLLEKYGN

SEQ ID NO: 2733884 - protein, 22 aa, Entamoeba histolytica
TPQKTFKPAKQQGKIAILTKQL

SEQ ID NO: 2733885 - protein, 24 aa, Entamoeba histolytica
TPQNTFNLLFFIRTVFPVFHAPQH

SEQ ID NO: 2733886 - protein, 22 aa, Entamoeba histolytica
TPSKQLNFLPPSKYPQSPSQQR

SEQ ID NO: 2733887 - protein, 19 aa, Entamoeba histolytica
TQGLIWKKLKTLKCIKCKV

SEQ ID NO: 2733888 - protein, 18 aa, Entamoeba histolytica
TQKFFLFTYNNNTQQIIH

SEQ ID NO: 2733889 - protein, 22 aa, Entamoeba histolytica
TQKQIMIQVITYMSYFVINTLI

SEQ ID NO: 2733890 - protein, 26 aa, Entamoeba histolytica
TQPLKPTKFIPPPKTLSPSEGETKTQ

SEQ ID NO: 2733891 - protein, 33 aa, Entamoeba histolytica
TQQMFDMSLFPQSFIQFLAWQRLMQIYSKLDAN

SEQ ID NO: 2733892 - protein, 17 aa, Entamoeba histolytica
TRKSIIQFLKLMKPNSF

SEQ ID NO: 2733893 - protein, 28 aa, Entamoeba histolytica
TRQEEYYYLFQIVSYLYFAPFRQEGLSI

SEQ ID NO: 2733894 - protein, 21 aa, Entamoeba histolytica
TRQFWFCSFADDLQDFKLIGI

SEQ ID NO: 2733895 - protein, 18 aa, Entamoeba histolytica
TRQYFFLDYLLDKQFNSL

SEQ ID NO: 2733896 - protein, 17 aa, Entamoeba histolytica
TRRLIELLLIRGYSFNR

SEQ ID NO: 2733897 - protein, 23 aa, Entamoeba histolytica
TRRPLYLQMFNNPKQRTPKCCFA

SEQ ID NO: 2733898 - protein, 20 aa, Entamoeba histolytica
TRRRVFVIPYLLYQTMNRAS

SEQ ID NO: 2733899 - protein, 24 aa, Entamoeba histolytica
TRVARYWPMFPRTFGLFKKLFEEE

SEQ ID NO: 2733900 - protein, 24 aa, Entamoeba histolytica
TSFRWQYIKYLFKMSYNALHYTHL

SEQ ID NO: 2733901 - protein, 33 aa, Entamoeba histolytica
TSHKALFVILYGHALYLLLHLNVFPFKLLQGIA

SEQ ID NO: 2733902 - protein, 21 aa, Entamoeba histolytica
TSLFRIYFLTNDKGNPFIRTL

SEQ ID NO: 2733903 - protein, 24 aa, Entamoeba histolytica
TSNDHFCIFDLPAGSYEIFAYNDE

SEQ ID NO: 2733904 - protein, 25 aa, Entamoeba histolytica
TSNLYQLIPFIPVDYFSSSLRSLID

SEQ ID NO: 2733905 - protein, 23 aa, Entamoeba histolytica
TSQNFFYFPFINVLVQPVTVALE

SEQ ID NO: 2733906 - protein, 22 aa, Entamoeba histolytica
TSYNYMYIIPSFRKIVIQLVSQ

SEQ ID NO: 2733907 - protein, 27 aa, Entamoeba histolytica
TTASLVLGFIWMLFDKFQEKDIKLSMK

SEQ ID NO: 2733908 - protein, 18 aa, Entamoeba histolytica
TTDKLLRRFIFNLNVKMC

SEQ ID NO: 2733909 - protein, 26 aa, Entamoeba histolytica
TTFKTIFFLRFLFPALNHAEKYIPSE

SEQ ID NO: 2733910 - protein, 17 aa, Entamoeba histolytica
TTNILFHHLMIEDIFEN

SEQ ID NO: 2733911 - protein, 23 aa, Entamoeba histolytica
TTNKIVFHVLFTLKQGLTGFIDE

SEQ ID NO: 2733912 - protein, 23 aa, Entamoeba histolytica
TTRCLLFYLMYFLGHSQMFDGNE

SEQ ID NO: 2733913 - protein, 26 aa, Entamoeba histolytica
TVDKDLWMKYPLMKFLALYVINISEV

SEQ ID NO: 2733914 - protein, 18 aa, Entamoeba histolytica
TVILCELLMILSGAQYVG

SEQ ID NO: 2733915 - protein, 20 aa, Entamoeba histolytica
TVKRLFLMYLSCIKRVDEQG

SEQ ID NO: 2733916 - protein, 18 aa, Entamoeba histolytica
TVNMIPYPRLHFFSSSIA

SEQ ID NO: 2733917 - protein, 22 aa, Entamoeba histolytica
TVQEYWECTLKALKFGENQGPQ

SEQ ID NO: 2733918 - protein, 23 aa, Entamoeba histolytica
TVRICLWVLYQLLCKIKTIIEME

SEQ ID NO: 2733919 - protein, 25 aa, Entamoeba histolytica
TVVYSDGFLFFYKIKRKPSLILNIG

SEQ ID NO: 2733920 - protein, 21 aa, Entamoeba histolytica
TVYVLLKYFYWKYTEPSVMSL

SEQ ID NO: 2733921 - protein, 19 aa, Entamoeba histolytica
TWENYFYKFLPPFPRHLIQ

SEQ ID NO: 2733922 - protein, 22 aa, Entamoeba histolytica
TWLNIIPLKMRCNEVFGVPLSV

SEQ ID NO: 2733923 - protein, 17 aa, Entamoeba histolytica
TWPVPMFENLLPRHLQI

SEQ ID NO: 2733924 - protein, 17 aa, Entamoeba histolytica
TWRLMDNGWYFIGKYPG

SEQ ID NO: 2733925 - protein, 19 aa, Entamoeba histolytica
TYLDFLQRTLCWDPDLRLT

SEQ ID NO: 2733926 - protein, 26 aa, Entamoeba histolytica
TYQRMVFLWMIWLIMNQHPQVFGFNY

SEQ ID NO: 2733927 - protein, 19 aa, Entamoeba histolytica
TYVLLCGYPPFFGDTLGEI

SEQ ID NO: 2733928 - protein, 18 aa, Entamoeba histolytica
VAFLIFYHFAVINDIFIL

SEQ ID NO: 2733929 - protein, 21 aa, Entamoeba histolytica
VAKMVLYDFQRGRLPYFVTPP

SEQ ID NO: 2733930 - protein, 22 aa, Entamoeba histolytica
VAPPIPHRSLPPKPLRSSVITS

SEQ ID NO: 2733931 - protein, 26 aa, Entamoeba histolytica
VAVEYCWFFFDVIIKSLTLYLEELGI

SEQ ID NO: 2733932 - protein, 17 aa, Entamoeba histolytica
VCFAHWFQPLTSKSAKK

SEQ ID NO: 2733933 - protein, 17 aa, Entamoeba histolytica
VCKRVLQGLVYLHKMGI

SEQ ID NO: 2733934 - protein, 19 aa, Entamoeba histolytica
VCKSLFMKYLRQQPNWNIK

SEQ ID NO: 2733935 - protein, 17 aa, Entamoeba histolytica
VCLLFPWVIRPQQNIMF

SEQ ID NO: 2733936 - protein, 17 aa, Entamoeba histolytica
VCVAIAGWILSAKIPET

SEQ ID NO: 2733937 - protein, 25 aa, Entamoeba histolytica
VDELEKRYRLLTKDILLNYKPTQKK

SEQ ID NO: 2733938 - protein, 25 aa, Entamoeba histolytica
VDGKAFLALLCSLDKDQKTFDKYAT

SEQ ID NO: 2733939 - protein, 18 aa, Entamoeba histolytica
VDIPYACKLLFQELMSMA

SEQ ID NO: 2733940 - protein, 17 aa, Entamoeba histolytica
VDVIVNWHRKKPNKEFQ

SEQ ID NO: 2733941 - protein, 17 aa, Entamoeba histolytica
VDYFIYDKITPNPLYTS

SEQ ID NO: 2733942 - protein, 23 aa, Entamoeba histolytica
VEIRVCHLISILFLGRIRSKNLF

SEQ ID NO: 2733943 - protein, 17 aa, Entamoeba histolytica
VEKKIHFGILLVDAIFP

SEQ ID NO: 2733944 - protein, 18 aa, Entamoeba histolytica
VELFLDTLKGYRIKFPHL

SEQ ID NO: 2733945 - protein, 22 aa, Entamoeba histolytica
VELVPIIYYPISKKPTSLVFIR

SEQ ID NO: 2733946 - protein, 17 aa, Entamoeba histolytica
VEMCIPISVLKGFVVTN

SEQ ID NO: 2733947 - protein, 19 aa, Entamoeba histolytica
VEQLKSFIPLLIATKGRFE

SEQ ID NO: 2733948 - protein, 24 aa, Entamoeba histolytica
VESDSILLLDTFFYIVVFRGEAVA

SEQ ID NO: 2733949 - protein, 20 aa, Entamoeba histolytica
VEVPNVIEFSLKRAGSKFVI

SEQ ID NO: 2733950 - protein, 25 aa, Entamoeba histolytica
VFGQWGFLIYYILLKGGSVTIKPFV

SEQ ID NO: 2733951 - protein, 17 aa, Entamoeba histolytica
VFIPYRDSRLTFMLKDS

SEQ ID NO: 2733952 - protein, 22 aa, Entamoeba histolytica
VFPFILQILINCQINFSSKSDK

SEQ ID NO: 2733953 - protein, 22 aa, Entamoeba histolytica
VFSKVWPCNLLPPSLPTPNIEY

SEQ ID NO: 2733954 - protein, 19 aa, Entamoeba histolytica
VFTTSLFNFLWPPIIERNE

SEQ ID NO: 2733955 - protein, 23 aa, Entamoeba histolytica
VFVELQIKFYLLARLLGVESSDG

SEQ ID NO: 2733956 - protein, 24 aa, Entamoeba histolytica
VGEYHLKFLIQPFLHWPDTMMTVI

SEQ ID NO: 2733957 - protein, 19 aa, Entamoeba histolytica
VHLEWDFETPFYYIFVMTY

SEQ ID NO: 2733958 - protein, 19 aa, Entamoeba histolytica
VHMLQPFLLDNLRYNIKSP

SEQ ID NO: 2733959 - protein, 22 aa, Entamoeba histolytica
VHSFIYYYPYQFGFNSTLIHFL

SEQ ID NO: 2733960 - protein, 18 aa, Entamoeba histolytica
VIAYLPYLIKVITNINAL

SEQ ID NO: 2733961 - protein, 19 aa, Entamoeba histolytica
VIDGLLFVFGRRAKQIRQQ

SEQ ID NO: 2733962 - protein, 24 aa, Entamoeba histolytica
VIDMNLLLRYIFGLIGYVPTVSFG

SEQ ID NO: 2733963 - protein, 22 aa, Entamoeba histolytica
VIFAFPIYWYAMPGQLKVFIDR

SEQ ID NO: 2733964 - protein, 18 aa, Entamoeba histolytica
VIITWYSMYQNILKQKLR

SEQ ID NO: 2733965 - protein, 17 aa, Entamoeba histolytica
VILPIKFPQLFTDKRKP

SEQ ID NO: 2733966 - protein, 18 aa, Entamoeba histolytica
VIMAQIGMFIPCSEAHIS

SEQ ID NO: 2733967 - protein, 17 aa, Entamoeba histolytica
VIMAQIGMFVPCSEAHI

SEQ ID NO: 2733968 - protein, 18 aa, Entamoeba histolytica
VINNPLDWSYSYCLPLFI

SEQ ID NO: 2733969 - protein, 19 aa, Entamoeba histolytica
VINSYFAFLPFIQMGRIIQ

SEQ ID NO: 2733970 - protein, 24 aa, Entamoeba histolytica
VIPDPLCLMCYLFPEIITHTDVVE

SEQ ID NO: 2733971 - protein, 23 aa, Entamoeba histolytica
VIPFTRFLRVFLPYTLVNSEEGN

SEQ ID NO: 2733972 - protein, 25 aa, Entamoeba histolytica
VIPPLPLLKPLPFPPSITVFPGETK

SEQ ID NO: 2733973 - protein, 20 aa, Entamoeba histolytica
VIQLMHFFPVIMSNLFGMFN

SEQ ID NO: 2733974 - protein, 35 aa, Entamoeba histolytica; identical to SEQ ID NO: 2547469

SEQ ID NO: 2733975 - protein, 23 aa, Entamoeba histolytica
VIQTFFVIHLLKERFSENKVEWK

SEQ ID NO: 2733976 - protein, 17 aa, Entamoeba histolytica
VIRLLPEQVSALILLKI

SEQ ID NO: 2733977 - protein, 18 aa, Entamoeba histolytica
VIRRQHEVLLKLKKEREI

SEQ ID NO: 2733978 - protein, 19 aa, Entamoeba histolytica
VIVKKMILPSLLRIPIPQI

SEQ ID NO: 2733979 - protein, 20 aa, Entamoeba histolytica
VKCIYQCVLLKRIIKEIPDF

SEQ ID NO: 2733980 - protein, 23 aa, Entamoeba histolytica
VKFKTIVPFLKAYKQFVSYNEKA

SEQ ID NO: 2733981 - protein, 20 aa, Entamoeba histolytica
VKGIITWFSLHNCQTRFEGT

SEQ ID NO: 2733982 - protein, 23 aa, Entamoeba histolytica
VKLILGLLYTLYRKYRLSVLVDK

SEQ ID NO: 2733983 - protein, 18 aa, Entamoeba histolytica
VKLLINKFSQNQNISEGD

SEQ ID NO: 2733984 - protein, 17 aa, Entamoeba histolytica
VKMFPFKFDLIYKWLRR

SEQ ID NO: 2733985 - protein, 18 aa, Entamoeba histolytica
VKMHFFPEMTEEAELVIQ

SEQ ID NO: 2733986 - protein, 24 aa, Entamoeba histolytica
VKNKKIPLCQWPLYVSTTFDNEVN

SEQ ID NO: 2733987 - protein, 18 aa, Entamoeba histolytica
VKPSTIFDLWRQCHQPYS

SEQ ID NO: 2733988 - protein, 17 aa, Entamoeba histolytica
VKSLPIFKWIISGGTMP

SEQ ID NO: 2733989 - protein, 26 aa, Entamoeba histolytica
VKTIKRRWFVLTTNKLFYFTSQNATE

SEQ ID NO: 2733990 - protein, 25 aa, Entamoeba histolytica
VKTWKKRWFVLKDNRLWYFASKTAE

SEQ ID NO: 2733991 - protein, 22 aa, Entamoeba histolytica
VKVLTLPFFQIKKLQFNNSEDG

SEQ ID NO: 2733992 - protein, 21 aa, Entamoeba histolytica
VLEYIKTIKWLLQVPQEIKEY

SEQ ID NO: 2733993 - protein, 19 aa, Entamoeba histolytica
VLFILFHRALCSRLSLFIS

SEQ ID NO: 2733994 - protein, 20 aa, Entamoeba histolytica
VLFMYFDLFMKYLQFVQPIL

SEQ ID NO: 2733995 - protein, 19 aa, Entamoeba histolytica
VLGFPLLVAIRKSGWRVPN

SEQ ID NO: 2733996 - protein, 20 aa, Entamoeba histolytica
VLHAWFHMKILRLFTDSVLH

SEQ ID NO: 2733997 - protein, 24 aa, Entamoeba histolytica
VLHFNALLYLLLKKGWTIQLTKTK

SEQ ID NO: 2733998 - protein, 21 aa, Entamoeba histolytica
VLIMFVNYYIYFFPLLDQITA

SEQ ID NO: 2733999 - protein, 22 aa, Entamoeba histolytica
VLIQTFNIMRIILLDASETLCD

SEQ ID NO: 2734000 - protein, 25 aa, Entamoeba histolytica
VLLEKIWEIIGLFKVYPKTKAGVID

SEQ ID NO: 2734001 - protein, 17 aa, Entamoeba histolytica
VLPFPFSVPISSPTPSP

SEQ ID NO: 2734002 - protein, 20 aa, Entamoeba histolytica
VLSYYLPIHCGIKKIYIEVE

SEQ ID NO: 2734003 - protein, 18 aa, Entamoeba histolytica
VLTLFSFMIIYPNSVFLA

SEQ ID NO: 2734004 - protein, 22 aa, Entamoeba histolytica
VLYSIIQLYLRSGFYGRVLDYH

SEQ ID NO: 2734005 - protein, 20 aa, Entamoeba histolytica
VMEPVMFYDLLTSLEIMKNA

SEQ ID NO: 2734006 - protein, 24 aa, Entamoeba histolytica
VMKEIWIGLYFWYWHSDGRDYQEK

SEQ ID NO: 2734007 - protein, 26 aa, Entamoeba histolytica
VMKYSWILFTILFKGIVMMTNSGKKL

SEQ ID NO: 2734008 - protein, 23 aa, Entamoeba histolytica
VMQALVLKHRWFPKLVKSKEPIV

SEQ ID NO: 2734009 - protein, 25 aa, Entamoeba histolytica
VMTPENFFFFRMPKFTPFDGKLLDP

SEQ ID NO: 2734010 - protein, 17 aa, Entamoeba histolytica
VMVSRWFGGILLGPDRF

SEQ ID NO: 2734011 - protein, 23 aa, Entamoeba histolytica
VNDKKYVFPSLYLHIFNSEVEMK

SEQ ID NO: 2734012 - protein, 24 aa, Entamoeba histolytica
VNPSYFIYMYYLYANIVSLNIYRM

SEQ ID NO: 2734013 - protein, 18 aa, Entamoeba histolytica
VPFLLKFVEIQLVGAKGE

SEQ ID NO: 2734014 - protein, 19 aa, Entamoeba histolytica
VPFSIIIPIVPHPSLHLKG

SEQ ID NO: 2734015 - protein, 18 aa, Entamoeba histolytica
VPLILFPKLDQSIVDECI

SEQ ID NO: 2734016 - protein, 20 aa, Entamoeba histolytica
VPLTNWFVYCKSSLVPKVKQ

SEQ ID NO: 2734017 - protein, 18 aa, Entamoeba histolytica
VPMFENLLPRHLQICYEI

SEQ ID NO: 2734018 - protein, 25 aa, Entamoeba histolytica
VPSQRPMILFEYYETFIVKSSVYKA

SEQ ID NO: 2734019 - protein, 18 aa, Entamoeba histolytica
VPVYINHLWRKCYGDESC

SEQ ID NO: 2734020 - protein, 21 aa, Entamoeba histolytica
VQRLPRYELLLKDLLKNTKSD

SEQ ID NO: 2734021 - protein, 19 aa, Entamoeba histolytica
VQRLPRYQLLLKDLLKHTQ

SEQ ID NO: 2734022 - protein, 26 aa, Entamoeba histolytica
VREKNPDLFIPWIPNNMQLAVCDVPP

SEQ ID NO: 2734023 - protein, 20 aa, Entamoeba histolytica
VRELYCGLIQLFCNLFEKEK

SEQ ID NO: 2734024 - protein, 22 aa, Entamoeba histolytica
VRIGWLYCQRGFETGYIPQNFT

SEQ ID NO: 2734025 - protein, 23 aa, Entamoeba histolytica
VRKGKVIVVYPRKLKYLILLQHS

SEQ ID NO: 2734026 - protein, 23 aa, Entamoeba histolytica
VRLKGLMLLFMSIGGVIEVNDVM

SEQ ID NO: 2734027 - protein, 25 aa, Entamoeba histolytica
VRLTNLLPFDKILGGLAWGISATCY

SEQ ID NO: 2734028 - protein, 27 aa, Entamoeba histolytica
VRRVFHILFPYFLKQSFRRIIILLWKS

SEQ ID NO: 2734029 - protein, 18 aa, Entamoeba histolytica
VSCRRLFHPFISPRGICI

SEQ ID NO: 2734030 - protein, 26 aa, Entamoeba histolytica
VSELYLRWAPLFWNFLRNPNIPFDKK

SEQ ID NO: 2734031 - protein, 19 aa, Entamoeba histolytica
VSFVMPKFHDITISQIVEG

SEQ ID NO: 2734032 - protein, 19 aa, Entamoeba histolytica
VSFYFFRIFFSNSILHLSF

SEQ ID NO: 2734033 - protein, 25 aa, Entamoeba histolytica
VSKPTQWNYFFLFSDRLIGTVIKKY

SEQ ID NO: 2734034 - protein, 26 aa, Entamoeba histolytica
VSLNEYLFFKLCDFITILKSLRKSIL

SEQ ID NO: 2734035 - protein, 24 aa, Entamoeba histolytica
VSMPWLVIVLIKLIPLICIEKREI

SEQ ID NO: 2734036 - protein, 22 aa, Entamoeba histolytica
VSPITFILPFYTKVLILFKLNN

SEQ ID NO: 2734037 - protein, 19 aa, Entamoeba histolytica
VSRLLWQFLMKIKDDMEKV

SEQ ID NO: 2734038 - protein, 22 aa, Entamoeba histolytica
VSTLFYYMRLCVLSYGKWVYIQ

SEQ ID NO: 2734039 - protein, 24 aa, Entamoeba histolytica
VTNQISMFFAFAAPMILCLCEALN

SEQ ID NO: 2734040 - protein, 31 aa, Entamoeba histolytica; identical to SEQ ID NO: 2547530

SEQ ID NO: 2734041 - protein, 31 aa, Entamoeba histolytica
VTSFKKISMINFLIFIYGYDWAEVVNAPQGG

SEQ ID NO: 2734042 - protein, 17 aa, Entamoeba histolytica
VTSIPTILVLNPGSWKA

SEQ ID NO: 2734043 - protein, 25 aa, Entamoeba histolytica
VTVHFLRLPYFFNYLQIAAGEEEVW

SEQ ID NO: 2734044 - protein, 17 aa, Entamoeba histolytica
VVKLYYAFQDKCSLFLV

SEQ ID NO: 2734045 - protein, 20 aa, Entamoeba histolytica
VVKMNFAFLAALMKWKKEQD

SEQ ID NO: 2734046 - protein, 17 aa, Entamoeba histolytica
VVKWLWEILHSYSIELK

SEQ ID NO: 2734047 - protein, 19 aa, Entamoeba histolytica
VVLLFYPLDWTFVCPTEMI

SEQ ID NO: 2734048 - protein, 19 aa, Entamoeba histolytica
VVNRPMFTSPLKSVVIPFT

SEQ ID NO: 2734049 - protein, 24 aa, Entamoeba histolytica
VVVINSFFLIKKSRELWIPSEPFK

SEQ ID NO: 2734050 - protein, 19 aa, Entamoeba histolytica
VWDFRQFDFPYATFNWHKK

SEQ ID NO: 2734051 - protein, 18 aa, Entamoeba histolytica
VWSFGVLIFKLLTGFCPF

SEQ ID NO: 2734052 - protein, 18 aa, Entamoeba histolytica
VYAYLIKNGLKKTAKSFL

SEQ ID NO: 2734053 - protein, 23 aa, Entamoeba histolytica
VYDFFVTDGLFYKILKKTKSSGG

SEQ ID NO: 2734054 - protein, 18 aa, Entamoeba histolytica
VYDKLSIIGFYIQQKQKS

SEQ ID NO: 2734055 - protein, 17 aa, Entamoeba histolytica
VYFKYFFDLSDLTLEQL

SEQ ID NO: 2734056 - protein, 17 aa, Entamoeba histolytica
VYIIWFSHIQFNEIISI

SEQ ID NO: 2734057 - protein, 20 aa, Entamoeba histolytica
VYLNYILRCPYFVDHFPVFS

SEQ ID NO: 2734058 - protein, 21 aa, Entamoeba histolytica
VYRLFFYYYCFINDIFFNIRN

SEQ ID NO: 2734059 - protein, 21 aa, Entamoeba histolytica
WAEFEYCVLFPFNVLKMTNTK

SEQ ID NO: 2734060 - protein, 20 aa, Entamoeba histolytica
WAFGVMLYYLKFGITPFNSS

SEQ ID NO: 2734061 - protein, 18 aa, Entamoeba histolytica
WALGCLLFETAIGTPPFS

SEQ ID NO: 2734062 - protein, 19 aa, Entamoeba histolytica
WCKAYLIGLLILCETRNSL

SEQ ID NO: 2734063 - protein, 17 aa, Entamoeba histolytica
WEEAWEIIQKGFTLRHT

SEQ ID NO: 2734064 - protein, 23 aa, Entamoeba histolytica
WEEKKRCTPLPRKFIKFVEGPEV

SEQ ID NO: 2734065 - protein, 17 aa, Entamoeba histolytica
WELFYERLPFEEFLKDP

SEQ ID NO: 2734066 - protein, 19 aa, Entamoeba histolytica
WEYAKSAILVLFKPLDYAM

SEQ ID NO: 2734067 - protein, 19 aa, Entamoeba histolytica
WFPPQWKVNFAKRLPIGNV

SEQ ID NO: 2734068 - protein, 17 aa, Entamoeba histolytica
WIEPIMSNFLYESPMIL

SEQ ID NO: 2734069 - protein, 18 aa, Entamoeba histolytica
WIFTFDTYDFRLFVGNSE

SEQ ID NO: 2734070 - protein, 17 aa, Entamoeba histolytica
WIHTLETTDIKRPPALV

SEQ ID NO: 2734071 - protein, 20 aa, Entamoeba histolytica
WIKAMLMFVLLIKSLEEKEK

SEQ ID NO: 2734072 - protein, 20 aa, Entamoeba histolytica
WIYDCLTCQLKIDRTGYCLN

SEQ ID NO: 2734073 - protein, 17 aa, Entamoeba histolytica
WIYIRAAAIARKVYLNN

SEQ ID NO: 2734074 - protein, 18 aa, Entamoeba histolytica
WIYIRAAAIARKVYLNNG

SEQ ID NO: 2734075 - protein, 22 aa, Entamoeba histolytica
WKDIIIPFKLKVFFYSKQTQEA

SEQ ID NO: 2734076 - protein, 17 aa, Entamoeba histolytica
WKNKIFHLIFNLEKERY

SEQ ID NO: 2734077 - protein, 24 aa, Entamoeba histolytica
WKSWKRRFFVLKDRKLWYFESENS

SEQ ID NO: 2734078 - protein, 23 aa, Entamoeba histolytica
WKVRHKLMRFISAAKIIKLNKSS

SEQ ID NO: 2734079 - protein, 17 aa, Entamoeba histolytica
WLHTPVCTLILNNLLRP

SEQ ID NO: 2734080 - protein, 17 aa, Entamoeba histolytica
WLKVFELLLEKMPIIRL

SEQ ID NO: 2734081 - protein, 18 aa, Entamoeba histolytica
WLLMLFKREFWSKEVLRL

SEQ ID NO: 2734082 - protein, 18 aa, Entamoeba histolytica
WLPFILAVLDAEKKTFVI

SEQ ID NO: 2734083 - protein, 18 aa, Entamoeba histolytica
WLRHNLLATLGLSIGFSS

SEQ ID NO: 2734084 - protein, 22 aa, Entamoeba histolytica
WLTMTYYYICILRSPLLYGLQP

SEQ ID NO: 2734085 - protein, 17 aa, Entamoeba histolytica
WMTLFAKIATHILIVKD

SEQ ID NO: 2734086 - protein, 19 aa, Entamoeba histolytica
WNYVELFASLDLENGKEGS

SEQ ID NO: 2734087 - protein, 24 aa, Entamoeba histolytica
WREIYKSLLVLDNILKNGSEEAVN

SEQ ID NO: 2734088 - protein, 19 aa, Entamoeba histolytica
WRNFCEVFRYLPVSALIEG

SEQ ID NO: 2734089 - protein, 29 aa, Entamoeba histolytica
WVFQQLFFVKFLFPLLENPLFILDGVKQD

SEQ ID NO: 2734090 - protein, 18 aa, Entamoeba histolytica
WVVLARYLLPYTTDYNYA

SEQ ID NO: 2734091 - protein, 19 aa, Entamoeba histolytica
WWKRNSLTVFLNKKIYKDP

SEQ ID NO: 2734092 - protein, 18 aa, Entamoeba histolytica
WYLILCELSKILQQHKIH

SEQ ID NO: 2734093 - protein, 19 aa, Entamoeba histolytica
WYNFYYLFEGIFNHSLNES

SEQ ID NO: 2734094 - protein, 18 aa, Entamoeba histolytica
YADILWIFQWHFVELQST

SEQ ID NO: 2734095 - protein, 17 aa, Entamoeba histolytica
YAFRWFNCFLLREFSPE

SEQ ID NO: 2734096 - protein, 17 aa, Entamoeba histolytica
YAILYFQVLVRLLQVFD

SEQ ID NO: 2734097 - protein, 24 aa, Entamoeba histolytica
YALGLIMWQTFTQKQLFPEYDDFD

SEQ ID NO: 2734098 - protein, 17 aa, Entamoeba histolytica
YARLRPLSYPATDVFIV

SEQ ID NO: 2734099 - protein, 18 aa, Entamoeba histolytica
YARLRPLSYPGTDVFIVL

SEQ ID NO: 2734100 - protein, 18 aa, Entamoeba histolytica
YAYLLFLLTKIEPLKQLS

SEQ ID NO: 2734101 - protein, 23 aa, Entamoeba histolytica
YCHTPTYLPLYDADGLIIKQEGA

SEQ ID NO: 2734102 - protein, 23 aa, Entamoeba histolytica
YCLKDTYLPIKLLEKLMSLVNGF

SEQ ID NO: 2734103 - protein, 22 aa, Entamoeba histolytica
YCLKNPFFYYEIDNEYLYVKTR

SEQ ID NO: 2734104 - protein, 25 aa, Entamoeba histolytica
YCNQKSIWLKLFKECEKDLESYHKA

SEQ ID NO: 2734105 - protein, 24 aa, Entamoeba histolytica
YCYALGYTAFILLALKKTGQICCI

SEQ ID NO: 2734106 - protein, 18 aa, Entamoeba histolytica
YDFYLLRLLIRHSSATVT

SEQ ID NO: 2734107 - protein, 25 aa, Entamoeba histolytica
YDMLDPIILLYMKLVVNLTGEKAVS

SEQ ID NO: 2734108 - protein, 18 aa, Entamoeba histolytica
YDNYNIIGPFLVIVPLST

SEQ ID NO: 2734109 - protein, 24 aa, Entamoeba histolytica
YDRIRPLSYPQTDVFLLCFSVVSP

SEQ ID NO: 2734110 - protein, 23 aa, Entamoeba histolytica
YDRLRPLSYPSTDVFLVCFSVIA

SEQ ID NO: 2734111 - protein, 18 aa, Entamoeba histolytica
YEGLHTLAILYIGTIRPF

SEQ ID NO: 2734112 - protein, 18 aa, Entamoeba histolytica
YELFNFYGVKRIIRIGSA

SEQ ID NO: 2734113 - protein, 27 aa, Entamoeba histolytica
YELPFQIHKIFYFLYTVGYSSTGIFRL

SEQ ID NO: 2734114 - protein, 23 aa, Entamoeba histolytica
YEQLRPLSYPNTDLFLLCFSVIS

SEQ ID NO: 2734115 - protein, 24 aa, Entamoeba histolytica
YEQLRPLSYPNTDLFLLCFSVISR

SEQ ID NO: 2734116 - protein, 23 aa, Entamoeba histolytica
YESIRPLSYPSTDVFLLCYSVVQ

SEQ ID NO: 2734117 - protein, 19 aa, Entamoeba histolytica
YESQGLVPLLRLAWNHFDP

SEQ ID NO: 2734118 - protein, 20 aa, Entamoeba histolytica
YESQGLVPLLRLAWNHFDPN

SEQ ID NO: 2734119 - protein, 18 aa, Entamoeba histolytica
YEYLRYIIVPYLQKVTLC

SEQ ID NO: 2734120 - protein, 18 aa, Entamoeba histolytica
YFEHLLKNSYAQFLEILK

SEQ ID NO: 2734121 - protein, 22 aa, Entamoeba histolytica
YFNIPRQYFYLIKNGKLKYEGH

SEQ ID NO: 2734122 - protein, 23 aa, Entamoeba histolytica
YFNLTDWYIGYLIQLYKNGDKSI

SEQ ID NO: 2734123 - protein, 17 aa, Entamoeba histolytica
YFPIIQSIKPQQFSQII

SEQ ID NO: 2734124 - protein, 17 aa, Entamoeba histolytica
YFPPFLDGKIHIAAGSA

SEQ ID NO: 2734125 - protein, 19 aa, Entamoeba histolytica
YFRNAMAAIIMFDVSNKES

SEQ ID NO: 2734126 - protein, 20 aa, Entamoeba histolytica
YFSFQQLDYIKLLLVNAYKK

SEQ ID NO: 2734127 - protein, 17 aa, Entamoeba histolytica
YFYYMYYTYANIASLNY

SEQ ID NO: 2734128 - protein, 21 aa, Entamoeba histolytica
YGEYCHLCLLPYLRAVTKEVI

SEQ ID NO: 2734129 - protein, 27 aa, Entamoeba histolytica
YGNKLILGLLYTLYRIYRMNPVDLVGS

SEQ ID NO: 2734130 - protein, 22 aa, Entamoeba histolytica
YGQLRAFPWNSLALMTTTGAKG

SEQ ID NO: 2734131 - protein, 18 aa, Entamoeba histolytica
YGTLIYEMLLGLPPFFDN

SEQ ID NO: 2734132 - protein, 23 aa, Entamoeba histolytica
YHDLTQYPIFPWILKDYKSTSLN

SEQ ID NO: 2734133 - protein, 20 aa, Entamoeba histolytica
YHFENLFLPSFFKKFGMDYS

SEQ ID NO: 2734134 - protein, 18 aa, Entamoeba histolytica
YHILYFWQGRKCPILDKG

SEQ ID NO: 2734135 - protein, 19 aa, Entamoeba histolytica
YHITEYLALGATLAVSYVE

SEQ ID NO: 2734136 - protein, 17 aa, Entamoeba histolytica
YHMYLFKALRNYFMTQA

SEQ ID NO: 2734137 - protein, 17 aa, Entamoeba histolytica
YHTIPSFFPLPIPLLRS

SEQ ID NO: 2734138 - protein, 17 aa, Entamoeba histolytica
YHYKIWAKDMYLLYFWQ

SEQ ID NO: 2734139 - protein, 23 aa, Entamoeba histolytica
YIDLLIILFVQWKFGPDQWKILK

SEQ ID NO: 2734140 - protein, 19 aa, Entamoeba histolytica
YIHRMYLKVGFYLTGETTD

SEQ ID NO: 2734141 - protein, 18 aa, Entamoeba histolytica
YIIHFYGAVFIPNKICMV

SEQ ID NO: 2734142 - protein, 19 aa, Entamoeba histolytica
YIKILLRSAISSSPYKALE

SEQ ID NO: 2734143 - protein, 17 aa, Entamoeba histolytica
YIKRFFQFIRKLVRTYG

SEQ ID NO: 2734144 - protein, 19 aa, Entamoeba histolytica
YILGMVWTMILKYKINANQ

SEQ ID NO: 2734145 - protein, 17 aa, Entamoeba histolytica
YILLTKHFLIFDTALRS

SEQ ID NO: 2734146 - protein, 20 aa, Entamoeba histolytica
YINLINYFRTFFSIATESAI

SEQ ID NO: 2734147 - protein, 24 aa, Entamoeba histolytica
YIPLLRHPIIFPTMKLKILELLNF

SEQ ID NO: 2734148 - protein, 18 aa, Entamoeba histolytica
YISYWRLFRNGRWKPVKE

SEQ ID NO: 2734149 - protein, 17 aa, Entamoeba histolytica
YITAYFLLFIDIEFVKP

SEQ ID NO: 2734150 - protein, 18 aa, Entamoeba histolytica
YITGLLKIAKLLLPKVEI

SEQ ID NO: 2734151 - protein, 21 aa, Entamoeba histolytica
YIVTTFRPELILPANKWYEIK

SEQ ID NO: 2734152 - protein, 19 aa, Entamoeba histolytica
YKFILFDDINYDKNLLRLI

SEQ ID NO: 2734153 - protein, 20 aa, Entamoeba histolytica
YKFILGMMFSLYRKYCICRS

SEQ ID NO: 2734154 - protein, 25 aa, Entamoeba histolytica
YKGKWFMYVYGVIDKLLTKIQSEPK

SEQ ID NO: 2734155 - protein, 24 aa, Entamoeba histolytica
YKGKYVVLLFYPLDWTFVCPTEMI

SEQ ID NO: 2734156 - protein, 26 aa, Entamoeba histolytica
YKKELLLFILTYVFYPNIIIPQQIIG

SEQ ID NO: 2734157 - protein, 26 aa, Entamoeba histolytica
YKNWKKRYFVLKDKKLWYFDNKDSVS

SEQ ID NO: 2734158 - protein, 23 aa, Entamoeba histolytica
YKRLRFLQVKLFNTSLKSYSKLP

SEQ ID NO: 2734159 - protein, 18 aa, Entamoeba histolytica
YKWKLFTIWDTVKGEIVA

SEQ ID NO: 2734160 - protein, 25 aa, Entamoeba histolytica
YKYDLYIFEYYLMIQLYSITKDDAS

SEQ ID NO: 2734161 - protein, 17 aa, Entamoeba histolytica
YLAYYCWIKSSGSNVER

SEQ ID NO: 2734162 - protein, 19 aa, Entamoeba histolytica
YLDYLIDIVRPRKLLYLAV

SEQ ID NO: 2734163 - protein, 18 aa, Entamoeba histolytica
YLFSTLCPTPWTAFAVGY

SEQ ID NO: 2734164 - protein, 19 aa, Entamoeba histolytica
YLILIATLDQKMIQCLPSQ

SEQ ID NO: 2734165 - protein, 20 aa, Entamoeba histolytica
YLLKKVCAIPAFIVTFTVCI

SEQ ID NO: 2734166 - protein, 20 aa, Entamoeba histolytica
YLLKSKYWITIFIDIAVSLV

SEQ ID NO: 2734167 - protein, 19 aa, Entamoeba histolytica
YLNIFIQQLYSWLQDFLHI

SEQ ID NO: 2734168 - protein, 19 aa, Entamoeba histolytica
YLPLPFMPKLQILTIRFTQ

SEQ ID NO: 2734169 - protein, 17 aa, Entamoeba histolytica
YLRLPRNLSYQEKIWDH

SEQ ID NO: 2734170 - protein, 20 aa, Entamoeba histolytica
YLSTFFPINAIFKSALQTQS

SEQ ID NO: 2734171 - protein, 24 aa, Entamoeba histolytica
YLTTNIIPILQRYKIRTDPTTLQI

SEQ ID NO: 2734172 - protein, 17 aa, Entamoeba histolytica
YMNEHILRRIKLLYPHL

SEQ ID NO: 2734173 - protein, 18 aa, Entamoeba histolytica
YNDPRLLNILLYLYNNGY

SEQ ID NO: 2734174 - protein, 21 aa, Entamoeba histolytica
YNHLFVYLITFLKKLICLGEN

SEQ ID NO: 2734175 - protein, 17 aa, Entamoeba histolytica
YNIPIMIMFPYDYPMKP

SEQ ID NO: 2734176 - protein, 17 aa, Entamoeba histolytica
YNKLFDVFPLLLKQTLS

SEQ ID NO: 2734177 - protein, 17 aa, Entamoeba histolytica
YNKYRFYNINRGEKKLL

SEQ ID NO: 2734178 - protein, 22 aa, Entamoeba histolytica
YNMFQLFFFKIFHNYFQCFKAN

SEQ ID NO: 2734179 - protein, 17 aa, Entamoeba histolytica
YNPAFVMPLFRKTIIRL

SEQ ID NO: 2734180 - protein, 23 aa, Entamoeba histolytica
YNPQLVNWLFLWKHSLPLPLSNS

SEQ ID NO: 2734181 - protein, 33 aa, Entamoeba histolytica
YNRLTNTIQNIYNNIHLIAETLTEPAPANSQSA

SEQ ID NO: 2734182 - protein, 22 aa, Entamoeba histolytica
YNSLRPLSYPQTDIFLLCFSVV

SEQ ID NO: 2734183 - protein, 17 aa, Entamoeba histolytica
YNSPIIDIPFFLKEDQI

SEQ ID NO: 2734184 - protein, 20 aa, Entamoeba histolytica
YNWWRRNSLTVFLDKKIYKD

SEQ ID NO: 2734185 - protein, 24 aa, Entamoeba histolytica
YPELPFGIFFIYNKNFFGFQIRFR

SEQ ID NO: 2734186 - protein, 24 aa, Entamoeba histolytica
YPETYFHYYLKYFAIRDKVSARKI

SEQ ID NO: 2734187 - protein, 19 aa, Entamoeba histolytica
YPFVIMKYKEQIIQISHLS

SEQ ID NO: 2734188 - protein, 23 aa, Entamoeba histolytica
YPHVFLEWLYGLLLFLQSPFEPE

SEQ ID NO: 2734189 - protein, 22 aa, Entamoeba histolytica
YPLFRDITIPILFGLYLLKTGI

SEQ ID NO: 2734190 - protein, 17 aa, Entamoeba histolytica
YPLLYLWGEFFGTYEDV

SEQ ID NO: 2734191 - protein, 20 aa, Entamoeba histolytica
YPVRIPFMAILPKPISEPWE

SEQ ID NO: 2734192 - protein, 19 aa, Entamoeba histolytica
YPWWPAKIIIMDKLNEKTK

SEQ ID NO: 2734193 - protein, 24 aa, Entamoeba histolytica
YQHLYFPCLIPLKETIDILKGFYP

SEQ ID NO: 2734194 - protein, 18 aa, Entamoeba histolytica
YQLCGVVLYVFFNTKIQN

SEQ ID NO: 2734195 - protein, 18 aa, Entamoeba histolytica
YQQFQILTQLFISPLRNL

SEQ ID NO: 2734196 - protein, 23 aa, Entamoeba histolytica
YQQGVMIYLLVKSGFEVRVKRLD

SEQ ID NO: 2734197 - protein, 29 aa, Entamoeba histolytica
YQRMMYQYPYYYYPYCYYPQPYNINGDSP

SEQ ID NO: 2734198 - protein, 26 aa, Entamoeba histolytica
YQSKYYYYHFLSWPYLMYVAETINKK

SEQ ID NO: 2734199 - protein, 22 aa, Entamoeba histolytica
YRAKTFLPYYIQPLLSLIPVDQ

SEQ ID NO: 2734200 - protein, 19 aa, Entamoeba histolytica
YREIFNDIFLLADGKGLFN

SEQ ID NO: 2734201 - protein, 20 aa, Entamoeba histolytica
YRFRPFIIKLTINTSFGIEF

SEQ ID NO: 2734202 - protein, 24 aa, Entamoeba histolytica
YRGKYVVLLFYPLDWTFVCPTEMI

SEQ ID NO: 2734203 - protein, 24 aa, Entamoeba histolytica
YRHLWSYILHIIRLFISFSFKNPK

SEQ ID NO: 2734204 - protein, 17 aa, Entamoeba histolytica
YRIDHILGFFRIWAIPA

SEQ ID NO: 2734205 - protein, 18 aa, Entamoeba histolytica
YRQQLLLIKMAIETSLLL

SEQ ID NO: 2734206 - protein, 18 aa, Entamoeba histolytica
YSARQLRILFLMQSWDAV

SEQ ID NO: 2734207 - protein, 25 aa, Entamoeba histolytica
YSDTVQIFYLLRTLSFHPLSRFFEE

SEQ ID NO: 2734208 - protein, 17 aa, Entamoeba histolytica
YSEIINHALHYEKPIIN

SEQ ID NO: 2734209 - protein, 25 aa, Entamoeba histolytica
YSIRIPMPAILKPIPKWTGKQVVTA

SEQ ID NO: 2734210 - protein, 19 aa, Entamoeba histolytica
YSLVLKFLPNLFNPDVTSL

SEQ ID NO: 2734211 - protein, 18 aa, Entamoeba histolytica
YSVKRFYKLNKMSASLFT

SEQ ID NO: 2734212 - protein, 22 aa, Entamoeba histolytica
YSYILIFLKFNYGNILGIFFQK

SEQ ID NO: 2734213 - protein, 17 aa, Entamoeba histolytica
YSYLLFKSKYPNVYSDS

SEQ ID NO: 2734214 - protein, 21 aa, Entamoeba histolytica
YTELILKFITFYLNLFFSRIE

SEQ ID NO: 2734215 - protein, 17 aa, Entamoeba histolytica
YVISLLDPSIRYSIKCK

SEQ ID NO: 2734216 - protein, 17 aa, Entamoeba histolytica
YVIWYKVDYSRYLEEKE

SEQ ID NO: 2734217 - protein, 18 aa, Entamoeba histolytica
YVIWYKVEYSRYLKEKEE

SEQ ID NO: 2734218 - protein, 18 aa, Entamoeba histolytica
YVLLFKRCDVNGDGVLDK

SEQ ID NO: 2734219 - protein, 18 aa, Entamoeba histolytica
YVWKLGEFLKRNPGAQKY

SEQ ID NO: 2734220 - protein, 17 aa, Entamoeba histolytica
YWHHWALINFEIVSYIE

SEQ ID NO: 2734221 - protein, 17 aa, Entamoeba histolytica
YYEPFGCYINHPFKKEG

SEQ ID NO: 2734222 - protein, 21 aa, Entamoeba histolytica
YYEVYIFISNIFKPLVISEFL

SEQ ID NO: 2734223 - protein, 19 aa, Entamoeba histolytica
YYFQPIFSRTYFSIAVTPI

SEQ ID NO: 2734224 - protein, 17 aa, Entamoeba histolytica
YYIKGDGFVLVYSIDNK

SEQ ID NO: 2734225 - protein, 18 aa, Entamoeba histolytica
YYLIWFKRELFSSKGRLF

SEQ ID NO: 2734226 - protein, 17 aa, Entamoeba histolytica
YYRGIYQKRLKDRELFK

SEQ ID NO: 2734227 - protein, 18 aa, Entamoeba histolytica
YYTTYMNIYFPLKTFYES

SEQ ID NO: 2734228 - protein, 21 aa, Entamoeba histolytica
YYYNQLPFLFPGVPITYIVNP

SEQ ID NO: 2734229 - protein, 18 aa, Entamoeba histolytica
YYYQRLKSWIGLEKYKII

SEQ ID NO: 2734230 - protein, 5 aa, Entamoeba histolytica
DGTIN

SEQ ID NO: 2734231 - protein, 7 aa, Entamoeba histolytica
GGNVGDS

SEQ ID NO: 2734232 - protein, 8 aa, Entamoeba histolytica
KIKSGGVA

SEQ ID NO: 2734233 - protein, 11 aa, Entamoeba histolytica
PCGETRYPSYP

SEQ ID NO: 2734234 - protein, 7 aa, Entamoeba histolytica
TSPRNYN

SEQ ID NO: 2734235 - protein, 6 aa, Entamoeba histolytica
AAGTVG

SEQ ID NO: 2734236 - protein, 10 aa, Entamoeba histolytica
CNDGKSKELL

SEQ ID NO: 2734237 - protein, 4 aa, Entamoeba histolytica
DGNA

SEQ ID NO: 2734238 - protein, 8 aa, Entamoeba histolytica
DNENNVNN

SEQ ID NO: 2734239 - protein, 6 aa, Entamoeba histolytica
GCNTNG

SEQ ID NO: 2734240 - protein, 6 aa, Entamoeba histolytica
GKCGEN

SEQ ID NO: 2734241 - protein, 33 aa, Entamoeba histolytica
KKAATDKGHSEWGNGSPSNAGNYNSKPPSSTGF

SEQ ID NO: 2734242 - protein, 8 aa, Entamoeba histolytica
NAGAANDA

SEQ ID NO: 2734243 - protein, 7 aa, Entamoeba histolytica
NEYQTEY

SEQ ID NO: 2734244 - protein, 14 aa, Entamoeba histolytica
NSNGVNNKGQLQND

SEQ ID NO: 2734245 - protein, 14 aa, Entamoeba histolytica
SGTDGNCGSSPANL

SEQ ID NO: 2734246 - protein, 6 aa, Entamoeba histolytica
SHAAEM

SEQ ID NO: 2734247 - protein, 6 aa, Entamoeba histolytica
SIFEGR

SEQ ID NO: 2734248 - protein, 11 aa, Entamoeba histolytica
VLNSRNEEKSY

SEQ ID NO: 2734249 - protein, 20 aa, Entamoeba histolytica
YYNSNGNDAYKTLSNTFKNN

SEQ ID NO: 2734250 - protein, 12 aa, Entamoeba histolytica
KTSKRPTVRRGR

SEQ ID NO: 2734251 - protein, 12 aa, Entamoeba histolytica
NTCKDSFKENFG

SEQ ID NO: 2734252 - protein, 6 aa, Entamoeba histolytica
NYQSEY

SEQ ID NO: 2734253 - protein, 10 aa, Entamoeba histolytica
RANSNSAAYA

SEQ ID NO: 2734254 - protein, 13 aa, Entamoeba histolytica
RTTKETAVNAEKP

SEQ ID NO: 2734255 - protein, 8 aa, Entamoeba histolytica
SANQENYV

SEQ ID NO: 2734256 - protein, 6 aa, Entamoeba histolytica
SEAEYN

SEQ ID NO: 2734257 - protein, 7 aa, Entamoeba histolytica
SQPNTVK

SEQ ID NO: 2734258 - protein, 11 aa, Entamoeba histolytica
TESWGGCGGGF

SEQ ID NO: 2734259 - protein, 6 aa, Entamoeba histolytica
VDTANS

SEQ ID NO: 2734260 - protein, 7 aa, Entamoeba histolytica
YPSNNGI

SEQ ID NO: 2734261 - protein, 7 aa, Entamoeba histolytica
AAFPGNN

SEQ ID NO: 2734262 - protein, 7 aa, Entamoeba histolytica
AKDGCSA

SEQ ID NO: 2734263 - protein, 8 aa, Entamoeba histolytica
DNDKKKNY

SEQ ID NO: 2734264 - protein, 5 aa, Entamoeba histolytica
DQQIS

SEQ ID NO: 2734265 - protein, 10 aa, Entamoeba histolytica
DYGPNKPKTY

SEQ ID NO: 2734266 - protein, 10 aa, Entamoeba histolytica
EEENKTKHSL

SEQ ID NO: 2734267 - protein, 7 aa, Entamoeba histolytica
EESKNTE

SEQ ID NO: 2734268 - protein, 9 aa, Entamoeba histolytica
EESNIDAST

SEQ ID NO: 2734269 - protein, 9 aa, Entamoeba histolytica
EGYKEKEGP

SEQ ID NO: 2734270 - protein, 5 aa, Entamoeba histolytica
ERDSL

SEQ ID NO: 2734271 - protein, 4 aa, Entamoeba histolytica
FNGD

SEQ ID NO: 2734272 - protein, 6 aa, Entamoeba histolytica
GECKGR

SEQ ID NO: 2734273 - protein, 7 aa, Entamoeba histolytica
GSEDIEG

SEQ ID NO: 2734274 - protein, 9 aa, Entamoeba histolytica
HNAKGSSYR

SEQ ID NO: 2734275 - protein, 19 aa, Entamoeba histolytica
HYEYGTNNKLKGDNGETEL

SEQ ID NO: 2734276 - protein, 6 aa, Entamoeba histolytica
IGKIEN

SEQ ID NO: 2734277 - protein, 6 aa, Entamoeba histolytica
INPIEN

SEQ ID NO: 2734278 - protein, 6 aa, Entamoeba histolytica
KAVGGC

SEQ ID NO: 2734279 - protein, 7 aa, Entamoeba histolytica
KCQIPPN

SEQ ID NO: 2734280 - protein, 7 aa, Entamoeba histolytica
KDCENVT

SEQ ID NO: 2734281 - protein, 10 aa, Entamoeba histolytica
KNPPQPAFSD

SEQ ID NO: 2734282 - protein, 5 aa, Entamoeba histolytica
KQGNE

SEQ ID NO: 2734283 - protein, 8 aa, Entamoeba histolytica
KSPYTDAQ

SEQ ID NO: 2734284 - protein, 11 aa, Entamoeba histolytica
KSTGKTYNADE

SEQ ID NO: 2734285 - protein, 10 aa, Entamoeba histolytica
KTTEKENSDI

SEQ ID NO: 2734286 - protein, 7 aa, Entamoeba histolytica
KTTEKTL

SEQ ID NO: 2734287 - protein, 6 aa, Entamoeba histolytica
LTETEP

SEQ ID NO: 2734288 - protein, 6 aa, Entamoeba histolytica
NEKPIT

SEQ ID NO: 2734289 - protein, 7 aa, Entamoeba histolytica
NPECSSA

SEQ ID NO: 2734290 - protein, 10 aa, Entamoeba histolytica
NTYKENKSYT

SEQ ID NO: 2734291 - protein, 12 aa, Entamoeba histolytica
PLPTPTPNKYPV

SEQ ID NO: 2734292 - protein, 17 aa, Entamoeba histolytica
PNGTTCHTKDIGYNNPC

SEQ ID NO: 2734293 - protein, 12 aa, Entamoeba histolytica
QCNDYKQGYEID

SEQ ID NO: 2734294 - protein, 5 aa, Entamoeba histolytica
QEYKK

SEQ ID NO: 2734295 - protein, 9 aa, Entamoeba histolytica
QSNRRMGAK

SEQ ID NO: 2734296 - protein, 11 aa, Entamoeba histolytica
QVDNNKPKRKM

SEQ ID NO: 2734297 - protein, 7 aa, Entamoeba histolytica
SCKTNPN

SEQ ID NO: 2734298 - protein, 4 aa, Entamoeba histolytica
SEES

SEQ ID NO: 2734299 - protein, 10 aa, Entamoeba histolytica
SEGNSFNLNE

SEQ ID NO: 2734300 - protein, 8 aa, Entamoeba histolytica
SLVTGSNE

SEQ ID NO: 2734301 - protein, 13 aa, Entamoeba histolytica
STKQTLKQAVPDN

SEQ ID NO: 2734302 - protein, 5 aa, Entamoeba histolytica
STPIS

SEQ ID NO: 2734303 - protein, 6 aa, Entamoeba histolytica
SVECQG

SEQ ID NO: 2734304 - protein, 4 aa, Entamoeba histolytica
SYKG

SEQ ID NO: 2734305 - protein, 7 aa, Entamoeba histolytica
TINGEDP

SEQ ID NO: 2734306 - protein, 5 aa, Entamoeba histolytica
TNNID

SEQ ID NO: 2734307 - protein, 10 aa, Entamoeba histolytica
VCTGRGEFEI

SEQ ID NO: 2734308 - protein, 4 aa, Entamoeba histolytica
AAEI

SEQ ID NO: 2734309 - protein, 5 aa, Entamoeba histolytica
AAVTD

SEQ ID NO: 2734310 - protein, 9 aa, Entamoeba histolytica
AEIGKGING

SEQ ID NO: 2734311 - protein, 9 aa, Entamoeba histolytica
AGEKKTGSM

SEQ ID NO: 2734312 - protein, 9 aa, Entamoeba histolytica
AIQKQQNKN

SEQ ID NO: 2734313 - protein, 7 aa, Entamoeba histolytica
AKALSDA

SEQ ID NO: 2734314 - protein, 11 aa, Entamoeba histolytica
AKASPPQGNST

SEQ ID NO: 2734315 - protein, 14 aa, Entamoeba histolytica
AKSEGEERSTWTGN

SEQ ID NO: 2734316 - protein, 7 aa, Entamoeba histolytica
AKYGTRK

SEQ ID NO: 2734317 - protein, 6 aa, Entamoeba histolytica
ALPDRD

SEQ ID NO: 2734318 - protein, 7 aa, Entamoeba histolytica
ALPKNTA

SEQ ID NO: 2734319 - protein, 10 aa, Entamoeba histolytica
ANKPINEKRG

SEQ ID NO: 2734320 - protein, 4 aa, Entamoeba histolytica
APIE

SEQ ID NO: 2734321 - protein, 8 aa, Entamoeba histolytica
AQAEQMRN

SEQ ID NO: 2734322 - protein, 7 aa, Entamoeba histolytica
ARRVQSK

SEQ ID NO: 2734323 - protein, 10 aa, Entamoeba histolytica
ASDDNENSFD

SEQ ID NO: 2734324 - protein, 6 aa, Entamoeba histolytica
ASGGYG

SEQ ID NO: 2734325 - protein, 7 aa, Entamoeba histolytica
ASTPSLE

SEQ ID NO: 2734326 - protein, 6 aa, Entamoeba histolytica
AVNYET

SEQ ID NO: 2734327 - protein, 5 aa, Entamoeba histolytica
CDKES

SEQ ID NO: 2734328 - protein, 13 aa, Entamoeba histolytica
CEESGKGGYDASN

SEQ ID NO: 2734329 - protein, 8 aa, Entamoeba histolytica
CNDCASSD

SEQ ID NO: 2734330 - protein, 24 aa, Entamoeba histolytica
CSPSSMPSSPDKTITYTKVTCEND

SEQ ID NO: 2734331 - protein, 9 aa, Entamoeba histolytica
DAGGYTVEG

SEQ ID NO: 2734332 - protein, 7 aa, Entamoeba histolytica
DDDSHIE

SEQ ID NO: 2734333 - protein, 7 aa, Entamoeba histolytica
DDKDFQE

SEQ ID NO: 2734334 - protein, 7 aa, Entamoeba histolytica
DDKQTVS

SEQ ID NO: 2734335 - protein, 7 aa, Entamoeba histolytica
DDNRNEC

SEQ ID NO: 2734336 - protein, 15 aa, Entamoeba histolytica
DEITNNQDSTQTGIT

SEQ ID NO: 2734337 - protein, 4 aa, Entamoeba histolytica
DGTA

SEQ ID NO: 2734338 - protein, 4 aa, Entamoeba histolytica
DGTI

SEQ ID NO: 2734339 - protein, 9 aa, Entamoeba histolytica
DHKNEGDIL

SEQ ID NO: 2734340 - protein, 32 aa, Entamoeba histolytica
DKECTPSSQEESYKTLQNTSTYAEGNEDASGR

SEQ ID NO: 2734341 - protein, 14 aa, Entamoeba histolytica
DKFKKVAKKAYNKY

SEQ ID NO: 2734342 - protein, 10 aa, Entamoeba histolytica
DKQLSKSPTE

SEQ ID NO: 2734343 - protein, 7 aa, Entamoeba histolytica
DKSKEIR

SEQ ID NO: 2734344 - protein, 11 aa, Entamoeba histolytica
DNCRKSISNNY

SEQ ID NO: 2734345 - protein, 9 aa, Entamoeba histolytica
DQNNNEVRE

SEQ ID NO: 2734346 - protein, 11 aa, Entamoeba histolytica
DSGNETKPFAG

SEQ ID NO: 2734347 - protein, 19 aa, Entamoeba histolytica
DTQCGSGQDLISGRSYSGT

SEQ ID NO: 2734348 - protein, 4 aa, Entamoeba histolytica
DTRY

SEQ ID NO: 2734349 - protein, 7 aa, Entamoeba histolytica
EEDDNSI

SEQ ID NO: 2734350 - protein, 6 aa, Entamoeba histolytica
EEDSFD

SEQ ID NO: 2734351 - protein, 14 aa, Entamoeba histolytica
EEMENEEDCPCTKY

SEQ ID NO: 2734352 - protein, 4 aa, Entamoeba histolytica
EESA

SEQ ID NO: 2734353 - protein, 6 aa, Entamoeba histolytica
EGERTF

SEQ ID NO: 2734354 - protein, 4 aa, Entamoeba histolytica
EIAS

SEQ ID NO: 2734355 - protein, 4 aa, Entamoeba histolytica
ELGV

SEQ ID NO: 2734356 - protein, 4 aa, Entamoeba histolytica
ENDP

SEQ ID NO: 2734357 - protein, 6 aa, Entamoeba histolytica
ENEQRK

SEQ ID NO: 2734358 - protein, 18 aa, Entamoeba histolytica
ETIESTCDNRKNQGKQWG

SEQ ID NO: 2734359 - protein, 12 aa, Entamoeba histolytica
ETYKNYKSTFSQ

SEQ ID NO: 2734360 - protein, 17 aa, Entamoeba histolytica
EYDGTTCAEARKSNKEA

SEQ ID NO: 2734361 - protein, 5 aa, Entamoeba histolytica
FGEKD

SEQ ID NO: 2734362 - protein, 21 aa, Entamoeba histolytica
FQDGDSSRGYCTGYGPSKHCG

SEQ ID NO: 2734363 - protein, 16 aa, Entamoeba histolytica
FSAESFPSGSPKIEGE

SEQ ID NO: 2734364 - protein, 7 aa, Entamoeba histolytica
GCNTNGF

SEQ ID NO: 2734365 - protein, 7 aa, Entamoeba histolytica
GDPAGQV

SEQ ID NO: 2734366 - protein, 4 aa, Entamoeba histolytica
GECD

SEQ ID NO: 2734367 - protein, 7 aa, Entamoeba histolytica
GGKKPCV

SEQ ID NO: 2734368 - protein, 4 aa, Entamoeba histolytica
GIET

SEQ ID NO: 2734369 - protein, 4 aa, Entamoeba histolytica
GKEI

SEQ ID NO: 2734370 - protein, 4 aa, Entamoeba histolytica
GNDW

SEQ ID NO: 2734371 - protein, 11 aa, Entamoeba histolytica
GNGNDNYKSEY

SEQ ID NO: 2734372 - protein, 16 aa, Entamoeba histolytica
GPMNSSQEQESRLEEN

SEQ ID NO: 2734373 - protein, 8 aa, Entamoeba histolytica
GRSYNDPQ

SEQ ID NO: 2734374 - protein, 4 aa, Entamoeba histolytica
GSGK

SEQ ID NO: 2734375 - protein, 26 aa, Entamoeba histolytica
GTCSYHEGQQADSRMRKVGKSRGYQV

SEQ ID NO: 2734376 - protein, 15 aa, Entamoeba histolytica
GTESINNKEERNREV

SEQ ID NO: 2734377 - protein, 20 aa, Entamoeba histolytica
GTKKTYPVDNPTNKQKYSYS

SEQ ID NO: 2734378 - protein, 9 aa, Entamoeba histolytica
GTPATRMNS

SEQ ID NO: 2734379 - protein, 4 aa, Entamoeba histolytica
HAQF

SEQ ID NO: 2734380 - protein, 4 aa, Entamoeba histolytica
HGTC

SEQ ID NO: 2734381 - protein, 5 aa, Entamoeba histolytica
HIRPD

SEQ ID NO: 2734382 - protein, 7 aa, Entamoeba histolytica
HKAERKE

SEQ ID NO: 2734383 - protein, 11 aa, Entamoeba histolytica
HKYNAKKFQRA

SEQ ID NO: 2734384 - protein, 19 aa, Entamoeba histolytica
IAEQNGLKQEVKKANVKKT

SEQ ID NO: 2734385 - protein, 9 aa, Entamoeba histolytica
IEKQPRKFK

SEQ ID NO: 2734386 - protein, 9 aa, Entamoeba histolytica
INGNGNNNI

SEQ ID NO: 2734387 - protein, 10 aa, Entamoeba histolytica
IQGREYSDSS

SEQ ID NO: 2734388 - protein, 9 aa, Entamoeba histolytica
IQNPSNNDQ

SEQ ID NO: 2734389 - protein, 7 aa, Entamoeba histolytica
KAARHPP

SEQ ID NO: 2734390 - protein, 6 aa, Entamoeba histolytica
KAVSGC

SEQ ID NO: 2734391 - protein, 6 aa, Entamoeba histolytica
KDEEKN

SEQ ID NO: 2734392 - protein, 4 aa, Entamoeba histolytica
KDYW

SEQ ID NO: 2734393 - protein, 6 aa, Entamoeba histolytica
KECPAK

SEQ ID NO: 2734394 - protein, 8 aa, Entamoeba histolytica
KETLPEED

SEQ ID NO: 2734395 - protein, 5 aa, Entamoeba histolytica
KGRNV

SEQ ID NO: 2734396 - protein, 7 aa, Entamoeba histolytica
KHPTEPA

SEQ ID NO: 2734397 - protein, 8 aa, Entamoeba histolytica
KINTQTTS

SEQ ID NO: 2734398 - protein, 6 aa, Entamoeba histolytica
KKARHN

SEQ ID NO: 2734399 - protein, 6 aa, Entamoeba histolytica
KKKKLA

SEQ ID NO: 2734400 - protein, 10 aa, Entamoeba histolytica
KKYQQSKEEY

SEQ ID NO: 2734401 - protein, 5 aa, Entamoeba histolytica
KLEQL

SEQ ID NO: 2734402 - protein, 9 aa, Entamoeba histolytica
KLQRQLTQN

SEQ ID NO: 2734403 - protein, 10 aa, Entamoeba histolytica
KMGKKGEQWE

SEQ ID NO: 2734404 - protein, 13 aa, Entamoeba histolytica
KQKKKLEITKPEL

SEQ ID NO: 2734405 - protein, 8 aa, Entamoeba histolytica
KQLGEGVQ

SEQ ID NO: 2734406 - protein, 6 aa, Entamoeba histolytica
KRIANQ

SEQ ID NO: 2734407 - protein, 19 aa, Entamoeba histolytica
KRYNKKQANLKKNLEKRIE

SEQ ID NO: 2734408 - protein, 9 aa, Entamoeba histolytica
KSESCTGKI

SEQ ID NO: 2734409 - protein, 8 aa, Entamoeba histolytica
KSITGNDN

SEQ ID NO: 2734410 - protein, 6 aa, Entamoeba histolytica
KSMDKN

SEQ ID NO: 2734411 - protein, 6 aa, Entamoeba histolytica
KSQSRK

SEQ ID NO: 2734412 - protein, 8 aa, Entamoeba histolytica
KSVPKRQA

SEQ ID NO: 2734413 - protein, 7 aa, Entamoeba histolytica
KVSGSNR

SEQ ID NO: 2734414 - protein, 8 aa, Entamoeba histolytica
KVSKAVKS

SEQ ID NO: 2734415 - protein, 22 aa, Entamoeba histolytica
KYDCPARPFGGNEEYDISPDGT

SEQ ID NO: 2734416 - protein, 12 aa, Entamoeba histolytica
LEDEEEDDMTTF

SEQ ID NO: 2734417 - protein, 5 aa, Entamoeba histolytica
LEERK

SEQ ID NO: 2734418 - protein, 5 aa, Entamoeba histolytica
LKNDR

SEQ ID NO: 2734419 - protein, 9 aa, Entamoeba histolytica
LSNPSKPPF

SEQ ID NO: 2734420 - protein, 11 aa, Entamoeba histolytica
MENESYDSDSK

SEQ ID NO: 2734421 - protein, 4 aa, Entamoeba histolytica
MSSY

SEQ ID NO: 2734422 - protein, 11 aa, Entamoeba histolytica
MTTTEEGRKEL

SEQ ID NO: 2734423 - protein, 6 aa, Entamoeba histolytica
NAAGQV

SEQ ID NO: 2734424 - protein, 7 aa, Entamoeba histolytica
NAKKVKA

SEQ ID NO: 2734425 - protein, 5 aa, Entamoeba histolytica
NEIGS

SEQ ID NO: 2734426 - protein, 23 aa, Entamoeba histolytica
NEQKRINSNAKKMAKEISKSISK

SEQ ID NO: 2734427 - protein, 5 aa, Entamoeba histolytica
NFQSN

SEQ ID NO: 2734428 - protein, 10 aa, Entamoeba histolytica
NGATGPKDYA

SEQ ID NO: 2734429 - protein, 10 aa, Entamoeba histolytica
NGVPSESEVY

SEQ ID NO: 2734430 - protein, 11 aa, Entamoeba histolytica
NHHGSEHSNNA

SEQ ID NO: 2734431 - protein, 13 aa, Entamoeba histolytica
NISNGLKTTQNTL

SEQ ID NO: 2734432 - protein, 4 aa, Entamoeba histolytica
NKMR

SEQ ID NO: 2734433 - protein, 6 aa, Entamoeba histolytica
NKNNQC

SEQ ID NO: 2734434 - protein, 6 aa, Entamoeba histolytica
NKTNDD

SEQ ID NO: 2734435 - protein, 13 aa, Entamoeba histolytica
NLAPNYNKGQKGG

SEQ ID NO: 2734436 - protein, 14 aa, Entamoeba histolytica
NSSNWKPSYESTDS

SEQ ID NO: 2734437 - protein, 6 aa, Entamoeba histolytica
NTTNQR

SEQ ID NO: 2734438 - protein, 14 aa, Entamoeba histolytica
NVKKNKPQRKACGV

SEQ ID NO: 2734439 - protein, 4 aa, Entamoeba histolytica
PEQY

SEQ ID NO: 2734440 - protein, 7 aa, Entamoeba histolytica
PFARRTE

SEQ ID NO: 2734441 - protein, 19 aa, Entamoeba histolytica
PGDCGGVYNDNAARSDGHI

SEQ ID NO: 2734442 - protein, 8 aa, Entamoeba histolytica
PKFGTNDE

SEQ ID NO: 2734443 - protein, 9 aa, Entamoeba histolytica
PLDPGTNNQ

SEQ ID NO: 2734444 - protein, 11 aa, Entamoeba histolytica
PSGATKQETCG

SEQ ID NO: 2734445 - protein, 8 aa, Entamoeba histolytica
PSKNELPG

SEQ ID NO: 2734446 - protein, 8 aa, Entamoeba histolytica
PSSLEDPG

SEQ ID NO: 2734447 - protein, 7 aa, Entamoeba histolytica
PTDPESM

SEQ ID NO: 2734448 - protein, 6 aa, Entamoeba histolytica
QAKAEY

SEQ ID NO: 2734449 - protein, 6 aa, Entamoeba histolytica
QAKARY

SEQ ID NO: 2734450 - protein, 5 aa, Entamoeba histolytica
QEENN

SEQ ID NO: 2734451 - protein, 11 aa, Entamoeba histolytica
QGFNSNEQSLH

SEQ ID NO: 2734452 - protein, 11 aa, Entamoeba histolytica
QIGDANNNAAK

SEQ ID NO: 2734453 - protein, 10 aa, Entamoeba histolytica
QINPPDEGAS

SEQ ID NO: 2734454 - protein, 8 aa, Entamoeba histolytica
QQEVKRRR

SEQ ID NO: 2734455 - protein, 21 aa, Entamoeba histolytica
QRAQGNKAATNIRKAKETFRE

SEQ ID NO: 2734456 - protein, 9 aa, Entamoeba histolytica
QRSTTGGIS

SEQ ID NO: 2734457 - protein, 5 aa, Entamoeba histolytica
QSKQH

SEQ ID NO: 2734458 - protein, 11 aa, Entamoeba histolytica
QTQDAKQKVQL

SEQ ID NO: 2734459 - protein, 11 aa, Entamoeba histolytica
QVSTRNQDRNY

SEQ ID NO: 2734460 - protein, 5 aa, Entamoeba histolytica
RESKL

SEQ ID NO: 2734461 - protein, 4 aa, Entamoeba histolytica
RFGS

SEQ ID NO: 2734462 - protein, 11 aa, Entamoeba histolytica
RGSDYTRTHRD

SEQ ID NO: 2734463 - protein, 13 aa, Entamoeba histolytica
RIKNDSYKIDGSL

SEQ ID NO: 2734464 - protein, 4 aa, Entamoeba histolytica
RKGK

SEQ ID NO: 2734465 - protein, 9 aa, Entamoeba histolytica
RKKGEGLAN

SEQ ID NO: 2734466 - protein, 23 aa, Entamoeba histolytica
RKPNNKPQFKYNSETNTLEIDGN

SEQ ID NO: 2734467 - protein, 8 aa, Entamoeba histolytica
RKQRAREL

SEQ ID NO: 2734468 - protein, 4 aa, Entamoeba histolytica
RPLK

SEQ ID NO: 2734469 - protein, 10 aa, Entamoeba histolytica
RQYRNKPREF

SEQ ID NO: 2734470 - protein, 19 aa, Entamoeba histolytica
RRTQRKRLRRQRRVAGKTV

SEQ ID NO: 2734471 - protein, 6 aa, Entamoeba histolytica
RSPAAE

SEQ ID NO: 2734472 - protein, 5 aa, Entamoeba histolytica
RSTRD

SEQ ID NO: 2734473 - protein, 6 aa, Entamoeba histolytica
SAAEQK

SEQ ID NO: 2734474 - protein, 8 aa, Entamoeba histolytica
SAIQRNNG

SEQ ID NO: 2734475 - protein, 5 aa, Entamoeba histolytica
SISTT

SEQ ID NO: 2734476 - protein, 7 aa, Entamoeba histolytica
SKAIEEE

SEQ ID NO: 2734477 - protein, 16 aa, Entamoeba histolytica
SKDQIDKKRIPKLSGK

SEQ ID NO: 2734478 - protein, 7 aa, Entamoeba histolytica
SKELPGL

SEQ ID NO: 2734479 - protein, 9 aa, Entamoeba histolytica
SKTPLPEKC

SEQ ID NO: 2734480 - protein, 8 aa, Entamoeba histolytica
SKVKYESK

SEQ ID NO: 2734481 - protein, 11 aa, Entamoeba histolytica
SNGGSQLDSTG

SEQ ID NO: 2734482 - protein, 5 aa, Entamoeba histolytica
SNINT

SEQ ID NO: 2734483 - protein, 19 aa, Entamoeba histolytica
SNPALYQGRRENQNASGTL

SEQ ID NO: 2734484 - protein, 7 aa, Entamoeba histolytica
SRKHQNN

SEQ ID NO: 2734485 - protein, 5 aa, Entamoeba histolytica
SRPVV

SEQ ID NO: 2734486 - protein, 6 aa, Entamoeba histolytica
SSIPTE

SEQ ID NO: 2734487 - protein, 8 aa, Entamoeba histolytica
STSKEQID

SEQ ID NO: 2734488 - protein, 11 aa, Entamoeba histolytica
SVKGSLKNANK

SEQ ID NO: 2734489 - protein, 5 aa, Entamoeba histolytica
SYSGN

SEQ ID NO: 2734490 - protein, 4 aa, Entamoeba histolytica
TDRN

SEQ ID NO: 2734491 - protein, 9 aa, Entamoeba histolytica
TESDHQEGN

SEQ ID NO: 2734492 - protein, 5 aa, Entamoeba histolytica
TKKIQ

SEQ ID NO: 2734493 - protein, 8 aa, Entamoeba histolytica
TNGNTDPW

SEQ ID NO: 2734494 - protein, 16 aa, Entamoeba histolytica
TQNVQQKETAKKAGIE

SEQ ID NO: 2734495 - protein, 8 aa, Entamoeba histolytica
TSTKANPQ

SEQ ID NO: 2734496 - protein, 14 aa, Entamoeba histolytica
TTEVPDPYYGGEKG

SEQ ID NO: 2734497 - protein, 6 aa, Entamoeba histolytica
TTNNEC

SEQ ID NO: 2734498 - protein, 7 aa, Entamoeba histolytica
TTPSLNQ

SEQ ID NO: 2734499 - protein, 4 aa, Entamoeba histolytica
TVKG

SEQ ID NO: 2734500 - protein, 8 aa, Entamoeba histolytica
TWSSPTTM

SEQ ID NO: 2734501 - protein, 12 aa, Entamoeba histolytica
TYTVKDNKYSVG

SEQ ID NO: 2734502 - protein, 10 aa, Entamoeba histolytica
VADGKTSYKK

SEQ ID NO: 2734503 - protein, 11 aa, Entamoeba histolytica
VGTGDDKNLTS

SEQ ID NO: 2734504 - protein, 6 aa, Entamoeba histolytica
VKEAEN

SEQ ID NO: 2734505 - protein, 11 aa, Entamoeba histolytica
VKTCTSNGNDY

SEQ ID NO: 2734506 - protein, 16 aa, Entamoeba histolytica
VKTHSVQNTTRKPTNV

SEQ ID NO: 2734507 - protein, 5 aa, Entamoeba histolytica
VNPKY

SEQ ID NO: 2734508 - protein, 4 aa, Entamoeba histolytica
VQTI

SEQ ID NO: 2734509 - protein, 8 aa, Entamoeba histolytica
VSEQSSVK

SEQ ID NO: 2734510 - protein, 7 aa, Entamoeba histolytica
WASSAPV

SEQ ID NO: 2734511 - protein, 9 aa, Entamoeba histolytica
WEGESKGKI

SEQ ID NO: 2734512 - protein, 4 aa, Entamoeba histolytica
WTED

SEQ ID NO: 2734513 - protein, 7 aa, Entamoeba histolytica
YGGEYSD

SEQ ID NO: 2734514 - protein, 12 aa, Entamoeba histolytica
YGYGRDNNDYWG

SEQ ID NO: 2734515 - protein, 6 aa, Entamoeba histolytica
YNPEWA

SEQ ID NO: 2734516 - protein, 8 aa, Entamoeba histolytica
YNPQNEYE

SEQ ID NO: 2734517 - protein, 24 aa, Entamoeba histolytica
YRSSTTTYQSISQHNGEATANEGK

SEQ ID NO: 2734518 - protein, 11 aa, Entamoeba histolytica
YSEKENDVPEL

SEQ ID NO: 2734519 - protein, 20 aa, Entamoeba histolytica
YTKKSNCNGKGWSYSSESVI

SEQ ID NO: 2734520 - protein, 34 aa, Entamoeba histolytica
AAAASNAGHSEWGYSSPSNAGNYNSRPPSSTGFF

SEQ ID NO: 2734521 - protein, 16 aa, Entamoeba histolytica
AAAGAIAAGAKAVQGV

SEQ ID NO: 2734522 - protein, 11 aa, Entamoeba histolytica
AAAPSDKPEIS

SEQ ID NO: 2734523 - protein, 21 aa, Entamoeba histolytica
AADSSQGIDNYPYGKKNTNAN

SEQ ID NO: 2734524 - protein, 6 aa, Entamoeba histolytica
AAEERI

SEQ ID NO: 2734525 - protein, 7 aa, Entamoeba histolytica
AAEGPVA

SEQ ID NO: 2734526 - protein, 6 aa, Entamoeba histolytica
AAESNM

SEQ ID NO: 2734527 - protein, 6 aa, Entamoeba histolytica
AAGKTT

SEQ ID NO: 2734528 - protein, 8 aa, Entamoeba histolytica
AAHKMNKD

SEQ ID NO: 2734529 - protein, 4 aa, Entamoeba histolytica
AAKG

SEQ ID NO: 2734530 - protein, 10 aa, Entamoeba histolytica
AAKKANKMNN

SEQ ID NO: 2734531 - protein, 6 aa, Entamoeba histolytica
AAKKIS

SEQ ID NO: 2734532 - protein, 23 aa, Entamoeba histolytica
AAKKSMKKYSKKIAKRSSNKRLL

SEQ ID NO: 2734533 - protein, 8 aa, Entamoeba histolytica
AAKNNKHF

SEQ ID NO: 2734534 - protein, 13 aa, Entamoeba histolytica
AAKNQIAQNPENT

SEQ ID NO: 2734535 - protein, 12 aa, Entamoeba histolytica
AANNGCNGGSLS

SEQ ID NO: 2734536 - protein, 12 aa, Entamoeba histolytica
AAPESQKGNIQK

SEQ ID NO: 2734537 - protein, 19 aa, Entamoeba histolytica
AAQSNVAKAAKKFNNDAAK

SEQ ID NO: 2734538 - protein, 6 aa, Entamoeba histolytica
AATSRD

SEQ ID NO: 2734539 - protein, 12 aa, Entamoeba histolytica
ACDAPTVNEHSE

SEQ ID NO: 2734540 - protein, 5 aa, Entamoeba histolytica
ACEKI

SEQ ID NO: 2734541 - protein, 18 aa, Entamoeba histolytica
ADCVGNPGDIKNLTFQQS

SEQ ID NO: 2734542 - protein, 8 aa, Entamoeba histolytica
ADEINEKR

SEQ ID NO: 2734543 - protein, 9 aa, Entamoeba histolytica
ADFEEAQRQ

SEQ ID NO: 2734544 - protein, 18 aa, Entamoeba histolytica
ADIESQVSEATRKRNEDI

SEQ ID NO: 2734545 - protein, 7 aa, Entamoeba histolytica
ADKFTGS

SEQ ID NO: 2734546 - protein, 8 aa, Entamoeba histolytica
ADKTDEEF

SEQ ID NO: 2734547 - protein, 12 aa, Entamoeba histolytica
ADKYYDGTSCVN

SEQ ID NO: 2734548 - protein, 6 aa, Entamoeba histolytica
ADMDPC

SEQ ID NO: 2734549 - protein, 6 aa, Entamoeba histolytica
ADNIDP

SEQ ID NO: 2734550 - protein, 7 aa, Entamoeba histolytica
ADNQEQV

SEQ ID NO: 2734551 - protein, 8 aa, Entamoeba histolytica
ADRSNNNW

SEQ ID NO: 2734552 - protein, 9 aa, Entamoeba histolytica
ADSLTGVER

SEQ ID NO: 2734553 - protein, 9 aa, Entamoeba histolytica
ADTASTYLG

SEQ ID NO: 2734554 - protein, 6 aa, Entamoeba histolytica
ADTGAT

SEQ ID NO: 2734555 - protein, 25 aa, Entamoeba histolytica
ADTSDGRNQLSEKYPYGMDNRNTKF

SEQ ID NO: 2734556 - protein, 9 aa, Entamoeba histolytica
ADVKLEDDH

SEQ ID NO: 2734557 - protein, 6 aa, Entamoeba histolytica
ADYPKS

SEQ ID NO: 2734558 - protein, 8 aa, Entamoeba histolytica
AEAKSHSE

SEQ ID NO: 2734559 - protein, 46 aa, Entamoeba histolytica
AEEELEEEKDNCAEQYDEMSDKSVSEDVTEEELEEEEENETSYESV

SEQ ID NO: 2734560 - protein, 5 aa, Entamoeba histolytica
AEEIK

SEQ ID NO: 2734561 - protein, 19 aa, Entamoeba histolytica
AEEKQYYENKRIKAEKKAF

SEQ ID NO: 2734562 - protein, 17 aa, Entamoeba histolytica
AEELKSQRLDNIKEAKN

SEQ ID NO: 2734563 - protein, 23 aa, Entamoeba histolytica
AEERAEDDKKLKEQVEAKNQLEN

SEQ ID NO: 2734564 - protein, 16 aa, Entamoeba histolytica
AEGKVTPVRDQGGCSS

SEQ ID NO: 2734565 - protein, 15 aa, Entamoeba histolytica
AEGPNPFAPKDPEKL

SEQ ID NO: 2734566 - protein, 7 aa, Entamoeba histolytica
AEGSAAK

SEQ ID NO: 2734567 - protein, 16 aa, Entamoeba histolytica
AEKDTDPEQLKQQRME

SEQ ID NO: 2734568 - protein, 11 aa, Entamoeba histolytica
AEKETKKAKIN

SEQ ID NO: 2734569 - protein, 11 aa, Entamoeba histolytica
AEKGNSCDSAI

SEQ ID NO: 2734570 - protein, 16 aa, Entamoeba histolytica
AEKINEKNKNKERKVR

SEQ ID NO: 2734571 - protein, 9 aa, Entamoeba histolytica
AEKQATRAT

SEQ ID NO: 2734572 - protein, 7 aa, Entamoeba histolytica
AEKQIAK

SEQ ID NO: 2734573 - protein, 68 aa, Entamoeba histolytica
AELDDVNNDENDEYELEQDAGGADPNAAQGGADQNAAQGGADQSAAQGGAAGSWSQEAENQGGQSPNA

SEQ ID NO: 2734574 - protein, 18 aa, Entamoeba histolytica
AELEAARKYYKNKKAIAK

SEQ ID NO: 2734575 - protein, 8 aa, Entamoeba histolytica
AENGEKIS

SEQ ID NO: 2734576 - protein, 6 aa, Entamoeba histolytica
AENQAT

SEQ ID NO: 2734577 - protein, 5 aa, Entamoeba histolytica
AENSK

SEQ ID NO: 2734578 - protein, 8 aa, Entamoeba histolytica
AENTIERQ

SEQ ID NO: 2734579 - protein, 20 aa, Entamoeba histolytica
AEQSESDKCDCTRTNNKYSE

SEQ ID NO: 2734580 - protein, 16 aa, Entamoeba histolytica
AERGNQPQYKQAADKW

SEQ ID NO: 2734581 - protein, 17 aa, Entamoeba histolytica
AERGNQPQYKQAADKWK

SEQ ID NO: 2734582 - protein, 8 aa, Entamoeba histolytica
AETEQSYC

SEQ ID NO: 2734583 - protein, 15 aa, Entamoeba histolytica
AEVVNEKKEGNDVAE

SEQ ID NO: 2734584 - protein, 5 aa, Entamoeba histolytica
AFGTS

SEQ ID NO: 2734585 - protein, 7 aa, Entamoeba histolytica
AFPDGTS

SEQ ID NO: 2734586 - protein, 5 aa, Entamoeba histolytica
AFTEN

SEQ ID NO: 2734587 - protein, 6 aa, Entamoeba histolytica
AGDCGA

SEQ ID NO: 2734588 - protein, 7 aa, Entamoeba histolytica
AGESAGA

SEQ ID NO: 2734589 - protein, 4 aa, Entamoeba histolytica
AGEV

SEQ ID NO: 2734590 - protein, 10 aa, Entamoeba histolytica
AGEYPKTDPG

SEQ ID NO: 2734591 - protein, 6 aa, Entamoeba histolytica
AGFSAK

SEQ ID NO: 2734592 - protein, 4 aa, Entamoeba histolytica
AGFT

SEQ ID NO: 2734593 - protein, 8 aa, Entamoeba histolytica
AGGSRESY

SEQ ID NO: 2734594 - protein, 7 aa, Entamoeba histolytica
AGNERFQ

SEQ ID NO: 2734595 - protein, 9 aa, Entamoeba histolytica
AGPTHDNQP

SEQ ID NO: 2734596 - protein, 5 aa, Entamoeba histolytica
AGQAS

SEQ ID NO: 2734597 - protein, 7 aa, Entamoeba histolytica
AGRGMTR

SEQ ID NO: 2734598 - protein, 5 aa, Entamoeba histolytica
AGSQK

SEQ ID NO: 2734599 - protein, 6 aa, Entamoeba histolytica
AGSSLS

SEQ ID NO: 2734600 - protein, 5 aa, Entamoeba histolytica
AGTCK

SEQ ID NO: 2734601 - protein, 9 aa, Entamoeba histolytica
AGVASKTAG

SEQ ID NO: 2734602 - protein, 11 aa, Entamoeba histolytica
AGVGEKCEADN

SEQ ID NO: 2734603 - protein, 13 aa, Entamoeba histolytica
AGVKRRDLADPDT

SEQ ID NO: 2734604 - protein, 15 aa, Entamoeba histolytica
AGVSRSNEGTTWSAK

SEQ ID NO: 2734605 - protein, 5 aa, Entamoeba histolytica
AGWKD

SEQ ID NO: 2734606 - protein, 5 aa, Entamoeba histolytica
AGYPG

SEQ ID NO: 2734607 - protein, 22 aa, Entamoeba histolytica
AIEKANEKTQVEREVANEQKKT

SEQ ID NO: 2734608 - protein, 9 aa, Entamoeba histolytica
AIESEENQI

SEQ ID NO: 2734609 - protein, 13 aa, Entamoeba histolytica
AIKETATKVIEKG

SEQ ID NO: 2734610 - protein, 15 aa, Entamoeba histolytica
AIKKDKKSFNSLNES

SEQ ID NO: 2734611 - protein, 12 aa, Entamoeba histolytica
AINKEKITKGNL

SEQ ID NO: 2734612 - protein, 78 aa, Entamoeba histolytica
AIQKGASGVSKTAKKVSQFSDKLSDTKGNKSRSHSHSSSSRKGRSSGSSKPKAPRRQSSKPKAPRRQSSKRSTGTKGK

SEQ ID NO: 2734613 - protein, 9 aa, Entamoeba histolytica
AISKRGKES

SEQ ID NO: 2734614 - protein, 12 aa, Entamoeba histolytica
AISPKSASVKGR

SEQ ID NO: 2734615 - protein, 8 aa, Entamoeba histolytica
AITGSGLD

SEQ ID NO: 2734616 - protein, 10 aa, Entamoeba histolytica
AITKREKYTI

SEQ ID NO: 2734617 - protein, 32 aa, Entamoeba histolytica
AKAKKEQQKANKLAKKGDNKAAKKAAKKAKKL

SEQ ID NO: 2734618 - protein, 11 aa, Entamoeba histolytica
AKASKSERKTL

SEQ ID NO: 2734619 - protein, 11 aa, Entamoeba histolytica
AKDAKSPEKNE

SEQ ID NO: 2734620 - protein, 5 aa, Entamoeba histolytica
AKDLQ

SEQ ID NO: 2734621 - protein, 4 aa, Entamoeba histolytica
AKEL

SEQ ID NO: 2734622 - protein, 19 aa, Entamoeba histolytica
AKESDYPYTGSDSTCKTNV

SEQ ID NO: 2734623 - protein, 8 aa, Entamoeba histolytica
AKEYNKRS

SEQ ID NO: 2734624 - protein, 7 aa, Entamoeba histolytica
AKFPGGI

SEQ ID NO: 2734625 - protein, 22 aa, Entamoeba histolytica
AKGINNKVQGIAKKAGKVGKTI

SEQ ID NO: 2734626 - protein, 15 aa, Entamoeba histolytica
AKGKVPAIRDQASCG

SEQ ID NO: 2734627 - protein, 6 aa, Entamoeba histolytica
AKGPQF

SEQ ID NO: 2734628 - protein, 8 aa, Entamoeba histolytica
AKHDHSIQ

SEQ ID NO: 2734629 - protein, 6 aa, Entamoeba histolytica
AKIAEN

SEQ ID NO: 2734630 - protein, 9 aa, Entamoeba histolytica
AKKANSAIE

SEQ ID NO: 2734631 - protein, 5 aa, Entamoeba histolytica
AKKEL

SEQ ID NO: 2734632 - protein, 4 aa, Entamoeba histolytica
AKKG

SEQ ID NO: 2734633 - protein, 34 aa, Entamoeba histolytica
AKKSNIKRRANRRINRRRPTRRYNTKKAQRKARS

SEQ ID NO: 2734634 - protein, 9 aa, Entamoeba histolytica
AKKTGKVDA

SEQ ID NO: 2734635 - protein, 8 aa, Entamoeba histolytica
AKLDKKDV

SEQ ID NO: 2734636 - protein, 7 aa, Entamoeba histolytica
AKLENQN

SEQ ID NO: 2734637 - protein, 5 aa, Entamoeba histolytica
AKMAT

SEQ ID NO: 2734638 - protein, 8 aa, Entamoeba histolytica
AKNYGNEK

SEQ ID NO: 2734639 - protein, 7 aa, Entamoeba histolytica
AKQIREA

SEQ ID NO: 2734640 - protein, 9 aa, Entamoeba histolytica
AKQKERPVV

SEQ ID NO: 2734641 - protein, 8 aa, Entamoeba histolytica
AKRETDIH

SEQ ID NO: 2734642 - protein, 6 aa, Entamoeba histolytica
AKRNDN

SEQ ID NO: 2734643 - protein, 8 aa, Entamoeba histolytica
AKTLTTSG

SEQ ID NO: 2734644 - protein, 7 aa, Entamoeba histolytica
AKTNNNI

SEQ ID NO: 2734645 - protein, 7 aa, Entamoeba histolytica
AKTQGIK

SEQ ID NO: 2734646 - protein, 9 aa, Entamoeba histolytica
AKVPQYSSC

SEQ ID NO: 2734647 - protein, 7 aa, Entamoeba histolytica
ALEAKGR

SEQ ID NO: 2734648 - protein, 15 aa, Entamoeba histolytica
ALEEKKRTEEEIKER

SEQ ID NO: 2734649 - protein, 7 aa, Entamoeba histolytica
ALEETER

SEQ ID NO: 2734650 - protein, 8 aa, Entamoeba histolytica
ALESSSSA

SEQ ID NO: 2734651 - protein, 10 aa, Entamoeba histolytica
ALKKSDEIKN

SEQ ID NO: 2734652 - protein, 7 aa, Entamoeba histolytica
ALQREKK

SEQ ID NO: 2734653 - protein, 14 aa, Entamoeba histolytica
ALRPEGKKCNKQTD

SEQ ID NO: 2734654 - protein, 8 aa, Entamoeba histolytica
ALSTTINQ

SEQ ID NO: 2734655 - protein, 16 aa, Entamoeba histolytica
AMKSQKVIQKSQKKTI

SEQ ID NO: 2734656 - protein, 11 aa, Entamoeba histolytica
AMTPKGSNPSL

SEQ ID NO: 2734657 - protein, 19 aa, Entamoeba histolytica
ANAASGTSSGMGETGLTRV

SEQ ID NO: 2734658 - protein, 28 aa, Entamoeba histolytica
ANDAQIEKDTLKAAKVTQMRKNREYEMN

SEQ ID NO: 2734659 - protein, 6 aa, Entamoeba histolytica
ANDLEK

SEQ ID NO: 2734660 - protein, 13 aa, Entamoeba histolytica
ANEYENGQPSNTL

SEQ ID NO: 2734661 - protein, 9 aa, Entamoeba histolytica
ANGNPITTP

SEQ ID NO: 2734662 - protein, 7 aa, Entamoeba histolytica
ANKNHQI

SEQ ID NO: 2734663 - protein, 8 aa, Entamoeba histolytica
ANKNKAKD

SEQ ID NO: 2734664 - protein, 8 aa, Entamoeba histolytica
ANKNSVDY

SEQ ID NO: 2734665 - protein, 7 aa, Entamoeba histolytica
ANKTNSW

SEQ ID NO: 2734666 - protein, 11 aa, Entamoeba histolytica
ANMKQNEELRK

SEQ ID NO: 2734667 - protein, 6 aa, Entamoeba histolytica
ANNQND

SEQ ID NO: 2734668 - protein, 5 aa, Entamoeba histolytica
ANPKE

SEQ ID NO: 2734669 - protein, 7 aa, Entamoeba histolytica
ANPTSRV

SEQ ID NO: 2734670 - protein, 8 aa, Entamoeba histolytica
ANQENYVR

SEQ ID NO: 2734671 - protein, 16 aa, Entamoeba histolytica
ANQFADDKCEDPIPGT

SEQ ID NO: 2734672 - protein, 13 aa, Entamoeba histolytica
ANQKIDKAQKTVN

SEQ ID NO: 2734673 - protein, 12 aa, Entamoeba histolytica
ANQSLSKNLNDV

SEQ ID NO: 2734674 - protein, 6 aa, Entamoeba histolytica
ANSEGL

SEQ ID NO: 2734675 - protein, 15 aa, Entamoeba histolytica
ANSIPSDLSKKQCDY

SEQ ID NO: 2734676 - protein, 16 aa, Entamoeba histolytica
ANTKTEEEGNRLASTR

SEQ ID NO: 2734677 - protein, 8 aa, Entamoeba histolytica
ANYNPDNK

SEQ ID NO: 2734678 - protein, 4 aa, Entamoeba histolytica
ANYV

SEQ ID NO: 2734679 - protein, 6 aa, Entamoeba histolytica
APAGPW

SEQ ID NO: 2734680 - protein, 9 aa, Entamoeba histolytica
APDATNKCQ

SEQ ID NO: 2734681 - protein, 7 aa, Entamoeba histolytica
APDFGKT

SEQ ID NO: 2734682 - protein, 7 aa, Entamoeba histolytica
APEAVGA

SEQ ID NO: 2734683 - protein, 21 aa, Entamoeba histolytica
APESVDWRKEGKVTPIRDQAQ

SEQ ID NO: 2734684 - protein, 6 aa, Entamoeba histolytica
APGIEV

SEQ ID NO: 2734685 - protein, 7 aa, Entamoeba histolytica
APGTRNQ

SEQ ID NO: 2734686 - protein, 6 aa, Entamoeba histolytica
APHINT

SEQ ID NO: 2734687 - protein, 18 aa, Entamoeba histolytica
APISNGPNPNPIQKTNVN

SEQ ID NO: 2734688 - protein, 9 aa, Entamoeba histolytica
APKCAQTNV

SEQ ID NO: 2734689 - protein, 10 aa, Entamoeba histolytica
APKDESDKSV

SEQ ID NO: 2734690 - protein, 30 aa, Entamoeba histolytica
APLPEEKKEEEVPESDSDSEEVEKPKEKKE

SEQ ID NO: 2734691 - protein, 63 aa, Entamoeba histolytica
APPLPPSSRGLGTRPAQSAPQRPSGSAPRPTPPRRKESGVGAPPPPPPRGGVSPRGAPPPPPH

SEQ ID NO: 2734692 - protein, 8 aa, Entamoeba histolytica
APRCTPTT

SEQ ID NO: 2734693 - protein, 8 aa, Entamoeba histolytica
APSHNDQE

SEQ ID NO: 2734694 - protein, 4 aa, Entamoeba histolytica
APTT

SEQ ID NO: 2734695 - protein, 5 aa, Entamoeba histolytica
APTYE

SEQ ID NO: 2734696 - protein, 9 aa, Entamoeba histolytica
APVSSRSNI

SEQ ID NO: 2734697 - protein, 9 aa, Entamoeba histolytica
APYTNPRHK

SEQ ID NO: 2734698 - protein, 10 aa, Entamoeba histolytica
AQASSYDPKY

SEQ ID NO: 2734699 - protein, 24 aa, Entamoeba histolytica
AQCTDSGRIDDYDEECGRCDDGEY

SEQ ID NO: 2734700 - protein, 25 aa, Entamoeba histolytica
AQDKKSGKKEEITITSEKGRLTEEQ

SEQ ID NO: 2734701 - protein, 15 aa, Entamoeba histolytica
AQDNGMQSESSFPYK

SEQ ID NO: 2734702 - protein, 8 aa, Entamoeba histolytica
AQEKKNFD

SEQ ID NO: 2734703 - protein, 13 aa, Entamoeba histolytica
AQFGSNDCVEATS

SEQ ID NO: 2734704 - protein, 9 aa, Entamoeba histolytica
AQGQTTGYV

SEQ ID NO: 2734705 - protein, 14 aa, Entamoeba histolytica
AQKAASEPDKRVSQ

SEQ ID NO: 2734706 - protein, 5 aa, Entamoeba histolytica
AQKDK

SEQ ID NO: 2734707 - protein, 7 aa, Entamoeba histolytica
AQKEFNE

SEQ ID NO: 2734708 - protein, 11 aa, Entamoeba histolytica
AQKKRSNEKEF

SEQ ID NO: 2734709 - protein, 9 aa, Entamoeba histolytica
AQKPPSCGC

SEQ ID NO: 2734710 - protein, 14 aa, Entamoeba histolytica
AQKVISKAKKIAKK

SEQ ID NO: 2734711 - protein, 11 aa, Entamoeba histolytica
AQNAAANVKGA

SEQ ID NO: 2734712 - protein, 7 aa, Entamoeba histolytica
AQNNEKE

SEQ ID NO: 2734713 - protein, 13 aa, Entamoeba histolytica
AQPMSFASSPGLI

SEQ ID NO: 2734714 - protein, 14 aa, Entamoeba histolytica
AQPSVEAADKVAQN

SEQ ID NO: 2734715 - protein, 23 aa, Entamoeba histolytica
AQQGHQRRTPRDYNGPREARAIS

SEQ ID NO: 2734716 - protein, 5 aa, Entamoeba histolytica
AQSTG

SEQ ID NO: 2734717 - protein, 12 aa, Entamoeba histolytica
AQSTQCNRTINS

SEQ ID NO: 2734718 - protein, 4 aa, Entamoeba histolytica
AQTI

SEQ ID NO: 2734719 - protein, 7 aa, Entamoeba histolytica
AQTPLCQ

SEQ ID NO: 2734720 - protein, 128 aa, Entamoeba histolytica
AQVPKENSVSTEGKQSVVGNTDASQKEQATASTPSSQAKATEETQQIHNQQQHNKQQAQSSPGTTTNTPTGQEQPAVKPQQLETTNNDPKPQPSQNPQKETQPSKQEEQGEEHKPEIKEPEKKERTKR

SEQ ID NO: 2734721 - protein, 7 aa, Entamoeba histolytica
ARDATNV

SEQ ID NO: 2734722 - protein, 7 aa, Entamoeba histolytica
ARGYSPT

SEQ ID NO: 2734723 - protein, 6 aa, Entamoeba histolytica
ARKNGE

SEQ ID NO: 2734724 - protein, 10 aa, Entamoeba histolytica
ARNGKSKKKI

SEQ ID NO: 2734725 - protein, 12 aa, Entamoeba histolytica
ARNQITENPKNT

SEQ ID NO: 2734726 - protein, 4 aa, Entamoeba histolytica
ARPE

SEQ ID NO: 2734727 - protein, 4 aa, Entamoeba histolytica
ARQP

SEQ ID NO: 2734728 - protein, 37 aa, Entamoeba histolytica
ARRSTKKSSVRKSPRRSLKSNSFSTKIRSAKRKVTAK

SEQ ID NO: 2734729 - protein, 5 aa, Entamoeba histolytica
ARRTE

SEQ ID NO: 2734730 - protein, 4 aa, Entamoeba histolytica
ARTF

SEQ ID NO: 2734731 - protein, 4 aa, Entamoeba histolytica
ARTL

SEQ ID NO: 2734732 - protein, 5 aa, Entamoeba histolytica
ASEDN

SEQ ID NO: 2734733 - protein, 5 aa, Entamoeba histolytica
ASESM

SEQ ID NO: 2734734 - protein, 4 aa, Entamoeba histolytica
ASKE

SEQ ID NO: 2734735 - protein, 6 aa, Entamoeba histolytica
ASKKLN

SEQ ID NO: 2734736 - protein, 6 aa, Entamoeba histolytica
ASKKTQ

SEQ ID NO: 2734737 - protein, 20 aa, Entamoeba histolytica
ASKLSELRGEYNSNDNEMRK

SEQ ID NO: 2734738 - protein, 8 aa, Entamoeba histolytica
ASKNGKEF

SEQ ID NO: 2734739 - protein, 8 aa, Entamoeba histolytica
ASKNNKHF

SEQ ID NO: 2734740 - protein, 7 aa, Entamoeba histolytica
ASKRSER

SEQ ID NO: 2734741 - protein, 15 aa, Entamoeba histolytica
ASNEKRNALDKSATL

SEQ ID NO: 2734742 - protein, 9 aa, Entamoeba histolytica
ASPAEEELP

SEQ ID NO: 2734743 - protein, 7 aa, Entamoeba histolytica
ASPIDKN

SEQ ID NO: 2734744 - protein, 8 aa, Entamoeba histolytica
ASPKNQDQ

SEQ ID NO: 2734745 - protein, 16 aa, Entamoeba histolytica
ASQFADDKCEDPIPGT

SEQ ID NO: 2734746 - protein, 14 aa, Entamoeba histolytica
ASQIATSLSTSSPI

SEQ ID NO: 2734747 - protein, 9 aa, Entamoeba histolytica
ASQSPVKEV

SEQ ID NO: 2734748 - protein, 7 aa, Entamoeba histolytica
ASSGLKN

SEQ ID NO: 2734749 - protein, 9 aa, Entamoeba histolytica
ASSSSGNAL

SEQ ID NO: 2734750 - protein, 13 aa, Entamoeba histolytica
ATCNQKDKCTTCA

SEQ ID NO: 2734751 - protein, 6 aa, Entamoeba histolytica
ATENEY

SEQ ID NO: 2734752 - protein, 6 aa, Entamoeba histolytica
ATEQQG

SEQ ID NO: 2734753 - protein, 13 aa, Entamoeba histolytica
ATESINKQEYRNT

SEQ ID NO: 2734754 - protein, 8 aa, Entamoeba histolytica
ATESINNK

SEQ ID NO: 2734755 - protein, 14 aa, Entamoeba histolytica
ATESINNKEERNKK

SEQ ID NO: 2734756 - protein, 14 aa, Entamoeba histolytica
ATESINNQEERNKE

SEQ ID NO: 2734757 - protein, 14 aa, Entamoeba histolytica
ATESINNQEERNNE

SEQ ID NO: 2734758 - protein, 14 aa, Entamoeba histolytica
ATESINNQEERTKE

SEQ ID NO: 2734759 - protein, 14 aa, Entamoeba histolytica
ATESINNTEERNRE

SEQ ID NO: 2734760 - protein, 4 aa, Entamoeba histolytica
ATHQ

SEQ ID NO: 2734761 - protein, 7 aa, Entamoeba histolytica
ATIDEET

SEQ ID NO: 2734762 - protein, 5 aa, Entamoeba histolytica
ATIQS

SEQ ID NO: 2734763 - protein, 8 aa, Entamoeba histolytica
ATKGQLKA

SEQ ID NO: 2734764 - protein, 15 aa, Entamoeba histolytica
ATKKNGTPKESKELS

SEQ ID NO: 2734765 - protein, 8 aa, Entamoeba histolytica
ATKSIDNT

SEQ ID NO: 2734766 - protein, 10 aa, Entamoeba histolytica
ATKTENTKWK

SEQ ID NO: 2734767 - protein, 7 aa, Entamoeba histolytica
ATKTGGH

SEQ ID NO: 2734768 - protein, 6 aa, Entamoeba histolytica
ATLGDK

SEQ ID NO: 2734769 - protein, 9 aa, Entamoeba histolytica
ATNTIQNEL

SEQ ID NO: 2734770 - protein, 16 aa, Entamoeba histolytica
ATPKTNSTEKKQSSID

SEQ ID NO: 2734771 - protein, 6 aa, Entamoeba histolytica
ATPVLD

SEQ ID NO: 2734772 - protein, 5 aa, Entamoeba histolytica
ATQEY

SEQ ID NO: 2734773 - protein, 5 aa, Entamoeba histolytica
ATRKN

SEQ ID NO: 2734774 - protein, 7 aa, Entamoeba histolytica
ATRSHGF

SEQ ID NO: 2734775 - protein, 7 aa, Entamoeba histolytica
ATSQSKV

SEQ ID NO: 2734776 - protein, 6 aa, Entamoeba histolytica
ATTAQA

SEQ ID NO: 2734777 - protein, 47 aa, Entamoeba histolytica
ATTASKAYQDIKNGKSSSSSSSSSSTSSSSSSSKGSKSSKGGNPISN

SEQ ID NO: 2734778 - protein, 4 aa, Entamoeba histolytica
ATTF

SEQ ID NO: 2734779 - protein, 8 aa, Entamoeba histolytica
ATTSTNTI

SEQ ID NO: 2734780 - protein, 12 aa, Entamoeba histolytica
AVESSKKMNQKR

SEQ ID NO: 2734781 - protein, 5 aa, Entamoeba histolytica
AVHKG

SEQ ID NO: 2734782 - protein, 30 aa, Entamoeba histolytica
AVKEQQKAVIPTKKQVKKAVKKQLNKASKL

SEQ ID NO: 2734783 - protein, 5 aa, Entamoeba histolytica
AVNKQ

SEQ ID NO: 2734784 - protein, 5 aa, Entamoeba histolytica
AVNPQ

SEQ ID NO: 2734785 - protein, 19 aa, Entamoeba histolytica
AVTNPNTPVDTTLEGKQYG

SEQ ID NO: 2734786 - protein, 8 aa, Entamoeba histolytica
AWESNGEG

SEQ ID NO: 2734787 - protein, 6 aa, Entamoeba histolytica
AYASST

SEQ ID NO: 2734788 - protein, 5 aa, Entamoeba histolytica
AYEDY

SEQ ID NO: 2734789 - protein, 6 aa, Entamoeba histolytica
AYKQCE

SEQ ID NO: 2734790 - protein, 16 aa, Entamoeba histolytica
AYKSAASAGLGKCGEN

SEQ ID NO: 2734791 - protein, 14 aa, Entamoeba histolytica
AYNSEAKKNHGHSL

SEQ ID NO: 2734792 - protein, 10 aa, Entamoeba histolytica
AYSGLNSTKA

SEQ ID NO: 2734793 - protein, 9 aa, Entamoeba histolytica
AYSKAQTTL

SEQ ID NO: 2734794 - protein, 7 aa, Entamoeba histolytica
CDDNGTC

SEQ ID NO: 2734795 - protein, 11 aa, Entamoeba histolytica
CDKCGGKGKIY

SEQ ID NO: 2734796 - protein, 8 aa, Entamoeba histolytica
CDKRGENA

SEQ ID NO: 2734797 - protein, 5 aa, Entamoeba histolytica
CDLDD

SEQ ID NO: 2734798 - protein, 6 aa, Entamoeba histolytica
CDRGKQ

SEQ ID NO: 2734799 - protein, 6 aa, Entamoeba histolytica
CDTCTE

SEQ ID NO: 2734800 - protein, 9 aa, Entamoeba histolytica
CEDPIPGGK

SEQ ID NO: 2734801 - protein, 7 aa, Entamoeba histolytica
CEGLPGD

SEQ ID NO: 2734802 - protein, 4 aa, Entamoeba histolytica
CEND

SEQ ID NO: 2734803 - protein, 15 aa, Entamoeba histolytica
CESSCEENKYYDGDN

SEQ ID NO: 2734804 - protein, 12 aa, Entamoeba histolytica
CEVKSTKIQSVG

SEQ ID NO: 2734805 - protein, 15 aa, Entamoeba histolytica
CGDSTRRYIKTTSSI

SEQ ID NO: 2734806 - protein, 5 aa, Entamoeba histolytica
CGENK

SEQ ID NO: 2734807 - protein, 6 aa, Entamoeba histolytica
CGGSKR

SEQ ID NO: 2734808 - protein, 10 aa, Entamoeba histolytica
CGKNEKISSI

SEQ ID NO: 2734809 - protein, 7 aa, Entamoeba histolytica
CGSIRTG

SEQ ID NO: 2734810 - protein, 4 aa, Entamoeba histolytica
CGTY

SEQ ID NO: 2734811 - protein, 5 aa, Entamoeba histolytica
CIETS

SEQ ID NO: 2734812 - protein, 12 aa, Entamoeba histolytica
CIPSGNKFDGGF

SEQ ID NO: 2734813 - protein, 8 aa, Entamoeba histolytica
CIPSPTNP

SEQ ID NO: 2734814 - protein, 6 aa, Entamoeba histolytica
CKEGYE

SEQ ID NO: 2734815 - protein, 8 aa, Entamoeba histolytica
CKIPPNKS

SEQ ID NO: 2734816 - protein, 9 aa, Entamoeba histolytica
CKPAKHNKI

SEQ ID NO: 2734817 - protein, 13 aa, Entamoeba histolytica
CKSCEDKKCTNCK

SEQ ID NO: 2734818 - protein, 9 aa, Entamoeba histolytica
CKTNSTQYW

SEQ ID NO: 2734819 - protein, 10 aa, Entamoeba histolytica
CKTQDYKATP

SEQ ID NO: 2734820 - protein, 6 aa, Entamoeba histolytica
CKTSVN

SEQ ID NO: 2734821 - protein, 8 aa, Entamoeba histolytica
CLNKTDPN

SEQ ID NO: 2734822 - protein, 11 aa, Entamoeba histolytica
CNAGSSGYPWK

SEQ ID NO: 2734823 - protein, 14 aa, Entamoeba histolytica
CNATEPRQVFIPVF

SEQ ID NO: 2734824 - protein, 10 aa, Entamoeba histolytica
CNFPKGDPIE

SEQ ID NO: 2734825 - protein, 6 aa, Entamoeba histolytica
CNKNNK

SEQ ID NO: 2734826 - protein, 5 aa, Entamoeba histolytica
CNPGS

SEQ ID NO: 2734827 - protein, 14 aa, Entamoeba histolytica
CNPQPDNSYLDENG

SEQ ID NO: 2734828 - protein, 13 aa, Entamoeba histolytica
CPDGSDEKNTGVC

SEQ ID NO: 2734829 - protein, 6 aa, Entamoeba histolytica
CPGSTL

SEQ ID NO: 2734830 - protein, 9 aa, Entamoeba histolytica
CPYKPTEDQ

SEQ ID NO: 2734831 - protein, 4 aa, Entamoeba histolytica
CQDE

SEQ ID NO: 2734832 - protein, 5 aa, Entamoeba histolytica
CREPY

SEQ ID NO: 2734833 - protein, 8 aa, Entamoeba histolytica
CRGEQCRK

SEQ ID NO: 2734834 - protein, 14 aa, Entamoeba histolytica
CSATEARQIFIPVF

SEQ ID NO: 2734835 - protein, 8 aa, Entamoeba histolytica
CSATTTTF

SEQ ID NO: 2734836 - protein, 44 aa, Entamoeba histolytica
CSDKNSLSKLASAASNVGHSEWGHASPSNAGNYNSKPPSSTGFF

SEQ ID NO: 2734837 - protein, 13 aa, Entamoeba histolytica
CSDQDLNELNSQS

SEQ ID NO: 2734838 - protein, 5 aa, Entamoeba histolytica
CSEGQ

SEQ ID NO: 2734839 - protein, 6 aa, Entamoeba histolytica
CSEQQN

SEQ ID NO: 2734840 - protein, 5 aa, Entamoeba histolytica
CSGKS

SEQ ID NO: 2734841 - protein, 13 aa, Entamoeba histolytica
CSIDSNDFTVESD

SEQ ID NO: 2734842 - protein, 13 aa, Entamoeba histolytica
CSLNGKEEKGRFE

SEQ ID NO: 2734843 - protein, 7 aa, Entamoeba histolytica
CSNGSVE

SEQ ID NO: 2734844 - protein, 15 aa, Entamoeba histolytica
CSNKAYDKQEDEELN

SEQ ID NO: 2734845 - protein, 9 aa, Entamoeba histolytica
CSPKLTTSL

SEQ ID NO: 2734846 - protein, 24 aa, Entamoeba histolytica
CSPSSMPSSSDETITYTKVTCEND

SEQ ID NO: 2734847 - protein, 10 aa, Entamoeba histolytica
CSVSKKEEAV

SEQ ID NO: 2734848 - protein, 6 aa, Entamoeba histolytica
CTCQRE

SEQ ID NO: 2734849 - protein, 4 aa, Entamoeba histolytica
CTEK

SEQ ID NO: 2734850 - protein, 8 aa, Entamoeba histolytica
CTGLNSED

SEQ ID NO: 2734851 - protein, 25 aa, Entamoeba histolytica
CTGTPGNGDETPNHSSEEQPTNDDY

SEQ ID NO: 2734852 - protein, 5 aa, Entamoeba histolytica
CTGTR

SEQ ID NO: 2734853 - protein, 9 aa, Entamoeba histolytica
CTNANQPPF

SEQ ID NO: 2734854 - protein, 7 aa, Entamoeba histolytica
CTNKDNH

SEQ ID NO: 2734855 - protein, 5 aa, Entamoeba histolytica
CTQNQ

SEQ ID NO: 2734856 - protein, 10 aa, Entamoeba histolytica
CTQTSSTTFT

SEQ ID NO: 2734857 - protein, 5 aa, Entamoeba histolytica
CTRRG

SEQ ID NO: 2734858 - protein, 4 aa, Entamoeba histolytica
CTST

SEQ ID NO: 2734859 - protein, 5 aa, Entamoeba histolytica
CYPEG

SEQ ID NO: 2734860 - protein, 97 aa, Entamoeba histolytica
DAAKKMDDFQKKTNKVVDNAQSKVAAAQKKANNVIDKTQKTVKEVQTKVNKGLDKGQAISRKVQTKTNKAINAVGGVAKKVGKFSDKLGKTADKVAN

SEQ ID NO: 2734861 - protein, 10 aa, Entamoeba histolytica
DADKSGSLDV

SEQ ID NO: 2734862 - protein, 15 aa, Entamoeba histolytica
DAEQIKVERTTTNIK

SEQ ID NO: 2734863 - protein, 7 aa, Entamoeba histolytica
DAETNPL

SEQ ID NO: 2734864 - protein, 20 aa, Entamoeba histolytica
DAEVTRNTLKEQTKKAQKAL

SEQ ID NO: 2734865 - protein, 5 aa, Entamoeba histolytica
DAFKT

SEQ ID NO: 2734866 - protein, 8 aa, Entamoeba histolytica
DAKNRGIE

SEQ ID NO: 2734867 - protein, 7 aa, Entamoeba histolytica
DALATKD

SEQ ID NO: 2734868 - protein, 4 aa, Entamoeba histolytica
DAMN

SEQ ID NO: 2734869 - protein, 8 aa, Entamoeba histolytica
DANDPNAP

SEQ ID NO: 2734870 - protein, 65 aa, Entamoeba histolytica
DAPSPKNSKKAQKPKSNRKASTKPANTPKNNQRVKQNKKTQAPQPKRTVQTTTKKPTVASKQRKQ

SEQ ID NO: 2734871 - protein, 14 aa, Entamoeba histolytica
DAQRQATKDAGKIA

SEQ ID NO: 2734872 - protein, 14 aa, Entamoeba histolytica
DAQRQATKDAGTIA

SEQ ID NO: 2734873 - protein, 5 aa, Entamoeba histolytica
DAQSG

SEQ ID NO: 2734874 - protein, 15 aa, Entamoeba histolytica
DASDNGCEGGHPSNS

SEQ ID NO: 2734875 - protein, 7 aa, Entamoeba histolytica
DASRPSF

SEQ ID NO: 2734876 - protein, 8 aa, Entamoeba histolytica
DASVGKTG

SEQ ID NO: 2734877 - protein, 5 aa, Entamoeba histolytica
DATEY

SEQ ID NO: 2734878 - protein, 61 aa, Entamoeba histolytica
DAVTGTLAETISGAVGAKLDESSSLSKLAQATKDTVSEKVGELATSPITTGIEKGTGKLEG

SEQ ID NO: 2734879 - protein, 7 aa, Entamoeba histolytica
DCDGDDC

SEQ ID NO: 2734880 - protein, 5 aa, Entamoeba histolytica
DCDRS

SEQ ID NO: 2734881 - protein, 10 aa, Entamoeba histolytica
DCEKKPGDFF

SEQ ID NO: 2734882 - protein, 4 aa, Entamoeba histolytica
DCKT

SEQ ID NO: 2734883 - protein, 23 aa, Entamoeba histolytica
DDDMEEDDDDELEDDDDEDYEFD

SEQ ID NO: 2734884 - protein, 10 aa, Entamoeba histolytica
DDEDDFDDFE

SEQ ID NO: 2734885 - protein, 6 aa, Entamoeba histolytica
DDEEDF

SEQ ID NO: 2734886 - protein, 6 aa, Entamoeba histolytica
DDEITR

SEQ ID NO: 2734887 - protein, 8 aa, Entamoeba histolytica
DDEPEKKQ

SEQ ID NO: 2734888 - protein, 6 aa, Entamoeba histolytica
DDETKN

SEQ ID NO: 2734889 - protein, 259 aa, Entamoeba histolytica
DDEYELEDDEEDDDDDEFELEDDEEDDDEEEEDEEEEDEEEEDEEDEEDDDEEDDDEEDDDEEDDDEEDDDEEDDDEEDDDEEDDDEEDDDDEDDDDEDDDEEDDDEDDDDEDDEFELEDDDEDDDEEDDDEDDDDDEEDDDEEDDDEEDDDEEDDEEDDDDDDDDDDEDDDDDDDEEDDEEDDEEDDEEDDEEDDEEDDEEDDEEDDDEEDDEEDDEEDDEEDDDEEDDEEDDEEDDDEFELEDDDEFELEDDEEEDD

SEQ ID NO: 2734890 - protein, 229 aa, Entamoeba histolytica
DDEYELEDDEEDDDDDEFELEDDEEDDDEEEEDEEEEDEEEEDEEEEDEEDEEDDDEEDDDEEDDDEEDDDEEDDDEEDDDEEDDDEEDDDEEDDDDEDDDDEDDDEEDDDEDDDDEDDEFELEDDDEDDDEEDDDEDDDDDEEDDDEEDDDEEDDDEEDDDEEDDDEDDDDDEEDDDDDEEDDEEDDEEDDEEDDEEDDEEDDEEDDDEEDDDDEEDDDEEDDDEEDM

SEQ ID NO: 2734891 - protein, 9 aa, Entamoeba histolytica
DDGKGSTGD

SEQ ID NO: 2734892 - protein, 18 aa, Entamoeba histolytica
DDHDQQKPGSSSRDMHDQ

SEQ ID NO: 2734893 - protein, 13 aa, Entamoeba histolytica
DDIEDGSNDSTFE

SEQ ID NO: 2734894 - protein, 6 aa, Entamoeba histolytica
DDIKQQ

SEQ ID NO: 2734895 - protein, 6 aa, Entamoeba histolytica
DDIKSI

SEQ ID NO: 2734896 - protein, 9 aa, Entamoeba histolytica
DDKQKLNVT

SEQ ID NO: 2734897 - protein, 8 aa, Entamoeba histolytica
DDKSYRDN

SEQ ID NO: 2734898 - protein, 4 aa, Entamoeba histolytica
DDLD

SEQ ID NO: 2734899 - protein, 6 aa, Entamoeba histolytica
DDLKQQ

SEQ ID NO: 2734900 - protein, 4 aa, Entamoeba histolytica
DDLP

SEQ ID NO: 2734901 - protein, 6 aa, Entamoeba histolytica
DDNEKY

SEQ ID NO: 2734902 - protein, 6 aa, Entamoeba histolytica
DDNERD

SEQ ID NO: 2734903 - protein, 6 aa, Entamoeba histolytica
DDNNDI

SEQ ID NO: 2734904 - protein, 5 aa, Entamoeba histolytica
DDNVK

SEQ ID NO: 2734905 - protein, 16 aa, Entamoeba histolytica
DDQYDYNAAKQTLTNL

SEQ ID NO: 2734906 - protein, 8 aa, Entamoeba histolytica
DDSTTRRY

SEQ ID NO: 2734907 - protein, 7 aa, Entamoeba histolytica
DDTCSHR

SEQ ID NO: 2734908 - protein, 7 aa, Entamoeba histolytica
DDTTNPH

SEQ ID NO: 2734909 - protein, 44 aa, Entamoeba histolytica
DDVDELNEEEDNEEDEIDLEEGEEEDNDEYELTDDDDEDRRRRR

SEQ ID NO: 2734910 - protein, 4 aa, Entamoeba histolytica
DDVR

SEQ ID NO: 2734911 - protein, 5 aa, Entamoeba histolytica
DEAGF

SEQ ID NO: 2734912 - protein, 25 aa, Entamoeba histolytica
DECDPSESSLSPLSDQIQKNYTKGC

SEQ ID NO: 2734913 - protein, 10 aa, Entamoeba histolytica
DECSTETGCN

SEQ ID NO: 2734914 - protein, 9 aa, Entamoeba histolytica
DEEFSNKDK

SEQ ID NO: 2734915 - protein, 7 aa, Entamoeba histolytica
DEEKPSR

SEQ ID NO: 2734916 - protein, 8 aa, Entamoeba histolytica
DEEMKDNS

SEQ ID NO: 2734917 - protein, 10 aa, Entamoeba histolytica
DEENGFKMNE

SEQ ID NO: 2734918 - protein, 6 aa, Entamoeba histolytica
DEFDDT

SEQ ID NO: 2734919 - protein, 4 aa, Entamoeba histolytica
DEFE

SEQ ID NO: 2734920 - protein, 8 aa, Entamoeba histolytica
DEGKQGNY

SEQ ID NO: 2734921 - protein, 5 aa, Entamoeba histolytica
DEIAE

SEQ ID NO: 2734922 - protein, 15 aa, Entamoeba histolytica
DEITNNQDSNQTGIT

SEQ ID NO: 2734923 - protein, 9 aa, Entamoeba histolytica
DEKGEAEGY

SEQ ID NO: 2734924 - protein, 24 aa, Entamoeba histolytica
DELEEEEDEMDYESYENDDDMYED

SEQ ID NO: 2734925 - protein, 7 aa, Entamoeba histolytica
DELPPEY

SEQ ID NO: 2734926 - protein, 6 aa, Entamoeba histolytica
DELQEI

SEQ ID NO: 2734927 - protein, 37 aa, Entamoeba histolytica
DENSINPSIERAKAVAKKVKKAAKITKKYTKGTPCGD

SEQ ID NO: 2734928 - protein, 4 aa, Entamoeba histolytica
DEPT

SEQ ID NO: 2734929 - protein, 10 aa, Entamoeba histolytica
DERDKLRSTI

SEQ ID NO: 2734930 - protein, 9 aa, Entamoeba histolytica
DESASKTLE

SEQ ID NO: 2734931 - protein, 11 aa, Entamoeba histolytica
DESTESTSGTD

SEQ ID NO: 2734932 - protein, 4 aa, Entamoeba histolytica
DESY

SEQ ID NO: 2734933 - protein, 5 aa, Entamoeba histolytica
DEVQE

SEQ ID NO: 2734934 - protein, 5 aa, Entamoeba histolytica
DEVTL

SEQ ID NO: 2734935 - protein, 5 aa, Entamoeba histolytica
DEYKS

SEQ ID NO: 2734936 - protein, 6 aa, Entamoeba histolytica
DEYNNG

SEQ ID NO: 2734937 - protein, 6 aa, Entamoeba histolytica
DFPYPL

SEQ ID NO: 2734938 - protein, 6 aa, Entamoeba histolytica
DFSSEF

SEQ ID NO: 2734939 - protein, 13 aa, Entamoeba histolytica
DGAEIKESALSDV

SEQ ID NO: 2734940 - protein, 13 aa, Entamoeba histolytica
DGANGNDGFPDGF

SEQ ID NO: 2734941 - protein, 13 aa, Entamoeba histolytica
DGANGNDGFPDGL

SEQ ID NO: 2734942 - protein, 5 aa, Entamoeba histolytica
DGDEV

SEQ ID NO: 2734943 - protein, 7 aa, Entamoeba histolytica
DGDLGDL

SEQ ID NO: 2734944 - protein, 7 aa, Entamoeba histolytica
DGDLSDL

SEQ ID NO: 2734945 - protein, 8 aa, Entamoeba histolytica
DGDPWPPV

SEQ ID NO: 2734946 - protein, 8 aa, Entamoeba histolytica
DGDSPKEV

SEQ ID NO: 2734947 - protein, 4 aa, Entamoeba histolytica
DGDV

SEQ ID NO: 2734948 - protein, 7 aa, Entamoeba histolytica
DGEETEL

SEQ ID NO: 2734949 - protein, 14 aa, Entamoeba histolytica
DGFGVENDDKEYDE

SEQ ID NO: 2734950 - protein, 17 aa, Entamoeba histolytica
DGIKSTLETEKKALEGL

SEQ ID NO: 2734951 - protein, 4 aa, Entamoeba histolytica
DGIP

SEQ ID NO: 2734952 - protein, 7 aa, Entamoeba histolytica
DGLTTKH

SEQ ID NO: 2734953 - protein, 9 aa, Entamoeba histolytica
DGNLDGPFQ

SEQ ID NO: 2734954 - protein, 6 aa, Entamoeba histolytica
DGNTIT

SEQ ID NO: 2734955 - protein, 4 aa, Entamoeba histolytica
DGPQ

SEQ ID NO: 2734956 - protein, 8 aa, Entamoeba histolytica
DGQKKVST

SEQ ID NO: 2734957 - protein, 7 aa, Entamoeba histolytica
DGRRDDL

SEQ ID NO: 2734958 - protein, 10 aa, Entamoeba histolytica
DGSDEKEGLC

SEQ ID NO: 2734959 - protein, 4 aa, Entamoeba histolytica
DGST

SEQ ID NO: 2734960 - protein, 5 aa, Entamoeba histolytica
DGSVI

SEQ ID NO: 2734961 - protein, 7 aa, Entamoeba histolytica
DGSYEKL

SEQ ID NO: 2734962 - protein, 7 aa, Entamoeba histolytica
DGSYRAD

SEQ ID NO: 2734963 - protein, 4 aa, Entamoeba histolytica
DGTF

SEQ ID NO: 2734964 - protein, 6 aa, Entamoeba histolytica
DGTTSF

SEQ ID NO: 2734965 - protein, 8 aa, Entamoeba histolytica
DGYGGHTT

SEQ ID NO: 2734966 - protein, 8 aa, Entamoeba histolytica
DGYKMKPG

SEQ ID NO: 2734967 - protein, 4 aa, Entamoeba histolytica
DGYY

SEQ ID NO: 2734968 - protein, 18 aa, Entamoeba histolytica
DHGGEEALKNNGGGPHMN

SEQ ID NO: 2734969 - protein, 8 aa, Entamoeba histolytica
DHTPSNCP

SEQ ID NO: 2734970 - protein, 7 aa, Entamoeba histolytica
DIDEAEK

SEQ ID NO: 2734971 - protein, 11 aa, Entamoeba histolytica
DIDESTSKSLT

SEQ ID NO: 2734972 - protein, 7 aa, Entamoeba histolytica
DIDNRAK

SEQ ID NO: 2734973 - protein, 6 aa, Entamoeba histolytica
DIEEYR

SEQ ID NO: 2734974 - protein, 11 aa, Entamoeba histolytica
DIEGENQQHKR

SEQ ID NO: 2734975 - protein, 8 aa, Entamoeba histolytica
DIEGSIND

SEQ ID NO: 2734976 - protein, 9 aa, Entamoeba histolytica
DIKGSINDR

SEQ ID NO: 2734977 - protein, 5 aa, Entamoeba histolytica
DINNM

SEQ ID NO: 2734978 - protein, 13 aa, Entamoeba histolytica
DISNEPSEQVTGC

SEQ ID NO: 2734979 - protein, 4 aa, Entamoeba histolytica
DISQ

SEQ ID NO: 2734980 - protein, 4 aa, Entamoeba histolytica
DKAC

SEQ ID NO: 2734981 - protein, 8 aa, Entamoeba histolytica
DKASKGRT

SEQ ID NO: 2734982 - protein, 9 aa, Entamoeba histolytica
DKDATGLPY

SEQ ID NO: 2734983 - protein, 10 aa, Entamoeba histolytica
DKEAGNGKSK

SEQ ID NO: 2734984 - protein, 14 aa, Entamoeba histolytica
DKECKTSSDVKQYT

SEQ ID NO: 2734985 - protein, 15 aa, Entamoeba histolytica
DKECKTSSDVKQYTV

SEQ ID NO: 2734986 - protein, 15 aa, Entamoeba histolytica
DKEDECNSKKLPTKI

SEQ ID NO: 2734987 - protein, 4 aa, Entamoeba histolytica
DKEF

SEQ ID NO: 2734988 - protein, 18 aa, Entamoeba histolytica
DKETDEVEKQKKKMEEVE

SEQ ID NO: 2734989 - protein, 5 aa, Entamoeba histolytica
DKETM

SEQ ID NO: 2734990 - protein, 6 aa, Entamoeba histolytica
DKEVQR

SEQ ID NO: 2734991 - protein, 7 aa, Entamoeba histolytica
DKFKPSQ

SEQ ID NO: 2734992 - protein, 20 aa, Entamoeba histolytica
DKGIGKASKYIGKGTSEWLG

SEQ ID NO: 2734993 - protein, 9 aa, Entamoeba histolytica
DKINTKTTS

SEQ ID NO: 2734994 - protein, 10 aa, Entamoeba histolytica
DKKCRSDKST

SEQ ID NO: 2734995 - protein, 9 aa, Entamoeba histolytica
DKKERSVAV

SEQ ID NO: 2734996 - protein, 22 aa, Entamoeba histolytica
DKKKGVSLPTSLESSPGKTTSC

SEQ ID NO: 2734997 - protein, 4 aa, Entamoeba histolytica
DKLT

SEQ ID NO: 2734998 - protein, 7 aa, Entamoeba histolytica
DKLTTSS

SEQ ID NO: 2734999 - protein, 6 aa, Entamoeba histolytica
DKNNGK

SEQ ID NO: 2735000 - protein, 5 aa, Entamoeba histolytica
DKPFN

SEQ ID NO: 2735001 - protein, 7 aa, Entamoeba histolytica
DKPKTEI

SEQ ID NO: 2735002 - protein, 8 aa, Entamoeba histolytica
DKQSQRKV

SEQ ID NO: 2735003 - protein, 10 aa, Entamoeba histolytica
DKQYDKTHGF

SEQ ID NO: 2735004 - protein, 10 aa, Entamoeba histolytica
DKRAKEIESK

SEQ ID NO: 2735005 - protein, 13 aa, Entamoeba histolytica
DKRSVRYANGGYE

SEQ ID NO: 2735006 - protein, 5 aa, Entamoeba histolytica
DKSGF

SEQ ID NO: 2735007 - protein, 7 aa, Entamoeba histolytica
DKSPHSR

SEQ ID NO: 2735008 - protein, 9 aa, Entamoeba histolytica
DKSTGIPEE

SEQ ID NO: 2735009 - protein, 9 aa, Entamoeba histolytica
DKTKTTSID

SEQ ID NO: 2735010 - protein, 8 aa, Entamoeba histolytica
DKTNVSSI

SEQ ID NO: 2735011 - protein, 18 aa, Entamoeba histolytica
DKTSQEVTVTEEQKKIQM

SEQ ID NO: 2735012 - protein, 7 aa, Entamoeba histolytica
DKVGKKV

SEQ ID NO: 2735013 - protein, 7 aa, Entamoeba histolytica
DKVTTQT

SEQ ID NO: 2735014 - protein, 9 aa, Entamoeba histolytica
DKYKEENKK

SEQ ID NO: 2735015 - protein, 18 aa, Entamoeba histolytica
DKYLSSNRTCQSNNELNG

SEQ ID NO: 2735016 - protein, 6 aa, Entamoeba histolytica
DKYPEF

SEQ ID NO: 2735017 - protein, 7 aa, Entamoeba histolytica
DLEEQRQ

SEQ ID NO: 2735018 - protein, 5 aa, Entamoeba histolytica
DLENQ

SEQ ID NO: 2735019 - protein, 10 aa, Entamoeba histolytica
DLEQPTYNTV

SEQ ID NO: 2735020 - protein, 11 aa, Entamoeba histolytica
DLGKGEHGTVI

SEQ ID NO: 2735021 - protein, 7 aa, Entamoeba histolytica
DLGPYQS

SEQ ID NO: 2735022 - protein, 10 aa, Entamoeba histolytica
DLKKKSTKLV

SEQ ID NO: 2735023 - protein, 23 aa, Entamoeba histolytica
DLKKQIKKEEKKAAQKSIKKVNT

SEQ ID NO: 2735024 - protein, 26 aa, Entamoeba histolytica
DLLDSDEGLDDDDELDLDDDDEDLEE

SEQ ID NO: 2735025 - protein, 6 aa, Entamoeba histolytica
DLNPTN

SEQ ID NO: 2735026 - protein, 11 aa, Entamoeba histolytica
DLNRKRKIEAT

SEQ ID NO: 2735027 - protein, 18 aa, Entamoeba histolytica
DLPDRQVTKEEGEAFAKE

SEQ ID NO: 2735028 - protein, 10 aa, Entamoeba histolytica
DLPKKEAPEI

SEQ ID NO: 2735029 - protein, 6 aa, Entamoeba histolytica
DLPTIT

SEQ ID NO: 2735030 - protein, 9 aa, Entamoeba histolytica
DLRPDDLDT

SEQ ID NO: 2735031 - protein, 4 aa, Entamoeba histolytica
DLSE

SEQ ID NO: 2735032 - protein, 4 aa, Entamoeba histolytica
DLSG

SEQ ID NO: 2735033 - protein, 6 aa, Entamoeba histolytica
DLSPNS

SEQ ID NO: 2735034 - protein, 10 aa, Entamoeba histolytica
DLSPSNYALS

SEQ ID NO: 2735035 - protein, 4 aa, Entamoeba histolytica
DMEG

SEQ ID NO: 2735036 - protein, 30 aa, Entamoeba histolytica; identical to SEQ ID NO: 2416735

SEQ ID NO: 2735037 - protein, 14 aa, Entamoeba histolytica
DMSNTTANAQGNKA

SEQ ID NO: 2735038 - protein, 7 aa, Entamoeba histolytica
DMSTEGL

SEQ ID NO: 2735039 - protein, 10 aa, Entamoeba histolytica
DNAPYTLGQA

SEQ ID NO: 2735040 - protein, 6 aa, Entamoeba histolytica
DNASFN

SEQ ID NO: 2735041 - protein, 31 aa, Entamoeba histolytica; identical to SEQ ID NO: 2548610

SEQ ID NO: 2735042 - protein, 13 aa, Entamoeba histolytica
DNECNEPKSIESI

SEQ ID NO: 2735043 - protein, 22 aa, Entamoeba histolytica
DNEKTIKKSNFKEPDCQQSTDF

SEQ ID NO: 2735044 - protein, 217 aa, Entamoeba histolytica
DNELEEDDDDEFELEDEDDDDDDEDEEDEEEDDDDDEEEEEDDDEFELEDEEDEDDDDEEDDDDEDDDEDEEDDDDEEDEEEDDDDEFELEDEEDEEDEEDDDDDDEDDEDDEDDEDDEDDEDDDDDDEDEEEEDDDEFELEDEEDEDDDEDEEDEDDDEFELEDEDEDEDEEEDEDDEEEEEEDDDEDEEEDDDEDDDEDDEDDEDVDEDDEDVDD

SEQ ID NO: 2735045 - protein, 220 aa, Entamoeba histolytica
DNELEEDDDDEFELEDEDDDDDDEDEEDEEEDDDDDEEEEEDDDEFELEDEEDEDDDDEEDDDDEDDDEDEEDDDDEEDEEEDDDDEFELEDEEDEEDEEDDDDDDEDDEDDEDDEDDEDDEDDEDDDDDDEDEEEEDDDEFELEDEEDEDDDEDEEDEDDDEFELEDEDEDEDEEEDEDDEEEEEEDDDEDEEEDDDEDDDEDDEDDEDVDEDDEDVDD

SEQ ID NO: 2735046 - protein, 10 aa, Entamoeba histolytica
DNGLSMKDGT

SEQ ID NO: 2735047 - protein, 14 aa, Entamoeba histolytica
DNIHTDGNKTYEHR

SEQ ID NO: 2735048 - protein, 6 aa, Entamoeba histolytica
DNISED

SEQ ID NO: 2735049 - protein, 5 aa, Entamoeba histolytica
DNKEV

SEQ ID NO: 2735050 - protein, 4 aa, Entamoeba histolytica
DNKP

SEQ ID NO: 2735051 - protein, 10 aa, Entamoeba histolytica
DNKPNNYASD

SEQ ID NO: 2735052 - protein, 7 aa, Entamoeba histolytica
DNKTQLY

SEQ ID NO: 2735053 - protein, 4 aa, Entamoeba histolytica
DNNI

SEQ ID NO: 2735054 - protein, 8 aa, Entamoeba histolytica
DNNSPNAP

SEQ ID NO: 2735055 - protein, 9 aa, Entamoeba histolytica
DNPSHDYKK

SEQ ID NO: 2735056 - protein, 7 aa, Entamoeba histolytica
DNQPNEM

SEQ ID NO: 2735057 - protein, 8 aa, Entamoeba histolytica
DNQQLDNN

SEQ ID NO: 2735058 - protein, 7 aa, Entamoeba histolytica
DNQSLQF

SEQ ID NO: 2735059 - protein, 6 aa, Entamoeba histolytica
DNRPIT

SEQ ID NO: 2735060 - protein, 5 aa, Entamoeba histolytica
DNSND

SEQ ID NO: 2735061 - protein, 8 aa, Entamoeba histolytica
DNSPSFSD

SEQ ID NO: 2735062 - protein, 8 aa, Entamoeba histolytica
DNTDKAAK

SEQ ID NO: 2735063 - protein, 10 aa, Entamoeba histolytica
DNTTQEDKRS

SEQ ID NO: 2735064 - protein, 7 aa, Entamoeba histolytica
DNYPSEY

SEQ ID NO: 2735065 - protein, 10 aa, Entamoeba histolytica
DPIKPEDQKD

SEQ ID NO: 2735066 - protein, 8 aa, Entamoeba histolytica
DPKDSKML

SEQ ID NO: 2735067 - protein, 11 aa, Entamoeba histolytica
DPKERLTPDQA

SEQ ID NO: 2735068 - protein, 6 aa, Entamoeba histolytica
DPKTFE

SEQ ID NO: 2735069 - protein, 10 aa, Entamoeba histolytica
DPLNTNETQK

SEQ ID NO: 2735070 - protein, 5 aa, Entamoeba histolytica
DPNKK

SEQ ID NO: 2735071 - protein, 20 aa, Entamoeba histolytica
DPSYENLTKNNGLNHMKPKL

SEQ ID NO: 2735072 - protein, 5 aa, Entamoeba histolytica
DPTKD

SEQ ID NO: 2735073 - protein, 16 aa, Entamoeba histolytica
DPTNNFEKLKDSSDRY

SEQ ID NO: 2735074 - protein, 8 aa, Entamoeba histolytica
DPTTTGCL

SEQ ID NO: 2735075 - protein, 7 aa, Entamoeba histolytica
DPTTYQE

SEQ ID NO: 2735076 - protein, 24 aa, Entamoeba histolytica
DPYHKSNDCLEKSNEVCNEYGEPD

SEQ ID NO: 2735077 - protein, 4 aa, Entamoeba histolytica
DPYI

SEQ ID NO: 2735078 - protein, 5 aa, Entamoeba histolytica
DPYSR

SEQ ID NO: 2735079 - protein, 7 aa, Entamoeba histolytica
DQCEQRK

SEQ ID NO: 2735080 - protein, 5 aa, Entamoeba histolytica
DQEVT

SEQ ID NO: 2735081 - protein, 8 aa, Entamoeba histolytica
DQGNRITP

SEQ ID NO: 2735082 - protein, 4 aa, Entamoeba histolytica
DQIE

SEQ ID NO: 2735083 - protein, 5 aa, Entamoeba histolytica
DQLNS

SEQ ID NO: 2735084 - protein, 6 aa, Entamoeba histolytica
DQPQDN

SEQ ID NO: 2735085 - protein, 7 aa, Entamoeba histolytica
DQSSTAY

SEQ ID NO: 2735086 - protein, 7 aa, Entamoeba histolytica
DQTNNNN

SEQ ID NO: 2735087 - protein, 12 aa, Entamoeba histolytica
DQTRSDKCTQCR

SEQ ID NO: 2735088 - protein, 6 aa, Entamoeba histolytica
DQTSVS

SEQ ID NO: 2735089 - protein, 6 aa, Entamoeba histolytica
DQYAEQ

SEQ ID NO: 2735090 - protein, 5 aa, Entamoeba histolytica
DQYDL

SEQ ID NO: 2735091 - protein, 13 aa, Entamoeba histolytica
DRARKRRENEIKT

SEQ ID NO: 2735092 - protein, 6 aa, Entamoeba histolytica
DRGYEE

SEQ ID NO: 2735093 - protein, 10 aa, Entamoeba histolytica
DRKEKTKIKH

SEQ ID NO: 2735094 - protein, 4 aa, Entamoeba histolytica
DRKH

SEQ ID NO: 2735095 - protein, 8 aa, Entamoeba histolytica
DRKNSNQR

SEQ ID NO: 2735096 - protein, 9 aa, Entamoeba histolytica
DRNKEVEQK

SEQ ID NO: 2735097 - protein, 4 aa, Entamoeba histolytica
DRPI

SEQ ID NO: 2735098 - protein, 6 aa, Entamoeba histolytica
DRPNAF

SEQ ID NO: 2735099 - protein, 15 aa, Entamoeba histolytica
DRQLARQKIREEKRA

SEQ ID NO: 2735100 - protein, 9 aa, Entamoeba histolytica
DRSNADNYK

SEQ ID NO: 2735101 - protein, 5 aa, Entamoeba histolytica
DRSPW

SEQ ID NO: 2735102 - protein, 72 aa, Entamoeba histolytica
  misc_feature (18)..(51): Xaa can be any naturally occurring amino acid
DRTFDEDEFDSLEEFIKXXXXXXXXXXXXXXXXXXXXXXXXXXXXXXXXXXSELGFFLVDKTSSSLLKNKTE

SEQ ID NO: 2735103 - protein, 12 aa, Entamoeba histolytica
DSANFKGSRPSG

SEQ ID NO: 2735104 - protein, 25 aa, Entamoeba histolytica
DSASTTTNKTNVSTKKELTKEEKAK

SEQ ID NO: 2735105 - protein, 5 aa, Entamoeba histolytica
DSASY

SEQ ID NO: 2735106 - protein, 6 aa, Entamoeba histolytica
DSCTNP

SEQ ID NO: 2735107 - protein, 6 aa, Entamoeba histolytica
DSDPIF

SEQ ID NO: 2735108 - protein, 5 aa, Entamoeba histolytica
DSECT

SEQ ID NO: 2735109 - protein, 13 aa, Entamoeba histolytica
DSECTKPTGFVED

SEQ ID NO: 2735110 - protein, 14 aa, Entamoeba histolytica
DSECTKPTGYVENQ

SEQ ID NO: 2735111 - protein, 7 aa, Entamoeba histolytica
DSEDLTK

SEQ ID NO: 2735112 - protein, 4 aa, Entamoeba histolytica
DSEL

SEQ ID NO: 2735113 - protein, 8 aa, Entamoeba histolytica
DSGVGKTS

SEQ ID NO: 2735114 - protein, 14 aa, Entamoeba histolytica
DSKASYKAVYPFVC

SEQ ID NO: 2735115 - protein, 8 aa, Entamoeba histolytica
DSKGNEYI

SEQ ID NO: 2735116 - protein, 15 aa, Entamoeba histolytica
DSNGEVECQDNKGKA

SEQ ID NO: 2735117 - protein, 9 aa, Entamoeba histolytica
DSNKQKHAV

SEQ ID NO: 2735118 - protein, 6 aa, Entamoeba histolytica
DSNTSV

SEQ ID NO: 2735119 - protein, 10 aa, Entamoeba histolytica
DSNYTMEENQ

SEQ ID NO: 2735120 - protein, 4 aa, Entamoeba histolytica
DSPR

SEQ ID NO: 2735121 - protein, 8 aa, Entamoeba histolytica
DSPTNVET

SEQ ID NO: 2735122 - protein, 13 aa, Entamoeba histolytica
DSQYKSTLDGEKQ

SEQ ID NO: 2735123 - protein, 20 aa, Entamoeba histolytica
DSRIKSTTTAWSNTNRNQLR

SEQ ID NO: 2735124 - protein, 7 aa, Entamoeba histolytica
DSSDTSL

SEQ ID NO: 2735125 - protein, 7 aa, Entamoeba histolytica
DSSSCGQ

SEQ ID NO: 2735126 - protein, 10 aa, Entamoeba histolytica
DSSSMSPSDW

SEQ ID NO: 2735127 - protein, 8 aa, Entamoeba histolytica
DSTTEITI

SEQ ID NO: 2735128 - protein, 16 aa, Entamoeba histolytica
DSTTFSKEIQRNEEEW

SEQ ID NO: 2735129 - protein, 10 aa, Entamoeba histolytica
DSVPKGNNFE

SEQ ID NO: 2735130 - protein, 7 aa, Entamoeba histolytica
DSVPNKE

SEQ ID NO: 2735131 - protein, 4 aa, Entamoeba histolytica
DSYQ

SEQ ID NO: 2735132 - protein, 8 aa, Entamoeba histolytica
DTAGSEQF

SEQ ID NO: 2735133 - protein, 8 aa, Entamoeba histolytica
DTCGQEQY

SEQ ID NO: 2735134 - protein, 8 aa, Entamoeba histolytica
DTCGSDRF

SEQ ID NO: 2735135 - protein, 6 aa, Entamoeba histolytica
DTCNAC

SEQ ID NO: 2735136 - protein, 7 aa, Entamoeba histolytica
DTDDALK

SEQ ID NO: 2735137 - protein, 6 aa, Entamoeba histolytica
DTDDVP

SEQ ID NO: 2735138 - protein, 4 aa, Entamoeba histolytica
DTEA

SEQ ID NO: 2735139 - protein, 6 aa, Entamoeba histolytica
DTFDKN

SEQ ID NO: 2735140 - protein, 11 aa, Entamoeba histolytica
DTGCSNCDENK

SEQ ID NO: 2735141 - protein, 7 aa, Entamoeba histolytica
DTKRREP

SEQ ID NO: 2735142 - protein, 12 aa, Entamoeba histolytica
DTLNAKKNSGIF

SEQ ID NO: 2735143 - protein, 11 aa, Entamoeba histolytica
DTLPKSNDKEG

SEQ ID NO: 2735144 - protein, 6 aa, Entamoeba histolytica
DTMQYT

SEQ ID NO: 2735145 - protein, 10 aa, Entamoeba histolytica
DTNQSNRSIA

SEQ ID NO: 2735146 - protein, 9 aa, Entamoeba histolytica
DTPAHTASW

SEQ ID NO: 2735147 - protein, 7 aa, Entamoeba histolytica
DTPGFTC

SEQ ID NO: 2735148 - protein, 7 aa, Entamoeba histolytica
DTQERDI

SEQ ID NO: 2735149 - protein, 5 aa, Entamoeba histolytica
DTSTI

SEQ ID NO: 2735150 - protein, 5 aa, Entamoeba histolytica
DTTEV

SEQ ID NO: 2735151 - protein, 10 aa, Entamoeba histolytica
DTTLSIPKRN

SEQ ID NO: 2735152 - protein, 5 aa, Entamoeba histolytica
DTVTS

SEQ ID NO: 2735153 - protein, 8 aa, Entamoeba histolytica
DTYPSQKG

SEQ ID NO: 2735154 - protein, 6 aa, Entamoeba histolytica
DTYYKK

SEQ ID NO: 2735155 - protein, 13 aa, Entamoeba histolytica
DVDDNYQPFPQKC

SEQ ID NO: 2735156 - protein, 6 aa, Entamoeba histolytica
DVKNNK

SEQ ID NO: 2735157 - protein, 7 aa, Entamoeba histolytica
DVKSTAI

SEQ ID NO: 2735158 - protein, 8 aa, Entamoeba histolytica
DVPNQETN

SEQ ID NO: 2735159 - protein, 7 aa, Entamoeba histolytica
DVPNRGR

SEQ ID NO: 2735160 - protein, 6 aa, Entamoeba histolytica
DVSNEV

SEQ ID NO: 2735161 - protein, 11 aa, Entamoeba histolytica
DVSQPTSASSI

SEQ ID NO: 2735162 - protein, 7 aa, Entamoeba histolytica
DWTPENG

SEQ ID NO: 2735163 - protein, 11 aa, Entamoeba histolytica
DYATKQNVLGG

SEQ ID NO: 2735164 - protein, 4 aa, Entamoeba histolytica
DYDY

SEQ ID NO: 2735165 - protein, 10 aa, Entamoeba histolytica
DYKASNAWRV

SEQ ID NO: 2735166 - protein, 7 aa, Entamoeba histolytica
DYNGGNV

SEQ ID NO: 2735167 - protein, 8 aa, Entamoeba histolytica
DYSAAYGY

SEQ ID NO: 2735168 - protein, 11 aa, Entamoeba histolytica
DYSPSYSGRGD

SEQ ID NO: 2735169 - protein, 8 aa, Entamoeba histolytica
DYSSWPPY

SEQ ID NO: 2735170 - protein, 6 aa, Entamoeba histolytica
DYTNYQ

SEQ ID NO: 2735171 - protein, 10 aa, Entamoeba histolytica
DYYTVSAEDT

SEQ ID NO: 2735172 - protein, 4 aa, Entamoeba histolytica
EAAA

SEQ ID NO: 2735173 - protein, 6 aa, Entamoeba histolytica
EAATAG

SEQ ID NO: 2735174 - protein, 7 aa, Entamoeba histolytica
EADDQIR

SEQ ID NO: 2735175 - protein, 292 aa, Entamoeba histolytica
EAEVTEPTIKESNAKGTHTETPTNTDEEKKKEQMSQDKHEEVEGQEKNLQSQEQKNSVVDEKKNTVSGEEKQNKGDGQQDKAAEKQTPTTDTEHNKQKDSITSNEGGSQEKQEGKQNEESEKGKIGQGQKAKEKEEGNEVENGGGIKEEKTKNEEEQKGEESKENHTGDDKKSQGENEKVNENDQNSKETKAEEQGKEKEEEKEKGEEKSGESEQSKGTTQEKNTEKQESQKEGEKVDKTEEEKKESDNKNQEKKSEEKEQKEEKSPNSSESKTESESDELNGHNNIDGTTP

SEQ ID NO: 2735176 - protein, 14 aa, Entamoeba histolytica
EAFDEERKVENRKI

SEQ ID NO: 2735177 - protein, 8 aa, Entamoeba histolytica
EAGNIPPE

SEQ ID NO: 2735178 - protein, 8 aa, Entamoeba histolytica
EAGSSMDK

SEQ ID NO: 2735179 - protein, 7 aa, Entamoeba histolytica
EAKKVNP

SEQ ID NO: 2735180 - protein, 347 aa, Entamoeba histolytica
EAKPTPQEKPSVTATNTHEEEKSKGNTEGGAQNEATTKNSETGESKKQEGSGNGQTSEGENKAIKGTEVSGGGSSSNQKVSSGENSAETGAPSASGSATTGKGGKGSESEHTVESGTSGQGGSETTSEGSKVSEKTDVKNQESGGSQTVGQEGQGQKENGETGGKTDKGSSGTSSSQTQEQNSQNINGKGEVGGSDSSGKSGKEGQPSGGEKGDSGQEAGKEQKEQAGNEGATGEGKKESDSGVAGEGQKENENKGSVDDNKSDSKGGDGEKGNDGVAGNQAKDNKETEGQTDNNEQNNQQQNEQNNTKVDNNEEHKDNKTTNTSESKPDNKTDVDSTSYTNLDSSS

SEQ ID NO: 2735181 - protein, 24 aa, Entamoeba histolytica
EAKRRNTETKEAVEKVKQAEHKER

SEQ ID NO: 2735182 - protein, 24 aa, Entamoeba histolytica
EAKTAPKVVAPKATKSSTQAPQVI

SEQ ID NO: 2735183 - protein, 7 aa, Entamoeba histolytica
EALKRNA

SEQ ID NO: 2735184 - protein, 8 aa, Entamoeba histolytica
EANQFAES

SEQ ID NO: 2735185 - protein, 9 aa, Entamoeba histolytica
EANSGESRV

SEQ ID NO: 2735186 - protein, 179 aa, Entamoeba histolytica
EAPSESVPQALKEGAETVSQGTTTTVQQEQGSRVTTHGDATGTLSQLGSASAGVSSTSQPQVPSGQGDGVSSTGVSSQSGGSTQAEQTTHSIETSSQTKPSGASTTSSEGGATKGGAEAITTVPADTAQQSTPTTSTTGSTSSTTQSKPSTPITPPQSSSAVGITETTTHLGDTPSPVT

SEQ ID NO: 2735187 - protein, 24 aa, Entamoeba histolytica
EAQERSGEDNKAKKMIESRNELEN

SEQ ID NO: 2735188 - protein, 4 aa, Entamoeba histolytica
EAQR

SEQ ID NO: 2735189 - protein, 19 aa, Entamoeba histolytica
EASERTRIRKQANKFAKDL

SEQ ID NO: 2735190 - protein, 5 aa, Entamoeba histolytica
EASQL

SEQ ID NO: 2735191 - protein, 6 aa, Entamoeba histolytica
EATAET

SEQ ID NO: 2735192 - protein, 13 aa, Entamoeba histolytica
EATRKEAEEMKKK

SEQ ID NO: 2735193 - protein, 10 aa, Entamoeba histolytica
ECEESHVSGS

SEQ ID NO: 2735194 - protein, 4 aa, Entamoeba histolytica
ECEK

SEQ ID NO: 2735195 - protein, 12 aa, Entamoeba histolytica
ECEKKTPNGLEG

SEQ ID NO: 2735196 - protein, 5 aa, Entamoeba histolytica
ECFTE

SEQ ID NO: 2735197 - protein, 6 aa, Entamoeba histolytica
ECGERK

SEQ ID NO: 2735198 - protein, 6 aa, Entamoeba histolytica
ECNSCE

SEQ ID NO: 2735199 - protein, 8 aa, Entamoeba histolytica
ECPQSPKK

SEQ ID NO: 2735200 - protein, 10 aa, Entamoeba histolytica
ECRETQSAYE

SEQ ID NO: 2735201 - protein, 8 aa, Entamoeba histolytica
ECSQSSPR

SEQ ID NO: 2735202 - protein, 8 aa, Entamoeba histolytica
ECSSCSTN

SEQ ID NO: 2735203 - protein, 5 aa, Entamoeba histolytica
ECTSC

SEQ ID NO: 2735204 - protein, 7 aa, Entamoeba histolytica
EDAPHVH

SEQ ID NO: 2735205 - protein, 190 aa, Entamoeba histolytica
EDATLDNKETENNDELNIEDNDDEEYDDDDEEYDDDDDEDDDEDDDEDDDEDDDEDDDEDDDEDDDEDDDEDDDEDDDEDDDEDDDEDDDEDDDEDDDEDDDEDDDEDDDEDEEYDLEDDDFDYDDDDDFELEEDEEDDDEEEDDEDEDDDDDEDDDEDDDDEDDDEDEDDDEDDDDEDDDEDEDDDEDD

SEQ ID NO: 2735206 - protein, 9 aa, Entamoeba histolytica
EDDDNSSSI

SEQ ID NO: 2735207 - protein, 9 aa, Entamoeba histolytica
EDDEEEQVR

SEQ ID NO: 2735208 - protein, 17 aa, Entamoeba histolytica
EDEEDEEDDTEEEEEYE

SEQ ID NO: 2735209 - protein, 5 aa, Entamoeba histolytica
EDEEL

SEQ ID NO: 2735210 - protein, 6 aa, Entamoeba histolytica
EDEGNF

SEQ ID NO: 2735211 - protein, 19 aa, Entamoeba histolytica
EDELKEFKKEKSGNNQLEP

SEQ ID NO: 2735212 - protein, 9 aa, Entamoeba histolytica
EDEMRRNAP

SEQ ID NO: 2735213 - protein, 10 aa, Entamoeba histolytica
EDEVPMEEQG

SEQ ID NO: 2735214 - protein, 12 aa, Entamoeba histolytica
EDEYNEDEEYNL

SEQ ID NO: 2735215 - protein, 5 aa, Entamoeba histolytica
EDGIQ

SEQ ID NO: 2735216 - protein, 8 aa, Entamoeba histolytica
EDGNIKEK

SEQ ID NO: 2735217 - protein, 7 aa, Entamoeba histolytica
EDGTTKK

SEQ ID NO: 2735218 - protein, 12 aa, Entamoeba histolytica
EDITDPESHEVR

SEQ ID NO: 2735219 - protein, 8 aa, Entamoeba histolytica
EDKKEQAI

SEQ ID NO: 2735220 - protein, 14 aa, Entamoeba histolytica
EDKVKASQLVPALI

SEQ ID NO: 2735221 - protein, 4 aa, Entamoeba histolytica
EDLQ

SEQ ID NO: 2735222 - protein, 8 aa, Entamoeba histolytica
EDQIRGED

SEQ ID NO: 2735223 - protein, 9 aa, Entamoeba histolytica
EDSGMSKGS

SEQ ID NO: 2735224 - protein, 10 aa, Entamoeba histolytica
EDTEKAKKEY

SEQ ID NO: 2735225 - protein, 11 aa, Entamoeba histolytica
EDTEMATTRKD

SEQ ID NO: 2735226 - protein, 5 aa, Entamoeba histolytica
EDTHL

SEQ ID NO: 2735227 - protein, 13 aa, Entamoeba histolytica
EDTKQEDKVDGPV

SEQ ID NO: 2735228 - protein, 9 aa, Entamoeba histolytica
EDTKSDYYP

SEQ ID NO: 2735229 - protein, 4 aa, Entamoeba histolytica
EDYG

SEQ ID NO: 2735230 - protein, 11 aa, Entamoeba histolytica
EDYPETSEKGI

SEQ ID NO: 2735231 - protein, 9 aa, Entamoeba histolytica
EEASEEVRK

SEQ ID NO: 2735232 - protein, 9 aa, Entamoeba histolytica
EEATAEGVV

SEQ ID NO: 2735233 - protein, 10 aa, Entamoeba histolytica
EEATSEGVNN

SEQ ID NO: 2735234 - protein, 5 aa, Entamoeba histolytica
EEDEF

SEQ ID NO: 2735235 - protein, 9 aa, Entamoeba histolytica
EEDERQLQT

SEQ ID NO: 2735236 - protein, 8 aa, Entamoeba histolytica
EEDPEQQW

SEQ ID NO: 2735237 - protein, 5 aa, Entamoeba histolytica
EEDYP

SEQ ID NO: 2735238 - protein, 4 aa, Entamoeba histolytica
EEEE

SEQ ID NO: 2735239 - protein, 7 aa, Entamoeba histolytica
EEEGTVV

SEQ ID NO: 2735240 - protein, 6 aa, Entamoeba histolytica
EEEKSD

SEQ ID NO: 2735241 - protein, 16 aa, Entamoeba histolytica
EEETNFKKEDKELEKE

SEQ ID NO: 2735242 - protein, 4 aa, Entamoeba histolytica
EEGI

SEQ ID NO: 2735243 - protein, 18 aa, Entamoeba histolytica
EEGVDKVKDKVTNKLGDA

SEQ ID NO: 2735244 - protein, 4 aa, Entamoeba histolytica
EEIA

SEQ ID NO: 2735245 - protein, 11 aa, Entamoeba histolytica
EEIATTKKGGY

SEQ ID NO: 2735246 - protein, 9 aa, Entamoeba histolytica
EEKDDKMSE

SEQ ID NO: 2735247 - protein, 4 aa, Entamoeba histolytica
EEKK

SEQ ID NO: 2735248 - protein, 296 aa, Entamoeba histolytica
EEKNNKEKAVQEKQSKATGSKEIQGISGEGEEKVQDKQESKDKGTKNEHEGKEQKEQTQNEIHSTGEETEKKQQETTEQKIEKGGNDKNQEESEKGKSQEGEKKKNSGEGQNEDINKQKENQENQKGKEVDEGHKEETQKDENSKQQKENINEKQKKEEVSDGTQNNENEKEGKTNEKGIEQSTNKNPNQPEEKKANSSDNTNQAQTKDTDETHKQESDGKGKETKEEKKTEASNNNKQEEEEKQKTKDSKQKEEKEETEKVKENNTTNSSSSDSKRSDETDEDSNKHNNPDGSTS

SEQ ID NO: 2735249 - protein, 7 aa, Entamoeba histolytica
EEKTNHP

SEQ ID NO: 2735250 - protein, 8 aa, Entamoeba histolytica
EELNDQSI

SEQ ID NO: 2735251 - protein, 5 aa, Entamoeba histolytica
EEMKQ

SEQ ID NO: 2735252 - protein, 147 aa, Entamoeba histolytica
EENNDEDDEFQLDEEEDDEEDEEDEEDEEDEEDEEDEEDEEDEEDEEDEEDEEDEEDEEDEEDEEDEEDEEDEEDEEDEEDEEDEEDEEDEEDEEDEEDEEDEEDEEDEEDEEDEEDEEDEEDEEDEEDEEDEYDLEEEEEDDDAVA

SEQ ID NO: 2735253 - protein, 6 aa, Entamoeba histolytica
EENNEL

SEQ ID NO: 2735254 - protein, 6 aa, Entamoeba histolytica
EEPSKH

SEQ ID NO: 2735255 - protein, 5 aa, Entamoeba histolytica
EEPVF

SEQ ID NO: 2735256 - protein, 42 aa, Entamoeba histolytica
EERSRIKKEKNRERYQEKLKEKLQKKINGKQSKKKTTLKRVH

SEQ ID NO: 2735257 - protein, 6 aa, Entamoeba histolytica
EESEVE

SEQ ID NO: 2735258 - protein, 15 aa, Entamoeba histolytica
EESKKRVDETNEALE

SEQ ID NO: 2735259 - protein, 19 aa, Entamoeba histolytica
EESSKKEIQELKKRKKEIR

SEQ ID NO: 2735260 - protein, 25 aa, Entamoeba histolytica
EEVNETENNSTENIPKTEKESIKEE

SEQ ID NO: 2735261 - protein, 5 aa, Entamoeba histolytica
EEYPK

SEQ ID NO: 2735262 - protein, 5 aa, Entamoeba histolytica
EEYQP

SEQ ID NO: 2735263 - protein, 10 aa, Entamoeba histolytica
EFDEKSAKRI

SEQ ID NO: 2735264 - protein, 6 aa, Entamoeba histolytica
EFEEGE

SEQ ID NO: 2735265 - protein, 8 aa, Entamoeba histolytica
EFGSSSKI

SEQ ID NO: 2735266 - protein, 4 aa, Entamoeba histolytica
EFNK

SEQ ID NO: 2735267 - protein, 7 aa, Entamoeba histolytica
EFNSEEQ

SEQ ID NO: 2735268 - protein, 6 aa, Entamoeba histolytica
EFPTPT

SEQ ID NO: 2735269 - protein, 12 aa, Entamoeba histolytica
EFTTPSKKIELT

SEQ ID NO: 2735270 - protein, 6 aa, Entamoeba histolytica
EGCDKY

SEQ ID NO: 2735271 - protein, 4 aa, Entamoeba histolytica
EGDT

SEQ ID NO: 2735272 - protein, 7 aa, Entamoeba histolytica
EGDTNLT

SEQ ID NO: 2735273 - protein, 8 aa, Entamoeba histolytica
EGEKGYYD

SEQ ID NO: 2735274 - protein, 8 aa, Entamoeba histolytica
EGEQQHEP

SEQ ID NO: 2735275 - protein, 7 aa, Entamoeba histolytica
EGERFAS

SEQ ID NO: 2735276 - protein, 6 aa, Entamoeba histolytica
EGESIA

SEQ ID NO: 2735277 - protein, 14 aa, Entamoeba histolytica
EGGSAKLICGLIHA

SEQ ID NO: 2735278 - protein, 12 aa, Entamoeba histolytica
EGIYSEAKSEVK

SEQ ID NO: 2735279 - protein, 6 aa, Entamoeba histolytica
EGKEFA

SEQ ID NO: 2735280 - protein, 12 aa, Entamoeba histolytica
EGKVTPIRDQAQ

SEQ ID NO: 2735281 - protein, 8 aa, Entamoeba histolytica
EGNEEVKE

SEQ ID NO: 2735282 - protein, 8 aa, Entamoeba histolytica
EGNKKEIC

SEQ ID NO: 2735283 - protein, 8 aa, Entamoeba histolytica
EGNRSDED

SEQ ID NO: 2735284 - protein, 4 aa, Entamoeba histolytica
EGNT

SEQ ID NO: 2735285 - protein, 12 aa, Entamoeba histolytica
EGPHAALTSEEY

SEQ ID NO: 2735286 - protein, 24 aa, Entamoeba histolytica
EGRKMDRLKKQKKQWKTQKNGEKR

SEQ ID NO: 2735287 - protein, 28 aa, Entamoeba histolytica
EGRNKINSFKQKAKSLLGSLKQKQKKFS

SEQ ID NO: 2735288 - protein, 5 aa, Entamoeba histolytica
EGTGS

SEQ ID NO: 2735289 - protein, 7 aa, Entamoeba histolytica
EGTSPVA

SEQ ID NO: 2735290 - protein, 11 aa, Entamoeba histolytica
EGTYQANKNVS

SEQ ID NO: 2735291 - protein, 10 aa, Entamoeba histolytica
EGVDNDADKY

SEQ ID NO: 2735292 - protein, 6 aa, Entamoeba histolytica
EGYMKR

SEQ ID NO: 2735293 - protein, 7 aa, Entamoeba histolytica
EGYSHSY

SEQ ID NO: 2735294 - protein, 7 aa, Entamoeba histolytica
EGYTQPR

SEQ ID NO: 2735295 - protein, 5 aa, Entamoeba histolytica
EHEGE

SEQ ID NO: 2735296 - protein, 6 aa, Entamoeba histolytica
EHHQKA

SEQ ID NO: 2735297 - protein, 7 aa, Entamoeba histolytica
EHKSESN

SEQ ID NO: 2735298 - protein, 12 aa, Entamoeba histolytica
EHPRNSEKDCYK

SEQ ID NO: 2735299 - protein, 5 aa, Entamoeba histolytica
EHPSK

SEQ ID NO: 2735300 - protein, 30 aa, Entamoeba histolytica
EIAEEKGQSEKSVKNPTESQNAKSSDKVPV

SEQ ID NO: 2735301 - protein, 6 aa, Entamoeba histolytica
EICNSD

SEQ ID NO: 2735302 - protein, 27 aa, Entamoeba histolytica
EIEEVEKKEEKEEKTVGVDDIVNQKNE

SEQ ID NO: 2735303 - protein, 40 aa, Entamoeba histolytica
EIENENEINEEENELKEDDEDDGEYELEDDEDDEERRRRR

SEQ ID NO: 2735304 - protein, 5 aa, Entamoeba histolytica
EIENN

SEQ ID NO: 2735305 - protein, 8 aa, Entamoeba histolytica
EIEPEGGH

SEQ ID NO: 2735306 - protein, 5 aa, Entamoeba histolytica
EIEQQ

SEQ ID NO: 2735307 - protein, 9 aa, Entamoeba histolytica
EIKKYEGKM

SEQ ID NO: 2735308 - protein, 8 aa, Entamoeba histolytica
EIKPNTDI

SEQ ID NO: 2735309 - protein, 5 aa, Entamoeba histolytica
EILPK

SEQ ID NO: 2735310 - protein, 38 aa, Entamoeba histolytica
EIPESQLPPLEEEDEDDEDIEDDIDEELEEEDERKPKI

SEQ ID NO: 2735311 - protein, 4 aa, Entamoeba histolytica
EIQA

SEQ ID NO: 2735312 - protein, 13 aa, Entamoeba histolytica
EIQDKKRKAAIQK

SEQ ID NO: 2735313 - protein, 5 aa, Entamoeba histolytica
EIQEE

SEQ ID NO: 2735314 - protein, 7 aa, Entamoeba histolytica
EIQNTSS

SEQ ID NO: 2735315 - protein, 8 aa, Entamoeba histolytica
EIQSETAV

SEQ ID NO: 2735316 - protein, 4 aa, Entamoeba histolytica
EIRR

SEQ ID NO: 2735317 - protein, 5 aa, Entamoeba histolytica
EIRTN

SEQ ID NO: 2735318 - protein, 10 aa, Entamoeba histolytica
EISKREKDTY

SEQ ID NO: 2735319 - protein, 5 aa, Entamoeba histolytica
EITEA

SEQ ID NO: 2735320 - protein, 7 aa, Entamoeba histolytica
EITEKNE

SEQ ID NO: 2735321 - protein, 64 aa, Entamoeba histolytica
EITKKTEKDLKKQEKKALDKITKTEKTSSVKAASKTEKKTSTSAKKSKAATEQKKTTKQVQTKK

SEQ ID NO: 2735322 - protein, 8 aa, Entamoeba histolytica
EKALAEEH

SEQ ID NO: 2735323 - protein, 9 aa, Entamoeba histolytica
EKCDTQKKD

SEQ ID NO: 2735324 - protein, 14 aa, Entamoeba histolytica
EKCGNAWKEATDSI

SEQ ID NO: 2735325 - protein, 10 aa, Entamoeba histolytica
EKCNTQKKDV

SEQ ID NO: 2735326 - protein, 6 aa, Entamoeba histolytica
EKCTPD

SEQ ID NO: 2735327 - protein, 6 aa, Entamoeba histolytica
EKCTPE

SEQ ID NO: 2735328 - protein, 4 aa, Entamoeba histolytica
EKDL

SEQ ID NO: 2735329 - protein, 4 aa, Entamoeba histolytica
EKDY

SEQ ID NO: 2735330 - protein, 19 aa, Entamoeba histolytica
EKEEFKKQYSPNNEYGYNN

SEQ ID NO: 2735331 - protein, 8 aa, Entamoeba histolytica
EKEKVLTE

SEQ ID NO: 2735332 - protein, 8 aa, Entamoeba histolytica
EKEKYSAE

SEQ ID NO: 2735333 - protein, 12 aa, Entamoeba histolytica
EKEQLERDATKK

SEQ ID NO: 2735334 - protein, 5 aa, Entamoeba histolytica
EKERI

SEQ ID NO: 2735335 - protein, 8 aa, Entamoeba histolytica
EKGARIGQ

SEQ ID NO: 2735336 - protein, 8 aa, Entamoeba histolytica
EKGEKTIR

SEQ ID NO: 2735337 - protein, 9 aa, Entamoeba histolytica
EKGKESNPQ

SEQ ID NO: 2735338 - protein, 17 aa, Entamoeba histolytica
EKGPSGSPRYMGGLQIS

SEQ ID NO: 2735339 - protein, 5 aa, Entamoeba histolytica
EKGQY

SEQ ID NO: 2735340 - protein, 16 aa, Entamoeba histolytica
EKGSSCYASQTSQYNG

SEQ ID NO: 2735341 - protein, 8 aa, Entamoeba histolytica
EKIATNED

SEQ ID NO: 2735342 - protein, 5 aa, Entamoeba histolytica
EKIEA

SEQ ID NO: 2735343 - protein, 21 aa, Entamoeba histolytica
EKIKTEKVNLTKQTLKQAVPA

SEQ ID NO: 2735344 - protein, 21 aa, Entamoeba histolytica
EKIQKGKDMYKKGKDIINKGK

SEQ ID NO: 2735345 - protein, 8 aa, Entamoeba histolytica
EKKDDPDI

SEQ ID NO: 2735346 - protein, 21 aa, Entamoeba histolytica
EKKDKKDSASQQDSFNSHDSE

SEQ ID NO: 2735347 - protein, 10 aa, Entamoeba histolytica
EKKERETSLR

SEQ ID NO: 2735348 - protein, 17 aa, Entamoeba histolytica
EKKIKSKTHKKDQIKKE

SEQ ID NO: 2735349 - protein, 14 aa, Entamoeba histolytica
EKKKEKGTYVRDVL

SEQ ID NO: 2735350 - protein, 5 aa, Entamoeba histolytica
EKKKF

SEQ ID NO: 2735351 - protein, 7 aa, Entamoeba histolytica
EKKLSNS

SEQ ID NO: 2735352 - protein, 12 aa, Entamoeba histolytica
EKKNGTISAPIE

SEQ ID NO: 2735353 - protein, 10 aa, Entamoeba histolytica
EKKQKAKEDK

SEQ ID NO: 2735354 - protein, 7 aa, Entamoeba histolytica
EKKRRVV

SEQ ID NO: 2735355 - protein, 4 aa, Entamoeba histolytica
EKLA

SEQ ID NO: 2735356 - protein, 10 aa, Entamoeba histolytica
EKLKDEGKKF

SEQ ID NO: 2735357 - protein, 12 aa, Entamoeba histolytica
EKLTQPKAKDIA

SEQ ID NO: 2735358 - protein, 14 aa, Entamoeba histolytica
EKMTEVKSKHGKRI

SEQ ID NO: 2735359 - protein, 8 aa, Entamoeba histolytica
EKNAQRKK

SEQ ID NO: 2735360 - protein, 10 aa, Entamoeba histolytica
EKNGETKKVE

SEQ ID NO: 2735361 - protein, 9 aa, Entamoeba histolytica
EKNKDLTPK

SEQ ID NO: 2735362 - protein, 9 aa, Entamoeba histolytica
EKNKGKGKL

SEQ ID NO: 2735363 - protein, 22 aa, Entamoeba histolytica
EKPCNAPKPIQNKTATDKLSSD

SEQ ID NO: 2735364 - protein, 7 aa, Entamoeba histolytica
EKQTEDY

SEQ ID NO: 2735365 - protein, 17 aa, Entamoeba histolytica
EKRKISGRGVVSKQEKK

SEQ ID NO: 2735366 - protein, 65 aa, Entamoeba histolytica
EKSPDSSESKHESSEIKPDSSESKHESSEVKPDSSESKHESSEIKPDSSESKHESSEPEVSIPKK

SEQ ID NO: 2735367 - protein, 12 aa, Entamoeba histolytica
EKSSSSVDVGAY

SEQ ID NO: 2735368 - protein, 14 aa, Entamoeba histolytica
EKSSSTHKQSNQYA

SEQ ID NO: 2735369 - protein, 9 aa, Entamoeba histolytica
EKSTENEKE

SEQ ID NO: 2735370 - protein, 26 aa, Entamoeba histolytica
EKSTNDTNNNKDNNNVQIPSQPQQCQ

SEQ ID NO: 2735371 - protein, 12 aa, Entamoeba histolytica
EKTVQAARKSRE

SEQ ID NO: 2735372 - protein, 7 aa, Entamoeba histolytica
EKYTKAE

SEQ ID NO: 2735373 - protein, 14 aa, Entamoeba histolytica
ELDQVENEEERKKL

SEQ ID NO: 2735374 - protein, 6 aa, Entamoeba histolytica
ELEARS

SEQ ID NO: 2735375 - protein, 15 aa, Entamoeba histolytica
ELEDDYGDDEEARRI

SEQ ID NO: 2735376 - protein, 10 aa, Entamoeba histolytica
ELEEKNALNE

SEQ ID NO: 2735377 - protein, 13 aa, Entamoeba histolytica
ELKHEKKETVINE

SEQ ID NO: 2735378 - protein, 14 aa, Entamoeba histolytica
ELKSREDDLSNEAS

SEQ ID NO: 2735379 - protein, 6 aa, Entamoeba histolytica
ELPKQK

SEQ ID NO: 2735380 - protein, 12 aa, Entamoeba histolytica
ELPNSCEGNCRK

SEQ ID NO: 2735381 - protein, 5 aa, Entamoeba histolytica
ELRAT

SEQ ID NO: 2735382 - protein, 6 aa, Entamoeba histolytica
ELRSER

SEQ ID NO: 2735383 - protein, 12 aa, Entamoeba histolytica
ELSKSGDKYEKS

SEQ ID NO: 2735384 - protein, 4 aa, Entamoeba histolytica
EMDR

SEQ ID NO: 2735385 - protein, 4 aa, Entamoeba histolytica
EMGK

SEQ ID NO: 2735386 - protein, 4 aa, Entamoeba histolytica
EMNA

SEQ ID NO: 2735387 - protein, 18 aa, Entamoeba histolytica
EMNKPSVIQSKTNLQKQK

SEQ ID NO: 2735388 - protein, 6 aa, Entamoeba histolytica
EMRRNS

SEQ ID NO: 2735389 - protein, 7 aa, Entamoeba histolytica
ENAGIDG

SEQ ID NO: 2735390 - protein, 12 aa, Entamoeba histolytica
ENECTFNDPVSN

SEQ ID NO: 2735391 - protein, 4 aa, Entamoeba histolytica
ENEF

SEQ ID NO: 2735392 - protein, 5 aa, Entamoeba histolytica
ENEHD

SEQ ID NO: 2735393 - protein, 6 aa, Entamoeba histolytica
ENELDN

SEQ ID NO: 2735394 - protein, 12 aa, Entamoeba histolytica
ENENGSSIPSSK

SEQ ID NO: 2735395 - protein, 5 aa, Entamoeba histolytica
ENEQV

SEQ ID NO: 2735396 - protein, 29 aa, Entamoeba histolytica
ENFYEGKEENKEEDNFGRDRDEEEEEKDE

SEQ ID NO: 2735397 - protein, 11 aa, Entamoeba histolytica
ENGKEQINEEN

SEQ ID NO: 2735398 - protein, 5 aa, Entamoeba histolytica
ENGPV

SEQ ID NO: 2735399 - protein, 12 aa, Entamoeba histolytica
ENGSIRKDQSID

SEQ ID NO: 2735400 - protein, 8 aa, Entamoeba histolytica
ENGTEGTV

SEQ ID NO: 2735401 - protein, 12 aa, Entamoeba histolytica
ENGYYKSPFDGK

SEQ ID NO: 2735402 - protein, 10 aa, Entamoeba histolytica
ENIEFEGPRT

SEQ ID NO: 2735403 - protein, 32 aa, Entamoeba histolytica; identical to SEQ ID NO: 2548985

SEQ ID NO: 2735404 - protein, 9 aa, Entamoeba histolytica
ENKANAPTN

SEQ ID NO: 2735405 - protein, 26 aa, Entamoeba histolytica
ENKEVSQEARKIEGKLGQLTGSERIK

SEQ ID NO: 2735406 - protein, 5 aa, Entamoeba histolytica
ENKKN

SEQ ID NO: 2735407 - protein, 13 aa, Entamoeba histolytica
ENLKVSGVSTSNQ

SEQ ID NO: 2735408 - protein, 6 aa, Entamoeba histolytica
ENMPDM

SEQ ID NO: 2735409 - protein, 8 aa, Entamoeba histolytica
ENNKSFCT

SEQ ID NO: 2735410 - protein, 4 aa, Entamoeba histolytica
ENNR

SEQ ID NO: 2735411 - protein, 8 aa, Entamoeba histolytica
ENPEDKQM

SEQ ID NO: 2735412 - protein, 4 aa, Entamoeba histolytica
ENSL

SEQ ID NO: 2735413 - protein, 12 aa, Entamoeba histolytica
ENTDNSGTIGNG

SEQ ID NO: 2735414 - protein, 4 aa, Entamoeba histolytica
ENTH

SEQ ID NO: 2735415 - protein, 11 aa, Entamoeba histolytica
ENTQQNPTEQE

SEQ ID NO: 2735416 - protein, 12 aa, Entamoeba histolytica
ENWGGNTKNTYG

SEQ ID NO: 2735417 - protein, 4 aa, Entamoeba histolytica
EPLP

SEQ ID NO: 2735418 - protein, 10 aa, Entamoeba histolytica
EPMQEGLSEE

SEQ ID NO: 2735419 - protein, 5 aa, Entamoeba histolytica
EPNTC

SEQ ID NO: 2735420 - protein, 6 aa, Entamoeba histolytica
EPPSPV

SEQ ID NO: 2735421 - protein, 9 aa, Entamoeba histolytica
EPQTSEIVT

SEQ ID NO: 2735422 - protein, 10 aa, Entamoeba histolytica
EPSTANGRKT

SEQ ID NO: 2735423 - protein, 5 aa, Entamoeba histolytica
EPSVF

SEQ ID NO: 2735424 - protein, 5 aa, Entamoeba histolytica
EPTAA

SEQ ID NO: 2735425 - protein, 6 aa, Entamoeba histolytica
EPTAAS

SEQ ID NO: 2735426 - protein, 9 aa, Entamoeba histolytica
EQDFDKDSD

SEQ ID NO: 2735427 - protein, 7 aa, Entamoeba histolytica
EQENKKH

SEQ ID NO: 2735428 - protein, 13 aa, Entamoeba histolytica
EQENLKAAQRAQI

SEQ ID NO: 2735429 - protein, 5 aa, Entamoeba histolytica
EQETF

SEQ ID NO: 2735430 - protein, 8 aa, Entamoeba histolytica
EQFTGDPI

SEQ ID NO: 2735431 - protein, 19 aa, Entamoeba histolytica
EQGAEFKTVTEEELTSEGC

SEQ ID NO: 2735432 - protein, 6 aa, Entamoeba histolytica
EQGTHQ

SEQ ID NO: 2735433 - protein, 4 aa, Entamoeba histolytica
EQKQ

SEQ ID NO: 2735434 - protein, 10 aa, Entamoeba histolytica
EQLEKNKKYL

SEQ ID NO: 2735435 - protein, 7 aa, Entamoeba histolytica
EQLKSKN

SEQ ID NO: 2735436 - protein, 4 aa, Entamoeba histolytica
EQNE

SEQ ID NO: 2735437 - protein, 7 aa, Entamoeba histolytica
EQNSSSL

SEQ ID NO: 2735438 - protein, 14 aa, Entamoeba histolytica
EQQGNLQKKNNCVI

SEQ ID NO: 2735439 - protein, 5 aa, Entamoeba histolytica
EQRIQ

SEQ ID NO: 2735440 - protein, 5 aa, Entamoeba histolytica
EQSST

SEQ ID NO: 2735441 - protein, 4 aa, Entamoeba histolytica
EQTA

SEQ ID NO: 2735442 - protein, 7 aa, Entamoeba histolytica
EQTSTSI

SEQ ID NO: 2735443 - protein, 44 aa, Entamoeba histolytica
EQYNEQGNKDDNKREDNMIDSTRTKQHKYENNYNNDENTQHQTY

SEQ ID NO: 2735444 - protein, 13 aa, Entamoeba histolytica
ERADLEKSSEFSS

SEQ ID NO: 2735445 - protein, 25 aa, Entamoeba histolytica
ERCPRNSDELANASPETKLRCKNIK

SEQ ID NO: 2735446 - protein, 5 aa, Entamoeba histolytica
ERDAK

SEQ ID NO: 2735447 - protein, 7 aa, Entamoeba histolytica
ERDLKDD

SEQ ID NO: 2735448 - protein, 26 aa, Entamoeba histolytica
ERESGIRRREEKEMKIKGAQKSTQKG

SEQ ID NO: 2735449 - protein, 6 aa, Entamoeba histolytica
ERISQA

SEQ ID NO: 2735450 - protein, 12 aa, Entamoeba histolytica
ERKEKRRAKTAK

SEQ ID NO: 2735451 - protein, 6 aa, Entamoeba histolytica
ERKHEI

SEQ ID NO: 2735452 - protein, 8 aa, Entamoeba histolytica
ERKRRASE

SEQ ID NO: 2735453 - protein, 9 aa, Entamoeba histolytica
ERNKEDVKT

SEQ ID NO: 2735454 - protein, 6 aa, Entamoeba histolytica
ERQKMQ

SEQ ID NO: 2735455 - protein, 8 aa, Entamoeba histolytica
ERSLTKDN

SEQ ID NO: 2735456 - protein, 7 aa, Entamoeba histolytica
ERTMTKD

SEQ ID NO: 2735457 - protein, 6 aa, Entamoeba histolytica
ERTQPK

SEQ ID NO: 2735458 - protein, 4 aa, Entamoeba histolytica
ESAE

SEQ ID NO: 2735459 - protein, 4 aa, Entamoeba histolytica
ESCN

SEQ ID NO: 2735460 - protein, 9 aa, Entamoeba histolytica
ESDIQNSST

SEQ ID NO: 2735461 - protein, 7 aa, Entamoeba histolytica
ESDNPIN

SEQ ID NO: 2735462 - protein, 5 aa, Entamoeba histolytica
ESDPA

SEQ ID NO: 2735463 - protein, 4 aa, Entamoeba histolytica
ESEL

SEQ ID NO: 2735464 - protein, 9 aa, Entamoeba histolytica
ESGIPEGTL

SEQ ID NO: 2735465 - protein, 4 aa, Entamoeba histolytica
ESGN

SEQ ID NO: 2735466 - protein, 8 aa, Entamoeba histolytica
ESGNRSDQ

SEQ ID NO: 2735467 - protein, 6 aa, Entamoeba histolytica
ESISTA

SEQ ID NO: 2735468 - protein, 5 aa, Entamoeba histolytica
ESKFD

SEQ ID NO: 2735469 - protein, 15 aa, Entamoeba histolytica
ESKLSNAETAKSAYD

SEQ ID NO: 2735470 - protein, 4 aa, Entamoeba histolytica
ESKT

SEQ ID NO: 2735471 - protein, 23 aa, Entamoeba histolytica
ESLPKKNPARDYGKAQQALNNQR

SEQ ID NO: 2735472 - protein, 8 aa, Entamoeba histolytica
ESNDISKE

SEQ ID NO: 2735473 - protein, 10 aa, Entamoeba histolytica
ESNHEPSETC

SEQ ID NO: 2735474 - protein, 6 aa, Entamoeba histolytica
ESNPKE

SEQ ID NO: 2735475 - protein, 5 aa, Entamoeba histolytica
ESRGG

SEQ ID NO: 2735476 - protein, 7 aa, Entamoeba histolytica
ESRRRMK

SEQ ID NO: 2735477 - protein, 14 aa, Entamoeba histolytica
ESSDGWTGNSLPTQ

SEQ ID NO: 2735478 - protein, 5 aa, Entamoeba histolytica
ESSQD

SEQ ID NO: 2735479 - protein, 7 aa, Entamoeba histolytica
ESSYKDV

SEQ ID NO: 2735480 - protein, 5 aa, Entamoeba histolytica
ESTDN

SEQ ID NO: 2735481 - protein, 7 aa, Entamoeba histolytica
ESTEDHK

SEQ ID NO: 2735482 - protein, 7 aa, Entamoeba histolytica
ESTSDHS

SEQ ID NO: 2735483 - protein, 10 aa, Entamoeba histolytica
ESTTPKSERK

SEQ ID NO: 2735484 - protein, 4 aa, Entamoeba histolytica
ESVS

SEQ ID NO: 2735485 - protein, 5 aa, Entamoeba histolytica
ESVSV

SEQ ID NO: 2735486 - protein, 5 aa, Entamoeba histolytica
ESYPK

SEQ ID NO: 2735487 - protein, 7 aa, Entamoeba histolytica
ETANKKK

SEQ ID NO: 2735488 - protein, 22 aa, Entamoeba histolytica
ETCEEGKIKDQNGKCNSNISNC

SEQ ID NO: 2735489 - protein, 7 aa, Entamoeba histolytica
ETCPESL

SEQ ID NO: 2735490 - protein, 5 aa, Entamoeba histolytica
ETCSR

SEQ ID NO: 2735491 - protein, 7 aa, Entamoeba histolytica
ETCTYDK

SEQ ID NO: 2735492 - protein, 6 aa, Entamoeba histolytica
ETEGAE

SEQ ID NO: 2735493 - protein, 4 aa, Entamoeba histolytica
ETFE

SEQ ID NO: 2735494 - protein, 4 aa, Entamoeba histolytica
ETFK

SEQ ID NO: 2735495 - protein, 7 aa, Entamoeba histolytica
ETGGMST

SEQ ID NO: 2735496 - protein, 5 aa, Entamoeba histolytica
ETKDY

SEQ ID NO: 2735497 - protein, 8 aa, Entamoeba histolytica
ETKIEDGV

SEQ ID NO: 2735498 - protein, 6 aa, Entamoeba histolytica
ETKKSI

SEQ ID NO: 2735499 - protein, 12 aa, Entamoeba histolytica
ETKPEESNQCKE

SEQ ID NO: 2735500 - protein, 13 aa, Entamoeba histolytica
ETKPEESNQCKEV

SEQ ID NO: 2735501 - protein, 10 aa, Entamoeba histolytica
ETKYDSASFS

SEQ ID NO: 2735502 - protein, 4 aa, Entamoeba histolytica
ETNK

SEQ ID NO: 2735503 - protein, 7 aa, Entamoeba histolytica
ETPSQEI

SEQ ID NO: 2735504 - protein, 5 aa, Entamoeba histolytica
ETSEL

SEQ ID NO: 2735505 - protein, 4 aa, Entamoeba histolytica
ETSH

SEQ ID NO: 2735506 - protein, 7 aa, Entamoeba histolytica
ETSSSDY

SEQ ID NO: 2735507 - protein, 9 aa, Entamoeba histolytica
ETSSTDDAI

SEQ ID NO: 2735508 - protein, 175 aa, Entamoeba histolytica
ETTTSSQGAKEGVTSGNTATVSQGSAATVSSQGDKSLSQPVEGNSSPVTPNPVSQTSQTPEADSQPSSPTPPTSPSSPQTSSTPTTNQPSQPQTNSASSTSTPQSQDKQDTIPNEQHPKPEEQPQKPSSQSQQNHPQQNEKQDNKNTTTSDNSHDKTNNSSDDISDNHNNLDGTS

SEQ ID NO: 2735509 - protein, 7 aa, Entamoeba histolytica
ETVPEEK

SEQ ID NO: 2735510 - protein, 11 aa, Entamoeba histolytica
ETVSNNDKQYH

SEQ ID NO: 2735511 - protein, 4 aa, Entamoeba histolytica
EVDK

SEQ ID NO: 2735512 - protein, 10 aa, Entamoeba histolytica
EVDYKKKTKH

SEQ ID NO: 2735513 - protein, 6 aa, Entamoeba histolytica
EVEDLN

SEQ ID NO: 2735514 - protein, 11 aa, Entamoeba histolytica
EVEGNTPSTIF

SEQ ID NO: 2735515 - protein, 10 aa, Entamoeba histolytica
EVGETNDFEE

SEQ ID NO: 2735516 - protein, 6 aa, Entamoeba histolytica
EVKDTN

SEQ ID NO: 2735517 - protein, 6 aa, Entamoeba histolytica
EVKEDT

SEQ ID NO: 2735518 - protein, 16 aa, Entamoeba histolytica
EVKKGLEKKQENAEEI

SEQ ID NO: 2735519 - protein, 21 aa, Entamoeba histolytica
EVNENGTACVKKEKKQIDGSE

SEQ ID NO: 2735520 - protein, 13 aa, Entamoeba histolytica
EVQVSQKSIEEKV

SEQ ID NO: 2735521 - protein, 48 aa, Entamoeba histolytica
  misc_feature (13)..(46): Xaa can be any naturally occurring amino acid
EVSGTSTLTMSNXXXXXXXXXXXXXXXXXXXXXXXXXXXXXXXXXXEI

SEQ ID NO: 2735522 - protein, 14 aa, Entamoeba histolytica
EVSQESINKQQTSL

SEQ ID NO: 2735523 - protein, 10 aa, Entamoeba histolytica
EVTDETSEEI

SEQ ID NO: 2735524 - protein, 5 aa, Entamoeba histolytica
EVTPS

SEQ ID NO: 2735525 - protein, 12 aa, Entamoeba histolytica
EWSEQAKSEVHP

SEQ ID NO: 2735526 - protein, 33 aa, Entamoeba histolytica
EYAKEAAKLAAKNAYSKIQEAEGEDKPSEKDIK

SEQ ID NO: 2735527 - protein, 29 aa, Entamoeba histolytica
EYDDDSSNSSVTHTPSLPENGEGGFIPSS

SEQ ID NO: 2735528 - protein, 8 aa, Entamoeba histolytica
EYEDETKE

SEQ ID NO: 2735529 - protein, 5 aa, Entamoeba histolytica
EYGNK

SEQ ID NO: 2735530 - protein, 4 aa, Entamoeba histolytica
EYKK

SEQ ID NO: 2735531 - protein, 7 aa, Entamoeba histolytica
EYKPNKN

SEQ ID NO: 2735532 - protein, 14 aa, Entamoeba histolytica
EYNSTTKYTQNGKT

SEQ ID NO: 2735533 - protein, 7 aa, Entamoeba histolytica
EYPELSK

SEQ ID NO: 2735534 - protein, 4 aa, Entamoeba histolytica
EYPP

SEQ ID NO: 2735535 - protein, 5 aa, Entamoeba histolytica
EYQIT

SEQ ID NO: 2735536 - protein, 27 aa, Entamoeba histolytica
EYQKINGKLKDEKDDKKQKIIQQTRDD

SEQ ID NO: 2735537 - protein, 22 aa, Entamoeba histolytica
EYTLNNGTCESKENKNGKNEEI

SEQ ID NO: 2735538 - protein, 16 aa, Entamoeba histolytica
EYTTNGSEKVDNSNEM

SEQ ID NO: 2735539 - protein, 10 aa, Entamoeba histolytica
FAGKEGKFGK

SEQ ID NO: 2735540 - protein, 7 aa, Entamoeba histolytica
FAHNPST

SEQ ID NO: 2735541 - protein, 8 aa, Entamoeba histolytica
FAQKNQDL

SEQ ID NO: 2735542 - protein, 4 aa, Entamoeba histolytica
FDNG

SEQ ID NO: 2735543 - protein, 7 aa, Entamoeba histolytica
FDQPQDN

SEQ ID NO: 2735544 - protein, 4 aa, Entamoeba histolytica
FDSI

SEQ ID NO: 2735545 - protein, 11 aa, Entamoeba histolytica
FDSKSKTMYGY

SEQ ID NO: 2735546 - protein, 11 aa, Entamoeba histolytica
FEDAKARTGVG

SEQ ID NO: 2735547 - protein, 5 aa, Entamoeba histolytica
FEDGF

SEQ ID NO: 2735548 - protein, 6 aa, Entamoeba histolytica
FEDGFN

SEQ ID NO: 2735549 - protein, 10 aa, Entamoeba histolytica
FEEEQDDEAL

SEQ ID NO: 2735550 - protein, 13 aa, Entamoeba histolytica
FEETTKKIERLQN

SEQ ID NO: 2735551 - protein, 19 aa, Entamoeba histolytica
FEKKAMKKGIKKGKFNKKA

SEQ ID NO: 2735552 - protein, 4 aa, Entamoeba histolytica
FENR

SEQ ID NO: 2735553 - protein, 14 aa, Entamoeba histolytica
FETKPEESNQCKEV

SEQ ID NO: 2735554 - protein, 4 aa, Entamoeba histolytica
FGAS

SEQ ID NO: 2735555 - protein, 11 aa, Entamoeba histolytica
FGGLDSKTINY

SEQ ID NO: 2735556 - protein, 6 aa, Entamoeba histolytica
FGKEPM

SEQ ID NO: 2735557 - protein, 7 aa, Entamoeba histolytica
FGNGTTL

SEQ ID NO: 2735558 - protein, 23 aa, Entamoeba histolytica
FGSGKNVHQPLPLTDKSKGAFTE

SEQ ID NO: 2735559 - protein, 13 aa, Entamoeba histolytica
FGSPKTRADEFST

SEQ ID NO: 2735560 - protein, 15 aa, Entamoeba histolytica
FGTGKISGNNVDFTT

SEQ ID NO: 2735561 - protein, 6 aa, Entamoeba histolytica
FHSDDG

SEQ ID NO: 2735562 - protein, 26 aa, Entamoeba histolytica
FKEGEGIPSKMKTCENKRGVDPEIDE

SEQ ID NO: 2735563 - protein, 6 aa, Entamoeba histolytica
FKEKAE

SEQ ID NO: 2735564 - protein, 5 aa, Entamoeba histolytica
FKGEK

SEQ ID NO: 2735565 - protein, 7 aa, Entamoeba histolytica
FKGQKKE

SEQ ID NO: 2735566 - protein, 12 aa, Entamoeba histolytica
FKKDPSDNPRAM

SEQ ID NO: 2735567 - protein, 8 aa, Entamoeba histolytica
FKKEKAIN

SEQ ID NO: 2735568 - protein, 9 aa, Entamoeba histolytica
FKKRTQDSA

SEQ ID NO: 2735569 - protein, 5 aa, Entamoeba histolytica
FKNNG

SEQ ID NO: 2735570 - protein, 11 aa, Entamoeba histolytica
FKPGKRPQPGT

SEQ ID NO: 2735571 - protein, 12 aa, Entamoeba histolytica
FLDEKNGGYNYS

SEQ ID NO: 2735572 - protein, 54 aa, Entamoeba histolytica
FLGGGKKSKGASKKASKPKKVSKPKKVSKPKKVSKPKKVSKPAKPAKSRSKKSK

SEQ ID NO: 2735573 - protein, 9 aa, Entamoeba histolytica
FNDTKRAEL

SEQ ID NO: 2735574 - protein, 7 aa, Entamoeba histolytica
FNEATQL

SEQ ID NO: 2735575 - protein, 27 aa, Entamoeba histolytica
FNHEKGKREATQTANKKASSTTSKSHK

SEQ ID NO: 2735576 - protein, 24 aa, Entamoeba histolytica
FNKTIKKAANEKKKAKIAKKQVKE

SEQ ID NO: 2735577 - protein, 13 aa, Entamoeba histolytica
FNRPEESKEAFTE

SEQ ID NO: 2735578 - protein, 9 aa, Entamoeba histolytica
FPPAAGVAG

SEQ ID NO: 2735579 - protein, 19 aa, Entamoeba histolytica
FPSKSSQINECRNREASFS

SEQ ID NO: 2735580 - protein, 10 aa, Entamoeba histolytica
FPSNEKEQIT

SEQ ID NO: 2735581 - protein, 4 aa, Entamoeba histolytica
FRNG

SEQ ID NO: 2735582 - protein, 11 aa, Entamoeba histolytica
FRSSEDDDYYS

SEQ ID NO: 2735583 - protein, 8 aa, Entamoeba histolytica
FSDDSEKD

SEQ ID NO: 2735584 - protein, 23 aa, Entamoeba histolytica
FSDGFNSQTNTSSLQCSTTHSNK

SEQ ID NO: 2735585 - protein, 11 aa, Entamoeba histolytica
FSIDDDKSIKK

SEQ ID NO: 2735586 - protein, 10 aa, Entamoeba histolytica
FSKNEKSTIS

SEQ ID NO: 2735587 - protein, 10 aa, Entamoeba histolytica
FSKNSQNING

SEQ ID NO: 2735588 - protein, 5 aa, Entamoeba histolytica
FSKQE

SEQ ID NO: 2735589 - protein, 9 aa, Entamoeba histolytica
FSSDDSDVD

SEQ ID NO: 2735590 - protein, 8 aa, Entamoeba histolytica
FSSSPGLI

SEQ ID NO: 2735591 - protein, 6 aa, Entamoeba histolytica
FSTNRP

SEQ ID NO: 2735592 - protein, 24 aa, Entamoeba histolytica
FTENTQKSFQTQTQLNYNGRGNEL

SEQ ID NO: 2735593 - protein, 5 aa, Entamoeba histolytica
FTKSG

SEQ ID NO: 2735594 - protein, 6 aa, Entamoeba histolytica
FTQENG

SEQ ID NO: 2735595 - protein, 7 aa, Entamoeba histolytica
FTTGRGR

SEQ ID NO: 2735596 - protein, 8 aa, Entamoeba histolytica
FVDGPNKN

SEQ ID NO: 2735597 - protein, 9 aa, Entamoeba histolytica
FVETKNDVA

SEQ ID NO: 2735598 - protein, 12 aa, Entamoeba histolytica
FWGPKDSTTHKP

SEQ ID NO: 2735599 - protein, 9 aa, Entamoeba histolytica
FYNENPSQF

SEQ ID NO: 2735600 - protein, 11 aa, Entamoeba histolytica
FYRSNKTGEYK

SEQ ID NO: 2735601 - protein, 5 aa, Entamoeba histolytica
FYSKS

SEQ ID NO: 2735602 - protein, 9 aa, Entamoeba histolytica
GADRSDTTK

SEQ ID NO: 2735603 - protein, 6 aa, Entamoeba histolytica
GADYDN

SEQ ID NO: 2735604 - protein, 10 aa, Entamoeba histolytica
GAFKTEAKRP

SEQ ID NO: 2735605 - protein, 8 aa, Entamoeba histolytica
GAGASGIR

SEQ ID NO: 2735606 - protein, 8 aa, Entamoeba histolytica
GAGASGMR

SEQ ID NO: 2735607 - protein, 10 aa, Entamoeba histolytica
GAGNGPDKEN

SEQ ID NO: 2735608 - protein, 5 aa, Entamoeba histolytica
GAIRG

SEQ ID NO: 2735609 - protein, 12 aa, Entamoeba histolytica
GANLNKDDKTKL

SEQ ID NO: 2735610 - protein, 5 aa, Entamoeba histolytica
GAQAV

SEQ ID NO: 2735611 - protein, 14 aa, Entamoeba histolytica
GARAAAGATRTVTE

SEQ ID NO: 2735612 - protein, 5 aa, Entamoeba histolytica
GATGA

SEQ ID NO: 2735613 - protein, 7 aa, Entamoeba histolytica
GATGRCN

SEQ ID NO: 2735614 - protein, 7 aa, Entamoeba histolytica
GATSGFG

SEQ ID NO: 2735615 - protein, 12 aa, Entamoeba histolytica
GAVADGKTKISK

SEQ ID NO: 2735616 - protein, 5 aa, Entamoeba histolytica
GAVGK

SEQ ID NO: 2735617 - protein, 5 aa, Entamoeba histolytica
GAVKE

SEQ ID NO: 2735618 - protein, 6 aa, Entamoeba histolytica
GCAGTT

SEQ ID NO: 2735619 - protein, 6 aa, Entamoeba histolytica
GCGDEH

SEQ ID NO: 2735620 - protein, 9 aa, Entamoeba histolytica
GCKGENSPL

SEQ ID NO: 2735621 - protein, 8 aa, Entamoeba histolytica
GCNGGTLQ

SEQ ID NO: 2735622 - protein, 5 aa, Entamoeba histolytica
GCREC

SEQ ID NO: 2735623 - protein, 9 aa, Entamoeba histolytica
GCTKAKAQL

SEQ ID NO: 2735624 - protein, 6 aa, Entamoeba histolytica
GDATLG

SEQ ID NO: 2735625 - protein, 5 aa, Entamoeba histolytica
GDAVA

SEQ ID NO: 2735626 - protein, 12 aa, Entamoeba histolytica
GDDITTHGHRPE

SEQ ID NO: 2735627 - protein, 4 aa, Entamoeba histolytica
GDDR

SEQ ID NO: 2735628 - protein, 10 aa, Entamoeba histolytica
GDEKPDWKTG

SEQ ID NO: 2735629 - protein, 5 aa, Entamoeba histolytica
GDEVD

SEQ ID NO: 2735630 - protein, 9 aa, Entamoeba histolytica
GDEWTPVPL

SEQ ID NO: 2735631 - protein, 6 aa, Entamoeba histolytica
GDGDGV

SEQ ID NO: 2735632 - protein, 22 aa, Entamoeba histolytica
GDGDTADYNPQDGAGENKQDPI

SEQ ID NO: 2735633 - protein, 14 aa, Entamoeba histolytica
GDISNKNGEKTNKF

SEQ ID NO: 2735634 - protein, 6 aa, Entamoeba histolytica
GDKCSE

SEQ ID NO: 2735635 - protein, 12 aa, Entamoeba histolytica
GDKECTEPIPAT

SEQ ID NO: 2735636 - protein, 13 aa, Entamoeba histolytica
GDKEIKESKKRLS

SEQ ID NO: 2735637 - protein, 21 aa, Entamoeba histolytica
GDLDGSYSRSFDNSINDVENT

SEQ ID NO: 2735638 - protein, 4 aa, Entamoeba histolytica
GDNA

SEQ ID NO: 2735639 - protein, 5 aa, Entamoeba histolytica
GDNGF

SEQ ID NO: 2735640 - protein, 8 aa, Entamoeba histolytica
GDNNNTEY

SEQ ID NO: 2735641 - protein, 7 aa, Entamoeba histolytica
GDQATYN

SEQ ID NO: 2735642 - protein, 14 aa, Entamoeba histolytica
GDRGAQISGGQKQR

SEQ ID NO: 2735643 - protein, 5 aa, Entamoeba histolytica
GDRNS

SEQ ID NO: 2735644 - protein, 7 aa, Entamoeba histolytica
GDSDATW

SEQ ID NO: 2735645 - protein, 6 aa, Entamoeba histolytica
GDSFDS

SEQ ID NO: 2735646 - protein, 6 aa, Entamoeba histolytica
GDSIEI

SEQ ID NO: 2735647 - protein, 4 aa, Entamoeba histolytica
GDSL

SEQ ID NO: 2735648 - protein, 8 aa, Entamoeba histolytica
GDTDSTWG

SEQ ID NO: 2735649 - protein, 9 aa, Entamoeba histolytica
GDTFDSKST

SEQ ID NO: 2735650 - protein, 4 aa, Entamoeba histolytica
GDVL

SEQ ID NO: 2735651 - protein, 9 aa, Entamoeba histolytica
GDVPESEIQ

SEQ ID NO: 2735652 - protein, 6 aa, Entamoeba histolytica
GDYKVD

SEQ ID NO: 2735653 - protein, 8 aa, Entamoeba histolytica
GDYNPTPN

SEQ ID NO: 2735654 - protein, 21 aa, Entamoeba histolytica
GEAKPYLQSRKREDVGEDEIV

SEQ ID NO: 2735655 - protein, 6 aa, Entamoeba histolytica
GECQGM

SEQ ID NO: 2735656 - protein, 8 aa, Entamoeba histolytica
GEDNFNGA

SEQ ID NO: 2735657 - protein, 10 aa, Entamoeba histolytica
GEEKIYSPEE

SEQ ID NO: 2735658 - protein, 14 aa, Entamoeba histolytica
GEESKKFQEQRTVE

SEQ ID NO: 2735659 - protein, 15 aa, Entamoeba histolytica
GEFNANTKTSIGSDV

SEQ ID NO: 2735660 - protein, 10 aa, Entamoeba histolytica
GEGNAPENKD

SEQ ID NO: 2735661 - protein, 10 aa, Entamoeba histolytica
GEGPASPKVL

SEQ ID NO: 2735662 - protein, 10 aa, Entamoeba histolytica
GEGPEDETGL

SEQ ID NO: 2735663 - protein, 6 aa, Entamoeba histolytica
GEGTYE

SEQ ID NO: 2735664 - protein, 7 aa, Entamoeba histolytica
GEGYKMD

SEQ ID NO: 2735665 - protein, 7 aa, Entamoeba histolytica
GEINGYR

SEQ ID NO: 2735666 - protein, 5 aa, Entamoeba histolytica
GEKAY

SEQ ID NO: 2735667 - protein, 8 aa, Entamoeba histolytica
GEKGIGKY

SEQ ID NO: 2735668 - protein, 14 aa, Entamoeba histolytica
GEKGMGKSGKPLHY

SEQ ID NO: 2735669 - protein, 5 aa, Entamoeba histolytica
GEKGS

SEQ ID NO: 2735670 - protein, 11 aa, Entamoeba histolytica
GEKRTSDEERK

SEQ ID NO: 2735671 - protein, 25 aa, Entamoeba histolytica
GELDKGNKKAAVKLATQASTLADKA

SEQ ID NO: 2735672 - protein, 4 aa, Entamoeba histolytica
GEMN

SEQ ID NO: 2735673 - protein, 7 aa, Entamoeba histolytica
GENKGDK

SEQ ID NO: 2735674 - protein, 9 aa, Entamoeba histolytica
GENKNVTDY

SEQ ID NO: 2735675 - protein, 11 aa, Entamoeba histolytica
GENYENVTTRD

SEQ ID NO: 2735676 - protein, 6 aa, Entamoeba histolytica
GEPYSK

SEQ ID NO: 2735677 - protein, 5 aa, Entamoeba histolytica
GEQYR

SEQ ID NO: 2735678 - protein, 11 aa, Entamoeba histolytica
GESEEVKSKGF

SEQ ID NO: 2735679 - protein, 6 aa, Entamoeba histolytica
GESVSV

SEQ ID NO: 2735680 - protein, 9 aa, Entamoeba histolytica
GETSECSKC

SEQ ID NO: 2735681 - protein, 6 aa, Entamoeba histolytica
GEVDGL

SEQ ID NO: 2735682 - protein, 9 aa, Entamoeba histolytica
GEVSQEPTM

SEQ ID NO: 2735683 - protein, 12 aa, Entamoeba histolytica
GEYKVEKVQENK

SEQ ID NO: 2735684 - protein, 5 aa, Entamoeba histolytica
GEYSS

SEQ ID NO: 2735685 - protein, 6 aa, Entamoeba histolytica
GFDEGA

SEQ ID NO: 2735686 - protein, 5 aa, Entamoeba histolytica
GFRSD

SEQ ID NO: 2735687 - protein, 19 aa, Entamoeba histolytica
GFSQNSTNKLSTKVGSEYP

SEQ ID NO: 2735688 - protein, 5 aa, Entamoeba histolytica
GGAIR

SEQ ID NO: 2735689 - protein, 14 aa, Entamoeba histolytica
GGDDDDPSNGSKES

SEQ ID NO: 2735690 - protein, 136 aa, Entamoeba histolytica
GGDISEAAKHSVEEQVSQEIPTETKVQEEVGNHNKERKEKEIDGTSVISPESSSSDEKSKEGTGSIKSGQQTSTNELPHTTAPNTQTNTNEDSQAERKDPISTSTTTTKDITKLSNGADTLSSGISGKEQGTTDTT

SEQ ID NO: 2735691 - protein, 6 aa, Entamoeba histolytica
GGDLGT

SEQ ID NO: 2735692 - protein, 6 aa, Entamoeba histolytica
GGDVSI

SEQ ID NO: 2735693 - protein, 11 aa, Entamoeba histolytica
GGEGTQRAAAV

SEQ ID NO: 2735694 - protein, 8 aa, Entamoeba histolytica
GGKIEEQK

SEQ ID NO: 2735695 - protein, 8 aa, Entamoeba histolytica
GGKITKKY

SEQ ID NO: 2735696 - protein, 8 aa, Entamoeba histolytica
GGLKTATG

SEQ ID NO: 2735697 - protein, 6 aa, Entamoeba histolytica
GGNVGD

SEQ ID NO: 2735698 - protein, 8 aa, Entamoeba histolytica
GGNVGDSV

SEQ ID NO: 2735699 - protein, 5 aa, Entamoeba histolytica
GGPDE

SEQ ID NO: 2735700 - protein, 8 aa, Entamoeba histolytica
GGPESPWT

SEQ ID NO: 2735701 - protein, 4 aa, Entamoeba histolytica
GGQL

SEQ ID NO: 2735702 - protein, 7 aa, Entamoeba histolytica
GGQSSLR

SEQ ID NO: 2735703 - protein, 15 aa, Entamoeba histolytica
GGRMTFSKSKQSNYA

SEQ ID NO: 2735704 - protein, 12 aa, Entamoeba histolytica
GGRVASDSSTTT

SEQ ID NO: 2735705 - protein, 5 aa, Entamoeba histolytica
GGSDY

SEQ ID NO: 2735706 - protein, 8 aa, Entamoeba histolytica
GGSIDSTK

SEQ ID NO: 2735707 - protein, 9 aa, Entamoeba histolytica
GGTDNGHIE

SEQ ID NO: 2735708 - protein, 4 aa, Entamoeba histolytica
GGTF

SEQ ID NO: 2735709 - protein, 6 aa, Entamoeba histolytica
GGTHGM

SEQ ID NO: 2735710 - protein, 12 aa, Entamoeba histolytica
GGVNHSKRDLSG

SEQ ID NO: 2735711 - protein, 27 aa, Entamoeba histolytica
GGWSNPAIKQYQGTTSMCSASVDLSYQ

SEQ ID NO: 2735712 - protein, 4 aa, Entamoeba histolytica
GGWT

SEQ ID NO: 2735713 - protein, 14 aa, Entamoeba histolytica
GGWTSPSMKQYRGD

SEQ ID NO: 2735714 - protein, 7 aa, Entamoeba histolytica
GHESIDG

SEQ ID NO: 2735715 - protein, 6 aa, Entamoeba histolytica
GHQPNK

SEQ ID NO: 2735716 - protein, 7 aa, Entamoeba histolytica
GHVGTTY

SEQ ID NO: 2735717 - protein, 12 aa, Entamoeba histolytica
GHYQGVNNSDAI

SEQ ID NO: 2735718 - protein, 5 aa, Entamoeba histolytica
GINTL

SEQ ID NO: 2735719 - protein, 20 aa, Entamoeba histolytica
GINTSSGNEQPERPKEEEVP

SEQ ID NO: 2735720 - protein, 10 aa, Entamoeba histolytica
GIQPAPRGVP

SEQ ID NO: 2735721 - protein, 6 aa, Entamoeba histolytica
GIQRKE

SEQ ID NO: 2735722 - protein, 8 aa, Entamoeba histolytica
GITTDSTK

SEQ ID NO: 2735723 - protein, 4 aa, Entamoeba histolytica
GIYS

SEQ ID NO: 2735724 - protein, 5 aa, Entamoeba histolytica
GIYTN

SEQ ID NO: 2735725 - protein, 6 aa, Entamoeba histolytica
GKAGNI

SEQ ID NO: 2735726 - protein, 4 aa, Entamoeba histolytica
GKCE

SEQ ID NO: 2735727 - protein, 8 aa, Entamoeba histolytica
GKDGLTAN

SEQ ID NO: 2735728 - protein, 8 aa, Entamoeba histolytica
GKDTKAIK

SEQ ID NO: 2735729 - protein, 6 aa, Entamoeba histolytica
GKDYER

SEQ ID NO: 2735730 - protein, 9 aa, Entamoeba histolytica
GKEGAANEF

SEQ ID NO: 2735731 - protein, 12 aa, Entamoeba histolytica
GKEHGKKHKTKV

SEQ ID NO: 2735732 - protein, 43 aa, Entamoeba histolytica
GKEMKGKRCSISTNVPQEIQEEMKKEQNKLKERIQKASNRIKA

SEQ ID NO: 2735733 - protein, 14 aa, Entamoeba histolytica
GKEPNKDVNPDEAV

SEQ ID NO: 2735734 - protein, 14 aa, Entamoeba histolytica
GKEPSRGINPDEAV

SEQ ID NO: 2735735 - protein, 7 aa, Entamoeba histolytica
GKETPYS

SEQ ID NO: 2735736 - protein, 9 aa, Entamoeba histolytica
GKEYPGNSR

SEQ ID NO: 2735737 - protein, 8 aa, Entamoeba histolytica
GKIQTEYN

SEQ ID NO: 2735738 - protein, 11 aa, Entamoeba histolytica
GKKEYNYTGSS

SEQ ID NO: 2735739 - protein, 6 aa, Entamoeba histolytica
GKKNGF

SEQ ID NO: 2735740 - protein, 10 aa, Entamoeba histolytica
GKKQTTTYQA

SEQ ID NO: 2735741 - protein, 9 aa, Entamoeba histolytica
GKKSTQYKA

SEQ ID NO: 2735742 - protein, 7 aa, Entamoeba histolytica
GKKTFSD

SEQ ID NO: 2735743 - protein, 21 aa, Entamoeba histolytica
GKKTNKYDEQTVNDLDQRKKA

SEQ ID NO: 2735744 - protein, 8 aa, Entamoeba histolytica
GKKYYPKD

SEQ ID NO: 2735745 - protein, 6 aa, Entamoeba histolytica
GKLESI

SEQ ID NO: 2735746 - protein, 5 aa, Entamoeba histolytica
GKMVG

SEQ ID NO: 2735747 - protein, 6 aa, Entamoeba histolytica
GKPLGG

SEQ ID NO: 2735748 - protein, 7 aa, Entamoeba histolytica
GKPSEVV

SEQ ID NO: 2735749 - protein, 4 aa, Entamoeba histolytica
GKQF

SEQ ID NO: 2735750 - protein, 15 aa, Entamoeba histolytica
GKSYMTPVKDQGNCG

SEQ ID NO: 2735751 - protein, 16 aa, Entamoeba histolytica
GKTDASAKTISTTTEW

SEQ ID NO: 2735752 - protein, 6 aa, Entamoeba histolytica
GKTKYN

SEQ ID NO: 2735753 - protein, 25 aa, Entamoeba histolytica
GKTNDNRDQFSPNYPYGKQNQGTKF

SEQ ID NO: 2735754 - protein, 9 aa, Entamoeba histolytica
GKTNKSVEK

SEQ ID NO: 2735755 - protein, 18 aa, Entamoeba histolytica
GKTQDGKDQLSPNYPYGK

SEQ ID NO: 2735756 - protein, 5 aa, Entamoeba histolytica
GKTTI

SEQ ID NO: 2735757 - protein, 11 aa, Entamoeba histolytica
GKWSKKATGSK

SEQ ID NO: 2735758 - protein, 9 aa, Entamoeba histolytica
GKYGKTYSA

SEQ ID NO: 2735759 - protein, 5 aa, Entamoeba histolytica
GLDMT

SEQ ID NO: 2735760 - protein, 7 aa, Entamoeba histolytica
GLDNETG

SEQ ID NO: 2735761 - protein, 49 aa, Entamoeba histolytica
GLETEQYNEQGNKDDNKHEDNMVDSTRTTQHKHENKYNDDENTQHQTYN

SEQ ID NO: 2735762 - protein, 9 aa, Entamoeba histolytica
GLKSSGQFD

SEQ ID NO: 2735763 - protein, 10 aa, Entamoeba histolytica
GLLERTNNKY

SEQ ID NO: 2735764 - protein, 18 aa, Entamoeba histolytica
GLMEEKDNPYTGKDGKCL

SEQ ID NO: 2735765 - protein, 8 aa, Entamoeba histolytica
GLNPRARN

SEQ ID NO: 2735766 - protein, 14 aa, Entamoeba histolytica
GLQEQRAKRRMQDQ

SEQ ID NO: 2735767 - protein, 4 aa, Entamoeba histolytica
GLTL

SEQ ID NO: 2735768 - protein, 22 aa, Entamoeba histolytica
GNCDDKTLAQLSQQTQKLKQEI

SEQ ID NO: 2735769 - protein, 6 aa, Entamoeba histolytica
GNCDDT

SEQ ID NO: 2735770 - protein, 10 aa, Entamoeba histolytica
GNCKKEEENL

SEQ ID NO: 2735771 - protein, 12 aa, Entamoeba histolytica
GNCTTNSDKSSD

SEQ ID NO: 2735772 - protein, 12 aa, Entamoeba histolytica
GNDHCEKTKDNY

SEQ ID NO: 2735773 - protein, 9 aa, Entamoeba histolytica
GNDKYTGKI

SEQ ID NO: 2735774 - protein, 9 aa, Entamoeba histolytica
GNDNQKIDR

SEQ ID NO: 2735775 - protein, 6 aa, Entamoeba histolytica
GNEIQN

SEQ ID NO: 2735776 - protein, 9 aa, Entamoeba histolytica
GNEKTGKNN

SEQ ID NO: 2735777 - protein, 7 aa, Entamoeba histolytica
GNELSKQ

SEQ ID NO: 2735778 - protein, 4 aa, Entamoeba histolytica
GNET

SEQ ID NO: 2735779 - protein, 6 aa, Entamoeba histolytica
GNGENT

SEQ ID NO: 2735780 - protein, 5 aa, Entamoeba histolytica
GNGKL

SEQ ID NO: 2735781 - protein, 14 aa, Entamoeba histolytica
GNGNQTSGAKNEWA

SEQ ID NO: 2735782 - protein, 6 aa, Entamoeba histolytica
GNGVNV

SEQ ID NO: 2735783 - protein, 7 aa, Entamoeba histolytica
GNGYTQN

SEQ ID NO: 2735784 - protein, 7 aa, Entamoeba histolytica
GNHKPAR

SEQ ID NO: 2735785 - protein, 9 aa, Entamoeba histolytica
GNKKYSANN

SEQ ID NO: 2735786 - protein, 9 aa, Entamoeba histolytica
GNKTVEDNE

SEQ ID NO: 2735787 - protein, 7 aa, Entamoeba histolytica
GNKYPLK

SEQ ID NO: 2735788 - protein, 9 aa, Entamoeba histolytica
GNPTTFNPN

SEQ ID NO: 2735789 - protein, 6 aa, Entamoeba histolytica
GNRSNV

SEQ ID NO: 2735790 - protein, 6 aa, Entamoeba histolytica
GNSDEN

SEQ ID NO: 2735791 - protein, 9 aa, Entamoeba histolytica
GNSKPADEL

SEQ ID NO: 2735792 - protein, 9 aa, Entamoeba histolytica
GNSTNNYKK

SEQ ID NO: 2735793 - protein, 5 aa, Entamoeba histolytica
GNSWG

SEQ ID NO: 2735794 - protein, 90 aa, Entamoeba histolytica
GNTPDCDGKPGKYFSGTTPEEPSESSTVNPPEDSSSIPPSPDSSSTPVSSSSHTPEPSESSSQQKSESSTSQSSNNSGDDDYNPDWPDVE

SEQ ID NO: 2735795 - protein, 6 aa, Entamoeba histolytica
GNTPGY

SEQ ID NO: 2735796 - protein, 4 aa, Entamoeba histolytica
GNTY

SEQ ID NO: 2735797 - protein, 26 aa, Entamoeba histolytica
GNVKNDKLDLSANAEFGKNNKKADLT

SEQ ID NO: 2735798 - protein, 7 aa, Entamoeba histolytica
GPEVTMP

SEQ ID NO: 2735799 - protein, 12 aa, Entamoeba histolytica
GPGLDEESSGYL

SEQ ID NO: 2735800 - protein, 4 aa, Entamoeba histolytica
GPKP

SEQ ID NO: 2735801 - protein, 5 aa, Entamoeba histolytica
GPKVT

SEQ ID NO: 2735802 - protein, 6 aa, Entamoeba histolytica
GPSQKP

SEQ ID NO: 2735803 - protein, 10 aa, Entamoeba histolytica
GPTHEGGLPP

SEQ ID NO: 2735804 - protein, 12 aa, Entamoeba histolytica
GPVGSAMDASRS

SEQ ID NO: 2735805 - protein, 6 aa, Entamoeba histolytica
GPYAAM

SEQ ID NO: 2735806 - protein, 4 aa, Entamoeba histolytica
GPYP

SEQ ID NO: 2735807 - protein, 7 aa, Entamoeba histolytica
GQDEMVP

SEQ ID NO: 2735808 - protein, 6 aa, Entamoeba histolytica
GQENQE

SEQ ID NO: 2735809 - protein, 14 aa, Entamoeba histolytica
GQEQPQRPKKTPDI

SEQ ID NO: 2735810 - protein, 12 aa, Entamoeba histolytica
GQLNKYAGRIPK

SEQ ID NO: 2735811 - protein, 12 aa, Entamoeba histolytica
GQNDITSEIPND

SEQ ID NO: 2735812 - protein, 12 aa, Entamoeba histolytica
GQPLGQPTGGKL

SEQ ID NO: 2735813 - protein, 4 aa, Entamoeba histolytica
GQSS

SEQ ID NO: 2735814 - protein, 9 aa, Entamoeba histolytica
GQTSAPSAT

SEQ ID NO: 2735815 - protein, 8 aa, Entamoeba histolytica
GQTSVTKE

SEQ ID NO: 2735816 - protein, 13 aa, Entamoeba histolytica
GQWSSDKTLNQQT

SEQ ID NO: 2735817 - protein, 4 aa, Entamoeba histolytica
GQYS

SEQ ID NO: 2735818 - protein, 21 aa, Entamoeba histolytica
GRAEGKFYTDDGISVDNSDNY

SEQ ID NO: 2735819 - protein, 12 aa, Entamoeba histolytica
GRDSNYPTGVKL

SEQ ID NO: 2735820 - protein, 6 aa, Entamoeba histolytica
GRGKYS

SEQ ID NO: 2735821 - protein, 10 aa, Entamoeba histolytica
GRNNENAYKN

SEQ ID NO: 2735822 - protein, 7 aa, Entamoeba histolytica
GRSEHDI

SEQ ID NO: 2735823 - protein, 14 aa, Entamoeba histolytica
GRSKKVYGGERNVE

SEQ ID NO: 2735824 - protein, 5 aa, Entamoeba histolytica
GRTQY

SEQ ID NO: 2735825 - protein, 7 aa, Entamoeba histolytica
GRVDRTN

SEQ ID NO: 2735826 - protein, 9 aa, Entamoeba histolytica
GSANLDTTI

SEQ ID NO: 2735827 - protein, 7 aa, Entamoeba histolytica
GSATSME

SEQ ID NO: 2735828 - protein, 12 aa, Entamoeba histolytica
GSCRGNASISNN

SEQ ID NO: 2735829 - protein, 10 aa, Entamoeba histolytica
GSDESYSLSI

SEQ ID NO: 2735830 - protein, 10 aa, Entamoeba histolytica
GSDISKEYRK

SEQ ID NO: 2735831 - protein, 6 aa, Entamoeba histolytica
GSDQAT

SEQ ID NO: 2735832 - protein, 14 aa, Entamoeba histolytica
GSFDPNAKSINENA

SEQ ID NO: 2735833 - protein, 5 aa, Entamoeba histolytica
GSGCG

SEQ ID NO: 2735834 - protein, 7 aa, Entamoeba histolytica
GSGVGKT

SEQ ID NO: 2735835 - protein, 11 aa, Entamoeba histolytica
GSHGPNTYDSL

SEQ ID NO: 2735836 - protein, 9 aa, Entamoeba histolytica
GSITSESCS

SEQ ID NO: 2735837 - protein, 5 aa, Entamoeba histolytica
GSKDK

SEQ ID NO: 2735838 - protein, 6 aa, Entamoeba histolytica
GSNTVE

SEQ ID NO: 2735839 - protein, 9 aa, Entamoeba histolytica
GSQTYNADN

SEQ ID NO: 2735840 - protein, 7 aa, Entamoeba histolytica
GSSKTTL

SEQ ID NO: 2735841 - protein, 14 aa, Entamoeba histolytica
GSSLGSKKVSKNQF

SEQ ID NO: 2735842 - protein, 7 aa, Entamoeba histolytica
GSTEGGE

SEQ ID NO: 2735843 - protein, 5 aa, Entamoeba histolytica
GSTFT

SEQ ID NO: 2735844 - protein, 7 aa, Entamoeba histolytica
GSTRIPK

SEQ ID NO: 2735845 - protein, 5 aa, Entamoeba histolytica
GSVGS

SEQ ID NO: 2735846 - protein, 15 aa, Entamoeba histolytica
GSVPRANAAGALAAT

SEQ ID NO: 2735847 - protein, 17 aa, Entamoeba histolytica
GSYESKNGKLSATGDFS

SEQ ID NO: 2735848 - protein, 11 aa, Entamoeba histolytica
GSYNGSSNINC

SEQ ID NO: 2735849 - protein, 6 aa, Entamoeba histolytica
GTAPMV

SEQ ID NO: 2735850 - protein, 8 aa, Entamoeba histolytica
GTASGKTT

SEQ ID NO: 2735851 - protein, 19 aa, Entamoeba histolytica
GTDKYTGKINTAEFPGAAY

SEQ ID NO: 2735852 - protein, 8 aa, Entamoeba histolytica
GTEEEEKT

SEQ ID NO: 2735853 - protein, 5 aa, Entamoeba histolytica
GTEGY

SEQ ID NO: 2735854 - protein, 5 aa, Entamoeba histolytica
GTENF

SEQ ID NO: 2735855 - protein, 4 aa, Entamoeba histolytica
GTFT

SEQ ID NO: 2735856 - protein, 22 aa, Entamoeba histolytica
GTGDTAEYNPKDGAGDDNKDPI

SEQ ID NO: 2735857 - protein, 11 aa, Entamoeba histolytica
GTGGDTPDDVK

SEQ ID NO: 2735858 - protein, 4 aa, Entamoeba histolytica
GTGP

SEQ ID NO: 2735859 - protein, 7 aa, Entamoeba histolytica
GTGWGDK

SEQ ID NO: 2735860 - protein, 5 aa, Entamoeba histolytica
GTHCE

SEQ ID NO: 2735861 - protein, 4 aa, Entamoeba histolytica
GTHG

SEQ ID NO: 2735862 - protein, 9 aa, Entamoeba histolytica
GTHVPTKKS

SEQ ID NO: 2735863 - protein, 10 aa, Entamoeba histolytica
GTIAKSGTAE

SEQ ID NO: 2735864 - protein, 11 aa, Entamoeba histolytica
GTIYSDTKCRS

SEQ ID NO: 2735865 - protein, 20 aa, Entamoeba histolytica
GTKKTYPVSNPTNKQKYSYS

SEQ ID NO: 2735866 - protein, 7 aa, Entamoeba histolytica
GTQRRRY

SEQ ID NO: 2735867 - protein, 10 aa, Entamoeba histolytica
GTRAENSHDI

SEQ ID NO: 2735868 - protein, 8 aa, Entamoeba histolytica
GTSPSIRK

SEQ ID NO: 2735869 - protein, 4 aa, Entamoeba histolytica
GTSW

SEQ ID NO: 2735870 - protein, 6 aa, Entamoeba histolytica
GTSWGD

SEQ ID NO: 2735871 - protein, 8 aa, Entamoeba histolytica
GTTRYTAQ

SEQ ID NO: 2735872 - protein, 7 aa, Entamoeba histolytica
GTTTLPN

SEQ ID NO: 2735873 - protein, 6 aa, Entamoeba histolytica
GTTTND

SEQ ID NO: 2735874 - protein, 6 aa, Entamoeba histolytica
GTTYAS

SEQ ID NO: 2735875 - protein, 24 aa, Entamoeba histolytica
GTTYTGSKFNGNAKYNKKLDPMGK

SEQ ID NO: 2735876 - protein, 6 aa, Entamoeba histolytica
GTYSST

SEQ ID NO: 2735877 - protein, 14 aa, Entamoeba histolytica
GVATDPLYPTGVQY

SEQ ID NO: 2735878 - protein, 11 aa, Entamoeba histolytica
GVEKQEGKFDE

SEQ ID NO: 2735879 - protein, 33 aa, Entamoeba histolytica
GVHKDSETAKYEATFSPQTYQLNETSSEDAKGQ

SEQ ID NO: 2735880 - protein, 26 aa, Entamoeba histolytica
GVNSDGKPLAADYHDQNDVPSENDYS

SEQ ID NO: 2735881 - protein, 5 aa, Entamoeba histolytica
GVPST

SEQ ID NO: 2735882 - protein, 7 aa, Entamoeba histolytica
GVYDEPK

SEQ ID NO: 2735883 - protein, 6 aa, Entamoeba histolytica
GVYTKS

SEQ ID NO: 2735884 - protein, 5 aa, Entamoeba histolytica
GYGAD

SEQ ID NO: 2735885 - protein, 8 aa, Entamoeba histolytica
GYGEQAEP

SEQ ID NO: 2735886 - protein, 13 aa, Entamoeba histolytica
GYGIDEEGKCKDV

SEQ ID NO: 2735887 - protein, 14 aa, Entamoeba histolytica
GYGNSTGKPSEQGF

SEQ ID NO: 2735888 - protein, 9 aa, Entamoeba histolytica
GYGSNSNGK

SEQ ID NO: 2735889 - protein, 9 aa, Entamoeba histolytica
GYGSQDGQD

SEQ ID NO: 2735890 - protein, 10 aa, Entamoeba histolytica
GYGSQDGQDY

SEQ ID NO: 2735891 - protein, 4 aa, Entamoeba histolytica
GYKD

SEQ ID NO: 2735892 - protein, 8 aa, Entamoeba histolytica
GYKDKKSL

SEQ ID NO: 2735893 - protein, 8 aa, Entamoeba histolytica
GYKKNNQK

SEQ ID NO: 2735894 - protein, 12 aa, Entamoeba histolytica
GYPNDPLVNDPG

SEQ ID NO: 2735895 - protein, 9 aa, Entamoeba histolytica
GYRKTGQRA

SEQ ID NO: 2735896 - protein, 4 aa, Entamoeba histolytica
GYSL

SEQ ID NO: 2735897 - protein, 6 aa, Entamoeba histolytica
GYSTYS

SEQ ID NO: 2735898 - protein, 11 aa, Entamoeba histolytica
GYTVTDSNEYA

SEQ ID NO: 2735899 - protein, 12 aa, Entamoeba histolytica
GYYNTNNQNAYA

SEQ ID NO: 2735900 - protein, 6 aa, Entamoeba histolytica
HASSNT

SEQ ID NO: 2735901 - protein, 11 aa, Entamoeba histolytica
HATANKKDFNL

SEQ ID NO: 2735902 - protein, 4 aa, Entamoeba histolytica
HDDT

SEQ ID NO: 2735903 - protein, 8 aa, Entamoeba histolytica
HDEESEYK

SEQ ID NO: 2735904 - protein, 9 aa, Entamoeba histolytica
HDENRAVQN

SEQ ID NO: 2735905 - protein, 8 aa, Entamoeba histolytica
HDETKTLR

SEQ ID NO: 2735906 - protein, 6 aa, Entamoeba histolytica
HDSQSI

SEQ ID NO: 2735907 - protein, 4 aa, Entamoeba histolytica
HDTS

SEQ ID NO: 2735908 - protein, 14 aa, Entamoeba histolytica
HEDRRKLEKKAEQK

SEQ ID NO: 2735909 - protein, 6 aa, Entamoeba histolytica
HEEEKV

SEQ ID NO: 2735910 - protein, 4 aa, Entamoeba histolytica
HERA

SEQ ID NO: 2735911 - protein, 5 aa, Entamoeba histolytica
HESIS

SEQ ID NO: 2735912 - protein, 306 aa, Entamoeba histolytica
HESTEAQNIQTKQDVSPKNSNDSGEQKETKIVTPNTETQTTSTTNVPTQGTDTHNNPESTVTHPESKVNQNPTSESGTISPSNGQSEATPANTEGSTNSASSTSSNKQTDSSNGNNADKNKQGDSPEGSGKSPKPTNGQEESINQNEQTTTGSGKDSGKGESTTATTQDGQGTTDRPTGEGNNVTPTNGKNDVPTDGTSTKEDGKGSKTEESEKVTDGTGKESGQKPKDGEDGKQTKGQNENTTDSKTDSKENTKTNSEQNGKNSSNEKQQTTSEEKHNTTNTNSENKTDDKSNNINDEQNEHHNM

SEQ ID NO: 2735913 - protein, 5 aa, Entamoeba histolytica
HETGD

SEQ ID NO: 2735914 - protein, 7 aa, Entamoeba histolytica
HETGKKV

SEQ ID NO: 2735915 - protein, 6 aa, Entamoeba histolytica
HETLPS

SEQ ID NO: 2735916 - protein, 5 aa, Entamoeba histolytica
HFDPV

SEQ ID NO: 2735917 - protein, 10 aa, Entamoeba histolytica
HFGGNKKNGG

SEQ ID NO: 2735918 - protein, 15 aa, Entamoeba histolytica
HGDRAPGDSFYGDNG

SEQ ID NO: 2735919 - protein, 5 aa, Entamoeba histolytica
HGGIS

SEQ ID NO: 2735920 - protein, 9 aa, Entamoeba histolytica
HGKGTVTKS

SEQ ID NO: 2735921 - protein, 6 aa, Entamoeba histolytica
HGNHTR

SEQ ID NO: 2735922 - protein, 8 aa, Entamoeba histolytica
HGSGSYGD

SEQ ID NO: 2735923 - protein, 11 aa, Entamoeba histolytica
HGSRYPTSNDI

SEQ ID NO: 2735924 - protein, 9 aa, Entamoeba histolytica
HGTSQSQLS

SEQ ID NO: 2735925 - protein, 11 aa, Entamoeba histolytica
HHGSQTSNTAG

SEQ ID NO: 2735926 - protein, 5 aa, Entamoeba histolytica
HISPS

SEQ ID NO: 2735927 - protein, 6 aa, Entamoeba histolytica
HKEPYA

SEQ ID NO: 2735928 - protein, 8 aa, Entamoeba histolytica
HKGEYVKQ

SEQ ID NO: 2735929 - protein, 12 aa, Entamoeba histolytica
HKGYQNHETTVS

SEQ ID NO: 2735930 - protein, 13 aa, Entamoeba histolytica
HKSYCKRDGVSAY

SEQ ID NO: 2735931 - protein, 7 aa, Entamoeba histolytica
HKVSQPS

SEQ ID NO: 2735932 - protein, 11 aa, Entamoeba histolytica
HLTTTTTSYQI

SEQ ID NO: 2735933 - protein, 10 aa, Entamoeba histolytica
HNAKESSYTM

SEQ ID NO: 2735934 - protein, 4 aa, Entamoeba histolytica
HNAS

SEQ ID NO: 2735935 - protein, 7 aa, Entamoeba histolytica
HNGVTGS

SEQ ID NO: 2735936 - protein, 8 aa, Entamoeba histolytica
HNIRSSSS

SEQ ID NO: 2735937 - protein, 6 aa, Entamoeba histolytica
HNPHSF

SEQ ID NO: 2735938 - protein, 6 aa, Entamoeba histolytica
HNPSFS

SEQ ID NO: 2735939 - protein, 8 aa, Entamoeba histolytica
HNQTEHDT

SEQ ID NO: 2735940 - protein, 5 aa, Entamoeba histolytica
HNTEV

SEQ ID NO: 2735941 - protein, 16 aa, Entamoeba histolytica
HPDKPTGDKKKYEQIN

SEQ ID NO: 2735942 - protein, 10 aa, Entamoeba histolytica
HPDKPTGDKV

SEQ ID NO: 2735943 - protein, 8 aa, Entamoeba histolytica
HPDPNNIS

SEQ ID NO: 2735944 - protein, 9 aa, Entamoeba histolytica
HPEKGRRVR

SEQ ID NO: 2735945 - protein, 8 aa, Entamoeba histolytica
HPETRGDA

SEQ ID NO: 2735946 - protein, 11 aa, Entamoeba histolytica
HPPSKYDNNPT

SEQ ID NO: 2735947 - protein, 4 aa, Entamoeba histolytica
HPYP

SEQ ID NO: 2735948 - protein, 8 aa, Entamoeba histolytica
HQCEDNGV

SEQ ID NO: 2735949 - protein, 4 aa, Entamoeba histolytica
HQDH

SEQ ID NO: 2735950 - protein, 4 aa, Entamoeba histolytica
HQFN

SEQ ID NO: 2735951 - protein, 4 aa, Entamoeba histolytica
HQKL

SEQ ID NO: 2735952 - protein, 5 aa, Entamoeba histolytica
HQSES

SEQ ID NO: 2735953 - protein, 6 aa, Entamoeba histolytica
HSFKET

SEQ ID NO: 2735954 - protein, 15 aa, Entamoeba histolytica
HSHNSVSSRTDNAVH

SEQ ID NO: 2735955 - protein, 6 aa, Entamoeba histolytica
HSNRYG

SEQ ID NO: 2735956 - protein, 13 aa, Entamoeba histolytica
HSNSTYVQFYNHT

SEQ ID NO: 2735957 - protein, 6 aa, Entamoeba histolytica
HSPPLA

SEQ ID NO: 2735958 - protein, 9 aa, Entamoeba histolytica
HSSKQAKYS

SEQ ID NO: 2735959 - protein, 11 aa, Entamoeba histolytica
HSTNGNTKLPS

SEQ ID NO: 2735960 - protein, 9 aa, Entamoeba histolytica
HSTNSQPHK

SEQ ID NO: 2735961 - protein, 6 aa, Entamoeba histolytica
HTDDKK

SEQ ID NO: 2735962 - protein, 10 aa, Entamoeba histolytica
HTGPKLSASA

SEQ ID NO: 2735963 - protein, 12 aa, Entamoeba histolytica
HTKGETSYEENG

SEQ ID NO: 2735964 - protein, 10 aa, Entamoeba histolytica
HTLNSQTMDR

SEQ ID NO: 2735965 - protein, 4 aa, Entamoeba histolytica
HTNK

SEQ ID NO: 2735966 - protein, 7 aa, Entamoeba histolytica
HTNPPHT

SEQ ID NO: 2735967 - protein, 4 aa, Entamoeba histolytica
HTRF

SEQ ID NO: 2735968 - protein, 8 aa, Entamoeba histolytica
HVENTRNT

SEQ ID NO: 2735969 - protein, 5 aa, Entamoeba histolytica
HVSDE

SEQ ID NO: 2735970 - protein, 11 aa, Entamoeba histolytica
IADEEQPSSTA

SEQ ID NO: 2735971 - protein, 8 aa, Entamoeba histolytica
IAEGNENE

SEQ ID NO: 2735972 - protein, 6 aa, Entamoeba histolytica
IAGDTA

SEQ ID NO: 2735973 - protein, 9 aa, Entamoeba histolytica
IAKRNRKAA

SEQ ID NO: 2735974 - protein, 10 aa, Entamoeba histolytica
IANEPNADQE

SEQ ID NO: 2735975 - protein, 4 aa, Entamoeba histolytica
IAPA

SEQ ID NO: 2735976 - protein, 8 aa, Entamoeba histolytica
IAQAKGNN

SEQ ID NO: 2735977 - protein, 4 aa, Entamoeba histolytica
IAQE

SEQ ID NO: 2735978 - protein, 9 aa, Entamoeba histolytica
IAQKGTDTD

SEQ ID NO: 2735979 - protein, 7 aa, Entamoeba histolytica
IARSNKI

SEQ ID NO: 2735980 - protein, 5 aa, Entamoeba histolytica
IATIG

SEQ ID NO: 2735981 - protein, 10 aa, Entamoeba histolytica
ICDTSSSSFM

SEQ ID NO: 2735982 - protein, 21 aa, Entamoeba histolytica
ICPGNTPSGDTSDNNDDSAPS

SEQ ID NO: 2735983 - protein, 7 aa, Entamoeba histolytica
IDAERRR

SEQ ID NO: 2735984 - protein, 4 aa, Entamoeba histolytica
IDAS

SEQ ID NO: 2735985 - protein, 7 aa, Entamoeba histolytica
IDASSAK

SEQ ID NO: 2735986 - protein, 12 aa, Entamoeba histolytica
IDDEQSQDNLKN

SEQ ID NO: 2735987 - protein, 9 aa, Entamoeba histolytica
IDDESHEVR

SEQ ID NO: 2735988 - protein, 15 aa, Entamoeba histolytica
IDEVKGCKGEIDKEY

SEQ ID NO: 2735989 - protein, 10 aa, Entamoeba histolytica
IDGHKSLTAN

SEQ ID NO: 2735990 - protein, 6 aa, Entamoeba histolytica
IDKRQR

SEQ ID NO: 2735991 - protein, 6 aa, Entamoeba histolytica
IDNVND

SEQ ID NO: 2735992 - protein, 14 aa, Entamoeba histolytica
IDQPAPQAQKSDCP

SEQ ID NO: 2735993 - protein, 10 aa, Entamoeba histolytica
IDQSDADDEV

SEQ ID NO: 2735994 - protein, 11 aa, Entamoeba histolytica
IDSKNNQGKIS

SEQ ID NO: 2735995 - protein, 12 aa, Entamoeba histolytica
IDSTSSGKALGP

SEQ ID NO: 2735996 - protein, 9 aa, Entamoeba histolytica
IDTGDGTWK

SEQ ID NO: 2735997 - protein, 6 aa, Entamoeba histolytica
IEARSS

SEQ ID NO: 2735998 - protein, 10 aa, Entamoeba histolytica
IEDTKEDKIF

SEQ ID NO: 2735999 - protein, 8 aa, Entamoeba histolytica
IEEAEKEA

SEQ ID NO: 2736000 - protein, 5 aa, Entamoeba histolytica
IEENE

SEQ ID NO: 2736001 - protein, 7 aa, Entamoeba histolytica
IEEPTNG

SEQ ID NO: 2736002 - protein, 5 aa, Entamoeba histolytica
IEETQ

SEQ ID NO: 2736003 - protein, 22 aa, Entamoeba histolytica
IEEYQKNKKEMERLTEKREELN

SEQ ID NO: 2736004 - protein, 9 aa, Entamoeba histolytica
IEGATQETN

SEQ ID NO: 2736005 - protein, 7 aa, Entamoeba histolytica
IEGDQQK

SEQ ID NO: 2736006 - protein, 4 aa, Entamoeba histolytica
IEGI

SEQ ID NO: 2736007 - protein, 4 aa, Entamoeba histolytica
IEIG

SEQ ID NO: 2736008 - protein, 37 aa, Entamoeba histolytica
IEKAKKEAKKLTKASKKVTKKDSKKASSLKKSMKALK

SEQ ID NO: 2736009 - protein, 21 aa, Entamoeba histolytica
IELNKQTSYLNPESHKCTDGN

SEQ ID NO: 2736010 - protein, 6 aa, Entamoeba histolytica
IENEEG

SEQ ID NO: 2736011 - protein, 14 aa, Entamoeba histolytica
IENESLEKEKKEEF

SEQ ID NO: 2736012 - protein, 8 aa, Entamoeba histolytica
IEPPRFGS

SEQ ID NO: 2736013 - protein, 9 aa, Entamoeba histolytica
IEQQSAKVN

SEQ ID NO: 2736014 - protein, 16 aa, Entamoeba histolytica
IERKNSSSIKRYEEAS

SEQ ID NO: 2736015 - protein, 6 aa, Entamoeba histolytica
IETAAS

SEQ ID NO: 2736016 - protein, 6 aa, Entamoeba histolytica
IETINK

SEQ ID NO: 2736017 - protein, 5 aa, Entamoeba histolytica
IGEKS

SEQ ID NO: 2736018 - protein, 4 aa, Entamoeba histolytica
IGEN

SEQ ID NO: 2736019 - protein, 10 aa, Entamoeba histolytica
IGGECPTECN

SEQ ID NO: 2736020 - protein, 6 aa, Entamoeba histolytica
IGGNSR

SEQ ID NO: 2736021 - protein, 7 aa, Entamoeba histolytica
IGKKQMN

SEQ ID NO: 2736022 - protein, 10 aa, Entamoeba histolytica
IGKNSKINWN

SEQ ID NO: 2736023 - protein, 9 aa, Entamoeba histolytica
IGKSSHNDI

SEQ ID NO: 2736024 - protein, 9 aa, Entamoeba histolytica
IGNDGTTFG

SEQ ID NO: 2736025 - protein, 10 aa, Entamoeba histolytica
IGNENKGIEA

SEQ ID NO: 2736026 - protein, 6 aa, Entamoeba histolytica
IGNSSS

SEQ ID NO: 2736027 - protein, 12 aa, Entamoeba histolytica
IGQPHRPTDAYA

SEQ ID NO: 2736028 - protein, 8 aa, Entamoeba histolytica
IGRDGVKN

SEQ ID NO: 2736029 - protein, 14 aa, Entamoeba histolytica
IGSAIGRAVDKGTK

SEQ ID NO: 2736030 - protein, 6 aa, Entamoeba histolytica
IGSKKM

SEQ ID NO: 2736031 - protein, 11 aa, Entamoeba histolytica
IGTDGKIPTNV

SEQ ID NO: 2736032 - protein, 4 aa, Entamoeba histolytica
IGVE

SEQ ID NO: 2736033 - protein, 4 aa, Entamoeba histolytica
IGYH

SEQ ID NO: 2736034 - protein, 8 aa, Entamoeba histolytica
IHNTRSDS

SEQ ID NO: 2736035 - protein, 4 aa, Entamoeba histolytica
IHSE

SEQ ID NO: 2736036 - protein, 8 aa, Entamoeba histolytica
IKANPEDQ

SEQ ID NO: 2736037 - protein, 5 aa, Entamoeba histolytica
IKDEP

SEQ ID NO: 2736038 - protein, 6 aa, Entamoeba histolytica
IKEDGY

SEQ ID NO: 2736039 - protein, 10 aa, Entamoeba histolytica
IKEDNVNSDE

SEQ ID NO: 2736040 - protein, 6 aa, Entamoeba histolytica
IKEDRF

SEQ ID NO: 2736041 - protein, 8 aa, Entamoeba histolytica
IKEEGVSG

SEQ ID NO: 2736042 - protein, 16 aa, Entamoeba histolytica
IKEQTEKKKRKSKKIV

SEQ ID NO: 2736043 - protein, 5 aa, Entamoeba histolytica
IKGTE

SEQ ID NO: 2736044 - protein, 24 aa, Entamoeba histolytica
IKGTWNRKRTSERNNFKEQTEKVI

SEQ ID NO: 2736045 - protein, 4 aa, Entamoeba histolytica
IKKQ

SEQ ID NO: 2736046 - protein, 16 aa, Entamoeba histolytica
IKKQSKKVKKEVKTVT

SEQ ID NO: 2736047 - protein, 7 aa, Entamoeba histolytica
IKNHSNE

SEQ ID NO: 2736048 - protein, 257 aa, Entamoeba histolytica
IKPEQPQSAQNQQLQPTASGDTQTKESVSTAGQGTEEQHSTGQETSKTTEKNTQSSGVASSTGKDQTANADTTSPSSSSTNSKGQDAVQPNNQGNEERVEEKATEKETSTKGEDSGKQSGKEVGKEEAKPTEQADEKDKTTPPSEPNATHNNEQGEKSKNTEKEETKDDTAKDNATSGKQTDGTDPKDGKQQPQDEQEPKTNSEQDGKNSSDKTPKIIPEEKQNNTTNPTDTNSSNKTDDKSNDNSNEQNEHHNMDN

SEQ ID NO: 2736049 - protein, 6 aa, Entamoeba histolytica
IKPPHL

SEQ ID NO: 2736050 - protein, 7 aa, Entamoeba histolytica
IKPTIRS

SEQ ID NO: 2736051 - protein, 21 aa, Entamoeba histolytica
IKQAKEARKEEKVAKQNGNIQ

SEQ ID NO: 2736052 - protein, 17 aa, Entamoeba histolytica
IKRNERELKSIMKHLNR

SEQ ID NO: 2736053 - protein, 4 aa, Entamoeba histolytica
IKSD

SEQ ID NO: 2736054 - protein, 9 aa, Entamoeba histolytica
IKSEDSKEG

SEQ ID NO: 2736055 - protein, 6 aa, Entamoeba histolytica
IKSENE

SEQ ID NO: 2736056 - protein, 10 aa, Entamoeba histolytica
IKSGEYSDSS

SEQ ID NO: 2736057 - protein, 14 aa, Entamoeba histolytica
IKSGSVNDETNTSV

SEQ ID NO: 2736058 - protein, 13 aa, Entamoeba histolytica
IKSTTTSVSASVN

SEQ ID NO: 2736059 - protein, 11 aa, Entamoeba histolytica
IKTQHEKEDKA

SEQ ID NO: 2736060 - protein, 10 aa, Entamoeba histolytica
IKYDNDKKQL

SEQ ID NO: 2736061 - protein, 27 aa, Entamoeba histolytica
IKYDTTLKSKNALEQKYKEAEIDKKQR

SEQ ID NO: 2736062 - protein, 4 aa, Entamoeba histolytica
ILGR

SEQ ID NO: 2736063 - protein, 9 aa, Entamoeba histolytica
ILNQNSQLK

SEQ ID NO: 2736064 - protein, 20 aa, Entamoeba histolytica
ILTSSQQCSTIPNSERTSNI

SEQ ID NO: 2736065 - protein, 29 aa, Entamoeba histolytica
INDDGYEEEDDDDENEDEEEDENEDDEDI

SEQ ID NO: 2736066 - protein, 8 aa, Entamoeba histolytica
INEDRERV

SEQ ID NO: 2736067 - protein, 12 aa, Entamoeba histolytica
INEESCKSQYSK

SEQ ID NO: 2736068 - protein, 5 aa, Entamoeba histolytica
INEND

SEQ ID NO: 2736069 - protein, 11 aa, Entamoeba histolytica
INETQNSEKLE

SEQ ID NO: 2736070 - protein, 5 aa, Entamoeba histolytica
INGKK

SEQ ID NO: 2736071 - protein, 7 aa, Entamoeba histolytica
INKQKTA

SEQ ID NO: 2736072 - protein, 18 aa, Entamoeba histolytica
INKQQPQAVNKTQEVNEQ

SEQ ID NO: 2736073 - protein, 11 aa, Entamoeba histolytica
INKRKAAGKSI

SEQ ID NO: 2736074 - protein, 5 aa, Entamoeba histolytica
INNST

SEQ ID NO: 2736075 - protein, 16 aa, Entamoeba histolytica
INNSTSVNKTQEVNEQ

SEQ ID NO: 2736076 - protein, 10 aa, Entamoeba histolytica
INNTDDYTGE

SEQ ID NO: 2736077 - protein, 18 aa, Entamoeba histolytica
INRRNRKAALKVNKAENK

SEQ ID NO: 2736078 - protein, 7 aa, Entamoeba histolytica
INSKDEI

SEQ ID NO: 2736079 - protein, 8 aa, Entamoeba histolytica
INTNEKGI

SEQ ID NO: 2736080 - protein, 9 aa, Entamoeba histolytica
IPATEKLPE

SEQ ID NO: 2736081 - protein, 14 aa, Entamoeba histolytica
IPDSNSSVKADKKT

SEQ ID NO: 2736082 - protein, 9 aa, Entamoeba histolytica
IPINRDDNR

SEQ ID NO: 2736083 - protein, 4 aa, Entamoeba histolytica
IPIS

SEQ ID NO: 2736084 - protein, 5 aa, Entamoeba histolytica
IPKEL

SEQ ID NO: 2736085 - protein, 12 aa, Entamoeba histolytica
IPKGYEKKTYEG

SEQ ID NO: 2736086 - protein, 4 aa, Entamoeba histolytica
IPLN

SEQ ID NO: 2736087 - protein, 5 aa, Entamoeba histolytica
IPNDS

SEQ ID NO: 2736088 - protein, 18 aa, Entamoeba histolytica
IPQKKINQAKLTAQHKND

SEQ ID NO: 2736089 - protein, 8 aa, Entamoeba histolytica
IPRNPKSL

SEQ ID NO: 2736090 - protein, 8 aa, Entamoeba histolytica
IPSQYKGY

SEQ ID NO: 2736091 - protein, 15 aa, Entamoeba histolytica
IPTPPNEDIDNPEEK

SEQ ID NO: 2736092 - protein, 12 aa, Entamoeba histolytica
IQEGETNHQVQI

SEQ ID NO: 2736093 - protein, 7 aa, Entamoeba histolytica
IQESTSH

SEQ ID NO: 2736094 - protein, 10 aa, Entamoeba histolytica
IQEVSQKNKI

SEQ ID NO: 2736095 - protein, 5 aa, Entamoeba histolytica
IQKEY

SEQ ID NO: 2736096 - protein, 10 aa, Entamoeba histolytica
IQLTKQENNI

SEQ ID NO: 2736097 - protein, 4 aa, Entamoeba histolytica
IQNA

SEQ ID NO: 2736098 - protein, 15 aa, Entamoeba histolytica
IQPQPRFVQAYPTLM

SEQ ID NO: 2736099 - protein, 4 aa, Entamoeba histolytica
IQRV

SEQ ID NO: 2736100 - protein, 5 aa, Entamoeba histolytica
IQTEQ

SEQ ID NO: 2736101 - protein, 9 aa, Entamoeba histolytica
IRGGANEGA

SEQ ID NO: 2736102 - protein, 9 aa, Entamoeba histolytica
IRGGANKGA

SEQ ID NO: 2736103 - protein, 4 aa, Entamoeba histolytica
IRGR

SEQ ID NO: 2736104 - protein, 31 aa, Entamoeba histolytica
IRKASRPVSRPKPTRSSRSRPSRRSSGSRRR

SEQ ID NO: 2736105 - protein, 12 aa, Entamoeba histolytica
IRKLEKKKNEEM

SEQ ID NO: 2736106 - protein, 5 aa, Entamoeba histolytica
IRPRL

SEQ ID NO: 2736107 - protein, 12 aa, Entamoeba histolytica
IRRENDNTKRLL

SEQ ID NO: 2736108 - protein, 9 aa, Entamoeba histolytica
IRRGTQKRL

SEQ ID NO: 2736109 - protein, 4 aa, Entamoeba histolytica
IRRI

SEQ ID NO: 2736110 - protein, 11 aa, Entamoeba histolytica
IRVKDSQKETY

SEQ ID NO: 2736111 - protein, 5 aa, Entamoeba histolytica
ISDDE

SEQ ID NO: 2736112 - protein, 6 aa, Entamoeba histolytica
ISDSSY

SEQ ID NO: 2736113 - protein, 13 aa, Entamoeba histolytica
ISEAKRKSNEKTF

SEQ ID NO: 2736114 - protein, 8 aa, Entamoeba histolytica
ISESDNIT

SEQ ID NO: 2736115 - protein, 15 aa, Entamoeba histolytica
ISEYNKKNKKFSERK

SEQ ID NO: 2736116 - protein, 12 aa, Entamoeba histolytica
ISHKTDTKKTLK

SEQ ID NO: 2736117 - protein, 4 aa, Entamoeba histolytica
ISKD

SEQ ID NO: 2736118 - protein, 10 aa, Entamoeba histolytica
ISKGAEKQIA

SEQ ID NO: 2736119 - protein, 12 aa, Entamoeba histolytica
ISKIPKQKSSKI

SEQ ID NO: 2736120 - protein, 6 aa, Entamoeba histolytica
ISKPED

SEQ ID NO: 2736121 - protein, 4 aa, Entamoeba histolytica
ISKR

SEQ ID NO: 2736122 - protein, 12 aa, Entamoeba histolytica
ISKTKRNSKRLS

SEQ ID NO: 2736123 - protein, 12 aa, Entamoeba histolytica
ISNIQDNSNLNT

SEQ ID NO: 2736124 - protein, 13 aa, Entamoeba histolytica
ISNTTQLKEVKEK

SEQ ID NO: 2736125 - protein, 15 aa, Entamoeba histolytica
ISPKQKRQAKKALKQ

SEQ ID NO: 2736126 - protein, 14 aa, Entamoeba histolytica
ISPSEQPPKPTPEL

SEQ ID NO: 2736127 - protein, 5 aa, Entamoeba histolytica
ISPSF

SEQ ID NO: 2736128 - protein, 12 aa, Entamoeba histolytica
ISQTSNKLEKSG

SEQ ID NO: 2736129 - protein, 10 aa, Entamoeba histolytica
ISSGNEYTQT

SEQ ID NO: 2736130 - protein, 13 aa, Entamoeba histolytica
ISSPQYENQPAYE

SEQ ID NO: 2736131 - protein, 22 aa, Entamoeba histolytica
ISTTSISVSSSAVSRPTIAASS

SEQ ID NO: 2736132 - protein, 6 aa, Entamoeba histolytica
ITESFN

SEQ ID NO: 2736133 - protein, 4 aa, Entamoeba histolytica
ITGI

SEQ ID NO: 2736134 - protein, 6 aa, Entamoeba histolytica
ITGKTV

SEQ ID NO: 2736135 - protein, 16 aa, Entamoeba histolytica
ITKSTSIDVSDSQTYT

SEQ ID NO: 2736136 - protein, 8 aa, Entamoeba histolytica
ITNEQTVS

SEQ ID NO: 2736137 - protein, 7 aa, Entamoeba histolytica
ITNSNEK

SEQ ID NO: 2736138 - protein, 9 aa, Entamoeba histolytica
ITNTGNSPL

SEQ ID NO: 2736139 - protein, 6 aa, Entamoeba histolytica
ITPNGR

SEQ ID NO: 2736140 - protein, 23 aa, Entamoeba histolytica
ITPTTTPVQPNVTSSNNTVPVNN

SEQ ID NO: 2736141 - protein, 8 aa, Entamoeba histolytica
ITQEASIT

SEQ ID NO: 2736142 - protein, 14 aa, Entamoeba histolytica
ITQKDQKMDFENKQ

SEQ ID NO: 2736143 - protein, 7 aa, Entamoeba histolytica
ITQKTNQ

SEQ ID NO: 2736144 - protein, 36 aa, Entamoeba histolytica
ITQSNNSFRDERTMRGRTKRRKVEKEALKSSKDKID

SEQ ID NO: 2736145 - protein, 7 aa, Entamoeba histolytica
ITSNTLE

SEQ ID NO: 2736146 - protein, 10 aa, Entamoeba histolytica
ITSSSSSNRI

SEQ ID NO: 2736147 - protein, 4 aa, Entamoeba histolytica
ITTT

SEQ ID NO: 2736148 - protein, 5 aa, Entamoeba histolytica
IVKQP

SEQ ID NO: 2736149 - protein, 10 aa, Entamoeba histolytica
IYEGNNQFNI

SEQ ID NO: 2736150 - protein, 12 aa, Entamoeba histolytica
IYNSKECSSTQL

SEQ ID NO: 2736151 - protein, 23 aa, Entamoeba histolytica
KAAAEGQSIEDITEAQNQASIES

SEQ ID NO: 2736152 - protein, 27 aa, Entamoeba histolytica
KAAKAAKKSVRKATKSVKKSMNQNRRR

SEQ ID NO: 2736153 - protein, 9 aa, Entamoeba histolytica
KADSKSPMN

SEQ ID NO: 2736154 - protein, 8 aa, Entamoeba histolytica
KAEAAYTK

SEQ ID NO: 2736155 - protein, 12 aa, Entamoeba histolytica
KAEQEANSMEAE

SEQ ID NO: 2736156 - protein, 7 aa, Entamoeba histolytica
KAESGIE

SEQ ID NO: 2736157 - protein, 25 aa, Entamoeba histolytica
KAETELSTRLDPDELKEEKKIGEGS

SEQ ID NO: 2736158 - protein, 8 aa, Entamoeba histolytica
KAFDNQEA

SEQ ID NO: 2736159 - protein, 7 aa, Entamoeba histolytica
KAGLEES

SEQ ID NO: 2736160 - protein, 8 aa, Entamoeba histolytica
KAGTNIKA

SEQ ID NO: 2736161 - protein, 9 aa, Entamoeba histolytica
KAITASGEL

SEQ ID NO: 2736162 - protein, 8 aa, Entamoeba histolytica
KAKDYPKS

SEQ ID NO: 2736163 - protein, 6 aa, Entamoeba histolytica
KAKEYP

SEQ ID NO: 2736164 - protein, 19 aa, Entamoeba histolytica
KAKIEKEKRELRKKRIETE

SEQ ID NO: 2736165 - protein, 6 aa, Entamoeba histolytica
KALENV

SEQ ID NO: 2736166 - protein, 6 aa, Entamoeba histolytica
KALKGE

SEQ ID NO: 2736167 - protein, 13 aa, Entamoeba histolytica
KALNKKQQEMEKK

SEQ ID NO: 2736168 - protein, 12 aa, Entamoeba histolytica
KANERMGKSEKY

SEQ ID NO: 2736169 - protein, 10 aa, Entamoeba histolytica
KANGLSDEDI

SEQ ID NO: 2736170 - protein, 4 aa, Entamoeba histolytica
KANP

SEQ ID NO: 2736171 - protein, 15 aa, Entamoeba histolytica
KAQEKGNTEKVTQLQ

SEQ ID NO: 2736172 - protein, 4 aa, Entamoeba histolytica
KAQK

SEQ ID NO: 2736173 - protein, 46 aa, Entamoeba histolytica
KAQKNIKKDNKKIAKVEKKAAKKVTKVEKKADVKKTAVKKTPTLNK

SEQ ID NO: 2736174 - protein, 14 aa, Entamoeba histolytica
KAQKQQLEREATQS

SEQ ID NO: 2736175 - protein, 9 aa, Entamoeba histolytica
KASDKPHTC

SEQ ID NO: 2736176 - protein, 6 aa, Entamoeba histolytica
KASEKQ

SEQ ID NO: 2736177 - protein, 4 aa, Entamoeba histolytica
KASF

SEQ ID NO: 2736178 - protein, 22 aa, Entamoeba histolytica
KASKNASPKKIKNLKKAEKKFI

SEQ ID NO: 2736179 - protein, 6 aa, Entamoeba histolytica
KASLKR

SEQ ID NO: 2736180 - protein, 4 aa, Entamoeba histolytica
KASS

SEQ ID NO: 2736181 - protein, 41 aa, Entamoeba histolytica
KATPKKTTDKTSKKVETAKKEVKKDQKKAKKYVKKAEKIQK

SEQ ID NO: 2736182 - protein, 22 aa, Entamoeba histolytica
KATQRSRNYEREMAKRDKQQLE

SEQ ID NO: 2736183 - protein, 7 aa, Entamoeba histolytica
KATSSLK

SEQ ID NO: 2736184 - protein, 5 aa, Entamoeba histolytica
KAVAD

SEQ ID NO: 2736185 - protein, 14 aa, Entamoeba histolytica
KAVGEKAQKEISKK

SEQ ID NO: 2736186 - protein, 15 aa, Entamoeba histolytica
KAVKSQQERQGLKTQ

SEQ ID NO: 2736187 - protein, 8 aa, Entamoeba histolytica
KAYDNTSE

SEQ ID NO: 2736188 - protein, 12 aa, Entamoeba histolytica
KCDDNCKTCYGS

SEQ ID NO: 2736189 - protein, 12 aa, Entamoeba histolytica
KCDSKCNECEHK

SEQ ID NO: 2736190 - protein, 8 aa, Entamoeba histolytica
KCEENSDY

SEQ ID NO: 2736191 - protein, 7 aa, Entamoeba histolytica
KCEGNCR

SEQ ID NO: 2736192 - protein, 6 aa, Entamoeba histolytica
KCESDD

SEQ ID NO: 2736193 - protein, 9 aa, Entamoeba histolytica
KCESSSNPA

SEQ ID NO: 2736194 - protein, 11 aa, Entamoeba histolytica
KCKEVKNNKCS

SEQ ID NO: 2736195 - protein, 8 aa, Entamoeba histolytica
KCKNSPFK

SEQ ID NO: 2736196 - protein, 8 aa, Entamoeba histolytica
KCNSNGKL

SEQ ID NO: 2736197 - protein, 5 aa, Entamoeba histolytica
KCPAN

SEQ ID NO: 2736198 - protein, 12 aa, Entamoeba histolytica
KCSNGRKPDNGF

SEQ ID NO: 2736199 - protein, 7 aa, Entamoeba histolytica
KCTPLPS

SEQ ID NO: 2736200 - protein, 6 aa, Entamoeba histolytica
KDDIKT

SEQ ID NO: 2736201 - protein, 5 aa, Entamoeba histolytica
KDDSF

SEQ ID NO: 2736202 - protein, 8 aa, Entamoeba histolytica
KDEKGNYV

SEQ ID NO: 2736203 - protein, 15 aa, Entamoeba histolytica
KDENANRQVTSNEGK

SEQ ID NO: 2736204 - protein, 6 aa, Entamoeba histolytica
KDENGM

SEQ ID NO: 2736205 - protein, 17 aa, Entamoeba histolytica
KDGELTFEDNSEATNGY

SEQ ID NO: 2736206 - protein, 5 aa, Entamoeba histolytica
KDGIP

SEQ ID NO: 2736207 - protein, 14 aa, Entamoeba histolytica
KDGKGKSNTLSGKF

SEQ ID NO: 2736208 - protein, 5 aa, Entamoeba histolytica
KDGTN

SEQ ID NO: 2736209 - protein, 8 aa, Entamoeba histolytica
KDHQSLSA

SEQ ID NO: 2736210 - protein, 6 aa, Entamoeba histolytica
KDIDRH

SEQ ID NO: 2736211 - protein, 6 aa, Entamoeba histolytica
KDIESP

SEQ ID NO: 2736212 - protein, 9 aa, Entamoeba histolytica
KDKEQQTSL

SEQ ID NO: 2736213 - protein, 18 aa, Entamoeba histolytica
KDKLADKLQEGDKKTILD

SEQ ID NO: 2736214 - protein, 7 aa, Entamoeba histolytica
KDKQLNE

SEQ ID NO: 2736215 - protein, 9 aa, Entamoeba histolytica
KDKSGTLEI

SEQ ID NO: 2736216 - protein, 14 aa, Entamoeba histolytica
KDLKSCPNTFNENA

SEQ ID NO: 2736217 - protein, 7 aa, Entamoeba histolytica
KDNCGDE

SEQ ID NO: 2736218 - protein, 5 aa, Entamoeba histolytica
KDNNE

SEQ ID NO: 2736219 - protein, 7 aa, Entamoeba histolytica
KDNTPEI

SEQ ID NO: 2736220 - protein, 23 aa, Entamoeba histolytica
KDNTTVSGNHKGEIPAPSENDYS

SEQ ID NO: 2736221 - protein, 11 aa, Entamoeba histolytica
KDPQGNKNDEY

SEQ ID NO: 2736222 - protein, 9 aa, Entamoeba histolytica
KDQTPSEDN

SEQ ID NO: 2736223 - protein, 5 aa, Entamoeba histolytica
KDTGH

SEQ ID NO: 2736224 - protein, 13 aa, Entamoeba histolytica
KDTKDKYQNAQNG

SEQ ID NO: 2736225 - protein, 5 aa, Entamoeba histolytica
KDTRY

SEQ ID NO: 2736226 - protein, 27 aa, Entamoeba histolytica
KDVASSNKTVKPSEIKEQTKKSLDDLK

SEQ ID NO: 2736227 - protein, 10 aa, Entamoeba histolytica
KDVKGQIKRD

SEQ ID NO: 2736228 - protein, 8 aa, Entamoeba histolytica
KDYEPTNV

SEQ ID NO: 2736229 - protein, 15 aa, Entamoeba histolytica
KDYPYTATNGTCQYD

SEQ ID NO: 2736230 - protein, 10 aa, Entamoeba histolytica
KEAEERKKEG

SEQ ID NO: 2736231 - protein, 11 aa, Entamoeba histolytica
KEAESTLTERQ

SEQ ID NO: 2736232 - protein, 9 aa, Entamoeba histolytica
KEAKETKAL

SEQ ID NO: 2736233 - protein, 7 aa, Entamoeba histolytica
KEAKQQR

SEQ ID NO: 2736234 - protein, 4 aa, Entamoeba histolytica
KEAT

SEQ ID NO: 2736235 - protein, 8 aa, Entamoeba histolytica
KEAVENSF

SEQ ID NO: 2736236 - protein, 13 aa, Entamoeba histolytica
KECKTSSDVQQYT

SEQ ID NO: 2736237 - protein, 6 aa, Entamoeba histolytica
KEDEQE

SEQ ID NO: 2736238 - protein, 8 aa, Entamoeba histolytica
KEDGECTD

SEQ ID NO: 2736239 - protein, 5 aa, Entamoeba histolytica
KEDHA

SEQ ID NO: 2736240 - protein, 13 aa, Entamoeba histolytica
KEDKSLNSITPKD

SEQ ID NO: 2736241 - protein, 7 aa, Entamoeba histolytica
KEDNKLH

SEQ ID NO: 2736242 - protein, 28 aa, Entamoeba histolytica
KEEDTKQENAGIKAGLRKQNSDSQKSMT

SEQ ID NO: 2736243 - protein, 7 aa, Entamoeba histolytica
KEEEEHK

SEQ ID NO: 2736244 - protein, 25 aa, Entamoeba histolytica
KEEEINNNETENHNETKKTKITPKV

SEQ ID NO: 2736245 - protein, 15 aa, Entamoeba histolytica
KEEGNGLNNTSPSYM

SEQ ID NO: 2736246 - protein, 7 aa, Entamoeba histolytica
KEEKAVN

SEQ ID NO: 2736247 - protein, 6 aa, Entamoeba histolytica
KEENGV

SEQ ID NO: 2736248 - protein, 5 aa, Entamoeba histolytica
KEENN

SEQ ID NO: 2736249 - protein, 5 aa, Entamoeba histolytica
KEEPL

SEQ ID NO: 2736250 - protein, 13 aa, Entamoeba histolytica
KEEQSTKAPAGDK

SEQ ID NO: 2736251 - protein, 6 aa, Entamoeba histolytica
KEERIE

SEQ ID NO: 2736252 - protein, 6 aa, Entamoeba histolytica
KEEYSP

SEQ ID NO: 2736253 - protein, 6 aa, Entamoeba histolytica
KEGKRV

SEQ ID NO: 2736254 - protein, 4 aa, Entamoeba histolytica
KEGV

SEQ ID NO: 2736255 - protein, 321 aa, Entamoeba histolytica
KEHDEAEEKKKGQNIPTENGVESVEMGKKSQENVRENENGQENGEKTVKEIPEQKEPKKVNEMGDEEQKKPSKKEEVSKESGLTEDGKEKNKEEKSHVESGEGVKGKSGNPESQKGETPNEKKAVGDEEPKKTKGENDETQEQADDKSQVSNEGKQNGQTGQDKSNEEQKQNKQGGGNNDEKVNQEKNKGEKDTKKEEGESGTNNQEKKEEKTEDEGAKKSGDESDETKKNKDQENKSEGGNDGKKDETGKEEEKKTEGNEPKKEEEKENKEKQNEPKKDEEKPTNENKNQTENKTTNSSDNSQNKTDNKTDEHNNLDNST

SEQ ID NO: 2736256 - protein, 6 aa, Entamoeba histolytica
KEIAEQ

SEQ ID NO: 2736257 - protein, 16 aa, Entamoeba histolytica
KEIDDPNDKKPEGWDD

SEQ ID NO: 2736258 - protein, 15 aa, Entamoeba histolytica
KEIDDPNVSKPADWV

SEQ ID NO: 2736259 - protein, 17 aa, Entamoeba histolytica
KEIEKRRREQKEREEKV

SEQ ID NO: 2736260 - protein, 6 aa, Entamoeba histolytica
KEIETT

SEQ ID NO: 2736261 - protein, 10 aa, Entamoeba histolytica
KEIKDEDGIK

SEQ ID NO: 2736262 - protein, 9 aa, Entamoeba histolytica
KEKELARKQ

SEQ ID NO: 2736263 - protein, 6 aa, Entamoeba histolytica
KEKMPK

SEQ ID NO: 2736264 - protein, 7 aa, Entamoeba histolytica
KEKSISN

SEQ ID NO: 2736265 - protein, 9 aa, Entamoeba histolytica
KEKSTKSEV

SEQ ID NO: 2736266 - protein, 16 aa, Entamoeba histolytica
KELEEKQKELKNKKAV

SEQ ID NO: 2736267 - protein, 17 aa, Entamoeba histolytica
KELKRAESQRDKLAKET

SEQ ID NO: 2736268 - protein, 5 aa, Entamoeba histolytica
KELPS

SEQ ID NO: 2736269 - protein, 7 aa, Entamoeba histolytica
KENERRL

SEQ ID NO: 2736270 - protein, 7 aa, Entamoeba histolytica
KENPFKN

SEQ ID NO: 2736271 - protein, 6 aa, Entamoeba histolytica
KENQTE

SEQ ID NO: 2736272 - protein, 8 aa, Entamoeba histolytica
KENSDLYS

SEQ ID NO: 2736273 - protein, 8 aa, Entamoeba histolytica
KENSKISI

SEQ ID NO: 2736274 - protein, 7 aa, Entamoeba histolytica
KENSQQI

SEQ ID NO: 2736275 - protein, 6 aa, Entamoeba histolytica
KEPAFS

SEQ ID NO: 2736276 - protein, 4 aa, Entamoeba histolytica
KEPL

SEQ ID NO: 2736277 - protein, 12 aa, Entamoeba histolytica
KEQIEQAEKERQ

SEQ ID NO: 2736278 - protein, 27 aa, Entamoeba histolytica
KEQLDKDLRQTIQNAKKQKIKSENEQK

SEQ ID NO: 2736279 - protein, 10 aa, Entamoeba histolytica
KEQSQDFEKR

SEQ ID NO: 2736280 - protein, 9 aa, Entamoeba histolytica
KEREYGDRY

SEQ ID NO: 2736281 - protein, 8 aa, Entamoeba histolytica
KERKIRKD

SEQ ID NO: 2736282 - protein, 6 aa, Entamoeba histolytica
KERNEA

SEQ ID NO: 2736283 - protein, 19 aa, Entamoeba histolytica
KERSNEGTTKERERNQNKI

SEQ ID NO: 2736284 - protein, 6 aa, Entamoeba histolytica
KESESV

SEQ ID NO: 2736285 - protein, 4 aa, Entamoeba histolytica
KESF

SEQ ID NO: 2736286 - protein, 5 aa, Entamoeba histolytica
KESFN

SEQ ID NO: 2736287 - protein, 166 aa, Entamoeba histolytica
KESIHENDIENEEDKKSSSNSELDENSNNQPDESSNNKPNESSDNKPNESSDNKPNESSNNKPSESSNNKPDESSNNKPNESSDNKPNESSNNKPNESSNNKPSESSNNKPDESSNNKPNESSDNKPNESSNNKPNESSDNKPNESSNNKPGSSSDNYDNLDAASS

SEQ ID NO: 2736288 - protein, 4 aa, Entamoeba histolytica
KESL

SEQ ID NO: 2736289 - protein, 8 aa, Entamoeba histolytica
KETATDVL

SEQ ID NO: 2736290 - protein, 4 aa, Entamoeba histolytica
KETE

SEQ ID NO: 2736291 - protein, 6 aa, Entamoeba histolytica
KETKGK

SEQ ID NO: 2736292 - protein, 14 aa, Entamoeba histolytica
KETMEEGIIENQEV

SEQ ID NO: 2736293 - protein, 9 aa, Entamoeba histolytica
KETNCSTSS

SEQ ID NO: 2736294 - protein, 7 aa, Entamoeba histolytica
KETNLKT

SEQ ID NO: 2736295 - protein, 6 aa, Entamoeba histolytica
KEVEGL

SEQ ID NO: 2736296 - protein, 18 aa, Entamoeba histolytica
KEVRNKMNKDEEEYKQKK

SEQ ID NO: 2736297 - protein, 7 aa, Entamoeba histolytica
KEYKTEL

SEQ ID NO: 2736298 - protein, 20 aa, Entamoeba histolytica
KEYNQKKIRRTKHEEREKEI

SEQ ID NO: 2736299 - protein, 5 aa, Entamoeba histolytica
KEYPA

SEQ ID NO: 2736300 - protein, 6 aa, Entamoeba histolytica
KEYQSS

SEQ ID NO: 2736301 - protein, 7 aa, Entamoeba histolytica
KFAEGGY

SEQ ID NO: 2736302 - protein, 9 aa, Entamoeba histolytica
KFAGEEAEI

SEQ ID NO: 2736303 - protein, 5 aa, Entamoeba histolytica
KFGEF

SEQ ID NO: 2736304 - protein, 11 aa, Entamoeba histolytica
KFGSPLPPLGK

SEQ ID NO: 2736305 - protein, 5 aa, Entamoeba histolytica
KFGST

SEQ ID NO: 2736306 - protein, 5 aa, Entamoeba histolytica
KFIKK

SEQ ID NO: 2736307 - protein, 41 aa, Entamoeba histolytica
KFKNSGVGKALSKLKKGASKVESKIDSAKDKVKDVSGYNKL

SEQ ID NO: 2736308 - protein, 18 aa, Entamoeba histolytica
KFLDDSKTCIKSKNEFDK

SEQ ID NO: 2736309 - protein, 11 aa, Entamoeba histolytica
KFNSKKTCTSI

SEQ ID NO: 2736310 - protein, 7 aa, Entamoeba histolytica
KFPTPNE

SEQ ID NO: 2736311 - protein, 7 aa, Entamoeba histolytica
KFTGATG

SEQ ID NO: 2736312 - protein, 7 aa, Entamoeba histolytica
KGADAVE

SEQ ID NO: 2736313 - protein, 7 aa, Entamoeba histolytica
KGADRVK

SEQ ID NO: 2736314 - protein, 10 aa, Entamoeba histolytica
KGDANINIKG

SEQ ID NO: 2736315 - protein, 9 aa, Entamoeba histolytica
KGDINQERE

SEQ ID NO: 2736316 - protein, 6 aa, Entamoeba histolytica
KGDIPT

SEQ ID NO: 2736317 - protein, 9 aa, Entamoeba histolytica
KGDNNTVNQ

SEQ ID NO: 2736318 - protein, 8 aa, Entamoeba histolytica
KGDRKQIE

SEQ ID NO: 2736319 - protein, 9 aa, Entamoeba histolytica
KGDTANKKK

SEQ ID NO: 2736320 - protein, 314 aa, Entamoeba histolytica
KGEEGITKTPSVQSTDASDTHNKQQEGQPQTNNSLEPSKTSTTKPNNAQTSVSSDTSSKTTSVTGGQEPTSTESVTTGEKGQSNTDNTNYPSSPQPTSDISGKGTPQASGVKNGEDGQGTIPSTGEATQEKNEKAEGSGEGAGKTNSGKEQEIEKNEQGHNGDTEATGESEETKNKKEGLDEKGGSSNEALPTDKNGKVEEGNNGKEMSGGESTTGANDGEANDNTSAKEKETQPVNGNDKSEMNEQKGNTTNEKTDSKNNTKTNNEQDGKNNSDKTPEIIPEEKQNNTTNTTDTNSSNETDDKPDNNNNEQIE

SEQ ID NO: 2736321 - protein, 23 aa, Entamoeba histolytica
KGEIEEAKETTTVEKSPIVTTEE

SEQ ID NO: 2736322 - protein, 4 aa, Entamoeba histolytica
KGEK

SEQ ID NO: 2736323 - protein, 9 aa, Entamoeba histolytica
KGENEEAKE

SEQ ID NO: 2736324 - protein, 10 aa, Entamoeba histolytica
KGEQKRQVDA

SEQ ID NO: 2736325 - protein, 12 aa, Entamoeba histolytica
KGERKEYSPEEI

SEQ ID NO: 2736326 - protein, 61 aa, Entamoeba histolytica
KGEVTKEPEETPTGVKDVSSQTINTGTGGITTSTNPSGQATDTTNSKSKTDKNPEEEYTIT

SEQ ID NO: 2736327 - protein, 328 aa, Entamoeba histolytica
KGEVTKEPEETPTGVKDVSSQTINTGTGGITTSTNPSGQATDTTNSKSKTDKNTEENTPSPNEQNTKGATGQEKNPVSQPQAEQKPVTPNTTGEKGQEHDSTTGQGAESGASNTGKETNKPNSNGEDNTGKTKSPSETKQKTESTTGEGIDETSNTDGQNPKASTSTTEGGDKNEATHGNNEQETGTSGAGGEEGQKQDEQHDKGTNDSTNEQGKEQNNKGATTDGNGEPATNNNNKGEEGKKEEKVKPKNETTPDEKDTKTKNDKDEKNNSETGTSDNTKNKSNEKQQTTSNDKQNNTTNTNSENKTNEKSNNNHDEQNEQHNIDNA

SEQ ID NO: 2736328 - protein, 10 aa, Entamoeba histolytica
KGGDANTLDL

SEQ ID NO: 2736329 - protein, 8 aa, Entamoeba histolytica
KGGDEHYE

SEQ ID NO: 2736330 - protein, 7 aa, Entamoeba histolytica
KGGKSTA

SEQ ID NO: 2736331 - protein, 7 aa, Entamoeba histolytica
KGIEYGA

SEQ ID NO: 2736332 - protein, 8 aa, Entamoeba histolytica
KGIGEGRK

SEQ ID NO: 2736333 - protein, 12 aa, Entamoeba histolytica
KGIKDDSITQYS

SEQ ID NO: 2736334 - protein, 9 aa, Entamoeba histolytica
KGKKKSNNI

SEQ ID NO: 2736335 - protein, 7 aa, Entamoeba histolytica
KGKQWRN

SEQ ID NO: 2736336 - protein, 8 aa, Entamoeba histolytica
KGKTDDAI

SEQ ID NO: 2736337 - protein, 5 aa, Entamoeba histolytica
KGKTI

SEQ ID NO: 2736338 - protein, 10 aa, Entamoeba histolytica
KGKVSPKKAF

SEQ ID NO: 2736339 - protein, 4 aa, Entamoeba histolytica
KGLQ

SEQ ID NO: 2736340 - protein, 6 aa, Entamoeba histolytica
KGMREG

SEQ ID NO: 2736341 - protein, 9 aa, Entamoeba histolytica
KGNAKKEST

SEQ ID NO: 2736342 - protein, 7 aa, Entamoeba histolytica
KGNEHLE

SEQ ID NO: 2736343 - protein, 4 aa, Entamoeba histolytica
KGNK

SEQ ID NO: 2736344 - protein, 9 aa, Entamoeba histolytica
KGNTRKAQQ

SEQ ID NO: 2736345 - protein, 12 aa, Entamoeba histolytica
KGQKVTDKLQSG

SEQ ID NO: 2736346 - protein, 10 aa, Entamoeba histolytica
KGQYAHGNEP

SEQ ID NO: 2736347 - protein, 7 aa, Entamoeba histolytica
KGRKKEI

SEQ ID NO: 2736348 - protein, 6 aa, Entamoeba histolytica
KGSDLY

SEQ ID NO: 2736349 - protein, 5 aa, Entamoeba histolytica
KGSND

SEQ ID NO: 2736350 - protein, 13 aa, Entamoeba histolytica
KGTGPLYTSYCDA

SEQ ID NO: 2736351 - protein, 8 aa, Entamoeba histolytica
KGTHPSDG

SEQ ID NO: 2736352 - protein, 12 aa, Entamoeba histolytica
KGTKNKQKKIEI

SEQ ID NO: 2736353 - protein, 9 aa, Entamoeba histolytica
KGTNYNNGG

SEQ ID NO: 2736354 - protein, 8 aa, Entamoeba histolytica
KGTTIESN

SEQ ID NO: 2736355 - protein, 4 aa, Entamoeba histolytica
KGVH

SEQ ID NO: 2736356 - protein, 6 aa, Entamoeba histolytica
KGVNGE

SEQ ID NO: 2736357 - protein, 20 aa, Entamoeba histolytica
KGVTDEASYPYTATKGTCKA

SEQ ID NO: 2736358 - protein, 11 aa, Entamoeba histolytica
KHDPTKDFTDA

SEQ ID NO: 2736359 - protein, 5 aa, Entamoeba histolytica
KHDTS

SEQ ID NO: 2736360 - protein, 6 aa, Entamoeba histolytica
KHERKK

SEQ ID NO: 2736361 - protein, 5 aa, Entamoeba histolytica
KHFES

SEQ ID NO: 2736362 - protein, 7 aa, Entamoeba histolytica
KHSNEET

SEQ ID NO: 2736363 - protein, 45 aa, Entamoeba histolytica
KHTKDTNGIKTNSAGISAQFNPNDKFGASLGGRISNINGKRNVGL

SEQ ID NO: 2736364 - protein, 10 aa, Entamoeba histolytica
KHTTNDKIGD

SEQ ID NO: 2736365 - protein, 19 aa, Entamoeba histolytica
KIEEEEKKNKQQKQTSIKK

SEQ ID NO: 2736366 - protein, 53 aa, Entamoeba histolytica
KIEKEREKQLEKERKKEEKQRKKEEKKAGKAHSRGSSKEQSIERTEEKPKNLI

SEQ ID NO: 2736367 - protein, 8 aa, Entamoeba histolytica
KIGKPESR

SEQ ID NO: 2736368 - protein, 37 aa, Entamoeba histolytica
KIKDTKETVKNDRKKNEDAKEKATKRAKNLKKGDNLK

SEQ ID NO: 2736369 - protein, 35 aa, Entamoeba histolytica
KIKEKTNKEKGAQKKQIRNEKKRPKEGKVKDQEKI

SEQ ID NO: 2736370 - protein, 5 aa, Entamoeba histolytica
KIKEQ

SEQ ID NO: 2736371 - protein, 8 aa, Entamoeba histolytica
KIKETNQL

SEQ ID NO: 2736372 - protein, 7 aa, Entamoeba histolytica
KIKSYPE

SEQ ID NO: 2736373 - protein, 10 aa, Entamoeba histolytica
KIKTTNPKKV

SEQ ID NO: 2736374 - protein, 12 aa, Entamoeba histolytica
KINETQKTEKME

SEQ ID NO: 2736375 - protein, 14 aa, Entamoeba histolytica
KINRNVDAQEGGAF

SEQ ID NO: 2736376 - protein, 7 aa, Entamoeba histolytica
KINSKGY

SEQ ID NO: 2736377 - protein, 12 aa, Entamoeba histolytica
KIPPENRTEAIQ

SEQ ID NO: 2736378 - protein, 12 aa, Entamoeba histolytica
KIPTENRTEAIR

SEQ ID NO: 2736379 - protein, 23 aa, Entamoeba histolytica
KIQATTGEEQDKAIIEYNVLEQF

SEQ ID NO: 2736380 - protein, 11 aa, Entamoeba histolytica
KIQTSQGGVEV

SEQ ID NO: 2736381 - protein, 13 aa, Entamoeba histolytica
KIREEEAKIRERN

SEQ ID NO: 2736382 - protein, 7 aa, Entamoeba histolytica
KIREKAH

SEQ ID NO: 2736383 - protein, 8 aa, Entamoeba histolytica
KIRRNNKR

SEQ ID NO: 2736384 - protein, 5 aa, Entamoeba histolytica
KIRRQ

SEQ ID NO: 2736385 - protein, 6 aa, Entamoeba histolytica
KIRRQK

SEQ ID NO: 2736386 - protein, 7 aa, Entamoeba histolytica
KISDNSP

SEQ ID NO: 2736387 - protein, 11 aa, Entamoeba histolytica
KISRNERERKQ

SEQ ID NO: 2736388 - protein, 9 aa, Entamoeba histolytica
KITAKKKLK

SEQ ID NO: 2736389 - protein, 6 aa, Entamoeba histolytica
KITPHG

SEQ ID NO: 2736390 - protein, 17 aa, Entamoeba histolytica
KITTTKKDIEAKKNQYI

SEQ ID NO: 2736391 - protein, 14 aa, Entamoeba histolytica
KKAAPKPAAKKIAK

SEQ ID NO: 2736392 - protein, 7 aa, Entamoeba histolytica
KKAGVSK

SEQ ID NO: 2736393 - protein, 42 aa, Entamoeba histolytica
KKAKEEAKKMTSKAKKAAEETKKAAKADTKKSEKKVKEIKKA

SEQ ID NO: 2736394 - protein, 14 aa, Entamoeba histolytica
KKAKKDAIREKRRM

SEQ ID NO: 2736395 - protein, 9 aa, Entamoeba histolytica
KKANKNATD

SEQ ID NO: 2736396 - protein, 7 aa, Entamoeba histolytica
KKATLSL

SEQ ID NO: 2736397 - protein, 24 aa, Entamoeba histolytica
KKAVKDAAKGNINKANKEVAQAKT

SEQ ID NO: 2736398 - protein, 12 aa, Entamoeba histolytica
KKCKSGEVIKNG

SEQ ID NO: 2736399 - protein, 6 aa, Entamoeba histolytica
KKCQTQ

SEQ ID NO: 2736400 - protein, 8 aa, Entamoeba histolytica
KKDPLYKQ

SEQ ID NO: 2736401 - protein, 8 aa, Entamoeba histolytica
KKDPQSEV

SEQ ID NO: 2736402 - protein, 10 aa, Entamoeba histolytica
KKDTETDDQL

SEQ ID NO: 2736403 - protein, 7 aa, Entamoeba histolytica
KKDTMGV

SEQ ID NO: 2736404 - protein, 7 aa, Entamoeba histolytica
KKEEDSI

SEQ ID NO: 2736405 - protein, 37 aa, Entamoeba histolytica
KKEEEEVEDTEAMKQEAQEKAKKRIEEGETSKTEEEL

SEQ ID NO: 2736406 - protein, 24 aa, Entamoeba histolytica
KKEEMKDKAIEKKEARERAITERK

SEQ ID NO: 2736407 - protein, 9 aa, Entamoeba histolytica
KKEIKESFG

SEQ ID NO: 2736408 - protein, 12 aa, Entamoeba histolytica
KKEIKRNKGTEY

SEQ ID NO: 2736409 - protein, 8 aa, Entamoeba histolytica
KKEKGNDY

SEQ ID NO: 2736410 - protein, 10 aa, Entamoeba histolytica
KKEKQAAPND

SEQ ID NO: 2736411 - protein, 5 aa, Entamoeba histolytica
KKELD

SEQ ID NO: 2736412 - protein, 10 aa, Entamoeba histolytica
KKENSSISKF

SEQ ID NO: 2736413 - protein, 9 aa, Entamoeba histolytica
KKETSDSSH

SEQ ID NO: 2736414 - protein, 6 aa, Entamoeba histolytica
KKFEVE

SEQ ID NO: 2736415 - protein, 5 aa, Entamoeba histolytica
KKFSN

SEQ ID NO: 2736416 - protein, 4 aa, Entamoeba histolytica
KKFT

SEQ ID NO: 2736417 - protein, 13 aa, Entamoeba histolytica
KKGIKTNKDIGGV

SEQ ID NO: 2736418 - protein, 15 aa, Entamoeba histolytica
KKGIQSRRERKAAIR

SEQ ID NO: 2736419 - protein, 7 aa, Entamoeba histolytica
KKGITPY

SEQ ID NO: 2736420 - protein, 67 aa, Entamoeba histolytica
KKGKNQINTLKEASKDRGKDKLKTLKENALKKGKTVIDAAKKKGKKIANTLTSKLAKAQNKKENVKE

SEQ ID NO: 2736421 - protein, 10 aa, Entamoeba histolytica
KKGKNTVKGI

SEQ ID NO: 2736422 - protein, 14 aa, Entamoeba histolytica
KKGKSIAKKGVSAV

SEQ ID NO: 2736423 - protein, 5 aa, Entamoeba histolytica
KKGQY

SEQ ID NO: 2736424 - protein, 129 aa, Entamoeba histolytica
KKGVNAAKEKINSIKKGGKELLNKGKSALKKGKDMINKGKNALKKGKDALKKGVDNLKKKGAKVLKSAKDKGKKAVENIKKYGKKAMKKYSDAKKKISEGIKGMSKKAQKKFKETANKLKEKAKGMADK

SEQ ID NO: 2736425 - protein, 7 aa, Entamoeba histolytica
KKGWKYD

SEQ ID NO: 2736426 - protein, 9 aa, Entamoeba histolytica
KKIAKKSNF

SEQ ID NO: 2736427 - protein, 7 aa, Entamoeba histolytica
KKINETI

SEQ ID NO: 2736428 - protein, 10 aa, Entamoeba histolytica
KKINRKEEID

SEQ ID NO: 2736429 - protein, 9 aa, Entamoeba histolytica
KKKEELRKK

SEQ ID NO: 2736430 - protein, 22 aa, Entamoeba histolytica
KKKENQSNENQITLTPGEDDVK

SEQ ID NO: 2736431 - protein, 10 aa, Entamoeba histolytica
KKKGSAGWDD

SEQ ID NO: 2736432 - protein, 8 aa, Entamoeba histolytica
KKKKAEIT

SEQ ID NO: 2736433 - protein, 79 aa, Entamoeba histolytica
KKKQEKAFKPVNTTQQNKPVNNTHKQKIQDNKQMNKSNQKKLNKPKTNDVAKQVSNASSAGKESSPMTPALSNGESTVK

SEQ ID NO: 2736434 - protein, 9 aa, Entamoeba histolytica
KKKQPKQRK

SEQ ID NO: 2736435 - protein, 7 aa, Entamoeba histolytica
KKKSQNL

SEQ ID NO: 2736436 - protein, 7 aa, Entamoeba histolytica
KKKYDGF

SEQ ID NO: 2736437 - protein, 7 aa, Entamoeba histolytica
KKLGGDV

SEQ ID NO: 2736438 - protein, 70 aa, Entamoeba histolytica
KKLKKEMKKQIKKTAQKAKKTAKKSAQKAAKKSAKKAQKKALSSAKKYVKKTTKKVTKKDAKKIKKTQKK

SEQ ID NO: 2736439 - protein, 13 aa, Entamoeba histolytica
KKLSQENSRGKRQ

SEQ ID NO: 2736440 - protein, 8 aa, Entamoeba histolytica
KKMAGDAV

SEQ ID NO: 2736441 - protein, 19 aa, Entamoeba histolytica
KKMSKVNKLSKKNTKKAQL

SEQ ID NO: 2736442 - protein, 8 aa, Entamoeba histolytica
KKNEYKHG

SEQ ID NO: 2736443 - protein, 7 aa, Entamoeba histolytica
KKNLHSH

SEQ ID NO: 2736444 - protein, 12 aa, Entamoeba histolytica
KKNNPADPAEEN

SEQ ID NO: 2736445 - protein, 12 aa, Entamoeba histolytica
KKPLRKSMKTLS

SEQ ID NO: 2736446 - protein, 4 aa, Entamoeba histolytica
KKPY

SEQ ID NO: 2736447 - protein, 7 aa, Entamoeba histolytica
KKQAPKK

SEQ ID NO: 2736448 - protein, 6 aa, Entamoeba histolytica
KKQEEI

SEQ ID NO: 2736449 - protein, 14 aa, Entamoeba histolytica
KKQFISPTTSTVNP

SEQ ID NO: 2736450 - protein, 11 aa, Entamoeba histolytica
KKQKENAAKKI

SEQ ID NO: 2736451 - protein, 10 aa, Entamoeba histolytica
KKQSEFKKEK

SEQ ID NO: 2736452 - protein, 7 aa, Entamoeba histolytica
KKQTIDY

SEQ ID NO: 2736453 - protein, 6 aa, Entamoeba histolytica
KKRDEF

SEQ ID NO: 2736454 - protein, 6 aa, Entamoeba histolytica
KKREER

SEQ ID NO: 2736455 - protein, 20 aa, Entamoeba histolytica
KKSESSTSKEEIVSDTSEYE

SEQ ID NO: 2736456 - protein, 11 aa, Entamoeba histolytica
KKSIENEKKGI

SEQ ID NO: 2736457 - protein, 15 aa, Entamoeba histolytica
KKSIESEEKFTPESE

SEQ ID NO: 2736458 - protein, 89 aa, Entamoeba histolytica
KKSKTTASGSNAGSATNNVTNPGSSTGGSTNTSSSVSTSSQRRNSVRRPTLTRTRSTSNGFATKNSRSSMRSSLSSRQRSLSVRTSRNT

SEQ ID NO: 2736459 - protein, 7 aa, Entamoeba histolytica
KKSLEGI

SEQ ID NO: 2736460 - protein, 9 aa, Entamoeba histolytica
KKSSKRVRK

SEQ ID NO: 2736461 - protein, 15 aa, Entamoeba histolytica
KKTIDDIQKETLNKT

SEQ ID NO: 2736462 - protein, 63 aa, Entamoeba histolytica
KKTMKKTMKKTMKKTMKKTMKKTMKKTMKKTMKKTMKKTMKKTMKKTMKKTMKKTMKKTMMNL

SEQ ID NO: 2736463 - protein, 11 aa, Entamoeba histolytica
KKTPGETTNLK

SEQ ID NO: 2736464 - protein, 6 aa, Entamoeba histolytica
KKTRKI

SEQ ID NO: 2736465 - protein, 80 aa, Entamoeba histolytica
KKTSGGSSSHSKSKRSSRRSSRSSSSSGSGSSSGSGSSASASASASVNVGGGSDSGYAGGSDSGYAGGSDSGSSAGQQVN

SEQ ID NO: 2736466 - protein, 6 aa, Entamoeba histolytica
KKTSIT

SEQ ID NO: 2736467 - protein, 4 aa, Entamoeba histolytica
KKVE

SEQ ID NO: 2736468 - protein, 9 aa, Entamoeba histolytica
KKVEAKNMK

SEQ ID NO: 2736469 - protein, 10 aa, Entamoeba histolytica
KKVEEGETTI

SEQ ID NO: 2736470 - protein, 41 aa, Entamoeba histolytica
KKVGSVAKKIATAKVTKQMNKKNAKVVAKKSEKKVVKILKK

SEQ ID NO: 2736471 - protein, 8 aa, Entamoeba histolytica
KKVNGAVD

SEQ ID NO: 2736472 - protein, 13 aa, Entamoeba histolytica
KKVPKSSDCNAKN

SEQ ID NO: 2736473 - protein, 14 aa, Entamoeba histolytica
KKVQNAAKKGMGAV

SEQ ID NO: 2736474 - protein, 122 aa, Entamoeba histolytica
KKVQSQVKKAKKNAKKALSKESKLKKSLAKKISKTSKNAKAIAKKSAKKAAKKAEKKAEKKAISKAKAYTKKNTKKIAKEDKKKLKKVQSKLEKKVKKVEKNDKKALAKVAKKDKKALAKIT

SEQ ID NO: 2736475 - protein, 5 aa, Entamoeba histolytica
KKVSY

SEQ ID NO: 2736476 - protein, 4 aa, Entamoeba histolytica
KKYN

SEQ ID NO: 2736477 - protein, 10 aa, Entamoeba histolytica
KKYNEQDPGD

SEQ ID NO: 2736478 - protein, 8 aa, Entamoeba histolytica
KKYNSSEK

SEQ ID NO: 2736479 - protein, 5 aa, Entamoeba histolytica
KKYST

SEQ ID NO: 2736480 - protein, 6 aa, Entamoeba histolytica
KLAFSS

SEQ ID NO: 2736481 - protein, 8 aa, Entamoeba histolytica
KLDDTERA

SEQ ID NO: 2736482 - protein, 8 aa, Entamoeba histolytica
KLDIEKND

SEQ ID NO: 2736483 - protein, 7 aa, Entamoeba histolytica
KLEEQKK

SEQ ID NO: 2736484 - protein, 13 aa, Entamoeba histolytica
KLEKETRVKSLSD

SEQ ID NO: 2736485 - protein, 12 aa, Entamoeba histolytica
KLKDKNLQKEER

SEQ ID NO: 2736486 - protein, 13 aa, Entamoeba histolytica
KLKEKKCENDVCT

SEQ ID NO: 2736487 - protein, 4 aa, Entamoeba histolytica
KLNE

SEQ ID NO: 2736488 - protein, 19 aa, Entamoeba histolytica
KLNNTAVPKQNLKNPFMMN

SEQ ID NO: 2736489 - protein, 4 aa, Entamoeba histolytica
KLPG

SEQ ID NO: 2736490 - protein, 8 aa, Entamoeba histolytica
KLPGQKAD

SEQ ID NO: 2736491 - protein, 6 aa, Entamoeba histolytica
KLQTTN

SEQ ID NO: 2736492 - protein, 4 aa, Entamoeba histolytica
KLRK

SEQ ID NO: 2736493 - protein, 12 aa, Entamoeba histolytica
KLSEADRDYKRM

SEQ ID NO: 2736494 - protein, 16 aa, Entamoeba histolytica
KLTKAGEEVKNHKEEI

SEQ ID NO: 2736495 - protein, 7 aa, Entamoeba histolytica
KLVNEES

SEQ ID NO: 2736496 - protein, 12 aa, Entamoeba histolytica
KMGSDIKEGKKT

SEQ ID NO: 2736497 - protein, 4 aa, Entamoeba histolytica
KMNY

SEQ ID NO: 2736498 - protein, 18 aa, Entamoeba histolytica
KMQSKISKALKNAAGDVR

SEQ ID NO: 2736499 - protein, 6 aa, Entamoeba histolytica
KMSSSF

SEQ ID NO: 2736500 - protein, 11 aa, Entamoeba histolytica
KNAKKSKNKEL

SEQ ID NO: 2736501 - protein, 29 aa, Entamoeba histolytica
KNALDCDENTYNHYSPKDFDKGLSMTDGT

SEQ ID NO: 2736502 - protein, 6 aa, Entamoeba histolytica
KNALND

SEQ ID NO: 2736503 - protein, 9 aa, Entamoeba histolytica
KNANRRNER

SEQ ID NO: 2736504 - protein, 12 aa, Entamoeba histolytica
KNCNGNNNKYSY

SEQ ID NO: 2736505 - protein, 6 aa, Entamoeba histolytica
KNDKSM

SEQ ID NO: 2736506 - protein, 5 aa, Entamoeba histolytica
KNDPS

SEQ ID NO: 2736507 - protein, 5 aa, Entamoeba histolytica
KNECD

SEQ ID NO: 2736508 - protein, 5 aa, Entamoeba histolytica
KNENI

SEQ ID NO: 2736509 - protein, 10 aa, Entamoeba histolytica
KNESPNYQYD

SEQ ID NO: 2736510 - protein, 6 aa, Entamoeba histolytica
KNETSR

SEQ ID NO: 2736511 - protein, 10 aa, Entamoeba histolytica
KNGEAISNTL

SEQ ID NO: 2736512 - protein, 6 aa, Entamoeba histolytica
KNGKTP

SEQ ID NO: 2736513 - protein, 10 aa, Entamoeba histolytica
KNGKTWSETE

SEQ ID NO: 2736514 - protein, 10 aa, Entamoeba histolytica
KNGLEPRKGY

SEQ ID NO: 2736515 - protein, 4 aa, Entamoeba histolytica
KNIE

SEQ ID NO: 2736516 - protein, 6 aa, Entamoeba histolytica
KNIKDY

SEQ ID NO: 2736517 - protein, 8 aa, Entamoeba histolytica
KNITNKPK

SEQ ID NO: 2736518 - protein, 13 aa, Entamoeba histolytica
KNKAKSKSNIEEL

SEQ ID NO: 2736519 - protein, 14 aa, Entamoeba histolytica
KNKMSEKDKQKIKS

SEQ ID NO: 2736520 - protein, 11 aa, Entamoeba histolytica
KNKSGNNKETL

SEQ ID NO: 2736521 - protein, 7 aa, Entamoeba histolytica
KNKTEIG

SEQ ID NO: 2736522 - protein, 65 aa, Entamoeba histolytica
KNLKKEVKQETKEATKKAAKDAKAKAKEVSKKISKQSKATVEKKVSAAKKQLEKSEKQTKKELKA

SEQ ID NO: 2736523 - protein, 5 aa, Entamoeba histolytica
KNNDN

SEQ ID NO: 2736524 - protein, 8 aa, Entamoeba histolytica
KNNENDDV

SEQ ID NO: 2736525 - protein, 29 aa, Entamoeba histolytica
KNNKSGNVAGSPSGKYPTGGNDPVSYPGS

SEQ ID NO: 2736526 - protein, 6 aa, Entamoeba histolytica
KNNKTT

SEQ ID NO: 2736527 - protein, 4 aa, Entamoeba histolytica
KNNL

SEQ ID NO: 2736528 - protein, 7 aa, Entamoeba histolytica
KNNQKFK

SEQ ID NO: 2736529 - protein, 5 aa, Entamoeba histolytica
KNNSF

SEQ ID NO: 2736530 - protein, 7 aa, Entamoeba histolytica
KNPGEDV

SEQ ID NO: 2736531 - protein, 6 aa, Entamoeba histolytica
KNPNFQ

SEQ ID NO: 2736532 - protein, 9 aa, Entamoeba histolytica
KNPNSTRCY

SEQ ID NO: 2736533 - protein, 12 aa, Entamoeba histolytica
KNPPKTPRKCSI

SEQ ID NO: 2736534 - protein, 11 aa, Entamoeba histolytica
KNPPQPSFSNN

SEQ ID NO: 2736535 - protein, 5 aa, Entamoeba histolytica
KNQNA

SEQ ID NO: 2736536 - protein, 10 aa, Entamoeba histolytica
KNQPSSREYA

SEQ ID NO: 2736537 - protein, 7 aa, Entamoeba histolytica
KNQTQQL

SEQ ID NO: 2736538 - protein, 13 aa, Entamoeba histolytica
KNREKEKKELQKA

SEQ ID NO: 2736539 - protein, 7 aa, Entamoeba histolytica
KNRRSSI

SEQ ID NO: 2736540 - protein, 14 aa, Entamoeba histolytica
KNRVKTKEVIPEEN

SEQ ID NO: 2736541 - protein, 6 aa, Entamoeba histolytica
KNSGKK

SEQ ID NO: 2736542 - protein, 16 aa, Entamoeba histolytica
KNSKEKMSERRREIAE

SEQ ID NO: 2736543 - protein, 5 aa, Entamoeba histolytica
KNSNN

SEQ ID NO: 2736544 - protein, 9 aa, Entamoeba histolytica
KNSNSKCKD

SEQ ID NO: 2736545 - protein, 5 aa, Entamoeba histolytica
KNSVT

SEQ ID NO: 2736546 - protein, 13 aa, Entamoeba histolytica
KNTKRKIEITQPE

SEQ ID NO: 2736547 - protein, 6 aa, Entamoeba histolytica
KNTKSP

SEQ ID NO: 2736548 - protein, 26 aa, Entamoeba histolytica
KNTMTTKTNKQTKKEASKVANKIVSK

SEQ ID NO: 2736549 - protein, 8 aa, Entamoeba histolytica
KNTNNEIT

SEQ ID NO: 2736550 - protein, 7 aa, Entamoeba histolytica
KNTNPYA

SEQ ID NO: 2736551 - protein, 7 aa, Entamoeba histolytica
KNTSRIA

SEQ ID NO: 2736552 - protein, 7 aa, Entamoeba histolytica
KNVDRHR

SEQ ID NO: 2736553 - protein, 20 aa, Entamoeba histolytica
KNVLKETSRKIKKFNIRDNL

SEQ ID NO: 2736554 - protein, 22 aa, Entamoeba histolytica
KNYQSGGGTPEERMKRATGKAW

SEQ ID NO: 2736555 - protein, 7 aa, Entamoeba histolytica
KPDEKWD

SEQ ID NO: 2736556 - protein, 8 aa, Entamoeba histolytica
KPDGYSDS

SEQ ID NO: 2736557 - protein, 5 aa, Entamoeba histolytica
KPFDT

SEQ ID NO: 2736558 - protein, 6 aa, Entamoeba histolytica
KPFTAQ

SEQ ID NO: 2736559 - protein, 6 aa, Entamoeba histolytica
KPFTSA

SEQ ID NO: 2736560 - protein, 5 aa, Entamoeba histolytica
KPIPK

SEQ ID NO: 2736561 - protein, 21 aa, Entamoeba histolytica
KPKQKLREYGKVESNTSLRPE

SEQ ID NO: 2736562 - protein, 6 aa, Entamoeba histolytica
KPKRTL

SEQ ID NO: 2736563 - protein, 7 aa, Entamoeba histolytica
KPLEPTS

SEQ ID NO: 2736564 - protein, 41 aa, Entamoeba histolytica
KPLVKKGSKSTRKSSVQQKNKKVVKSNAKPTLKKNKLNSPF

SEQ ID NO: 2736565 - protein, 14 aa, Entamoeba histolytica
KPMNETKPANITTP

SEQ ID NO: 2736566 - protein, 4 aa, Entamoeba histolytica
KPNL

SEQ ID NO: 2736567 - protein, 6 aa, Entamoeba histolytica
KPNRNC

SEQ ID NO: 2736568 - protein, 7 aa, Entamoeba histolytica
KPSPKNI

SEQ ID NO: 2736569 - protein, 6 aa, Entamoeba histolytica
KPYASG

SEQ ID NO: 2736570 - protein, 14 aa, Entamoeba histolytica
KPYYEKNNYKVPNQ

SEQ ID NO: 2736571 - protein, 12 aa, Entamoeba histolytica
KQADNNKPKRKM

SEQ ID NO: 2736572 - protein, 8 aa, Entamoeba histolytica
KQAIKNDK

SEQ ID NO: 2736573 - protein, 38 aa, Entamoeba histolytica
KQAIKTENKYRKQLGKSALKPKESVKKTNTKKVVPAQI

SEQ ID NO: 2736574 - protein, 8 aa, Entamoeba histolytica
KQATCPNG

SEQ ID NO: 2736575 - protein, 6 aa, Entamoeba histolytica
KQCSEY

SEQ ID NO: 2736576 - protein, 8 aa, Entamoeba histolytica
KQDADQIT

SEQ ID NO: 2736577 - protein, 9 aa, Entamoeba histolytica
KQDGTYSIT

SEQ ID NO: 2736578 - protein, 14 aa, Entamoeba histolytica
KQDMEGALSSAQIS

SEQ ID NO: 2736579 - protein, 5 aa, Entamoeba histolytica
KQENE

SEQ ID NO: 2736580 - protein, 9 aa, Entamoeba histolytica
KQENKLPTG

SEQ ID NO: 2736581 - protein, 6 aa, Entamoeba histolytica
KQETCG

SEQ ID NO: 2736582 - protein, 7 aa, Entamoeba histolytica
KQGARGY

SEQ ID NO: 2736583 - protein, 24 aa, Entamoeba histolytica
KQIEPNQVKQVPPKKIKEIQSTNM

SEQ ID NO: 2736584 - protein, 10 aa, Entamoeba histolytica
KQIKDAREIT

SEQ ID NO: 2736585 - protein, 5 aa, Entamoeba histolytica
KQLKK

SEQ ID NO: 2736586 - protein, 7 aa, Entamoeba histolytica
KQLQNNI

SEQ ID NO: 2736587 - protein, 6 aa, Entamoeba histolytica
KQLSGK

SEQ ID NO: 2736588 - protein, 11 aa, Entamoeba histolytica
KQNQCKDKGDC

SEQ ID NO: 2736589 - protein, 8 aa, Entamoeba histolytica
KQNSGTYN

SEQ ID NO: 2736590 - protein, 8 aa, Entamoeba histolytica
KQNTKEID

SEQ ID NO: 2736591 - protein, 12 aa, Entamoeba histolytica
KQPFDKKKDALN

SEQ ID NO: 2736592 - protein, 14 aa, Entamoeba histolytica
KQQHKKEKKDKQIA

SEQ ID NO: 2736593 - protein, 4 aa, Entamoeba histolytica
KQQK

SEQ ID NO: 2736594 - protein, 4 aa, Entamoeba histolytica
KQSA

SEQ ID NO: 2736595 - protein, 10 aa, Entamoeba histolytica
KQSDNNFEGT

SEQ ID NO: 2736596 - protein, 7 aa, Entamoeba histolytica
KQSGNFP

SEQ ID NO: 2736597 - protein, 11 aa, Entamoeba histolytica
KQTMDSTDPLG

SEQ ID NO: 2736598 - protein, 7 aa, Entamoeba histolytica
KQYQRKE

SEQ ID NO: 2736599 - protein, 17 aa, Entamoeba histolytica
KQYQSKKISKKQVKKAA

SEQ ID NO: 2736600 - protein, 11 aa, Entamoeba histolytica
KQYTKEIPIGD

SEQ ID NO: 2736601 - protein, 28 aa, Entamoeba histolytica
KRAEKKVERKIRKNSYKASTPSTASKKC

SEQ ID NO: 2736602 - protein, 5 aa, Entamoeba histolytica
KRDNS

SEQ ID NO: 2736603 - protein, 4 aa, Entamoeba histolytica
KREQ

SEQ ID NO: 2736604 - protein, 14 aa, Entamoeba histolytica
KRESEEKDNRMNKR

SEQ ID NO: 2736605 - protein, 5 aa, Entamoeba histolytica
KRETL

SEQ ID NO: 2736606 - protein, 6 aa, Entamoeba histolytica
KRGDKF

SEQ ID NO: 2736607 - protein, 6 aa, Entamoeba histolytica
KRGGYY

SEQ ID NO: 2736608 - protein, 11 aa, Entamoeba histolytica
KRHRDANRSSL

SEQ ID NO: 2736609 - protein, 10 aa, Entamoeba histolytica
KRHSTDGKKC

SEQ ID NO: 2736610 - protein, 11 aa, Entamoeba histolytica
KRIKEEREKQY

SEQ ID NO: 2736611 - protein, 6 aa, Entamoeba histolytica
KRIRGS

SEQ ID NO: 2736612 - protein, 6 aa, Entamoeba histolytica
KRKEIE

SEQ ID NO: 2736613 - protein, 27 aa, Entamoeba histolytica
KRKKNSATSSVEKAEAKNSMKQINSEL

SEQ ID NO: 2736614 - protein, 5 aa, Entamoeba histolytica
KRLET

SEQ ID NO: 2736615 - protein, 10 aa, Entamoeba histolytica
KRNEEEARKA

SEQ ID NO: 2736616 - protein, 20 aa, Entamoeba histolytica
KRNKIATKAISRAQNANQKE

SEQ ID NO: 2736617 - protein, 16 aa, Entamoeba histolytica
KRNNKKGLSNRKKSLT

SEQ ID NO: 2736618 - protein, 9 aa, Entamoeba histolytica
KRNPHKTED

SEQ ID NO: 2736619 - protein, 9 aa, Entamoeba histolytica
KRNTDKINE

SEQ ID NO: 2736620 - protein, 6 aa, Entamoeba histolytica
KRPREG

SEQ ID NO: 2736621 - protein, 9 aa, Entamoeba histolytica
KRPTKPAKL

SEQ ID NO: 2736622 - protein, 8 aa, Entamoeba histolytica
KRQPQIKQ

SEQ ID NO: 2736623 - protein, 12 aa, Entamoeba histolytica
KRSVRFRNGGYE

SEQ ID NO: 2736624 - protein, 13 aa, Entamoeba histolytica
KRSVRYPDGNYEQ

SEQ ID NO: 2736625 - protein, 21 aa, Entamoeba histolytica
KRTPSSKVMSSVDTSRLYTGY

SEQ ID NO: 2736626 - protein, 11 aa, Entamoeba histolytica
KRTRKFNPSVQ

SEQ ID NO: 2736627 - protein, 25 aa, Entamoeba histolytica
KRTVTKPNTPKQEQKPFKIPEPEPF

SEQ ID NO: 2736628 - protein, 6 aa, Entamoeba histolytica
KRYNKI

SEQ ID NO: 2736629 - protein, 9 aa, Entamoeba histolytica
KSAADIPSK

SEQ ID NO: 2736630 - protein, 9 aa, Entamoeba histolytica
KSALSEAQN

SEQ ID NO: 2736631 - protein, 129 aa, Entamoeba histolytica
KSANKTKVQNKKTLKPMKKGLTGKKSTFTNTKKQSTTTKPLSTKSKKNIKPLTKGLSGKKVPTFSVKGNKNVTSVSQPTKSTTNTNTKIINEKGKKGIEASIDYKGDKLSTNSQAKFTKDGNGKTTSFG

SEQ ID NO: 2736632 - protein, 7 aa, Entamoeba histolytica
KSCQPIE

SEQ ID NO: 2736633 - protein, 7 aa, Entamoeba histolytica
KSDIPNV

SEQ ID NO: 2736634 - protein, 7 aa, Entamoeba histolytica
KSDNSFD

SEQ ID NO: 2736635 - protein, 7 aa, Entamoeba histolytica
KSEEANY

SEQ ID NO: 2736636 - protein, 5 aa, Entamoeba histolytica
KSEEE

SEQ ID NO: 2736637 - protein, 5 aa, Entamoeba histolytica
KSEMK

SEQ ID NO: 2736638 - protein, 7 aa, Entamoeba histolytica
KSENRLR

SEQ ID NO: 2736639 - protein, 12 aa, Entamoeba histolytica
KSEQTQNAQNPK

SEQ ID NO: 2736640 - protein, 12 aa, Entamoeba histolytica
KSESCTGKITDH

SEQ ID NO: 2736641 - protein, 8 aa, Entamoeba histolytica
KSETDKEI

SEQ ID NO: 2736642 - protein, 5 aa, Entamoeba histolytica
KSGAR

SEQ ID NO: 2736643 - protein, 26 aa, Entamoeba histolytica
KSGNVAGSPSGKYPTGGNDPVSYPGS

SEQ ID NO: 2736644 - protein, 30 aa, Entamoeba histolytica
KSGVKGSLNVKKPVSKLNTPIKPTLAEQYP

SEQ ID NO: 2736645 - protein, 6 aa, Entamoeba histolytica
KSKEAF

SEQ ID NO: 2736646 - protein, 6 aa, Entamoeba histolytica
KSKEYK

SEQ ID NO: 2736647 - protein, 4 aa, Entamoeba histolytica
KSKG

SEQ ID NO: 2736648 - protein, 12 aa, Entamoeba histolytica
KSKNPPRNEDRI

SEQ ID NO: 2736649 - protein, 8 aa, Entamoeba histolytica
KSKYPTTC

SEQ ID NO: 2736650 - protein, 59 aa, Entamoeba histolytica
KSLKAKVKKAEKKAKAQAKKQAKKIAKKQAAKTQKAIAKKVNSKVKKVTKKEAADKKKL

SEQ ID NO: 2736651 - protein, 4 aa, Entamoeba histolytica
KSLT

SEQ ID NO: 2736652 - protein, 6 aa, Entamoeba histolytica
KSLTGI

SEQ ID NO: 2736653 - protein, 6 aa, Entamoeba histolytica
KSNGKM

SEQ ID NO: 2736654 - protein, 9 aa, Entamoeba histolytica
KSNKQVPAS

SEQ ID NO: 2736655 - protein, 5 aa, Entamoeba histolytica
KSNLT

SEQ ID NO: 2736656 - protein, 6 aa, Entamoeba histolytica
KSNNGT

SEQ ID NO: 2736657 - protein, 12 aa, Entamoeba histolytica
KSNNKKTALDKA

SEQ ID NO: 2736658 - protein, 6 aa, Entamoeba histolytica
KSNPRR

SEQ ID NO: 2736659 - protein, 6 aa, Entamoeba histolytica
KSNQYK

SEQ ID NO: 2736660 - protein, 7 aa, Entamoeba histolytica
KSPLPKI

SEQ ID NO: 2736661 - protein, 6 aa, Entamoeba histolytica
KSPYTC

SEQ ID NO: 2736662 - protein, 14 aa, Entamoeba histolytica
KSQISKSKKNVKKA

SEQ ID NO: 2736663 - protein, 6 aa, Entamoeba histolytica
KSQMTS

SEQ ID NO: 2736664 - protein, 8 aa, Entamoeba histolytica
KSQRNSNA

SEQ ID NO: 2736665 - protein, 15 aa, Entamoeba histolytica
KSQTFSTYQDNQPSV

SEQ ID NO: 2736666 - protein, 7 aa, Entamoeba histolytica
KSRNPNL

SEQ ID NO: 2736667 - protein, 6 aa, Entamoeba histolytica
KSSPKY

SEQ ID NO: 2736668 - protein, 9 aa, Entamoeba histolytica
KSSSKGTFT

SEQ ID NO: 2736669 - protein, 9 aa, Entamoeba histolytica
KSSSRRNER

SEQ ID NO: 2736670 - protein, 11 aa, Entamoeba histolytica
KSSVISSTSSL

SEQ ID NO: 2736671 - protein, 14 aa, Entamoeba histolytica
KSTASASDKKNYLK

SEQ ID NO: 2736672 - protein, 20 aa, Entamoeba histolytica
KSTEENKKEDDEKQVKTKED

SEQ ID NO: 2736673 - protein, 11 aa, Entamoeba histolytica
KSTGSDGYNEP

SEQ ID NO: 2736674 - protein, 4 aa, Entamoeba histolytica
KSTI

SEQ ID NO: 2736675 - protein, 10 aa, Entamoeba histolytica
KSTKKDEPAL

SEQ ID NO: 2736676 - protein, 7 aa, Entamoeba histolytica
KSVKEAT

SEQ ID NO: 2736677 - protein, 14 aa, Entamoeba histolytica
KSVKSKKANSVAKK

SEQ ID NO: 2736678 - protein, 13 aa, Entamoeba histolytica
KSVPEGGLSQENL

SEQ ID NO: 2736679 - protein, 8 aa, Entamoeba histolytica
KSYSDEKF

SEQ ID NO: 2736680 - protein, 9 aa, Entamoeba histolytica
KSYSGSGNY

SEQ ID NO: 2736681 - protein, 10 aa, Entamoeba histolytica
KTASDYLGKE

SEQ ID NO: 2736682 - protein, 12 aa, Entamoeba histolytica
KTASESCPKKAA

SEQ ID NO: 2736683 - protein, 6 aa, Entamoeba histolytica
KTCEEG

SEQ ID NO: 2736684 - protein, 10 aa, Entamoeba histolytica
KTDCRNRESA

SEQ ID NO: 2736685 - protein, 8 aa, Entamoeba histolytica
KTDKNSKR

SEQ ID NO: 2736686 - protein, 9 aa, Entamoeba histolytica
KTDNTSFDK

SEQ ID NO: 2736687 - protein, 6 aa, Entamoeba histolytica
KTDQTK

SEQ ID NO: 2736688 - protein, 12 aa, Entamoeba histolytica
KTDSGKAQLKND

SEQ ID NO: 2736689 - protein, 9 aa, Entamoeba histolytica
KTDTTTYNC

SEQ ID NO: 2736690 - protein, 5 aa, Entamoeba histolytica
KTEQK

SEQ ID NO: 2736691 - protein, 6 aa, Entamoeba histolytica
KTFASS

SEQ ID NO: 2736692 - protein, 6 aa, Entamoeba histolytica
KTGDNS

SEQ ID NO: 2736693 - protein, 7 aa, Entamoeba histolytica
KTGFKGK

SEQ ID NO: 2736694 - protein, 9 aa, Entamoeba histolytica
KTGKEPETS

SEQ ID NO: 2736695 - protein, 6 aa, Entamoeba histolytica
KTIPRS

SEQ ID NO: 2736696 - protein, 17 aa, Entamoeba histolytica
KTKATKRCCGGHPRDAV

SEQ ID NO: 2736697 - protein, 4 aa, Entamoeba histolytica
KTKE

SEQ ID NO: 2736698 - protein, 6 aa, Entamoeba histolytica
KTKISK

SEQ ID NO: 2736699 - protein, 38 aa, Entamoeba histolytica
KTKITKKNCKEDSPKVKEAKKEVKKAMKRVNKSSEEFK

SEQ ID NO: 2736700 - protein, 5 aa, Entamoeba histolytica
KTKQC

SEQ ID NO: 2736701 - protein, 5 aa, Entamoeba histolytica
KTKQY

SEQ ID NO: 2736702 - protein, 8 aa, Entamoeba histolytica
KTKTKDNE

SEQ ID NO: 2736703 - protein, 13 aa, Entamoeba histolytica
KTLETKAPSGDKL

SEQ ID NO: 2736704 - protein, 13 aa, Entamoeba histolytica
KTLNEKRTQPSDA

SEQ ID NO: 2736705 - protein, 40 aa, Entamoeba histolytica
KTLNNNKTQVNSTQNNITQSNVTKVENATKTNNTSIQDQR

SEQ ID NO: 2736706 - protein, 11 aa, Entamoeba histolytica
KTLSNEGKKYL

SEQ ID NO: 2736707 - protein, 6 aa, Entamoeba histolytica
KTLSTD

SEQ ID NO: 2736708 - protein, 4 aa, Entamoeba histolytica
KTME

SEQ ID NO: 2736709 - protein, 9 aa, Entamoeba histolytica
KTNETEALT

SEQ ID NO: 2736710 - protein, 8 aa, Entamoeba histolytica
KTNTNPTE

SEQ ID NO: 2736711 - protein, 13 aa, Entamoeba histolytica
KTPTLGQTFKTGE

SEQ ID NO: 2736712 - protein, 34 aa, Entamoeba histolytica
KTPTTTPVVQSKKTQTPLKEAKPINGTKPLNVTQ

SEQ ID NO: 2736713 - protein, 6 aa, Entamoeba histolytica
KTQATI

SEQ ID NO: 2736714 - protein, 21 aa, Entamoeba histolytica
KTQISEEVAQQALKEAKVGRQ

SEQ ID NO: 2736715 - protein, 9 aa, Entamoeba histolytica
KTQYQTTVT

SEQ ID NO: 2736716 - protein, 6 aa, Entamoeba histolytica
KTRNAK

SEQ ID NO: 2736717 - protein, 4 aa, Entamoeba histolytica
KTSN

SEQ ID NO: 2736718 - protein, 18 aa, Entamoeba histolytica
KTSSGKCLGTATKEDIQK

SEQ ID NO: 2736719 - protein, 8 aa, Entamoeba histolytica
KTSTIRGY

SEQ ID NO: 2736720 - protein, 37 aa, Entamoeba histolytica
KTTMKTTMKTTMKKTMKKTMKKTMKKTMKKTMKKTMK

SEQ ID NO: 2736721 - protein, 7 aa, Entamoeba histolytica
KTTNNDY

SEQ ID NO: 2736722 - protein, 5 aa, Entamoeba histolytica
KTTTL

SEQ ID NO: 2736723 - protein, 35 aa, Entamoeba histolytica
KTVPQNKDSQPPMADQPKEDQPKEDQPKEDQPKAE

SEQ ID NO: 2736724 - protein, 8 aa, Entamoeba histolytica
KTYGIDAN

SEQ ID NO: 2736725 - protein, 38 aa, Entamoeba histolytica
KVASKTAKKAAKAEKKAESKLSKIKKDVKKGTKTAAQL

SEQ ID NO: 2736726 - protein, 4 aa, Entamoeba histolytica
KVDL

SEQ ID NO: 2736727 - protein, 25 aa, Entamoeba histolytica
KVDQPTSRFQTPVKTESKEETGTGL

SEQ ID NO: 2736728 - protein, 6 aa, Entamoeba histolytica
KVGEKY

SEQ ID NO: 2736729 - protein, 6 aa, Entamoeba histolytica
KVGGEK

SEQ ID NO: 2736730 - protein, 11 aa, Entamoeba histolytica
KVGQVSKPNIS

SEQ ID NO: 2736731 - protein, 6 aa, Entamoeba histolytica
KVGTTT

SEQ ID NO: 2736732 - protein, 16 aa, Entamoeba histolytica
KVKKALNDIKKPKIPP

SEQ ID NO: 2736733 - protein, 9 aa, Entamoeba histolytica
KVKQKKAER

SEQ ID NO: 2736734 - protein, 9 aa, Entamoeba histolytica
KVKSKAKTI

SEQ ID NO: 2736735 - protein, 5 aa, Entamoeba histolytica
KVNMS

SEQ ID NO: 2736736 - protein, 7 aa, Entamoeba histolytica
KVPEVPQ

SEQ ID NO: 2736737 - protein, 6 aa, Entamoeba histolytica
KVPKCK

SEQ ID NO: 2736738 - protein, 6 aa, Entamoeba histolytica
KVPNGT

SEQ ID NO: 2736739 - protein, 25 aa, Entamoeba histolytica
KVQLKKAKKAGLKIGPTEKKLAQKA

SEQ ID NO: 2736740 - protein, 8 aa, Entamoeba histolytica
KVQTIEDK

SEQ ID NO: 2736741 - protein, 7 aa, Entamoeba histolytica
KVRTLQS

SEQ ID NO: 2736742 - protein, 7 aa, Entamoeba histolytica
KVTSQLA

SEQ ID NO: 2736743 - protein, 5 aa, Entamoeba histolytica
KWGTD

SEQ ID NO: 2736744 - protein, 5 aa, Entamoeba histolytica
KWRAQ

SEQ ID NO: 2736745 - protein, 8 aa, Entamoeba histolytica
KYCDNGKK

SEQ ID NO: 2736746 - protein, 11 aa, Entamoeba histolytica
KYDSTGKKVDT

SEQ ID NO: 2736747 - protein, 21 aa, Entamoeba histolytica
KYEPKDNGASCGCASPYTEVS

SEQ ID NO: 2736748 - protein, 8 aa, Entamoeba histolytica
KYERQAAQ

SEQ ID NO: 2736749 - protein, 9 aa, Entamoeba histolytica
KYEVSKDSK

SEQ ID NO: 2736750 - protein, 7 aa, Entamoeba histolytica
KYGKSIT

SEQ ID NO: 2736751 - protein, 8 aa, Entamoeba histolytica
KYGRTKIG

SEQ ID NO: 2736752 - protein, 4 aa, Entamoeba histolytica
KYIK

SEQ ID NO: 2736753 - protein, 7 aa, Entamoeba histolytica
KYKDTTE

SEQ ID NO: 2736754 - protein, 18 aa, Entamoeba histolytica
KYKEKEREKIEKKKGEIL

SEQ ID NO: 2736755 - protein, 12 aa, Entamoeba histolytica
KYPSVCNTPGDD

SEQ ID NO: 2736756 - protein, 7 aa, Entamoeba histolytica
KYSFNEE

SEQ ID NO: 2736757 - protein, 7 aa, Entamoeba histolytica
KYSNPNT

SEQ ID NO: 2736758 - protein, 5 aa, Entamoeba histolytica
KYSVG

SEQ ID NO: 2736759 - protein, 7 aa, Entamoeba histolytica
KYTEDPE

SEQ ID NO: 2736760 - protein, 5 aa, Entamoeba histolytica
KYTKK

SEQ ID NO: 2736761 - protein, 11 aa, Entamoeba histolytica
LADDKKDKTKV

SEQ ID NO: 2736762 - protein, 17 aa, Entamoeba histolytica
LADEIDELKKQKTAFET

SEQ ID NO: 2736763 - protein, 26 aa, Entamoeba histolytica
LADEIDELKKQKTAFETEKTIAEKKI

SEQ ID NO: 2736764 - protein, 4 aa, Entamoeba histolytica
LAEG

SEQ ID NO: 2736765 - protein, 10 aa, Entamoeba histolytica
LAKKGKDISK

SEQ ID NO: 2736766 - protein, 12 aa, Entamoeba histolytica
LAKKMSTPCTEQ

SEQ ID NO: 2736767 - protein, 140 aa, Entamoeba histolytica
LAKKRVKKSTKKVVRHSQKPNQNKANQLNNQPTAQPAVQSNSQPAPQPTAQPTPQPAAQPAPQPAAQPAPQPAAQPAAQPAPQPAPQPAPQPAPQPAPQPAAQPAPQPAAQPAPQPAAQPTPQPTAQPANNQNGQTGKEI

SEQ ID NO: 2736768 - protein, 10 aa, Entamoeba histolytica
LAKKSSPINS

SEQ ID NO: 2736769 - protein, 11 aa, Entamoeba histolytica
LAKTNKPSSSL

SEQ ID NO: 2736770 - protein, 9 aa, Entamoeba histolytica
LANRKQTSH

SEQ ID NO: 2736771 - protein, 5 aa, Entamoeba histolytica
LAPLT

SEQ ID NO: 2736772 - protein, 8 aa, Entamoeba histolytica
LASGEENA

SEQ ID NO: 2736773 - protein, 5 aa, Entamoeba histolytica
LATGT

SEQ ID NO: 2736774 - protein, 9 aa, Entamoeba histolytica
LDDKNKAYA

SEQ ID NO: 2736775 - protein, 13 aa, Entamoeba histolytica
LDEEQNESAQQYT

SEQ ID NO: 2736776 - protein, 9 aa, Entamoeba histolytica
LDEIDDQKR

SEQ ID NO: 2736777 - protein, 9 aa, Entamoeba histolytica
LDENKEDVH

SEQ ID NO: 2736778 - protein, 10 aa, Entamoeba histolytica
LDESRPSPFG

SEQ ID NO: 2736779 - protein, 10 aa, Entamoeba histolytica
LDETKQYKQI

SEQ ID NO: 2736780 - protein, 5 aa, Entamoeba histolytica
LDFDE

SEQ ID NO: 2736781 - protein, 8 aa, Entamoeba histolytica
LDGEVETK

SEQ ID NO: 2736782 - protein, 5 aa, Entamoeba histolytica
LDGKT

SEQ ID NO: 2736783 - protein, 20 aa, Entamoeba histolytica
LDRKTGDFAGKTIEEQSKQV

SEQ ID NO: 2736784 - protein, 19 aa, Entamoeba histolytica
LEAAKKKKADLEELAKSFQ

SEQ ID NO: 2736785 - protein, 7 aa, Entamoeba histolytica
LEAAQRR

SEQ ID NO: 2736786 - protein, 65 aa, Entamoeba histolytica
LEDDKAKAAPKKAAPKKAAPKKAAPKKAAPKKSTPKKSTPKKSTPKKSTPKKSTTKKPAQKKKSL

SEQ ID NO: 2736787 - protein, 8 aa, Entamoeba histolytica
LEDRPSHN

SEQ ID NO: 2736788 - protein, 16 aa, Entamoeba histolytica
LEEAKNSPVAQSAVNA

SEQ ID NO: 2736789 - protein, 5 aa, Entamoeba histolytica
LEEQE

SEQ ID NO: 2736790 - protein, 17 aa, Entamoeba histolytica
LEETRNTIVNGQKKVTD

SEQ ID NO: 2736791 - protein, 57 aa, Entamoeba histolytica
LEKAQAEKDAKEESAEQKAKQAAGMNNGASTQPNKKSGNQIPTQTPVQNQAPNSQQT

SEQ ID NO: 2736792 - protein, 6 aa, Entamoeba histolytica
LEKEIN

SEQ ID NO: 2736793 - protein, 88 aa, Entamoeba histolytica
LENDDLDEYELDDDDELDDDDELDDDDELHDDDELDDDDELDDDDELDDDDELDDDDELDDDEDGDSEFELEDDDDEERRRRRRRRGS

SEQ ID NO: 2736794 - protein, 15 aa, Entamoeba histolytica
LENEENEETINSKCE

SEQ ID NO: 2736795 - protein, 57 aa, Entamoeba histolytica
LENNNGVDENDNEEEVIEAEDDDNGDDEYDLEEEDDDEDGEYELEDDEDDEERRRRR

SEQ ID NO: 2736796 - protein, 327 aa, Entamoeba histolytica
LENNYNNELEDEDEDEYELEEEEDDDDDEEEEDDEDDDDEEDDDEEDDDEEDDDDEEDDEEDDEEEEDDEDEDDEDDEDDEYELEDDDDEEEEDDDEDDEDDEDDEYELEDDDDDEEEDDDEEEEDDDEDDDEEEDEEDDEEDDEDDDEEEEDDDEDDEDDEDDEYELEDDDEEEEDDDEEEEDDDEDDDEEEDEDDDEEEDEDDDEEEDDDEEEDEEEEDDEEDDEEEEDDDEDDEYELEDDEEDDEEDDEEEDDEEEEDDDDDDEEDDDEDDEEDEDDEEEEDEDDEDDEDDEDDEDDEDDEYELEDELDDEDDEDDDEDEYELE

SEQ ID NO: 2736797 - protein, 11 aa, Entamoeba histolytica
LENQKKVEDLK

SEQ ID NO: 2736798 - protein, 28 aa, Entamoeba histolytica
LEPAKARLEAKKTNSTESVADKKVADAI

SEQ ID NO: 2736799 - protein, 4 aa, Entamoeba histolytica
LEPQ

SEQ ID NO: 2736800 - protein, 9 aa, Entamoeba histolytica
LERTEKGHM

SEQ ID NO: 2736801 - protein, 8 aa, Entamoeba histolytica
LESDERKP

SEQ ID NO: 2736802 - protein, 6 aa, Entamoeba histolytica
LESNGE

SEQ ID NO: 2736803 - protein, 4 aa, Entamoeba histolytica
LETR

SEQ ID NO: 2736804 - protein, 6 aa, Entamoeba histolytica
LGDESV

SEQ ID NO: 2736805 - protein, 8 aa, Entamoeba histolytica
LGENNESI

SEQ ID NO: 2736806 - protein, 11 aa, Entamoeba histolytica
LGGKGSGDKIK

SEQ ID NO: 2736807 - protein, 6 aa, Entamoeba histolytica
LGGSKQ

SEQ ID NO: 2736808 - protein, 9 aa, Entamoeba histolytica
LGISDGSDQ

SEQ ID NO: 2736809 - protein, 4 aa, Entamoeba histolytica
LGLT

SEQ ID NO: 2736810 - protein, 7 aa, Entamoeba histolytica
LGNGNAN

SEQ ID NO: 2736811 - protein, 9 aa, Entamoeba histolytica
LGPTSTNPL

SEQ ID NO: 2736812 - protein, 4 aa, Entamoeba histolytica
LGRV

SEQ ID NO: 2736813 - protein, 5 aa, Entamoeba histolytica
LGRVD

SEQ ID NO: 2736814 - protein, 9 aa, Entamoeba histolytica
LGSNAPKTI

SEQ ID NO: 2736815 - protein, 7 aa, Entamoeba histolytica
LHENAQD

SEQ ID NO: 2736816 - protein, 5 aa, Entamoeba histolytica
LHGGN

SEQ ID NO: 2736817 - protein, 10 aa, Entamoeba histolytica
LHPKKTEYTY

SEQ ID NO: 2736818 - protein, 13 aa, Entamoeba histolytica
LHSNDKEKRKTKC

SEQ ID NO: 2736819 - protein, 9 aa, Entamoeba histolytica
LIDTTNSQY

SEQ ID NO: 2736820 - protein, 7 aa, Entamoeba histolytica
LIERKED

SEQ ID NO: 2736821 - protein, 12 aa, Entamoeba histolytica
LIRSSKDKTVIP

SEQ ID NO: 2736822 - protein, 14 aa, Entamoeba histolytica
LKANSYEGFDSANY

SEQ ID NO: 2736823 - protein, 21 aa, Entamoeba histolytica
LKASSDNKNVFTATSSTVSFP

SEQ ID NO: 2736824 - protein, 9 aa, Entamoeba histolytica
LKEAKENKE

SEQ ID NO: 2736825 - protein, 17 aa, Entamoeba histolytica
LKEANQLASDKKRFAQQ

SEQ ID NO: 2736826 - protein, 14 aa, Entamoeba histolytica
LKEDQPSLISSPSS

SEQ ID NO: 2736827 - protein, 6 aa, Entamoeba histolytica
LKEEYQ

SEQ ID NO: 2736828 - protein, 5 aa, Entamoeba histolytica
LKEMN

SEQ ID NO: 2736829 - protein, 14 aa, Entamoeba histolytica
LKEQINASTKNAAQ

SEQ ID NO: 2736830 - protein, 9 aa, Entamoeba histolytica
LKEQKEKDI

SEQ ID NO: 2736831 - protein, 4 aa, Entamoeba histolytica
LKES

SEQ ID NO: 2736832 - protein, 251 aa, Entamoeba histolytica
LKGEVTTQITDEVPKSSQPTIQKEQRSEEDTNTKEVGSTLNPKNNPEDSETGKSLNTNTENKVDKGVNEPAKGGEVKTENNAETETNKQSETTDKRLNPESSTTGQEETTPKQTNAGSTGKGEDPVPKSEGEVPSTKPGSSDSEKGQESNKNGQGDSGVNEQGKEGSGTGADSKEKGEINDKGKEEKATNEKDGGNTKDKEGKEQGNSVTDDGHSNKNGESNKEKDGNSGETGQKEESGKNGVAGQDEKKW

SEQ ID NO: 2736833 - protein, 14 aa, Entamoeba histolytica
LKHGTITTEDIEAA

SEQ ID NO: 2736834 - protein, 20 aa, Entamoeba histolytica
LKKADLSYNKVTGPNGVSSN

SEQ ID NO: 2736835 - protein, 21 aa, Entamoeba histolytica
LKKENQLEKAQLNSKDLQRTE

SEQ ID NO: 2736836 - protein, 10 aa, Entamoeba histolytica
LKKNGEEKDI

SEQ ID NO: 2736837 - protein, 13 aa, Entamoeba histolytica
LKKQNNEKRYREE

SEQ ID NO: 2736838 - protein, 11 aa, Entamoeba histolytica
LKKSTQNIKKQ

SEQ ID NO: 2736839 - protein, 22 aa, Entamoeba histolytica
LKKVEKPWNEVPPLPSGDNLPQ

SEQ ID NO: 2736840 - protein, 4 aa, Entamoeba histolytica
LKNS

SEQ ID NO: 2736841 - protein, 7 aa, Entamoeba histolytica
LKPQNEP

SEQ ID NO: 2736842 - protein, 11 aa, Entamoeba histolytica
LKQQKKVEDLK

SEQ ID NO: 2736843 - protein, 103 aa, Entamoeba histolytica
LKQQRKAQKEKRKLEKENRKAIKEQKKASRLAKKEERKIRKEERKIKKENRKAIKEAKKSRKVAKKEERKTEKEKRKLEKEKQKNSIDKTKLKAQKKKAERKL

SEQ ID NO: 2736844 - protein, 10 aa, Entamoeba histolytica
LKQSKANGEK

SEQ ID NO: 2736845 - protein, 7 aa, Entamoeba histolytica
LKQTRKI

SEQ ID NO: 2736846 - protein, 10 aa, Entamoeba histolytica
LKRSSKSFEA

SEQ ID NO: 2736847 - protein, 8 aa, Entamoeba histolytica
LKSEENIR

SEQ ID NO: 2736848 - protein, 28 aa, Entamoeba histolytica
LKSEEPEKVTPKIPQPASPKTPETAEHS

SEQ ID NO: 2736849 - protein, 8 aa, Entamoeba histolytica
LKSSGAVT

SEQ ID NO: 2736850 - protein, 28 aa, Entamoeba histolytica
LKSSSDHEMGSAATGASKSGTCTGENGY

SEQ ID NO: 2736851 - protein, 6 aa, Entamoeba histolytica
LKTAPS

SEQ ID NO: 2736852 - protein, 5 aa, Entamoeba histolytica
LKTNP

SEQ ID NO: 2736853 - protein, 33 aa, Entamoeba histolytica
LKTYEKSYEIKTNKPERKQCIGEEEDSENSSNK

SEQ ID NO: 2736854 - protein, 8 aa, Entamoeba histolytica
LLESTNNQ

SEQ ID NO: 2736855 - protein, 19 aa, Entamoeba histolytica
LLKEETAKEEKGKKKGKKI

SEQ ID NO: 2736856 - protein, 10 aa, Entamoeba histolytica
LLNGDSEDIF

SEQ ID NO: 2736857 - protein, 9 aa, Entamoeba histolytica
LMNEKNQRI

SEQ ID NO: 2736858 - protein, 10 aa, Entamoeba histolytica
LMQGPSKSYN

SEQ ID NO: 2736859 - protein, 25 aa, Entamoeba histolytica
LMSKTPQKEISFDESNGQNKSDDQI

SEQ ID NO: 2736860 - protein, 10 aa, Entamoeba histolytica
LNAANTTDAQ

SEQ ID NO: 2736861 - protein, 4 aa, Entamoeba histolytica
LNAK

SEQ ID NO: 2736862 - protein, 5 aa, Entamoeba histolytica
LNERG

SEQ ID NO: 2736863 - protein, 7 aa, Entamoeba histolytica
LNGEGVT

SEQ ID NO: 2736864 - protein, 6 aa, Entamoeba histolytica
LNGTSS

SEQ ID NO: 2736865 - protein, 6 aa, Entamoeba histolytica
LNIDPS

SEQ ID NO: 2736866 - protein, 8 aa, Entamoeba histolytica
LNKAQSKI

SEQ ID NO: 2736867 - protein, 8 aa, Entamoeba histolytica
LNKGTNYT

SEQ ID NO: 2736868 - protein, 26 aa, Entamoeba histolytica
LNKKKSVKKINKKKTIKKYSKKRFTK

SEQ ID NO: 2736869 - protein, 9 aa, Entamoeba histolytica
LNKKNQCEK

SEQ ID NO: 2736870 - protein, 8 aa, Entamoeba histolytica
LNKTQKVD

SEQ ID NO: 2736871 - protein, 39 aa, Entamoeba histolytica
LNNEKKRQSLKKNAKKIAKKTSSTQEKQMKKIAKKILLK

SEQ ID NO: 2736872 - protein, 8 aa, Entamoeba histolytica
LNNSEFGE

SEQ ID NO: 2736873 - protein, 10 aa, Entamoeba histolytica
LNPCTTSDIP

SEQ ID NO: 2736874 - protein, 10 aa, Entamoeba histolytica
LNPKQPMGTN

SEQ ID NO: 2736875 - protein, 13 aa, Entamoeba histolytica
LNQSKTKKVSQEI

SEQ ID NO: 2736876 - protein, 8 aa, Entamoeba histolytica
LNRKLTKK

SEQ ID NO: 2736877 - protein, 5 aa, Entamoeba histolytica
LNSTY

SEQ ID NO: 2736878 - protein, 8 aa, Entamoeba histolytica
LNTKKNNY

SEQ ID NO: 2736879 - protein, 11 aa, Entamoeba histolytica
LNTNYSQSPTD

SEQ ID NO: 2736880 - protein, 31 aa, Entamoeba histolytica
LPDPSINTTNPNMTNGTNMTYPNQPLFTQNK

SEQ ID NO: 2736881 - protein, 20 aa, Entamoeba histolytica
LPEEEKNKKKKYCDSYGSPN

SEQ ID NO: 2736882 - protein, 6 aa, Entamoeba histolytica
LPETTR

SEQ ID NO: 2736883 - protein, 14 aa, Entamoeba histolytica
LPKGALVEVECIAT

SEQ ID NO: 2736884 - protein, 6 aa, Entamoeba histolytica
LPKKRR

SEQ ID NO: 2736885 - protein, 6 aa, Entamoeba histolytica
LPKTKD

SEQ ID NO: 2736886 - protein, 9 aa, Entamoeba histolytica
LPPCPNSEC

SEQ ID NO: 2736887 - protein, 6 aa, Entamoeba histolytica
LPPIIE

SEQ ID NO: 2736888 - protein, 18 aa, Entamoeba histolytica
LPPPPPPVTEVEEEEDIE

SEQ ID NO: 2736889 - protein, 6 aa, Entamoeba histolytica
LPPQCP

SEQ ID NO: 2736890 - protein, 5 aa, Entamoeba histolytica
LPSLK

SEQ ID NO: 2736891 - protein, 9 aa, Entamoeba histolytica
LPTDPESVV

SEQ ID NO: 2736892 - protein, 17 aa, Entamoeba histolytica
LQEAENAEKVAHDTASK

SEQ ID NO: 2736893 - protein, 5 aa, Entamoeba histolytica
LQGKL

SEQ ID NO: 2736894 - protein, 6 aa, Entamoeba histolytica
LQKTGG

SEQ ID NO: 2736895 - protein, 5 aa, Entamoeba histolytica
LQNDD

SEQ ID NO: 2736896 - protein, 6 aa, Entamoeba histolytica
LQNTHD

SEQ ID NO: 2736897 - protein, 16 aa, Entamoeba histolytica
LQPDIKSSNHSKQGEI

SEQ ID NO: 2736898 - protein, 6 aa, Entamoeba histolytica
LQPNNN

SEQ ID NO: 2736899 - protein, 14 aa, Entamoeba histolytica
LQTSSEDSELKDSS

SEQ ID NO: 2736900 - protein, 11 aa, Entamoeba histolytica
LREKQKKLEGF

SEQ ID NO: 2736901 - protein, 6 aa, Entamoeba histolytica
LRPSEL

SEQ ID NO: 2736902 - protein, 10 aa, Entamoeba histolytica
LRSSAKNSMN

SEQ ID NO: 2736903 - protein, 13 aa, Entamoeba histolytica
LRTKAQKERFERI

SEQ ID NO: 2736904 - protein, 7 aa, Entamoeba histolytica
LSDEESK

SEQ ID NO: 2736905 - protein, 12 aa, Entamoeba histolytica
LSDIRKKGKKFA

SEQ ID NO: 2736906 - protein, 5 aa, Entamoeba histolytica
LSEGI

SEQ ID NO: 2736907 - protein, 14 aa, Entamoeba histolytica
LSEGKTESIGNNDN

SEQ ID NO: 2736908 - protein, 4 aa, Entamoeba histolytica
LSEQ

SEQ ID NO: 2736909 - protein, 15 aa, Entamoeba histolytica
LSFTEDKDHGFVNIS

SEQ ID NO: 2736910 - protein, 4 aa, Entamoeba histolytica
LSKE

SEQ ID NO: 2736911 - protein, 39 aa, Entamoeba histolytica
LSKKAVKAAKKLNGKKLANKDSVKKVAKKQTKKQAKKVV

SEQ ID NO: 2736912 - protein, 13 aa, Entamoeba histolytica
LSKRTKREQRDSL

SEQ ID NO: 2736913 - protein, 5 aa, Entamoeba histolytica
LSKTN

SEQ ID NO: 2736914 - protein, 5 aa, Entamoeba histolytica
LSNNK

SEQ ID NO: 2736915 - protein, 7 aa, Entamoeba histolytica
LSNTNSE

SEQ ID NO: 2736916 - protein, 5 aa, Entamoeba histolytica
LSPKE

SEQ ID NO: 2736917 - protein, 11 aa, Entamoeba histolytica
LSPKLDKAATK

SEQ ID NO: 2736918 - protein, 13 aa, Entamoeba histolytica
LSQNQITELKKIL

SEQ ID NO: 2736919 - protein, 4 aa, Entamoeba histolytica
LSTE

SEQ ID NO: 2736920 - protein, 7 aa, Entamoeba histolytica
LSTEKGQ

SEQ ID NO: 2736921 - protein, 13 aa, Entamoeba histolytica
LSTPTKNGQIDTD

SEQ ID NO: 2736922 - protein, 6 aa, Entamoeba histolytica
LSTQNE

SEQ ID NO: 2736923 - protein, 29 aa, Entamoeba histolytica
LSYNPSDKFSVDGKVGYSYANGHGSSNYG

SEQ ID NO: 2736924 - protein, 12 aa, Entamoeba histolytica
LTANGYSTPSTE

SEQ ID NO: 2736925 - protein, 8 aa, Entamoeba histolytica
LTDKKNAA

SEQ ID NO: 2736926 - protein, 10 aa, Entamoeba histolytica
LTDTEKEDLQ

SEQ ID NO: 2736927 - protein, 7 aa, Entamoeba histolytica
LTEEGRK

SEQ ID NO: 2736928 - protein, 5 aa, Entamoeba histolytica
LTETQ

SEQ ID NO: 2736929 - protein, 5 aa, Entamoeba histolytica
LTETT

SEQ ID NO: 2736930 - protein, 4 aa, Entamoeba histolytica
LTGI

SEQ ID NO: 2736931 - protein, 4 aa, Entamoeba histolytica
LTGQ

SEQ ID NO: 2736932 - protein, 4 aa, Entamoeba histolytica
LTKE

SEQ ID NO: 2736933 - protein, 9 aa, Entamoeba histolytica
LTKKFGKKK

SEQ ID NO: 2736934 - protein, 12 aa, Entamoeba histolytica
LTNEENKEPENS

SEQ ID NO: 2736935 - protein, 4 aa, Entamoeba histolytica
LTNQ

SEQ ID NO: 2736936 - protein, 4 aa, Entamoeba histolytica
LTNV

SEQ ID NO: 2736937 - protein, 50 aa, Entamoeba histolytica
LTPAQQESLKKTKKVVQEAQKEIKKSDEEQKQLNKVKEAKKKIQKQKDEL

SEQ ID NO: 2736938 - protein, 8 aa, Entamoeba histolytica
LTPNQRVE

SEQ ID NO: 2736939 - protein, 5 aa, Entamoeba histolytica
LTPPR

SEQ ID NO: 2736940 - protein, 13 aa, Entamoeba histolytica
LTQSTDDKQQPTY

SEQ ID NO: 2736941 - protein, 10 aa, Entamoeba histolytica
LTSAQAESMA

SEQ ID NO: 2736942 - protein, 44 aa, Entamoeba histolytica
LTTSITENGKEQKSNEAINNKEDKGEGNVKEKTNEGVSQPKSGG

SEQ ID NO: 2736943 - protein, 6 aa, Entamoeba histolytica
LVNEAK

SEQ ID NO: 2736944 - protein, 8 aa, Entamoeba histolytica
LVPKKGDK

SEQ ID NO: 2736945 - protein, 8 aa, Entamoeba histolytica
LVRPGSEK

SEQ ID NO: 2736946 - protein, 11 aa, Entamoeba histolytica
LVSNDGNLNRC

SEQ ID NO: 2736947 - protein, 17 aa, Entamoeba histolytica
LYGNAHSISPSSINTDT

SEQ ID NO: 2736948 - protein, 23 aa, Entamoeba histolytica
LYQQTNNAAGKNTKVNVDGTYRV

SEQ ID NO: 2736949 - protein, 7 aa, Entamoeba histolytica
MDSEGSY

SEQ ID NO: 2736950 - protein, 5 aa, Entamoeba histolytica
MEEEE

SEQ ID NO: 2736951 - protein, 7 aa, Entamoeba histolytica
MEEVAKE

SEQ ID NO: 2736952 - protein, 8 aa, Entamoeba histolytica
MENYEDKI

SEQ ID NO: 2736953 - protein, 11 aa, Entamoeba histolytica
MGSGQQAVTGL

SEQ ID NO: 2736954 - protein, 9 aa, Entamoeba histolytica
MGVDPSTGV

SEQ ID NO: 2736955 - protein, 32 aa, Entamoeba histolytica
MKAEKKAEKTVKKAEKEAKKVAESVKKEAKKL

SEQ ID NO: 2736956 - protein, 14 aa, Entamoeba histolytica
MKESDRQQSSLDEF

SEQ ID NO: 2736957 - protein, 17 aa, Entamoeba histolytica
MKYESAKKAGSSQIEQY

SEQ ID NO: 2736958 - protein, 10 aa, Entamoeba histolytica
MNEMPSEENT

SEQ ID NO: 2736959 - protein, 5 aa, Entamoeba histolytica
MNETI

SEQ ID NO: 2736960 - protein, 7 aa, Entamoeba histolytica
MNQGECG

SEQ ID NO: 2736961 - protein, 25 aa, Entamoeba histolytica
MQKRREDIADDDGDDDFEDDSDEWD

SEQ ID NO: 2736962 - protein, 11 aa, Entamoeba histolytica
MQNATKQHLPK

SEQ ID NO: 2736963 - protein, 15 aa, Entamoeba histolytica
MQTRENEQQAQQLSG

SEQ ID NO: 2736964 - protein, 9 aa, Entamoeba histolytica
MRKNPKEIE

SEQ ID NO: 2736965 - protein, 9 aa, Entamoeba histolytica
MRQKQRSQL

SEQ ID NO: 2736966 - protein, 10 aa, Entamoeba histolytica
MRTNTSEKLK

SEQ ID NO: 2736967 - protein, 4 aa, Entamoeba histolytica
MRYG

SEQ ID NO: 2736968 - protein, 8 aa, Entamoeba histolytica
MSKESQKL

SEQ ID NO: 2736969 - protein, 19 aa, Entamoeba histolytica
MSKKESQYRESINNAKRLT

SEQ ID NO: 2736970 - protein, 9 aa, Entamoeba histolytica
MSPPGTYKG

SEQ ID NO: 2736971 - protein, 19 aa, Entamoeba histolytica
MSSKKAVKKAVKKALKAAL

SEQ ID NO: 2736972 - protein, 10 aa, Entamoeba histolytica
MTKEELGKNL

SEQ ID NO: 2736973 - protein, 20 aa, Entamoeba histolytica
MTPDEVRNNIKSNLRGELTI

SEQ ID NO: 2736974 - protein, 5 aa, Entamoeba histolytica
MTSPV

SEQ ID NO: 2736975 - protein, 5 aa, Entamoeba histolytica
MYGGS

SEQ ID NO: 2736976 - protein, 46 aa, Entamoeba histolytica
NAAEKKMRDEIKEAEKQKEEEAKKEAEKQKEEETKEEIKKEENKEE

SEQ ID NO: 2736977 - protein, 8 aa, Entamoeba histolytica
NADRQKEC

SEQ ID NO: 2736978 - protein, 4 aa, Entamoeba histolytica
NAEH

SEQ ID NO: 2736979 - protein, 4 aa, Entamoeba histolytica
NAEY

SEQ ID NO: 2736980 - protein, 14 aa, Entamoeba histolytica
NAFNSAKKLKNNSL

SEQ ID NO: 2736981 - protein, 9 aa, Entamoeba histolytica
NAGKDTNGS

SEQ ID NO: 2736982 - protein, 8 aa, Entamoeba histolytica
NAGSSQDA

SEQ ID NO: 2736983 - protein, 5 aa, Entamoeba histolytica
NAGSV

SEQ ID NO: 2736984 - protein, 8 aa, Entamoeba histolytica
NAHAGGMS

SEQ ID NO: 2736985 - protein, 14 aa, Entamoeba histolytica
NAHSGNAALKASLS

SEQ ID NO: 2736986 - protein, 5 aa, Entamoeba histolytica
NAIKQ

SEQ ID NO: 2736987 - protein, 13 aa, Entamoeba histolytica
NAKEPRQIFIPVF

SEQ ID NO: 2736988 - protein, 9 aa, Entamoeba histolytica
NAKKEIETN

SEQ ID NO: 2736989 - protein, 7 aa, Entamoeba histolytica
NAKKGND

SEQ ID NO: 2736990 - protein, 13 aa, Entamoeba histolytica
NAKQTLQNKLIDQ

SEQ ID NO: 2736991 - protein, 12 aa, Entamoeba histolytica
NALPEAKTEISE

SEQ ID NO: 2736992 - protein, 14 aa, Entamoeba histolytica
NALPSAKSEIAEKM

SEQ ID NO: 2736993 - protein, 7 aa, Entamoeba histolytica
NAPDGGE

SEQ ID NO: 2736994 - protein, 6 aa, Entamoeba histolytica
NASDAI

SEQ ID NO: 2736995 - protein, 5 aa, Entamoeba histolytica
NATEC

SEQ ID NO: 2736996 - protein, 18 aa, Entamoeba histolytica
NATIKSNTNIYKRNEKEW

SEQ ID NO: 2736997 - protein, 10 aa, Entamoeba histolytica
NCEEQNTYGC

SEQ ID NO: 2736998 - protein, 17 aa, Entamoeba histolytica
NCEESKEICEKEGIEGY

SEQ ID NO: 2736999 - protein, 5 aa, Entamoeba histolytica
NCEGL

SEQ ID NO: 2737000 - protein, 8 aa, Entamoeba histolytica
NCKKSERN

SEQ ID NO: 2737001 - protein, 12 aa, Entamoeba histolytica
NCPNGCDTCSSS

SEQ ID NO: 2737002 - protein, 8 aa, Entamoeba histolytica
NCPSSKTA

SEQ ID NO: 2737003 - protein, 7 aa, Entamoeba histolytica
NCQNDPN

SEQ ID NO: 2737004 - protein, 39 aa, Entamoeba histolytica
NCSTIENNSTKESKEFIQNKNTKTHKTSFKEKRKDNQTI

SEQ ID NO: 2737005 - protein, 7 aa, Entamoeba histolytica
NCTTDSI

SEQ ID NO: 2737006 - protein, 12 aa, Entamoeba histolytica
NDATNTSKPIPV

SEQ ID NO: 2737007 - protein, 19 aa, Entamoeba histolytica
NDDHDQQKPGSSSRDMHDQ

SEQ ID NO: 2737008 - protein, 10 aa, Entamoeba histolytica
NDDPKPMSHT

SEQ ID NO: 2737009 - protein, 14 aa, Entamoeba histolytica
NDFTKNTKKWAKEK

SEQ ID NO: 2737010 - protein, 4 aa, Entamoeba histolytica
NDID

SEQ ID NO: 2737011 - protein, 7 aa, Entamoeba histolytica
NDISPSY

SEQ ID NO: 2737012 - protein, 10 aa, Entamoeba histolytica
NDKINNTKYY

SEQ ID NO: 2737013 - protein, 6 aa, Entamoeba histolytica
NDKTET

SEQ ID NO: 2737014 - protein, 9 aa, Entamoeba histolytica
NDKYNVEDN

SEQ ID NO: 2737015 - protein, 6 aa, Entamoeba histolytica
NDLRDT

SEQ ID NO: 2737016 - protein, 7 aa, Entamoeba histolytica
NDNDSVV

SEQ ID NO: 2737017 - protein, 8 aa, Entamoeba histolytica
NDNLPKYS

SEQ ID NO: 2737018 - protein, 4 aa, Entamoeba histolytica
NDNN

SEQ ID NO: 2737019 - protein, 5 aa, Entamoeba histolytica
NDNQD

SEQ ID NO: 2737020 - protein, 6 aa, Entamoeba histolytica
NDPRYE

SEQ ID NO: 2737021 - protein, 9 aa, Entamoeba histolytica
NDPSGNSGY

SEQ ID NO: 2737022 - protein, 8 aa, Entamoeba histolytica
NDRHGSQV

SEQ ID NO: 2737023 - protein, 4 aa, Entamoeba histolytica
NDST

SEQ ID NO: 2737024 - protein, 6 aa, Entamoeba histolytica
NDTTAT

SEQ ID NO: 2737025 - protein, 20 aa, Entamoeba histolytica
NDTVYGPSIANTARGVRGSH

SEQ ID NO: 2737026 - protein, 6 aa, Entamoeba histolytica
NDYTSY

SEQ ID NO: 2737027 - protein, 10 aa, Entamoeba histolytica
NEAEKTVQKG

SEQ ID NO: 2737028 - protein, 15 aa, Entamoeba histolytica
NEAGNLAGKVAGKFG

SEQ ID NO: 2737029 - protein, 10 aa, Entamoeba histolytica
NEAKKNQRKW

SEQ ID NO: 2737030 - protein, 13 aa, Entamoeba histolytica
NEAQSQQLKGETT

SEQ ID NO: 2737031 - protein, 184 aa, Entamoeba histolytica
NEASPEKLEEAEEKEKSSSAKPESSSNEDNEDDEDEKASSSDNSESSSSDKPDNKPEASSSDKPEASSSDKPDNKPEASSSDKPDNKPEASSSDKPDNKPEASSSDKPDNKPEASSSDKPDNKPEASSTNKPEASSTNKPEASSTNKPEASSTNKPEASSTSNSNDKSGSSSDNDNNNLDAASS

SEQ ID NO: 2737032 - protein, 14 aa, Entamoeba histolytica
NECNETEEYKQVTS

SEQ ID NO: 2737033 - protein, 5 aa, Entamoeba histolytica
NECSE

SEQ ID NO: 2737034 - protein, 34 aa, Entamoeba histolytica
NEDNYDEENEFDDSEDFDSNGIEQNEDIHKNKEE

SEQ ID NO: 2737035 - protein, 6 aa, Entamoeba histolytica
NEDRII

SEQ ID NO: 2737036 - protein, 10 aa, Entamoeba histolytica
NEEGQVDRKR

SEQ ID NO: 2737037 - protein, 4 aa, Entamoeba histolytica
NEEI

SEQ ID NO: 2737038 - protein, 4 aa, Entamoeba histolytica
NEEL

SEQ ID NO: 2737039 - protein, 11 aa, Entamoeba histolytica
NEESKVRSGLE

SEQ ID NO: 2737040 - protein, 9 aa, Entamoeba histolytica
NEESPEKIA

SEQ ID NO: 2737041 - protein, 8 aa, Entamoeba histolytica
NEEVKGEI

SEQ ID NO: 2737042 - protein, 4 aa, Entamoeba histolytica
NEEY

SEQ ID NO: 2737043 - protein, 4 aa, Entamoeba histolytica
NEGP

SEQ ID NO: 2737044 - protein, 4 aa, Entamoeba histolytica
NEGV

SEQ ID NO: 2737045 - protein, 22 aa, Entamoeba histolytica
NEHSTLSSSGSVKSTPDGRSNT

SEQ ID NO: 2737046 - protein, 4 aa, Entamoeba histolytica
NEHY

SEQ ID NO: 2737047 - protein, 13 aa, Entamoeba histolytica
NEIDSDQAKLNEL

SEQ ID NO: 2737048 - protein, 38 aa, Entamoeba histolytica
NEIEEIENDNDAFSDINNEEYELEEDDDQIPMQFHPVK

SEQ ID NO: 2737049 - protein, 7 aa, Entamoeba histolytica
NEIENER

SEQ ID NO: 2737050 - protein, 12 aa, Entamoeba histolytica
NEIKHQKSKRHH

SEQ ID NO: 2737051 - protein, 9 aa, Entamoeba histolytica
NEIQERKGQ

SEQ ID NO: 2737052 - protein, 10 aa, Entamoeba histolytica
NEITPTTEEM

SEQ ID NO: 2737053 - protein, 5 aa, Entamoeba histolytica
NEKER

SEQ ID NO: 2737054 - protein, 8 aa, Entamoeba histolytica
NEKPVEYT

SEQ ID NO: 2737055 - protein, 6 aa, Entamoeba histolytica
NEKTIQ

SEQ ID NO: 2737056 - protein, 13 aa, Entamoeba histolytica
NEKTQLKNGSRSV

SEQ ID NO: 2737057 - protein, 17 aa, Entamoeba histolytica
NELEKQRKLRKKYSKPK

SEQ ID NO: 2737058 - protein, 9 aa, Entamoeba histolytica
NENEFDNNT

SEQ ID NO: 2737059 - protein, 7 aa, Entamoeba histolytica
NENNTSK

SEQ ID NO: 2737060 - protein, 6 aa, Entamoeba histolytica
NEPTEF

SEQ ID NO: 2737061 - protein, 5 aa, Entamoeba histolytica
NEQHS

SEQ ID NO: 2737062 - protein, 4 aa, Entamoeba histolytica
NEQQ

SEQ ID NO: 2737063 - protein, 4 aa, Entamoeba histolytica
NEQY

SEQ ID NO: 2737064 - protein, 15 aa, Entamoeba histolytica
NERGPQPPPKVQPKI

SEQ ID NO: 2737065 - protein, 8 aa, Entamoeba histolytica
NESDRTNQ

SEQ ID NO: 2737066 - protein, 8 aa, Entamoeba histolytica
NESIKKYG

SEQ ID NO: 2737067 - protein, 7 aa, Entamoeba histolytica
NESNNQK

SEQ ID NO: 2737068 - protein, 8 aa, Entamoeba histolytica
NESNTTRL

SEQ ID NO: 2737069 - protein, 5 aa, Entamoeba histolytica
NETAN

SEQ ID NO: 2737070 - protein, 16 aa, Entamoeba histolytica
NETECSKCGNKYTLTS

SEQ ID NO: 2737071 - protein, 5 aa, Entamoeba histolytica
NETKV

SEQ ID NO: 2737072 - protein, 6 aa, Entamoeba histolytica
NETTIG

SEQ ID NO: 2737073 - protein, 4 aa, Entamoeba histolytica
NEYA

SEQ ID NO: 2737074 - protein, 5 aa, Entamoeba histolytica
NEYEK

SEQ ID NO: 2737075 - protein, 6 aa, Entamoeba histolytica
NFDSPD

SEQ ID NO: 2737076 - protein, 6 aa, Entamoeba histolytica
NFPSTK

SEQ ID NO: 2737077 - protein, 16 aa, Entamoeba histolytica
NFQTEVQTTTNEPTIK

SEQ ID NO: 2737078 - protein, 4 aa, Entamoeba histolytica
NGAY

SEQ ID NO: 2737079 - protein, 9 aa, Entamoeba histolytica
NGCEGGSME

SEQ ID NO: 2737080 - protein, 6 aa, Entamoeba histolytica
NGDGID

SEQ ID NO: 2737081 - protein, 4 aa, Entamoeba histolytica
NGDM

SEQ ID NO: 2737082 - protein, 16 aa, Entamoeba histolytica
NGEEDNEKKNQLYDTN

SEQ ID NO: 2737083 - protein, 6 aa, Entamoeba histolytica
NGGKDW

SEQ ID NO: 2737084 - protein, 10 aa, Entamoeba histolytica
NGHGKTETVT

SEQ ID NO: 2737085 - protein, 8 aa, Entamoeba histolytica
NGIDSDTP

SEQ ID NO: 2737086 - protein, 6 aa, Entamoeba histolytica
NGIGDH

SEQ ID NO: 2737087 - protein, 7 aa, Entamoeba histolytica
NGIRQRK

SEQ ID NO: 2737088 - protein, 4 aa, Entamoeba histolytica
NGKA

SEQ ID NO: 2737089 - protein, 9 aa, Entamoeba histolytica
NGKYSQTRE

SEQ ID NO: 2737090 - protein, 12 aa, Entamoeba histolytica
NGLGLESDYPYK

SEQ ID NO: 2737091 - protein, 11 aa, Entamoeba histolytica
NGLRPNATCSL

SEQ ID NO: 2737092 - protein, 9 aa, Entamoeba histolytica
NGMKKTITE

SEQ ID NO: 2737093 - protein, 4 aa, Entamoeba histolytica
NGNF

SEQ ID NO: 2737094 - protein, 24 aa, Entamoeba histolytica
NGNKNCRTSVNSSTPSKIDYNQKG

SEQ ID NO: 2737095 - protein, 6 aa, Entamoeba histolytica
NGNKYS

SEQ ID NO: 2737096 - protein, 4 aa, Entamoeba histolytica
NGNN

SEQ ID NO: 2737097 - protein, 5 aa, Entamoeba histolytica
NGPNW

SEQ ID NO: 2737098 - protein, 10 aa, Entamoeba histolytica
NGRKGGKVND

SEQ ID NO: 2737099 - protein, 10 aa, Entamoeba histolytica
NGRTSYPLNQ

SEQ ID NO: 2737100 - protein, 4 aa, Entamoeba histolytica
NGSC

SEQ ID NO: 2737101 - protein, 7 aa, Entamoeba histolytica
NGSGNVK

SEQ ID NO: 2737102 - protein, 8 aa, Entamoeba histolytica
NGTCERYS

SEQ ID NO: 2737103 - protein, 11 aa, Entamoeba histolytica
NGTKYNATATK

SEQ ID NO: 2737104 - protein, 4 aa, Entamoeba histolytica
NGTW

SEQ ID NO: 2737105 - protein, 13 aa, Entamoeba histolytica
NGVKADGATSYKK

SEQ ID NO: 2737106 - protein, 6 aa, Entamoeba histolytica
NGYDPK

SEQ ID NO: 2737107 - protein, 18 aa, Entamoeba histolytica
NGYGKSAFTPSITGPLIT

SEQ ID NO: 2737108 - protein, 4 aa, Entamoeba histolytica
NGYT

SEQ ID NO: 2737109 - protein, 4 aa, Entamoeba histolytica
NHHE

SEQ ID NO: 2737110 - protein, 5 aa, Entamoeba histolytica
NHNIS

SEQ ID NO: 2737111 - protein, 11 aa, Entamoeba histolytica
NHPDSDSISSN

SEQ ID NO: 2737112 - protein, 15 aa, Entamoeba histolytica
NHQRSYELTYFLQLI

SEQ ID NO: 2737113 - protein, 10 aa, Entamoeba histolytica
NHSTYENQGP

SEQ ID NO: 2737114 - protein, 6 aa, Entamoeba histolytica
NIDENG

SEQ ID NO: 2737115 - protein, 7 aa, Entamoeba histolytica
NIEGEKR

SEQ ID NO: 2737116 - protein, 12 aa, Entamoeba histolytica
NIENKENITTEV

SEQ ID NO: 2737117 - protein, 8 aa, Entamoeba histolytica
NIKKDSKT

SEQ ID NO: 2737118 - protein, 20 aa, Entamoeba histolytica
NIKKEEEKSSQELKEENQRL

SEQ ID NO: 2737119 - protein, 11 aa, Entamoeba histolytica
NIKKSTEKNIK

SEQ ID NO: 2737120 - protein, 8 aa, Entamoeba histolytica
NINTNDGT

SEQ ID NO: 2737121 - protein, 12 aa, Entamoeba histolytica
NIRDSMANQRAQ

SEQ ID NO: 2737122 - protein, 7 aa, Entamoeba histolytica
NITNGSK

SEQ ID NO: 2737123 - protein, 13 aa, Entamoeba histolytica
NITSTGAAVTTAE

SEQ ID NO: 2737124 - protein, 13 aa, Entamoeba histolytica
NKAKDGNKDKTLT

SEQ ID NO: 2737125 - protein, 18 aa, Entamoeba histolytica
NKANDKIDYYQKKGNEFL

SEQ ID NO: 2737126 - protein, 4 aa, Entamoeba histolytica
NKCS

SEQ ID NO: 2737127 - protein, 12 aa, Entamoeba histolytica
NKCSKGSETSSK

SEQ ID NO: 2737128 - protein, 7 aa, Entamoeba histolytica
NKCVKNT

SEQ ID NO: 2737129 - protein, 9 aa, Entamoeba histolytica
NKDNEQVKK

SEQ ID NO: 2737130 - protein, 8 aa, Entamoeba histolytica
NKEGSFEY

SEQ ID NO: 2737131 - protein, 38 aa, Entamoeba histolytica
NKEKKELNVTKPGKKEQNKKEVKTNKKQNKKVPTNEHK

SEQ ID NO: 2737132 - protein, 6 aa, Entamoeba histolytica
NKERNM

SEQ ID NO: 2737133 - protein, 7 aa, Entamoeba histolytica
NKESNMT

SEQ ID NO: 2737134 - protein, 4 aa, Entamoeba histolytica
NKET

SEQ ID NO: 2737135 - protein, 9 aa, Entamoeba histolytica
NKETENAKR

SEQ ID NO: 2737136 - protein, 5 aa, Entamoeba histolytica
NKETS

SEQ ID NO: 2737137 - protein, 8 aa, Entamoeba histolytica
NKEVENDM

SEQ ID NO: 2737138 - protein, 5 aa, Entamoeba histolytica
NKFNR

SEQ ID NO: 2737139 - protein, 4 aa, Entamoeba histolytica
NKGI

SEQ ID NO: 2737140 - protein, 7 aa, Entamoeba histolytica
NKGKNTI

SEQ ID NO: 2737141 - protein, 8 aa, Entamoeba histolytica
NKGLDPTK

SEQ ID NO: 2737142 - protein, 9 aa, Entamoeba histolytica
NKGSTNGIE

SEQ ID NO: 2737143 - protein, 4 aa, Entamoeba histolytica
NKHY

SEQ ID NO: 2737144 - protein, 8 aa, Entamoeba histolytica
NKIDITQN

SEQ ID NO: 2737145 - protein, 7 aa, Entamoeba histolytica
NKIDKTK

SEQ ID NO: 2737146 - protein, 6 aa, Entamoeba histolytica
NKIPSK

SEQ ID NO: 2737147 - protein, 8 aa, Entamoeba histolytica
NKKDEPPI

SEQ ID NO: 2737148 - protein, 10 aa, Entamoeba histolytica
NKKKEELRKK

SEQ ID NO: 2737149 - protein, 5 aa, Entamoeba histolytica
NKKRL

SEQ ID NO: 2737150 - protein, 4 aa, Entamoeba histolytica
NKKT

SEQ ID NO: 2737151 - protein, 10 aa, Entamoeba histolytica
NKKYSPEEQA

SEQ ID NO: 2737152 - protein, 4 aa, Entamoeba histolytica
NKLT

SEQ ID NO: 2737153 - protein, 5 aa, Entamoeba histolytica
NKNDR

SEQ ID NO: 2737154 - protein, 8 aa, Entamoeba histolytica
NKNNQCGI

SEQ ID NO: 2737155 - protein, 20 aa, Entamoeba histolytica
NKNNQCGIASGAAYPVGVAD

SEQ ID NO: 2737156 - protein, 6 aa, Entamoeba histolytica
NKPAYF

SEQ ID NO: 2737157 - protein, 9 aa, Entamoeba histolytica
NKPPTCSSR

SEQ ID NO: 2737158 - protein, 5 aa, Entamoeba histolytica
NKQPV

SEQ ID NO: 2737159 - protein, 7 aa, Entamoeba histolytica
NKRAIEK

SEQ ID NO: 2737160 - protein, 59 aa, Entamoeba histolytica
NKRLKSKKSNLQNTKSKKLSSPKRNTKPKRNTKPKRNTKPRHSPKRRQTNKQSNSQKKK

SEQ ID NO: 2737161 - protein, 9 aa, Entamoeba histolytica
NKSAASKQK

SEQ ID NO: 2737162 - protein, 12 aa, Entamoeba histolytica
NKTGELENLINQ

SEQ ID NO: 2737163 - protein, 9 aa, Entamoeba histolytica
NKTKQMKNY

SEQ ID NO: 2737164 - protein, 112 aa, Entamoeba histolytica
NKTMNQENSSDNQPNEKPNDQPDEKQNDKSEGTKNTESSSNNNSQTEDTSKHNSEGSKSKDDDSKNQTDEKSMNHSEDGTKGHSENSFNAQSDGNSKSDSEDASTHNIDSAP

SEQ ID NO: 2737165 - protein, 8 aa, Entamoeba histolytica
NKVEKEIK

SEQ ID NO: 2737166 - protein, 22 aa, Entamoeba histolytica
NKVSHTASSKATVIDKKNNPFA

SEQ ID NO: 2737167 - protein, 6 aa, Entamoeba histolytica
NKWKEQ

SEQ ID NO: 2737168 - protein, 42 aa, Entamoeba histolytica
NKYGQKSNGLNVKADYKSTNTTGNISAGFKNDEKGKSNYVSG

SEQ ID NO: 2737169 - protein, 10 aa, Entamoeba histolytica
NKYGQKTKNF

SEQ ID NO: 2737170 - protein, 9 aa, Entamoeba histolytica
NLDDAKRTL

SEQ ID NO: 2737171 - protein, 5 aa, Entamoeba histolytica
NLLRN

SEQ ID NO: 2737172 - protein, 6 aa, Entamoeba histolytica
NLNNPR

SEQ ID NO: 2737173 - protein, 9 aa, Entamoeba histolytica
NLPNPASVS

SEQ ID NO: 2737174 - protein, 7 aa, Entamoeba histolytica
NLPSSNN

SEQ ID NO: 2737175 - protein, 8 aa, Entamoeba histolytica
NLSGSIPN

SEQ ID NO: 2737176 - protein, 12 aa, Entamoeba histolytica
NLSTDETPVSIL

SEQ ID NO: 2737177 - protein, 6 aa, Entamoeba histolytica
NLTHST

SEQ ID NO: 2737178 - protein, 23 aa, Entamoeba histolytica
NLTLSANGKISNDYGKKTTDING

SEQ ID NO: 2737179 - protein, 9 aa, Entamoeba histolytica
NMKEQDNYR

SEQ ID NO: 2737180 - protein, 5 aa, Entamoeba histolytica
NMQEY

SEQ ID NO: 2737181 - protein, 14 aa, Entamoeba histolytica
NNAMTADNEKISEY

SEQ ID NO: 2737182 - protein, 17 aa, Entamoeba histolytica
NNATPTKEECDDKYKQL

SEQ ID NO: 2737183 - protein, 11 aa, Entamoeba histolytica
NNDTPTPKNIT

SEQ ID NO: 2737184 - protein, 6 aa, Entamoeba histolytica
NNEKDW

SEQ ID NO: 2737185 - protein, 5 aa, Entamoeba histolytica
NNFTC

SEQ ID NO: 2737186 - protein, 7 aa, Entamoeba histolytica
NNGPQYY

SEQ ID NO: 2737187 - protein, 21 aa, Entamoeba histolytica
NNINKSKNNDFSQEVEEDIRV

SEQ ID NO: 2737188 - protein, 13 aa, Entamoeba histolytica
NNKCVKDKEECYY

SEQ ID NO: 2737189 - protein, 5 aa, Entamoeba histolytica
NNKEY

SEQ ID NO: 2737190 - protein, 8 aa, Entamoeba histolytica
NNKLTGSL

SEQ ID NO: 2737191 - protein, 5 aa, Entamoeba histolytica
NNKPF

SEQ ID NO: 2737192 - protein, 10 aa, Entamoeba histolytica
NNKSKENTKK

SEQ ID NO: 2737193 - protein, 9 aa, Entamoeba histolytica
NNKTQTMEN

SEQ ID NO: 2737194 - protein, 7 aa, Entamoeba histolytica
NNMKETS

SEQ ID NO: 2737195 - protein, 10 aa, Entamoeba histolytica
NNNKECETYT

SEQ ID NO: 2737196 - protein, 6 aa, Entamoeba histolytica
NNPTEQ

SEQ ID NO: 2737197 - protein, 6 aa, Entamoeba histolytica
NNPTET

SEQ ID NO: 2737198 - protein, 13 aa, Entamoeba histolytica
NNQCDETGKEFGE

SEQ ID NO: 2737199 - protein, 5 aa, Entamoeba histolytica
NNQKE

SEQ ID NO: 2737200 - protein, 8 aa, Entamoeba histolytica
NNQRASNV

SEQ ID NO: 2737201 - protein, 7 aa, Entamoeba histolytica
NNQRKDQ

SEQ ID NO: 2737202 - protein, 9 aa, Entamoeba histolytica
NNRSKQAQR

SEQ ID NO: 2737203 - protein, 8 aa, Entamoeba histolytica
NNSEGTND

SEQ ID NO: 2737204 - protein, 8 aa, Entamoeba histolytica
NNSLSGSL

SEQ ID NO: 2737205 - protein, 4 aa, Entamoeba histolytica
NNST

SEQ ID NO: 2737206 - protein, 9 aa, Entamoeba histolytica
NNTKSIGHI

SEQ ID NO: 2737207 - protein, 6 aa, Entamoeba histolytica
NNTNEE

SEQ ID NO: 2737208 - protein, 6 aa, Entamoeba histolytica
NNTNSI

SEQ ID NO: 2737209 - protein, 10 aa, Entamoeba histolytica
NNTNSKEVNE

SEQ ID NO: 2737210 - protein, 6 aa, Entamoeba histolytica
NNWEPN

SEQ ID NO: 2737211 - protein, 4 aa, Entamoeba histolytica
NNWS

SEQ ID NO: 2737212 - protein, 15 aa, Entamoeba histolytica
NPAGKEAGEASPPWG

SEQ ID NO: 2737213 - protein, 7 aa, Entamoeba histolytica
NPANEKT

SEQ ID NO: 2737214 - protein, 8 aa, Entamoeba histolytica
NPASSLDN

SEQ ID NO: 2737215 - protein, 14 aa, Entamoeba histolytica
NPASSLDNNRYYWK

SEQ ID NO: 2737216 - protein, 5 aa, Entamoeba histolytica
NPDNQ

SEQ ID NO: 2737217 - protein, 7 aa, Entamoeba histolytica
NPHQPYG

SEQ ID NO: 2737218 - protein, 16 aa, Entamoeba histolytica
NPKNNEGYNKENKIKG

SEQ ID NO: 2737219 - protein, 16 aa, Entamoeba histolytica
NPKNNGGYNKENKIKG

SEQ ID NO: 2737220 - protein, 17 aa, Entamoeba histolytica
NPKNNGGYNKENKRKGF

SEQ ID NO: 2737221 - protein, 7 aa, Entamoeba histolytica
NPLPKIQ

SEQ ID NO: 2737222 - protein, 13 aa, Entamoeba histolytica
NPPLSDAPGTKNQ

SEQ ID NO: 2737223 - protein, 13 aa, Entamoeba histolytica
NPPLSDAPGTRNQ

SEQ ID NO: 2737224 - protein, 8 aa, Entamoeba histolytica
NPSNISSL

SEQ ID NO: 2737225 - protein, 23 aa, Entamoeba histolytica
NPSTFNQQEINEKDFSFNELFEK

SEQ ID NO: 2737226 - protein, 11 aa, Entamoeba histolytica
NPTAASEAKAH

SEQ ID NO: 2737227 - protein, 16 aa, Entamoeba histolytica
NPTDLKADPKSRPEDL

SEQ ID NO: 2737228 - protein, 5 aa, Entamoeba histolytica
NPTDT

SEQ ID NO: 2737229 - protein, 5 aa, Entamoeba histolytica
NPTLG

SEQ ID NO: 2737230 - protein, 4 aa, Entamoeba histolytica
NPTV

SEQ ID NO: 2737231 - protein, 4 aa, Entamoeba histolytica
NPVQ

SEQ ID NO: 2737232 - protein, 20 aa, Entamoeba histolytica
NQGNRSGETTKPVIIEDSGE

SEQ ID NO: 2737233 - protein, 6 aa, Entamoeba histolytica
NQKGNS

SEQ ID NO: 2737234 - protein, 7 aa, Entamoeba histolytica
NQKTQSI

SEQ ID NO: 2737235 - protein, 6 aa, Entamoeba histolytica
NQNTKF

SEQ ID NO: 2737236 - protein, 4 aa, Entamoeba histolytica
NQPN

SEQ ID NO: 2737237 - protein, 6 aa, Entamoeba histolytica
NQPRSM

SEQ ID NO: 2737238 - protein, 7 aa, Entamoeba histolytica
NQQITQD

SEQ ID NO: 2737239 - protein, 4 aa, Entamoeba histolytica
NQRR

SEQ ID NO: 2737240 - protein, 7 aa, Entamoeba histolytica
NQRSEAN

SEQ ID NO: 2737241 - protein, 11 aa, Entamoeba histolytica
NQRTKSQTTIT

SEQ ID NO: 2737242 - protein, 17 aa, Entamoeba histolytica
NQRTSYPFNGTLTKESV

SEQ ID NO: 2737243 - protein, 9 aa, Entamoeba histolytica
NQSNAINQN

SEQ ID NO: 2737244 - protein, 9 aa, Entamoeba histolytica
NQTNKLETI

SEQ ID NO: 2737245 - protein, 16 aa, Entamoeba histolytica
NRADDLRNRAEEISNS

SEQ ID NO: 2737246 - protein, 7 aa, Entamoeba histolytica
NREAERD

SEQ ID NO: 2737247 - protein, 6 aa, Entamoeba histolytica
NRERKI

SEQ ID NO: 2737248 - protein, 7 aa, Entamoeba histolytica
NRERKIE

SEQ ID NO: 2737249 - protein, 12 aa, Entamoeba histolytica
NRKESNKQEQKN

SEQ ID NO: 2737250 - protein, 7 aa, Entamoeba histolytica
NRNPEKI

SEQ ID NO: 2737251 - protein, 6 aa, Entamoeba histolytica
NRSEEV

SEQ ID NO: 2737252 - protein, 8 aa, Entamoeba histolytica
NRSSFDDN

SEQ ID NO: 2737253 - protein, 13 aa, Entamoeba histolytica
NRVTKTSANSLRG

SEQ ID NO: 2737254 - protein, 17 aa, Entamoeba histolytica
NRYKVTQQTYFTENPFC

SEQ ID NO: 2737255 - protein, 5 aa, Entamoeba histolytica
NSAQE

SEQ ID NO: 2737256 - protein, 16 aa, Entamoeba histolytica
NSATSDTLSNKDDYPN

SEQ ID NO: 2737257 - protein, 10 aa, Entamoeba histolytica
NSDPIDENKQ

SEQ ID NO: 2737258 - protein, 6 aa, Entamoeba histolytica
NSDPYL

SEQ ID NO: 2737259 - protein, 4 aa, Entamoeba histolytica
NSDR

SEQ ID NO: 2737260 - protein, 15 aa, Entamoeba histolytica
NSDTFTSDKIQEKTD

SEQ ID NO: 2737261 - protein, 4 aa, Entamoeba histolytica
NSEI

SEQ ID NO: 2737262 - protein, 11 aa, Entamoeba histolytica
NSEPITCSNSG

SEQ ID NO: 2737263 - protein, 4 aa, Entamoeba histolytica
NSET

SEQ ID NO: 2737264 - protein, 5 aa, Entamoeba histolytica
NSFSR

SEQ ID NO: 2737265 - protein, 6 aa, Entamoeba histolytica
NSGTYN

SEQ ID NO: 2737266 - protein, 10 aa, Entamoeba histolytica
NSIERDKEAL

SEQ ID NO: 2737267 - protein, 7 aa, Entamoeba histolytica
NSINTIK

SEQ ID NO: 2737268 - protein, 11 aa, Entamoeba histolytica
NSIPRKGQENF

SEQ ID NO: 2737269 - protein, 10 aa, Entamoeba histolytica
NSISEAEEIS

SEQ ID NO: 2737270 - protein, 4 aa, Entamoeba histolytica
NSKS

SEQ ID NO: 2737271 - protein, 6 aa, Entamoeba histolytica
NSNEQS

SEQ ID NO: 2737272 - protein, 14 aa, Entamoeba histolytica
NSNGINNKGQLQND

SEQ ID NO: 2737273 - protein, 7 aa, Entamoeba histolytica
NSNIKNA

SEQ ID NO: 2737274 - protein, 34 aa, Entamoeba histolytica
NSNNGQFGCNGNDISMKPSAEESRWQTPPRGSED

SEQ ID NO: 2737275 - protein, 10 aa, Entamoeba histolytica
NSNSKIGSQS

SEQ ID NO: 2737276 - protein, 9 aa, Entamoeba histolytica
NSNSNTVNI

SEQ ID NO: 2737277 - protein, 5 aa, Entamoeba histolytica
NSPFT

SEQ ID NO: 2737278 - protein, 6 aa, Entamoeba histolytica
NSQTSE

SEQ ID NO: 2737279 - protein, 6 aa, Entamoeba histolytica
NSQVPH

SEQ ID NO: 2737280 - protein, 6 aa, Entamoeba histolytica
NSRGAL

SEQ ID NO: 2737281 - protein, 9 aa, Entamoeba histolytica
NSSAHISTG

SEQ ID NO: 2737282 - protein, 12 aa, Entamoeba histolytica
NSSTSKMENIPG

SEQ ID NO: 2737283 - protein, 4 aa, Entamoeba histolytica
NSTE

SEQ ID NO: 2737284 - protein, 9 aa, Entamoeba histolytica
NSTEIAKEP

SEQ ID NO: 2737285 - protein, 10 aa, Entamoeba histolytica
NSTEIAKEPT

SEQ ID NO: 2737286 - protein, 24 aa, Entamoeba histolytica
NSTQKEVEHKKGKLQEEVNKMSKD

SEQ ID NO: 2737287 - protein, 9 aa, Entamoeba histolytica
NSTSGRMEN

SEQ ID NO: 2737288 - protein, 14 aa, Entamoeba histolytica
NSVTNNGKRDTGYG

SEQ ID NO: 2737289 - protein, 7 aa, Entamoeba histolytica
NSYNSFK

SEQ ID NO: 2737290 - protein, 10 aa, Entamoeba histolytica
NTAQQDNAIN

SEQ ID NO: 2737291 - protein, 22 aa, Entamoeba histolytica
NTCGTEEKDLKSTKLENKPENT

SEQ ID NO: 2737292 - protein, 12 aa, Entamoeba histolytica
NTCKESFKENFG

SEQ ID NO: 2737293 - protein, 18 aa, Entamoeba histolytica
NTCTERTGKENNKTTKME

SEQ ID NO: 2737294 - protein, 9 aa, Entamoeba histolytica
NTCTNSQCK

SEQ ID NO: 2737295 - protein, 10 aa, Entamoeba histolytica
NTDASKSNIK

SEQ ID NO: 2737296 - protein, 5 aa, Entamoeba histolytica
NTDVN

SEQ ID NO: 2737297 - protein, 10 aa, Entamoeba histolytica
NTECEDPTDC

SEQ ID NO: 2737298 - protein, 6 aa, Entamoeba histolytica
NTEGDS

SEQ ID NO: 2737299 - protein, 13 aa, Entamoeba histolytica
NTEQTCRKIGVCG

SEQ ID NO: 2737300 - protein, 6 aa, Entamoeba histolytica
NTGITQ

SEQ ID NO: 2737301 - protein, 14 aa, Entamoeba histolytica
NTIDKNASEDGAHA

SEQ ID NO: 2737302 - protein, 14 aa, Entamoeba histolytica
NTIEAQEGKVSEKK

SEQ ID NO: 2737303 - protein, 13 aa, Entamoeba histolytica
NTINNTNTYQNVE

SEQ ID NO: 2737304 - protein, 15 aa, Entamoeba histolytica
NTISENNNEIDKVTN

SEQ ID NO: 2737305 - protein, 7 aa, Entamoeba histolytica
NTKITGE

SEQ ID NO: 2737306 - protein, 10 aa, Entamoeba histolytica
NTKYSGSEAL

SEQ ID NO: 2737307 - protein, 8 aa, Entamoeba histolytica
NTLEKNPA

SEQ ID NO: 2737308 - protein, 6 aa, Entamoeba histolytica
NTNGNV

SEQ ID NO: 2737309 - protein, 15 aa, Entamoeba histolytica
NTNITDEEKYITEPK

SEQ ID NO: 2737310 - protein, 10 aa, Entamoeba histolytica
NTNKPSTSNS

SEQ ID NO: 2737311 - protein, 5 aa, Entamoeba histolytica
NTPIK

SEQ ID NO: 2737312 - protein, 15 aa, Entamoeba histolytica
NTPKIKKLSKTQNVW

SEQ ID NO: 2737313 - protein, 6 aa, Entamoeba histolytica
NTQNEK

SEQ ID NO: 2737314 - protein, 4 aa, Entamoeba histolytica
NTQQ

SEQ ID NO: 2737315 - protein, 10 aa, Entamoeba histolytica
NTTKKYGKNY

SEQ ID NO: 2737316 - protein, 9 aa, Entamoeba histolytica
NTVKTCTSQ

SEQ ID NO: 2737317 - protein, 18 aa, Entamoeba histolytica
NTVNDNEKLGGKIEEGDK

SEQ ID NO: 2737318 - protein, 6 aa, Entamoeba histolytica
NVDGRS

SEQ ID NO: 2737319 - protein, 6 aa, Entamoeba histolytica
NVFRTS

SEQ ID NO: 2737320 - protein, 16 aa, Entamoeba histolytica
NVNDLTKNSNEAKDKI

SEQ ID NO: 2737321 - protein, 33 aa, Entamoeba histolytica
NVNGGGYPSGSAGSSAATSVQPSAPVIQPSSSV

SEQ ID NO: 2737322 - protein, 17 aa, Entamoeba histolytica
NVYGGEGCSWDESCDDE

SEQ ID NO: 2737323 - protein, 5 aa, Entamoeba histolytica
NVYNG

SEQ ID NO: 2737324 - protein, 10 aa, Entamoeba histolytica
NVYPSIGTPF

SEQ ID NO: 2737325 - protein, 17 aa, Entamoeba histolytica
NYEPNGGRVTLDGKDIR

SEQ ID NO: 2737326 - protein, 4 aa, Entamoeba histolytica
NYKE

SEQ ID NO: 2737327 - protein, 36 aa, Entamoeba histolytica
NYKSKDGKFDGSLDAKRSKNSNGVSRSASATGTYKV

SEQ ID NO: 2737328 - protein, 19 aa, Entamoeba histolytica
NYKTNTQFTDEDDKKGDER

SEQ ID NO: 2737329 - protein, 5 aa, Entamoeba histolytica
NYMRE

SEQ ID NO: 2737330 - protein, 5 aa, Entamoeba histolytica
NYNDY

SEQ ID NO: 2737331 - protein, 6 aa, Entamoeba histolytica
NYPNDL

SEQ ID NO: 2737332 - protein, 8 aa, Entamoeba histolytica
NYPTPYSL

SEQ ID NO: 2737333 - protein, 6 aa, Entamoeba histolytica
NYQASS

SEQ ID NO: 2737334 - protein, 4 aa, Entamoeba histolytica
NYST

SEQ ID NO: 2737335 - protein, 7 aa, Entamoeba histolytica
NYTEEEM

SEQ ID NO: 2737336 - protein, 7 aa, Entamoeba histolytica
NYTNEEI

SEQ ID NO: 2737337 - protein, 14 aa, Entamoeba histolytica
NYVNTKYIKSLIEK

SEQ ID NO: 2737338 - protein, 11 aa, Entamoeba histolytica
PACTSRTNLDP

SEQ ID NO: 2737339 - protein, 10 aa, Entamoeba histolytica
PADDEVNGIE

SEQ ID NO: 2737340 - protein, 4 aa, Entamoeba histolytica
PAEY

SEQ ID NO: 2737341 - protein, 9 aa, Entamoeba histolytica
PAKDQGQCG

SEQ ID NO: 2737342 - protein, 14 aa, Entamoeba histolytica
PANEDQGGRPVDTQ

SEQ ID NO: 2737343 - protein, 10 aa, Entamoeba histolytica
PANETDEELP

SEQ ID NO: 2737344 - protein, 10 aa, Entamoeba histolytica
PANGNSDWCA

SEQ ID NO: 2737345 - protein, 11 aa, Entamoeba histolytica
PANSKRRKTCE

SEQ ID NO: 2737346 - protein, 7 aa, Entamoeba histolytica
PAPGNHD

SEQ ID NO: 2737347 - protein, 24 aa, Entamoeba histolytica
PAVDAGKQTGIEVSKNKAKAVNNL

SEQ ID NO: 2737348 - protein, 13 aa, Entamoeba histolytica
PCGETRYPSYPGA

SEQ ID NO: 2737349 - protein, 4 aa, Entamoeba histolytica
PCRG

SEQ ID NO: 2737350 - protein, 7 aa, Entamoeba histolytica
PCTFNPE

SEQ ID NO: 2737351 - protein, 7 aa, Entamoeba histolytica
PDCGDDG

SEQ ID NO: 2737352 - protein, 24 aa, Entamoeba histolytica
PDGDITADNVDTDKTYWANKYFTR

SEQ ID NO: 2737353 - protein, 4 aa, Entamoeba histolytica
PDLT

SEQ ID NO: 2737354 - protein, 13 aa, Entamoeba histolytica
PDNFKTYQNSGKT

SEQ ID NO: 2737355 - protein, 12 aa, Entamoeba histolytica
PDNNDNNHNGSD

SEQ ID NO: 2737356 - protein, 10 aa, Entamoeba histolytica
PDNQKLLQSK

SEQ ID NO: 2737357 - protein, 4 aa, Entamoeba histolytica
PDPS

SEQ ID NO: 2737358 - protein, 5 aa, Entamoeba histolytica
PDYRT

SEQ ID NO: 2737359 - protein, 10 aa, Entamoeba histolytica
PEARQKIRDV

SEQ ID NO: 2737360 - protein, 4 aa, Entamoeba histolytica
PEFA

SEQ ID NO: 2737361 - protein, 8 aa, Entamoeba histolytica
PEIGSDDD

SEQ ID NO: 2737362 - protein, 4 aa, Entamoeba histolytica
PEKQ

SEQ ID NO: 2737363 - protein, 5 aa, Entamoeba histolytica
PEKQT

SEQ ID NO: 2737364 - protein, 8 aa, Entamoeba histolytica
PELKDKTD

SEQ ID NO: 2737365 - protein, 6 aa, Entamoeba histolytica
PEPDKH

SEQ ID NO: 2737366 - protein, 6 aa, Entamoeba histolytica
PEPTQT

SEQ ID NO: 2737367 - protein, 12 aa, Entamoeba histolytica
PERGNEKCRCPS

SEQ ID NO: 2737368 - protein, 9 aa, Entamoeba histolytica
PESDDLFDN

SEQ ID NO: 2737369 - protein, 6 aa, Entamoeba histolytica
PESSYI

SEQ ID NO: 2737370 - protein, 7 aa, Entamoeba histolytica
PETKSSI

SEQ ID NO: 2737371 - protein, 7 aa, Entamoeba histolytica
PEVAEQF

SEQ ID NO: 2737372 - protein, 12 aa, Entamoeba histolytica
PEYNNRNKWPSY

SEQ ID NO: 2737373 - protein, 10 aa, Entamoeba histolytica
PGAGKGTQCA

SEQ ID NO: 2737374 - protein, 5 aa, Entamoeba histolytica
PGEDP

SEQ ID NO: 2737375 - protein, 4 aa, Entamoeba histolytica
PGFL

SEQ ID NO: 2737376 - protein, 5 aa, Entamoeba histolytica
PGHTA

SEQ ID NO: 2737377 - protein, 4 aa, Entamoeba histolytica
PGKE

SEQ ID NO: 2737378 - protein, 10 aa, Entamoeba histolytica
PGKTQEPSME

SEQ ID NO: 2737379 - protein, 61 aa, Entamoeba histolytica
PGLSTGSSSGSSSTSSIGTSISTSITGLGSTGSVGTSGSVGTSGSVGTSGSVGTSTSSVNV

SEQ ID NO: 2737380 - protein, 14 aa, Entamoeba histolytica
PGNQIEPKATKTGK

SEQ ID NO: 2737381 - protein, 9 aa, Entamoeba histolytica
PGSNEAEKA

SEQ ID NO: 2737382 - protein, 4 aa, Entamoeba histolytica
PGYQ

SEQ ID NO: 2737383 - protein, 5 aa, Entamoeba histolytica
PHAQF

SEQ ID NO: 2737384 - protein, 8 aa, Entamoeba histolytica
PHKKTEDT

SEQ ID NO: 2737385 - protein, 5 aa, Entamoeba histolytica
PIENT

SEQ ID NO: 2737386 - protein, 97 aa, Entamoeba histolytica
PIGYVSKKNNKKEVKNEPKKNVKTITKKDTKKETVKKEDIKKENLKKEVKKDLKKEVKKDLKKDVKKEIKKEIKKEIKKEEKKIPSNKQIKETQLES

SEQ ID NO: 2737387 - protein, 7 aa, Entamoeba histolytica
PIKPLGK

SEQ ID NO: 2737388 - protein, 8 aa, Entamoeba histolytica
PIKPPRLG

SEQ ID NO: 2737389 - protein, 7 aa, Entamoeba histolytica
PIKPQRL

SEQ ID NO: 2737390 - protein, 9 aa, Entamoeba histolytica
PIKSSGTRY

SEQ ID NO: 2737391 - protein, 14 aa, Entamoeba histolytica
PKDIQSLNSTQKAE

SEQ ID NO: 2737392 - protein, 7 aa, Entamoeba histolytica
PKDKDTQ

SEQ ID NO: 2737393 - protein, 10 aa, Entamoeba histolytica
PKDNNSNNSM

SEQ ID NO: 2737394 - protein, 7 aa, Entamoeba histolytica
PKGVEAN

SEQ ID NO: 2737395 - protein, 19 aa, Entamoeba histolytica
PKKDKLKPKTTIKQPSDGF

SEQ ID NO: 2737396 - protein, 4 aa, Entamoeba histolytica
PKKE

SEQ ID NO: 2737397 - protein, 10 aa, Entamoeba histolytica
PKLSAAKQEF

SEQ ID NO: 2737398 - protein, 9 aa, Entamoeba histolytica
PKLTGDDCG

SEQ ID NO: 2737399 - protein, 25 aa, Entamoeba histolytica
PKPKGDEPVIEDRPNGKKEVVSGDK

SEQ ID NO: 2737400 - protein, 7 aa, Entamoeba histolytica
PKQHKRM

SEQ ID NO: 2737401 - protein, 5 aa, Entamoeba histolytica
PKRKI

SEQ ID NO: 2737402 - protein, 11 aa, Entamoeba histolytica
PKRLKTNKKTV

SEQ ID NO: 2737403 - protein, 11 aa, Entamoeba histolytica
PKRSDSMGSIK

SEQ ID NO: 2737404 - protein, 15 aa, Entamoeba histolytica
PKSLNNQQQEAIEKL

SEQ ID NO: 2737405 - protein, 8 aa, Entamoeba histolytica
PKSSSFTV

SEQ ID NO: 2737406 - protein, 4 aa, Entamoeba histolytica
PKTT

SEQ ID NO: 2737407 - protein, 10 aa, Entamoeba histolytica
PKTTMATKPG

SEQ ID NO: 2737408 - protein, 7 aa, Entamoeba histolytica
PKVESQL

SEQ ID NO: 2737409 - protein, 7 aa, Entamoeba histolytica
PKVQTTG

SEQ ID NO: 2737410 - protein, 5 aa, Entamoeba histolytica
PLEGA

SEQ ID NO: 2737411 - protein, 5 aa, Entamoeba histolytica
PLKKS

SEQ ID NO: 2737412 - protein, 7 aa, Entamoeba histolytica
PLPPIDK

SEQ ID NO: 2737413 - protein, 5 aa, Entamoeba histolytica
PLSNR

SEQ ID NO: 2737414 - protein, 4 aa, Entamoeba histolytica
PLTD

SEQ ID NO: 2737415 - protein, 8 aa, Entamoeba histolytica
PNDQTTYS

SEQ ID NO: 2737416 - protein, 9 aa, Entamoeba histolytica
PNEKDEHSQ

SEQ ID NO: 2737417 - protein, 4 aa, Entamoeba histolytica
PNGN

SEQ ID NO: 2737418 - protein, 7 aa, Entamoeba histolytica
PNKLPSE

SEQ ID NO: 2737419 - protein, 9 aa, Entamoeba histolytica
PNMKTNTKY

SEQ ID NO: 2737420 - protein, 4 aa, Entamoeba histolytica
PNNA

SEQ ID NO: 2737421 - protein, 4 aa, Entamoeba histolytica
PNNL

SEQ ID NO: 2737422 - protein, 7 aa, Entamoeba histolytica
PNPSYGL

SEQ ID NO: 2737423 - protein, 8 aa, Entamoeba histolytica
PNQDGSFT

SEQ ID NO: 2737424 - protein, 5 aa, Entamoeba histolytica
PNQTI

SEQ ID NO: 2737425 - protein, 6 aa, Entamoeba histolytica
PNSQAI

SEQ ID NO: 2737426 - protein, 4 aa, Entamoeba histolytica
PNSS

SEQ ID NO: 2737427 - protein, 5 aa, Entamoeba histolytica
PPELT

SEQ ID NO: 2737428 - protein, 4 aa, Entamoeba histolytica
PPGT

SEQ ID NO: 2737429 - protein, 6 aa, Entamoeba histolytica
PPGVSS

SEQ ID NO: 2737430 - protein, 7 aa, Entamoeba histolytica
PPKYEAG

SEQ ID NO: 2737431 - protein, 5 aa, Entamoeba histolytica
PPLPK

SEQ ID NO: 2737432 - protein, 10 aa, Entamoeba histolytica
PQHNTQCEPQ

SEQ ID NO: 2737433 - protein, 12 aa, Entamoeba histolytica
PQNNTRMSSPPV

SEQ ID NO: 2737434 - protein, 7 aa, Entamoeba histolytica
PQYNGSY

SEQ ID NO: 2737435 - protein, 6 aa, Entamoeba histolytica
PRGNER

SEQ ID NO: 2737436 - protein, 10 aa, Entamoeba histolytica
PRKGKRSGAW

SEQ ID NO: 2737437 - protein, 13 aa, Entamoeba histolytica
PRNANEKEIKKAY

SEQ ID NO: 2737438 - protein, 12 aa, Entamoeba histolytica
PRQNEFANCVVW

SEQ ID NO: 2737439 - protein, 20 aa, Entamoeba histolytica
PSASSSAAASSATSTQPQMP

SEQ ID NO: 2737440 - protein, 14 aa, Entamoeba histolytica
PSECRGCEGGSIGG

SEQ ID NO: 2737441 - protein, 4 aa, Entamoeba histolytica
PSFK

SEQ ID NO: 2737442 - protein, 19 aa, Entamoeba histolytica
PSGDPSNSPEDNKTTGVVM

SEQ ID NO: 2737443 - protein, 8 aa, Entamoeba histolytica
PSGSCSDK

SEQ ID NO: 2737444 - protein, 21 aa, Entamoeba histolytica
PSHSYHKEPYPLEHYKSPLKE

SEQ ID NO: 2737445 - protein, 4 aa, Entamoeba histolytica
PSIP

SEQ ID NO: 2737446 - protein, 10 aa, Entamoeba histolytica
PSNEKYEGLK

SEQ ID NO: 2737447 - protein, 9 aa, Entamoeba histolytica
PSNPNIPSM

SEQ ID NO: 2737448 - protein, 4 aa, Entamoeba histolytica
PSNY

SEQ ID NO: 2737449 - protein, 8 aa, Entamoeba histolytica
PSPTQNLA

SEQ ID NO: 2737450 - protein, 6 aa, Entamoeba histolytica
PSQSVT

SEQ ID NO: 2737451 - protein, 10 aa, Entamoeba histolytica
PSSPDCGING

SEQ ID NO: 2737452 - protein, 17 aa, Entamoeba histolytica
PSSSYSTGYSSMHGNTE

SEQ ID NO: 2737453 - protein, 16 aa, Entamoeba histolytica
PSSTNSVTLKGRNDLK

SEQ ID NO: 2737454 - protein, 4 aa, Entamoeba histolytica
PSSY

SEQ ID NO: 2737455 - protein, 24 aa, Entamoeba histolytica
PSTKRLKDKPKSHLDEEENVDQPI

SEQ ID NO: 2737456 - protein, 8 aa, Entamoeba histolytica
PSTTSTAS

SEQ ID NO: 2737457 - protein, 5 aa, Entamoeba histolytica
PSYKT

SEQ ID NO: 2737458 - protein, 4 aa, Entamoeba histolytica
PTDT

SEQ ID NO: 2737459 - protein, 9 aa, Entamoeba histolytica
PTELNKDEN

SEQ ID NO: 2737460 - protein, 7 aa, Entamoeba histolytica
PTGCKKK

SEQ ID NO: 2737461 - protein, 6 aa, Entamoeba histolytica
PTGKGI

SEQ ID NO: 2737462 - protein, 8 aa, Entamoeba histolytica
PTLTEYPT

SEQ ID NO: 2737463 - protein, 4 aa, Entamoeba histolytica
PTNE

SEQ ID NO: 2737464 - protein, 5 aa, Entamoeba histolytica
PTNNT

SEQ ID NO: 2737465 - protein, 8 aa, Entamoeba histolytica
PTNQKEQY

SEQ ID NO: 2737466 - protein, 4 aa, Entamoeba histolytica
PTQT

SEQ ID NO: 2737467 - protein, 23 aa, Entamoeba histolytica
PTSSTPSLISPTTTLDQQQEFQP

SEQ ID NO: 2737468 - protein, 16 aa, Entamoeba histolytica
PTSYYQNSNQNKWKDY

SEQ ID NO: 2737469 - protein, 8 aa, Entamoeba histolytica
PTTGNCPK

SEQ ID NO: 2737470 - protein, 5 aa, Entamoeba histolytica
PTTNE

SEQ ID NO: 2737471 - protein, 9 aa, Entamoeba histolytica
PTTTSTEQF

SEQ ID NO: 2737472 - protein, 9 aa, Entamoeba histolytica
PTTTSTGQF

SEQ ID NO: 2737473 - protein, 5 aa, Entamoeba histolytica
PWAGS

SEQ ID NO: 2737474 - protein, 4 aa, Entamoeba histolytica
PWTN

SEQ ID NO: 2737475 - protein, 10 aa, Entamoeba histolytica
PYAEEQDAFR

SEQ ID NO: 2737476 - protein, 5 aa, Entamoeba histolytica
PYANE

SEQ ID NO: 2737477 - protein, 8 aa, Entamoeba histolytica
PYSDATNN

SEQ ID NO: 2737478 - protein, 7 aa, Entamoeba histolytica
QAKSNGL

SEQ ID NO: 2737479 - protein, 6 aa, Entamoeba histolytica
QALENS

SEQ ID NO: 2737480 - protein, 8 aa, Entamoeba histolytica
QANTLTQS

SEQ ID NO: 2737481 - protein, 5 aa, Entamoeba histolytica
QARKK

SEQ ID NO: 2737482 - protein, 31 aa, Entamoeba histolytica
QATATSSGFAEVQTENNNEEENTSETITETN

SEQ ID NO: 2737483 - protein, 7 aa, Entamoeba histolytica
QATDDGS

SEQ ID NO: 2737484 - protein, 9 aa, Entamoeba histolytica
QATSLSDRI

SEQ ID NO: 2737485 - protein, 5 aa, Entamoeba histolytica
QCGKQ

SEQ ID NO: 2737486 - protein, 4 aa, Entamoeba histolytica
QCNG

SEQ ID NO: 2737487 - protein, 13 aa, Entamoeba histolytica
QDCVNEKQSTGAS

SEQ ID NO: 2737488 - protein, 6 aa, Entamoeba histolytica
QDDTYK

SEQ ID NO: 2737489 - protein, 18 aa, Entamoeba histolytica
QDIAQEMKERADNLKKEE

SEQ ID NO: 2737490 - protein, 8 aa, Entamoeba histolytica
QDKNPDEL

SEQ ID NO: 2737491 - protein, 50 aa, Entamoeba histolytica
QDPISKKKKIIEKKKKAITKKHSEKHENNKTSLLTNTTNTTNSSLENNSK

SEQ ID NO: 2737492 - protein, 6 aa, Entamoeba histolytica
QDPNSE

SEQ ID NO: 2737493 - protein, 6 aa, Entamoeba histolytica
QEIRRT

SEQ ID NO: 2737494 - protein, 9 aa, Entamoeba histolytica
QEKDVKKQG

SEQ ID NO: 2737495 - protein, 4 aa, Entamoeba histolytica
QEKK

SEQ ID NO: 2737496 - protein, 8 aa, Entamoeba histolytica
QEKQQDRE

SEQ ID NO: 2737497 - protein, 11 aa, Entamoeba histolytica
QEKYQNKLDTL

SEQ ID NO: 2737498 - protein, 4 aa, Entamoeba histolytica
QELK

SEQ ID NO: 2737499 - protein, 7 aa, Entamoeba histolytica
QELNEEK

SEQ ID NO: 2737500 - protein, 13 aa, Entamoeba histolytica
QENESKKKETFRR

SEQ ID NO: 2737501 - protein, 5 aa, Entamoeba histolytica
QEQTC

SEQ ID NO: 2737502 - protein, 5 aa, Entamoeba histolytica
QEQVN

SEQ ID NO: 2737503 - protein, 8 aa, Entamoeba histolytica
QERNEKTK

SEQ ID NO: 2737504 - protein, 6 aa, Entamoeba histolytica
QESVSN

SEQ ID NO: 2737505 - protein, 10 aa, Entamoeba histolytica
QEYPAKDPGN

SEQ ID NO: 2737506 - protein, 8 aa, Entamoeba histolytica
QFDDGFTS

SEQ ID NO: 2737507 - protein, 8 aa, Entamoeba histolytica
QFNSGTYN

SEQ ID NO: 2737508 - protein, 6 aa, Entamoeba histolytica
QFPDQN

SEQ ID NO: 2737509 - protein, 5 aa, Entamoeba histolytica
QFPPE

SEQ ID NO: 2737510 - protein, 15 aa, Entamoeba histolytica
QFSPDSVKGPHDTSF

SEQ ID NO: 2737511 - protein, 10 aa, Entamoeba histolytica
QGEQEGPYQY

SEQ ID NO: 2737512 - protein, 17 aa, Entamoeba histolytica
QGKEKIYKQDEEIRKSK

SEQ ID NO: 2737513 - protein, 26 aa, Entamoeba histolytica
QGKKMKSLEDPAPETVTIPEEPPEGC

SEQ ID NO: 2737514 - protein, 6 aa, Entamoeba histolytica
QGLNAK

SEQ ID NO: 2737515 - protein, 7 aa, Entamoeba histolytica
QGNRITP

SEQ ID NO: 2737516 - protein, 5 aa, Entamoeba histolytica
QGRQD

SEQ ID NO: 2737517 - protein, 13 aa, Entamoeba histolytica
QGVDDGIKQKSQC

SEQ ID NO: 2737518 - protein, 17 aa, Entamoeba histolytica
QHEREMSEKKIAKEIQK

SEQ ID NO: 2737519 - protein, 6 aa, Entamoeba histolytica
QHYNQY

SEQ ID NO: 2737520 - protein, 5 aa, Entamoeba histolytica
QIDDS

SEQ ID NO: 2737521 - protein, 23 aa, Entamoeba histolytica
QIEGKKKNIEIKGKNVTAEIEGV

SEQ ID NO: 2737522 - protein, 5 aa, Entamoeba histolytica
QIKEK

SEQ ID NO: 2737523 - protein, 8 aa, Entamoeba histolytica
QINDKKYN

SEQ ID NO: 2737524 - protein, 9 aa, Entamoeba histolytica
QINGNTNNE

SEQ ID NO: 2737525 - protein, 5 aa, Entamoeba histolytica
QINNQ

SEQ ID NO: 2737526 - protein, 10 aa, Entamoeba histolytica
QINPPDPDTQ

SEQ ID NO: 2737527 - protein, 9 aa, Entamoeba histolytica
QIPASEKEE

SEQ ID NO: 2737528 - protein, 15 aa, Entamoeba histolytica
QIPISEPYTDAKNNL

SEQ ID NO: 2737529 - protein, 4 aa, Entamoeba histolytica
QIST

SEQ ID NO: 2737530 - protein, 4 aa, Entamoeba histolytica
QITG

SEQ ID NO: 2737531 - protein, 8 aa, Entamoeba histolytica
QITPENDC

SEQ ID NO: 2737532 - protein, 4 aa, Entamoeba histolytica
QITS

SEQ ID NO: 2737533 - protein, 4 aa, Entamoeba histolytica
QKAT

SEQ ID NO: 2737534 - protein, 4 aa, Entamoeba histolytica
QKEE

SEQ ID NO: 2737535 - protein, 16 aa, Entamoeba histolytica
QKEKIEKEKKRLTKRE

SEQ ID NO: 2737536 - protein, 10 aa, Entamoeba histolytica
QKGNDKQYSY

SEQ ID NO: 2737537 - protein, 7 aa, Entamoeba histolytica
QKGQEIP

SEQ ID NO: 2737538 - protein, 9 aa, Entamoeba histolytica
QKGSADKKT

SEQ ID NO: 2737539 - protein, 20 aa, Entamoeba histolytica
QKGTQLKKVDTNAPRPSMAN

SEQ ID NO: 2737540 - protein, 29 aa, Entamoeba histolytica
QKHLKTDEITSPKTEKTQKEIKTKSDDNV

SEQ ID NO: 2737541 - protein, 5 aa, Entamoeba histolytica
QKHQM

SEQ ID NO: 2737542 - protein, 12 aa, Entamoeba histolytica
QKKQGSTNYSSV

SEQ ID NO: 2737543 - protein, 7 aa, Entamoeba histolytica
QKNCGAA

SEQ ID NO: 2737544 - protein, 27 aa, Entamoeba histolytica
QKNEKGKVQEEAERMKTKLERNKERMN

SEQ ID NO: 2737545 - protein, 4 aa, Entamoeba histolytica
QKNL

SEQ ID NO: 2737546 - protein, 11 aa, Entamoeba histolytica
QKNQKDKEQKL

SEQ ID NO: 2737547 - protein, 4 aa, Entamoeba histolytica
QKNT

SEQ ID NO: 2737548 - protein, 14 aa, Entamoeba histolytica
QKQMNDQKEMNDTI

SEQ ID NO: 2737549 - protein, 20 aa, Entamoeba histolytica
QKQSTNKTQEQVEQEKKDGC

SEQ ID NO: 2737550 - protein, 4 aa, Entamoeba histolytica
QKQV

SEQ ID NO: 2737551 - protein, 42 aa, Entamoeba histolytica
QKRPTISQPKTSSNQQKNKEDSTVDIQQNPATGEAGEEEAGC

SEQ ID NO: 2737552 - protein, 10 aa, Entamoeba histolytica
QKSAKKVAAK

SEQ ID NO: 2737553 - protein, 15 aa, Entamoeba histolytica
QKSELKKDTCDSRSP

SEQ ID NO: 2737554 - protein, 7 aa, Entamoeba histolytica
QKSITRK

SEQ ID NO: 2737555 - protein, 8 aa, Entamoeba histolytica
QKTESTYP

SEQ ID NO: 2737556 - protein, 16 aa, Entamoeba histolytica
QKTQQPIVEENNDQVQ

SEQ ID NO: 2737557 - protein, 5 aa, Entamoeba histolytica
QLENE

SEQ ID NO: 2737558 - protein, 12 aa, Entamoeba histolytica
QLKARKDYDEDL

SEQ ID NO: 2737559 - protein, 17 aa, Entamoeba histolytica
QLKGSENNTIDNGIEEI

SEQ ID NO: 2737560 - protein, 9 aa, Entamoeba histolytica
QLKQDRSNL

SEQ ID NO: 2737561 - protein, 5 aa, Entamoeba histolytica
QLPPY

SEQ ID NO: 2737562 - protein, 6 aa, Entamoeba histolytica
QLRKYS

SEQ ID NO: 2737563 - protein, 17 aa, Entamoeba histolytica
QLSGEYSKEKRKNWKED

SEQ ID NO: 2737564 - protein, 12 aa, Entamoeba histolytica
QLSKDAAKVTKK

SEQ ID NO: 2737565 - protein, 4 aa, Entamoeba histolytica
QLSQ

SEQ ID NO: 2737566 - protein, 17 aa, Entamoeba histolytica
QNDEFSKNDPKESIASR

SEQ ID NO: 2737567 - protein, 7 aa, Entamoeba histolytica
QNEANEV

SEQ ID NO: 2737568 - protein, 4 aa, Entamoeba histolytica
QNEE

SEQ ID NO: 2737569 - protein, 10 aa, Entamoeba histolytica
QNELNKKKQM

SEQ ID NO: 2737570 - protein, 6 aa, Entamoeba histolytica
QNENDY

SEQ ID NO: 2737571 - protein, 6 aa, Entamoeba histolytica
QNETSQ

SEQ ID NO: 2737572 - protein, 8 aa, Entamoeba histolytica
QNGNAPSH

SEQ ID NO: 2737573 - protein, 15 aa, Entamoeba histolytica
QNGTCSNENNEEQLK

SEQ ID NO: 2737574 - protein, 24 aa, Entamoeba histolytica
QNKKDKEKALKDINKRSKQLQKEY

SEQ ID NO: 2737575 - protein, 4 aa, Entamoeba histolytica
QNKN

SEQ ID NO: 2737576 - protein, 11 aa, Entamoeba histolytica
QNKQIYDSQKP

SEQ ID NO: 2737577 - protein, 5 aa, Entamoeba histolytica
QNNNI

SEQ ID NO: 2737578 - protein, 5 aa, Entamoeba histolytica
QNNNK

SEQ ID NO: 2737579 - protein, 7 aa, Entamoeba histolytica
QNPDERI

SEQ ID NO: 2737580 - protein, 6 aa, Entamoeba histolytica
QNPYKN

SEQ ID NO: 2737581 - protein, 10 aa, Entamoeba histolytica
QNQEQLPEDA

SEQ ID NO: 2737582 - protein, 5 aa, Entamoeba histolytica
QNQIF

SEQ ID NO: 2737583 - protein, 6 aa, Entamoeba histolytica
QNQPNL

SEQ ID NO: 2737584 - protein, 11 aa, Entamoeba histolytica
QNRIRNEKENL

SEQ ID NO: 2737585 - protein, 17 aa, Entamoeba histolytica
QNSETASGVHRDKEYAE

SEQ ID NO: 2737586 - protein, 4 aa, Entamoeba histolytica
QNTL

SEQ ID NO: 2737587 - protein, 12 aa, Entamoeba histolytica
QNTNDDEYQLSN

SEQ ID NO: 2737588 - protein, 5 aa, Entamoeba histolytica
QNTRN

SEQ ID NO: 2737589 - protein, 18 aa, Entamoeba histolytica
QNVQEGIEKQEKKLTKIK

SEQ ID NO: 2737590 - protein, 5 aa, Entamoeba histolytica
QNYPQ

SEQ ID NO: 2737591 - protein, 9 aa, Entamoeba histolytica
QPAAPSQPQ

SEQ ID NO: 2737592 - protein, 8 aa, Entamoeba histolytica
QPDLPDDA

SEQ ID NO: 2737593 - protein, 8 aa, Entamoeba histolytica
QPDNPINI

SEQ ID NO: 2737594 - protein, 6 aa, Entamoeba histolytica
QPDSWK

SEQ ID NO: 2737595 - protein, 7 aa, Entamoeba histolytica
QPDTSKT

SEQ ID NO: 2737596 - protein, 15 aa, Entamoeba histolytica
QPGAQAPAQAQQQAA

SEQ ID NO: 2737597 - protein, 5 aa, Entamoeba histolytica
QPKGP

SEQ ID NO: 2737598 - protein, 17 aa, Entamoeba histolytica
QPLGSEKFEGLEIIPLN

SEQ ID NO: 2737599 - protein, 4 aa, Entamoeba histolytica
QPPI

SEQ ID NO: 2737600 - protein, 6 aa, Entamoeba histolytica
QPQQNQ

SEQ ID NO: 2737601 - protein, 4 aa, Entamoeba histolytica
QPSP

SEQ ID NO: 2737602 - protein, 8 aa, Entamoeba histolytica
QPSSQPSI

SEQ ID NO: 2737603 - protein, 14 aa, Entamoeba histolytica
QPVNGQPEQPVPHP

SEQ ID NO: 2737604 - protein, 13 aa, Entamoeba histolytica
QPWPKSGKCEKNK

SEQ ID NO: 2737605 - protein, 6 aa, Entamoeba histolytica
QPYAVN

SEQ ID NO: 2737606 - protein, 9 aa, Entamoeba histolytica
QQDQINNGE

SEQ ID NO: 2737607 - protein, 8 aa, Entamoeba histolytica
QQHNQQPP

SEQ ID NO: 2737608 - protein, 10 aa, Entamoeba histolytica
QQIKPEKTVK

SEQ ID NO: 2737609 - protein, 12 aa, Entamoeba histolytica
QQKMKKAEEKAK

SEQ ID NO: 2737610 - protein, 4 aa, Entamoeba histolytica
QQKR

SEQ ID NO: 2737611 - protein, 40 aa, Entamoeba histolytica
QQLKQQSTKTENKYKQALGKKPVSASLKKEAKAAAKAAYE

SEQ ID NO: 2737612 - protein, 11 aa, Entamoeba histolytica
QQQPGQKSYAS

SEQ ID NO: 2737613 - protein, 8 aa, Entamoeba histolytica
QQQQQQQM

SEQ ID NO: 2737614 - protein, 14 aa, Entamoeba histolytica
QQRSKSSSNEINQK

SEQ ID NO: 2737615 - protein, 4 aa, Entamoeba histolytica
QQRT

SEQ ID NO: 2737616 - protein, 9 aa, Entamoeba histolytica
QQSYRTAPY

SEQ ID NO: 2737617 - protein, 13 aa, Entamoeba histolytica
QQTQTKIDEVDNE

SEQ ID NO: 2737618 - protein, 8 aa, Entamoeba histolytica
QQYAESGV

SEQ ID NO: 2737619 - protein, 12 aa, Entamoeba histolytica
QRACKNETKKLE

SEQ ID NO: 2737620 - protein, 5 aa, Entamoeba histolytica
QRFED

SEQ ID NO: 2737621 - protein, 4 aa, Entamoeba histolytica
QRGN

SEQ ID NO: 2737622 - protein, 7 aa, Entamoeba histolytica
QRKELSN

SEQ ID NO: 2737623 - protein, 13 aa, Entamoeba histolytica
QRKNLDGNVEDYR

SEQ ID NO: 2737624 - protein, 4 aa, Entamoeba histolytica
QRLD

SEQ ID NO: 2737625 - protein, 11 aa, Entamoeba histolytica
QRNMKNKGEME

SEQ ID NO: 2737626 - protein, 6 aa, Entamoeba histolytica
QRPGRL

SEQ ID NO: 2737627 - protein, 12 aa, Entamoeba histolytica
QRPRKKSSQTQQ

SEQ ID NO: 2737628 - protein, 5 aa, Entamoeba histolytica
QRRNE

SEQ ID NO: 2737629 - protein, 7 aa, Entamoeba histolytica
QRTQEMA

SEQ ID NO: 2737630 - protein, 19 aa, Entamoeba histolytica
QRVEDYKTQLDSNKDNTQL

SEQ ID NO: 2737631 - protein, 11 aa, Entamoeba histolytica
QRVKDDKECQN

SEQ ID NO: 2737632 - protein, 7 aa, Entamoeba histolytica
QSCEKRK

SEQ ID NO: 2737633 - protein, 11 aa, Entamoeba histolytica
QSCGEPKEGSC

SEQ ID NO: 2737634 - protein, 5 aa, Entamoeba histolytica
QSEKA

SEQ ID NO: 2737635 - protein, 5 aa, Entamoeba histolytica
QSFSE

SEQ ID NO: 2737636 - protein, 11 aa, Entamoeba histolytica
QSGSTTSTSLA

SEQ ID NO: 2737637 - protein, 11 aa, Entamoeba histolytica
QSIAKKGVSAV

SEQ ID NO: 2737638 - protein, 10 aa, Entamoeba histolytica
QSIANKGISA

SEQ ID NO: 2737639 - protein, 7 aa, Entamoeba histolytica
QSKADIK

SEQ ID NO: 2737640 - protein, 7 aa, Entamoeba histolytica
QSKDVGR

SEQ ID NO: 2737641 - protein, 7 aa, Entamoeba histolytica
QSKERNV

SEQ ID NO: 2737642 - protein, 12 aa, Entamoeba histolytica
QSKKEIEEFNKE

SEQ ID NO: 2737643 - protein, 8 aa, Entamoeba histolytica
QSKKTLHE

SEQ ID NO: 2737644 - protein, 5 aa, Entamoeba histolytica
QSKQY

SEQ ID NO: 2737645 - protein, 8 aa, Entamoeba histolytica
QSKSNGNI

SEQ ID NO: 2737646 - protein, 4 aa, Entamoeba histolytica
QSKY

SEQ ID NO: 2737647 - protein, 5 aa, Entamoeba histolytica
QSNNS

SEQ ID NO: 2737648 - protein, 5 aa, Entamoeba histolytica
QSNQH

SEQ ID NO: 2737649 - protein, 6 aa, Entamoeba histolytica
QSNQQR

SEQ ID NO: 2737650 - protein, 10 aa, Entamoeba histolytica
QSQDANMGSA

SEQ ID NO: 2737651 - protein, 35 aa, Entamoeba histolytica
QSQENKPEPSRVHAGTAQRQLDKVQSASKQSQNSV

SEQ ID NO: 2737652 - protein, 6 aa, Entamoeba histolytica
QSSFNS

SEQ ID NO: 2737653 - protein, 8 aa, Entamoeba histolytica
QSSGDRCE

SEQ ID NO: 2737654 - protein, 11 aa, Entamoeba histolytica
QSSKSASVEEL

SEQ ID NO: 2737655 - protein, 7 aa, Entamoeba histolytica
QSTPTIE

SEQ ID NO: 2737656 - protein, 5 aa, Entamoeba histolytica
QSTSL

SEQ ID NO: 2737657 - protein, 11 aa, Entamoeba histolytica
QSTVTISSPIN

SEQ ID NO: 2737658 - protein, 18 aa, Entamoeba histolytica
QTATDVKTDGVSSNKCGT

SEQ ID NO: 2737659 - protein, 6 aa, Entamoeba histolytica
QTAVNA

SEQ ID NO: 2737660 - protein, 12 aa, Entamoeba histolytica
QTCSNSAKQCTS

SEQ ID NO: 2737661 - protein, 5 aa, Entamoeba histolytica
QTECN

SEQ ID NO: 2737662 - protein, 7 aa, Entamoeba histolytica
QTEELAK

SEQ ID NO: 2737663 - protein, 14 aa, Entamoeba histolytica
QTETDKDKLNSMKA

SEQ ID NO: 2737664 - protein, 4 aa, Entamoeba histolytica
QTGC

SEQ ID NO: 2737665 - protein, 6 aa, Entamoeba histolytica
QTIITT

SEQ ID NO: 2737666 - protein, 8 aa, Entamoeba histolytica
QTIPHSND

SEQ ID NO: 2737667 - protein, 13 aa, Entamoeba histolytica
QTISRESKSRITK

SEQ ID NO: 2737668 - protein, 8 aa, Entamoeba histolytica
QTKCNEGE

SEQ ID NO: 2737669 - protein, 6 aa, Entamoeba histolytica
QTKKTD

SEQ ID NO: 2737670 - protein, 5 aa, Entamoeba histolytica
QTNTT

SEQ ID NO: 2737671 - protein, 9 aa, Entamoeba histolytica
QTPKEITKT

SEQ ID NO: 2737672 - protein, 27 aa, Entamoeba histolytica
QTQPTTPSEKAEANKKAKAALKKDISD

SEQ ID NO: 2737673 - protein, 5 aa, Entamoeba histolytica
QTQRE

SEQ ID NO: 2737674 - protein, 5 aa, Entamoeba histolytica
QTRKT

SEQ ID NO: 2737675 - protein, 17 aa, Entamoeba histolytica
QTRNQQSPSYSSKKRAE

SEQ ID NO: 2737676 - protein, 11 aa, Entamoeba histolytica
QTSAKTNKNVD

SEQ ID NO: 2737677 - protein, 5 aa, Entamoeba histolytica
QTSNE

SEQ ID NO: 2737678 - protein, 6 aa, Entamoeba histolytica
QTSSNW

SEQ ID NO: 2737679 - protein, 7 aa, Entamoeba histolytica
QTSSTSI

SEQ ID NO: 2737680 - protein, 10 aa, Entamoeba histolytica
QTTEDENTEI

SEQ ID NO: 2737681 - protein, 17 aa, Entamoeba histolytica
QVKNKTKESLNTKEVKE

SEQ ID NO: 2737682 - protein, 6 aa, Entamoeba histolytica
QVNQQK

SEQ ID NO: 2737683 - protein, 40 aa, Entamoeba histolytica
QVNQTQVNEQVNSTTIRSDEENKEIKEQDEITNKTSNNEK

SEQ ID NO: 2737684 - protein, 55 aa, Entamoeba histolytica
  misc_feature (23)..(55): Xaa can be any naturally occurring amino acid
QVNSPSSSFSSPDYIENVKVNGXXXXXXXXXXXXXXXXXXXXXXXXXXXXXXXXX

SEQ ID NO: 2737685 - protein, 11 aa, Entamoeba histolytica
QVNVSDEKGGL

SEQ ID NO: 2737686 - protein, 4 aa, Entamoeba histolytica
QVPN

SEQ ID NO: 2737687 - protein, 7 aa, Entamoeba histolytica
QVTRADA

SEQ ID NO: 2737688 - protein, 5 aa, Entamoeba histolytica
QWETQ

SEQ ID NO: 2737689 - protein, 6 aa, Entamoeba histolytica
QYPPQN

SEQ ID NO: 2737690 - protein, 38 aa, Entamoeba histolytica
QYPTTTPQQTNQQTGMQQTNPPQINATTFDNKSFQKQV

SEQ ID NO: 2737691 - protein, 4 aa, Entamoeba histolytica
QYQP

SEQ ID NO: 2737692 - protein, 6 aa, Entamoeba histolytica
RAADEI

SEQ ID NO: 2737693 - protein, 11 aa, Entamoeba histolytica
RADEQQERNLN

SEQ ID NO: 2737694 - protein, 13 aa, Entamoeba histolytica
RAGTRTKGRSHKY

SEQ ID NO: 2737695 - protein, 8 aa, Entamoeba histolytica
RAIASRKD

SEQ ID NO: 2737696 - protein, 10 aa, Entamoeba histolytica
RANEQKKIDS

SEQ ID NO: 2737697 - protein, 8 aa, Entamoeba histolytica
RANSNSAA

SEQ ID NO: 2737698 - protein, 7 aa, Entamoeba histolytica
RAPRGIP

SEQ ID NO: 2737699 - protein, 6 aa, Entamoeba histolytica
RAQEDQ

SEQ ID NO: 2737700 - protein, 8 aa, Entamoeba histolytica
RAQNTKQQ

SEQ ID NO: 2737701 - protein, 9 aa, Entamoeba histolytica
RASADGQRC

SEQ ID NO: 2737702 - protein, 9 aa, Entamoeba histolytica
RAYNKRPKK

SEQ ID NO: 2737703 - protein, 5 aa, Entamoeba histolytica
RDAKN

SEQ ID NO: 2737704 - protein, 11 aa, Entamoeba histolytica
RDEAERDGRAV

SEQ ID NO: 2737705 - protein, 6 aa, Entamoeba histolytica
RDEITS

SEQ ID NO: 2737706 - protein, 12 aa, Entamoeba histolytica
RDIDGLKPSDFG

SEQ ID NO: 2737707 - protein, 5 aa, Entamoeba histolytica
RDLGR

SEQ ID NO: 2737708 - protein, 14 aa, Entamoeba histolytica
RDNGNNGCNGGLGS

SEQ ID NO: 2737709 - protein, 4 aa, Entamoeba histolytica
RDPT

SEQ ID NO: 2737710 - protein, 8 aa, Entamoeba histolytica
RDRMSPKE

SEQ ID NO: 2737711 - protein, 12 aa, Entamoeba histolytica
RDSKIIRKDPNF

SEQ ID NO: 2737712 - protein, 13 aa, Entamoeba histolytica
RDTKKNSKEALEE

SEQ ID NO: 2737713 - protein, 6 aa, Entamoeba histolytica
RDTNYT

SEQ ID NO: 2737714 - protein, 4 aa, Entamoeba histolytica
RDVS

SEQ ID NO: 2737715 - protein, 9 aa, Entamoeba histolytica
REAEGCNVQ

SEQ ID NO: 2737716 - protein, 17 aa, Entamoeba histolytica
REAERAKRALSVQQQDR

SEQ ID NO: 2737717 - protein, 6 aa, Entamoeba histolytica
REEGIN

SEQ ID NO: 2737718 - protein, 7 aa, Entamoeba histolytica
REEIDNA

SEQ ID NO: 2737719 - protein, 24 aa, Entamoeba histolytica
REENKEIEELQKKAKEMKKEIKGI

SEQ ID NO: 2737720 - protein, 8 aa, Entamoeba histolytica
REENKGKE

SEQ ID NO: 2737721 - protein, 17 aa, Entamoeba histolytica
REESPSKCSQCNKGKCE

SEQ ID NO: 2737722 - protein, 14 aa, Entamoeba histolytica
REGKGNAGKYGDYS

SEQ ID NO: 2737723 - protein, 9 aa, Entamoeba histolytica
REGKSLKTI

SEQ ID NO: 2737724 - protein, 12 aa, Entamoeba histolytica
REGSNFDGATQK

SEQ ID NO: 2737725 - protein, 7 aa, Entamoeba histolytica
REGWTNN

SEQ ID NO: 2737726 - protein, 5 aa, Entamoeba histolytica
REKGQ

SEQ ID NO: 2737727 - protein, 10 aa, Entamoeba histolytica
REKQNDIKNT

SEQ ID NO: 2737728 - protein, 6 aa, Entamoeba histolytica
REMNND

SEQ ID NO: 2737729 - protein, 9 aa, Entamoeba histolytica
RENSGTYNN

SEQ ID NO: 2737730 - protein, 5 aa, Entamoeba histolytica
REQVE

SEQ ID NO: 2737731 - protein, 15 aa, Entamoeba histolytica
REVESIKKEKNERAK

SEQ ID NO: 2737732 - protein, 16 aa, Entamoeba histolytica
REVSYEEGKQYANERG

SEQ ID NO: 2737733 - protein, 4 aa, Entamoeba histolytica
REYR

SEQ ID NO: 2737734 - protein, 11 aa, Entamoeba histolytica
RFDGTGGESIY

SEQ ID NO: 2737735 - protein, 9 aa, Entamoeba histolytica
RGAENNPYN

SEQ ID NO: 2737736 - protein, 6 aa, Entamoeba histolytica
RGDGWT

SEQ ID NO: 2737737 - protein, 8 aa, Entamoeba histolytica
RGDQNPNV

SEQ ID NO: 2737738 - protein, 24 aa, Entamoeba histolytica
RGDSIANGKGRSSRSALLNALKNL

SEQ ID NO: 2737739 - protein, 17 aa, Entamoeba histolytica
RGKTSGRADDNTEAAAK

SEQ ID NO: 2737740 - protein, 7 aa, Entamoeba histolytica
RGNKEQI

SEQ ID NO: 2737741 - protein, 6 aa, Entamoeba histolytica
RGNKPL

SEQ ID NO: 2737742 - protein, 20 aa, Entamoeba histolytica
RGQDAAQEMKEREEKLRKDR

SEQ ID NO: 2737743 - protein, 7 aa, Entamoeba histolytica
RGRLSQT

SEQ ID NO: 2737744 - protein, 7 aa, Entamoeba histolytica
RGRNPDF

SEQ ID NO: 2737745 - protein, 5 aa, Entamoeba histolytica
RGTKT

SEQ ID NO: 2737746 - protein, 13 aa, Entamoeba histolytica
RGVSEGVEVSNEQ

SEQ ID NO: 2737747 - protein, 5 aa, Entamoeba histolytica
RGWTE

SEQ ID NO: 2737748 - protein, 13 aa, Entamoeba histolytica
RHGDRSPMNSFDQ

SEQ ID NO: 2737749 - protein, 19 aa, Entamoeba histolytica
RHSSEDPKSYIGKNAPIQF

SEQ ID NO: 2737750 - protein, 6 aa, Entamoeba histolytica
RIDSNG

SEQ ID NO: 2737751 - protein, 6 aa, Entamoeba histolytica
RIEENT

SEQ ID NO: 2737752 - protein, 10 aa, Entamoeba histolytica
RIKDKNSMEE

SEQ ID NO: 2737753 - protein, 20 aa, Entamoeba histolytica
RILSPKKAITHKSSTKKTLK

SEQ ID NO: 2737754 - protein, 8 aa, Entamoeba histolytica
RIQNEKDK

SEQ ID NO: 2737755 - protein, 5 aa, Entamoeba histolytica
RIRNP

SEQ ID NO: 2737756 - protein, 11 aa, Entamoeba histolytica
RISKGAEKQIA

SEQ ID NO: 2737757 - protein, 21 aa, Entamoeba histolytica
RKAETLKEKSINAKSSGNKVV

SEQ ID NO: 2737758 - protein, 11 aa, Entamoeba histolytica
RKAHGSSKAQL

SEQ ID NO: 2737759 - protein, 8 aa, Entamoeba histolytica
RKAKKMAK

SEQ ID NO: 2737760 - protein, 23 aa, Entamoeba histolytica
RKATDGRSTWTGNKNLNTTSKSY

SEQ ID NO: 2737761 - protein, 19 aa, Entamoeba histolytica
RKEAEKAKIALSSEEQTKI

SEQ ID NO: 2737762 - protein, 10 aa, Entamoeba histolytica
RKEEKGITGV

SEQ ID NO: 2737763 - protein, 8 aa, Entamoeba histolytica
RKEEMDKE

SEQ ID NO: 2737764 - protein, 7 aa, Entamoeba histolytica
RKEERTL

SEQ ID NO: 2737765 - protein, 51 aa, Entamoeba histolytica
RKELTKEIKNNKAALKEVKEELKNGDFDDTIKEQKRKRDNFSADYKERYNN

SEQ ID NO: 2737766 - protein, 7 aa, Entamoeba histolytica
RKEQKTL

SEQ ID NO: 2737767 - protein, 5 aa, Entamoeba histolytica
RKESF

SEQ ID NO: 2737768 - protein, 11 aa, Entamoeba histolytica
RKETDKITAPF

SEQ ID NO: 2737769 - protein, 23 aa, Entamoeba histolytica
RKETYQKVRDSAINEKKSVSNEI

SEQ ID NO: 2737770 - protein, 5 aa, Entamoeba histolytica
RKEVY

SEQ ID NO: 2737771 - protein, 6 aa, Entamoeba histolytica
RKEVYD

SEQ ID NO: 2737772 - protein, 6 aa, Entamoeba histolytica
RKGHRR

SEQ ID NO: 2737773 - protein, 10 aa, Entamoeba histolytica
RKGNEIKEEI

SEQ ID NO: 2737774 - protein, 5 aa, Entamoeba histolytica
RKGVQ

SEQ ID NO: 2737775 - protein, 20 aa, Entamoeba histolytica
RKKNEAKEKWTGNNHLNTTS

SEQ ID NO: 2737776 - protein, 23 aa, Entamoeba histolytica
RKKTEQSFTNGQKIEARTAKTTL

SEQ ID NO: 2737777 - protein, 9 aa, Entamoeba histolytica
RKKTRNVTT

SEQ ID NO: 2737778 - protein, 14 aa, Entamoeba histolytica
RKKYEEKKKHIATR

SEQ ID NO: 2737779 - protein, 14 aa, Entamoeba histolytica
RKMNQLKERQKEIK

SEQ ID NO: 2737780 - protein, 6 aa, Entamoeba histolytica
RKNESL

SEQ ID NO: 2737781 - protein, 14 aa, Entamoeba histolytica
RKNNHKKTSKKQIL

SEQ ID NO: 2737782 - protein, 8 aa, Entamoeba histolytica
RKNSTQKD

SEQ ID NO: 2737783 - protein, 4 aa, Entamoeba histolytica
RKNY

SEQ ID NO: 2737784 - protein, 4 aa, Entamoeba histolytica
RKPI

SEQ ID NO: 2737785 - protein, 45 aa, Entamoeba histolytica
RKQSKKYAQKKSAKLNKKISKINRRKKVSKKINNKRRVNKRLNKK

SEQ ID NO: 2737786 - protein, 8 aa, Entamoeba histolytica
RKSGMSKK

SEQ ID NO: 2737787 - protein, 8 aa, Entamoeba histolytica
RKSQRKAR

SEQ ID NO: 2737788 - protein, 7 aa, Entamoeba histolytica
RKVEQHK

SEQ ID NO: 2737789 - protein, 5 aa, Entamoeba histolytica
RKVGI

SEQ ID NO: 2737790 - protein, 9 aa, Entamoeba histolytica
RKVRGKKYR

SEQ ID NO: 2737791 - protein, 5 aa, Entamoeba histolytica
RLPDA

SEQ ID NO: 2737792 - protein, 7 aa, Entamoeba histolytica
RLSADEA

SEQ ID NO: 2737793 - protein, 11 aa, Entamoeba histolytica
RLSDQTKNADC

SEQ ID NO: 2737794 - protein, 20 aa, Entamoeba histolytica
RMSKKEKHTLDSRKNKNKRS

SEQ ID NO: 2737795 - protein, 14 aa, Entamoeba histolytica
RNAQHRKINEYSKG

SEQ ID NO: 2737796 - protein, 20 aa, Entamoeba histolytica
RNEAKKEAKKVTKKPLRKSM

SEQ ID NO: 2737797 - protein, 9 aa, Entamoeba histolytica
RNESLAQRI

SEQ ID NO: 2737798 - protein, 6 aa, Entamoeba histolytica
RNGVMQ

SEQ ID NO: 2737799 - protein, 6 aa, Entamoeba histolytica
RNIQSG

SEQ ID NO: 2737800 - protein, 11 aa, Entamoeba histolytica
RNKNEEYSNRV

SEQ ID NO: 2737801 - protein, 6 aa, Entamoeba histolytica
RNNEIA

SEQ ID NO: 2737802 - protein, 28 aa, Entamoeba histolytica
RNNRKHRTRNNRRHRRRNNKRKINRRRL

SEQ ID NO: 2737803 - protein, 4 aa, Entamoeba histolytica
RNTI

SEQ ID NO: 2737804 - protein, 9 aa, Entamoeba histolytica
RPERRSQKT

SEQ ID NO: 2737805 - protein, 11 aa, Entamoeba histolytica
RPNRNPRNKYY

SEQ ID NO: 2737806 - protein, 4 aa, Entamoeba histolytica
RPYE

SEQ ID NO: 2737807 - protein, 8 aa, Entamoeba histolytica
RQANMDPE

SEQ ID NO: 2737808 - protein, 4 aa, Entamoeba histolytica
RQDE

SEQ ID NO: 2737809 - protein, 10 aa, Entamoeba histolytica
RQEAKSKFKE

SEQ ID NO: 2737810 - protein, 12 aa, Entamoeba histolytica
RQHADEKAGKFN

SEQ ID NO: 2737811 - protein, 10 aa, Entamoeba histolytica
RQKEQTIRSG

SEQ ID NO: 2737812 - protein, 7 aa, Entamoeba histolytica
RQKEQTV

SEQ ID NO: 2737813 - protein, 4 aa, Entamoeba histolytica
RQKY

SEQ ID NO: 2737814 - protein, 7 aa, Entamoeba histolytica
RQSISTK

SEQ ID NO: 2737815 - protein, 9 aa, Entamoeba histolytica
RQTQRDTMY

SEQ ID NO: 2737816 - protein, 7 aa, Entamoeba histolytica
RRAKESL

SEQ ID NO: 2737817 - protein, 7 aa, Entamoeba histolytica
RREEPTF

SEQ ID NO: 2737818 - protein, 8 aa, Entamoeba histolytica
RRHPKRRH

SEQ ID NO: 2737819 - protein, 6 aa, Entamoeba histolytica
RRIDSK

SEQ ID NO: 2737820 - protein, 15 aa, Entamoeba histolytica
RRPRRHYRRKSHRRH

SEQ ID NO: 2737821 - protein, 7 aa, Entamoeba histolytica
RRRGMEQ

SEQ ID NO: 2737822 - protein, 73 aa, Entamoeba histolytica
RRVGSTSNLKASKITKQAKKQVKKIAKESAKKYSSIAAKRAGKKAVEEAKKKFGNDQQKIKLEKKKAEKNVYK

SEQ ID NO: 2737823 - protein, 12 aa, Entamoeba histolytica
RSASEPKSPVAQ

SEQ ID NO: 2737824 - protein, 9 aa, Entamoeba histolytica
RSDESGSKM

SEQ ID NO: 2737825 - protein, 7 aa, Entamoeba histolytica
RSDVDTA

SEQ ID NO: 2737826 - protein, 9 aa, Entamoeba histolytica
RSEEPNQEV

SEQ ID NO: 2737827 - protein, 15 aa, Entamoeba histolytica
RSEGKVTPVKNQRKC

SEQ ID NO: 2737828 - protein, 7 aa, Entamoeba histolytica
RSGNEEV

SEQ ID NO: 2737829 - protein, 10 aa, Entamoeba histolytica
RSIAKEKMNQ

SEQ ID NO: 2737830 - protein, 10 aa, Entamoeba histolytica
RSKYENCEDT

SEQ ID NO: 2737831 - protein, 7 aa, Entamoeba histolytica
RSNEYRF

SEQ ID NO: 2737832 - protein, 9 aa, Entamoeba histolytica
RSRKEEIAD

SEQ ID NO: 2737833 - protein, 8 aa, Entamoeba histolytica
RSTRTEHR

SEQ ID NO: 2737834 - protein, 8 aa, Entamoeba histolytica
RSTTGGIS

SEQ ID NO: 2737835 - protein, 5 aa, Entamoeba histolytica
RSVGG

SEQ ID NO: 2737836 - protein, 8 aa, Entamoeba histolytica
RTAPKTVV

SEQ ID NO: 2737837 - protein, 9 aa, Entamoeba histolytica
RTCQSKYNN

SEQ ID NO: 2737838 - protein, 4 aa, Entamoeba histolytica
RTDV

SEQ ID NO: 2737839 - protein, 9 aa, Entamoeba histolytica
RTEEDQINE

SEQ ID NO: 2737840 - protein, 5 aa, Entamoeba histolytica
RTEPG

SEQ ID NO: 2737841 - protein, 30 aa, Entamoeba histolytica
RTFKKDSRRTKTQKRYNKETRKAYKEKRKV

SEQ ID NO: 2737842 - protein, 6 aa, Entamoeba histolytica
RTGSAE

SEQ ID NO: 2737843 - protein, 5 aa, Entamoeba histolytica
RTKEY

SEQ ID NO: 2737844 - protein, 7 aa, Entamoeba histolytica
RTNCDGL

SEQ ID NO: 2737845 - protein, 4 aa, Entamoeba histolytica
RTND

SEQ ID NO: 2737846 - protein, 6 aa, Entamoeba histolytica
RTNGVD

SEQ ID NO: 2737847 - protein, 8 aa, Entamoeba histolytica
RTNPSTGY

SEQ ID NO: 2737848 - protein, 6 aa, Entamoeba histolytica
RTQQLN

SEQ ID NO: 2737849 - protein, 11 aa, Entamoeba histolytica
RTSEYSPKQFN

SEQ ID NO: 2737850 - protein, 5 aa, Entamoeba histolytica
RTSPF

SEQ ID NO: 2737851 - protein, 17 aa, Entamoeba histolytica
RTTKETAVNAEKPIECF

SEQ ID NO: 2737852 - protein, 8 aa, Entamoeba histolytica
RTVNDNTI

SEQ ID NO: 2737853 - protein, 9 aa, Entamoeba histolytica
RTYDDKEVQ

SEQ ID NO: 2737854 - protein, 5 aa, Entamoeba histolytica
RTYLK

SEQ ID NO: 2737855 - protein, 5 aa, Entamoeba histolytica
RVASK

SEQ ID NO: 2737856 - protein, 7 aa, Entamoeba histolytica
RVKQRKK

SEQ ID NO: 2737857 - protein, 5 aa, Entamoeba histolytica
RVNKD

SEQ ID NO: 2737858 - protein, 9 aa, Entamoeba histolytica
RVTPDDKEV

SEQ ID NO: 2737859 - protein, 4 aa, Entamoeba histolytica
RYEP

SEQ ID NO: 2737860 - protein, 30 aa, Entamoeba histolytica
RYYDSEKGTCQKCTTNNPQCSSCNETNGEC

SEQ ID NO: 2737861 - protein, 5 aa, Entamoeba histolytica
SAAKE

SEQ ID NO: 2737862 - protein, 9 aa, Entamoeba histolytica
SAAKEVNGK

SEQ ID NO: 2737863 - protein, 7 aa, Entamoeba histolytica
SAAPHNL

SEQ ID NO: 2737864 - protein, 6 aa, Entamoeba histolytica
SADDPV

SEQ ID NO: 2737865 - protein, 26 aa, Entamoeba histolytica
SAEDKKSGKSEKITITSEKGRLTEEE

SEQ ID NO: 2737866 - protein, 18 aa, Entamoeba histolytica
SAEEEMKTAKIKKTEEME

SEQ ID NO: 2737867 - protein, 13 aa, Entamoeba histolytica
SAEEGMEQNKRDV

SEQ ID NO: 2737868 - protein, 7 aa, Entamoeba histolytica
SAESYGV

SEQ ID NO: 2737869 - protein, 14 aa, Entamoeba histolytica
SAETRSIDQSVKTT

SEQ ID NO: 2737870 - protein, 6 aa, Entamoeba histolytica
SAGGND

SEQ ID NO: 2737871 - protein, 9 aa, Entamoeba histolytica
SAKNATNVD

SEQ ID NO: 2737872 - protein, 8 aa, Entamoeba histolytica
SAKTARCV

SEQ ID NO: 2737873 - protein, 9 aa, Entamoeba histolytica
SANDQLTQL

SEQ ID NO: 2737874 - protein, 10 aa, Entamoeba histolytica
SANGLGGESI

SEQ ID NO: 2737875 - protein, 10 aa, Entamoeba histolytica
SAQAPDTSNL

SEQ ID NO: 2737876 - protein, 8 aa, Entamoeba histolytica
SAQSTSLD

SEQ ID NO: 2737877 - protein, 6 aa, Entamoeba histolytica
SAQVAN

SEQ ID NO: 2737878 - protein, 15 aa, Entamoeba histolytica
SCDAGEARQIFIPVF

SEQ ID NO: 2737879 - protein, 4 aa, Entamoeba histolytica
SCDD

SEQ ID NO: 2737880 - protein, 4 aa, Entamoeba histolytica
SCEN

SEQ ID NO: 2737881 - protein, 11 aa, Entamoeba histolytica
SCEPGQLTPEG

SEQ ID NO: 2737882 - protein, 8 aa, Entamoeba histolytica
SCPGHSNS

SEQ ID NO: 2737883 - protein, 15 aa, Entamoeba histolytica
SDDSYNSKRHGIKDG

SEQ ID NO: 2737884 - protein, 8 aa, Entamoeba histolytica
SDEECKTV

SEQ ID NO: 2737885 - protein, 5 aa, Entamoeba histolytica
SDETL

SEQ ID NO: 2737886 - protein, 27 aa, Entamoeba histolytica
SDETQRRRYDLGGEEALKNPDRQNGFG

SEQ ID NO: 2737887 - protein, 4 aa, Entamoeba histolytica
SDEV

SEQ ID NO: 2737888 - protein, 6 aa, Entamoeba histolytica
SDGCLK

SEQ ID NO: 2737889 - protein, 23 aa, Entamoeba histolytica
SDGKPLAADYHDQKNVPSENDYS

SEQ ID NO: 2737890 - protein, 8 aa, Entamoeba histolytica
SDGSNKIR

SEQ ID NO: 2737891 - protein, 17 aa, Entamoeba histolytica
SDHKPNEISGYGDEKGI

SEQ ID NO: 2737892 - protein, 6 aa, Entamoeba histolytica
SDIETN

SEQ ID NO: 2737893 - protein, 14 aa, Entamoeba histolytica
SDKLLTTETNITGL

SEQ ID NO: 2737894 - protein, 9 aa, Entamoeba histolytica
SDKPFEEAC

SEQ ID NO: 2737895 - protein, 9 aa, Entamoeba histolytica
SDKRQREIY

SEQ ID NO: 2737896 - protein, 18 aa, Entamoeba histolytica
SDKTTCEGKDKDSCRKCN

SEQ ID NO: 2737897 - protein, 13 aa, Entamoeba histolytica
SDLEQYKPSKREM

SEQ ID NO: 2737898 - protein, 10 aa, Entamoeba histolytica
SDLTPKTDLS

SEQ ID NO: 2737899 - protein, 5 aa, Entamoeba histolytica
SDNNN

SEQ ID NO: 2737900 - protein, 6 aa, Entamoeba histolytica
SDNSTD

SEQ ID NO: 2737901 - protein, 4 aa, Entamoeba histolytica
SDPE

SEQ ID NO: 2737902 - protein, 8 aa, Entamoeba histolytica
SDQEQLPV

SEQ ID NO: 2737903 - protein, 8 aa, Entamoeba histolytica
SDSKEQKV

SEQ ID NO: 2737904 - protein, 8 aa, Entamoeba histolytica
SDSKNNIV

SEQ ID NO: 2737905 - protein, 17 aa, Entamoeba histolytica
SDSVPRKHTEDDTAGRC

SEQ ID NO: 2737906 - protein, 4 aa, Entamoeba histolytica
SDTN

SEQ ID NO: 2737907 - protein, 14 aa, Entamoeba histolytica
SDTRRAAAAGSESH

SEQ ID NO: 2737908 - protein, 6 aa, Entamoeba histolytica
SDVGSN

SEQ ID NO: 2737909 - protein, 5 aa, Entamoeba histolytica
SDVNS

SEQ ID NO: 2737910 - protein, 6 aa, Entamoeba histolytica
SDVQKY

SEQ ID NO: 2737911 - protein, 6 aa, Entamoeba histolytica
SECTND

SEQ ID NO: 2737912 - protein, 4 aa, Entamoeba histolytica
SEDC

SEQ ID NO: 2737913 - protein, 6 aa, Entamoeba histolytica
SEDIAD

SEQ ID NO: 2737914 - protein, 7 aa, Entamoeba histolytica
SEEGKWS

SEQ ID NO: 2737915 - protein, 8 aa, Entamoeba histolytica
SEGITDDK

SEQ ID NO: 2737916 - protein, 7 aa, Entamoeba histolytica
SEGQFDN

SEQ ID NO: 2737917 - protein, 11 aa, Entamoeba histolytica
SEGSSFNLNED

SEQ ID NO: 2737918 - protein, 5 aa, Entamoeba histolytica
SEIGE

SEQ ID NO: 2737919 - protein, 8 aa, Entamoeba histolytica
SEITGQQE

SEQ ID NO: 2737920 - protein, 6 aa, Entamoeba histolytica
SEKDGY

SEQ ID NO: 2737921 - protein, 9 aa, Entamoeba histolytica
SEKKTESQL

SEQ ID NO: 2737922 - protein, 4 aa, Entamoeba histolytica
SEKN

SEQ ID NO: 2737923 - protein, 8 aa, Entamoeba histolytica
SEKQTELK

SEQ ID NO: 2737924 - protein, 6 aa, Entamoeba histolytica
SEKSPC

SEQ ID NO: 2737925 - protein, 4 aa, Entamoeba histolytica
SELE

SEQ ID NO: 2737926 - protein, 20 aa, Entamoeba histolytica
SELKPLEKQMENVESQLSKE

SEQ ID NO: 2737927 - protein, 13 aa, Entamoeba histolytica
SELNGSLNRKNSL

SEQ ID NO: 2737928 - protein, 6 aa, Entamoeba histolytica
SELRDG

SEQ ID NO: 2737929 - protein, 6 aa, Entamoeba histolytica
SENNST

SEQ ID NO: 2737930 - protein, 5 aa, Entamoeba histolytica
SEPTC

SEQ ID NO: 2737931 - protein, 15 aa, Entamoeba histolytica
SEPTKAPSTNQPADH

SEQ ID NO: 2737932 - protein, 6 aa, Entamoeba histolytica
SEQKVE

SEQ ID NO: 2737933 - protein, 6 aa, Entamoeba histolytica
SEQNDL

SEQ ID NO: 2737934 - protein, 10 aa, Entamoeba histolytica
SERAEDKMEQ

SEQ ID NO: 2737935 - protein, 9 aa, Entamoeba histolytica
SESNTTGAI

SEQ ID NO: 2737936 - protein, 170 aa, Entamoeba histolytica
SETDVKPPASINVPTKPESQGVQPLSQDGNSQTTQPHGHEGEQHNEQQPIPERQPHPYNEHQPMPEQNPHPHNEKQPHVEQDQQKQYHNEHQPMPEKQQSDQNNEQHNEHQPPVPHDNTPKNDTPKNTDSQNNNNQNINNNQNNQSDNTNQNNQQDDKKNESKDKNKEKD

SEQ ID NO: 2737937 - protein, 16 aa, Entamoeba histolytica
SETKISITTYSETSSC

SEQ ID NO: 2737938 - protein, 14 aa, Entamoeba histolytica
SEVSGMGQAGIEEV

SEQ ID NO: 2737939 - protein, 4 aa, Entamoeba histolytica
SEYE

SEQ ID NO: 2737940 - protein, 9 aa, Entamoeba histolytica
SEYEGPRDL

SEQ ID NO: 2737941 - protein, 14 aa, Entamoeba histolytica
SFDPNKVPTLQSLQ

SEQ ID NO: 2737942 - protein, 6 aa, Entamoeba histolytica
SFEEEL

SEQ ID NO: 2737943 - protein, 6 aa, Entamoeba histolytica
SFETET

SEQ ID NO: 2737944 - protein, 15 aa, Entamoeba histolytica
SFGSTSQELTRTSDN

SEQ ID NO: 2737945 - protein, 4 aa, Entamoeba histolytica
SFHP

SEQ ID NO: 2737946 - protein, 4 aa, Entamoeba histolytica
SFIP

SEQ ID NO: 2737947 - protein, 9 aa, Entamoeba histolytica
SFKNEAEKK

SEQ ID NO: 2737948 - protein, 7 aa, Entamoeba histolytica
SFNRRSH

SEQ ID NO: 2737949 - protein, 14 aa, Entamoeba histolytica
SFPELSKQGAFNQE

SEQ ID NO: 2737950 - protein, 6 aa, Entamoeba histolytica
SFPQKS

SEQ ID NO: 2737951 - protein, 4 aa, Entamoeba histolytica
SGAG

SEQ ID NO: 2737952 - protein, 7 aa, Entamoeba histolytica
SGAKCVQ

SEQ ID NO: 2737953 - protein, 6 aa, Entamoeba histolytica
SGATEA

SEQ ID NO: 2737954 - protein, 10 aa, Entamoeba histolytica
SGAYTDTKCK

SEQ ID NO: 2737955 - protein, 8 aa, Entamoeba histolytica
SGCRKSTT

SEQ ID NO: 2737956 - protein, 4 aa, Entamoeba histolytica
SGDI

SEQ ID NO: 2737957 - protein, 10 aa, Entamoeba histolytica
SGDNSNKEIT

SEQ ID NO: 2737958 - protein, 12 aa, Entamoeba histolytica
SGDTHLGGSDFD

SEQ ID NO: 2737959 - protein, 9 aa, Entamoeba histolytica
SGETEGIPV

SEQ ID NO: 2737960 - protein, 5 aa, Entamoeba histolytica
SGGDM

SEQ ID NO: 2737961 - protein, 6 aa, Entamoeba histolytica
SGGDVG

SEQ ID NO: 2737962 - protein, 6 aa, Entamoeba histolytica
SGIPNT

SEQ ID NO: 2737963 - protein, 9 aa, Entamoeba histolytica
SGPTHQGQP

SEQ ID NO: 2737964 - protein, 4 aa, Entamoeba histolytica
SGRK

SEQ ID NO: 2737965 - protein, 21 aa, Entamoeba histolytica
SGSAAASSASSAASSVSSIPS

SEQ ID NO: 2737966 - protein, 16 aa, Entamoeba histolytica
SGSKENKYGKTTNTFN

SEQ ID NO: 2737967 - protein, 17 aa, Entamoeba histolytica
SGSLEVGKSSKNGLEYS

SEQ ID NO: 2737968 - protein, 13 aa, Entamoeba histolytica
SGTDGNCGSNPAA

SEQ ID NO: 2737969 - protein, 14 aa, Entamoeba histolytica
SGTDGNCGSTPANL

SEQ ID NO: 2737970 - protein, 9 aa, Entamoeba histolytica
SGTGFSSYS

SEQ ID NO: 2737971 - protein, 10 aa, Entamoeba histolytica
SGTSKDPKGV

SEQ ID NO: 2737972 - protein, 11 aa, Entamoeba histolytica
SGVKTETRRIG

SEQ ID NO: 2737973 - protein, 8 aa, Entamoeba histolytica
SGWGEGDN

SEQ ID NO: 2737974 - protein, 14 aa, Entamoeba histolytica
SGYSLNSNNECQEN

SEQ ID NO: 2737975 - protein, 9 aa, Entamoeba histolytica
SGYSTYNEN

SEQ ID NO: 2737976 - protein, 6 aa, Entamoeba histolytica
SHAAEL

SEQ ID NO: 2737977 - protein, 20 aa, Entamoeba histolytica
SHAAEVTAGYYNTNNQNAYT

SEQ ID NO: 2737978 - protein, 5 aa, Entamoeba histolytica
SHANA

SEQ ID NO: 2737979 - protein, 5 aa, Entamoeba histolytica
SHEHS

SEQ ID NO: 2737980 - protein, 9 aa, Entamoeba histolytica
SHGEDGPQY

SEQ ID NO: 2737981 - protein, 7 aa, Entamoeba histolytica
SHGNVND

SEQ ID NO: 2737982 - protein, 7 aa, Entamoeba histolytica
SHKPTLI

SEQ ID NO: 2737983 - protein, 4 aa, Entamoeba histolytica
SIAN

SEQ ID NO: 2737984 - protein, 16 aa, Entamoeba histolytica
SIATNSSQVIGTGGST

SEQ ID NO: 2737985 - protein, 6 aa, Entamoeba histolytica
SIDDEF

SEQ ID NO: 2737986 - protein, 13 aa, Entamoeba histolytica
SIEELDNSIEKTI

SEQ ID NO: 2737987 - protein, 5 aa, Entamoeba histolytica
SIEGK

SEQ ID NO: 2737988 - protein, 5 aa, Entamoeba histolytica
SIEYP

SEQ ID NO: 2737989 - protein, 10 aa, Entamoeba histolytica
SIKNEKNKSH

SEQ ID NO: 2737990 - protein, 8 aa, Entamoeba histolytica
SINESTVE

SEQ ID NO: 2737991 - protein, 9 aa, Entamoeba histolytica
SINPTSSSS

SEQ ID NO: 2737992 - protein, 16 aa, Entamoeba histolytica
SINSDEQATPKPTTLT

SEQ ID NO: 2737993 - protein, 4 aa, Entamoeba histolytica
SIPK

SEQ ID NO: 2737994 - protein, 6 aa, Entamoeba histolytica
SIPVSG

SEQ ID NO: 2737995 - protein, 4 aa, Entamoeba histolytica
SIQP

SEQ ID NO: 2737996 - protein, 7 aa, Entamoeba histolytica
SISGGNE

SEQ ID NO: 2737997 - protein, 8 aa, Entamoeba histolytica
SISGNETM

SEQ ID NO: 2737998 - protein, 6 aa, Entamoeba histolytica
SISPST

SEQ ID NO: 2737999 - protein, 7 aa, Entamoeba histolytica
SISTDSP

SEQ ID NO: 2738000 - protein, 6 aa, Entamoeba histolytica
SITNGA

SEQ ID NO: 2738001 - protein, 8 aa, Entamoeba histolytica
SKCKENCT

SEQ ID NO: 2738002 - protein, 8 aa, Entamoeba histolytica
SKDKKKTV

SEQ ID NO: 2738003 - protein, 8 aa, Entamoeba histolytica
SKDPNIRA

SEQ ID NO: 2738004 - protein, 4 aa, Entamoeba histolytica
SKED

SEQ ID NO: 2738005 - protein, 7 aa, Entamoeba histolytica
SKEDENK

SEQ ID NO: 2738006 - protein, 7 aa, Entamoeba histolytica
SKENKET

SEQ ID NO: 2738007 - protein, 7 aa, Entamoeba histolytica
SKERATK

SEQ ID NO: 2738008 - protein, 6 aa, Entamoeba histolytica
SKGFGE

SEQ ID NO: 2738009 - protein, 12 aa, Entamoeba histolytica
SKGIKTIDSDTI

SEQ ID NO: 2738010 - protein, 7 aa, Entamoeba histolytica
SKGLEGK

SEQ ID NO: 2738011 - protein, 29 aa, Entamoeba histolytica
SKGVFEGNQRSEEMKKRANEQRRKAADQA

SEQ ID NO: 2738012 - protein, 8 aa, Entamoeba histolytica
SKISSTKS

SEQ ID NO: 2738013 - protein, 7 aa, Entamoeba histolytica
SKITNIP

SEQ ID NO: 2738014 - protein, 6 aa, Entamoeba histolytica
SKITVT

SEQ ID NO: 2738015 - protein, 7 aa, Entamoeba histolytica
SKKALST

SEQ ID NO: 2738016 - protein, 9 aa, Entamoeba histolytica
SKKLADATK

SEQ ID NO: 2738017 - protein, 8 aa, Entamoeba histolytica
SKLEGIPE

SEQ ID NO: 2738018 - protein, 10 aa, Entamoeba histolytica
SKLKSGGVAG

SEQ ID NO: 2738019 - protein, 9 aa, Entamoeba histolytica
SKNTDRPKV

SEQ ID NO: 2738020 - protein, 7 aa, Entamoeba histolytica
SKPIKKS

SEQ ID NO: 2738021 - protein, 7 aa, Entamoeba histolytica
SKPTLTQ

SEQ ID NO: 2738022 - protein, 14 aa, Entamoeba histolytica
SKQATQSELKKAYR

SEQ ID NO: 2738023 - protein, 21 aa, Entamoeba histolytica
SKQKENKVKCNNHSRKNQNKS

SEQ ID NO: 2738024 - protein, 11 aa, Entamoeba histolytica
SKRTTEENGQV

SEQ ID NO: 2738025 - protein, 5 aa, Entamoeba histolytica
SKSPY

SEQ ID NO: 2738026 - protein, 12 aa, Entamoeba histolytica
SKTDEDDIEDLQ

SEQ ID NO: 2738027 - protein, 8 aa, Entamoeba histolytica
SKTDEHFK

SEQ ID NO: 2738028 - protein, 6 aa, Entamoeba histolytica
SKTIST

SEQ ID NO: 2738029 - protein, 14 aa, Entamoeba histolytica
SKTTDGRDQLSQNY

SEQ ID NO: 2738030 - protein, 50 aa, Entamoeba histolytica
SKVANTVSKYSGKAGKFGKAISSAANKVNKIGKAISKTSNTVSKASKKVG

SEQ ID NO: 2738031 - protein, 12 aa, Entamoeba histolytica
SKVESTTENSKN

SEQ ID NO: 2738032 - protein, 40 aa, Entamoeba histolytica
SKVQKQMKKAQKSLGAKSKKVSVKKASKLIKKSAKTEKKA

SEQ ID NO: 2738033 - protein, 11 aa, Entamoeba histolytica
SKVTKNAPKKV

SEQ ID NO: 2738034 - protein, 8 aa, Entamoeba histolytica
SKYNETTL

SEQ ID NO: 2738035 - protein, 9 aa, Entamoeba histolytica
SKYNQNNLD

SEQ ID NO: 2738036 - protein, 8 aa, Entamoeba histolytica
SLETFRKG

SEQ ID NO: 2738037 - protein, 5 aa, Entamoeba histolytica
SLGNE

SEQ ID NO: 2738038 - protein, 9 aa, Entamoeba histolytica
SLKQRSAEV

SEQ ID NO: 2738039 - protein, 9 aa, Entamoeba histolytica
SLLPKPPIV

SEQ ID NO: 2738040 - protein, 9 aa, Entamoeba histolytica
SLNPTNETS

SEQ ID NO: 2738041 - protein, 4 aa, Entamoeba histolytica
SLNS

SEQ ID NO: 2738042 - protein, 30 aa, Entamoeba histolytica
SLQGMSEAIESSSSLSGSATVSPALSPRIE

SEQ ID NO: 2738043 - protein, 5 aa, Entamoeba histolytica
SLSET

SEQ ID NO: 2738044 - protein, 6 aa, Entamoeba histolytica
SLTDSS

SEQ ID NO: 2738045 - protein, 12 aa, Entamoeba histolytica
SLTGAKHKETPL

SEQ ID NO: 2738046 - protein, 12 aa, Entamoeba histolytica
SMGTAKTQVEEM

SEQ ID NO: 2738047 - protein, 8 aa, Entamoeba histolytica
SNADLEDI

SEQ ID NO: 2738048 - protein, 13 aa, Entamoeba histolytica
SNAEPVSADNVRD

SEQ ID NO: 2738049 - protein, 4 aa, Entamoeba histolytica
SNEP

SEQ ID NO: 2738050 - protein, 10 aa, Entamoeba histolytica
SNEYETTSIE

SEQ ID NO: 2738051 - protein, 18 aa, Entamoeba histolytica
SNGDMKEKIETKRDELKT

SEQ ID NO: 2738052 - protein, 6 aa, Entamoeba histolytica
SNGDRI

SEQ ID NO: 2738053 - protein, 8 aa, Entamoeba histolytica
SNGKDTFN

SEQ ID NO: 2738054 - protein, 10 aa, Entamoeba histolytica
SNGKTYTAKQ

SEQ ID NO: 2738055 - protein, 14 aa, Entamoeba histolytica
SNGLNNKNQLKKDF

SEQ ID NO: 2738056 - protein, 8 aa, Entamoeba histolytica
SNGNEGGF

SEQ ID NO: 2738057 - protein, 16 aa, Entamoeba histolytica
SNGRLDGVSSKTSKSM

SEQ ID NO: 2738058 - protein, 8 aa, Entamoeba histolytica
SNGTTCEI

SEQ ID NO: 2738059 - protein, 5 aa, Entamoeba histolytica
SNHGW

SEQ ID NO: 2738060 - protein, 4 aa, Entamoeba histolytica
SNHP

SEQ ID NO: 2738061 - protein, 7 aa, Entamoeba histolytica
SNIPSSI

SEQ ID NO: 2738062 - protein, 9 aa, Entamoeba histolytica
SNKKESNTH

SEQ ID NO: 2738063 - protein, 6 aa, Entamoeba histolytica
SNKKNN

SEQ ID NO: 2738064 - protein, 10 aa, Entamoeba histolytica
SNKNNGCNGG

SEQ ID NO: 2738065 - protein, 9 aa, Entamoeba histolytica
SNKPAESQY

SEQ ID NO: 2738066 - protein, 7 aa, Entamoeba histolytica
SNKQYTS

SEQ ID NO: 2738067 - protein, 7 aa, Entamoeba histolytica
SNKTKVI

SEQ ID NO: 2738068 - protein, 6 aa, Entamoeba histolytica
SNNDCN

SEQ ID NO: 2738069 - protein, 6 aa, Entamoeba histolytica
SNNEKA

SEQ ID NO: 2738070 - protein, 8 aa, Entamoeba histolytica
SNNFGESI

SEQ ID NO: 2738071 - protein, 9 aa, Entamoeba histolytica
SNNKISGSI

SEQ ID NO: 2738072 - protein, 10 aa, Entamoeba histolytica
SNNKRSKAKL

SEQ ID NO: 2738073 - protein, 8 aa, Entamoeba histolytica
SNNLDNKR

SEQ ID NO: 2738074 - protein, 12 aa, Entamoeba histolytica
SNNLEGKLPSLS

SEQ ID NO: 2738075 - protein, 4 aa, Entamoeba histolytica
SNNM

SEQ ID NO: 2738076 - protein, 13 aa, Entamoeba histolytica
SNNNGCSGGWPTS

SEQ ID NO: 2738077 - protein, 8 aa, Entamoeba histolytica
SNNPPQGE

SEQ ID NO: 2738078 - protein, 18 aa, Entamoeba histolytica
SNNSTNQTNTTLSAPKLD

SEQ ID NO: 2738079 - protein, 34 aa, Entamoeba histolytica
SNQFEPKQESLQTNEQTTQPTVNSSQKKRWNLPP

SEQ ID NO: 2738080 - protein, 10 aa, Entamoeba histolytica
SNSNTDSNKL

SEQ ID NO: 2738081 - protein, 9 aa, Entamoeba histolytica
SNSNYNNEA

SEQ ID NO: 2738082 - protein, 6 aa, Entamoeba histolytica
SNSVSE

SEQ ID NO: 2738083 - protein, 14 aa, Entamoeba histolytica
SNTEEEARACVKLM

SEQ ID NO: 2738084 - protein, 8 aa, Entamoeba histolytica
SNTFTVDT

SEQ ID NO: 2738085 - protein, 6 aa, Entamoeba histolytica
SNWKDT

SEQ ID NO: 2738086 - protein, 10 aa, Entamoeba histolytica
SPDEEEVNVT

SEQ ID NO: 2738087 - protein, 5 aa, Entamoeba histolytica
SPEGR

SEQ ID NO: 2738088 - protein, 7 aa, Entamoeba histolytica
SPIDTAK

SEQ ID NO: 2738089 - protein, 4 aa, Entamoeba histolytica
SPIN

SEQ ID NO: 2738090 - protein, 7 aa, Entamoeba histolytica
SPKEIDD

SEQ ID NO: 2738091 - protein, 12 aa, Entamoeba histolytica
SPLRGTITPPSL

SEQ ID NO: 2738092 - protein, 8 aa, Entamoeba histolytica
SPNEEKWN

SEQ ID NO: 2738093 - protein, 8 aa, Entamoeba histolytica
SPNKASFQ

SEQ ID NO: 2738094 - protein, 8 aa, Entamoeba histolytica
SPNPDYWS

SEQ ID NO: 2738095 - protein, 15 aa, Entamoeba histolytica
SPQAQETFKKGGYYS

SEQ ID NO: 2738096 - protein, 10 aa, Entamoeba histolytica
SPSLKKYPKT

SEQ ID NO: 2738097 - protein, 8 aa, Entamoeba histolytica
SPSTGYNP

SEQ ID NO: 2738098 - protein, 12 aa, Entamoeba histolytica
SPTGDNDNKTTG

SEQ ID NO: 2738099 - protein, 7 aa, Entamoeba histolytica
SQAECRG

SEQ ID NO: 2738100 - protein, 18 aa, Entamoeba histolytica
SQDDPIAISSKGSRSRIS

SEQ ID NO: 2738101 - protein, 10 aa, Entamoeba histolytica
SQDEETYGRE

SEQ ID NO: 2738102 - protein, 25 aa, Entamoeba histolytica
SQDSNQQYRQTAVQPTGIHPTTTEA

SEQ ID NO: 2738103 - protein, 13 aa, Entamoeba histolytica
SQDTIKAEPHPSG

SEQ ID NO: 2738104 - protein, 7 aa, Entamoeba histolytica
SQGEYSN

SEQ ID NO: 2738105 - protein, 4 aa, Entamoeba histolytica
SQGF

SEQ ID NO: 2738106 - protein, 7 aa, Entamoeba histolytica
SQKPSTF

SEQ ID NO: 2738107 - protein, 7 aa, Entamoeba histolytica
SQNFEQD

SEQ ID NO: 2738108 - protein, 6 aa, Entamoeba histolytica
SQNTGR

SEQ ID NO: 2738109 - protein, 6 aa, Entamoeba histolytica
SQPDKH

SEQ ID NO: 2738110 - protein, 10 aa, Entamoeba histolytica
SQPDKTHKQY

SEQ ID NO: 2738111 - protein, 4 aa, Entamoeba histolytica
SQPI

SEQ ID NO: 2738112 - protein, 13 aa, Entamoeba histolytica
SQSNIISTNKSNY

SEQ ID NO: 2738113 - protein, 6 aa, Entamoeba histolytica
SQSPFV

SEQ ID NO: 2738114 - protein, 4 aa, Entamoeba histolytica
SQTL

SEQ ID NO: 2738115 - protein, 10 aa, Entamoeba histolytica
SQTPLPSDCD

SEQ ID NO: 2738116 - protein, 11 aa, Entamoeba histolytica
SQTSSLKTNKK

SEQ ID NO: 2738117 - protein, 5 aa, Entamoeba histolytica
SQTVD

SEQ ID NO: 2738118 - protein, 7 aa, Entamoeba histolytica
SREDHGT

SEQ ID NO: 2738119 - protein, 9 aa, Entamoeba histolytica
SRGDVPESV

SEQ ID NO: 2738120 - protein, 6 aa, Entamoeba histolytica
SRGLYE

SEQ ID NO: 2738121 - protein, 5 aa, Entamoeba histolytica
SRINS

SEQ ID NO: 2738122 - protein, 6 aa, Entamoeba histolytica
SRKALS

SEQ ID NO: 2738123 - protein, 9 aa, Entamoeba histolytica
SRKSEIERR

SEQ ID NO: 2738124 - protein, 9 aa, Entamoeba histolytica
SRMGTRKQY

SEQ ID NO: 2738125 - protein, 9 aa, Entamoeba histolytica
SRMGTRQQY

SEQ ID NO: 2738126 - protein, 12 aa, Entamoeba histolytica
SRNEAKKEAKKV

SEQ ID NO: 2738127 - protein, 7 aa, Entamoeba histolytica
SRNITEN

SEQ ID NO: 2738128 - protein, 12 aa, Entamoeba histolytica
SRPTMKQYNGDM

SEQ ID NO: 2738129 - protein, 20 aa, Entamoeba histolytica
SRPWEKGKEPLRSLTYSVVI

SEQ ID NO: 2738130 - protein, 4 aa, Entamoeba histolytica
SRSK

SEQ ID NO: 2738131 - protein, 15 aa, Entamoeba histolytica
SRSTPEEIDQYRNSS

SEQ ID NO: 2738132 - protein, 7 aa, Entamoeba histolytica
SRSYKAP

SEQ ID NO: 2738133 - protein, 4 aa, Entamoeba histolytica
SRVK

SEQ ID NO: 2738134 - protein, 8 aa, Entamoeba histolytica
SSAKQLEQ

SEQ ID NO: 2738135 - protein, 7 aa, Entamoeba histolytica
SSAMTPK

SEQ ID NO: 2738136 - protein, 7 aa, Entamoeba histolytica
SSAPVYA

SEQ ID NO: 2738137 - protein, 27 aa, Entamoeba histolytica
SSCESKLNTLKEGRKNIKNEIRKEKSK

SEQ ID NO: 2738138 - protein, 83 aa, Entamoeba histolytica
SSDKDSDNNSLLKDKKSKSSSGTKTKRNVKPKKTNKPKSVKRTKKPVTKPKTTTKPVAKPKKTNKSKTVTKPRTTTKSNRKVM

SEQ ID NO: 2738139 - protein, 9 aa, Entamoeba histolytica
SSEDNMGRS

SEQ ID NO: 2738140 - protein, 5 aa, Entamoeba histolytica
SSFSV

SEQ ID NO: 2738141 - protein, 13 aa, Entamoeba histolytica
SSGIADAGFKSGD

SEQ ID NO: 2738142 - protein, 7 aa, Entamoeba histolytica
SSGKQNG

SEQ ID NO: 2738143 - protein, 9 aa, Entamoeba histolytica
SSGKTGRAL

SEQ ID NO: 2738144 - protein, 5 aa, Entamoeba histolytica
SSGSM

SEQ ID NO: 2738145 - protein, 11 aa, Entamoeba histolytica
SSHAAEATAGY

SEQ ID NO: 2738146 - protein, 18 aa, Entamoeba histolytica
SSKEGSGVQWAKNFIREN

SEQ ID NO: 2738147 - protein, 16 aa, Entamoeba histolytica
SSKKQTHTENFITHFM

SEQ ID NO: 2738148 - protein, 9 aa, Entamoeba histolytica
SSKRGSGVQ

SEQ ID NO: 2738149 - protein, 6 aa, Entamoeba histolytica
SSKTTH

SEQ ID NO: 2738150 - protein, 10 aa, Entamoeba histolytica
SSLGPKEEPI

SEQ ID NO: 2738151 - protein, 6 aa, Entamoeba histolytica
SSLNKT

SEQ ID NO: 2738152 - protein, 6 aa, Entamoeba histolytica
SSNNYS

SEQ ID NO: 2738153 - protein, 12 aa, Entamoeba histolytica
SSNRNFKEKRNG

SEQ ID NO: 2738154 - protein, 5 aa, Entamoeba histolytica
SSNST

SEQ ID NO: 2738155 - protein, 6 aa, Entamoeba histolytica
SSPALK

SEQ ID NO: 2738156 - protein, 6 aa, Entamoeba histolytica
SSPNIT

SEQ ID NO: 2738157 - protein, 6 aa, Entamoeba histolytica
SSPQEL

SEQ ID NO: 2738158 - protein, 5 aa, Entamoeba histolytica
SSPSY

SEQ ID NO: 2738159 - protein, 9 aa, Entamoeba histolytica
SSQTASRRE

SEQ ID NO: 2738160 - protein, 11 aa, Entamoeba histolytica
SSSDSSLSSLS

SEQ ID NO: 2738161 - protein, 5 aa, Entamoeba histolytica
SSSLL

SEQ ID NO: 2738162 - protein, 9 aa, Entamoeba histolytica
SSSNSRPST

SEQ ID NO: 2738163 - protein, 140 aa, Entamoeba histolytica
SSSSNSYSYSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSSNSYSSSSSYST

SEQ ID NO: 2738164 - protein, 359 aa, Entamoeba histolytica
SSSTKSSSEYPSQEKSSTGVSSEERSYSDISSSEKKSSEEPTTPSTGVSSEEHSYSDHSCPDISSSEKKSSEEHSYSDHSCPDHSCPDHSCPDHSCPDHSCPDHSCPDHSCPDHSCPDHSCPDHSCPDISSSEKKSSEEHSYSDHSCPDHSCPDHSCPDHSCPDHSCPDHSCPDHSCPDHSCPDISSSEKKSSEEPTTPSIGVSSEEHSYSDISSSEKKSSEEPTTPSTGVSSEEHSYSDISSSDKKSSEEPTTPSTGVSSEEPTTPSTGVSSEEHSYSDISSSDKKSSEEPTTPSTGVSSEEPTTPSIGISSEEHSCPEHSCPDTSSSDKKSSEEPPCSDDTCISSEENSNSGDFQCT

SEQ ID NO: 2738165 - protein, 8 aa, Entamoeba histolytica
SSSVENNV

SEQ ID NO: 2738166 - protein, 16 aa, Entamoeba histolytica
SSTENGYCGDEDNGQM

SEQ ID NO: 2738167 - protein, 5 aa, Entamoeba histolytica
SSTNA

SEQ ID NO: 2738168 - protein, 73 aa, Entamoeba histolytica
SSVKKSVKKDEKKKIVDKAKGEKKEIKKDVKKQQKKLDKAKKEVAKAEKKIQQTTSKTTQKKQQKKLAQAQKK

SEQ ID NO: 2738169 - protein, 13 aa, Entamoeba histolytica
SSVTGQSSYSGYI

SEQ ID NO: 2738170 - protein, 7 aa, Entamoeba histolytica
SSWGSNG

SEQ ID NO: 2738171 - protein, 288 aa, Entamoeba histolytica
SSYIPTTSSSSPVHSSSVPVHSSSHPVRSSSIPIRSSSTPVKSSSHPVHSSSTPVKSSSVPIHSSSHPVHSSSTPVQSSSHPVHSSSHPVHSSSHPVHSSSVPVHSSSHPVHSSSVPVHSSSHPVHSSSVPVHSSSHPVHSSSTPVQSSSHPVHSSSVPVHSSSTPVQSSSHPVHSSSHPVQSSSHPVHSSSVPVHSSSVPVHSSSVPVHSSSHPVHSSSVPVHSSSHPVHSSSTPVQSSSHPVHSSSVPVQSSSTPVHSSSSPKHGSSSVPKFDSSEPKKCPPEKKD

SEQ ID NO: 2738172 - protein, 11 aa, Entamoeba histolytica
SSYNTCDGKCK

SEQ ID NO: 2738173 - protein, 8 aa, Entamoeba histolytica
SSYPGVTH

SEQ ID NO: 2738174 - protein, 6 aa, Entamoeba histolytica
SSYSKY

SEQ ID NO: 2738175 - protein, 5 aa, Entamoeba histolytica
STAHS

SEQ ID NO: 2738176 - protein, 13 aa, Entamoeba histolytica
STDDVEKSKEVLN

SEQ ID NO: 2738177 - protein, 8 aa, Entamoeba histolytica
STDDVSPE

SEQ ID NO: 2738178 - protein, 11 aa, Entamoeba histolytica
STDGKSLRTDM

SEQ ID NO: 2738179 - protein, 14 aa, Entamoeba histolytica
STERSRTIQSSQAF

SEQ ID NO: 2738180 - protein, 7 aa, Entamoeba histolytica
STGERYT

SEQ ID NO: 2738181 - protein, 5 aa, Entamoeba histolytica
STGFK

SEQ ID NO: 2738182 - protein, 24 aa, Entamoeba histolytica
STGSFDTNAPQTLKNANAAGFSIE

SEQ ID NO: 2738183 - protein, 7 aa, Entamoeba histolytica
STGSWDP

SEQ ID NO: 2738184 - protein, 7 aa, Entamoeba histolytica
STHPQYG

SEQ ID NO: 2738185 - protein, 22 aa, Entamoeba histolytica
STKGTKSTIKTPISGKVSGSYK

SEQ ID NO: 2738186 - protein, 6 aa, Entamoeba histolytica
STKGYQ

SEQ ID NO: 2738187 - protein, 5 aa, Entamoeba histolytica
STKSN

SEQ ID NO: 2738188 - protein, 11 aa, Entamoeba histolytica
STKTRNAEKEV

SEQ ID NO: 2738189 - protein, 7 aa, Entamoeba histolytica
STKYYQQ

SEQ ID NO: 2738190 - protein, 7 aa, Entamoeba histolytica
STLKSDS

SEQ ID NO: 2738191 - protein, 16 aa, Entamoeba histolytica
STNTIKTNDTQQNIKK

SEQ ID NO: 2738192 - protein, 9 aa, Entamoeba histolytica
STPNPKSYK

SEQ ID NO: 2738193 - protein, 6 aa, Entamoeba histolytica
STPSEM

SEQ ID NO: 2738194 - protein, 4 aa, Entamoeba histolytica
STQK

SEQ ID NO: 2738195 - protein, 6 aa, Entamoeba histolytica
STRIPK

SEQ ID NO: 2738196 - protein, 22 aa, Entamoeba histolytica
STSASESLKQAQQNPEHKGDLK

SEQ ID NO: 2738197 - protein, 15 aa, Entamoeba histolytica
STSGDLDGQDNSSRF

SEQ ID NO: 2738198 - protein, 15 aa, Entamoeba histolytica
STSGDLDGQDSGSRF

SEQ ID NO: 2738199 - protein, 21 aa, Entamoeba histolytica
STSGGRSNLCSSKSHKQVHYS

SEQ ID NO: 2738200 - protein, 4 aa, Entamoeba histolytica
STTP

SEQ ID NO: 2738201 - protein, 10 aa, Entamoeba histolytica
STTPNRAEGY

SEQ ID NO: 2738202 - protein, 9 aa, Entamoeba histolytica
STVKNSENK

SEQ ID NO: 2738203 - protein, 5 aa, Entamoeba histolytica
STVQE

SEQ ID NO: 2738204 - protein, 8 aa, Entamoeba histolytica
STYNGGST

SEQ ID NO: 2738205 - protein, 4 aa, Entamoeba histolytica
STYP

SEQ ID NO: 2738206 - protein, 7 aa, Entamoeba histolytica
STYSNPS

SEQ ID NO: 2738207 - protein, 4 aa, Entamoeba histolytica
SVAK

SEQ ID NO: 2738208 - protein, 16 aa, Entamoeba histolytica
SVATNSSQVAGTGPST

SEQ ID NO: 2738209 - protein, 9 aa, Entamoeba histolytica
SVDDESDPY

SEQ ID NO: 2738210 - protein, 21 aa, Entamoeba histolytica
SVEAQKEGNQKPKEEIKEEQR

SEQ ID NO: 2738211 - protein, 5 aa, Entamoeba histolytica
SVKDY

SEQ ID NO: 2738212 - protein, 12 aa, Entamoeba histolytica
SVPKKGKEEFIS

SEQ ID NO: 2738213 - protein, 22 aa, Entamoeba histolytica
SVPNPSPYCTNGQRSHNASDGL

SEQ ID NO: 2738214 - protein, 6 aa, Entamoeba histolytica
SVPQQG

SEQ ID NO: 2738215 - protein, 8 aa, Entamoeba histolytica
SVRDGDTT

SEQ ID NO: 2738216 - protein, 15 aa, Entamoeba histolytica
SVRESDSIGKAGDTI

SEQ ID NO: 2738217 - protein, 4 aa, Entamoeba histolytica
SVSG

SEQ ID NO: 2738218 - protein, 11 aa, Entamoeba histolytica
SVSVPDKKYSL

SEQ ID NO: 2738219 - protein, 6 aa, Entamoeba histolytica
SVTKID

SEQ ID NO: 2738220 - protein, 17 aa, Entamoeba histolytica
SVTKIDNNQNDNEETVQ

SEQ ID NO: 2738221 - protein, 17 aa, Entamoeba histolytica
SWDPNAKGINNNALSAG

SEQ ID NO: 2738222 - protein, 9 aa, Entamoeba histolytica
SYAAGSGLK

SEQ ID NO: 2738223 - protein, 7 aa, Entamoeba histolytica
SYDDDEH

SEQ ID NO: 2738224 - protein, 13 aa, Entamoeba histolytica
SYDDGSIKSTITT

SEQ ID NO: 2738225 - protein, 6 aa, Entamoeba histolytica
SYENPT

SEQ ID NO: 2738226 - protein, 10 aa, Entamoeba histolytica
SYENTVNSTG

SEQ ID NO: 2738227 - protein, 4 aa, Entamoeba histolytica
SYGN

SEQ ID NO: 2738228 - protein, 17 aa, Entamoeba histolytica
SYIGDGDPNYYPSPTID

SEQ ID NO: 2738229 - protein, 8 aa, Entamoeba histolytica
SYPTQYDN

SEQ ID NO: 2738230 - protein, 6 aa, Entamoeba histolytica
SYSGNL

SEQ ID NO: 2738231 - protein, 6 aa, Entamoeba histolytica
SYSPEA

SEQ ID NO: 2738232 - protein, 5 aa, Entamoeba histolytica
SYSQQ

SEQ ID NO: 2738233 - protein, 9 aa, Entamoeba histolytica
SYSRDPDAR

SEQ ID NO: 2738234 - protein, 8 aa, Entamoeba histolytica
TADISDAA

SEQ ID NO: 2738235 - protein, 14 aa, Entamoeba histolytica
TAEEERKVCPNAQD

SEQ ID NO: 2738236 - protein, 5 aa, Entamoeba histolytica
TAERI

SEQ ID NO: 2738237 - protein, 7 aa, Entamoeba histolytica
TAETPNK

SEQ ID NO: 2738238 - protein, 9 aa, Entamoeba histolytica
TAGSEKFRS

SEQ ID NO: 2738239 - protein, 29 aa, Entamoeba histolytica
TAKAKAKEAAKAAYKKTMKKSVKQAPSCN

SEQ ID NO: 2738240 - protein, 12 aa, Entamoeba histolytica
TAKIQNNEEDRI

SEQ ID NO: 2738241 - protein, 12 aa, Entamoeba histolytica
TAKIQNNEEQRI

SEQ ID NO: 2738242 - protein, 16 aa, Entamoeba histolytica
TALGLQPSAFKSKSAD

SEQ ID NO: 2738243 - protein, 7 aa, Entamoeba histolytica
TAPATQA

SEQ ID NO: 2738244 - protein, 6 aa, Entamoeba histolytica
TAPKRG

SEQ ID NO: 2738245 - protein, 23 aa, Entamoeba histolytica
TASSKDWRAEGKVTPVRDQGNCG

SEQ ID NO: 2738246 - protein, 7 aa, Entamoeba histolytica
TASSPLN

SEQ ID NO: 2738247 - protein, 9 aa, Entamoeba histolytica
TASSPSKEE

SEQ ID NO: 2738248 - protein, 10 aa, Entamoeba histolytica
TATIRSERTK

SEQ ID NO: 2738249 - protein, 8 aa, Entamoeba histolytica
TATQFSKG

SEQ ID NO: 2738250 - protein, 7 aa, Entamoeba histolytica
TATSKEE

SEQ ID NO: 2738251 - protein, 36 aa, Entamoeba histolytica
TCNSNNGQFGCNGNDISMKPSAEESRWQTPPRGSED

SEQ ID NO: 2738252 - protein, 6 aa, Entamoeba histolytica
TCPCSG

SEQ ID NO: 2738253 - protein, 4 aa, Entamoeba histolytica
TCPN

SEQ ID NO: 2738254 - protein, 5 aa, Entamoeba histolytica
TCPRN

SEQ ID NO: 2738255 - protein, 13 aa, Entamoeba histolytica
TCSSCSKDSDENY

SEQ ID NO: 2738256 - protein, 6 aa, Entamoeba histolytica
TCSSEM

SEQ ID NO: 2738257 - protein, 16 aa, Entamoeba histolytica
TDAGVYNSKPSDTSFF

SEQ ID NO: 2738258 - protein, 5 aa, Entamoeba histolytica
TDDAP

SEQ ID NO: 2738259 - protein, 8 aa, Entamoeba histolytica
TDDERGKC

SEQ ID NO: 2738260 - protein, 7 aa, Entamoeba histolytica
TDDFDSS

SEQ ID NO: 2738261 - protein, 13 aa, Entamoeba histolytica
TDEEENKNESDDV

SEQ ID NO: 2738262 - protein, 5 aa, Entamoeba histolytica
TDGEF

SEQ ID NO: 2738263 - protein, 6 aa, Entamoeba histolytica
TDGISV

SEQ ID NO: 2738264 - protein, 9 aa, Entamoeba histolytica
TDKCTKTEN

SEQ ID NO: 2738265 - protein, 11 aa, Entamoeba histolytica
TDKKPHGPAGV

SEQ ID NO: 2738266 - protein, 7 aa, Entamoeba histolytica
TDNNNQQ

SEQ ID NO: 2738267 - protein, 13 aa, Entamoeba histolytica
TDPISNKPRNQIA

SEQ ID NO: 2738268 - protein, 13 aa, Entamoeba histolytica
TDPLTEGRPGATI

SEQ ID NO: 2738269 - protein, 8 aa, Entamoeba histolytica
TDPTGAEI

SEQ ID NO: 2738270 - protein, 7 aa, Entamoeba histolytica
TDQSQST

SEQ ID NO: 2738271 - protein, 16 aa, Entamoeba histolytica
TDSGSALSCASGTDCK

SEQ ID NO: 2738272 - protein, 12 aa, Entamoeba histolytica
TDSITSKEEINK

SEQ ID NO: 2738273 - protein, 7 aa, Entamoeba histolytica
TDSPKYH

SEQ ID NO: 2738274 - protein, 8 aa, Entamoeba histolytica
TDSRHKPY

SEQ ID NO: 2738275 - protein, 10 aa, Entamoeba histolytica
TDSSVTSESI

SEQ ID NO: 2738276 - protein, 7 aa, Entamoeba histolytica
TDTISFK

SEQ ID NO: 2738277 - protein, 6 aa, Entamoeba histolytica
TDTNTI

SEQ ID NO: 2738278 - protein, 15 aa, Entamoeba histolytica
TDTTNCQHQTGKKWK

SEQ ID NO: 2738279 - protein, 7 aa, Entamoeba histolytica
TDVETLS

SEQ ID NO: 2738280 - protein, 5 aa, Entamoeba histolytica
TEDLP

SEQ ID NO: 2738281 - protein, 17 aa, Entamoeba histolytica
TEDLTKGYTVNYSDGDN

SEQ ID NO: 2738282 - protein, 10 aa, Entamoeba histolytica
TEEENKHVSN

SEQ ID NO: 2738283 - protein, 15 aa, Entamoeba histolytica
TEEGLKEQEYQGQYD

SEQ ID NO: 2738284 - protein, 4 aa, Entamoeba histolytica
TEEN

SEQ ID NO: 2738285 - protein, 4 aa, Entamoeba histolytica
TEGK

SEQ ID NO: 2738286 - protein, 8 aa, Entamoeba histolytica
TEGKTAYE

SEQ ID NO: 2738287 - protein, 9 aa, Entamoeba histolytica
TEGTPGKCI

SEQ ID NO: 2738288 - protein, 4 aa, Entamoeba histolytica
TEHY

SEQ ID NO: 2738289 - protein, 8 aa, Entamoeba histolytica
TEIKEEDD

SEQ ID NO: 2738290 - protein, 9 aa, Entamoeba histolytica
TENDTDPID

SEQ ID NO: 2738291 - protein, 6 aa, Entamoeba histolytica
TENEYV

SEQ ID NO: 2738292 - protein, 9 aa, Entamoeba histolytica
TENIQTNSL

SEQ ID NO: 2738293 - protein, 9 aa, Entamoeba histolytica
TEPNPKSKI

SEQ ID NO: 2738294 - protein, 6 aa, Entamoeba histolytica
TESEEA

SEQ ID NO: 2738295 - protein, 9 aa, Entamoeba histolytica
TESGEKECF

SEQ ID NO: 2738296 - protein, 13 aa, Entamoeba histolytica
TESIVNKEERNRE

SEQ ID NO: 2738297 - protein, 4 aa, Entamoeba histolytica
TESN

SEQ ID NO: 2738298 - protein, 4 aa, Entamoeba histolytica
TESQ

SEQ ID NO: 2738299 - protein, 11 aa, Entamoeba histolytica
TESRENKFRKA

SEQ ID NO: 2738300 - protein, 10 aa, Entamoeba histolytica
TESSTNTNEY

SEQ ID NO: 2738301 - protein, 24 aa, Entamoeba histolytica
TETPRNLASGFDSPIHKETEEALK

SEQ ID NO: 2738302 - protein, 31 aa, Entamoeba histolytica
TEYNGQECTTEKINVGNNKYTIDKDKEVQAV

SEQ ID NO: 2738303 - protein, 16 aa, Entamoeba histolytica
TFREEEHKQRKTVKEI

SEQ ID NO: 2738304 - protein, 10 aa, Entamoeba histolytica
TFSESNKPLV

SEQ ID NO: 2738305 - protein, 12 aa, Entamoeba histolytica
TFSRSDEIQSFE

SEQ ID NO: 2738306 - protein, 5 aa, Entamoeba histolytica
TFTIN

SEQ ID NO: 2738307 - protein, 6 aa, Entamoeba histolytica
TGATGV

SEQ ID NO: 2738308 - protein, 5 aa, Entamoeba histolytica
TGDLK

SEQ ID NO: 2738309 - protein, 10 aa, Entamoeba histolytica
TGENGAKDYV

SEQ ID NO: 2738310 - protein, 9 aa, Entamoeba histolytica
TGFQSGSSY

SEQ ID NO: 2738311 - protein, 6 aa, Entamoeba histolytica
TGGGND

SEQ ID NO: 2738312 - protein, 6 aa, Entamoeba histolytica
TGGQIE

SEQ ID NO: 2738313 - protein, 5 aa, Entamoeba histolytica
TGHDS

SEQ ID NO: 2738314 - protein, 6 aa, Entamoeba histolytica
TGIAES

SEQ ID NO: 2738315 - protein, 11 aa, Entamoeba histolytica
TGIKEKTQDVI

SEQ ID NO: 2738316 - protein, 15 aa, Entamoeba histolytica
TGKEVYNSCGIGWRG

SEQ ID NO: 2738317 - protein, 13 aa, Entamoeba histolytica
TGKTIRKTKLPNS

SEQ ID NO: 2738318 - protein, 4 aa, Entamoeba histolytica
TGLP

SEQ ID NO: 2738319 - protein, 7 aa, Entamoeba histolytica
TGLYGKS

SEQ ID NO: 2738320 - protein, 4 aa, Entamoeba histolytica
TGNI

SEQ ID NO: 2738321 - protein, 4 aa, Entamoeba histolytica
TGNK

SEQ ID NO: 2738322 - protein, 5 aa, Entamoeba histolytica
TGNQR

SEQ ID NO: 2738323 - protein, 10 aa, Entamoeba histolytica
TGNSCNECTS

SEQ ID NO: 2738324 - protein, 4 aa, Entamoeba histolytica
TGPF

SEQ ID NO: 2738325 - protein, 6 aa, Entamoeba histolytica
TGPGLK

SEQ ID NO: 2738326 - protein, 11 aa, Entamoeba histolytica
TGQTKENPELT

SEQ ID NO: 2738327 - protein, 4 aa, Entamoeba histolytica
TGRT

SEQ ID NO: 2738328 - protein, 8 aa, Entamoeba histolytica
TGSCDNTE

SEQ ID NO: 2738329 - protein, 5 aa, Entamoeba histolytica
THEQI

SEQ ID NO: 2738330 - protein, 12 aa, Entamoeba histolytica
THETEAAADSVY

SEQ ID NO: 2738331 - protein, 10 aa, Entamoeba histolytica
THKNRKAQLK

SEQ ID NO: 2738332 - protein, 4 aa, Entamoeba histolytica
THNP

SEQ ID NO: 2738333 - protein, 4 aa, Entamoeba histolytica
THTG

SEQ ID NO: 2738334 - protein, 10 aa, Entamoeba histolytica
TIEEESAKVN

SEQ ID NO: 2738335 - protein, 16 aa, Entamoeba histolytica
TIGESQQINKFSNKEQ

SEQ ID NO: 2738336 - protein, 17 aa, Entamoeba histolytica
TIGMKQGKQGWEPQPGY

SEQ ID NO: 2738337 - protein, 4 aa, Entamoeba histolytica
TIHT

SEQ ID NO: 2738338 - protein, 18 aa, Entamoeba histolytica
TIKGEEVDGAGEEKFAQF

SEQ ID NO: 2738339 - protein, 13 aa, Entamoeba histolytica
TIKTQKNKSHKKH

SEQ ID NO: 2738340 - protein, 4 aa, Entamoeba histolytica
TINE

SEQ ID NO: 2738341 - protein, 17 aa, Entamoeba histolytica
TINNTTTPVNTTKPINP

SEQ ID NO: 2738342 - protein, 6 aa, Entamoeba histolytica
TINSKS

SEQ ID NO: 2738343 - protein, 7 aa, Entamoeba histolytica
TIPIQGQ

SEQ ID NO: 2738344 - protein, 8 aa, Entamoeba histolytica
TIQPTKEC

SEQ ID NO: 2738345 - protein, 6 aa, Entamoeba histolytica
TIQTTG

SEQ ID NO: 2738346 - protein, 20 aa, Entamoeba histolytica
TISDNSDNSEDNESEIEERE

SEQ ID NO: 2738347 - protein, 12 aa, Entamoeba histolytica
TISFGDSTGYTP

SEQ ID NO: 2738348 - protein, 5 aa, Entamoeba histolytica
TISSG

SEQ ID NO: 2738349 - protein, 8 aa, Entamoeba histolytica
TITAQTKA

SEQ ID NO: 2738350 - protein, 18 aa, Entamoeba histolytica
TITEEKKKENVLNENEKV

SEQ ID NO: 2738351 - protein, 7 aa, Entamoeba histolytica
TITGSGI

SEQ ID NO: 2738352 - protein, 8 aa, Entamoeba histolytica
TITNNKEV

SEQ ID NO: 2738353 - protein, 15 aa, Entamoeba histolytica
TITQSSDVSTPSINV

SEQ ID NO: 2738354 - protein, 6 aa, Entamoeba histolytica
TITSDG

SEQ ID NO: 2738355 - protein, 7 aa, Entamoeba histolytica
TITSTTS

SEQ ID NO: 2738356 - protein, 5 aa, Entamoeba histolytica
TIYGT

SEQ ID NO: 2738357 - protein, 18 aa, Entamoeba histolytica
TKAQRTSKQNENKTKNKK

SEQ ID NO: 2738358 - protein, 16 aa, Entamoeba histolytica
TKDIEKQNRTAEEQAR

SEQ ID NO: 2738359 - protein, 8 aa, Entamoeba histolytica
TKDTKDPL

SEQ ID NO: 2738360 - protein, 14 aa, Entamoeba histolytica
TKEAIEELKKKENS

SEQ ID NO: 2738361 - protein, 6 aa, Entamoeba histolytica
TKEGIK

SEQ ID NO: 2738362 - protein, 15 aa, Entamoeba histolytica
TKEKGRHNKQKHPVR

SEQ ID NO: 2738363 - protein, 36 aa, Entamoeba histolytica
TKGNTLSRDDSVTESVTESESNSATPASFKNKNQRK

SEQ ID NO: 2738364 - protein, 10 aa, Entamoeba histolytica
TKGNTTIEQT

SEQ ID NO: 2738365 - protein, 14 aa, Entamoeba histolytica
TKGRKSGTESEKND

SEQ ID NO: 2738366 - protein, 13 aa, Entamoeba histolytica
TKITRNSSNINLT

SEQ ID NO: 2738367 - protein, 7 aa, Entamoeba histolytica
TKKDNIA

SEQ ID NO: 2738368 - protein, 24 aa, Entamoeba histolytica
TKKIAKSAEKTKKDGKDAAHSTNV

SEQ ID NO: 2738369 - protein, 9 aa, Entamoeba histolytica
TKKQEKEVS

SEQ ID NO: 2738370 - protein, 4 aa, Entamoeba histolytica
TKNE

SEQ ID NO: 2738371 - protein, 6 aa, Entamoeba histolytica
TKNEDA

SEQ ID NO: 2738372 - protein, 6 aa, Entamoeba histolytica
TKNTTI

SEQ ID NO: 2738373 - protein, 7 aa, Entamoeba histolytica
TKNVEKA

SEQ ID NO: 2738374 - protein, 10 aa, Entamoeba histolytica
TKPTEKAKNV

SEQ ID NO: 2738375 - protein, 8 aa, Entamoeba histolytica
TKQPTNTY

SEQ ID NO: 2738376 - protein, 5 aa, Entamoeba histolytica
TKSLE

SEQ ID NO: 2738377 - protein, 13 aa, Entamoeba histolytica
TKSRKNKNGFSPL

SEQ ID NO: 2738378 - protein, 40 aa, Entamoeba histolytica
TKSTAKVASSVAKEPAKTEEKKTEVKAAVKKAEKKVEKKV

SEQ ID NO: 2738379 - protein, 8 aa, Entamoeba histolytica
TKTEGDVS

SEQ ID NO: 2738380 - protein, 8 aa, Entamoeba histolytica
TKTKQNLE

SEQ ID NO: 2738381 - protein, 14 aa, Entamoeba histolytica
TKTSQCVNKTNLQT

SEQ ID NO: 2738382 - protein, 8 aa, Entamoeba histolytica
TKVIGKNE

SEQ ID NO: 2738383 - protein, 12 aa, Entamoeba histolytica
TKVPRNNEAELK

SEQ ID NO: 2738384 - protein, 8 aa, Entamoeba histolytica
TKVPSTSM

SEQ ID NO: 2738385 - protein, 4 aa, Entamoeba histolytica
TLAY

SEQ ID NO: 2738386 - protein, 7 aa, Entamoeba histolytica
TLESNPV

SEQ ID NO: 2738387 - protein, 8 aa, Entamoeba histolytica
TLKKPNSE

SEQ ID NO: 2738388 - protein, 14 aa, Entamoeba histolytica
TLLPKQSVKKIVEK

SEQ ID NO: 2738389 - protein, 15 aa, Entamoeba histolytica
TLRNEKKGLLDAAPK

SEQ ID NO: 2738390 - protein, 11 aa, Entamoeba histolytica
TLSLETDNSFT

SEQ ID NO: 2738391 - protein, 7 aa, Entamoeba histolytica
TLTGTRT

SEQ ID NO: 2738392 - protein, 5 aa, Entamoeba histolytica
TLTSP

SEQ ID NO: 2738393 - protein, 4 aa, Entamoeba histolytica
TMND

SEQ ID NO: 2738394 - protein, 4 aa, Entamoeba histolytica
TMNS

SEQ ID NO: 2738395 - protein, 8 aa, Entamoeba histolytica
TNAEEGQA

SEQ ID NO: 2738396 - protein, 6 aa, Entamoeba histolytica
TNATFN

SEQ ID NO: 2738397 - protein, 6 aa, Entamoeba histolytica
TNDKTL

SEQ ID NO: 2738398 - protein, 10 aa, Entamoeba histolytica
TNDNTNGKQV

SEQ ID NO: 2738399 - protein, 9 aa, Entamoeba histolytica
TNDSNSYSL

SEQ ID NO: 2738400 - protein, 6 aa, Entamoeba histolytica
TNEEEN

SEQ ID NO: 2738401 - protein, 6 aa, Entamoeba histolytica
TNEGPF

SEQ ID NO: 2738402 - protein, 9 aa, Entamoeba histolytica
TNETGDLES

SEQ ID NO: 2738403 - protein, 8 aa, Entamoeba histolytica
TNGEDKRM

SEQ ID NO: 2738404 - protein, 13 aa, Entamoeba histolytica
TNITQTNGTMNNQ

SEQ ID NO: 2738405 - protein, 13 aa, Entamoeba histolytica
TNKEGDGTVQKES

SEQ ID NO: 2738406 - protein, 9 aa, Entamoeba histolytica
TNKKQKENT

SEQ ID NO: 2738407 - protein, 10 aa, Entamoeba histolytica
TNKKYSDKEQ

SEQ ID NO: 2738408 - protein, 12 aa, Entamoeba histolytica
TNKKYTSEQSRI

SEQ ID NO: 2738409 - protein, 5 aa, Entamoeba histolytica
TNLGK

SEQ ID NO: 2738410 - protein, 6 aa, Entamoeba histolytica
TNNIDQ

SEQ ID NO: 2738411 - protein, 14 aa, Entamoeba histolytica
TNNKGYDNQPLFNN

SEQ ID NO: 2738412 - protein, 6 aa, Entamoeba histolytica
TNPRIR

SEQ ID NO: 2738413 - protein, 5 aa, Entamoeba histolytica
TNQEY

SEQ ID NO: 2738414 - protein, 5 aa, Entamoeba histolytica
TNQFD

SEQ ID NO: 2738415 - protein, 4 aa, Entamoeba histolytica
TNQS

SEQ ID NO: 2738416 - protein, 13 aa, Entamoeba histolytica
TNRVYDNNQSPLT

SEQ ID NO: 2738417 - protein, 9 aa, Entamoeba histolytica
TNSDDKINV

SEQ ID NO: 2738418 - protein, 8 aa, Entamoeba histolytica
TNSKTSNN

SEQ ID NO: 2738419 - protein, 9 aa, Entamoeba histolytica
TNSRTGEFT

SEQ ID NO: 2738420 - protein, 6 aa, Entamoeba histolytica
TNTATM

SEQ ID NO: 2738421 - protein, 11 aa, Entamoeba histolytica
TNTAYKPLKPQ

SEQ ID NO: 2738422 - protein, 61 aa, Entamoeba histolytica
TNTNDNKKEKTSEKKEQKVAEKKEQNDIVKTERESRNLEKKVGKGGVLSNEQEEQKEQRQA

SEQ ID NO: 2738423 - protein, 18 aa, Entamoeba histolytica
TNTSAGVKKTGKANKIEA

SEQ ID NO: 2738424 - protein, 6 aa, Entamoeba histolytica
TNVISQ

SEQ ID NO: 2738425 - protein, 7 aa, Entamoeba histolytica
TNYDTPT

SEQ ID NO: 2738426 - protein, 5 aa, Entamoeba histolytica
TNYGR

SEQ ID NO: 2738427 - protein, 6 aa, Entamoeba histolytica
TNYSRC

SEQ ID NO: 2738428 - protein, 11 aa, Entamoeba histolytica
TPAKDQGSRST

SEQ ID NO: 2738429 - protein, 6 aa, Entamoeba histolytica
TPEQEE

SEQ ID NO: 2738430 - protein, 20 aa, Entamoeba histolytica
TPFGEGSSYVTTNDDGTPQY

SEQ ID NO: 2738431 - protein, 4 aa, Entamoeba histolytica
TPIG

SEQ ID NO: 2738432 - protein, 5 aa, Entamoeba histolytica
TPPIN

SEQ ID NO: 2738433 - protein, 8 aa, Entamoeba histolytica
TPPISSYE

SEQ ID NO: 2738434 - protein, 6 aa, Entamoeba histolytica
TPPKFS

SEQ ID NO: 2738435 - protein, 14 aa, Entamoeba histolytica
TPRAYSSTNLDDSI

SEQ ID NO: 2738436 - protein, 45 aa, Entamoeba histolytica
TPTVPVTPTVNPVTPSEPVTPTVNPVTPVTPSYYPQQQQQQQTFS

SEQ ID NO: 2738437 - protein, 7 aa, Entamoeba histolytica
TPVKNGL

SEQ ID NO: 2738438 - protein, 6 aa, Entamoeba histolytica
TPVKPN

SEQ ID NO: 2738439 - protein, 9 aa, Entamoeba histolytica
TQCGNGNVN

SEQ ID NO: 2738440 - protein, 12 aa, Entamoeba histolytica
TQCPKCNGTGKI

SEQ ID NO: 2738441 - protein, 8 aa, Entamoeba histolytica
TQCQNNPN

SEQ ID NO: 2738442 - protein, 4 aa, Entamoeba histolytica
TQED

SEQ ID NO: 2738443 - protein, 7 aa, Entamoeba histolytica
TQEGCNE

SEQ ID NO: 2738444 - protein, 16 aa, Entamoeba histolytica
TQGNRRTKAEAMTNEQ

SEQ ID NO: 2738445 - protein, 10 aa, Entamoeba histolytica
TQHQNSNLQK

SEQ ID NO: 2738446 - protein, 4 aa, Entamoeba histolytica
TQID

SEQ ID NO: 2738447 - protein, 8 aa, Entamoeba histolytica
TQKGTAGS

SEQ ID NO: 2738448 - protein, 25 aa, Entamoeba histolytica
TQNVQQKETAKKAGIECGEKLMKQN

SEQ ID NO: 2738449 - protein, 19 aa, Entamoeba histolytica
TQNVQQKETAKKAGIEWVR

SEQ ID NO: 2738450 - protein, 9 aa, Entamoeba histolytica
TQRVQTDQS

SEQ ID NO: 2738451 - protein, 4 aa, Entamoeba histolytica
TQSD

SEQ ID NO: 2738452 - protein, 30 aa, Entamoeba histolytica
TQSDLPPPPPPPRGSHGVPAAPAAPAAPSL

SEQ ID NO: 2738453 - protein, 10 aa, Entamoeba histolytica
TQSKETNKKR

SEQ ID NO: 2738454 - protein, 6 aa, Entamoeba histolytica
TQSVND

SEQ ID NO: 2738455 - protein, 11 aa, Entamoeba histolytica
TRDAATLKSTG

SEQ ID NO: 2738456 - protein, 10 aa, Entamoeba histolytica
TREGITRPNV

SEQ ID NO: 2738457 - protein, 23 aa, Entamoeba histolytica
TRIDERKKRVEEITPKKPPRSRL

SEQ ID NO: 2738458 - protein, 11 aa, Entamoeba histolytica
TRLEEEKSEEI

SEQ ID NO: 2738459 - protein, 4 aa, Entamoeba histolytica
TRMT

SEQ ID NO: 2738460 - protein, 15 aa, Entamoeba histolytica
TRMTQSEKELQKRSE

SEQ ID NO: 2738461 - protein, 8 aa, Entamoeba histolytica
TRNNSPHF

SEQ ID NO: 2738462 - protein, 4 aa, Entamoeba histolytica
TRPS

SEQ ID NO: 2738463 - protein, 23 aa, Entamoeba histolytica
TRRDRLNAQEKEYRKQANTLNNK

SEQ ID NO: 2738464 - protein, 4 aa, Entamoeba histolytica
TRRH

SEQ ID NO: 2738465 - protein, 9 aa, Entamoeba histolytica
TSAKRNENI

SEQ ID NO: 2738466 - protein, 11 aa, Entamoeba histolytica
TSALDTQSEKI

SEQ ID NO: 2738467 - protein, 10 aa, Entamoeba histolytica
TSDASPSSIK

SEQ ID NO: 2738468 - protein, 6 aa, Entamoeba histolytica
TSDKCQ

SEQ ID NO: 2738469 - protein, 7 aa, Entamoeba histolytica
TSDTELK

SEQ ID NO: 2738470 - protein, 6 aa, Entamoeba histolytica
TSEDSD

SEQ ID NO: 2738471 - protein, 7 aa, Entamoeba histolytica
TSEEGGY

SEQ ID NO: 2738472 - protein, 5 aa, Entamoeba histolytica
TSEKD

SEQ ID NO: 2738473 - protein, 5 aa, Entamoeba histolytica
TSEPL

SEQ ID NO: 2738474 - protein, 7 aa, Entamoeba histolytica
TSETSNN

SEQ ID NO: 2738475 - protein, 20 aa, Entamoeba histolytica
TSFDNQPIQTFGDGDGTVPL

SEQ ID NO: 2738476 - protein, 20 aa, Entamoeba histolytica
TSGDSYNPTIEKYKKSADFS

SEQ ID NO: 2738477 - protein, 8 aa, Entamoeba histolytica
TSGKGGDF

SEQ ID NO: 2738478 - protein, 16 aa, Entamoeba histolytica
TSGNTHLGGSDFDQKV

SEQ ID NO: 2738479 - protein, 10 aa, Entamoeba histolytica
TSKEAKGYNE

SEQ ID NO: 2738480 - protein, 9 aa, Entamoeba histolytica
TSKSELTRE

SEQ ID NO: 2738481 - protein, 8 aa, Entamoeba histolytica
TSLESTGY

SEQ ID NO: 2738482 - protein, 4 aa, Entamoeba histolytica
TSMN

SEQ ID NO: 2738483 - protein, 5 aa, Entamoeba histolytica
TSNIE

SEQ ID NO: 2738484 - protein, 16 aa, Entamoeba histolytica
TSNKDEHLDEHLQKVE

SEQ ID NO: 2738485 - protein, 5 aa, Entamoeba histolytica
TSPHH

SEQ ID NO: 2738486 - protein, 6 aa, Entamoeba histolytica
TSPKNY

SEQ ID NO: 2738487 - protein, 9 aa, Entamoeba histolytica
TSPKSYNWN

SEQ ID NO: 2738488 - protein, 5 aa, Entamoeba histolytica
TSPLT

SEQ ID NO: 2738489 - protein, 8 aa, Entamoeba histolytica
TSPNSLTG

SEQ ID NO: 2738490 - protein, 7 aa, Entamoeba histolytica
TSPQGNV

SEQ ID NO: 2738491 - protein, 6 aa, Entamoeba histolytica
TSPQNE

SEQ ID NO: 2738492 - protein, 6 aa, Entamoeba histolytica
TSRAEV

SEQ ID NO: 2738493 - protein, 5 aa, Entamoeba histolytica
TSSDG

SEQ ID NO: 2738494 - protein, 14 aa, Entamoeba histolytica
TSSKIQNNRRMGAR

SEQ ID NO: 2738495 - protein, 12 aa, Entamoeba histolytica
TSSPEDKKNFGQ

SEQ ID NO: 2738496 - protein, 8 aa, Entamoeba histolytica
TSSSETTD

SEQ ID NO: 2738497 - protein, 8 aa, Entamoeba histolytica
TSTKSNPQ

SEQ ID NO: 2738498 - protein, 22 aa, Entamoeba histolytica
TSTNTENNTFSEPTQHNQKSEL

SEQ ID NO: 2738499 - protein, 7 aa, Entamoeba histolytica
TSTTKIE

SEQ ID NO: 2738500 - protein, 4 aa, Entamoeba histolytica
TSTY

SEQ ID NO: 2738501 - protein, 8 aa, Entamoeba histolytica
TSVGATGT

SEQ ID NO: 2738502 - protein, 7 aa, Entamoeba histolytica
TSVQNEG

SEQ ID NO: 2738503 - protein, 8 aa, Entamoeba histolytica
TSYSASQM

SEQ ID NO: 2738504 - protein, 7 aa, Entamoeba histolytica
TTAGDIP

SEQ ID NO: 2738505 - protein, 7 aa, Entamoeba histolytica
TTCPPRR

SEQ ID NO: 2738506 - protein, 344 aa, Entamoeba histolytica
TTDKNGKKTATVSKNLGPNTKVSGSVSAQKTPNGITAGVSGNINYNKGPITATAKTGYQTSPQGQSYGASVNGKYSKNGVNVNGNAYYGKQNGVNKAGANINASYDSKKVQANAKAGINKDGSSTTSSASASATYKPNGKTTISADGKVSKTNGQTTIQGNANASYNGDKLQANAGVNFNKDSNGKTTSASASATYKPNDKTTISADGKVSKTNGQTTIQGNANASYNGDKLQANAGVNFNKDSNGKTTSASASATYKPNDKTTISADGKVSKTNGKKTYEVNGKANYNGDKLQANLNAQAKNDGTNKVSSISGDATYTNGGLTAKVDGNMANTNGEKSNEIHG

SEQ ID NO: 2738507 - protein, 10 aa, Entamoeba histolytica
TTECSKCNKG

SEQ ID NO: 2738508 - protein, 5 aa, Entamoeba histolytica
TTERE

SEQ ID NO: 2738509 - protein, 10 aa, Entamoeba histolytica
TTGEKYTLGE

SEQ ID NO: 2738510 - protein, 4 aa, Entamoeba histolytica
TTGT

SEQ ID NO: 2738511 - protein, 6 aa, Entamoeba histolytica
TTINPQ

SEQ ID NO: 2738512 - protein, 10 aa, Entamoeba histolytica
TTKGADKVKD

SEQ ID NO: 2738513 - protein, 6 aa, Entamoeba histolytica
TTKGKD

SEQ ID NO: 2738514 - protein, 10 aa, Entamoeba histolytica
TTKGNSSSYG

SEQ ID NO: 2738515 - protein, 5 aa, Entamoeba histolytica
TTLER

SEQ ID NO: 2738516 - protein, 7 aa, Entamoeba histolytica
TTMPAYS

SEQ ID NO: 2738517 - protein, 7 aa, Entamoeba histolytica
TTNSITT

SEQ ID NO: 2738518 - protein, 8 aa, Entamoeba histolytica
TTNSVYNS

SEQ ID NO: 2738519 - protein, 10 aa, Entamoeba histolytica
TTNTQISANG

SEQ ID NO: 2738520 - protein, 5 aa, Entamoeba histolytica
TTPYD

SEQ ID NO: 2738521 - protein, 14 aa, Entamoeba histolytica
TTQENVQEQAQPVV

SEQ ID NO: 2738522 - protein, 13 aa, Entamoeba histolytica
TTQETVQEPAQPV

SEQ ID NO: 2738523 - protein, 19 aa, Entamoeba histolytica
TTQTVDYPSKFAKEIKKII

SEQ ID NO: 2738524 - protein, 5 aa, Entamoeba histolytica
TTSSI

SEQ ID NO: 2738525 - protein, 18 aa, Entamoeba histolytica
TTTCSGDKEEKTVDINDK

SEQ ID NO: 2738526 - protein, 5 aa, Entamoeba histolytica
TTTEI

SEQ ID NO: 2738527 - protein, 6 aa, Entamoeba histolytica
TTTGTK

SEQ ID NO: 2738528 - protein, 4 aa, Entamoeba histolytica
TTTK

SEQ ID NO: 2738529 - protein, 4 aa, Entamoeba histolytica
TTTP

SEQ ID NO: 2738530 - protein, 5 aa, Entamoeba histolytica
TTTTY

SEQ ID NO: 2738531 - protein, 19 aa, Entamoeba histolytica
TTYQSISQHNGETPADEGK

SEQ ID NO: 2738532 - protein, 7 aa, Entamoeba histolytica
TTYSDNK

SEQ ID NO: 2738533 - protein, 8 aa, Entamoeba histolytica
TTYSPELE

SEQ ID NO: 2738534 - protein, 19 aa, Entamoeba histolytica
TTYSPTNVQKPRKSMGPTQ

SEQ ID NO: 2738535 - protein, 25 aa, Entamoeba histolytica
TTYSVSYERNEEENTVYSKTSNIEY

SEQ ID NO: 2738536 - protein, 7 aa, Entamoeba histolytica
TVAEDRA

SEQ ID NO: 2738537 - protein, 7 aa, Entamoeba histolytica
TVAERNK

SEQ ID NO: 2738538 - protein, 5 aa, Entamoeba histolytica
TVDEN

SEQ ID NO: 2738539 - protein, 11 aa, Entamoeba histolytica
TVGDTNYSNLD

SEQ ID NO: 2738540 - protein, 7 aa, Entamoeba histolytica
TVGSSSK

SEQ ID NO: 2738541 - protein, 7 aa, Entamoeba histolytica
TVPKTVE

SEQ ID NO: 2738542 - protein, 7 aa, Entamoeba histolytica
TVQKQEK

SEQ ID NO: 2738543 - protein, 8 aa, Entamoeba histolytica
TVRKKDRS

SEQ ID NO: 2738544 - protein, 7 aa, Entamoeba histolytica
TVSNSRL

SEQ ID NO: 2738545 - protein, 11 aa, Entamoeba histolytica
TWNSETKEQID

SEQ ID NO: 2738546 - protein, 10 aa, Entamoeba histolytica
TYGGTKPKEP

SEQ ID NO: 2738547 - protein, 16 aa, Entamoeba histolytica
TYKSGTFELSSPNNIA

SEQ ID NO: 2738548 - protein, 4 aa, Entamoeba histolytica
TYPF

SEQ ID NO: 2738549 - protein, 9 aa, Entamoeba histolytica
TYQKDEEGK

SEQ ID NO: 2738550 - protein, 9 aa, Entamoeba histolytica
TYSNGTKAV

SEQ ID NO: 2738551 - protein, 11 aa, Entamoeba histolytica
TYSPDSKGECI

SEQ ID NO: 2738552 - protein, 5 aa, Entamoeba histolytica
TYSST

SEQ ID NO: 2738553 - protein, 8 aa, Entamoeba histolytica
TYSSTNAM

SEQ ID NO: 2738554 - protein, 6 aa, Entamoeba histolytica
TYTDKS

SEQ ID NO: 2738555 - protein, 5 aa, Entamoeba histolytica
TYTIN

SEQ ID NO: 2738556 - protein, 24 aa, Entamoeba histolytica
TYTSKKSQLETNLREADEQGNITQ

SEQ ID NO: 2738557 - protein, 10 aa, Entamoeba histolytica
TYVSTEPNQF

SEQ ID NO: 2738558 - protein, 210 aa, Entamoeba histolytica
TYVTGESITKEESASTSLGKTDKGQQSGKVSEGNQGATEESSGKKNEEKPKQQQEVSKKEEIPEKGSKSSEKKESLKENNQENQTQQQELNEYEDETEKDKKKTQEESESDQKQDKASTNQSKGTTSEKKDSKVGTNNKDGTSPEAQNDKVKNPDTESANKKNENTEEQEKQKQKEKEEQEKKEKENKPINNSDKSDNNNTNLNNLDSTT

SEQ ID NO: 2738559 - protein, 10 aa, Entamoeba histolytica
TYYPANTSVS

SEQ ID NO: 2738560 - protein, 12 aa, Entamoeba histolytica
TYYTKGNSSELN

SEQ ID NO: 2738561 - protein, 16 aa, Entamoeba histolytica
VADEDGDIKQEGLKRV

SEQ ID NO: 2738562 - protein, 18 aa, Entamoeba histolytica
VAGTVGKVAGTVSSVAGK

SEQ ID NO: 2738563 - protein, 15 aa, Entamoeba histolytica
VAHGKDPYFDPWPDT

SEQ ID NO: 2738564 - protein, 7 aa, Entamoeba histolytica
VAKKQVK

SEQ ID NO: 2738565 - protein, 13 aa, Entamoeba histolytica
VANEPRQIFIPVF

SEQ ID NO: 2738566 - protein, 7 aa, Entamoeba histolytica
VAPEQEG

SEQ ID NO: 2738567 - protein, 86 aa, Entamoeba histolytica
VAQKKAEKAKKEAKKSGKKAEKKAAKVAKKAEKKAAEAKKTATKSAAKATEKAKKSIEKAKSESKKAAKKVEKKLKESKKSLKSKI

SEQ ID NO: 2738568 - protein, 18 aa, Entamoeba histolytica
VATVTGSRRVTDGSETGL

SEQ ID NO: 2738569 - protein, 9 aa, Entamoeba histolytica
VCPNSRGSV

SEQ ID NO: 2738570 - protein, 6 aa, Entamoeba histolytica
VDDKTI

SEQ ID NO: 2738571 - protein, 13 aa, Entamoeba histolytica
VDEAASRSINTFE

SEQ ID NO: 2738572 - protein, 11 aa, Entamoeba histolytica
VDEYDDGSQLQ

SEQ ID NO: 2738573 - protein, 17 aa, Entamoeba histolytica
VDEYDDGSQLQNNLYVE

SEQ ID NO: 2738574 - protein, 8 aa, Entamoeba histolytica
VDGISGDP

SEQ ID NO: 2738575 - protein, 4 aa, Entamoeba histolytica
VDGN

SEQ ID NO: 2738576 - protein, 8 aa, Entamoeba histolytica
VDNANQTV

SEQ ID NO: 2738577 - protein, 4 aa, Entamoeba histolytica
VDNG

SEQ ID NO: 2738578 - protein, 8 aa, Entamoeba histolytica
VDPDQTKS

SEQ ID NO: 2738579 - protein, 44 aa, Entamoeba histolytica
VDPNAKKPEEWNDEDDGEWEAPTIENPEYKGEWKPKRIPNPAYK

SEQ ID NO: 2738580 - protein, 8 aa, Entamoeba histolytica
VDSSDGGY

SEQ ID NO: 2738581 - protein, 9 aa, Entamoeba histolytica
VDTTETNNG

SEQ ID NO: 2738582 - protein, 18 aa, Entamoeba histolytica
VDTYEGSPDAIKKKAEQW

SEQ ID NO: 2738583 - protein, 8 aa, Entamoeba histolytica
VEANANTE

SEQ ID NO: 2738584 - protein, 4 aa, Entamoeba histolytica
VECG

SEQ ID NO: 2738585 - protein, 8 aa, Entamoeba histolytica
VEDDERHY

SEQ ID NO: 2738586 - protein, 5 aa, Entamoeba histolytica
VEDEE

SEQ ID NO: 2738587 - protein, 7 aa, Entamoeba histolytica
VEDEERH

SEQ ID NO: 2738588 - protein, 4 aa, Entamoeba histolytica
VEDI

SEQ ID NO: 2738589 - protein, 10 aa, Entamoeba histolytica
VEDQSLNDPW

SEQ ID NO: 2738590 - protein, 7 aa, Entamoeba histolytica
VEGGRTP

SEQ ID NO: 2738591 - protein, 8 aa, Entamoeba histolytica
VEGPIPPL

SEQ ID NO: 2738592 - protein, 40 aa, Entamoeba histolytica
VEKQQKKQVQKAEIKKAEKKVAKMEKKTQQKATKKAEKIV

SEQ ID NO: 2738593 - protein, 7 aa, Entamoeba histolytica
VENDPAG

SEQ ID NO: 2738594 - protein, 13 aa, Entamoeba histolytica
VENEESKRKDPTL

SEQ ID NO: 2738595 - protein, 14 aa, Entamoeba histolytica
VENGVARNNVETVA

SEQ ID NO: 2738596 - protein, 6 aa, Entamoeba histolytica
VERLNE

SEQ ID NO: 2738597 - protein, 4 aa, Entamoeba histolytica
VESG

SEQ ID NO: 2738598 - protein, 6 aa, Entamoeba histolytica
VESINN

SEQ ID NO: 2738599 - protein, 7 aa, Entamoeba histolytica
VESSDHK

SEQ ID NO: 2738600 - protein, 6 aa, Entamoeba histolytica
VEVEEE

SEQ ID NO: 2738601 - protein, 8 aa, Entamoeba histolytica
VEYPGAAY

SEQ ID NO: 2738602 - protein, 12 aa, Entamoeba histolytica
VGGGDNIKGNNY

SEQ ID NO: 2738603 - protein, 9 aa, Entamoeba histolytica
VGLKESGTI

SEQ ID NO: 2738604 - protein, 8 aa, Entamoeba histolytica
VGLSQSDI

SEQ ID NO: 2738605 - protein, 7 aa, Entamoeba histolytica
VGNGQGY

SEQ ID NO: 2738606 - protein, 9 aa, Entamoeba histolytica
VGNKGCNGG

SEQ ID NO: 2738607 - protein, 8 aa, Entamoeba histolytica
VGPSGEIR

SEQ ID NO: 2738608 - protein, 5 aa, Entamoeba histolytica
VGSCT

SEQ ID NO: 2738609 - protein, 12 aa, Entamoeba histolytica
VGSQSGKTSKRV

SEQ ID NO: 2738610 - protein, 4 aa, Entamoeba histolytica
VITG

SEQ ID NO: 2738611 - protein, 10 aa, Entamoeba histolytica
VKAARRSVKR

SEQ ID NO: 2738612 - protein, 6 aa, Entamoeba histolytica
VKAEKK

SEQ ID NO: 2738613 - protein, 14 aa, Entamoeba histolytica
VKEPYVAPKYEEEE

SEQ ID NO: 2738614 - protein, 7 aa, Entamoeba histolytica
VKGTPDS

SEQ ID NO: 2738615 - protein, 126 aa, Entamoeba histolytica
VKKAEKKGKKAAKEAKKSGEKAAKKAAKAAKKATKKVTSVKSKAEKLSSKAIKKAQKAVKKATKEAKKANKDVSKKLKTTKSDLKKKAKKAAKAAKKAMKVEKKQEKKLKQVKKQVKKGTKKMSAV

SEQ ID NO: 2738616 - protein, 17 aa, Entamoeba histolytica
VKKAGNKAAVKAKTVTK

SEQ ID NO: 2738617 - protein, 20 aa, Entamoeba histolytica
VKKASAGLKATKNIKKTAKL

SEQ ID NO: 2738618 - protein, 11 aa, Entamoeba histolytica
VKKPVKKAVAK

SEQ ID NO: 2738619 - protein, 14 aa, Entamoeba histolytica
VKKPVNKKTTVKPL

SEQ ID NO: 2738620 - protein, 193 aa, Entamoeba histolytica
VKKVQKKDKKAIAKLAKKDKKALAKIAKKDKKAIAKLAKKAKDAKKVAKTAAKKAQKKATKAAKKEALKAKLSAKKAEKKLAKKVKAVKKNESKLIKKNNKKLAKKAAKAAKKEALKAKLSAKKAEKKLAKKIKAVKKNDAKLIKKSNKKLTKLSNKAASKVTKKSTKNTKFGKKAASKINKKAKLQKKKVNS

SEQ ID NO: 2738621 - protein, 6 aa, Entamoeba histolytica
VKNEEV

SEQ ID NO: 2738622 - protein, 7 aa, Entamoeba histolytica
VKNGTNA

SEQ ID NO: 2738623 - protein, 9 aa, Entamoeba histolytica
VKNVNAPVR

SEQ ID NO: 2738624 - protein, 10 aa, Entamoeba histolytica
VKQAEHNKRI

SEQ ID NO: 2738625 - protein, 9 aa, Entamoeba histolytica
VKSKEERQV

SEQ ID NO: 2738626 - protein, 14 aa, Entamoeba histolytica
VKSQLSRANDNNTE

SEQ ID NO: 2738627 - protein, 21 aa, Entamoeba histolytica
VKTDDLKEIDSLSQKEKERFK

SEQ ID NO: 2738628 - protein, 6 aa, Entamoeba histolytica
VKTEYS

SEQ ID NO: 2738629 - protein, 14 aa, Entamoeba histolytica
VKTVKTTKISKIKK

SEQ ID NO: 2738630 - protein, 7 aa, Entamoeba histolytica
VKVTPKK

SEQ ID NO: 2738631 - protein, 10 aa, Entamoeba histolytica
VKYNNKGRVV

SEQ ID NO: 2738632 - protein, 7 aa, Entamoeba histolytica
VLPNTTD

SEQ ID NO: 2738633 - protein, 9 aa, Entamoeba histolytica
VLSKEEKEF

SEQ ID NO: 2738634 - protein, 7 aa, Entamoeba histolytica
VNENSQF

SEQ ID NO: 2738635 - protein, 6 aa, Entamoeba histolytica
VNETPT

SEQ ID NO: 2738636 - protein, 9 aa, Entamoeba histolytica
VNGPTSLDA

SEQ ID NO: 2738637 - protein, 36 aa, Entamoeba histolytica
VNKNTTKKNTKNIEKKNNLKKASLTPKAKKCVSALK

SEQ ID NO: 2738638 - protein, 54 aa, Entamoeba histolytica
VNNNRNGGSDLGVDSDSDSSKPSSSTVVDQSGQPVVTPTEDYASPKTGVSETAI

SEQ ID NO: 2738639 - protein, 6 aa, Entamoeba histolytica
VNNTKE

SEQ ID NO: 2738640 - protein, 6 aa, Entamoeba histolytica
VNREKY

SEQ ID NO: 2738641 - protein, 7 aa, Entamoeba histolytica
VNSDPNL

SEQ ID NO: 2738642 - protein, 10 aa, Entamoeba histolytica
VNSPNDFYRN

SEQ ID NO: 2738643 - protein, 20 aa, Entamoeba histolytica
VNSTNGTQQNSTQPIQQKQQ

SEQ ID NO: 2738644 - protein, 13 aa, Entamoeba histolytica
VPAPPFVESPAGF

SEQ ID NO: 2738645 - protein, 6 aa, Entamoeba histolytica
VPEEEW

SEQ ID NO: 2738646 - protein, 15 aa, Entamoeba histolytica
VPEINKKVQKANQRL

SEQ ID NO: 2738647 - protein, 6 aa, Entamoeba histolytica
VPENKE

SEQ ID NO: 2738648 - protein, 19 aa, Entamoeba histolytica
VPETTSNVKAAVKAAPESV

SEQ ID NO: 2738649 - protein, 4 aa, Entamoeba histolytica
VPFT

SEQ ID NO: 2738650 - protein, 7 aa, Entamoeba histolytica
VPKPVNP

SEQ ID NO: 2738651 - protein, 10 aa, Entamoeba histolytica
VPQKPRYYKP

SEQ ID NO: 2738652 - protein, 4 aa, Entamoeba histolytica
VPSA

SEQ ID NO: 2738653 - protein, 5 aa, Entamoeba histolytica
VPTPN

SEQ ID NO: 2738654 - protein, 10 aa, Entamoeba histolytica
VQDSKTYQNV

SEQ ID NO: 2738655 - protein, 17 aa, Entamoeba histolytica
VQEEEKKKLNETDKNTL

SEQ ID NO: 2738656 - protein, 12 aa, Entamoeba histolytica
VQGEKKELEKKR

SEQ ID NO: 2738657 - protein, 4 aa, Entamoeba histolytica
VQGW

SEQ ID NO: 2738658 - protein, 6 aa, Entamoeba histolytica
VQNENL

SEQ ID NO: 2738659 - protein, 7 aa, Entamoeba histolytica
VQNKNGL

SEQ ID NO: 2738660 - protein, 8 aa, Entamoeba histolytica
VQRESNKT

SEQ ID NO: 2738661 - protein, 5 aa, Entamoeba histolytica
VQSNT

SEQ ID NO: 2738662 - protein, 14 aa, Entamoeba histolytica
VQTTSSSNLKTNGM

SEQ ID NO: 2738663 - protein, 8 aa, Entamoeba histolytica
VRKSINET

SEQ ID NO: 2738664 - protein, 11 aa, Entamoeba histolytica
VRTGSSCNPGA

SEQ ID NO: 2738665 - protein, 7 aa, Entamoeba histolytica
VSDSNSL

SEQ ID NO: 2738666 - protein, 8 aa, Entamoeba histolytica
VSEPIPNV

SEQ ID NO: 2738667 - protein, 6 aa, Entamoeba histolytica
VSFSSY

SEQ ID NO: 2738668 - protein, 7 aa, Entamoeba histolytica
VSGIDEY

SEQ ID NO: 2738669 - protein, 9 aa, Entamoeba histolytica
VSGKCDSNS

SEQ ID NO: 2738670 - protein, 9 aa, Entamoeba histolytica
VSKKGKNVI

SEQ ID NO: 2738671 - protein, 12 aa, Entamoeba histolytica
VSKKQAKKLTKK

SEQ ID NO: 2738672 - protein, 7 aa, Entamoeba histolytica
VSKPRHK

SEQ ID NO: 2738673 - protein, 7 aa, Entamoeba histolytica
VSNKLGN

SEQ ID NO: 2738674 - protein, 6 aa, Entamoeba histolytica
VSPFSD

SEQ ID NO: 2738675 - protein, 8 aa, Entamoeba histolytica
VSPQSKRA

SEQ ID NO: 2738676 - protein, 9 aa, Entamoeba histolytica
VSPSSTPIE

SEQ ID NO: 2738677 - protein, 10 aa, Entamoeba histolytica
VSQPTSTSSF

SEQ ID NO: 2738678 - protein, 7 aa, Entamoeba histolytica
VSSLSTK

SEQ ID NO: 2738679 - protein, 25 aa, Entamoeba histolytica
VSSRSSSRSSSRSSSRSSSRRTRVG

SEQ ID NO: 2738680 - protein, 9 aa, Entamoeba histolytica
VSSTSNYQE

SEQ ID NO: 2738681 - protein, 7 aa, Entamoeba histolytica
VSTSNPH

SEQ ID NO: 2738682 - protein, 5 aa, Entamoeba histolytica
VSVSS

SEQ ID NO: 2738683 - protein, 4 aa, Entamoeba histolytica
VTAG

SEQ ID NO: 2738684 - protein, 7 aa, Entamoeba histolytica
VTDEEYN

SEQ ID NO: 2738685 - protein, 5 aa, Entamoeba histolytica
VTGSH

SEQ ID NO: 2738686 - protein, 8 aa, Entamoeba histolytica
VTGSSTLC

SEQ ID NO: 2738687 - protein, 10 aa, Entamoeba histolytica
VTIPDSTNIE

SEQ ID NO: 2738688 - protein, 4 aa, Entamoeba histolytica
VTLE

SEQ ID NO: 2738689 - protein, 9 aa, Entamoeba histolytica
VTMKGASSV

SEQ ID NO: 2738690 - protein, 13 aa, Entamoeba histolytica
VTNSENGTEPKTE

SEQ ID NO: 2738691 - protein, 6 aa, Entamoeba histolytica
VTPGTD

SEQ ID NO: 2738692 - protein, 8 aa, Entamoeba histolytica
VTPTEEAL

SEQ ID NO: 2738693 - protein, 14 aa, Entamoeba histolytica
VTSEPAVEGSESTY

SEQ ID NO: 2738694 - protein, 15 aa, Entamoeba histolytica
VTTTDNNNSNKNTIP

SEQ ID NO: 2738695 - protein, 20 aa, Entamoeba histolytica
VTVTNTTKIVPSKVSTGEKC

SEQ ID NO: 2738696 - protein, 13 aa, Entamoeba histolytica
VTYEEDNKNKMKI

SEQ ID NO: 2738697 - protein, 14 aa, Entamoeba histolytica
VVKKSQKKSVKKAV

SEQ ID NO: 2738698 - protein, 6 aa, Entamoeba histolytica
VYDEPK

SEQ ID NO: 2738699 - protein, 13 aa, Entamoeba histolytica
VYDEPKCSKTVNH

SEQ ID NO: 2738700 - protein, 9 aa, Entamoeba histolytica
VYKQPKQKY

SEQ ID NO: 2738701 - protein, 7 aa, Entamoeba histolytica
VYSQNEV

SEQ ID NO: 2738702 - protein, 32 aa, Entamoeba histolytica
VYSSSTSETPDANTNEDAEDNKKEGVKREENV

SEQ ID NO: 2738703 - protein, 8 aa, Entamoeba histolytica
WDESVDEQ

SEQ ID NO: 2738704 - protein, 7 aa, Entamoeba histolytica
WGSPQPY

SEQ ID NO: 2738705 - protein, 7 aa, Entamoeba histolytica
WGTSWGD

SEQ ID NO: 2738706 - protein, 6 aa, Entamoeba histolytica
WGYNSQ

SEQ ID NO: 2738707 - protein, 7 aa, Entamoeba histolytica
WKKNKAE

SEQ ID NO: 2738708 - protein, 14 aa, Entamoeba histolytica
WKTQYGKAPYALSS

SEQ ID NO: 2738709 - protein, 9 aa, Entamoeba histolytica
WNDEESNKE

SEQ ID NO: 2738710 - protein, 10 aa, Entamoeba histolytica
WNEAKKNKEK

SEQ ID NO: 2738711 - protein, 7 aa, Entamoeba histolytica
WNEPAKE

SEQ ID NO: 2738712 - protein, 4 aa, Entamoeba histolytica
WPPV

SEQ ID NO: 2738713 - protein, 11 aa, Entamoeba histolytica
WRSNDVSDEYL

SEQ ID NO: 2738714 - protein, 8 aa, Entamoeba histolytica
WSSSYAAN

SEQ ID NO: 2738715 - protein, 10 aa, Entamoeba histolytica
WTSSVSTNQN

SEQ ID NO: 2738716 - protein, 7 aa, Entamoeba histolytica
YAADNKT

SEQ ID NO: 2738717 - protein, 6 aa, Entamoeba histolytica
YAEDVT

SEQ ID NO: 2738718 - protein, 8 aa, Entamoeba histolytica
YAEECPAK

SEQ ID NO: 2738719 - protein, 11 aa, Entamoeba histolytica
YAKYGGPVSGQ

SEQ ID NO: 2738720 - protein, 9 aa, Entamoeba histolytica
YARDLSRSI

SEQ ID NO: 2738721 - protein, 7 aa, Entamoeba histolytica
YASLAGT

SEQ ID NO: 2738722 - protein, 4 aa, Entamoeba histolytica
YCDQ

SEQ ID NO: 2738723 - protein, 10 aa, Entamoeba histolytica
YDEDYDENLE

SEQ ID NO: 2738724 - protein, 4 aa, Entamoeba histolytica
YDEP

SEQ ID NO: 2738725 - protein, 7 aa, Entamoeba histolytica
YDKDATG

SEQ ID NO: 2738726 - protein, 30 aa, Entamoeba histolytica
YDLGKNSHLSLTAGKSADKGGYVGAGFKWD

SEQ ID NO: 2738727 - protein, 10 aa, Entamoeba histolytica
YDNEHFNSKE

SEQ ID NO: 2738728 - protein, 9 aa, Entamoeba histolytica
YDQKDKKTI

SEQ ID NO: 2738729 - protein, 14 aa, Entamoeba histolytica
YDSIPSKCKRCKPG

SEQ ID NO: 2738730 - protein, 12 aa, Entamoeba histolytica
YDSNTGLSSQVR

SEQ ID NO: 2738731 - protein, 15 aa, Entamoeba histolytica
YEAETQDCKEFNNEY

SEQ ID NO: 2738732 - protein, 5 aa, Entamoeba histolytica
YECST

SEQ ID NO: 2738733 - protein, 8 aa, Entamoeba histolytica
YEDGSQLQ

SEQ ID NO: 2738734 - protein, 5 aa, Entamoeba histolytica
YEETI

SEQ ID NO: 2738735 - protein, 7 aa, Entamoeba histolytica
YEGKTNV

SEQ ID NO: 2738736 - protein, 8 aa, Entamoeba histolytica
YENENGTF

SEQ ID NO: 2738737 - protein, 13 aa, Entamoeba histolytica
YENETKINQTQLN

SEQ ID NO: 2738738 - protein, 16 aa, Entamoeba histolytica
YENKEKLEDDQKRLVE

SEQ ID NO: 2738739 - protein, 7 aa, Entamoeba histolytica
YENTGNK

SEQ ID NO: 2738740 - protein, 6 aa, Entamoeba histolytica
YENTKR

SEQ ID NO: 2738741 - protein, 7 aa, Entamoeba histolytica
YEPTIEQ

SEQ ID NO: 2738742 - protein, 16 aa, Entamoeba histolytica
YEQISQKNGETTAEQG

SEQ ID NO: 2738743 - protein, 16 aa, Entamoeba histolytica
YEQKRLSSKEHEQITR

SEQ ID NO: 2738744 - protein, 4 aa, Entamoeba histolytica
YESI

SEQ ID NO: 2738745 - protein, 14 aa, Entamoeba histolytica
YESIKGVEMENESY

SEQ ID NO: 2738746 - protein, 110 aa, Entamoeba histolytica
YETWKKQNNQDSSNSFVNEQTSGSSGYSGTTGSSEYYDGYSPSSTSTGSSSSSTGISGNGANIPNTPTTNIPNTPTTDSTNTPTTDNTNTPTTDTSTNPITTTENPPSPI

SEQ ID NO: 2738747 - protein, 13 aa, Entamoeba histolytica
YFSTGDTKRQYAS

SEQ ID NO: 2738748 - protein, 8 aa, Entamoeba histolytica
YGCTEDNK

SEQ ID NO: 2738749 - protein, 15 aa, Entamoeba histolytica
YGDANNKGLQTSEDN

SEQ ID NO: 2738750 - protein, 5 aa, Entamoeba histolytica
YGECD

SEQ ID NO: 2738751 - protein, 8 aa, Entamoeba histolytica
YGENTNNS

SEQ ID NO: 2738752 - protein, 25 aa, Entamoeba histolytica
YGETFTKELKEKKAPINNAGFGGGD

SEQ ID NO: 2738753 - protein, 28 aa, Entamoeba histolytica
YGGGAQQQAPGYDNNQQYGNYEEYEKDE

SEQ ID NO: 2738754 - protein, 9 aa, Entamoeba histolytica
YGGGTRYRD

SEQ ID NO: 2738755 - protein, 12 aa, Entamoeba histolytica
YGKDLRNDKRAI

SEQ ID NO: 2738756 - protein, 8 aa, Entamoeba histolytica
YGKEQEMT

SEQ ID NO: 2738757 - protein, 29 aa, Entamoeba histolytica
YGKKSSVVKRTTKQQKTTITNKKSSGSMV

SEQ ID NO: 2738758 - protein, 11 aa, Entamoeba histolytica
YGKTKQGYETQ

SEQ ID NO: 2738759 - protein, 10 aa, Entamoeba histolytica
YGKYGPPKAL

SEQ ID NO: 2738760 - protein, 9 aa, Entamoeba histolytica
YGNKVGQTN

SEQ ID NO: 2738761 - protein, 8 aa, Entamoeba histolytica
YGSQDGQD

SEQ ID NO: 2738762 - protein, 10 aa, Entamoeba histolytica
YGSSSEYGLK

SEQ ID NO: 2738763 - protein, 5 aa, Entamoeba histolytica
YGTPY

SEQ ID NO: 2738764 - protein, 8 aa, Entamoeba histolytica
YGTQNGTE

SEQ ID NO: 2738765 - protein, 7 aa, Entamoeba histolytica
YGTTEEH

SEQ ID NO: 2738766 - protein, 9 aa, Entamoeba histolytica
YGTTKEGQK

SEQ ID NO: 2738767 - protein, 5 aa, Entamoeba histolytica
YHDGY

SEQ ID NO: 2738768 - protein, 19 aa, Entamoeba histolytica
YIKNNDQCELKQSTNQITN

SEQ ID NO: 2738769 - protein, 8 aa, Entamoeba histolytica
YITQKQRE

SEQ ID NO: 2738770 - protein, 15 aa, Entamoeba histolytica
YKAAGSAGIGKCGEN

SEQ ID NO: 2738771 - protein, 26 aa, Entamoeba histolytica
YKANNNWTFTGNGKANNQYGKRSNEF

SEQ ID NO: 2738772 - protein, 8 aa, Entamoeba histolytica
YKDTSRIA

SEQ ID NO: 2738773 - protein, 8 aa, Entamoeba histolytica
YKKNQPKW

SEQ ID NO: 2738774 - protein, 21 aa, Entamoeba histolytica
YKNEPLSKDPTTELQDPGATI

SEQ ID NO: 2738775 - protein, 10 aa, Entamoeba histolytica
YKNNRKDLAK

SEQ ID NO: 2738776 - protein, 7 aa, Entamoeba histolytica
YKPGSEL

SEQ ID NO: 2738777 - protein, 20 aa, Entamoeba histolytica
YKPKATNVAYTSGSTDPWSP

SEQ ID NO: 2738778 - protein, 9 aa, Entamoeba histolytica
YKSEGSCNK

SEQ ID NO: 2738779 - protein, 10 aa, Entamoeba histolytica
YKSQSCTGQI

SEQ ID NO: 2738780 - protein, 15 aa, Entamoeba histolytica
YKTQQRAKQEGLQPM

SEQ ID NO: 2738781 - protein, 11 aa, Entamoeba histolytica
YLTSEEKQNMW

SEQ ID NO: 2738782 - protein, 12 aa, Entamoeba histolytica
YNAKKRNIEGRI

SEQ ID NO: 2738783 - protein, 4 aa, Entamoeba histolytica
YNDG

SEQ ID NO: 2738784 - protein, 21 aa, Entamoeba histolytica
YNEELSSSYLKGKKGISTKGI

SEQ ID NO: 2738785 - protein, 8 aa, Entamoeba histolytica
YNEEQTKE

SEQ ID NO: 2738786 - protein, 8 aa, Entamoeba histolytica
YNEPSSYF

SEQ ID NO: 2738787 - protein, 4 aa, Entamoeba histolytica
YNET

SEQ ID NO: 2738788 - protein, 7 aa, Entamoeba histolytica
YNGDSKE

SEQ ID NO: 2738789 - protein, 8 aa, Entamoeba histolytica
YNGEGKGV

SEQ ID NO: 2738790 - protein, 10 aa, Entamoeba histolytica
YNGKNEIIGE

SEQ ID NO: 2738791 - protein, 12 aa, Entamoeba histolytica
YNGSTGPKDYAT

SEQ ID NO: 2738792 - protein, 5 aa, Entamoeba histolytica
YNNKS

SEQ ID NO: 2738793 - protein, 10 aa, Entamoeba histolytica
YNNQTDNFNN

SEQ ID NO: 2738794 - protein, 11 aa, Entamoeba histolytica
YNNSTSDKHCS

SEQ ID NO: 2738795 - protein, 10 aa, Entamoeba histolytica
YNPDENSTIN

SEQ ID NO: 2738796 - protein, 5 aa, Entamoeba histolytica
YNPHS

SEQ ID NO: 2738797 - protein, 7 aa, Entamoeba histolytica
YNPSIDN

SEQ ID NO: 2738798 - protein, 6 aa, Entamoeba histolytica
YNPTGS

SEQ ID NO: 2738799 - protein, 7 aa, Entamoeba histolytica
YNSGTYN

SEQ ID NO: 2738800 - protein, 8 aa, Entamoeba histolytica
YNSPFSKK

SEQ ID NO: 2738801 - protein, 4 aa, Entamoeba histolytica
YNTP

SEQ ID NO: 2738802 - protein, 5 aa, Entamoeba histolytica
YNTPQ

SEQ ID NO: 2738803 - protein, 7 aa, Entamoeba histolytica
YNTQEEY

SEQ ID NO: 2738804 - protein, 20 aa, Entamoeba histolytica
YNYEHTRKVNKGNMRSYSKS

SEQ ID NO: 2738805 - protein, 20 aa, Entamoeba histolytica
YNYETQKQFTTDDDVKGTTR

SEQ ID NO: 2738806 - protein, 20 aa, Entamoeba histolytica
YNYKTEKQFTDEDDKNETPR

SEQ ID NO: 2738807 - protein, 20 aa, Entamoeba histolytica
YNYKTEKQFTDTDDKNGDDR

SEQ ID NO: 2738808 - protein, 19 aa, Entamoeba histolytica
YNYKTKKPFTDADDIRGDD

SEQ ID NO: 2738809 - protein, 10 aa, Entamoeba histolytica
YPDGDDLPAT

SEQ ID NO: 2738810 - protein, 4 aa, Entamoeba histolytica
YPKA

SEQ ID NO: 2738811 - protein, 4 aa, Entamoeba histolytica
YPNY

SEQ ID NO: 2738812 - protein, 7 aa, Entamoeba histolytica
YPPETRL

SEQ ID NO: 2738813 - protein, 5 aa, Entamoeba histolytica
YPPQD

SEQ ID NO: 2738814 - protein, 6 aa, Entamoeba histolytica
YPPQDS

SEQ ID NO: 2738815 - protein, 4 aa, Entamoeba histolytica
YPQY

SEQ ID NO: 2738816 - protein, 5 aa, Entamoeba histolytica
YPTAP

SEQ ID NO: 2738817 - protein, 4 aa, Entamoeba histolytica
YPTN

SEQ ID NO: 2738818 - protein, 5 aa, Entamoeba histolytica
YPTTI

SEQ ID NO: 2738819 - protein, 6 aa, Entamoeba histolytica
YPVDTS

SEQ ID NO: 2738820 - protein, 21 aa, Entamoeba histolytica
YPVPSGSASGATASAPAQASP

SEQ ID NO: 2738821 - protein, 5 aa, Entamoeba histolytica
YPYSE

SEQ ID NO: 2738822 - protein, 6 aa, Entamoeba histolytica
YPYSIS

SEQ ID NO: 2738823 - protein, 18 aa, Entamoeba histolytica
YPYTGKANNCSIDGKKPV

SEQ ID NO: 2738824 - protein, 9 aa, Entamoeba histolytica
YQKISKARD

SEQ ID NO: 2738825 - protein, 4 aa, Entamoeba histolytica
YQLE

SEQ ID NO: 2738826 - protein, 7 aa, Entamoeba histolytica
YQPATSD

SEQ ID NO: 2738827 - protein, 9 aa, Entamoeba histolytica
YQPTGDPLP

SEQ ID NO: 2738828 - protein, 4 aa, Entamoeba histolytica
YQQR

SEQ ID NO: 2738829 - protein, 5 aa, Entamoeba histolytica
YQRSK

SEQ ID NO: 2738830 - protein, 10 aa, Entamoeba histolytica
YQSPQSSLQP

SEQ ID NO: 2738831 - protein, 22 aa, Entamoeba histolytica
YQVTEGTTKERLKAGAKEGARQ

SEQ ID NO: 2738832 - protein, 7 aa, Entamoeba histolytica
YRENGIK

SEQ ID NO: 2738833 - protein, 5 aa, Entamoeba histolytica
YRNDP

SEQ ID NO: 2738834 - protein, 14 aa, Entamoeba histolytica
YRQQDGEINRENKW

SEQ ID NO: 2738835 - protein, 8 aa, Entamoeba histolytica
YRYKTRQE

SEQ ID NO: 2738836 - protein, 7 aa, Entamoeba histolytica
YSDETEK

SEQ ID NO: 2738837 - protein, 9 aa, Entamoeba histolytica
YSDGDETVN

SEQ ID NO: 2738838 - protein, 9 aa, Entamoeba histolytica
YSDGDGTVN

SEQ ID NO: 2738839 - protein, 8 aa, Entamoeba histolytica
YSFESDER

SEQ ID NO: 2738840 - protein, 10 aa, Entamoeba histolytica
YSGNSSSQFA

SEQ ID NO: 2738841 - protein, 7 aa, Entamoeba histolytica
YSGQEEK

SEQ ID NO: 2738842 - protein, 16 aa, Entamoeba histolytica
YSKQQAKDLSLSDPWG

SEQ ID NO: 2738843 - protein, 17 aa, Entamoeba histolytica
YSKSGYPTDHDEYTSCS

SEQ ID NO: 2738844 - protein, 4 aa, Entamoeba histolytica
YSPH

SEQ ID NO: 2738845 - protein, 10 aa, Entamoeba histolytica
YSPLSYSGRG

SEQ ID NO: 2738846 - protein, 11 aa, Entamoeba histolytica
YSSEQQLEEGK

SEQ ID NO: 2738847 - protein, 27 aa, Entamoeba histolytica
YSSGEECSNNGEGEANEKKYGCGKCED

SEQ ID NO: 2738848 - protein, 4 aa, Entamoeba histolytica
YSSL

SEQ ID NO: 2738849 - protein, 7 aa, Entamoeba histolytica
YSSQSNY

SEQ ID NO: 2738850 - protein, 9 aa, Entamoeba histolytica
YSSSQRGLC

SEQ ID NO: 2738851 - protein, 8 aa, Entamoeba histolytica
YSTEGKCP

SEQ ID NO: 2738852 - protein, 4 aa, Entamoeba histolytica
YSTI

SEQ ID NO: 2738853 - protein, 7 aa, Entamoeba histolytica
YSTNPYL

SEQ ID NO: 2738854 - protein, 19 aa, Entamoeba histolytica
YSTSASGQCTKTEYSDSSC

SEQ ID NO: 2738855 - protein, 6 aa, Entamoeba histolytica
YSTSSF

SEQ ID NO: 2738856 - protein, 8 aa, Entamoeba histolytica
YSYGPAAS

SEQ ID NO: 2738857 - protein, 10 aa, Entamoeba histolytica
YSYGSSTRCR

SEQ ID NO: 2738858 - protein, 7 aa, Entamoeba histolytica
YTDGDGM

SEQ ID NO: 2738859 - protein, 4 aa, Entamoeba histolytica
YTDS

SEQ ID NO: 2738860 - protein, 8 aa, Entamoeba histolytica
YTGANNDQ

SEQ ID NO: 2738861 - protein, 10 aa, Entamoeba histolytica
YTGTGDNKKI

SEQ ID NO: 2738862 - protein, 15 aa, Entamoeba histolytica
YTHSDTKGDDEKVRS

SEQ ID NO: 2738863 - protein, 7 aa, Entamoeba histolytica
YTNNPGY

SEQ ID NO: 2738864 - protein, 5 aa, Entamoeba histolytica
YTNRP

SEQ ID NO: 2738865 - protein, 5 aa, Entamoeba histolytica
YTPPE

SEQ ID NO: 2738866 - protein, 5 aa, Entamoeba histolytica
YTTKN

SEQ ID NO: 2738867 - protein, 10 aa, Entamoeba histolytica
YVDEEKDEEA

SEQ ID NO: 2738868 - protein, 18 aa, Entamoeba histolytica
YYASKDDSVYCSSSSNIN

SEQ ID NO: 2738869 - protein, 9 aa, Entamoeba histolytica
YYASTENLT

SEQ ID NO: 2738870 - protein, 11 aa, Entamoeba histolytica
YYGAGDRTEEL

SEQ ID NO: 2738871 - protein, 10 aa, Entamoeba histolytica
YYQKPQPAFS

SEQ ID NO: 2738872 - protein, 6 aa, Entamoeba histolytica
YYRGAS

SEQ ID NO: 2738873 - protein, 13 aa, Entamoeba histolytica
YYRNGKGCSECGE

SEQ ID NO: 2738874 - protein, 4 aa, Entamoeba histolytica
YYTD

SEQ ID NO: 2738875 - protein, 30 aa, Entamoeba histolytica; identical to SEQ ID NO: 2473023

SEQ ID NO: 2738876 - protein, 24 aa, Entamoeba histolytica
KIKSGGVAGVMADVWWGLVETSPR

SEQ ID NO: 2738877 - protein, 24 aa, Entamoeba histolytica
KKAGLKFQAVMSFHKCGGNVGDSV

SEQ ID NO: 2738878 - protein, 17 aa, Entamoeba histolytica
VMADVWWGLVETSPRNY

SEQ ID NO: 2738879 - protein, 22 aa, Entamoeba histolytica
CKQHGLTAFTYLRMTRGLLDDG

SEQ ID NO: 2738880 - protein, 24 aa, Entamoeba histolytica
GRFFQEWYFDLLLSHTDKVLSAAR

SEQ ID NO: 2738881 - protein, 22 aa, Entamoeba histolytica
NAEKPIECFCEMYGIPYSSVYL

SEQ ID NO: 2738882 - protein, 21 aa, Entamoeba histolytica
DCNTESWGGCGGGFAEDVLDS

SEQ ID NO: 2738883 - protein, 24 aa, Entamoeba histolytica
DGECKGRHGYFCYTDNDKKKNYYL

SEQ ID NO: 2738884 - protein, 23 aa, Entamoeba histolytica
QNLCGGCYAIATAHHLSTIYAYL

SEQ ID NO: 2738885 - protein, 20 aa, Entamoeba histolytica
VLFAHPVFWLSIPGEVKNFI

SEQ ID NO: 2738886 - protein, 24 aa, Entamoeba histolytica
AQFEKACSTFVFAILEEIPLTKEY

SEQ ID NO: 2738887 - protein, 20 aa, Entamoeba histolytica
AQLIVFPSGYSILVDAGEKK

SEQ ID NO: 2738888 - protein, 25 aa, Entamoeba histolytica
ASGRSWFFQTCIAYGYYQAVSEQSS

SEQ ID NO: 2738889 - protein, 25 aa, Entamoeba histolytica
ASSDCLADFCAFKITEYDGTTCAEA

SEQ ID NO: 2738890 - protein, 20 aa, Entamoeba histolytica
DIKPIHIITFTFENSTEIAK

SEQ ID NO: 2738891 - protein, 22 aa, Entamoeba histolytica
DKESRLCSIYSISHYPTIIYIT

SEQ ID NO: 2738892 - protein, 27 aa, Entamoeba histolytica
DRCPIMLVCQDCFWRCTVQGGCEYICN

SEQ ID NO: 2738893 - protein, 17 aa, Entamoeba histolytica
DYPLKFATSNKFTHFAN

SEQ ID NO: 2738894 - protein, 17 aa, Entamoeba histolytica
ECFACVPHKELFCTEKD

SEQ ID NO: 2738895 - protein, 17 aa, Entamoeba histolytica
EYLNTPITIIWENEESV

SEQ ID NO: 2738896 - protein, 24 aa, Entamoeba histolytica
EYYPLNSCIGFTDYAAYFFYNNNT

SEQ ID NO: 2738897 - protein, 41 aa, Entamoeba histolytica
FALLLTVHAEEDSFDLDENVEMEHEYQLEDNELEEDDDDEF

SEQ ID NO: 2738898 - protein, 22 aa, Entamoeba histolytica
FHFPGRYNLVQTLACEESGKGG

SEQ ID NO: 2738899 - protein, 17 aa, Entamoeba histolytica
FKIDWNTLCGINGVDEY

SEQ ID NO: 2738900 - protein, 17 aa, Entamoeba histolytica
FNMRRCQKFHKLCKKIM

SEQ ID NO: 2738901 - protein, 20 aa, Entamoeba histolytica
GEGLANRLAKYGTRKLGHLM

SEQ ID NO: 2738902 - protein, 21 aa, Entamoeba histolytica
GESKGKIGIFPSHYVERDVKI

SEQ ID NO: 2738903 - protein, 17 aa, Entamoeba histolytica
HRAAIAFLAAYTGPITI

SEQ ID NO: 2738904 - protein, 23 aa, Entamoeba histolytica
IDLEPLDFVWSIPAANLAPNYNK

SEQ ID NO: 2738905 - protein, 21 aa, Entamoeba histolytica
IFSQDIIKFIGKWENYYTFAP

SEQ ID NO: 2738906 - protein, 20 aa, Entamoeba histolytica
IKMVCRSAIDGLIRKLEHQY

SEQ ID NO: 2738907 - protein, 24 aa, Entamoeba histolytica
ILFFSLSSAYIWEFDPNKLQRQLT

SEQ ID NO: 2738908 - protein, 18 aa, Entamoeba histolytica
INGLKYYLESYVFKDILK

SEQ ID NO: 2738909 - protein, 25 aa, Entamoeba histolytica
ISEIAESIGQVFIREGWGCLTMNSK

SEQ ID NO: 2738910 - protein, 25 aa, Entamoeba histolytica
ISVGGKLRGLASMTVFPGMTLEESA

SEQ ID NO: 2738911 - protein, 23 aa, Entamoeba histolytica
KEACGLILFVGWKGQAKARYLKS

SEQ ID NO: 2738912 - protein, 20 aa, Entamoeba histolytica
KKHKGLMLSVEHRFYGASTP

SEQ ID NO: 2738913 - protein, 21 aa, Entamoeba histolytica
KNFIDRMICVFDFDTNTCKDS

SEQ ID NO: 2738914 - protein, 17 aa, Entamoeba histolytica
KYIDNWIAISTPFLGSG

SEQ ID NO: 2738915 - protein, 17 aa, Entamoeba histolytica
LEMDKLIYCTAEQALMD

SEQ ID NO: 2738916 - protein, 18 aa, Entamoeba histolytica
LFISLCFAETLKQKKKLE

SEQ ID NO: 2738917 - protein, 20 aa, Entamoeba histolytica
LKSKLVCSIVEFIAIPERDS

SEQ ID NO: 2738918 - protein, 18 aa, Entamoeba histolytica
LYRQCTKKIIKVLLNQNS

SEQ ID NO: 2738919 - protein, 18 aa, Entamoeba histolytica
NDLDICFANTQKNYFYID

SEQ ID NO: 2738920 - protein, 18 aa, Entamoeba histolytica
NIVSPRFGSTYACDEIDP

SEQ ID NO: 2738921 - protein, 19 aa, Entamoeba histolytica
NNDYWGRHRAAIAFLAAYT

SEQ ID NO: 2738922 - protein, 26 aa, Entamoeba histolytica
RAHSGWAIKIAEGILKRKNAFERLRK

SEQ ID NO: 2738923 - protein, 18 aa, Entamoeba histolytica
RAMMKRLHVKTMSSYKKR

SEQ ID NO: 2738924 - protein, 30 aa, Entamoeba histolytica
RHRHFWHYRNWWLRRHWMRNWKRQMRRWRR

SEQ ID NO: 2738925 - protein, 22 aa, Entamoeba histolytica
SKEIRKAIVSRAVKQNMILRKL

SEQ ID NO: 2738926 - protein, 24 aa, Entamoeba histolytica
STIDEIRNSYLLIYTYHDQGCKNL

SEQ ID NO: 2738927 - protein, 20 aa, Entamoeba histolytica
TEKTLPFNIETPIGVINVVH

SEQ ID NO: 2738928 - protein, 26 aa, Entamoeba histolytica
VENQRKCGVCSPSSMPSSPDKTITYT

SEQ ID NO: 2738929 - protein, 17 aa, Entamoeba histolytica
VLLAVNAEDRFVNHRVH

SEQ ID NO: 2738930 - protein, 18 aa, Entamoeba histolytica
WGTLGYMVGEIWDSASNI

SEQ ID NO: 2738931 - protein, 17 aa, Entamoeba histolytica
YCEKMGKKGEQWEAEFH

SEQ ID NO: 2738932 - protein, 18 aa, Entamoeba histolytica
YDQLMIRRWDTYWDGQFQ

SEQ ID NO: 2738933 - protein, 21 aa, Entamoeba histolytica
YKGGKCIVCVDGYYAKAGECF

SEQ ID NO: 2738934 - protein, 21 aa, Entamoeba histolytica
YKLPFDIKMQCMISSGYESIK

SEQ ID NO: 2738935 - protein, 17 aa, Entamoeba histolytica
YYLESYVFKDILKNPPQ

SEQ ID NO: 2738936 - protein, 20 aa, Entamoeba histolytica
AAAKRLAVYHAQHDEMIKAI

SEQ ID NO: 2738937 - protein, 17 aa, Entamoeba histolytica
AAFAFPYTDLESQIIAK

SEQ ID NO: 2738938 - protein, 25 aa, Entamoeba histolytica
AAFSKLTWLLAQGMTPDEVRNNIKS

SEQ ID NO: 2738939 - protein, 24 aa, Entamoeba histolytica
AAPYDWRFSQSKVIDIWLEQTKQL

SEQ ID NO: 2738940 - protein, 23 aa, Entamoeba histolytica
AAQRRKLPILAFFGGLECEQCGT

SEQ ID NO: 2738941 - protein, 18 aa, Entamoeba histolytica
AASSPFIVFCAIIIAIIF

SEQ ID NO: 2738942 - protein, 24 aa, Entamoeba histolytica
AAVKAAPESVDWRSIMNPAKDQGQ

SEQ ID NO: 2738943 - protein, 18 aa, Entamoeba histolytica
ACIDNCKTCIKKNECSEC

SEQ ID NO: 2738944 - protein, 22 aa, Entamoeba histolytica
ACSSRFPIVFVPAFMSSSLHIK

SEQ ID NO: 2738945 - protein, 25 aa, Entamoeba histolytica
ADICYECNEGFSLQENSCISIIKSI

SEQ ID NO: 2738946 - protein, 19 aa, Entamoeba histolytica
ADIIIPWGEISNNAMTADN

SEQ ID NO: 2738947 - protein, 19 aa, Entamoeba histolytica
ADKFKKLGKVTMKGASSVF

SEQ ID NO: 2738948 - protein, 25 aa, Entamoeba histolytica
ADKPFNIKSFYGMMKRKENSDLYSN

SEQ ID NO: 2738949 - protein, 18 aa, Entamoeba histolytica
AEAELDFRMIGQKFMTVQ

SEQ ID NO: 2738950 - protein, 23 aa, Entamoeba histolytica
AEAVKDLRGCIINMDKPYASGKY

SEQ ID NO: 2738951 - protein, 17 aa, Entamoeba histolytica
AEELKSQRLDNIKEAKN

SEQ ID NO: 2738952 - protein, 19 aa, Entamoeba histolytica
AFAAPKCAQTNVANVVSDL

SEQ ID NO: 2738953 - protein, 19 aa, Entamoeba histolytica
AFFNKAIEIQKDFKRNYNE

SEQ ID NO: 2738954 - protein, 24 aa, Entamoeba histolytica
AGCFLDRLFLLKSFYSKFNISVGI

SEQ ID NO: 2738955 - protein, 22 aa, Entamoeba histolytica
AGEASPPWGITTMFMSWAEMLA

SEQ ID NO: 2738956 - protein, 17 aa, Entamoeba histolytica
AGFKSGDKIAIFCETRY

SEQ ID NO: 2738957 - protein, 23 aa, Entamoeba histolytica
AGFTGVMGDVWWGLVETSPKNYN

SEQ ID NO: 2738958 - protein, 20 aa, Entamoeba histolytica
AGISAQFNPNDKFGASLGGR

SEQ ID NO: 2738959 - protein, 18 aa, Entamoeba histolytica
AGTLNFLGILGLKHAFNH

SEQ ID NO: 2738960 - protein, 24 aa, Entamoeba histolytica
AHHSIFYTKCDGICSLYSLDSNMQ

SEQ ID NO: 2738961 - protein, 19 aa, Entamoeba histolytica
AHIFELCIEFAVIMHGGTV

SEQ ID NO: 2738962 - protein, 24 aa, Entamoeba histolytica
AHNPSTELLIRWYQAGALQPFFRQ

SEQ ID NO: 2738963 - protein, 24 aa, Entamoeba histolytica
AIAEKILEVCGGTDNGHIEVTEEG

SEQ ID NO: 2738964 - protein, 18 aa, Entamoeba histolytica
AIAINAGIDLSNALQREK

SEQ ID NO: 2738965 - protein, 20 aa, Entamoeba histolytica
AIEMKYLLIDYWYKEYFMSV

SEQ ID NO: 2738966 - protein, 35 aa, Entamoeba histolytica
AIETKLFKEQRVKDDKECQNLRVTTHTITNNINKS

SEQ ID NO: 2738967 - protein, 20 aa, Entamoeba histolytica
AIKILGFKSKHEWLEDYVDI

SEQ ID NO: 2738968 - protein, 23 aa, Entamoeba histolytica
AISKRGKESYILARKIDDQIEQM

SEQ ID NO: 2738969 - protein, 24 aa, Entamoeba histolytica
AKDIAKMKFKVQVEILKKNKAKSK

SEQ ID NO: 2738970 - protein, 26 aa, Entamoeba histolytica
AKEIIRKEEKGITGVVEEKNNKEKAV

SEQ ID NO: 2738971 - protein, 19 aa, Entamoeba histolytica
AKKYSRWLPQSALETFKRG

SEQ ID NO: 2738972 - protein, 18 aa, Entamoeba histolytica
AKLEILRKLRKVADSLTG

SEQ ID NO: 2738973 - protein, 19 aa, Entamoeba histolytica
AKLPIVLAAVHAPILSIRS

SEQ ID NO: 2738974 - protein, 18 aa, Entamoeba histolytica
AKNYMSAYYTIRQLSFGK

SEQ ID NO: 2738975 - protein, 22 aa, Entamoeba histolytica
AKSNLTIQSWMYRVALPLFQPI

SEQ ID NO: 2738976 - protein, 17 aa, Entamoeba histolytica
AKVGRQKMHVWMERCKK

SEQ ID NO: 2738977 - protein, 24 aa, Entamoeba histolytica
ALAKLDLRIELAKPFVLQQPKGPM

SEQ ID NO: 2738978 - protein, 17 aa, Entamoeba histolytica
ALLFPIGGTKIFGEQTL

SEQ ID NO: 2738979 - protein, 28 aa, Entamoeba histolytica
ALVLFYDYWCPFGREFSKYLEKVAKNYG

SEQ ID NO: 2738980 - protein, 18 aa, Entamoeba histolytica
ALVRAVGDEVYFAHGTWR

SEQ ID NO: 2738981 - protein, 20 aa, Entamoeba histolytica
AMKALHTFDPSKFVVSEVCS

SEQ ID NO: 2738982 - protein, 18 aa, Entamoeba histolytica
AMNMAMKALHTFDPSKFV

SEQ ID NO: 2738983 - protein, 23 aa, Entamoeba histolytica
AMNRYPINWTPKVKLYCLYSSGI

SEQ ID NO: 2738984 - protein, 19 aa, Entamoeba histolytica
ANINIKGGSYYIHSDSKNN

SEQ ID NO: 2738985 - protein, 24 aa, Entamoeba histolytica
ANRAEYLYRFAVFLDNKKFVEANA

SEQ ID NO: 2738986 - protein, 25 aa, Entamoeba histolytica
ANYNPDNKWGIGIDGDISNKNGEKT

SEQ ID NO: 2738987 - protein, 22 aa, Entamoeba histolytica
AQDCIIDYPTLEYIKVRINYAI

SEQ ID NO: 2738988 - protein, 23 aa, Entamoeba histolytica
AQFEKACSTFVFAILEEIPLTKE

SEQ ID NO: 2738989 - protein, 17 aa, Entamoeba histolytica
AQLKKSLEGIRARVNLF

SEQ ID NO: 2738990 - protein, 19 aa, Entamoeba histolytica
AQSCEKRKPILILSGILAS

SEQ ID NO: 2738991 - protein, 18 aa, Entamoeba histolytica
AREWWAQLYSFEKYQYSS

SEQ ID NO: 2738992 - protein, 24 aa, Entamoeba histolytica
ARLRNMEIGKYFNILASHFSQFSP

SEQ ID NO: 2738993 - protein, 17 aa, Entamoeba histolytica
ASATGTYKVNEHSTLSS

SEQ ID NO: 2738994 - protein, 26 aa, Entamoeba histolytica
ASESCPKKAAKVEVMTEKAALLHKKA

SEQ ID NO: 2738995 - protein, 21 aa, Entamoeba histolytica
ASFSNALAWILLSKGYSLQLG

SEQ ID NO: 2738996 - protein, 23 aa, Entamoeba histolytica
ASGEENAKCVLYGDGKTIKVYSS

SEQ ID NO: 2738997 - protein, 19 aa, Entamoeba histolytica
ASLCVYVGIFVHLNTRIED

SEQ ID NO: 2738998 - protein, 24 aa, Entamoeba histolytica
ASYKLASECYLEYMHLQWNNKTKQ

SEQ ID NO: 2738999 - protein, 23 aa, Entamoeba histolytica
ATKPGFTLHGWWPNFVSGYPSCC

SEQ ID NO: 2739000 - protein, 30 aa, Entamoeba histolytica
AVAKEIKRTCKHLRITKKVCKKIANKMRSK

SEQ ID NO: 2739001 - protein, 27 aa, Entamoeba histolytica
AVDKGTKWLAKNGEAISNTLGKVADVA

SEQ ID NO: 2739002 - protein, 19 aa, Entamoeba histolytica
AVGKSCLLLQFQDKRFQPI

SEQ ID NO: 2739003 - protein, 19 aa, Entamoeba histolytica
AVLESRLLIAGSKYNQNNL

SEQ ID NO: 2739004 - protein, 25 aa, Entamoeba histolytica
AYIMALDIFPNYSFYCRVDDQILVT

SEQ ID NO: 2739005 - protein, 17 aa, Entamoeba histolytica
CANKKCKSGEVIKNGDE

SEQ ID NO: 2739006 - protein, 26 aa, Entamoeba histolytica
CAPYLQIKLLRLLRIMNPSTKYYQQS

SEQ ID NO: 2739007 - protein, 18 aa, Entamoeba histolytica
CCKHTNPPHTHYYSHCKK

SEQ ID NO: 2739008 - protein, 20 aa, Entamoeba histolytica
CCNCSCCKHTNPPHTHYYSH

SEQ ID NO: 2739009 - protein, 29 aa, Entamoeba histolytica
CCPLPSFDIIFTDSFHSFWTYTNKNSVTI

SEQ ID NO: 2739010 - protein, 23 aa, Entamoeba histolytica
CDGHKFLWVRNSWGNDWGVEGGH

SEQ ID NO: 2739011 - protein, 26 aa, Entamoeba histolytica
CENKKLFLIEKLHDFIPIENKEIETT

SEQ ID NO: 2739012 - protein, 28 aa, Entamoeba histolytica
CETRYEWMAMLLACCRQGIIIVTVYATL

SEQ ID NO: 2739013 - protein, 18 aa, Entamoeba histolytica
CFTCKEGYSLINTSCILS

SEQ ID NO: 2739014 - protein, 23 aa, Entamoeba histolytica
CGERKLKKFLIVFKDCENYYDPC

SEQ ID NO: 2739015 - protein, 21 aa, Entamoeba histolytica
CGGGYIKLLPKKSIESEEKFT

SEQ ID NO: 2739016 - protein, 18 aa, Entamoeba histolytica
CGNTYNFTKFISSKFTGA

SEQ ID NO: 2739017 - protein, 19 aa, Entamoeba histolytica
CGTCQVGYSCTEEGMCQRN

SEQ ID NO: 2739018 - protein, 20 aa, Entamoeba histolytica
CIDNKNYLWCYGRTEGTPGK

SEQ ID NO: 2739019 - protein, 31 aa, Entamoeba histolytica
CIILTGKSKEAFKCIKCKSGYSLNSNNECQE

SEQ ID NO: 2739020 - protein, 17 aa, Entamoeba histolytica
CILFVYTTAHSLEEDFE

SEQ ID NO: 2739021 - protein, 17 aa, Entamoeba histolytica
CILTTPFYQKSYSGSGN

SEQ ID NO: 2739022 - protein, 17 aa, Entamoeba histolytica
CIPINFNTIDSFDPNKV

SEQ ID NO: 2739023 - protein, 17 aa, Entamoeba histolytica
CKEEYQQRYGFKCIYVL

SEQ ID NO: 2739024 - protein, 18 aa, Entamoeba histolytica
CKELKPVMEQLEIEEKTN

SEQ ID NO: 2739025 - protein, 21 aa, Entamoeba histolytica
CKGNCKNNCMCAVRYPRQNEF

SEQ ID NO: 2739026 - protein, 19 aa, Entamoeba histolytica
CKGSRGLYEQTIKMVKERM

SEQ ID NO: 2739027 - protein, 17 aa, Entamoeba histolytica
CKIAAGVIKSSCESKLN

SEQ ID NO: 2739028 - protein, 24 aa, Entamoeba histolytica
CKNSPFKQVRVIRLMKKYVKKLER

SEQ ID NO: 2739029 - protein, 19 aa, Entamoeba histolytica
CKNVVKYTFDYCSPTQLNL

SEQ ID NO: 2739030 - protein, 21 aa, Entamoeba histolytica
CKQHGLTAFTYLRMTRGLLDD

SEQ ID NO: 2739031 - protein, 26 aa, Entamoeba histolytica
CKSDLCALEPTILIGVPTVFNRVRKA

SEQ ID NO: 2739032 - protein, 24 aa, Entamoeba histolytica
CLCGDPFVGKTCFFQRFSNGEFNA

SEQ ID NO: 2739033 - protein, 21 aa, Entamoeba histolytica
CLLELTLAVYPTGCKKKGYHC

SEQ ID NO: 2739034 - protein, 22 aa, Entamoeba histolytica
CLTMKKTEFVSGIVTPFSGNLP

SEQ ID NO: 2739035 - protein, 19 aa, Entamoeba histolytica
CLTVSLAYEDDVFVDNVDF

SEQ ID NO: 2739036 - protein, 18 aa, Entamoeba histolytica
CLYQKDYECRIVHSGCLD

SEQ ID NO: 2739037 - protein, 23 aa, Entamoeba histolytica
CNDPRYEQYYTLFKSQIPASEKE

SEQ ID NO: 2739038 - protein, 19 aa, Entamoeba histolytica
CNIDSSLLFKLKNYSTSSF

SEQ ID NO: 2739039 - protein, 17 aa, Entamoeba histolytica
CNKGYEMIHGECKRKEC

SEQ ID NO: 2739040 - protein, 28 aa, Entamoeba histolytica
CNKTIIITPVELVFPFSTNPRIRNAQIL

SEQ ID NO: 2739041 - protein, 23 aa, Entamoeba histolytica
CNNFKGCSKCTVTECLECSNGKD

SEQ ID NO: 2739042 - protein, 21 aa, Entamoeba histolytica
CNSPIILQCGISLQDMDIIFT

SEQ ID NO: 2739043 - protein, 21 aa, Entamoeba histolytica
CNTESWGGCGGGFAENVLNSV

SEQ ID NO: 2739044 - protein, 18 aa, Entamoeba histolytica
CNYNVLPQLVMRNKTNAI

SEQ ID NO: 2739045 - protein, 20 aa, Entamoeba histolytica
CPELIDLYSTSAWQDCFITT

SEQ ID NO: 2739046 - protein, 19 aa, Entamoeba histolytica
CPIPVSRYTASIPIPPLDI

SEQ ID NO: 2739047 - protein, 22 aa, Entamoeba histolytica
CPKCQREIRWGDIIKVLKNKTI

SEQ ID NO: 2739048 - protein, 22 aa, Entamoeba histolytica
CPVLPGPISIKFEMEIPNMSPP

SEQ ID NO: 2739049 - protein, 23 aa, Entamoeba histolytica
CQDGFYLKEGSCVSCENDCSKCL

SEQ ID NO: 2739050 - protein, 26 aa, Entamoeba histolytica
CRKQVPRLLYQMAELEIEWTKKCNPL

SEQ ID NO: 2739051 - protein, 19 aa, Entamoeba histolytica
CRVTWDFVLLVTTWPGEFC

SEQ ID NO: 2739052 - protein, 23 aa, Entamoeba histolytica
CSAISLTELGYWNGVKRIRREFP

SEQ ID NO: 2739053 - protein, 20 aa, Entamoeba histolytica
CSDCFYDCILINGSCIIPER

SEQ ID NO: 2739054 - protein, 19 aa, Entamoeba histolytica
CSECFACVPHKELFCTEKD

SEQ ID NO: 2739055 - protein, 18 aa, Entamoeba histolytica
CSPSCGVCRVGFTCNDYG

SEQ ID NO: 2739056 - protein, 18 aa, Entamoeba histolytica
CSRHKGWFRSWVTVKDAI

SEQ ID NO: 2739057 - protein, 23 aa, Entamoeba histolytica
CSYYFKSNFTYSLNKPMECKSTY

SEQ ID NO: 2739058 - protein, 18 aa, Entamoeba histolytica
CTCGNVGNSFNYVRDHGI

SEQ ID NO: 2739059 - protein, 28 aa, Entamoeba histolytica
CTIEIKEIPDYVGTFSFGIDDDTCSHRN

SEQ ID NO: 2739060 - protein, 20 aa, Entamoeba histolytica
CTQDGLFCVIDGVHNKQYYE

SEQ ID NO: 2739061 - protein, 22 aa, Entamoeba histolytica
CTTQYFRKVWVDPLRKRLPDAK

SEQ ID NO: 2739062 - protein, 24 aa, Entamoeba histolytica
CTTSDIPCSGIIHINDKTKTTSID

SEQ ID NO: 2739063 - protein, 17 aa, Entamoeba histolytica
CVILCFAQQSQENKPEP

SEQ ID NO: 2739064 - protein, 18 aa, Entamoeba histolytica
CWIVRNSWGTGWGDKGYI

SEQ ID NO: 2739065 - protein, 29 aa, Entamoeba histolytica
CWIVSFILPSWIELKWSNEGICFLFKLNK

SEQ ID NO: 2739066 - protein, 17 aa, Entamoeba histolytica
CYLWYLHGVWNPITNKL

SEQ ID NO: 2739067 - protein, 18 aa, Entamoeba histolytica
CYYASKKNYRMCVFTCRG

SEQ ID NO: 2739068 - protein, 19 aa, Entamoeba histolytica
DAASSPFIVLFAIIGVILF

SEQ ID NO: 2739069 - protein, 21 aa, Entamoeba histolytica
DACYYPCKKCVKSADICYECN

SEQ ID NO: 2739070 - protein, 23 aa, Entamoeba histolytica
DAKARTGVGIPIIKKYKEKIEAQ

SEQ ID NO: 2739071 - protein, 17 aa, Entamoeba histolytica
DALWRTFMQYFKDSSYN

SEQ ID NO: 2739072 - protein, 19 aa, Entamoeba histolytica
DASVGKTGIFKRFIKDQFS

SEQ ID NO: 2739073 - protein, 25 aa, Entamoeba histolytica
DAYFFPCYSCGNAAGQVNSFWQKVI

SEQ ID NO: 2739074 - protein, 17 aa, Entamoeba histolytica
DCISKCNDTVIFSKKEK

SEQ ID NO: 2739075 - protein, 18 aa, Entamoeba histolytica
DCTCTFKNFEYQNGYYDC

SEQ ID NO: 2739076 - protein, 27 aa, Entamoeba histolytica
DDDAVAESLFAEFDDEDLLDSDEGLDD

SEQ ID NO: 2739077 - protein, 20 aa, Entamoeba histolytica
DDDDEFELEDDEEDDDEEEE

SEQ ID NO: 2739078 - protein, 25 aa, Entamoeba histolytica
DDEFYHFRHGCIMHRRMVKAQRMTE

SEQ ID NO: 2739079 - protein, 26 aa, Entamoeba histolytica
DDERGKCYSLAFKIAKYAANLFDPQE

SEQ ID NO: 2739080 - protein, 17 aa, Entamoeba histolytica
DDKEVQRDLKLFPYKII

SEQ ID NO: 2739081 - protein, 22 aa, Entamoeba histolytica
DDLKQILKDAGVKRRDLADPDT

SEQ ID NO: 2739082 - protein, 21 aa, Entamoeba histolytica
DDMKLAVSIADRMKIETQIDK

SEQ ID NO: 2739083 - protein, 18 aa, Entamoeba histolytica
DDQLLICHPQIIPKEINV

SEQ ID NO: 2739084 - protein, 19 aa, Entamoeba histolytica
DDSEKDWLVGHTVVDGQIL

SEQ ID NO: 2739085 - protein, 24 aa, Entamoeba histolytica
DDVKECPVCHGSGVKTETRRIGPG

SEQ ID NO: 2739086 - protein, 23 aa, Entamoeba histolytica
DDVRLGRRIIRDMNFRGRTLQSV

SEQ ID NO: 2739087 - protein, 35 aa, Entamoeba histolytica
DEDEEYDLEDDDFDYDDDDDFELEEDEEDDDEEED

SEQ ID NO: 2739088 - protein, 22 aa, Entamoeba histolytica
DEFNTRCECCGLKNKQIQFEKM

SEQ ID NO: 2739089 - protein, 27 aa, Entamoeba histolytica
DEFRLLPSEDPVVMLVAIGISPVYTNN

SEQ ID NO: 2739090 - protein, 26 aa, Entamoeba histolytica
DEIDPNFPLSIFAKCFHDLIKKFKKL

SEQ ID NO: 2739091 - protein, 23 aa, Entamoeba histolytica
DEISFTIDCISSFEFVLTNFDSL

SEQ ID NO: 2739092 - protein, 30 aa, Entamoeba histolytica
DEKMYKLRLKKRLNKMVSIAKECEKKTPNG

SEQ ID NO: 2739093 - protein, 17 aa, Entamoeba histolytica
DEPNCKWVDHIVTVVGY

SEQ ID NO: 2739094 - protein, 18 aa, Entamoeba histolytica
DFRNFGYKIAAPLLEKIG

SEQ ID NO: 2739095 - protein, 28 aa, Entamoeba histolytica
DGFSDCSLCTGEWCGSCKSVPKRQAYVA

SEQ ID NO: 2739096 - protein, 17 aa, Entamoeba histolytica
DGIDFSFTLTRAKFEEL

SEQ ID NO: 2739097 - protein, 24 aa, Entamoeba histolytica
DGTWKDKLFEISCEENGYYINSNE

SEQ ID NO: 2739098 - protein, 25 aa, Entamoeba histolytica
DHVGMPFTNGFWYLMEKAGITFGKF

SEQ ID NO: 2739099 - protein, 23 aa, Entamoeba histolytica
DIDGYSRVTLCPSQITPENDCTC

SEQ ID NO: 2739100 - protein, 25 aa, Entamoeba histolytica
DIEQELKDVGLYDLFSKKESIHEND

SEQ ID NO: 2739101 - protein, 20 aa, Entamoeba histolytica
DIKAMLKMKIERMKIRANKN

SEQ ID NO: 2739102 - protein, 20 aa, Entamoeba histolytica
DINNRYILWVFFNQTLNEQY

SEQ ID NO: 2739103 - protein, 19 aa, Entamoeba histolytica
DISEAAKHSVEEQVSQEIP

SEQ ID NO: 2739104 - protein, 20 aa, Entamoeba histolytica
DKCETCCRVLFAMEYDPTNN

SEQ ID NO: 2739105 - protein, 23 aa, Entamoeba histolytica
DKCKVRSHILKVVYIICEKYTPD

SEQ ID NO: 2739106 - protein, 23 aa, Entamoeba histolytica
DKFSVDGKVGYSYANGHGSSNYG

SEQ ID NO: 2739107 - protein, 19 aa, Entamoeba histolytica
DKFVLSTLEEINWKKLFKV

SEQ ID NO: 2739108 - protein, 25 aa, Entamoeba histolytica
DKKFELDWWMNVVIFPVFSKLNDAM

SEQ ID NO: 2739109 - protein, 19 aa, Entamoeba histolytica
DKPEISRYIDTLKSELNGS

SEQ ID NO: 2739110 - protein, 23 aa, Entamoeba histolytica
DLFKKTLGPVRMVLSDAKLDKKD

SEQ ID NO: 2739111 - protein, 29 aa, Entamoeba histolytica
DLHYKPDEKWDISAGVSRSNEGTTWSAKA

SEQ ID NO: 2739112 - protein, 20 aa, Entamoeba histolytica
DLQAAAFDWRFISQPDSWKK

SEQ ID NO: 2739113 - protein, 18 aa, Entamoeba histolytica
DLTLSYNPSDKFSVDGKV

SEQ ID NO: 2739114 - protein, 17 aa, Entamoeba histolytica
DLYPRKGKRSGAWEEML

SEQ ID NO: 2739115 - protein, 24 aa, Entamoeba histolytica
DMILQGGFDLAKLQQFFDISTLPI

SEQ ID NO: 2739116 - protein, 28 aa, Entamoeba histolytica
DNFNGAKFPLDWICKINSLSNNKHKFHV

SEQ ID NO: 2739117 - protein, 24 aa, Entamoeba histolytica
DNQARLIRCLSLEHRVIIRYRHIV

SEQ ID NO: 2739118 - protein, 19 aa, Entamoeba histolytica
DNVSTIFILLSTITLTLLF

SEQ ID NO: 2739119 - protein, 24 aa, Entamoeba histolytica
DQAQCGSCYTFGSLAALEGRLLIE

SEQ ID NO: 2739120 - protein, 22 aa, Entamoeba histolytica
DQATCISCNYPGNQIEPKATKT

SEQ ID NO: 2739121 - protein, 21 aa, Entamoeba histolytica
DQGGCSSCYSFGAVAAIESRL

SEQ ID NO: 2739122 - protein, 24 aa, Entamoeba histolytica
DQRKCGVCTASSPSKEEIIYNKVI

SEQ ID NO: 2739123 - protein, 19 aa, Entamoeba histolytica
DRAAFVFYNIIGQKIEEIS

SEQ ID NO: 2739124 - protein, 25 aa, Entamoeba histolytica
DRIYPKKLWLAIIHSFPSKINHVEN

SEQ ID NO: 2739125 - protein, 19 aa, Entamoeba histolytica
DRKLLMCKMRTIRKNLRKI

SEQ ID NO: 2739126 - protein, 24 aa, Entamoeba histolytica
DRVAEVIRRKMLILQEQIKTAKIQ

SEQ ID NO: 2739127 - protein, 21 aa, Entamoeba histolytica
DSIKYPIVYLLHGMDSDCQSF

SEQ ID NO: 2739128 - protein, 21 aa, Entamoeba histolytica
DSLPQILCMAAYPSNNGIAVP

SEQ ID NO: 2739129 - protein, 22 aa, Entamoeba histolytica
DSPRFKWRGLMVDLARNAISKL

SEQ ID NO: 2739130 - protein, 18 aa, Entamoeba histolytica
DSVFRALLYIPAEGPNPF

SEQ ID NO: 2739131 - protein, 27 aa, Entamoeba histolytica
DTIPLARLDAGWFLRDILSFQQMKYEG

SEQ ID NO: 2739132 - protein, 18 aa, Entamoeba histolytica
DVACKKMNVDGRSYNIQL

SEQ ID NO: 2739133 - protein, 17 aa, Entamoeba histolytica
DVFKRKYGKDLRNDKRA

SEQ ID NO: 2739134 - protein, 22 aa, Entamoeba histolytica
DVIPYQSLCDAVFIDTQYFDPS

SEQ ID NO: 2739135 - protein, 24 aa, Entamoeba histolytica
DVSSCFKKLLPIVFPEDCLTISVM

SEQ ID NO: 2739136 - protein, 26 aa, Entamoeba histolytica
DWGVEGGHFKIDWDTLCGINGIDHYE

SEQ ID NO: 2739137 - protein, 18 aa, Entamoeba histolytica
DWRYYRYGEYKHKRNWFA

SEQ ID NO: 2739138 - protein, 19 aa, Entamoeba histolytica
DYKADKFTGSLDIKHTKDT

SEQ ID NO: 2739139 - protein, 25 aa, Entamoeba histolytica
DYLCKKKLGGVMFWSLDLDKNYVNT

SEQ ID NO: 2739140 - protein, 19 aa, Entamoeba histolytica
DYLYGEFINEFVLVTEKKF

SEQ ID NO: 2739141 - protein, 22 aa, Entamoeba histolytica
DYYECSPDFNGFRHCALGTHCR

SEQ ID NO: 2739142 - protein, 26 aa, Entamoeba histolytica
EATVALTFQKEVLFWVTVPCAKNVGS

SEQ ID NO: 2739143 - protein, 17 aa, Entamoeba histolytica
EAVGVVLTLLDHVKKTL

SEQ ID NO: 2739144 - protein, 17 aa, Entamoeba histolytica
ECCFTYWKNEEITQYVQ

SEQ ID NO: 2739145 - protein, 21 aa, Entamoeba histolytica
ECDGHKFLWVRSSWGNDWGVE

SEQ ID NO: 2739146 - protein, 23 aa, Entamoeba histolytica
ECDGHKFLWVRSSWGNDWGVENG

SEQ ID NO: 2739147 - protein, 25 aa, Entamoeba histolytica
ECKRKECSMFEKCVFCNNEECLECE

SEQ ID NO: 2739148 - protein, 25 aa, Entamoeba histolytica
ECLDKLEMINGICYPTTCSSFDKCF

SEQ ID NO: 2739149 - protein, 17 aa, Entamoeba histolytica
ECTSCPAIPIGCVGCSG

SEQ ID NO: 2739150 - protein, 24 aa, Entamoeba histolytica
EDDDDEDDEFELEDDDEDDDEEDD

SEQ ID NO: 2739151 - protein, 25 aa, Entamoeba histolytica
EDDDEFELEDDDEFELEDDEEEDDE

SEQ ID NO: 2739152 - protein, 46 aa, Entamoeba histolytica
EDEYELEDDGLFYDDIFGNGYGYYGIPYYGVGRYPFNFYHPMYEYF

SEQ ID NO: 2739153 - protein, 17 aa, Entamoeba histolytica
EDIIKLFSLDMKKGTTI

SEQ ID NO: 2739154 - protein, 17 aa, Entamoeba histolytica
EDINMVQLLGGGMRVPM

SEQ ID NO: 2739155 - protein, 29 aa, Entamoeba histolytica
EDIYSPFKRSCVIQNRINTITAQTKAIHN

SEQ ID NO: 2739156 - protein, 20 aa, Entamoeba histolytica
EDKIDSWKALDFHNEEFEEG

SEQ ID NO: 2739157 - protein, 25 aa, Entamoeba histolytica
EDLCLLRLISMRLFSQNVIKTSFGF

SEQ ID NO: 2739158 - protein, 18 aa, Entamoeba histolytica
EDLFRTILDESFITVVGF

SEQ ID NO: 2739159 - protein, 26 aa, Entamoeba histolytica
EDMCSGKLCRFRVKQVMRKCKLYEHK

SEQ ID NO: 2739160 - protein, 107 aa, Entamoeba histolytica
EDMMKKTMMKKTMMKKTMMKKTMMKKTMMKKTMMKKTMMKKTMMKKTMMKKTMMKKTMMKKTMMKKTMMKKTMMKKTMMKKMKMMKMMMMKKTMKKMMKTTMKTTMK

SEQ ID NO: 2739161 - protein, 18 aa, Entamoeba histolytica
EDRARLELEIEAIQKKLH

SEQ ID NO: 2739162 - protein, 28 aa, Entamoeba histolytica
EDSKEGCLCKFLWNDTKGVHYNKWDCQL

SEQ ID NO: 2739163 - protein, 22 aa, Entamoeba histolytica
EECTRRGLSHAMNLVGYGTTKE

SEQ ID NO: 2739164 - protein, 26 aa, Entamoeba histolytica
EEELPEIELYMLLSVGDLENLNEIYK

SEQ ID NO: 2739165 - protein, 21 aa, Entamoeba histolytica
EEEVIPRFKEHIVRINKRQPQ

SEQ ID NO: 2739166 - protein, 24 aa, Entamoeba histolytica
EEILKRKIKEYGFVSPDEEEVNVT

SEQ ID NO: 2739167 - protein, 25 aa, Entamoeba histolytica
EELLIRWYQVGTFYPFFRAHAHLDT

SEQ ID NO: 2739168 - protein, 17 aa, Entamoeba histolytica
EELPMNIRLGFVKDSVM

SEQ ID NO: 2739169 - protein, 19 aa, Entamoeba histolytica
EELRKELFIQYNKLCSEGQ

SEQ ID NO: 2739170 - protein, 24 aa, Entamoeba histolytica
EEMYMKQMIELCKERESGIRRREE

SEQ ID NO: 2739171 - protein, 22 aa, Entamoeba histolytica
EESEYKYTYVLHYTASSSSGNA

SEQ ID NO: 2739172 - protein, 24 aa, Entamoeba histolytica
EESKITCLLYHDYYSVCTDKEDEC

SEQ ID NO: 2739173 - protein, 20 aa, Entamoeba histolytica
EEYKDYLLKNGVVSLNECKP

SEQ ID NO: 2739174 - protein, 26 aa, Entamoeba histolytica
EEYQQRYGFKCIYVLVESSVRQTIYL

SEQ ID NO: 2739175 - protein, 21 aa, Entamoeba histolytica
EFTKRAEVIKSITEFLHPELY

SEQ ID NO: 2739176 - protein, 17 aa, Entamoeba histolytica
EFVKALEKMAQFDKLVG

SEQ ID NO: 2739177 - protein, 18 aa, Entamoeba histolytica
EGACIYCRKYFRQCAECD

SEQ ID NO: 2739178 - protein, 21 aa, Entamoeba histolytica
EGAILCNLCKDTVKLVENLLT

SEQ ID NO: 2739179 - protein, 23 aa, Entamoeba histolytica
EGIILRKRITEIDKIIKGYEHQI

SEQ ID NO: 2739180 - protein, 19 aa, Entamoeba histolytica
EGIRTCPRNTKCISNAHHT

SEQ ID NO: 2739181 - protein, 20 aa, Entamoeba histolytica
EGKFGKFASAIQKGASGVSK

SEQ ID NO: 2739182 - protein, 22 aa, Entamoeba histolytica
EGNCRKDLLCSIHCMKESEFIT

SEQ ID NO: 2739183 - protein, 17 aa, Entamoeba histolytica
EGSCVSCENDCSKCLYN

SEQ ID NO: 2739184 - protein, 24 aa, Entamoeba histolytica
EGTQRAAAVGGRFVINKYAEKYNS

SEQ ID NO: 2739185 - protein, 25 aa, Entamoeba histolytica
EGVSEYWLGFYVRNYIIGLKGVKIS

SEQ ID NO: 2739186 - protein, 19 aa, Entamoeba histolytica
EHCFIPFQFEQKIKGYSIE

SEQ ID NO: 2739187 - protein, 23 aa, Entamoeba histolytica
EHKSESNTVFWLMDAVPGDVLNQ

SEQ ID NO: 2739188 - protein, 24 aa, Entamoeba histolytica
EHRVIIRYRHIVIKEESSYIPTTS

SEQ ID NO: 2739189 - protein, 24 aa, Entamoeba histolytica
EIADCLRTSLDLTESFTNLISECP

SEQ ID NO: 2739190 - protein, 22 aa, Entamoeba histolytica
EIAEIVRRKMLILEEKIKTAKI

SEQ ID NO: 2739191 - protein, 36 aa, Entamoeba histolytica
EIFYTINGCFWKKFKIPWRNVAVAISFGKFHPIQIN

SEQ ID NO: 2739192 - protein, 23 aa, Entamoeba histolytica
EIKESKKRLSIRKEMMKMKREEL

SEQ ID NO: 2739193 - protein, 25 aa, Entamoeba histolytica
EILQMPAYCKLPLSVYITTHRYDNF

SEQ ID NO: 2739194 - protein, 23 aa, Entamoeba histolytica
EIPELRYIRGCYNTQQYFKIYKT

SEQ ID NO: 2739195 - protein, 28 aa, Entamoeba histolytica
EIRCREGIRWSQKVLRRIAIEMREELIK

SEQ ID NO: 2739196 - protein, 21 aa, Entamoeba histolytica
EIVLGLPYSCAIDMWSVGCMT

SEQ ID NO: 2739197 - protein, 26 aa, Entamoeba histolytica
EIYGANPLLFCFGNFFDEFRLCSDIP

SEQ ID NO: 2739198 - protein, 17 aa, Entamoeba histolytica
EKAEGSGEGAGKTNSGK

SEQ ID NO: 2739199 - protein, 17 aa, Entamoeba histolytica
EKCIKKELPSDVCVDIY

SEQ ID NO: 2739200 - protein, 23 aa, Entamoeba histolytica
EKCLEHCNLCYKDDTCNACDDNY

SEQ ID NO: 2739201 - protein, 22 aa, Entamoeba histolytica
EKDGLYYYLLRTEKALFNEYFN

SEQ ID NO: 2739202 - protein, 22 aa, Entamoeba histolytica
EKDGLYYYLLRTEKVSFNEYFN

SEQ ID NO: 2739203 - protein, 21 aa, Entamoeba histolytica
EKEGKTNEKGIEQSTNKNPNQ

SEQ ID NO: 2739204 - protein, 24 aa, Entamoeba histolytica
EKFFPSKLFYQWVTRNGKYSQTRE

SEQ ID NO: 2739205 - protein, 27 aa, Entamoeba histolytica
EKGFFSMRWYCESKLSMAIMAQELAKR

SEQ ID NO: 2739206 - protein, 23 aa, Entamoeba histolytica
EKGKKGIEASIDYKGDKLSTNSQ

SEQ ID NO: 2739207 - protein, 25 aa, Entamoeba histolytica
EKKYGCGKCEDKVKTICPGNTPSGD

SEQ ID NO: 2739208 - protein, 27 aa, Entamoeba histolytica
EKLKQMLRLYVRRVFVSGDFYTTLPDY

SEQ ID NO: 2739209 - protein, 19 aa, Entamoeba histolytica
EKLRKDRVAEVIRRKMLIL

SEQ ID NO: 2739210 - protein, 33 aa, Entamoeba histolytica
EKPVFIKFFAPWCGHCKRLAPIYEEFSNVAATE

SEQ ID NO: 2739211 - protein, 18 aa, Entamoeba histolytica
EKQILVFDLGGGTFDVSL

SEQ ID NO: 2739212 - protein, 25 aa, Entamoeba histolytica
EKQTNCFNLALKIAEHALKVRDPLT

SEQ ID NO: 2739213 - protein, 25 aa, Entamoeba histolytica
EKSNEIHGSLNYKSKDGKFDGSLDA

SEQ ID NO: 2739214 - protein, 27 aa, Entamoeba histolytica
EKSPCKMCVELGRRAKESLALNMDNAE

SEQ ID NO: 2739215 - protein, 18 aa, Entamoeba histolytica
EKTLPFNIETPIGVINVV

SEQ ID NO: 2739216 - protein, 18 aa, Entamoeba histolytica
ELDYQWVIESNVNKTQIL

SEQ ID NO: 2739217 - protein, 21 aa, Entamoeba histolytica
ELHSKEKWKIIGGMKNITENQ

SEQ ID NO: 2739218 - protein, 19 aa, Entamoeba histolytica
ELKTSINLMTIKKQKEEFV

SEQ ID NO: 2739219 - protein, 24 aa, Entamoeba histolytica
ELLLKVKIPIGFGALIHDAKYYLP

SEQ ID NO: 2739220 - protein, 18 aa, Entamoeba histolytica
ELPQHYCYFVLDELYFKI

SEQ ID NO: 2739221 - protein, 23 aa, Entamoeba histolytica
ELVEWKYQFDQMIAKRSNEYRFE

SEQ ID NO: 2739222 - protein, 18 aa, Entamoeba histolytica
EMVLELFSVLNYGQILDM

SEQ ID NO: 2739223 - protein, 20 aa, Entamoeba histolytica
EMYCQLITGMFVFLEDEQNS

SEQ ID NO: 2739224 - protein, 18 aa, Entamoeba histolytica
ENDVKIMRLFAGLGEKFF

SEQ ID NO: 2739225 - protein, 18 aa, Entamoeba histolytica
ENERRLNELIGIEIRCRE

SEQ ID NO: 2739226 - protein, 20 aa, Entamoeba histolytica
ENIDQIFALLARRLVEQQGN

SEQ ID NO: 2739227 - protein, 29 aa, Entamoeba histolytica
ENKLPTGCYCTYSLISKQECIFDCENENE

SEQ ID NO: 2739228 - protein, 23 aa, Entamoeba histolytica
ENRLRRLRKLIGHLKETKKSIYC

SEQ ID NO: 2739229 - protein, 25 aa, Entamoeba histolytica
ENTKRKVVIISHSMGAFITYKLLDY

SEQ ID NO: 2739230 - protein, 25 aa, Entamoeba histolytica
ENTMKFIMENALFKFEMPAPLPEEK

SEQ ID NO: 2739231 - protein, 26 aa, Entamoeba histolytica
EPIEYKRWGDPYIEGNAIHYRFSVVQ

SEQ ID NO: 2739232 - protein, 18 aa, Entamoeba histolytica
EPLLKPLFLMYPEDEMTY

SEQ ID NO: 2739233 - protein, 25 aa, Entamoeba histolytica
EPPEYPMRFYGKVYFNNTLKITKSD

SEQ ID NO: 2739234 - protein, 41 aa, Entamoeba histolytica
EQCGKVCEPQCEYLHCFGKQCKCRMVHLEYLLSTIEKKMKR

SEQ ID NO: 2739235 - protein, 26 aa, Entamoeba histolytica
EQEGPYQYNPCVWLDQTTWFNKKNNN

SEQ ID NO: 2739236 - protein, 32 aa, Entamoeba histolytica
EQINDCYDWAVANKRIRGSDCYVYGKEQLAID

SEQ ID NO: 2739237 - protein, 21 aa, Entamoeba histolytica
EQQWLFPKILHKIFGQCEKVA

SEQ ID NO: 2739238 - protein, 23 aa, Entamoeba histolytica
ERDISLYPAFIIIRHHSQKDMIL

SEQ ID NO: 2739239 - protein, 20 aa, Entamoeba histolytica
EREIKAIAINAGIDLSNALQ

SEQ ID NO: 2739240 - protein, 18 aa, Entamoeba histolytica
EREMHPSIEKCEEMYKKL

SEQ ID NO: 2739241 - protein, 25 aa, Entamoeba histolytica
ERLIKKKLARLVVRRKKYNSSEKLV

SEQ ID NO: 2739242 - protein, 17 aa, Entamoeba histolytica
ERLKAGAKEGARQLLKD

SEQ ID NO: 2739243 - protein, 19 aa, Entamoeba histolytica
ERSFRCMNRTKGVMQRIRY

SEQ ID NO: 2739244 - protein, 23 aa, Entamoeba histolytica
ERVKRLSKFRIHNFQKQHAELLK

SEQ ID NO: 2739245 - protein, 23 aa, Entamoeba histolytica
ESIYCLMPNYLFVEKEVGNCTTN

SEQ ID NO: 2739246 - protein, 24 aa, Entamoeba histolytica
ESKKSLKSKIKVASKTAKKAAKAE

SEQ ID NO: 2739247 - protein, 17 aa, Entamoeba histolytica
ESLKLCKEMGADILEIE

SEQ ID NO: 2739248 - protein, 19 aa, Entamoeba histolytica
ESLKVIHFYVWDSAITPNG

SEQ ID NO: 2739249 - protein, 17 aa, Entamoeba histolytica
ESLYRYSGGIYKSQSCT

SEQ ID NO: 2739250 - protein, 22 aa, Entamoeba histolytica
ESRPSPFGAVDCKIGSKKMGVN

SEQ ID NO: 2739251 - protein, 18 aa, Entamoeba histolytica
ESSFPYKPFEQHCLQNQK

SEQ ID NO: 2739252 - protein, 21 aa, Entamoeba histolytica
ESSSFPELSKQGAFNQENVLN

SEQ ID NO: 2739253 - protein, 19 aa, Entamoeba histolytica
ESVPQALKEGAETVSQGTT

SEQ ID NO: 2739254 - protein, 17 aa, Entamoeba histolytica
ETECSKCGNKYTLTSGK

SEQ ID NO: 2739255 - protein, 20 aa, Entamoeba histolytica
ETKGKLFVDIVVDYPKSLNN

SEQ ID NO: 2739256 - protein, 25 aa, Entamoeba histolytica
ETNIFYKGCSGLLIPKIEQCEITKS

SEQ ID NO: 2739257 - protein, 24 aa, Entamoeba histolytica
ETVNYRFWYHDSWQHALQNRPYHI

SEQ ID NO: 2739258 - protein, 24 aa, Entamoeba histolytica
EVAKELKISYFGGGTVVMAAADRD

SEQ ID NO: 2739259 - protein, 23 aa, Entamoeba histolytica
EVDNKFKSFIGMINVNGEIVMEE

SEQ ID NO: 2739260 - protein, 25 aa, Entamoeba histolytica
EVFIDLWEGYLYFRGFKCNTAQQDN

SEQ ID NO: 2739261 - protein, 31 aa, Entamoeba histolytica
EVGKSSKNGLEYSAGVNYDLGKNSHLSLTAG

SEQ ID NO: 2739262 - protein, 21 aa, Entamoeba histolytica
EVKMLESYNNLYVIYKSSLSQ

SEQ ID NO: 2739263 - protein, 19 aa, Entamoeba histolytica
EVNMLKSVIKRMKVIVNII

SEQ ID NO: 2739264 - protein, 18 aa, Entamoeba histolytica
EVNYLGCIAVSPTWDSLI

SEQ ID NO: 2739265 - protein, 20 aa, Entamoeba histolytica
EVVLVFGGLLLRGNRVTKTS

SEQ ID NO: 2739266 - protein, 20 aa, Entamoeba histolytica
EVVVTFGGHLYRGNRVQKLK

SEQ ID NO: 2739267 - protein, 19 aa, Entamoeba histolytica
EVYYGGDVFVEFKREKLCN

SEQ ID NO: 2739268 - protein, 24 aa, Entamoeba histolytica
EWEYPPKCQWMLEFMNEQFKNWLS

SEQ ID NO: 2739269 - protein, 27 aa, Entamoeba histolytica
EWQFPPESQWMLEIMIDLFKPWLSDSS

SEQ ID NO: 2739270 - protein, 19 aa, Entamoeba histolytica
EYGCRECSEGYYLINKECS

SEQ ID NO: 2739271 - protein, 19 aa, Entamoeba histolytica
EYTNAFKYTQGVKMKLKMN

SEQ ID NO: 2739272 - protein, 17 aa, Entamoeba histolytica
EYYPLNSCIGFTDYAAY

SEQ ID NO: 2739273 - protein, 20 aa, Entamoeba histolytica
FAGVKYPLEWINKFGNEKTG

SEQ ID NO: 2739274 - protein, 20 aa, Entamoeba histolytica
FAHGTWRGYYAMLRIYKVYD

SEQ ID NO: 2739275 - protein, 18 aa, Entamoeba histolytica
FAHPVFWLSIPGEVKNFI

SEQ ID NO: 2739276 - protein, 17 aa, Entamoeba histolytica
FAIACILSCGGSVGSIP

SEQ ID NO: 2739277 - protein, 33 aa, Entamoeba histolytica
FALFLTVHAEEEFELDDDFEINNEDFDFNDDEY

SEQ ID NO: 2739278 - protein, 25 aa, Entamoeba histolytica
FAPYKMYTSFAIPRRVHDIRGGAIR

SEQ ID NO: 2739279 - protein, 24 aa, Entamoeba histolytica
FAPYKMYTSFSIPRRVHDIRGGAN

SEQ ID NO: 2739280 - protein, 24 aa, Entamoeba histolytica
FAPYRMYTSYAIPKRVHDIRAGAF

SEQ ID NO: 2739281 - protein, 24 aa, Entamoeba histolytica
FAPYRMYTSYAIPKRVHDIRGGAN

SEQ ID NO: 2739282 - protein, 25 aa, Entamoeba histolytica
FAQYREKCVKKRDEFGVLRNKCDLP

SEQ ID NO: 2739283 - protein, 17 aa, Entamoeba histolytica
FCCVSCFPSDGVVGDGC

SEQ ID NO: 2739284 - protein, 17 aa, Entamoeba histolytica
FDDEDLLDSDEGLDDDD

SEQ ID NO: 2739285 - protein, 20 aa, Entamoeba histolytica
FDDLPIVLIFPENKTLISIK

SEQ ID NO: 2739286 - protein, 27 aa, Entamoeba histolytica
FDNGLSPHCWWGFYGKLLNRRQLNKFL

SEQ ID NO: 2739287 - protein, 17 aa, Entamoeba histolytica
FDNYPSEYGRFFQEWYF

SEQ ID NO: 2739288 - protein, 20 aa, Entamoeba histolytica
FDSLWLSPYANFNFQSFSMN

SEQ ID NO: 2739289 - protein, 20 aa, Entamoeba histolytica
FDVVKSFILMILIGNKYDLE

SEQ ID NO: 2739290 - protein, 20 aa, Entamoeba histolytica
FESLIQLPLIGLKININEKT

SEQ ID NO: 2739291 - protein, 17 aa, Entamoeba histolytica
FESLNNWREEFLVQASP

SEQ ID NO: 2739292 - protein, 17 aa, Entamoeba histolytica
FFPWLIKDKWDNLNEIK

SEQ ID NO: 2739293 - protein, 21 aa, Entamoeba histolytica
FGAAIAELQKTGGIIDLDPTK

SEQ ID NO: 2739294 - protein, 25 aa, Entamoeba histolytica
FGLIEWVSAMGIPLFYDGSKQLIEL

SEQ ID NO: 2739295 - protein, 18 aa, Entamoeba histolytica
FHFDYPVPIQWKTIIQHF

SEQ ID NO: 2739296 - protein, 21 aa, Entamoeba histolytica
FHRVIPGFIIQGGDIVSANGL

SEQ ID NO: 2739297 - protein, 17 aa, Entamoeba histolytica
FHTPRKCQIENEEGIKA

SEQ ID NO: 2739298 - protein, 18 aa, Entamoeba histolytica
FIAFTYSFKCETIDITIP

SEQ ID NO: 2739299 - protein, 17 aa, Entamoeba histolytica
FIEQLAVDDELWTKFDS

SEQ ID NO: 2739300 - protein, 26 aa, Entamoeba histolytica
FIIQLLRYAALRGILIYPEIDIPGHT

SEQ ID NO: 2739301 - protein, 21 aa, Entamoeba histolytica
FIKFAFSLRYQFIDYWYSSFY

SEQ ID NO: 2739302 - protein, 17 aa, Entamoeba histolytica
FINEFVLVTEKKFTKAF

SEQ ID NO: 2739303 - protein, 23 aa, Entamoeba histolytica
FIPYDVFKFGNSRFLNYGDDTIA

SEQ ID NO: 2739304 - protein, 26 aa, Entamoeba histolytica
FIRKARKSGMSKKAFTKFNAKRRLLK

SEQ ID NO: 2739305 - protein, 17 aa, Entamoeba histolytica
FIYLQRFGFMKEEDYPE

SEQ ID NO: 2739306 - protein, 24 aa, Entamoeba histolytica
FKDTLFQHGWGFLRINSAQSTSLD

SEQ ID NO: 2739307 - protein, 22 aa, Entamoeba histolytica
FKEIKVSLLHKMVKEDEQELNY

SEQ ID NO: 2739308 - protein, 20 aa, Entamoeba histolytica
FKENLKTKIQEMFVDSKTKI

SEQ ID NO: 2739309 - protein, 29 aa, Entamoeba histolytica
FKGQKKEMCFKEAFDMFTSVAHTFDPLKF

SEQ ID NO: 2739310 - protein, 26 aa, Entamoeba histolytica
FKGSRPSGLCQLRWNGNGYTQNLIQG

SEQ ID NO: 2739311 - protein, 17 aa, Entamoeba histolytica
FKIFGPIKAVRIGFLDI

SEQ ID NO: 2739312 - protein, 17 aa, Entamoeba histolytica
FKIGWIMTPSSSYSTGY

SEQ ID NO: 2739313 - protein, 21 aa, Entamoeba histolytica
FKLERMTGYTVTVFKNYCVEN

SEQ ID NO: 2739314 - protein, 20 aa, Entamoeba histolytica
FKRKQLRKIYNKMKYSVDPI

SEQ ID NO: 2739315 - protein, 17 aa, Entamoeba histolytica
FKTQIARDILVDAHNRH

SEQ ID NO: 2739316 - protein, 18 aa, Entamoeba histolytica
FLCKDIYCSLSNKKNNHF

SEQ ID NO: 2739317 - protein, 22 aa, Entamoeba histolytica
FLCVAFAYVPRTLSVIELFEKV

SEQ ID NO: 2739318 - protein, 17 aa, Entamoeba histolytica
FLGILGLKHAFNHFPNI

SEQ ID NO: 2739319 - protein, 18 aa, Entamoeba histolytica
FLIGVFALNLRDSLDDFL

SEQ ID NO: 2739320 - protein, 21 aa, Entamoeba histolytica
FLRIYPKPLFISIHHSNTAIF

SEQ ID NO: 2739321 - protein, 17 aa, Entamoeba histolytica
FLSAQGMESYEFHHIKT

SEQ ID NO: 2739322 - protein, 24 aa, Entamoeba histolytica
FLSEEARNWWAGLYSFDKYKDTTE

SEQ ID NO: 2739323 - protein, 27 aa, Entamoeba histolytica
FLVPIKKCCIHPNLIIMTDHFHTICSS

SEQ ID NO: 2739324 - protein, 17 aa, Entamoeba histolytica
FLWVRSSWGNDWGVENG

SEQ ID NO: 2739325 - protein, 19 aa, Entamoeba histolytica
FMGKAGWLAVKVYPPQDAV

SEQ ID NO: 2739326 - protein, 19 aa, Entamoeba histolytica
FMGKAGWLAVKVYPPQDSV

SEQ ID NO: 2739327 - protein, 17 aa, Entamoeba histolytica
FNFEWCLIYKIDRINKR

SEQ ID NO: 2739328 - protein, 19 aa, Entamoeba histolytica
FNFIGSSIFINIKFIPNIT

SEQ ID NO: 2739329 - protein, 19 aa, Entamoeba histolytica
FNKEHSFELTVEGPFAAMT

SEQ ID NO: 2739330 - protein, 27 aa, Entamoeba histolytica
FNPNDKFGASLGGRISNINGKRNVGLE

SEQ ID NO: 2739331 - protein, 20 aa, Entamoeba histolytica
FPRKKTRNVTTFNIDSLCYL

SEQ ID NO: 2739332 - protein, 25 aa, Entamoeba histolytica
FPSGSPKIEGEWVYKKNFTHNIGHI

SEQ ID NO: 2739333 - protein, 17 aa, Entamoeba histolytica
FPTKRLFGSGKNVHQPL

SEQ ID NO: 2739334 - protein, 19 aa, Entamoeba histolytica
FQGLCEELHFLIQEELNKG

SEQ ID NO: 2739335 - protein, 25 aa, Entamoeba histolytica
FQKYQMFIMMGLMMLFQMFMGQPGA

SEQ ID NO: 2739336 - protein, 24 aa, Entamoeba histolytica
FQLTWKNRWVKVYNISNLKEVRNY

SEQ ID NO: 2739337 - protein, 20 aa, Entamoeba histolytica
FRAAPNEAFYLSSQQCGICY

SEQ ID NO: 2739338 - protein, 23 aa, Entamoeba histolytica
FRDLCGFYKIRGYPTVNFYHNGE

SEQ ID NO: 2739339 - protein, 18 aa, Entamoeba histolytica
FRIKRPERRSQKTLQLML

SEQ ID NO: 2739340 - protein, 18 aa, Entamoeba histolytica
FRLNEIPSSLSYCGIYRK

SEQ ID NO: 2739341 - protein, 21 aa, Entamoeba histolytica
FRNMPTILVFRGSDHKPNEIS

SEQ ID NO: 2739342 - protein, 22 aa, Entamoeba histolytica
FRPCVTCGNIGGQLQTYKVRTE

SEQ ID NO: 2739343 - protein, 21 aa, Entamoeba histolytica
FRPLAISLFGSYLKAIIIGGS

SEQ ID NO: 2739344 - protein, 19 aa, Entamoeba histolytica
FSIPYEKNIGWNIKEDGNI

SEQ ID NO: 2739345 - protein, 27 aa, Entamoeba histolytica
FSPYCPHCVRFSPIYSEFAVKMQNEEN

SEQ ID NO: 2739346 - protein, 20 aa, Entamoeba histolytica
FSSYPGFVFSFDDFYMTSND

SEQ ID NO: 2739347 - protein, 19 aa, Entamoeba histolytica
FSTNPRIRNAQILMNQNWA

SEQ ID NO: 2739348 - protein, 24 aa, Entamoeba histolytica
FTLNYGRAFVLTSLDFHFRHNLVM

SEQ ID NO: 2739349 - protein, 17 aa, Entamoeba histolytica
FTNDLDICFANTQKNYF

SEQ ID NO: 2739350 - protein, 19 aa, Entamoeba histolytica
FTNNIYFMLYKKYQFKFNS

SEQ ID NO: 2739351 - protein, 18 aa, Entamoeba histolytica
FTPFGGWSRPTMKQYNGD

SEQ ID NO: 2739352 - protein, 18 aa, Entamoeba histolytica
FTTATNVIPDIEQELKDV

SEQ ID NO: 2739353 - protein, 18 aa, Entamoeba histolytica
FVGIFKRSSIPVSGINNN

SEQ ID NO: 2739354 - protein, 21 aa, Entamoeba histolytica
FVRNIIYFRIEAIRKEIKALK

SEQ ID NO: 2739355 - protein, 23 aa, Entamoeba histolytica
FYEVCSKPNLKRYVMCKNETLSI

SEQ ID NO: 2739356 - protein, 17 aa, Entamoeba histolytica
FYFLVKATSVGATGTLH

SEQ ID NO: 2739357 - protein, 18 aa, Entamoeba histolytica
FYGLRLTHQPSPWIRDYD

SEQ ID NO: 2739358 - protein, 17 aa, Entamoeba histolytica
FYKMFGFPTGVGCLIIK

SEQ ID NO: 2739359 - protein, 19 aa, Entamoeba histolytica
FYLPYRLDVDLCYQAKSAA

SEQ ID NO: 2739360 - protein, 24 aa, Entamoeba histolytica
FYPCISCGDPAGQVNSFWNQVVAN

SEQ ID NO: 2739361 - protein, 26 aa, Entamoeba histolytica
FYTIKVRNAVNWRQYQVLFNHFSGDN

SEQ ID NO: 2739362 - protein, 18 aa, Entamoeba histolytica
GAAYGPLHFHCERSLNSW

SEQ ID NO: 2739363 - protein, 21 aa, Entamoeba histolytica
GADEAQAVFNYGFVAQPQVDQ

SEQ ID NO: 2739364 - protein, 17 aa, Entamoeba histolytica
GAIRGATLIIWMKKAPL

SEQ ID NO: 2739365 - protein, 19 aa, Entamoeba histolytica
GAIRGSVAWGSYENTVNST

SEQ ID NO: 2739366 - protein, 19 aa, Entamoeba histolytica
GAKEGARQLLKDGISIGTE

SEQ ID NO: 2739367 - protein, 23 aa, Entamoeba histolytica
GAKRGVIVYPEIDTPAHTASWNA

SEQ ID NO: 2739368 - protein, 17 aa, Entamoeba histolytica
GALRKLPVLPLTETDIF

SEQ ID NO: 2739369 - protein, 21 aa, Entamoeba histolytica
GATSYKKSWLKGLVAKEIGVN

SEQ ID NO: 2739370 - protein, 25 aa, Entamoeba histolytica
GCMTAEFFLGYPLFGATSEYNLLFK

SEQ ID NO: 2739371 - protein, 20 aa, Entamoeba histolytica
GCVNTALWQFFPIWLQYLCW

SEQ ID NO: 2739372 - protein, 17 aa, Entamoeba histolytica
GDEVYFAHGTWRGYYAM

SEQ ID NO: 2739373 - protein, 23 aa, Entamoeba histolytica
GDFSSFGGWSWPTMKQYRGDVSI

SEQ ID NO: 2739374 - protein, 31 aa, Entamoeba histolytica; identical to SEQ ID NO: 2553500

SEQ ID NO: 2739375 - protein, 21 aa, Entamoeba histolytica
GDKFLKLKNFKVNCGSLAKKM

SEQ ID NO: 2739376 - protein, 20 aa, Entamoeba histolytica
GDPWPPVIGSKFKLNMVGVL

SEQ ID NO: 2739377 - protein, 21 aa, Entamoeba histolytica
GEEIYSCVYRNNWIIQKGKTD

SEQ ID NO: 2739378 - protein, 21 aa, Entamoeba histolytica
GEGVTEIFGAAIAELQKTGGI

SEQ ID NO: 2739379 - protein, 19 aa, Entamoeba histolytica
GEIMAIPNHYFRKGNKYPL

SEQ ID NO: 2739380 - protein, 17 aa, Entamoeba histolytica
GELYYYGSVSYPYSETF

SEQ ID NO: 2739381 - protein, 25 aa, Entamoeba histolytica
GETRYPSYPLSRWSYCGVGEFQCSD

SEQ ID NO: 2739382 - protein, 19 aa, Entamoeba histolytica
GEVSQEPTMTLTHESTEAQ

SEQ ID NO: 2739383 - protein, 21 aa, Entamoeba histolytica
GGANKGATLIIWMKKAPLDPG

SEQ ID NO: 2739384 - protein, 17 aa, Entamoeba histolytica
GGFVSYKLFDYLGKDFC

SEQ ID NO: 2739385 - protein, 23 aa, Entamoeba histolytica
GGSDYRIDVVAGYQQFVTLQRKN

SEQ ID NO: 2739386 - protein, 19 aa, Entamoeba histolytica
GGYLSIFSQDIIKFIGKWE

SEQ ID NO: 2739387 - protein, 19 aa, Entamoeba histolytica
GGYMAYRLLDYLGNDFCNQ

SEQ ID NO: 2739388 - protein, 18 aa, Entamoeba histolytica
GHCKALKPVYENLAKELY

SEQ ID NO: 2739389 - protein, 21 aa, Entamoeba histolytica
GHLKTSVAMTLNLNLVGILQS

SEQ ID NO: 2739390 - protein, 21 aa, Entamoeba histolytica
GHSMGGLIIHNFLESMPQKWI

SEQ ID NO: 2739391 - protein, 18 aa, Entamoeba histolytica
GIELLRRRAIFNMNSMFV

SEQ ID NO: 2739392 - protein, 30 aa, Entamoeba histolytica
GILGGKNSIGLCWSRSFDIDDIFNYPATIP

SEQ ID NO: 2739393 - protein, 17 aa, Entamoeba histolytica
GIRARVNLFRNWLDKTG

SEQ ID NO: 2739394 - protein, 23 aa, Entamoeba histolytica
GKCESCNQFGSLCQKCTSNQCIL

SEQ ID NO: 2739395 - protein, 19 aa, Entamoeba histolytica
GKCKACKVELCDQCKSPYT

SEQ ID NO: 2739396 - protein, 18 aa, Entamoeba histolytica
GKCPLDIQAFTSLYNNLI

SEQ ID NO: 2739397 - protein, 30 aa, Entamoeba histolytica
GKEFGEEMWKCGLCENGTMYKCGNKTMNQE

SEQ ID NO: 2739398 - protein, 18 aa, Entamoeba histolytica
GKELRFALQSEKNVQVIY

SEQ ID NO: 2739399 - protein, 17 aa, Entamoeba histolytica
GKHALAALVAFTNDGKF

SEQ ID NO: 2739400 - protein, 20 aa, Entamoeba histolytica
GKISGIHWWYTDASHAAEVT

SEQ ID NO: 2739401 - protein, 21 aa, Entamoeba histolytica
GKKKAMRIVKKMKRFEKKAMK

SEQ ID NO: 2739402 - protein, 25 aa, Entamoeba histolytica
GKKYLDPIRTCFGRLKNSYNSFKSE

SEQ ID NO: 2739403 - protein, 24 aa, Entamoeba histolytica
GKRLRPLSLLLFFIGGGGKIEEQK

SEQ ID NO: 2739404 - protein, 23 aa, Entamoeba histolytica
GKSKKKIARMVLARCKASDKPHT

SEQ ID NO: 2739405 - protein, 19 aa, Entamoeba histolytica
GKTKYNPCVFSFQELDDCE

SEQ ID NO: 2739406 - protein, 19 aa, Entamoeba histolytica
GKVVSKPLVKKGSKSTRKS

SEQ ID NO: 2739407 - protein, 18 aa, Entamoeba histolytica
GKYQCTLSEKILQPNNNT

SEQ ID NO: 2739408 - protein, 20 aa, Entamoeba histolytica
GLCERCEEGFFSTGNSCNEC

SEQ ID NO: 2739409 - protein, 22 aa, Entamoeba histolytica
GLNSFKGEKQILVFDLGGGTFD

SEQ ID NO: 2739410 - protein, 29 aa, Entamoeba histolytica
GLPPFNWELFPSIQHWGTPRVYNFDWVKI

SEQ ID NO: 2739411 - protein, 27 aa, Entamoeba histolytica
GLSDCSLCTGQWCGSCKSVPKRQAYVA

SEQ ID NO: 2739412 - protein, 18 aa, Entamoeba histolytica
GNFTRYVKDTSTIDCQCI

SEQ ID NO: 2739413 - protein, 21 aa, Entamoeba histolytica
GNRLASTRSWAWQICSEYSYF

SEQ ID NO: 2739414 - protein, 23 aa, Entamoeba histolytica
GNSMYFQNCGFLGNILNKAYQQN

SEQ ID NO: 2739415 - protein, 21 aa, Entamoeba histolytica
GNTRIFTSIEFGKCYYTGTVT

SEQ ID NO: 2739416 - protein, 21 aa, Entamoeba histolytica
GPIVCNLCIGLVNTLDGLIVN

SEQ ID NO: 2739417 - protein, 25 aa, Entamoeba histolytica
GQLKAIKTAVNFARLGEVKMLESYN

SEQ ID NO: 2739418 - protein, 17 aa, Entamoeba histolytica
GQRAIVSMHICPGVAER

SEQ ID NO: 2739419 - protein, 17 aa, Entamoeba histolytica
GRGDYIFNYPHCPCDDN

SEQ ID NO: 2739420 - protein, 17 aa, Entamoeba histolytica
GRISRQRMMDMKDERDK

SEQ ID NO: 2739421 - protein, 18 aa, Entamoeba histolytica
GRNDLKEKLIVNSNSNTV

SEQ ID NO: 2739422 - protein, 21 aa, Entamoeba histolytica
GRSDWMKEFACEFDGHYLQYR

SEQ ID NO: 2739423 - protein, 19 aa, Entamoeba histolytica
GRYDIKEIMIGGKKIKTTN

SEQ ID NO: 2739424 - protein, 17 aa, Entamoeba histolytica
GSFGIVYLGEFRGNKVA

SEQ ID NO: 2739425 - protein, 21 aa, Entamoeba histolytica
GSGCGICNKGYYRNGKGCSEC

SEQ ID NO: 2739426 - protein, 20 aa, Entamoeba histolytica
GSIKKKKWGFSFFHREKKDK

SEQ ID NO: 2739427 - protein, 19 aa, Entamoeba histolytica
GSMPACCKYATSRAEVQKV

SEQ ID NO: 2739428 - protein, 25 aa, Entamoeba histolytica
GSSGYPWKKEHSFKETYGINDMSTE

SEQ ID NO: 2739429 - protein, 18 aa, Entamoeba histolytica
GSYRADVTLNEFTTEKYL

SEQ ID NO: 2739430 - protein, 31 aa, Entamoeba histolytica
GTFIPKAVCDRFGYKRFLLFKEGENYENVTT

SEQ ID NO: 2739431 - protein, 21 aa, Entamoeba histolytica
GTPCGDELINLAKMYDNKIQI

SEQ ID NO: 2739432 - protein, 18 aa, Entamoeba histolytica
GVGNELYYSVAHHSIFYT

SEQ ID NO: 2739433 - protein, 17 aa, Entamoeba histolytica
GVIKSRVTQCTGLNSED

SEQ ID NO: 2739434 - protein, 17 aa, Entamoeba histolytica
GVLTYYKWFSIGDNKTQ

SEQ ID NO: 2739435 - protein, 23 aa, Entamoeba histolytica
GVNGEAAFFIGVEFNKYMCDDDT

SEQ ID NO: 2739436 - protein, 23 aa, Entamoeba histolytica
GVNYKFMVNRSIWVQNIGAFLSF

SEQ ID NO: 2739437 - protein, 25 aa, Entamoeba histolytica
GVSFMPPRFSLGFHNSKWGYNSQNI

SEQ ID NO: 2739438 - protein, 23 aa, Entamoeba histolytica
GVTVDCWDYLTSNKILYAENRVS

SEQ ID NO: 2739439 - protein, 18 aa, Entamoeba histolytica
GYFALDWLDQPDLPDDAP

SEQ ID NO: 2739440 - protein, 19 aa, Entamoeba histolytica
GYKPILLQMVFRHGDRSPW

SEQ ID NO: 2739441 - protein, 19 aa, Entamoeba histolytica
GYPSLFLFYNNYIYPEYSM

SEQ ID NO: 2739442 - protein, 18 aa, Entamoeba histolytica
GYPTLILFRKGRSKKVYG

SEQ ID NO: 2739443 - protein, 17 aa, Entamoeba histolytica
GYSRPWEKGKEPLRSLT

SEQ ID NO: 2739444 - protein, 21 aa, Entamoeba histolytica
HCPCYGLSCITKFSKEDTLII

SEQ ID NO: 2739445 - protein, 19 aa, Entamoeba histolytica
HCQKCREGYTLIGDECKKC

SEQ ID NO: 2739446 - protein, 24 aa, Entamoeba histolytica
HDESKSLLFRYAAKKYSRWLPQSA

SEQ ID NO: 2739447 - protein, 30 aa, Entamoeba histolytica
HDVVRRLATAHARASIAIRSVEKIEDKIFE

SEQ ID NO: 2739448 - protein, 20 aa, Entamoeba histolytica
HEIIFKLSLNISESDNITSL

SEQ ID NO: 2739449 - protein, 25 aa, Entamoeba histolytica
HFKYYCPYKPGSELKYFQITFVGEE

SEQ ID NO: 2739450 - protein, 25 aa, Entamoeba histolytica
HFYLPYRLDVDLCYQARKATDGRST

SEQ ID NO: 2739451 - protein, 24 aa, Entamoeba histolytica
HFYLPYRLDVDLCYQARKKNEAKE

SEQ ID NO: 2739452 - protein, 23 aa, Entamoeba histolytica
HGFKRRFPIYVAYTTGPLGIQIF

SEQ ID NO: 2739453 - protein, 18 aa, Entamoeba histolytica
HGIKDGQIVTVKFKDAQC

SEQ ID NO: 2739454 - protein, 20 aa, Entamoeba histolytica
HGPAGVSMGYSFPLAKKFFG

SEQ ID NO: 2739455 - protein, 18 aa, Entamoeba histolytica
HHRRRYFRRYPWRRYRFW

SEQ ID NO: 2739456 - protein, 18 aa, Entamoeba histolytica
HKERVAAIKRTKEYLNNL

SEQ ID NO: 2739457 - protein, 22 aa, Entamoeba histolytica
HKRIEMYASIIGKEIDFMKGTV

SEQ ID NO: 2739458 - protein, 22 aa, Entamoeba histolytica
HKVSQPSVMKWEPMKLMRKPRK

SEQ ID NO: 2739459 - protein, 20 aa, Entamoeba histolytica
HLQFKWKHYQQGILNYPDGD

SEQ ID NO: 2739460 - protein, 26 aa, Entamoeba histolytica
HMYSNKHKIIYNKYNIHLKSEAEVVN

SEQ ID NO: 2739461 - protein, 25 aa, Entamoeba histolytica
HNELKRRLPGFTVLPSIGNHDYFET

SEQ ID NO: 2739462 - protein, 19 aa, Entamoeba histolytica
HQIIKEICCSLNQINLNLN

SEQ ID NO: 2739463 - protein, 33 aa, Entamoeba histolytica
HQVNMPLFRRIENLPVYTLWYFYQGTIPKVHED

SEQ ID NO: 2739464 - protein, 25 aa, Entamoeba histolytica
HRDANRSSLSFAELLQMCEKIGYVF

SEQ ID NO: 2739465 - protein, 19 aa, Entamoeba histolytica
HSLDDFWLLSNGLSVIETT

SEQ ID NO: 2739466 - protein, 25 aa, Entamoeba histolytica
HSMGGLMFYKFLDYEGKEFADKYID

SEQ ID NO: 2739467 - protein, 24 aa, Entamoeba histolytica
HSMGGLMFYKFLDYVGKEFADKYI

SEQ ID NO: 2739468 - protein, 25 aa, Entamoeba histolytica
HSMGGLMFYKFLDYVGKEFADKYID

SEQ ID NO: 2739469 - protein, 26 aa, Entamoeba histolytica
HSNTLLDWIRIVLAVRASKNGKEFHD

SEQ ID NO: 2739470 - protein, 18 aa, Entamoeba histolytica
HTGPKLSASALYQQTNNA

SEQ ID NO: 2739471 - protein, 37 aa, Entamoeba histolytica
HTQIKSKEYKRMYKLYKVHFKSVNEIAEEKGQSEKSV

SEQ ID NO: 2739472 - protein, 22 aa, Entamoeba histolytica
HTRFPDKWYELHSHCTGLIKLL

SEQ ID NO: 2739473 - protein, 22 aa, Entamoeba histolytica
HVKHIPRNKCIWKKDKYVYKQP

SEQ ID NO: 2739474 - protein, 25 aa, Entamoeba histolytica
HVPKKYRIGRKWQFNKKKDIVKELP

SEQ ID NO: 2739475 - protein, 19 aa, Entamoeba histolytica
HYSPKDFDKGLSMTDGTAY

SEQ ID NO: 2739476 - protein, 18 aa, Entamoeba histolytica
IADLKKRMTEIINEIKDT

SEQ ID NO: 2739477 - protein, 23 aa, Entamoeba histolytica
IAETCTRHPVIIIPGIMASMLNA

SEQ ID NO: 2739478 - protein, 23 aa, Entamoeba histolytica
IAILKTEMDSVVFSMELYHKIQE

SEQ ID NO: 2739479 - protein, 34 aa, Entamoeba histolytica
IALILTVFAEDSFETETNFDFDFDDDYDYDEFDL

SEQ ID NO: 2739480 - protein, 42 aa, Entamoeba histolytica
IAMFLTLAFAVEEDATLDNKETENNDELNIEDNDDEEYDDDD

SEQ ID NO: 2739481 - protein, 18 aa, Entamoeba histolytica
IAMTPFCDGEWLNKETVN

SEQ ID NO: 2739482 - protein, 26 aa, Entamoeba histolytica
IARSIRGHLGLLYCTKGSYYDHQIGG

SEQ ID NO: 2739483 - protein, 20 aa, Entamoeba histolytica
IASGIFRSRMIHVGGGVKFD

SEQ ID NO: 2739484 - protein, 23 aa, Entamoeba histolytica
IATKHYYCICLNDAIANEPNADQ

SEQ ID NO: 2739485 - protein, 19 aa, Entamoeba histolytica
IAVSAFAAPKCAQTNVANV

SEQ ID NO: 2739486 - protein, 18 aa, Entamoeba histolytica
ICFCAFAEEDLFNPFIHG

SEQ ID NO: 2739487 - protein, 29 aa, Entamoeba histolytica
ICPTNCLKCLNGVCIQCKDNYFLDNGSCL

SEQ ID NO: 2739488 - protein, 19 aa, Entamoeba histolytica
ICSYAKLSLNQQVMQQISQ

SEQ ID NO: 2739489 - protein, 17 aa, Entamoeba histolytica
ICVCALAEEDLFNPFIH

SEQ ID NO: 2739490 - protein, 22 aa, Entamoeba histolytica
IDEYSPLAVIDREFIAGKREVY

SEQ ID NO: 2739491 - protein, 18 aa, Entamoeba histolytica
IDGLKYYLNAYVFKDILK

SEQ ID NO: 2739492 - protein, 25 aa, Entamoeba histolytica
IDILFNALWLRSFIKNNQRIINGRA

SEQ ID NO: 2739493 - protein, 22 aa, Entamoeba histolytica
IDKEIFSVLSPEFRKLLQEMSD

SEQ ID NO: 2739494 - protein, 21 aa, Entamoeba histolytica
IDKLRFLCITDKSLNIDPSSF

SEQ ID NO: 2739495 - protein, 19 aa, Entamoeba histolytica
IDNACAMGASYGGYMMNWI

SEQ ID NO: 2739496 - protein, 21 aa, Entamoeba histolytica
IDNRAKYALYQTILSRKGVQK

SEQ ID NO: 2739497 - protein, 23 aa, Entamoeba histolytica
IDPNWPVSIFAKCFHDLIKKFKK

SEQ ID NO: 2739498 - protein, 17 aa, Entamoeba histolytica
IDPNWPVSMFAKCFHDL

SEQ ID NO: 2739499 - protein, 22 aa, Entamoeba histolytica
IDRIKRKVVRKVLQLIQDLSEN

SEQ ID NO: 2739500 - protein, 24 aa, Entamoeba histolytica
IDYLQKRITAVSKKYSTLVDNLNT

SEQ ID NO: 2739501 - protein, 20 aa, Entamoeba histolytica
IEARSSFKRLFFDKDSNTSV

SEQ ID NO: 2739502 - protein, 24 aa, Entamoeba histolytica
IEEMYSSKMLSVFIPVTDANRYKV

SEQ ID NO: 2739503 - protein, 17 aa, Entamoeba histolytica
IEFELRKSIFEETTKKI

SEQ ID NO: 2739504 - protein, 17 aa, Entamoeba histolytica
IEIKQKYIYGSYKKLTN

SEQ ID NO: 2739505 - protein, 26 aa, Entamoeba histolytica
IEKEWRVQRGNGFVKELNEMQFIDNK

SEQ ID NO: 2739506 - protein, 25 aa, Entamoeba histolytica
IELGKEWGEHFGIAFQMRDDLLDID

SEQ ID NO: 2739507 - protein, 27 aa, Entamoeba histolytica
IELLFEIPKKYPIVWYFDKNITEQIKS

SEQ ID NO: 2739508 - protein, 20 aa, Entamoeba histolytica
IEMYKKALLSEEVKIPTENR

SEQ ID NO: 2739509 - protein, 17 aa, Entamoeba histolytica
IENWGKIIFKGIKVKVT

SEQ ID NO: 2739510 - protein, 27 aa, Entamoeba histolytica
IEPKQHKRMYNGYNIQLKGEVSQEPTM

SEQ ID NO: 2739511 - protein, 20 aa, Entamoeba histolytica
IERKKLNSTYIKELNFAKKS

SEQ ID NO: 2739512 - protein, 17 aa, Entamoeba histolytica
IESPIPLVADMSSDILS

SEQ ID NO: 2739513 - protein, 23 aa, Entamoeba histolytica
IETINIYGSLLFDDSTNVISQSK

SEQ ID NO: 2739514 - protein, 17 aa, Entamoeba histolytica
IFAHLFDGIAFDHIMIK

SEQ ID NO: 2739515 - protein, 17 aa, Entamoeba histolytica
IFAVCFAAVKTPTTTPV

SEQ ID NO: 2739516 - protein, 24 aa, Entamoeba histolytica
IFIFYLLVGYCFSSEIKILQISDI

SEQ ID NO: 2739517 - protein, 19 aa, Entamoeba histolytica
IFINIKFIPNITFISSTPF

SEQ ID NO: 2739518 - protein, 29 aa, Entamoeba histolytica
IFKELKSFIPNCCQVHFVQYFLPSSQLSF

SEQ ID NO: 2739519 - protein, 18 aa, Entamoeba histolytica
IFSTLAGNGVNVKDQLLL

SEQ ID NO: 2739520 - protein, 24 aa, Entamoeba histolytica
IGELKKAKFPGGIKVDDKTIKRLM

SEQ ID NO: 2739521 - protein, 23 aa, Entamoeba histolytica
IGGVIPKSLAFGVIKESQGFVKK

SEQ ID NO: 2739522 - protein, 25 aa, Entamoeba histolytica
IGIDVPRLATKIIIKKSDKIILSGA

SEQ ID NO: 2739523 - protein, 21 aa, Entamoeba histolytica
IGSIIDFKIGWIMTPSSSYST

SEQ ID NO: 2739524 - protein, 19 aa, Entamoeba histolytica
IGSTNTCICTLKDNEKTIK

SEQ ID NO: 2739525 - protein, 21 aa, Entamoeba histolytica
IGVLDGYFPVRVIKRTVENIC

SEQ ID NO: 2739526 - protein, 24 aa, Entamoeba histolytica
IHERANAFNLKWMKSNIKGTWNRK

SEQ ID NO: 2739527 - protein, 24 aa, Entamoeba histolytica
IHQIKRATFSSVRLKEDKSLNSIT

SEQ ID NO: 2739528 - protein, 25 aa, Entamoeba histolytica
IHSECYIEESFMFFSLNNTNYSRCG

SEQ ID NO: 2739529 - protein, 20 aa, Entamoeba histolytica
IHSFKKKKVAMIYTNDPSGN

SEQ ID NO: 2739530 - protein, 17 aa, Entamoeba histolytica
IHYRFSVVQDIEGLANL

SEQ ID NO: 2739531 - protein, 21 aa, Entamoeba histolytica
IIFKSGAKMATKMAALAKKGK

SEQ ID NO: 2739532 - protein, 20 aa, Entamoeba histolytica
IIFLMFNFSYAKNHVAVSIS

SEQ ID NO: 2739533 - protein, 22 aa, Entamoeba histolytica
IIGGAVRFKCPIIEFDRTMVNA

SEQ ID NO: 2739534 - protein, 25 aa, Entamoeba histolytica
IISDLHLERRLNIIDDILGEAKTAP

SEQ ID NO: 2739535 - protein, 18 aa, Entamoeba histolytica
IITNEFMYVNTLTLLIDR

SEQ ID NO: 2739536 - protein, 18 aa, Entamoeba histolytica
IIVRGGSIIPLKERKRRA

SEQ ID NO: 2739537 - protein, 19 aa, Entamoeba histolytica
IIVTHSFGGLAVLDLISSM

SEQ ID NO: 2739538 - protein, 17 aa, Entamoeba histolytica
IKAIGMTDIDESTSKSL

SEQ ID NO: 2739539 - protein, 19 aa, Entamoeba histolytica
IKALDLEPAKARLEAKKTN

SEQ ID NO: 2739540 - protein, 18 aa, Entamoeba histolytica
IKFIGKWENYYTFAPSSL

SEQ ID NO: 2739541 - protein, 19 aa, Entamoeba histolytica
IKFIGKWENYYTFAPSSLE

SEQ ID NO: 2739542 - protein, 17 aa, Entamoeba histolytica
IKFINSFINFFKNIFER

SEQ ID NO: 2739543 - protein, 21 aa, Entamoeba histolytica
IKFYGKMGGKIQTEYNGIYNY

SEQ ID NO: 2739544 - protein, 17 aa, Entamoeba histolytica
IKGFRKVHFKEESNIDA

SEQ ID NO: 2739545 - protein, 21 aa, Entamoeba histolytica
IKHDTSLALKEFIEAKKANKN

SEQ ID NO: 2739546 - protein, 18 aa, Entamoeba histolytica
IKIGTSFISNEYSYSHAL

SEQ ID NO: 2739547 - protein, 24 aa, Entamoeba histolytica
IKIVSADFYSFLDSVDNEIEEIEN

SEQ ID NO: 2739548 - protein, 19 aa, Entamoeba histolytica
IKIWQSWYPAEWGKCEENS

SEQ ID NO: 2739549 - protein, 21 aa, Entamoeba histolytica
IKKLSGSILPSFAEKLIEATE

SEQ ID NO: 2739550 - protein, 25 aa, Entamoeba histolytica
IKLFLRYFLSPLLFFNLIKNDPYQY

SEQ ID NO: 2739551 - protein, 23 aa, Entamoeba histolytica
IKLFLRYFLSPLLLFNLIKNDPY

SEQ ID NO: 2739552 - protein, 39 aa, Entamoeba histolytica
IKLKEYGKALGVTIEYCRFHWPYFMFKQVSKTRIIWANK

SEQ ID NO: 2739553 - protein, 19 aa, Entamoeba histolytica
IKMKVIEVKSHLNRLRSRK

SEQ ID NO: 2739554 - protein, 20 aa, Entamoeba histolytica
IKNNITFYIKVMREPSIIIV

SEQ ID NO: 2739555 - protein, 18 aa, Entamoeba histolytica
IKPWMKSPEIKRIITNEF

SEQ ID NO: 2739556 - protein, 17 aa, Entamoeba histolytica
IKRHSIELFSGIIKKEE

SEQ ID NO: 2739557 - protein, 25 aa, Entamoeba histolytica
IKRILKRITTSFLKQHNMNRTYANF

SEQ ID NO: 2739558 - protein, 20 aa, Entamoeba histolytica
IKRMKVIVNIIGIKQASFEE

SEQ ID NO: 2739559 - protein, 18 aa, Entamoeba histolytica
IKSAMSFARKYNLDGIDI

SEQ ID NO: 2739560 - protein, 18 aa, Entamoeba histolytica
IKSFLNHLHFEFIKSTII

SEQ ID NO: 2739561 - protein, 22 aa, Entamoeba histolytica
IKSTLFYPLHGWGITNDLNQTI

SEQ ID NO: 2739562 - protein, 19 aa, Entamoeba histolytica
IKTEGIPIEYTWKEVNTFL

SEQ ID NO: 2739563 - protein, 19 aa, Entamoeba histolytica
IKTPPKFSAQRFLDVTKTK

SEQ ID NO: 2739564 - protein, 26 aa, Entamoeba histolytica
IKVKCTMCRNLAAFLLQKVRRDRMSP

SEQ ID NO: 2739565 - protein, 23 aa, Entamoeba histolytica
IKYVDCLYKTYPAAVLTKVDNNI

SEQ ID NO: 2739566 - protein, 21 aa, Entamoeba histolytica
ILCNLCTGLINTLENLLTTKG

SEQ ID NO: 2739567 - protein, 31 aa, Entamoeba histolytica
ILHKYPLFIQWGYKILGFFIFKSVEDGIQTA

SEQ ID NO: 2739568 - protein, 18 aa, Entamoeba histolytica
ILHLDCPVVPTLNHAIIV

SEQ ID NO: 2739569 - protein, 27 aa, Entamoeba histolytica
ILIQVSFTYCYAEFCNVPTFSLKHLNN

SEQ ID NO: 2739570 - protein, 18 aa, Entamoeba histolytica
ILIYPEIDIPGHTASWGL

SEQ ID NO: 2739571 - protein, 18 aa, Entamoeba histolytica
ILPIKKLILENGFTNLVD

SEQ ID NO: 2739572 - protein, 19 aa, Entamoeba histolytica
ILQARKNYNSWVIEQQQKM

SEQ ID NO: 2739573 - protein, 18 aa, Entamoeba histolytica
ILRTLPLVDQQHIIDELG

SEQ ID NO: 2739574 - protein, 17 aa, Entamoeba histolytica
ILTWIRVQIANLLSSKR

SEQ ID NO: 2739575 - protein, 20 aa, Entamoeba histolytica
IMALKLFPNYYFYTRVDDEI

SEQ ID NO: 2739576 - protein, 17 aa, Entamoeba histolytica
IMENGCEIMYPTIEFIQ

SEQ ID NO: 2739577 - protein, 26 aa, Entamoeba histolytica
IMNQLFRLKHRMFRVEEKIRRENDNT

SEQ ID NO: 2739578 - protein, 26 aa, Entamoeba histolytica
INEDIKMILKRSGMNAIIIVDNEISK

SEQ ID NO: 2739579 - protein, 19 aa, Entamoeba histolytica
INERMYTRYNIHLKEETYV

SEQ ID NO: 2739580 - protein, 17 aa, Entamoeba histolytica
INGLKYYLESYVFKDIL

SEQ ID NO: 2739581 - protein, 17 aa, Entamoeba histolytica
INIQYYYKGSMNKLDEI

SEQ ID NO: 2739582 - protein, 24 aa, Entamoeba histolytica
INQLKEVISLAIIKNKELKALSQE

SEQ ID NO: 2739583 - protein, 17 aa, Entamoeba histolytica
INRCEKEINILKLQAQK

SEQ ID NO: 2739584 - protein, 23 aa, Entamoeba histolytica
INSPYLDKEFKLFSHKWKVDSMR

SEQ ID NO: 2739585 - protein, 17 aa, Entamoeba histolytica
IPIILDYQVHILNNSMY

SEQ ID NO: 2739586 - protein, 18 aa, Entamoeba histolytica
IPLEEWKLEFYIKSISIN

SEQ ID NO: 2739587 - protein, 21 aa, Entamoeba histolytica
IPNHYFRKGNKYPLKNYEVWS

SEQ ID NO: 2739588 - protein, 18 aa, Entamoeba histolytica
IPNSISINFILNKYRKIN

SEQ ID NO: 2739589 - protein, 19 aa, Entamoeba histolytica
IPQEHLIFISNARRLIHDE

SEQ ID NO: 2739590 - protein, 17 aa, Entamoeba histolytica
IPQVKAAAGAIAAGAKA

SEQ ID NO: 2739591 - protein, 24 aa, Entamoeba histolytica
IPYIKEIFVSSGYLKKMELGKKEY

SEQ ID NO: 2739592 - protein, 17 aa, Entamoeba histolytica
IQDSSVFAFRIDNEKER

SEQ ID NO: 2739593 - protein, 27 aa, Entamoeba histolytica
IQGNFSYKANNNWTFTGNGKANNQYGK

SEQ ID NO: 2739594 - protein, 17 aa, Entamoeba histolytica
IQMGSTWCPTVYINNER

SEQ ID NO: 2739595 - protein, 17 aa, Entamoeba histolytica
IQNRKLLRKSLDRLSEY

SEQ ID NO: 2739596 - protein, 25 aa, Entamoeba histolytica
IQSKQHKRMFNLYDIQLKGENEEAK

SEQ ID NO: 2739597 - protein, 19 aa, Entamoeba histolytica
IRDSYFLIYLYYDQGCKNL

SEQ ID NO: 2739598 - protein, 27 aa, Entamoeba histolytica
IRELKTMISDHFFKRKQLRKIYNKMKY

SEQ ID NO: 2739599 - protein, 26 aa, Entamoeba histolytica
IRFGLRSIIEYAPWINRIFLVTDGEI

SEQ ID NO: 2739600 - protein, 17 aa, Entamoeba histolytica
IRFIPNPYYYYRRPYYR

SEQ ID NO: 2739601 - protein, 18 aa, Entamoeba histolytica
IRFVSNWQSFMIGYTESD

SEQ ID NO: 2739602 - protein, 18 aa, Entamoeba histolytica
IRGATLIIWMKKAPLDPG

SEQ ID NO: 2739603 - protein, 18 aa, Entamoeba histolytica
IRGFPTVLVFNGEESKKF

SEQ ID NO: 2739604 - protein, 18 aa, Entamoeba histolytica
IRKLEHQYLIIVKSRNEA

SEQ ID NO: 2739605 - protein, 18 aa, Entamoeba histolytica
IRLPDKYYGMFLGYAMDA

SEQ ID NO: 2739606 - protein, 18 aa, Entamoeba histolytica
IRNAQILMNQNWAKLLKQ

SEQ ID NO: 2739607 - protein, 21 aa, Entamoeba histolytica
IRRFMSLQFNFWRKHIKNNEN

SEQ ID NO: 2739608 - protein, 34 aa, Entamoeba histolytica
IRTQIKSNQYKRMYNEYNVHLKSETDVKPPASIN

SEQ ID NO: 2739609 - protein, 20 aa, Entamoeba histolytica
ISDPLWKRIGLPDPSINTTN

SEQ ID NO: 2739610 - protein, 21 aa, Entamoeba histolytica
ISIEITDWYSVIFAPDKFWTF

SEQ ID NO: 2739611 - protein, 17 aa, Entamoeba histolytica
ISPKSASVKGRMKKIAK

SEQ ID NO: 2739612 - protein, 25 aa, Entamoeba histolytica
ISPQRMKAMLFIVFALICFVSANEL

SEQ ID NO: 2739613 - protein, 25 aa, Entamoeba histolytica
ISQVSMKLRIKFMLNAAKGISYLHS

SEQ ID NO: 2739614 - protein, 27 aa, Entamoeba histolytica
ISRIDYPLKVCAMINCAKREILNTNCD

SEQ ID NO: 2739615 - protein, 26 aa, Entamoeba histolytica
ITDFFRKFYRLRVSTFEYNINNYLNN

SEQ ID NO: 2739616 - protein, 23 aa, Entamoeba histolytica
ITGNIDLSFSAPMKVVGNYMHLS

SEQ ID NO: 2739617 - protein, 19 aa, Entamoeba histolytica
ITLSLAQFSCLIISKCYNF

SEQ ID NO: 2739618 - protein, 35 aa, Entamoeba histolytica
ITMYECFGWCAAYPKSQFQFPWSIADFVTQGNRRT

SEQ ID NO: 2739619 - protein, 20 aa, Entamoeba histolytica
ITNQFSRKVPFNFGCSPSCG

SEQ ID NO: 2739620 - protein, 22 aa, Entamoeba histolytica
ITPKVEWEEHIFECAKNETSRF

SEQ ID NO: 2739621 - protein, 17 aa, Entamoeba histolytica
ITQKGTAGSFVFTTTGI

SEQ ID NO: 2739622 - protein, 25 aa, Entamoeba histolytica
ITSRDSFEIVQDWITDVCSYCPQGV

SEQ ID NO: 2739623 - protein, 18 aa, Entamoeba histolytica
ITTEVEWERKTCPCSGDK

SEQ ID NO: 2739624 - protein, 17 aa, Entamoeba histolytica
ITTMLKVTVEWENFNKY

SEQ ID NO: 2739625 - protein, 25 aa, Entamoeba histolytica
IVADCPPRVIVEADVMSKCPDFRNF

SEQ ID NO: 2739626 - protein, 18 aa, Entamoeba histolytica
IVCTEFDKYFDGSNCVSC

SEQ ID NO: 2739627 - protein, 25 aa, Entamoeba histolytica
IVKNSWGSFWGMDGYILMSRNKNNQ

SEQ ID NO: 2739628 - protein, 24 aa, Entamoeba histolytica
IVKQAKWYGLHSFTYLRMTRALLD

SEQ ID NO: 2739629 - protein, 21 aa, Entamoeba histolytica
IVLFAHPVFWLSIPGEVKNFI

SEQ ID NO: 2739630 - protein, 17 aa, Entamoeba histolytica
IVLIFLLAQKGWSFYIK

SEQ ID NO: 2739631 - protein, 19 aa, Entamoeba histolytica
IVLIFPENKTLISIKDGIQ

SEQ ID NO: 2739632 - protein, 17 aa, Entamoeba histolytica
IVLLGPAFVGKSAIAFR

SEQ ID NO: 2739633 - protein, 25 aa, Entamoeba histolytica
IVLPPCGSEICLFEDFVKYYGKITK

SEQ ID NO: 2739634 - protein, 18 aa, Entamoeba histolytica
IVNKEERNREVIHTHKYA

SEQ ID NO: 2739635 - protein, 22 aa, Entamoeba histolytica
IVVSALAAPRCTPTTVANVVSE

SEQ ID NO: 2739636 - protein, 25 aa, Entamoeba histolytica
IVYSTEFKEGIVLANSLEKYWGKLL

SEQ ID NO: 2739637 - protein, 23 aa, Entamoeba histolytica
IWANKILFLDMMFPQTVDKIIFM

SEQ ID NO: 2739638 - protein, 23 aa, Entamoeba histolytica
IWKNWKYILDFHEIFMKEITMVY

SEQ ID NO: 2739639 - protein, 30 aa, Entamoeba histolytica
IYSNKHKRIYNRYGIYLKGEAEVTEPTIKE

SEQ ID NO: 2739640 - protein, 18 aa, Entamoeba histolytica
KAAGKSIVKVQCGMGHHN

SEQ ID NO: 2739641 - protein, 24 aa, Entamoeba histolytica
KAERLIKIADAFIQNTNDDEYQLS

SEQ ID NO: 2739642 - protein, 34 aa, Entamoeba histolytica; identical to SEQ ID NO: 2578463

SEQ ID NO: 2739643 - protein, 18 aa, Entamoeba histolytica
KAIAKRMKVLINRLRIKV

SEQ ID NO: 2739644 - protein, 17 aa, Entamoeba histolytica
KAIKGTEVSGGGSSSNQ

SEQ ID NO: 2739645 - protein, 21 aa, Entamoeba histolytica
KAKEDKIIFELDVRDAIEKAN

SEQ ID NO: 2739646 - protein, 23 aa, Entamoeba histolytica
KAMKGLYKELSFIRKEGKRVQLK

SEQ ID NO: 2739647 - protein, 33 aa, Entamoeba histolytica
KASFQFGEPCNYPSQLEWRGWKHVTYVETNKTD

SEQ ID NO: 2739648 - protein, 23 aa, Entamoeba histolytica
KASKGRTAIIIAHRLSTIQNADQ

SEQ ID NO: 2739649 - protein, 19 aa, Entamoeba histolytica
KATGSKEIQGISGEGEEKV

SEQ ID NO: 2739650 - protein, 18 aa, Entamoeba histolytica
KAVNNLRKAETLKEKSIN

SEQ ID NO: 2739651 - protein, 31 aa, Entamoeba histolytica
KCEKYEHCSLCSSSECLKCEKGYGIDEEGKC

SEQ ID NO: 2739652 - protein, 21 aa, Entamoeba histolytica
KCNLGYKIKLVISNTQNEKRF

SEQ ID NO: 2739653 - protein, 18 aa, Entamoeba histolytica
KCNVPGCVDCDGDVNKCN

SEQ ID NO: 2739654 - protein, 21 aa, Entamoeba histolytica
KCQEKKKFTIAGRYFQQLKYS

SEQ ID NO: 2739655 - protein, 20 aa, Entamoeba histolytica
KCTVTECLECSNGKDTFNNK

SEQ ID NO: 2739656 - protein, 20 aa, Entamoeba histolytica
KDAREITGKLAIEEMEGCGT

SEQ ID NO: 2739657 - protein, 20 aa, Entamoeba histolytica
KDGLYYYLLRTEKVSFNEYF

SEQ ID NO: 2739658 - protein, 27 aa, Entamoeba histolytica
KDISKVWKKKWASFMDKKLLKYLSKIK

SEQ ID NO: 2739659 - protein, 23 aa, Entamoeba histolytica
KDKCTTCADGYFMSWIGECKSID

SEQ ID NO: 2739660 - protein, 21 aa, Entamoeba histolytica
KDKGDCPLCRTLTELTKKNLI

SEQ ID NO: 2739661 - protein, 18 aa, Entamoeba histolytica
KDLLRISPVLLTLTDAVN

SEQ ID NO: 2739662 - protein, 18 aa, Entamoeba histolytica
KDQEHFFILILKNLKKEL

SEQ ID NO: 2739663 - protein, 25 aa, Entamoeba histolytica
KDQGNCGSCYAFSSVALMETAVLLS

SEQ ID NO: 2739664 - protein, 23 aa, Entamoeba histolytica
KDQGQCGSCWTFCTTAVLEGRVN

SEQ ID NO: 2739665 - protein, 25 aa, Entamoeba histolytica
KDTQLYFHKNCRRYVEYEKSSSTHK

SEQ ID NO: 2739666 - protein, 21 aa, Entamoeba histolytica
KDWRAEGKVTPVRDQGNCGSC

SEQ ID NO: 2739667 - protein, 21 aa, Entamoeba histolytica
KDWVRMAVVINENYNDYDGFV

SEQ ID NO: 2739668 - protein, 19 aa, Entamoeba histolytica
KDYWNAKTFYIQKHSQITL

SEQ ID NO: 2739669 - protein, 19 aa, Entamoeba histolytica
KEAPAVFSYSMKTLEPTIP

SEQ ID NO: 2739670 - protein, 22 aa, Entamoeba histolytica
KEDHCSLCMDGFLLQNGECVYG

SEQ ID NO: 2739671 - protein, 21 aa, Entamoeba histolytica
KEERNREVTHIQIEPKQHKRM

SEQ ID NO: 2739672 - protein, 24 aa, Entamoeba histolytica
KEIAQEMKRQILIKEQARKKILNE

SEQ ID NO: 2739673 - protein, 27 aa, Entamoeba histolytica
KEIERRLKVMIKRAVIARLNSAKTARC

SEQ ID NO: 2739674 - protein, 19 aa, Entamoeba histolytica
KEILVKWEYTNAFKYTQGV

SEQ ID NO: 2739675 - protein, 17 aa, Entamoeba histolytica
KEKLEWVESQTKVIGKN

SEQ ID NO: 2739676 - protein, 19 aa, Entamoeba histolytica
KELDIAANMLVKYKYTELA

SEQ ID NO: 2739677 - protein, 23 aa, Entamoeba histolytica
KELFKSQVTRSWYRRISYELNEQ

SEQ ID NO: 2739678 - protein, 18 aa, Entamoeba histolytica
KELIWEYDDVIFPTRSFG

SEQ ID NO: 2739679 - protein, 19 aa, Entamoeba histolytica
KELSIKKFKFISLVNGTEF

SEQ ID NO: 2739680 - protein, 19 aa, Entamoeba histolytica
KELTWPIEDSIIYKKVLVM

SEQ ID NO: 2739681 - protein, 17 aa, Entamoeba histolytica
KENRKAIKEAKKSRKVA

SEQ ID NO: 2739682 - protein, 20 aa, Entamoeba histolytica
KENSDLYSNVGLKMNGIDGV

SEQ ID NO: 2739683 - protein, 19 aa, Entamoeba histolytica
KEPDCQQSTDFKEYTLTLT

SEQ ID NO: 2739684 - protein, 34 aa, Entamoeba histolytica
KEPTLVKFFAPWCGHCNSLKPIWENISRESKLRI

SEQ ID NO: 2739685 - protein, 34 aa, Entamoeba histolytica
KEPTLVKFFVPWCGHCNSLKPIWENISRESKLRI

SEQ ID NO: 2739686 - protein, 21 aa, Entamoeba histolytica
KERATKRILVLKNHNEYAEVV

SEQ ID NO: 2739687 - protein, 24 aa, Entamoeba histolytica
KETGLKFQAVMSFHKCGGNVGDSV

SEQ ID NO: 2739688 - protein, 21 aa, Entamoeba histolytica
KEVKTEYSIAAGAIVVEITSE

SEQ ID NO: 2739689 - protein, 22 aa, Entamoeba histolytica
KEVQRDLKLFPYKIINKNNKPF

SEQ ID NO: 2739690 - protein, 18 aa, Entamoeba histolytica
KFFLEFYTQLMLNHTDRV

SEQ ID NO: 2739691 - protein, 18 aa, Entamoeba histolytica
KFGESVQFFGTRLIISAP

SEQ ID NO: 2739692 - protein, 20 aa, Entamoeba histolytica
KFGNPLIIWRRKEPLLESTN

SEQ ID NO: 2739693 - protein, 25 aa, Entamoeba histolytica
KFIRCGDVAQCDWIPATHEKEYIQN

SEQ ID NO: 2739694 - protein, 21 aa, Entamoeba histolytica
KFKPSQCMKLGYNYKAKVQTM

SEQ ID NO: 2739695 - protein, 21 aa, Entamoeba histolytica
KFKPTLRFIKELFMNQIDFII

SEQ ID NO: 2739696 - protein, 18 aa, Entamoeba histolytica
KFVKRIYINGVRYHKLYF

SEQ ID NO: 2739697 - protein, 26 aa, Entamoeba histolytica
KFVKSRLEIFGSKIIFYKNTQVKNKT

SEQ ID NO: 2739698 - protein, 22 aa, Entamoeba histolytica
KGASSVFKKEWKKMQSKISKAL

SEQ ID NO: 2739699 - protein, 18 aa, Entamoeba histolytica
KGIMDFVSQFFKFEALPE

SEQ ID NO: 2739700 - protein, 25 aa, Entamoeba histolytica
KGKGKLCERCFALAKTIRSAVFEKK

SEQ ID NO: 2739701 - protein, 18 aa, Entamoeba histolytica
KGKKFAVKTLKNAFNSAK

SEQ ID NO: 2739702 - protein, 27 aa, Entamoeba histolytica
KGTFTMPYRVCIGKQDYLYQFVIPSKT

SEQ ID NO: 2739703 - protein, 24 aa, Entamoeba histolytica
KGTHPSDGLALFIATLRYLQSLGS

SEQ ID NO: 2739704 - protein, 21 aa, Entamoeba histolytica
KGVITEGLYPCAIKCLKPIKE

SEQ ID NO: 2739705 - protein, 26 aa, Entamoeba histolytica
KHANCICFYCNFVLSNYSGLWLNYCP

SEQ ID NO: 2739706 - protein, 24 aa, Entamoeba histolytica
KHDKYFECNEFYEGIRTCPRNTKC

SEQ ID NO: 2739707 - protein, 19 aa, Entamoeba histolytica
KHDRICMFSEKRVNLVKGI

SEQ ID NO: 2739708 - protein, 25 aa, Entamoeba histolytica
KHFRRRIPPKFIRKVRHHHCGICGC

SEQ ID NO: 2739709 - protein, 25 aa, Entamoeba histolytica
KHIKRVFETSIEFKGLLIDFYTTCK

SEQ ID NO: 2739710 - protein, 22 aa, Entamoeba histolytica
KHKELFSACSPMSPALLPENTL

SEQ ID NO: 2739711 - protein, 24 aa, Entamoeba histolytica
KICDKSGFETLQFHVQAGPTHDNQ

SEQ ID NO: 2739712 - protein, 24 aa, Entamoeba histolytica
KIDNEFPLKYVINSVDGNRVVIVR

SEQ ID NO: 2739713 - protein, 18 aa, Entamoeba histolytica
KIESALKYIEEWKSYDEI

SEQ ID NO: 2739714 - protein, 25 aa, Entamoeba histolytica
KIKALECKARGLVKRLSNIAKEYNK

SEQ ID NO: 2739715 - protein, 23 aa, Entamoeba histolytica
KIKSGGVAGVMADIWWGLVETSP

SEQ ID NO: 2739716 - protein, 22 aa, Entamoeba histolytica
KILEIYPYFIVNEIKNTNNEIT

SEQ ID NO: 2739717 - protein, 17 aa, Entamoeba histolytica
KILNTKLKAAKIAENAE

SEQ ID NO: 2739718 - protein, 24 aa, Entamoeba histolytica
KIMKKKFIEERSRIKKEKNRERYQ

SEQ ID NO: 2739719 - protein, 18 aa, Entamoeba histolytica
KIMKKRHLENLGLNGYGK

SEQ ID NO: 2739720 - protein, 32 aa, Entamoeba histolytica
KIMRLFAGLGEKFFNKWCDVYHKEINTRRIYI

SEQ ID NO: 2739721 - protein, 18 aa, Entamoeba histolytica
KIRHGRFIITSSIMAQFA

SEQ ID NO: 2739722 - protein, 17 aa, Entamoeba histolytica
KIRKLRDKLDYLFTKRE

SEQ ID NO: 2739723 - protein, 24 aa, Entamoeba histolytica
KISKIYLIRRVYVVMGLIDLLDSF

SEQ ID NO: 2739724 - protein, 22 aa, Entamoeba histolytica
KIYKGEMFTDVGYWDISRAQIP

SEQ ID NO: 2739725 - protein, 18 aa, Entamoeba histolytica
KKAGIVIDTNKKQKENTM

SEQ ID NO: 2739726 - protein, 27 aa, Entamoeba histolytica
KKATSSLKCSSIEFGSVLYSRENYTFS

SEQ ID NO: 2739727 - protein, 24 aa, Entamoeba histolytica
KKCKKVEDWERFWASYKLASECYL

SEQ ID NO: 2739728 - protein, 20 aa, Entamoeba histolytica
KKDGLIIYCGLKTMRVISDR

SEQ ID NO: 2739729 - protein, 18 aa, Entamoeba histolytica
KKEQAIEFVKGMYNTALI

SEQ ID NO: 2739730 - protein, 19 aa, Entamoeba histolytica
KKIVLLKRHINSLKERISQ

SEQ ID NO: 2739731 - protein, 18 aa, Entamoeba histolytica
KKKLCFPDNGRWLNITIV

SEQ ID NO: 2739732 - protein, 24 aa, Entamoeba histolytica
KKKLETRKLYIAKLEEVRKSINET

SEQ ID NO: 2739733 - protein, 20 aa, Entamoeba histolytica
KKKVNSLLKKASKNASPKKI

SEQ ID NO: 2739734 - protein, 17 aa, Entamoeba histolytica
KKLCFPDNGRWLNITIV

SEQ ID NO: 2739735 - protein, 18 aa, Entamoeba histolytica
KKLFKVGKGFSIDDDKSI

SEQ ID NO: 2739736 - protein, 24 aa, Entamoeba histolytica
KKLIKRLSTMEGLLKEMAASKEMV

SEQ ID NO: 2739737 - protein, 20 aa, Entamoeba histolytica
KKLIQSIIFKSGAKMATKMA

SEQ ID NO: 2739738 - protein, 17 aa, Entamoeba histolytica
KKLNLGYPLKFATSNKF

SEQ ID NO: 2739739 - protein, 39 aa, Entamoeba histolytica
KKLYDGLKSQCWFKALQSCGCCKTCMAQKPPSCGCYKKT

SEQ ID NO: 2739740 - protein, 21 aa, Entamoeba histolytica
KKMFNTPVVKKYVPQKPRYYK

SEQ ID NO: 2739741 - protein, 30 aa, Entamoeba histolytica
KKMSLKAKFNRKIKLQLARKAKKMAKKIEY

SEQ ID NO: 2739742 - protein, 21 aa, Entamoeba histolytica
KKPKIPPMIPIVAQPPIIPVV

SEQ ID NO: 2739743 - protein, 25 aa, Entamoeba histolytica
KKQAPKKCYDFIGGKYHDLIHKPGK

SEQ ID NO: 2739744 - protein, 25 aa, Entamoeba histolytica
KKQYKIKDFVPIDWYINSPYLDKEF

SEQ ID NO: 2739745 - protein, 23 aa, Entamoeba histolytica
KKSELKFNLDNPFGERIINIQYY

SEQ ID NO: 2739746 - protein, 17 aa, Entamoeba histolytica
KKVVSLSDGVRCDMAHL

SEQ ID NO: 2739747 - protein, 19 aa, Entamoeba histolytica
KKYDCPARPFGGNEEYDIS

SEQ ID NO: 2739748 - protein, 23 aa, Entamoeba histolytica
KKYKIQLRKGLKKIIINRIKDAR

SEQ ID NO: 2739749 - protein, 20 aa, Entamoeba histolytica
KKYQNIIVGYVFGHDHRSEI

SEQ ID NO: 2739750 - protein, 24 aa, Entamoeba histolytica
KKYRKCKYHKVVVEESAVAPCESF

SEQ ID NO: 2739751 - protein, 23 aa, Entamoeba histolytica
KKYSKPKYVKIVYKNNGPQYYRK

SEQ ID NO: 2739752 - protein, 22 aa, Entamoeba histolytica
KLKEVKCLLKKSGVKGSLNVKK

SEQ ID NO: 2739753 - protein, 17 aa, Entamoeba histolytica
KLKMNRFGIDKTIGESQ

SEQ ID NO: 2739754 - protein, 17 aa, Entamoeba histolytica
KLLFDCVPIGNKFSDGF

SEQ ID NO: 2739755 - protein, 25 aa, Entamoeba histolytica
KLPSNEKYEGLKISEDQIRGEDVKI

SEQ ID NO: 2739756 - protein, 17 aa, Entamoeba histolytica
KLPVLPLTETDIFILNS

SEQ ID NO: 2739757 - protein, 25 aa, Entamoeba histolytica
KLRTKCSGLIRYVKENHDIYVSQVA

SEQ ID NO: 2739758 - protein, 20 aa, Entamoeba histolytica
KMIVIEIINIKGWSNFNNIK

SEQ ID NO: 2739759 - protein, 19 aa, Entamoeba histolytica
KMWYSSVFTLLYSQNPTLG

SEQ ID NO: 2739760 - protein, 31 aa, Entamoeba histolytica; identical to SEQ ID NO: 2552922

SEQ ID NO: 2739761 - protein, 17 aa, Entamoeba histolytica
KNCKGLIIENGFTTLLD

SEQ ID NO: 2739762 - protein, 24 aa, Entamoeba histolytica
KNETSRFNFFILYHPLISFMSRNY

SEQ ID NO: 2739763 - protein, 22 aa, Entamoeba histolytica
KNFIDRMICVFDFDTNTCKDSF

SEQ ID NO: 2739764 - protein, 23 aa, Entamoeba histolytica
KNGKLSATGDFSFSKNSQNINGQ

SEQ ID NO: 2739765 - protein, 30 aa, Entamoeba histolytica
KNIKRWLVICKTELIFKKNMEDFESLIQLP

SEQ ID NO: 2739766 - protein, 22 aa, Entamoeba histolytica
KNKERKVRELKQLREKQKKLEG

SEQ ID NO: 2739767 - protein, 22 aa, Entamoeba histolytica
KNKIPFTFIGHGMIYLKDIQDS

SEQ ID NO: 2739768 - protein, 27 aa, Entamoeba histolytica
KNLIGQFGVGFYSSFLVAENVTVISRK

SEQ ID NO: 2739769 - protein, 17 aa, Entamoeba histolytica
KNLKEFIEQLAVDDELW

SEQ ID NO: 2739770 - protein, 18 aa, Entamoeba histolytica
KNMEDFESLIQLPLIGLK

SEQ ID NO: 2739771 - protein, 20 aa, Entamoeba histolytica
KNNFYFSWWGGNHTLNSQTM

SEQ ID NO: 2739772 - protein, 25 aa, Entamoeba histolytica
KNNRCYKCFDGYHIHHGECEKNDIL

SEQ ID NO: 2739773 - protein, 18 aa, Entamoeba histolytica
KNRRSSIYNIKRVKASEK

SEQ ID NO: 2739774 - protein, 27 aa, Entamoeba histolytica
KNSKIIWNGAVSFERLIKFETTPSLNQ

SEQ ID NO: 2739775 - protein, 17 aa, Entamoeba histolytica
KNVSFNAGFNFENKYGQ

SEQ ID NO: 2739776 - protein, 24 aa, Entamoeba histolytica
KNVVVKFYVPWCNICKSIQSKYER

SEQ ID NO: 2739777 - protein, 24 aa, Entamoeba histolytica
KNWRCNTCLHLGELAQIGVVEHRG

SEQ ID NO: 2739778 - protein, 29 aa, Entamoeba histolytica
KNYTKGCAPFCGVCPFGYSCNQAARCVKN

SEQ ID NO: 2739779 - protein, 25 aa, Entamoeba histolytica
KPFKIPEPEPFKLPEHIETSKLTIK

SEQ ID NO: 2739780 - protein, 18 aa, Entamoeba histolytica
KPHDDMKFGQRLASNANF

SEQ ID NO: 2739781 - protein, 22 aa, Entamoeba histolytica
KPIHPIPFPSAAPHNLSADYII

SEQ ID NO: 2739782 - protein, 19 aa, Entamoeba histolytica
KPLEPTSCRIRTMKNYQAM

SEQ ID NO: 2739783 - protein, 23 aa, Entamoeba histolytica
KPLHYKGSIFHRVIPGFMIQGGD

SEQ ID NO: 2739784 - protein, 21 aa, Entamoeba histolytica
KPPHLGDGFIQRGNHYEYGTN

SEQ ID NO: 2739785 - protein, 21 aa, Entamoeba histolytica
KPQRLGDGFIQRGNHYEYGTN

SEQ ID NO: 2739786 - protein, 18 aa, Entamoeba histolytica
KPYINIFMQILANKTLST

SEQ ID NO: 2739787 - protein, 24 aa, Entamoeba histolytica
KQCNGKACLLLIFGEEENNELINQ

SEQ ID NO: 2739788 - protein, 21 aa, Entamoeba histolytica
KQGAHPIVWEEVFKKGNAKKE

SEQ ID NO: 2739789 - protein, 18 aa, Entamoeba histolytica
KQHKIMYNGYNIQLKGGD

SEQ ID NO: 2739790 - protein, 20 aa, Entamoeba histolytica
KQIREAEKVVGFLKVTIEDT

SEQ ID NO: 2739791 - protein, 19 aa, Entamoeba histolytica
KQKEEFVLRKASSSLLRTA

SEQ ID NO: 2739792 - protein, 34 aa, Entamoeba histolytica
KQLIFKFKRLFKGEFKTTNLITSFINVYDYLQVL

SEQ ID NO: 2739793 - protein, 24 aa, Entamoeba histolytica
KQPRKFKGKIFAIIESDEDMNIAI

SEQ ID NO: 2739794 - protein, 23 aa, Entamoeba histolytica
KQTDCKICRKLGKVAKYGIVHHE

SEQ ID NO: 2739795 - protein, 24 aa, Entamoeba histolytica
KRFPEVLETKMWVLPDAAMVISEA

SEQ ID NO: 2739796 - protein, 21 aa, Entamoeba histolytica
KRKIARIICGKKYWKKQAPKK

SEQ ID NO: 2739797 - protein, 26 aa, Entamoeba histolytica
KRKTKCGEFILGSVYIDIMKKIDQLN

SEQ ID NO: 2739798 - protein, 25 aa, Entamoeba histolytica
KRLAEEYRLKMLFIQVDGKDIELGL

SEQ ID NO: 2739799 - protein, 18 aa, Entamoeba histolytica
KRLETVKKINIMKKQRKN

SEQ ID NO: 2739800 - protein, 20 aa, Entamoeba histolytica
KRLPDAKTYFMNLDEDELPP

SEQ ID NO: 2739801 - protein, 17 aa, Entamoeba histolytica
KRLSGFRIYPVPGNHDY

SEQ ID NO: 2739802 - protein, 25 aa, Entamoeba histolytica
KRPKKYVHVCVPKSNIELMGKMKRC

SEQ ID NO: 2739803 - protein, 17 aa, Entamoeba histolytica
KRRIFLNKFLTSTDDVE

SEQ ID NO: 2739804 - protein, 21 aa, Entamoeba histolytica
KRVKIVKMIVKLLKMIKKTAE

SEQ ID NO: 2739805 - protein, 18 aa, Entamoeba histolytica
KSAKRIGQLRIIEENGSI

SEQ ID NO: 2739806 - protein, 22 aa, Entamoeba histolytica
KSASVKGRMKKIAKLAKKRVKK

SEQ ID NO: 2739807 - protein, 19 aa, Entamoeba histolytica
KSDVYFSIGTFYLNKIKIQ

SEQ ID NO: 2739808 - protein, 25 aa, Entamoeba histolytica
KSETDVKPPASINVPTKPESQGVQP

SEQ ID NO: 2739809 - protein, 18 aa, Entamoeba histolytica
KSKLVCSIVEFIAIPERD

SEQ ID NO: 2739810 - protein, 19 aa, Entamoeba histolytica
KSLSQPVEGNSSPVTPNPV

SEQ ID NO: 2739811 - protein, 29 aa, Entamoeba histolytica
KSNIELMGKMKRCLPIWKQDLPSLKRKLN

SEQ ID NO: 2739812 - protein, 19 aa, Entamoeba histolytica
KSPEIKRIITNEFMYVNTL

SEQ ID NO: 2739813 - protein, 25 aa, Entamoeba histolytica
KSQIVSLHARKTRIIGVMKKILNKF

SEQ ID NO: 2739814 - protein, 17 aa, Entamoeba histolytica
KSQWMLNNMSLWWKDWL

SEQ ID NO: 2739815 - protein, 19 aa, Entamoeba histolytica
KSRLLRFPYSTNVLTKNED

SEQ ID NO: 2739816 - protein, 23 aa, Entamoeba histolytica
KTGFKGKRFEVIGKMIMKKVQGE

SEQ ID NO: 2739817 - protein, 18 aa, Entamoeba histolytica
KTGIFKRFIKDQFSKNEK

SEQ ID NO: 2739818 - protein, 21 aa, Entamoeba histolytica
KTHGFSSIKVLPFNEDILVYL

SEQ ID NO: 2739819 - protein, 19 aa, Entamoeba histolytica
KTKEFKEIIKILKEGNKKE

SEQ ID NO: 2739820 - protein, 31 aa, Entamoeba histolytica
KTKKWWKVMIENVISFCIQFIIKHQIIKEIC

SEQ ID NO: 2739821 - protein, 17 aa, Entamoeba histolytica
KTLKAKIVQVKKAAKAA

SEQ ID NO: 2739822 - protein, 32 aa, Entamoeba histolytica
KTLLVKFFAPWCGHCKRLAPTYEEVAQAFTEN

SEQ ID NO: 2739823 - protein, 30 aa, Entamoeba histolytica
KTLPRREAIRLARRFDLRHRFDFAIDQEEF

SEQ ID NO: 2739824 - protein, 19 aa, Entamoeba histolytica
KTNKFDLTGHYKYKKLDAN

SEQ ID NO: 2739825 - protein, 18 aa, Entamoeba histolytica
KTNPCFIYLQRFGFMKEE

SEQ ID NO: 2739826 - protein, 21 aa, Entamoeba histolytica
KTPKRKITWDLAAQLIEYATA

SEQ ID NO: 2739827 - protein, 23 aa, Entamoeba histolytica
KTQNVWPRRVKDLIMNKKQILIN

SEQ ID NO: 2739828 - protein, 17 aa, Entamoeba histolytica
KTSNLSMVFVYPTVIML

SEQ ID NO: 2739829 - protein, 33 aa, Entamoeba histolytica
KTVAYYTNWAQYRFNSIDGWTCKYTADNIDPTI

SEQ ID NO: 2739830 - protein, 19 aa, Entamoeba histolytica
KVASFVPIPQVKAAAGAIA

SEQ ID NO: 2739831 - protein, 24 aa, Entamoeba histolytica
KVETLFSPSYFEWNDVCLSASEDN

SEQ ID NO: 2739832 - protein, 18 aa, Entamoeba histolytica
KVILNHAVCAVGYGSQDG

SEQ ID NO: 2739833 - protein, 17 aa, Entamoeba histolytica
KVIPGGIGMALQIELIK

SEQ ID NO: 2739834 - protein, 17 aa, Entamoeba histolytica
KVKEVIESAYILNNKKV

SEQ ID NO: 2739835 - protein, 26 aa, Entamoeba histolytica
KVKLIECGGIVLQECKTDTTTYNCPP

SEQ ID NO: 2739836 - protein, 27 aa, Entamoeba histolytica
KVLINRLRIKVAIFKRKIDKCKNSPFK

SEQ ID NO: 2739837 - protein, 17 aa, Entamoeba histolytica
KVLREIKKILSVIKSII

SEQ ID NO: 2739838 - protein, 19 aa, Entamoeba histolytica
KVNMSGPLIVADEFSTNRP

SEQ ID NO: 2739839 - protein, 17 aa, Entamoeba histolytica
KVPEVPQDIPLVGPQTP

SEQ ID NO: 2739840 - protein, 17 aa, Entamoeba histolytica
KVVKDLTLPPALIKSKQ

SEQ ID NO: 2739841 - protein, 28 aa, Entamoeba histolytica
KVYNLFAFPGTENFAGVKYPLEWINKFG

SEQ ID NO: 2739842 - protein, 24 aa, Entamoeba histolytica
KWKDYPKHFYLPFSNNNLCYQAKS

SEQ ID NO: 2739843 - protein, 17 aa, Entamoeba histolytica
KYDCPARPFGGNEEYDI

SEQ ID NO: 2739844 - protein, 24 aa, Entamoeba histolytica
KYDSFAYIGIDVWQVKAGTIYDDI

SEQ ID NO: 2739845 - protein, 24 aa, Entamoeba histolytica
KYELPKNLFISSLVSKENKETIRF

SEQ ID NO: 2739846 - protein, 19 aa, Entamoeba histolytica
KYKKLDANLNFNHIKDGKG

SEQ ID NO: 2739847 - protein, 33 aa, Entamoeba histolytica
KYLCIAFACCVGMKCVLSFPRKKTRNVTTFNID

SEQ ID NO: 2739848 - protein, 17 aa, Entamoeba histolytica
KYNETIDTFEFYQQLTT

SEQ ID NO: 2739849 - protein, 19 aa, Entamoeba histolytica
KYNSLMLAIEHRFYGKSVP

SEQ ID NO: 2739850 - protein, 20 aa, Entamoeba histolytica
KYTKAEGILKLMKKNQRRIM

SEQ ID NO: 2739851 - protein, 20 aa, Entamoeba histolytica
KYWIIRNSWGTSWGDAGYFL

SEQ ID NO: 2739852 - protein, 17 aa, Entamoeba histolytica
LAAKVSGVHWWYGSSSH

SEQ ID NO: 2739853 - protein, 23 aa, Entamoeba histolytica
LADPDTVQMLFGIITAQVEAGNI

SEQ ID NO: 2739854 - protein, 18 aa, Entamoeba histolytica
LAEKRKISGRGVVSKQEK

SEQ ID NO: 2739855 - protein, 25 aa, Entamoeba histolytica
LAFAWRPNPSYGLTNFKDMITTWCA

SEQ ID NO: 2739856 - protein, 23 aa, Entamoeba histolytica
LAFLVFLCLYISFPLTITETPRN

SEQ ID NO: 2739857 - protein, 31 aa, Entamoeba histolytica
LAFNIPKYFPFPAGYLSIFSQDIIKFIGKWE

SEQ ID NO: 2739858 - protein, 23 aa, Entamoeba histolytica
LAKELRGNIAIFRSQEKYQNKLD

SEQ ID NO: 2739859 - protein, 17 aa, Entamoeba histolytica
LAMFISFSYAEESEVEL

SEQ ID NO: 2739860 - protein, 17 aa, Entamoeba histolytica
LASIGGWNFNFYDSTKH

SEQ ID NO: 2739861 - protein, 17 aa, Entamoeba histolytica
LCDRGKQELFSLGKYYK

SEQ ID NO: 2739862 - protein, 18 aa, Entamoeba histolytica
LCGACSVMPHGDATLGSI

SEQ ID NO: 2739863 - protein, 22 aa, Entamoeba histolytica
LCGKASGFLGTLCEKILSFGVD

SEQ ID NO: 2739864 - protein, 27 aa, Entamoeba histolytica
LCQKCTSNQCILCLDGIINENGICVDP

SEQ ID NO: 2739865 - protein, 20 aa, Entamoeba histolytica
LDDIKLVLKEGSCNQMCSDH

SEQ ID NO: 2739866 - protein, 25 aa, Entamoeba histolytica
LDDLKKKKFEVEAKKIAVAKAEKIN

SEQ ID NO: 2739867 - protein, 25 aa, Entamoeba histolytica
LDDPHICKVRERYVSPEVLGEWYTN

SEQ ID NO: 2739868 - protein, 21 aa, Entamoeba histolytica
LDFMGDLFKDWLSPNALEQFK

SEQ ID NO: 2739869 - protein, 25 aa, Entamoeba histolytica
LDFNHQLPIFWYFSAKHNQTEHDTI

SEQ ID NO: 2739870 - protein, 20 aa, Entamoeba histolytica
LDGTSPVFMLLAFVIQLIFF

SEQ ID NO: 2739871 - protein, 24 aa, Entamoeba histolytica
LDKYCSSCNISSNICSSCVSGYYL

SEQ ID NO: 2739872 - protein, 18 aa, Entamoeba histolytica
LDTKIALKKKVLKLQSQD

SEQ ID NO: 2739873 - protein, 25 aa, Entamoeba histolytica
LDYKESIPPFLLIEGDVSVTIKTNY

SEQ ID NO: 2739874 - protein, 25 aa, Entamoeba histolytica
LDYKFSRAGSWPIWYPHYDGKKTFS

SEQ ID NO: 2739875 - protein, 27 aa, Entamoeba histolytica
LECKCGKTIYNPCMWPFQGNTPDCDGK

SEQ ID NO: 2739876 - protein, 17 aa, Entamoeba histolytica
LEDNELEEDDDDEFELE

SEQ ID NO: 2739877 - protein, 24 aa, Entamoeba histolytica
LEDRPSHNRLWKVEKKFFKLHKQA

SEQ ID NO: 2739878 - protein, 28 aa, Entamoeba histolytica
LEEFDRLKSKGIDYVWMMGVWQLGEYGL

SEQ ID NO: 2739879 - protein, 18 aa, Entamoeba histolytica
LEEINWKKLFKVGKGFSI

SEQ ID NO: 2739880 - protein, 25 aa, Entamoeba histolytica
LEELKKFKIVIAIPPMFIFTEHEIE

SEQ ID NO: 2739881 - protein, 24 aa, Entamoeba histolytica
LEKYGLKTAPSIAILHKNQRTSYP

SEQ ID NO: 2739882 - protein, 20 aa, Entamoeba histolytica
LELKDKYFLDINVLKDLVKK

SEQ ID NO: 2739883 - protein, 17 aa, Entamoeba histolytica
LENNYNNELEDEDEDEY

SEQ ID NO: 2739884 - protein, 26 aa, Entamoeba histolytica
LEQIVHPILRRYGGVHHRADENFYEG

SEQ ID NO: 2739885 - protein, 21 aa, Entamoeba histolytica
LEQLNKVIFIRSIDEKTVQAA

SEQ ID NO: 2739886 - protein, 24 aa, Entamoeba histolytica
LERHKKLTEKWVHLACTDKKIVEN

SEQ ID NO: 2739887 - protein, 23 aa, Entamoeba histolytica
LERTQPKILKFGILGGKNSIGLC

SEQ ID NO: 2739888 - protein, 19 aa, Entamoeba histolytica
LESMPQKWIDTYISKVITI

SEQ ID NO: 2739889 - protein, 28 aa, Entamoeba histolytica
LETDNSFTRRIEVTGGQIEVNNKITFSE

SEQ ID NO: 2739890 - protein, 25 aa, Entamoeba histolytica
LEVYEKQGWFVPDKGVLKVWNFDWE

SEQ ID NO: 2739891 - protein, 18 aa, Entamoeba histolytica
LEYIKVRINYAIKNNFSI

SEQ ID NO: 2739892 - protein, 17 aa, Entamoeba histolytica
LFCITVFSEDTKQEDKV

SEQ ID NO: 2739893 - protein, 18 aa, Entamoeba histolytica
LFDGIAFDHIMIKTINNI

SEQ ID NO: 2739894 - protein, 22 aa, Entamoeba histolytica
LFEIYKRLYGVSFKLNKEVQGW

SEQ ID NO: 2739895 - protein, 19 aa, Entamoeba histolytica
LFICFCLSKECSIDSNDFT

SEQ ID NO: 2739896 - protein, 21 aa, Entamoeba histolytica
LFIITFYFRIVSGDWCEFSPN

SEQ ID NO: 2739897 - protein, 18 aa, Entamoeba histolytica
LFKHYRGGIYYNEECTRR

SEQ ID NO: 2739898 - protein, 18 aa, Entamoeba histolytica
LFPHSGFIYTLSVNINEI

SEQ ID NO: 2739899 - protein, 23 aa, Entamoeba histolytica
LFRYKMDLDQCVVDLTLKDTCGQ

SEQ ID NO: 2739900 - protein, 22 aa, Entamoeba histolytica
LFSIQLCYGLKEDYVNIFIGTN

SEQ ID NO: 2739901 - protein, 17 aa, Entamoeba histolytica
LFSVFTFAEEEFTIDED

SEQ ID NO: 2739902 - protein, 17 aa, Entamoeba histolytica
LGESLSFKSLTDSSINI

SEQ ID NO: 2739903 - protein, 17 aa, Entamoeba histolytica
LGLKLDPLLLRPLARSW

SEQ ID NO: 2739904 - protein, 19 aa, Entamoeba histolytica
LHDRIQSLLYLPSNNEKAP

SEQ ID NO: 2739905 - protein, 20 aa, Entamoeba histolytica
LHLIEMKKEINLMGSDNLAK

SEQ ID NO: 2739906 - protein, 18 aa, Entamoeba histolytica
LHSHCLYCDTTVCNQCDP

SEQ ID NO: 2739907 - protein, 28 aa, Entamoeba histolytica
LIDTLFPLRHAWTFTAVFLPGAIPRSYI

SEQ ID NO: 2739908 - protein, 24 aa, Entamoeba histolytica
LIECKTSDCYIELNTDSSVTSESI

SEQ ID NO: 2739909 - protein, 18 aa, Entamoeba histolytica
LIEELSFGSHLYDSFEEE

SEQ ID NO: 2739910 - protein, 24 aa, Entamoeba histolytica
LIEGFEMKELITAPFNYITDFLEN

SEQ ID NO: 2739911 - protein, 18 aa, Entamoeba histolytica
LIEKLYRSVHETGDIISE

SEQ ID NO: 2739912 - protein, 25 aa, Entamoeba histolytica
LIGLGAKESFSFARYQATDDGSYFI

SEQ ID NO: 2739913 - protein, 17 aa, Entamoeba histolytica
LIISDTLTFTTMDITTT

SEQ ID NO: 2739914 - protein, 18 aa, Entamoeba histolytica
LIIVNFSFAINFDQWKIK

SEQ ID NO: 2739915 - protein, 22 aa, Entamoeba histolytica
LIKEIKEATDLLSQIENKFIER

SEQ ID NO: 2739916 - protein, 21 aa, Entamoeba histolytica
LINSCSVSFIIKSNKIPLIKL

SEQ ID NO: 2739917 - protein, 18 aa, Entamoeba histolytica
LKAALSQGLVDVSIDASS

SEQ ID NO: 2739918 - protein, 26 aa, Entamoeba histolytica
LKAIRKNWGGWPFEDLMKGMDYLKTS

SEQ ID NO: 2739919 - protein, 19 aa, Entamoeba histolytica
LKASLSAWGNFQILANSHT

SEQ ID NO: 2739920 - protein, 23 aa, Entamoeba histolytica
LKDQYYRLAALKERQKMQIKASK

SEQ ID NO: 2739921 - protein, 25 aa, Entamoeba histolytica
LKEKMREVIKVLPKREQYRLLRKMD

SEQ ID NO: 2739922 - protein, 20 aa, Entamoeba histolytica
LKKKCDEFETIGATGRCNEV

SEQ ID NO: 2739923 - protein, 23 aa, Entamoeba histolytica
LKKLLHHYGPFLVSVKVSGTGFS

SEQ ID NO: 2739924 - protein, 21 aa, Entamoeba histolytica
LKLDPLLLRPLARSWESDYQL

SEQ ID NO: 2739925 - protein, 25 aa, Entamoeba histolytica
LKLKEFRLRRTIAIILKQMATVLTS

SEQ ID NO: 2739926 - protein, 19 aa, Entamoeba histolytica
LKLMLDFVPNHSACDAPTV

SEQ ID NO: 2739927 - protein, 19 aa, Entamoeba histolytica
LKLSEEGKWSEIREYIKRC

SEQ ID NO: 2739928 - protein, 19 aa, Entamoeba histolytica
LKLSHEYDGLLKVKLSDLK

SEQ ID NO: 2739929 - protein, 17 aa, Entamoeba histolytica
LKMSKLIDDKSYRDNFI

SEQ ID NO: 2739930 - protein, 17 aa, Entamoeba histolytica
LKNILSYFLQETYTFKN

SEQ ID NO: 2739931 - protein, 19 aa, Entamoeba histolytica
LKNSMNLEFKKIIEKELLR

SEQ ID NO: 2739932 - protein, 19 aa, Entamoeba histolytica
LKNYEVWSMDDEEYFVFNK

SEQ ID NO: 2739933 - protein, 17 aa, Entamoeba histolytica
LKQRLIIVNGHKKELLI

SEQ ID NO: 2739934 - protein, 26 aa, Entamoeba histolytica
LKRQNSLRLLGKVAGSSLSYNEIIQG

SEQ ID NO: 2739935 - protein, 37 aa, Entamoeba histolytica; identical to SEQ ID NO: 2554195

SEQ ID NO: 2739936 - protein, 20 aa, Entamoeba histolytica
LKSKLVCSIVEFITIPVRDS

SEQ ID NO: 2739937 - protein, 18 aa, Entamoeba histolytica
LKVTVEWENFNKYAADNK

SEQ ID NO: 2739938 - protein, 20 aa, Entamoeba histolytica
LKYQPVMSFHKCGGNVGDTC

SEQ ID NO: 2739939 - protein, 23 aa, Entamoeba histolytica
LLANLRYYWPGLKQCSFFNYEYL

SEQ ID NO: 2739940 - protein, 19 aa, Entamoeba histolytica
LLASVPTYVKERIINTLHI

SEQ ID NO: 2739941 - protein, 19 aa, Entamoeba histolytica
LLCSIHCMKESEFITCINQ

SEQ ID NO: 2739942 - protein, 18 aa, Entamoeba histolytica
LLDHVKKTLSYVDKCKVR

SEQ ID NO: 2739943 - protein, 25 aa, Entamoeba histolytica
LLELYIKEGDGFILVYAVDDNASFN

SEQ ID NO: 2739944 - protein, 19 aa, Entamoeba histolytica
LLIDYWYKEYFMSVRNKEP

SEQ ID NO: 2739945 - protein, 23 aa, Entamoeba histolytica
LLILCVFAKYHIVIPMIGSPKKL

SEQ ID NO: 2739946 - protein, 18 aa, Entamoeba histolytica
LLKKFEDFFIIPMLGNHD

SEQ ID NO: 2739947 - protein, 21 aa, Entamoeba histolytica
LLKSNPRRIVPILHDDKKKGV

SEQ ID NO: 2739948 - protein, 18 aa, Entamoeba histolytica
LLLLFIILSTGKYIGFFP

SEQ ID NO: 2739949 - protein, 19 aa, Entamoeba histolytica
LLPKKSIESEEKFTPESEY

SEQ ID NO: 2739950 - protein, 18 aa, Entamoeba histolytica
LLSWQRILVSMYFGQTPK

SEQ ID NO: 2739951 - protein, 23 aa, Entamoeba histolytica
LLVDIATDFGFMFITSKMKNKFN

SEQ ID NO: 2739952 - protein, 24 aa, Entamoeba histolytica
LLYIPAEGPNPFAPKDPEKLKQML

SEQ ID NO: 2739953 - protein, 21 aa, Entamoeba histolytica
LMKKYERQAAQLVGEEMYMKQ

SEQ ID NO: 2739954 - protein, 19 aa, Entamoeba histolytica
LMMKGVESIIAQANDDLLQ

SEQ ID NO: 2739955 - protein, 17 aa, Entamoeba histolytica
LMRFCPNGITLNKNVIC

SEQ ID NO: 2739956 - protein, 20 aa, Entamoeba histolytica
LNAMRLPKEIIFPAQPPIGL

SEQ ID NO: 2739957 - protein, 17 aa, Entamoeba histolytica
LNFLGILGLKHAFNHFP

SEQ ID NO: 2739958 - protein, 22 aa, Entamoeba histolytica
LNNMSLWWKDWLSPEEIATTKK

SEQ ID NO: 2739959 - protein, 24 aa, Entamoeba histolytica
LNRMVMKKNIEIHSDFQIDEIITS

SEQ ID NO: 2739960 - protein, 25 aa, Entamoeba histolytica
LNSWSDGFIMNAGWLVGLSDLATEN

SEQ ID NO: 2739961 - protein, 17 aa, Entamoeba histolytica
LNTPITIIWENGESVSV

SEQ ID NO: 2739962 - protein, 19 aa, Entamoeba histolytica
LNVNGFGFRIKRPERRSQK

SEQ ID NO: 2739963 - protein, 19 aa, Entamoeba histolytica
LNYKIAIPLLDSIINGLKL

SEQ ID NO: 2739964 - protein, 22 aa, Entamoeba histolytica
LPDDAPIILVYHGLAGGSRESY

SEQ ID NO: 2739965 - protein, 18 aa, Entamoeba histolytica
LPDYSDLFVAQDTWSSPT

SEQ ID NO: 2739966 - protein, 30 aa, Entamoeba histolytica
LPEIILPSDFFLKAIRSFESSYGMIPSSLN

SEQ ID NO: 2739967 - protein, 30 aa, Entamoeba histolytica; identical to SEQ ID NO: 2554239

SEQ ID NO: 2739968 - protein, 17 aa, Entamoeba histolytica
LPINVIINGGYVLEKKL

SEQ ID NO: 2739969 - protein, 30 aa, Entamoeba histolytica
LPKEIIFPAQPPIGLQVTWSGCREAEGCNV

SEQ ID NO: 2739970 - protein, 17 aa, Entamoeba histolytica
LPKKEAPEIKIWKKERC

SEQ ID NO: 2739971 - protein, 22 aa, Entamoeba histolytica
LPLDLDMNILFRAINSYANPIV

SEQ ID NO: 2739972 - protein, 19 aa, Entamoeba histolytica
LPMNIRLGFVKDSVMHVIA

SEQ ID NO: 2739973 - protein, 24 aa, Entamoeba histolytica
LPQEWLWCESWCNQKVKSKAKTID

SEQ ID NO: 2739974 - protein, 19 aa, Entamoeba histolytica
LQCGISLQDMDIIFTDIVP

SEQ ID NO: 2739975 - protein, 17 aa, Entamoeba histolytica
LQFNFWRKHIKNNENDD

SEQ ID NO: 2739976 - protein, 28 aa, Entamoeba histolytica
LQKRMGLCPLNRLRIKRRLRVYKKEVSI

SEQ ID NO: 2739977 - protein, 17 aa, Entamoeba histolytica
LQMCEKIGYVFKKRPTK

SEQ ID NO: 2739978 - protein, 23 aa, Entamoeba histolytica
LQNRPYHISALFIADLKTFRMNN

SEQ ID NO: 2739979 - protein, 17 aa, Entamoeba histolytica
LQTIFSKKKLCFPDNGR

SEQ ID NO: 2739980 - protein, 23 aa, Entamoeba histolytica
LQTPCACNKKLLKSLHEKRKQLE

SEQ ID NO: 2739981 - protein, 18 aa, Entamoeba histolytica
LQYLCWPILQVIFKTPLE

SEQ ID NO: 2739982 - protein, 21 aa, Entamoeba histolytica
LRGYIDLIFAIKRILKRITTS

SEQ ID NO: 2739983 - protein, 18 aa, Entamoeba histolytica
LRHMMTGIRLHSLLVTYG

SEQ ID NO: 2739984 - protein, 17 aa, Entamoeba histolytica
LRKLPVLPLTETDIFIL

SEQ ID NO: 2739985 - protein, 18 aa, Entamoeba histolytica
LRKSMSLCTTQITSNTLE

SEQ ID NO: 2739986 - protein, 24 aa, Entamoeba histolytica
LRKVRKTRVELMRTLYKLVGKLSV

SEQ ID NO: 2739987 - protein, 25 aa, Entamoeba histolytica
LRLVRGERTFIYLIGHGGEGFMKFQ

SEQ ID NO: 2739988 - protein, 17 aa, Entamoeba histolytica
LRNKVLFSVDGKLVSND

SEQ ID NO: 2739989 - protein, 18 aa, Entamoeba histolytica
LRQLERIARVSAIKHMIK

SEQ ID NO: 2739990 - protein, 26 aa, Entamoeba histolytica
LRYQMLPYWYSLWYYHRVDYKPVIRA

SEQ ID NO: 2739991 - protein, 25 aa, Entamoeba histolytica
LSELRMTKNFWIARESFSLKAHSLE

SEQ ID NO: 2739992 - protein, 18 aa, Entamoeba histolytica
LSFAFTFDDWIKKYQYNK

SEQ ID NO: 2739993 - protein, 23 aa, Entamoeba histolytica
LSFLFIFCHALICNETNCSTIEN

SEQ ID NO: 2739994 - protein, 27 aa, Entamoeba histolytica
LSGKFDYKASNAWRVTGDGFISNKYGQ

SEQ ID NO: 2739995 - protein, 21 aa, Entamoeba histolytica
LSKCHGFSNFYILRFKTTTGT

SEQ ID NO: 2739996 - protein, 22 aa, Entamoeba histolytica
LSKKMCDLKAKISVAKNEIKHQ

SEQ ID NO: 2739997 - protein, 21 aa, Entamoeba histolytica
LSKLVPSWCKEKIPLEEWKLE

SEQ ID NO: 2739998 - protein, 18 aa, Entamoeba histolytica
LSKTDCRNRESAFSNFMA

SEQ ID NO: 2739999 - protein, 24 aa, Entamoeba histolytica
LSMLKLKKQRVRLSEEMGDILRTL

SEQ ID NO: 2740000 - protein, 18 aa, Entamoeba histolytica
LSNAISFDKWMAKNNQKF

SEQ ID NO: 2740001 - protein, 23 aa, Entamoeba histolytica
LSRSRKALSNALLVYHILLEGAT

SEQ ID NO: 2740002 - protein, 18 aa, Entamoeba histolytica
LSSKIVHGLSFYRDPYHK

SEQ ID NO: 2740003 - protein, 32 aa, Entamoeba histolytica
LSTSELRDGGFFPTCYDWYTGKISDFVEPQYD

SEQ ID NO: 2740004 - protein, 27 aa, Entamoeba histolytica
LTELKVKNLQRVVSWMKKKLETRKLYI

SEQ ID NO: 2740005 - protein, 19 aa, Entamoeba histolytica
LTELPNFYELIREFKSEEE

SEQ ID NO: 2740006 - protein, 19 aa, Entamoeba histolytica
LTHQPSPWIRDYDFLLLLP

SEQ ID NO: 2740007 - protein, 25 aa, Entamoeba histolytica
LTIILGKIPFEFDASIDSGITFDFQ

SEQ ID NO: 2740008 - protein, 20 aa, Entamoeba histolytica
LTIPKCKEACTLQVDQSSFN

SEQ ID NO: 2740009 - protein, 18 aa, Entamoeba histolytica
LTMIYTNFIEAMKSEEAN

SEQ ID NO: 2740010 - protein, 19 aa, Entamoeba histolytica
LTNKFIMKLYCFKQNTIRF

SEQ ID NO: 2740011 - protein, 20 aa, Entamoeba histolytica
LTNTIQYIHNNIHLIAETTT

SEQ ID NO: 2740012 - protein, 17 aa, Entamoeba histolytica
LTPTVSVISCGELNTYN

SEQ ID NO: 2740013 - protein, 19 aa, Entamoeba histolytica
LTRDCIPEYLTLNYNNKTQ

SEQ ID NO: 2740014 - protein, 28 aa, Entamoeba histolytica
LVKEYDKACGKYVSVGYDYLAVKNTSMV

SEQ ID NO: 2740015 - protein, 17 aa, Entamoeba histolytica
LWDSYCDMYDYWKFSGV

SEQ ID NO: 2740016 - protein, 33 aa, Entamoeba histolytica
LWDSYCDMYDYWKFSGVKVKWIPKVKTSVALPY

SEQ ID NO: 2740017 - protein, 25 aa, Entamoeba histolytica
LYAPWCGHCKHLAPEFASAAKEVNG

SEQ ID NO: 2740018 - protein, 18 aa, Entamoeba histolytica
LYEARYVIVYSTEFKEGI

SEQ ID NO: 2740019 - protein, 19 aa, Entamoeba histolytica
LYEKYNYKLPFDIKMQCMI

SEQ ID NO: 2740020 - protein, 19 aa, Entamoeba histolytica
LYEKYNYKLPFPIKMHCLI

SEQ ID NO: 2740021 - protein, 18 aa, Entamoeba histolytica
LYISFPLTITETPRNLAS

SEQ ID NO: 2740022 - protein, 18 aa, Entamoeba histolytica
LYKKIAIKKTLLDMSKES

SEQ ID NO: 2740023 - protein, 17 aa, Entamoeba histolytica
LYKNVMVILDKEKKQKA

SEQ ID NO: 2740024 - protein, 20 aa, Entamoeba histolytica
LYKTHLKSEEPEKVTPKIPQ

SEQ ID NO: 2740025 - protein, 19 aa, Entamoeba histolytica
LYSNVGLKMNGIDGVFNGG

SEQ ID NO: 2740026 - protein, 20 aa, Entamoeba histolytica
MAINPFCILHLVHSGILSSL

SEQ ID NO: 2740027 - protein, 23 aa, Entamoeba histolytica
MALKSGFTLHGWWPNFVSGYPSC

SEQ ID NO: 2740028 - protein, 19 aa, Entamoeba histolytica
MCKWKSFFDHMSKKVPKSS

SEQ ID NO: 2740029 - protein, 25 aa, Entamoeba histolytica
MDNKEVLDSIDWRSEGKVTPVKNQR

SEQ ID NO: 2740030 - protein, 23 aa, Entamoeba histolytica
MDPCTDCKLDGYGGHTTDIRIVC

SEQ ID NO: 2740031 - protein, 26 aa, Entamoeba histolytica
MDPESLIKCAFGSYGNTLMKEAVDRP

SEQ ID NO: 2740032 - protein, 24 aa, Entamoeba histolytica
MEGLDFSFVLTRARFNELNLDLFK

SEQ ID NO: 2740033 - protein, 24 aa, Entamoeba histolytica
MELQKRLPGFKVFPAPGNHDYFKH

SEQ ID NO: 2740034 - protein, 17 aa, Entamoeba histolytica
MEMSKWLIVKIIKKNKI

SEQ ID NO: 2740035 - protein, 20 aa, Entamoeba histolytica
MEYATALGFDYCAREENKGK

SEQ ID NO: 2740036 - protein, 23 aa, Entamoeba histolytica
MFDNEVLTYAGFRAYHDYFTLNY

SEQ ID NO: 2740037 - protein, 19 aa, Entamoeba histolytica
MFEGLYPFYNYKGMEMASL

SEQ ID NO: 2740038 - protein, 18 aa, Entamoeba histolytica
MFETSNLESLRVVDRKTI

SEQ ID NO: 2740039 - protein, 23 aa, Entamoeba histolytica
MFSEKRVNLVKGIPYLFDGCIPH

SEQ ID NO: 2740040 - protein, 19 aa, Entamoeba histolytica
MGASYGGYMMNWINSQNTG

SEQ ID NO: 2740041 - protein, 17 aa, Entamoeba histolytica
MGCMKKYRQRACKNETK

SEQ ID NO: 2740042 - protein, 21 aa, Entamoeba histolytica
MGYSFPLAKKFFGIPEHATDV

SEQ ID NO: 2740043 - protein, 19 aa, Entamoeba histolytica
MKEIHGMTLINKEFIIRTS

SEQ ID NO: 2740044 - protein, 19 aa, Entamoeba histolytica
MKEKVISSMALFLKPSLSE

SEQ ID NO: 2740045 - protein, 19 aa, Entamoeba histolytica
MKELKLLTKKVLKNLSTDE

SEQ ID NO: 2740046 - protein, 17 aa, Entamoeba histolytica
MKKIAKLAKKRVKKSTK

SEQ ID NO: 2740047 - protein, 24 aa, Entamoeba histolytica
MKKTMKKTMMKKTMKKTMKKTMKK

SEQ ID NO: 2740048 - protein, 26 aa, Entamoeba histolytica
MKLEEKRLKLAVHGKLPGQKADLISD

SEQ ID NO: 2740049 - protein, 22 aa, Entamoeba histolytica
MKNVAGSLVKKAIKKQVKAMNI

SEQ ID NO: 2740050 - protein, 24 aa, Entamoeba histolytica
MKSLKRIRIINSFHLNFYKCSYGS

SEQ ID NO: 2740051 - protein, 19 aa, Entamoeba histolytica
MKTGCCLNEMITFDETFGN

SEQ ID NO: 2740052 - protein, 21 aa, Entamoeba histolytica
MLRIYKVYDLFYGGRRLKMSF

SEQ ID NO: 2740053 - protein, 23 aa, Entamoeba histolytica
MLTWKEHKCHLINPSTLDIKSTL

SEQ ID NO: 2740054 - protein, 25 aa, Entamoeba histolytica
MMEVWDIPGSILMEMDETIMREILE

SEQ ID NO: 2740055 - protein, 17 aa, Entamoeba histolytica
MNCRICHNISLPCRNGE

SEQ ID NO: 2740056 - protein, 25 aa, Entamoeba histolytica
MNLKRCLRTRIAMNDEIKRKEIERR

SEQ ID NO: 2740057 - protein, 18 aa, Entamoeba histolytica
MPPAFTAIEFGKCNYISS

SEQ ID NO: 2740058 - protein, 20 aa, Entamoeba histolytica
MPYKNGFWYLMEKAGITFGK

SEQ ID NO: 2740059 - protein, 25 aa, Entamoeba histolytica
MRERMRRKRILALKKNLRKMYLERR

SEQ ID NO: 2740060 - protein, 19 aa, Entamoeba histolytica
MRKAAISRLVDLKRNKIEM

SEQ ID NO: 2740061 - protein, 18 aa, Entamoeba histolytica
MSLVVAFILTFTNAEEEL

SEQ ID NO: 2740062 - protein, 21 aa, Entamoeba histolytica
MSNDCSISFTGVTQLNRMVMK

SEQ ID NO: 2740063 - protein, 23 aa, Entamoeba histolytica
MTKYWRKRLDGVDEILRELQAVE

SEQ ID NO: 2740064 - protein, 21 aa, Entamoeba histolytica
MVGASYDWRYYRYGEYKHKRN

SEQ ID NO: 2740065 - protein, 24 aa, Entamoeba histolytica
MVGASYDWRYYRYGEYKHKRNWFE

SEQ ID NO: 2740066 - protein, 22 aa, Entamoeba histolytica
MVPKYSLGYHQCRWNYMSQNEA

SEQ ID NO: 2740067 - protein, 18 aa, Entamoeba histolytica
MVRRSVGKNAIMRKAAIS

SEQ ID NO: 2740068 - protein, 35 aa, Entamoeba histolytica
MYSKQHKIMYNLYKAELKGEVTTQITDEVPKSSQP

SEQ ID NO: 2740069 - protein, 25 aa, Entamoeba histolytica
NAEYKPNKNFTFGISGSKENKYGKT

SEQ ID NO: 2740070 - protein, 23 aa, Entamoeba histolytica
NAGLKFQAVMSFHKCGGNVGDSV

SEQ ID NO: 2740071 - protein, 17 aa, Entamoeba histolytica
NAGYPGVVADIWDYIVS

SEQ ID NO: 2740072 - protein, 17 aa, Entamoeba histolytica
NAIMRKAAISRLVDLKR

SEQ ID NO: 2740073 - protein, 22 aa, Entamoeba histolytica
NALKIDCLHPSISTTSISVSSS

SEQ ID NO: 2740074 - protein, 17 aa, Entamoeba histolytica
NANINCVYNIPSSTNSV

SEQ ID NO: 2740075 - protein, 18 aa, Entamoeba histolytica
NAPTNCLHLYGQYPLNTN

SEQ ID NO: 2740076 - protein, 21 aa, Entamoeba histolytica
NASDGLPEWLYYFKDVNNKWA

SEQ ID NO: 2740077 - protein, 28 aa, Entamoeba histolytica
NCKEFNKGRCAICSDGYFLNKNGSCDAC

SEQ ID NO: 2740078 - protein, 19 aa, Entamoeba histolytica
NCKWVDHIVTVVGYGTTEE

SEQ ID NO: 2740079 - protein, 24 aa, Entamoeba histolytica
NCNKCSEGQCYECLDKLEMINGIC

SEQ ID NO: 2740080 - protein, 18 aa, Entamoeba histolytica
NCYKRRHLWKKIKKIQEI

SEQ ID NO: 2740081 - protein, 17 aa, Entamoeba histolytica
NDFKLERMTGYTVTVFK

SEQ ID NO: 2740082 - protein, 17 aa, Entamoeba histolytica
NDKCLKCEDGYYRDGIL

SEQ ID NO: 2740083 - protein, 21 aa, Entamoeba histolytica
NDKLWNVLDAIQFKDIPQEHL

SEQ ID NO: 2740084 - protein, 19 aa, Entamoeba histolytica
NDPNCLSFMTFNFNHTITY

SEQ ID NO: 2740085 - protein, 25 aa, Entamoeba histolytica
NDQEPFCWSESVFADVVHKNLPDRF

SEQ ID NO: 2740086 - protein, 21 aa, Entamoeba histolytica
NDWYFDYWKSDRMKLIQRDAP

SEQ ID NO: 2740087 - protein, 18 aa, Entamoeba histolytica
NDYSIGIRIQFGNFVYVT

SEQ ID NO: 2740088 - protein, 26 aa, Entamoeba histolytica
NEAKDKISAMSLFFKAKVTQSVNDIK

SEQ ID NO: 2740089 - protein, 18 aa, Entamoeba histolytica
NEEFVIALNQLRKYTEDP

SEQ ID NO: 2740090 - protein, 19 aa, Entamoeba histolytica
NEGKYFFGTFTDKECKTSS

SEQ ID NO: 2740091 - protein, 20 aa, Entamoeba histolytica
NEGTTWSAKAAHKMNKDSSW

SEQ ID NO: 2740092 - protein, 17 aa, Entamoeba histolytica
NEHYKPYINIFMQILAN

SEQ ID NO: 2740093 - protein, 20 aa, Entamoeba histolytica
NEIKKLMMKGVESIIAQAND

SEQ ID NO: 2740094 - protein, 26 aa, Entamoeba histolytica
NELKRPREGWNWKLQILEIANAPMPK

SEQ ID NO: 2740095 - protein, 20 aa, Entamoeba histolytica
NELYYSVAHHSIFYTKCDGI

SEQ ID NO: 2740096 - protein, 20 aa, Entamoeba histolytica
NEMKEYLSGEWKFYQVETTI

SEQ ID NO: 2740097 - protein, 23 aa, Entamoeba histolytica
NEMWKTSCTLNRRILNIELMYEK

SEQ ID NO: 2740098 - protein, 21 aa, Entamoeba histolytica
NEPIPLLLIKSMKTIKNALPY

SEQ ID NO: 2740099 - protein, 19 aa, Entamoeba histolytica
NERYCLYDSYLCNATTLDD

SEQ ID NO: 2740100 - protein, 23 aa, Entamoeba histolytica
NFGSSISIFGYWIAVSSSLGNEF

SEQ ID NO: 2740101 - protein, 25 aa, Entamoeba histolytica
NFIGYACGYYSYKWAESISADAFEY

SEQ ID NO: 2740102 - protein, 22 aa, Entamoeba histolytica
NFKIGPILFEIGFQNPYKFEAQ

SEQ ID NO: 2740103 - protein, 24 aa, Entamoeba histolytica
NGCNGGSILYVFAYTKRNGVMQEK

SEQ ID NO: 2740104 - protein, 27 aa, Entamoeba histolytica
NGGKDWYKKRMQWLSKVGPGLDEESSG

SEQ ID NO: 2740105 - protein, 28 aa, Entamoeba histolytica
NGGSLLLSFRYVKLNGIMQEKDYPYVAA

SEQ ID NO: 2740106 - protein, 21 aa, Entamoeba histolytica
NGIERPKWFIKYANNDIDWHL

SEQ ID NO: 2740107 - protein, 17 aa, Entamoeba histolytica
NGITLNKNVICTMIGTD

SEQ ID NO: 2740108 - protein, 18 aa, Entamoeba histolytica
NGIVFLFKYNETIDTFEF

SEQ ID NO: 2740109 - protein, 19 aa, Entamoeba histolytica
NGSCDACYYPCKKCVKSAD

SEQ ID NO: 2740110 - protein, 20 aa, Entamoeba histolytica
NGTEFIDWANSKTFPLFHQV

SEQ ID NO: 2740111 - protein, 20 aa, Entamoeba histolytica
NGTMYKCGNKTMNQENSSDN

SEQ ID NO: 2740112 - protein, 18 aa, Entamoeba histolytica
NHDYWLSSNWQYPPQNQW

SEQ ID NO: 2740113 - protein, 17 aa, Entamoeba histolytica
NHGFSIQTIRKFVQQIL

SEQ ID NO: 2740114 - protein, 26 aa, Entamoeba histolytica
NHLHFEFIKSTIILTDWNLSNKKESN

SEQ ID NO: 2740115 - protein, 25 aa, Entamoeba histolytica
NHWVLRPYNSIDWHAQVFDWLAKYL

SEQ ID NO: 2740116 - protein, 21 aa, Entamoeba histolytica
NIDNASSIFILLSTFTLTLLF

SEQ ID NO: 2740117 - protein, 29 aa, Entamoeba histolytica
NIGFNSFFIFRCWRSLGSWDPNAKGINNN

SEQ ID NO: 2740118 - protein, 20 aa, Entamoeba histolytica
NIKLYIKIAHVLRKQEQTCP

SEQ ID NO: 2740119 - protein, 17 aa, Entamoeba histolytica
NIRFDDVQFVYPTRPSH

SEQ ID NO: 2740120 - protein, 21 aa, Entamoeba histolytica
NISTCFELTLKEFEYGNKDRV

SEQ ID NO: 2740121 - protein, 20 aa, Entamoeba histolytica
NIWCGKSISGGNEMIAVKGN

SEQ ID NO: 2740122 - protein, 21 aa, Entamoeba histolytica
NKCVPLKMDVLLNQSNNSITF

SEQ ID NO: 2740123 - protein, 23 aa, Entamoeba histolytica
NKFRKANDIVISFLHAATIVEQH

SEQ ID NO: 2740124 - protein, 17 aa, Entamoeba histolytica
NKFRRVVVEESKAIEEE

SEQ ID NO: 2740125 - protein, 18 aa, Entamoeba histolytica
NKFRRVVVEESKAIEEEL

SEQ ID NO: 2740126 - protein, 28 aa, Entamoeba histolytica
NKFVPEKWVIPSLRKNSMQFGSIIQKQI

SEQ ID NO: 2740127 - protein, 26 aa, Entamoeba histolytica
NKNMLKSNHGWRSDLFNRPLSQVKMT

SEQ ID NO: 2740128 - protein, 33 aa, Entamoeba histolytica
NKQYYECATTFKGFRPCASGTWCQGEQEGPYQY

SEQ ID NO: 2740129 - protein, 19 aa, Entamoeba histolytica
NKTLISIKDGIQLSQDAIA

SEQ ID NO: 2740130 - protein, 20 aa, Entamoeba histolytica
NKYPPFSFMLSKEIINRFEF

SEQ ID NO: 2740131 - protein, 17 aa, Entamoeba histolytica
NLDILLIQTMNVKKIHI

SEQ ID NO: 2740132 - protein, 25 aa, Entamoeba histolytica
NLENIKRVLIINGEHDIIIKINMLI

SEQ ID NO: 2740133 - protein, 25 aa, Entamoeba histolytica
NLHTFHSMFIFLLIIVITNATESIV

SEQ ID NO: 2740134 - protein, 23 aa, Entamoeba histolytica
NLLFKMIEMLGTPPIEMLERGTK

SEQ ID NO: 2740135 - protein, 17 aa, Entamoeba histolytica
NLQYILNKKKFCFPLNG

SEQ ID NO: 2740136 - protein, 25 aa, Entamoeba histolytica
NMVGASYDWRYYRYGEYKHKRNWFA

SEQ ID NO: 2740137 - protein, 22 aa, Entamoeba histolytica
NNDGYLALIERLFRLLHLIEMK

SEQ ID NO: 2740138 - protein, 17 aa, Entamoeba histolytica
NNELLLPFFEGIIEKDV

SEQ ID NO: 2740139 - protein, 21 aa, Entamoeba histolytica
NNHGFKFNAFYLNGVFINPEK

SEQ ID NO: 2740140 - protein, 25 aa, Entamoeba histolytica
NNPNCLSFMKFNFNHTITFPLQQQK

SEQ ID NO: 2740141 - protein, 23 aa, Entamoeba histolytica
NNQEERTKEIIHTQIQSKQHKRM

SEQ ID NO: 2740142 - protein, 23 aa, Entamoeba histolytica
NNQRASNVIEEWDKVTMEYINRN

SEQ ID NO: 2740143 - protein, 23 aa, Entamoeba histolytica
NNTEERNREIIRTQIKSNQYKRM

SEQ ID NO: 2740144 - protein, 20 aa, Entamoeba histolytica
NPHFPFSFTDKVFVPSPTQN

SEQ ID NO: 2740145 - protein, 18 aa, Entamoeba histolytica
NPLPRWGNYQRFGAYMRV

SEQ ID NO: 2740146 - protein, 24 aa, Entamoeba histolytica
NPLYALRILSRFITSTTMPAYSPH

SEQ ID NO: 2740147 - protein, 19 aa, Entamoeba histolytica
NPQVIAAQGYIVFAPNFHG

SEQ ID NO: 2740148 - protein, 24 aa, Entamoeba histolytica
NQRKCASCYAFGSIATIESLIMQE

SEQ ID NO: 2740149 - protein, 18 aa, Entamoeba histolytica
NREASFSNALAWILLSKG

SEQ ID NO: 2740150 - protein, 21 aa, Entamoeba histolytica
NRGRIAKLLRYHSSISGNETM

SEQ ID NO: 2740151 - protein, 25 aa, Entamoeba histolytica
NRNKWPSYSKHFYLPFSNNNLCYQA

SEQ ID NO: 2740152 - protein, 29 aa, Entamoeba histolytica
NRSKIDFCCIKLIYKYCLHIYLQKIDLHS

SEQ ID NO: 2740153 - protein, 22 aa, Entamoeba histolytica
NSETPIVVVLFTYEKNIDMIMK

SEQ ID NO: 2740154 - protein, 17 aa, Entamoeba histolytica
NSFTNDLDICFANTQKN

SEQ ID NO: 2740155 - protein, 17 aa, Entamoeba histolytica
NSHCLSCKDGYQLSVDR

SEQ ID NO: 2740156 - protein, 22 aa, Entamoeba histolytica
NSHVSKGFGERMRVKGSNDINV

SEQ ID NO: 2740157 - protein, 19 aa, Entamoeba histolytica
NSIEIMKRDILLALGTKKR

SEQ ID NO: 2740158 - protein, 20 aa, Entamoeba histolytica
NSIIKGCYVLSTPPISSYEE

SEQ ID NO: 2740159 - protein, 18 aa, Entamoeba histolytica
NSKITWKNPFPMEMEGEL

SEQ ID NO: 2740160 - protein, 22 aa, Entamoeba histolytica
NSKRRKTCETAFIGIGNITTTP

SEQ ID NO: 2740161 - protein, 19 aa, Entamoeba histolytica
NSLDSYLYERFPKQLESFF

SEQ ID NO: 2740162 - protein, 20 aa, Entamoeba histolytica
NSWGDWKWGEDGYMRLYRGG

SEQ ID NO: 2740163 - protein, 23 aa, Entamoeba histolytica
NSWGNSWGEMGYARISMNDLCGL

SEQ ID NO: 2740164 - protein, 19 aa, Entamoeba histolytica
NSWGTGWGDKGYINMVIEG

SEQ ID NO: 2740165 - protein, 18 aa, Entamoeba histolytica
NSWGTSWGDAGYFLLARD

SEQ ID NO: 2740166 - protein, 17 aa, Entamoeba histolytica
NSWSDGFIMNAGYLSGL

SEQ ID NO: 2740167 - protein, 25 aa, Entamoeba histolytica
NTGRFKCIICHDGIMDSEGSYYYMD

SEQ ID NO: 2740168 - protein, 19 aa, Entamoeba histolytica
NTIQNIYINIHLIAEAPSE

SEQ ID NO: 2740169 - protein, 22 aa, Entamoeba histolytica
NTIRIYRGEVCEMPKKIKDTKE

SEQ ID NO: 2740170 - protein, 22 aa, Entamoeba histolytica
NTQCFFKYFTPFWNNSNKHFES

SEQ ID NO: 2740171 - protein, 17 aa, Entamoeba histolytica
NTVKGIVKKGKNQINTL

SEQ ID NO: 2740172 - protein, 27 aa, Entamoeba histolytica
NTYRLEFRINLLLSKCHGFSNFYILRF

SEQ ID NO: 2740173 - protein, 18 aa, Entamoeba histolytica
NVFNKLKRITGFQSGSSY

SEQ ID NO: 2740174 - protein, 18 aa, Entamoeba histolytica
NVIASGMKKFDIGVDTYI

SEQ ID NO: 2740175 - protein, 19 aa, Entamoeba histolytica
NVIPCEFVKEEVMDVLPVD

SEQ ID NO: 2740176 - protein, 20 aa, Entamoeba histolytica
NVTLRIALTSGDSYNPTIEK

SEQ ID NO: 2740177 - protein, 25 aa, Entamoeba histolytica
NYKSEYGKFFLGWYHQLLLDHTNKV

SEQ ID NO: 2740178 - protein, 23 aa, Entamoeba histolytica
NYKSEYGKFFLGWYQQLLLDHAN

SEQ ID NO: 2740179 - protein, 20 aa, Entamoeba histolytica
PADEGKYFYGTFTDKECKTS

SEQ ID NO: 2740180 - protein, 18 aa, Entamoeba histolytica
PAIPIGCVGCSGINKCSV

SEQ ID NO: 2740181 - protein, 19 aa, Entamoeba histolytica
PALAMFGAEILVDWPHVNP

SEQ ID NO: 2740182 - protein, 20 aa, Entamoeba histolytica
PALLENWKDLLIQMLNPNYQ

SEQ ID NO: 2740183 - protein, 18 aa, Entamoeba histolytica
PDIRAIHFNYFNTFETSS

SEQ ID NO: 2740184 - protein, 23 aa, Entamoeba histolytica
PDWKTGDVLFKIHTIEHPNFTRR

SEQ ID NO: 2740185 - protein, 20 aa, Entamoeba histolytica
PDYWSNEPLIVFKKSGKQFF

SEQ ID NO: 2740186 - protein, 20 aa, Entamoeba histolytica
PEERMKRATGKAWEKLKDEG

SEQ ID NO: 2740187 - protein, 17 aa, Entamoeba histolytica
PEGIDFRKFGKLTYIRE

SEQ ID NO: 2740188 - protein, 28 aa, Entamoeba histolytica
PEIKIWKKERCPRNSDELANASPETKLR

SEQ ID NO: 2740189 - protein, 18 aa, Entamoeba histolytica
PELKKARHNELKFFAQVL

SEQ ID NO: 2740190 - protein, 19 aa, Entamoeba histolytica
PELKKARHNELKFFAQVLA

SEQ ID NO: 2740191 - protein, 19 aa, Entamoeba histolytica
PEQYRRMMIRQTKLESKFD

SEQ ID NO: 2740192 - protein, 25 aa, Entamoeba histolytica
PESPWTNNFHYRWNPQVIAAQGYIV

SEQ ID NO: 2740193 - protein, 22 aa, Entamoeba histolytica
PFEVLNFKFTVHELSFQSVLLS

SEQ ID NO: 2740194 - protein, 21 aa, Entamoeba histolytica
PFLIERCQWYLSQTNIKKSTE

SEQ ID NO: 2740195 - protein, 17 aa, Entamoeba histolytica
PHIKRDNSYYVYKEALD

SEQ ID NO: 2740196 - protein, 19 aa, Entamoeba histolytica
PHSRILKMLDYFMYYGHIC

SEQ ID NO: 2740197 - protein, 19 aa, Entamoeba histolytica
PHTCYSAAMSLMANFDSKV

SEQ ID NO: 2740198 - protein, 19 aa, Entamoeba histolytica
PIEDSIIYKKVLVMIEQAN

SEQ ID NO: 2740199 - protein, 18 aa, Entamoeba histolytica
PIEYTWKEVNTFLNEDWI

SEQ ID NO: 2740200 - protein, 18 aa, Entamoeba histolytica
PIIKTSIGIDVPRLATKI

SEQ ID NO: 2740201 - protein, 20 aa, Entamoeba histolytica
PKGIWYDWFTNTPVKNGLRT

SEQ ID NO: 2740202 - protein, 19 aa, Entamoeba histolytica
PKIDHIFIIDSRRRIDSKK

SEQ ID NO: 2740203 - protein, 18 aa, Entamoeba histolytica
PKLEFPLINLVKYSEIPF

SEQ ID NO: 2740204 - protein, 18 aa, Entamoeba histolytica
PLIHCHKNILMKLKESNP

SEQ ID NO: 2740205 - protein, 19 aa, Entamoeba histolytica
PLKLCREGKGNAGKYGDYS

SEQ ID NO: 2740206 - protein, 21 aa, Entamoeba histolytica
PLSNRGIVYISRRMEGDTFDF

SEQ ID NO: 2740207 - protein, 22 aa, Entamoeba histolytica
PLTEGRPGATIAARYDLDESRP

SEQ ID NO: 2740208 - protein, 20 aa, Entamoeba histolytica
PNIRFLREIIINDISDIYIG

SEQ ID NO: 2740209 - protein, 19 aa, Entamoeba histolytica
PNLKVLASIGGWNFNFYDS

SEQ ID NO: 2740210 - protein, 18 aa, Entamoeba histolytica
PNWPVSMFAKCFHDLIKK

SEQ ID NO: 2740211 - protein, 19 aa, Entamoeba histolytica
PPEGCGLTIKADECSTETG

SEQ ID NO: 2740212 - protein, 17 aa, Entamoeba histolytica
PPLDIPDGIEWLASGNY

SEQ ID NO: 2740213 - protein, 18 aa, Entamoeba histolytica
PPTFVAWNPYLDHNVMGN

SEQ ID NO: 2740214 - protein, 21 aa, Entamoeba histolytica
PQCPHKVKGQIWINRKDLIPF

SEQ ID NO: 2740215 - protein, 18 aa, Entamoeba histolytica
PQDIPLVGPQTPFGFRPY

SEQ ID NO: 2740216 - protein, 19 aa, Entamoeba histolytica
PQIPILLVACKVFDEKCNQ

SEQ ID NO: 2740217 - protein, 18 aa, Entamoeba histolytica
PQTFLKYKVIPLGEDVIP

SEQ ID NO: 2740218 - protein, 20 aa, Entamoeba histolytica
PRFNQDFNHMMTLYGDIIIT

SEQ ID NO: 2740219 - protein, 17 aa, Entamoeba histolytica
PRKGYMGDVLRGMSEIQ

SEQ ID NO: 2740220 - protein, 17 aa, Entamoeba histolytica
PRLQWRGLMIDVARNSF

SEQ ID NO: 2740221 - protein, 20 aa, Entamoeba histolytica
PRQGKDFLFFILLFVSLVTL

SEQ ID NO: 2740222 - protein, 28 aa, Entamoeba histolytica
PSEYGRFFQEWYFDLLLSHTDKVLSAAR

SEQ ID NO: 2740223 - protein, 18 aa, Entamoeba histolytica
PSGSAPRPTPPRRKESGV

SEQ ID NO: 2740224 - protein, 23 aa, Entamoeba histolytica
PSGSPKIEGEWVYKKNFTHNIGH

SEQ ID NO: 2740225 - protein, 25 aa, Entamoeba histolytica
PSKCKRCKPGYIPVDFEFCKKSDGC

SEQ ID NO: 2740226 - protein, 24 aa, Entamoeba histolytica
PSSFKIRIGIDAAKGSIYIIDNGI

SEQ ID NO: 2740227 - protein, 17 aa, Entamoeba histolytica
PSYSGRGDYIFNYPHCP

SEQ ID NO: 2740228 - protein, 18 aa, Entamoeba histolytica
PTDVMLRNAALVASTLFE

SEQ ID NO: 2740229 - protein, 21 aa, Entamoeba histolytica
PTDYCYSCITNIFDVVTLNYD

SEQ ID NO: 2740230 - protein, 19 aa, Entamoeba histolytica
PTENGVESVEMGKKSQENV

SEQ ID NO: 2740231 - protein, 25 aa, Entamoeba histolytica
PTGCKKKGYHCVFDGIKHDKYFECN

SEQ ID NO: 2740232 - protein, 18 aa, Entamoeba histolytica
PTHIVIKPKTEFTLFPHS

SEQ ID NO: 2740233 - protein, 19 aa, Entamoeba histolytica
PTIPLKLSEEGKWSEIREY

SEQ ID NO: 2740234 - protein, 20 aa, Entamoeba histolytica
PTVRRGRRVYKRRVYRKRRR

SEQ ID NO: 2740235 - protein, 19 aa, Entamoeba histolytica
PWCSHCIALQPVFEALADE

SEQ ID NO: 2740236 - protein, 23 aa, Entamoeba histolytica
PYFTERVKFVYYIKSYEKAMKID

SEQ ID NO: 2740237 - protein, 20 aa, Entamoeba histolytica
PYNFNPCVVDEVLISSSTKS

SEQ ID NO: 2740238 - protein, 19 aa, Entamoeba histolytica
PYPSHHCYFMLTNTLNEME

SEQ ID NO: 2740239 - protein, 18 aa, Entamoeba histolytica
PYRIEFEGDSFDSKYKVI

SEQ ID NO: 2740240 - protein, 25 aa, Entamoeba histolytica
PYSEESFSNFVCLNEGVYLLHNGQI

SEQ ID NO: 2740241 - protein, 23 aa, Entamoeba histolytica
PYYDNYYRVIKEFLIEQNQGDFS

SEQ ID NO: 2740242 - protein, 19 aa, Entamoeba histolytica
QAEQLLRSEFDDVVKKTKD

SEQ ID NO: 2740243 - protein, 25 aa, Entamoeba histolytica
QCVVPGVDIMQGFGMTELCGACSVM

SEQ ID NO: 2740244 - protein, 18 aa, Entamoeba histolytica
QDAIKFYGKMGGKIQTEY

SEQ ID NO: 2740245 - protein, 21 aa, Entamoeba histolytica
QDESSCLFIAQSFQYQPSEIY

SEQ ID NO: 2740246 - protein, 18 aa, Entamoeba histolytica
QDPMNWYVCDDACVTNEE

SEQ ID NO: 2740247 - protein, 20 aa, Entamoeba histolytica
QEIPSFHGLIALDYRRFNKN

SEQ ID NO: 2740248 - protein, 18 aa, Entamoeba histolytica
QEQKFIMENGCEIMYPTI

SEQ ID NO: 2740249 - protein, 35 aa, Entamoeba histolytica
QEVEEDIRVSKSNVFRTSKNLKHGTITTEDIEAAE

SEQ ID NO: 2740250 - protein, 25 aa, Entamoeba histolytica
QGECGGCYAMALAQVLQAHYTHLTL

SEQ ID NO: 2740251 - protein, 34 aa, Entamoeba histolytica
QGFVKKAECPEMVMARLAQKAHLSPVIQQAQNKL

SEQ ID NO: 2740252 - protein, 20 aa, Entamoeba histolytica
QGLKTQIARDILLDAHNRKM

SEQ ID NO: 2740253 - protein, 17 aa, Entamoeba histolytica
QIAIPYASTIVFEYYTK

SEQ ID NO: 2740254 - protein, 19 aa, Entamoeba histolytica
QIEPPRFGSTYAVDTISPS

SEQ ID NO: 2740255 - protein, 25 aa, Entamoeba histolytica
QIIKNGKTPVCWEEVYQKGSADKKT

SEQ ID NO: 2740256 - protein, 33 aa, Entamoeba histolytica
QIQSKQHKRMFNLHKVQLKGEVTKEPEETPTGV

SEQ ID NO: 2740257 - protein, 36 aa, Entamoeba histolytica
QIQSNKHKIMYKIYKLQLKGEEGITKTPSVQSTDAS

SEQ ID NO: 2740258 - protein, 20 aa, Entamoeba histolytica
QIWLHAWKYSFNSHDWIAEI

SEQ ID NO: 2740259 - protein, 22 aa, Entamoeba histolytica
QKCKVCVNLAEFILRQARNGKS

SEQ ID NO: 2740260 - protein, 23 aa, Entamoeba histolytica
QKEQRQAVKIVRVYEKQQHKKEK

SEQ ID NO: 2740261 - protein, 22 aa, Entamoeba histolytica
QKIFNACYWIKEKLYVNFNLRT

SEQ ID NO: 2740262 - protein, 26 aa, Entamoeba histolytica
QKKLIKKLKKAGVSKKVLRKVQKKMS

SEQ ID NO: 2740263 - protein, 25 aa, Entamoeba histolytica
QLESFFQYNPYRLFRYTSQDLYTFI

SEQ ID NO: 2740264 - protein, 19 aa, Entamoeba histolytica
QLIELKRYKKAKIACARDA

SEQ ID NO: 2740265 - protein, 17 aa, Entamoeba histolytica
QLKISKEKLEWVESQTK

SEQ ID NO: 2740266 - protein, 21 aa, Entamoeba histolytica
QLKQRFEPRITLEEIKSENEM

SEQ ID NO: 2740267 - protein, 19 aa, Entamoeba histolytica
QLLELKRYKKAKIACARNA

SEQ ID NO: 2740268 - protein, 23 aa, Entamoeba histolytica
QLVGPSQKPIVCMVAGSENLKVS

SEQ ID NO: 2740269 - protein, 17 aa, Entamoeba histolytica
QMFATGFADGFFSGNNI

SEQ ID NO: 2740270 - protein, 22 aa, Entamoeba histolytica
QMKFKRVWFDIEGQWYSDVGSN

SEQ ID NO: 2740271 - protein, 19 aa, Entamoeba histolytica
QNEFIALKGLEELNDQSIS

SEQ ID NO: 2740272 - protein, 17 aa, Entamoeba histolytica
QNIVEEWDDVTLQYINR

SEQ ID NO: 2740273 - protein, 24 aa, Entamoeba histolytica
QNLPYLRFIKKLNVTITYHPASHE

SEQ ID NO: 2740274 - protein, 24 aa, Entamoeba histolytica
QNVCGGCYAVGPAQHLSTIYAYLT

SEQ ID NO: 2740275 - protein, 20 aa, Entamoeba histolytica
QPGTLYAIEQMPGYYGAGDR

SEQ ID NO: 2740276 - protein, 17 aa, Entamoeba histolytica
QPIMPVYMSPIRFIPNP

SEQ ID NO: 2740277 - protein, 24 aa, Entamoeba histolytica
QPIRFKKLWEYSGNSSSQFAGWSV

SEQ ID NO: 2740278 - protein, 22 aa, Entamoeba histolytica
QPRKFKGKIFAIIESDEDMNIA

SEQ ID NO: 2740279 - protein, 18 aa, Entamoeba histolytica
QQCGICYEAVGEKGSIRF

SEQ ID NO: 2740280 - protein, 24 aa, Entamoeba histolytica
QQPIPERQPHPYNEHQPMPEQNPH

SEQ ID NO: 2740281 - protein, 24 aa, Entamoeba histolytica
QQSYRTAPYPGIILLSGDLAGHYQ

SEQ ID NO: 2740282 - protein, 21 aa, Entamoeba histolytica
QRDSLEFATAMYTYNRGVFDT

SEQ ID NO: 2740283 - protein, 20 aa, Entamoeba histolytica
QRGRLIRFVGGFDAEEVISF

SEQ ID NO: 2740284 - protein, 28 aa, Entamoeba histolytica
QRIRSLVQLYFKVIFNYLRSEKSIINSI

SEQ ID NO: 2740285 - protein, 19 aa, Entamoeba histolytica
QRRLECFHLVIDILSEKNI

SEQ ID NO: 2740286 - protein, 17 aa, Entamoeba histolytica
QRYMWVWTTRDFYKHDP

SEQ ID NO: 2740287 - protein, 26 aa, Entamoeba histolytica
QSNQHKRMFNLHKVQLKGEVTKEPEE

SEQ ID NO: 2740288 - protein, 18 aa, Entamoeba histolytica
QTFLKGYPSLFLFYNNYI

SEQ ID NO: 2740289 - protein, 33 aa, Entamoeba histolytica; identical to SEQ ID NO: 2554639

SEQ ID NO: 2740290 - protein, 25 aa, Entamoeba histolytica
QTGKKWKQQYIYSISKDGELTFEDN

SEQ ID NO: 2740291 - protein, 22 aa, Entamoeba histolytica
QTIKMVKERMGIREEEFKDFKD

SEQ ID NO: 2740292 - protein, 23 aa, Entamoeba histolytica
QTKKELKAKVAVAQKKAEKAKKE

SEQ ID NO: 2740293 - protein, 23 aa, Entamoeba histolytica
QTTDWSGLFGIDIDSLEGLVSLT

SEQ ID NO: 2740294 - protein, 20 aa, Entamoeba histolytica
QTYNRLTNTIQYIHNNIHLI

SEQ ID NO: 2740295 - protein, 20 aa, Entamoeba histolytica
QVDVQFPFSKEVEGNTPSTI

SEQ ID NO: 2740296 - protein, 17 aa, Entamoeba histolytica
QVFKTQIARDILVDAHN

SEQ ID NO: 2740297 - protein, 21 aa, Entamoeba histolytica
QVKELKLKKQAIKTENKYRKQ

SEQ ID NO: 2740298 - protein, 19 aa, Entamoeba histolytica
QYCTLRIGVELGTEGYLTS

SEQ ID NO: 2740299 - protein, 22 aa, Entamoeba histolytica
RAASIRSLYRIFLLSDHDSQSI

SEQ ID NO: 2740300 - protein, 20 aa, Entamoeba histolytica
RCGSCVELTGPGLKPITCMI

SEQ ID NO: 2740301 - protein, 23 aa, Entamoeba histolytica
RCSSLKINLMSSISVNENSQFSF

SEQ ID NO: 2740302 - protein, 17 aa, Entamoeba histolytica
RDEIISFLDGTSICKET

SEQ ID NO: 2740303 - protein, 26 aa, Entamoeba histolytica
RDLGFNSFFIFRAWRSLGSFDPNAKS

SEQ ID NO: 2740304 - protein, 26 aa, Entamoeba histolytica
RDQAQCGSCYSFGSLAAIESRLLIGG

SEQ ID NO: 2740305 - protein, 24 aa, Entamoeba histolytica
RDQASCGSCYSFASVAAIEGRLLV

SEQ ID NO: 2740306 - protein, 25 aa, Entamoeba histolytica
RDQGNCGSCYSFSSLAVLESRLLIA

SEQ ID NO: 2740307 - protein, 17 aa, Entamoeba histolytica
RDSHFLIYVYYDKGCKN

SEQ ID NO: 2740308 - protein, 18 aa, Entamoeba histolytica
REGVKLLKNYYYNYPDCV

SEQ ID NO: 2740309 - protein, 22 aa, Entamoeba histolytica
REGWGCLTMNSKIIERVSQYHW

SEQ ID NO: 2740310 - protein, 22 aa, Entamoeba histolytica
REGWGCLTMNSKIWERVSQYHW

SEQ ID NO: 2740311 - protein, 22 aa, Entamoeba histolytica
REIAEISGKLIIEESIYEQTVF

SEQ ID NO: 2740312 - protein, 18 aa, Entamoeba histolytica
REIVREGIRYKKLLEQQK

SEQ ID NO: 2740313 - protein, 20 aa, Entamoeba histolytica
RELNIKWLRNQIGIVGQEPV

SEQ ID NO: 2740314 - protein, 25 aa, Entamoeba histolytica
RENKWRAKYGWVFDKDCKDCNFPKG

SEQ ID NO: 2740315 - protein, 20 aa, Entamoeba histolytica
RFKHECKKLNLGYPLKFATS

SEQ ID NO: 2740316 - protein, 18 aa, Entamoeba histolytica
RFQFMLGGAFAGVVSRTA

SEQ ID NO: 2740317 - protein, 20 aa, Entamoeba histolytica
RFQSLGVAFYRGADCCALCY

SEQ ID NO: 2740318 - protein, 17 aa, Entamoeba histolytica
RGAPPPPPHLAMETQSD

SEQ ID NO: 2740319 - protein, 20 aa, Entamoeba histolytica
RGEGVSMFLEEEVKNYPMII

SEQ ID NO: 2740320 - protein, 18 aa, Entamoeba histolytica
RGKQELFSLGKYYKGEFK

SEQ ID NO: 2740321 - protein, 19 aa, Entamoeba histolytica
RHLWKKIKKIQEIRKEISK

SEQ ID NO: 2740322 - protein, 17 aa, Entamoeba histolytica
RHVSDIPLWISSDLLNP

SEQ ID NO: 2740323 - protein, 20 aa, Entamoeba histolytica
RHYRAPEIVLGLPYSCAIDM

SEQ ID NO: 2740324 - protein, 18 aa, Entamoeba histolytica
RIAKKIIKKAVKLSKKAV

SEQ ID NO: 2740325 - protein, 25 aa, Entamoeba histolytica
RIGRGKYSSVFKGVITEGLYPCAIK

SEQ ID NO: 2740326 - protein, 29 aa, Entamoeba histolytica
RIKTTNLCGIGWRIGDYVYPLNMIVYANT

SEQ ID NO: 2740327 - protein, 17 aa, Entamoeba histolytica
RINYAIKNNFSIGIWEL

SEQ ID NO: 2740328 - protein, 18 aa, Entamoeba histolytica
RITKTLLDCLLKEMQYSN

SEQ ID NO: 2740329 - protein, 19 aa, Entamoeba histolytica
RIYINGVRYHKLYFTYKTL

SEQ ID NO: 2740330 - protein, 19 aa, Entamoeba histolytica
RIYNLYKTHLKSEEPEKVT

SEQ ID NO: 2740331 - protein, 20 aa, Entamoeba histolytica
RKAFGTSLPLAAKVSGVHWW

SEQ ID NO: 2740332 - protein, 28 aa, Entamoeba histolytica
RKAIKGDIPTAIDWRAEGKVTPIRDQAQ

SEQ ID NO: 2740333 - protein, 20 aa, Entamoeba histolytica
RKAINTLLFMRFLYTPLIQS

SEQ ID NO: 2740334 - protein, 21 aa, Entamoeba histolytica
RKASSSLLRTAGVIRGISEAT

SEQ ID NO: 2740335 - protein, 24 aa, Entamoeba histolytica
RKEERKLLHRMGIKKKQTIDYDDV

SEQ ID NO: 2740336 - protein, 22 aa, Entamoeba histolytica
RKEKEIDGTSVISPESSSSDEK

SEQ ID NO: 2740337 - protein, 27 aa, Entamoeba histolytica
RKEPFMFINNIRFIKFAFSLRYQFIDY

SEQ ID NO: 2740338 - protein, 18 aa, Entamoeba histolytica
RKGFRKVHFKEESNIDAS

SEQ ID NO: 2740339 - protein, 17 aa, Entamoeba histolytica
RKGKRSGAWEEMLRVSY

SEQ ID NO: 2740340 - protein, 22 aa, Entamoeba histolytica
RKGNKYPLKNYEVWSMDDEEYF

SEQ ID NO: 2740341 - protein, 20 aa, Entamoeba histolytica
RKIAKCYRNLQSLDRARKRR

SEQ ID NO: 2740342 - protein, 27 aa, Entamoeba histolytica
RKIARTKRMVLAKMYKILRVLAPVEQG

SEQ ID NO: 2740343 - protein, 18 aa, Entamoeba histolytica
RKIDKCKNSPFKQVRVIR

SEQ ID NO: 2740344 - protein, 21 aa, Entamoeba histolytica
RKLAEIRRKKDVVVSTFKAEE

SEQ ID NO: 2740345 - protein, 20 aa, Entamoeba histolytica
RKLTHLRSKMVVYHTKKLAL

SEQ ID NO: 2740346 - protein, 24 aa, Entamoeba histolytica
RKNLRKIAMLKVKLNAQMRKGLNM

SEQ ID NO: 2740347 - protein, 20 aa, Entamoeba histolytica
RKRARHLAFELKNIEKKRRV

SEQ ID NO: 2740348 - protein, 25 aa, Entamoeba histolytica
RKSKYPTTCYRTLIELGSRVFEEGV

SEQ ID NO: 2740349 - protein, 28 aa, Entamoeba histolytica
RKTCPCSGDKCIIDFSATTSVIYKLPSN

SEQ ID NO: 2740350 - protein, 19 aa, Entamoeba histolytica
RKTLNLDFWRESTYLDTNY

SEQ ID NO: 2740351 - protein, 25 aa, Entamoeba histolytica
RKTVKEIKRQIRLLREAAQKEFNEF

SEQ ID NO: 2740352 - protein, 21 aa, Entamoeba histolytica
RKYPADFVVMSFYKIMGYPTG

SEQ ID NO: 2740353 - protein, 22 aa, Entamoeba histolytica
RLAANPTSRVQLERGIESILSE

SEQ ID NO: 2740354 - protein, 18 aa, Entamoeba histolytica
RLAHLPSSLISRASQIAT

SEQ ID NO: 2740355 - protein, 22 aa, Entamoeba histolytica
RLEKTIKLRMSLFGINKLFSNT

SEQ ID NO: 2740356 - protein, 20 aa, Entamoeba histolytica
RLHVNHLMLLGADEAQAVFN

SEQ ID NO: 2740357 - protein, 18 aa, Entamoeba histolytica
RLIREVHLEQRFNPVDDL

SEQ ID NO: 2740358 - protein, 18 aa, Entamoeba histolytica
RLLAELANHPYHGMYAPA

SEQ ID NO: 2740359 - protein, 19 aa, Entamoeba histolytica
RLYRHKKVLLRDIKDKEQQ

SEQ ID NO: 2740360 - protein, 19 aa, Entamoeba histolytica
RMVKNGTNAIEFINQLHDK

SEQ ID NO: 2740361 - protein, 17 aa, Entamoeba histolytica
RNAKLEILRKLRKVADS

SEQ ID NO: 2740362 - protein, 24 aa, Entamoeba histolytica
RNFKEKRNGVSLLINSISPLQQVR

SEQ ID NO: 2740363 - protein, 21 aa, Entamoeba histolytica
RNIKEGFVGIFKRSSIPVSGI

SEQ ID NO: 2740364 - protein, 19 aa, Entamoeba histolytica
RNKNVCGIYSYGTYVESIT

SEQ ID NO: 2740365 - protein, 27 aa, Entamoeba histolytica
RNNGFTGFFICRAWCSPGYFDDNAPYT

SEQ ID NO: 2740366 - protein, 18 aa, Entamoeba histolytica
RNPKSLYDLQAFEEKDDK

SEQ ID NO: 2740367 - protein, 23 aa, Entamoeba histolytica
RNSKRLSGHYIQIAYGMRSISPA

SEQ ID NO: 2740368 - protein, 17 aa, Entamoeba histolytica
RNTHIPISKSQTFSTYQ

SEQ ID NO: 2740369 - protein, 20 aa, Entamoeba histolytica
RNVGLETKLTYNLDDKNKAY

SEQ ID NO: 2740370 - protein, 30 aa, Entamoeba histolytica
RNYQRSKEILKWFDDIDESFKQIGEMINNF

SEQ ID NO: 2740371 - protein, 25 aa, Entamoeba histolytica
RPIKPPRLGDGFIQRGNHYEYGTNN

SEQ ID NO: 2740372 - protein, 24 aa, Entamoeba histolytica
RPSELKPLPFGQMDAKICDKSGFE

SEQ ID NO: 2740373 - protein, 22 aa, Entamoeba histolytica
RPTVRRGRRVYKRRVYRKRRRY

SEQ ID NO: 2740374 - protein, 23 aa, Entamoeba histolytica
RPTVRRGRRVYKRRVYRKRRRYY

SEQ ID NO: 2740375 - protein, 19 aa, Entamoeba histolytica
RPYWKCYYEKCSAIIFVVD

SEQ ID NO: 2740376 - protein, 22 aa, Entamoeba histolytica
RQKEQTVRFGIQKLVTTFSAVL

SEQ ID NO: 2740377 - protein, 18 aa, Entamoeba histolytica
RQRRVLKIHKKIMNIKKI

SEQ ID NO: 2740378 - protein, 20 aa, Entamoeba histolytica
RREAERAKRALSVQQQDRIE

SEQ ID NO: 2740379 - protein, 17 aa, Entamoeba histolytica
RRIKRHSIELFSGIIKK

SEQ ID NO: 2740380 - protein, 20 aa, Entamoeba histolytica
RRLNELIGIEIRCREGIRWS

SEQ ID NO: 2740381 - protein, 20 aa, Entamoeba histolytica
RRRRRGSWRRWFRRHHRRPR

SEQ ID NO: 2740382 - protein, 26 aa, Entamoeba histolytica
RRYFRRYPWRRYRFWRKHHHRRHPKR

SEQ ID NO: 2740383 - protein, 17 aa, Entamoeba histolytica
RSASATGTYKVNEHSTL

SEQ ID NO: 2740384 - protein, 24 aa, Entamoeba histolytica
RSKISHYALKVLRGESVIIESKKY

SEQ ID NO: 2740385 - protein, 25 aa, Entamoeba histolytica
RTIKTLKLSKSCPLIIDSQITIEKV

SEQ ID NO: 2740386 - protein, 21 aa, Entamoeba histolytica
RTPIDFYYDFMNAFSTEFKSY

SEQ ID NO: 2740387 - protein, 18 aa, Entamoeba histolytica
RTPYLFVPIVKLVDAIAF

SEQ ID NO: 2740388 - protein, 20 aa, Entamoeba histolytica
RTVENICYYRQFEVTIHSKN

SEQ ID NO: 2740389 - protein, 20 aa, Entamoeba histolytica
RVFQRFSAVAERFWSSEDIT

SEQ ID NO: 2740390 - protein, 20 aa, Entamoeba histolytica
RVIVRALKLSHEYDGLLKVK

SEQ ID NO: 2740391 - protein, 19 aa, Entamoeba histolytica
RVNLFRNWLDKTGIKEKTQ

SEQ ID NO: 2740392 - protein, 18 aa, Entamoeba histolytica
RWMFGYQQAAEWYFSNDT

SEQ ID NO: 2740393 - protein, 21 aa, Entamoeba histolytica
RYFTWGSSFPHPLKLQEQLKS

SEQ ID NO: 2740394 - protein, 23 aa, Entamoeba histolytica
RYPSYCAANGWQYPGIGEFQVSD

SEQ ID NO: 2740395 - protein, 19 aa, Entamoeba histolytica
SAIGIELFKSLQINNSTEC

SEQ ID NO: 2740396 - protein, 22 aa, Entamoeba histolytica
SAWYILSVMGFYSVTPGTDQFV

SEQ ID NO: 2740397 - protein, 26 aa, Entamoeba histolytica
SCFIKNDYCAYSFLTYSSFKKLKNIF

SEQ ID NO: 2740398 - protein, 19 aa, Entamoeba histolytica
SCGDPAGQVKSFWNQVTSK

SEQ ID NO: 2740399 - protein, 18 aa, Entamoeba histolytica
SCGSLVFEYNMTKQPTNT

SEQ ID NO: 2740400 - protein, 23 aa, Entamoeba histolytica
SCICSAFTYDEEDLLAFDDYLDY

SEQ ID NO: 2740401 - protein, 18 aa, Entamoeba histolytica
SCIPYCGTCQVGYSCTEE

SEQ ID NO: 2740402 - protein, 19 aa, Entamoeba histolytica
SCNPGACYGYLNITSDEVK

SEQ ID NO: 2740403 - protein, 18 aa, Entamoeba histolytica
SDCIYYFTASSISTTLTI

SEQ ID NO: 2740404 - protein, 27 aa, Entamoeba histolytica
SDFDQRIALFLVEICKRKFKKDPSDNP

SEQ ID NO: 2740405 - protein, 22 aa, Entamoeba histolytica
SDFKNFDYIFAMDNDNYYELLD

SEQ ID NO: 2740406 - protein, 24 aa, Entamoeba histolytica
SDGLLKYFNIRDAHIMEYIKDLET

SEQ ID NO: 2740407 - protein, 21 aa, Entamoeba histolytica
SDLKKIRRVVSKDLVNKNTTK

SEQ ID NO: 2740408 - protein, 25 aa, Entamoeba histolytica
SDPNLKFQWWFPLVERLDAKDLQNL

SEQ ID NO: 2740409 - protein, 25 aa, Entamoeba histolytica
SDTLKGKQWRNARVKVANKIDKTKM

SEQ ID NO: 2740410 - protein, 18 aa, Entamoeba histolytica
SECFACVPHKELFCTEKD

SEQ ID NO: 2740411 - protein, 17 aa, Entamoeba histolytica
SECKICRYLTKEDGECT

SEQ ID NO: 2740412 - protein, 22 aa, Entamoeba histolytica
SEDYGVCSPGFAISSPSYYISK

SEQ ID NO: 2740413 - protein, 38 aa, Entamoeba histolytica; identical to SEQ ID NO: 2503716

SEQ ID NO: 2740414 - protein, 20 aa, Entamoeba histolytica
SEFIQFPIEMEITKKEEEEV

SEQ ID NO: 2740415 - protein, 17 aa, Entamoeba histolytica
SEHIIKLNSLDSYLYER

SEQ ID NO: 2740416 - protein, 19 aa, Entamoeba histolytica
SEIEEREPLVAMNITARTD

SEQ ID NO: 2740417 - protein, 18 aa, Entamoeba histolytica
SEIERRLDKEIAQEMKRQ

SEQ ID NO: 2740418 - protein, 17 aa, Entamoeba histolytica
SEIYYCDEAMKLTKLTK

SEQ ID NO: 2740419 - protein, 19 aa, Entamoeba histolytica
SELFKGMNIIHSYPHNPHS

SEQ ID NO: 2740420 - protein, 21 aa, Entamoeba histolytica
SELSIDFTSLVMKLKVNGLVV

SEQ ID NO: 2740421 - protein, 25 aa, Entamoeba histolytica
SERNYCLKCLNGYKIENNKCVKDKE

SEQ ID NO: 2740422 - protein, 20 aa, Entamoeba histolytica
SESKLIFWLMDVVPGDVITQ

SEQ ID NO: 2740423 - protein, 21 aa, Entamoeba histolytica
SETYFDLRISPTLYVLNRNDT

SEQ ID NO: 2740424 - protein, 17 aa, Entamoeba histolytica
SEYPCQALFFNGETSEC

SEQ ID NO: 2740425 - protein, 20 aa, Entamoeba histolytica
SFLFFCTFAQKFSIIKKGDS

SEQ ID NO: 2740426 - protein, 22 aa, Entamoeba histolytica
SFNFKCEIFPKFSLEGITLYDI

SEQ ID NO: 2740427 - protein, 19 aa, Entamoeba histolytica
SFSNFVCLNEGVYLLHNGQ

SEQ ID NO: 2740428 - protein, 26 aa, Entamoeba histolytica
SFYHSRLSALPVIRPLFLNYPNDQTT

SEQ ID NO: 2740429 - protein, 18 aa, Entamoeba histolytica
SGDKIAIFCETRYEWMAM

SEQ ID NO: 2740430 - protein, 19 aa, Entamoeba histolytica
SGKAGKFGKAISSAANKVN

SEQ ID NO: 2740431 - protein, 19 aa, Entamoeba histolytica
SGLKAAHVVNGRDMTVSAA

SEQ ID NO: 2740432 - protein, 30 aa, Entamoeba histolytica
SHKKHVIKRRGCPCIHKVPDVPCKCSSIKR

SEQ ID NO: 2740433 - protein, 24 aa, Entamoeba histolytica
SHNTWRPYYAMLRIYKHYFFPWTK

SEQ ID NO: 2740434 - protein, 18 aa, Entamoeba histolytica
SHSIHKCPVFAIYHQFIS

SEQ ID NO: 2740435 - protein, 25 aa, Entamoeba histolytica
SHVYLKVVSPYLCLVMLLGDTQERD

SEQ ID NO: 2740436 - protein, 26 aa, Entamoeba histolytica
SIEEFPTILFHRAHLRDRTFDEDEFD

SEQ ID NO: 2740437 - protein, 18 aa, Entamoeba histolytica
SIELEFVHWNALLFPVKK

SEQ ID NO: 2740438 - protein, 20 aa, Entamoeba histolytica
SIELPPQCPHKVKGQIWINR

SEQ ID NO: 2740439 - protein, 23 aa, Entamoeba histolytica
SIEYPGEYLFNIKYYALNSLQID

SEQ ID NO: 2740440 - protein, 22 aa, Entamoeba histolytica
SIGETCSRKPVILIPGIMSSIL

SEQ ID NO: 2740441 - protein, 18 aa, Entamoeba histolytica
SIGLKITGMMDVNPYFTR

SEQ ID NO: 2740442 - protein, 25 aa, Entamoeba histolytica
SIKVSKPRHKTMITHEFIKISEIVF

SEQ ID NO: 2740443 - protein, 19 aa, Entamoeba histolytica
SINRRLRNSIIRASKRSER

SEQ ID NO: 2740444 - protein, 17 aa, Entamoeba histolytica
SIPAANLAPNYNKGQKG

SEQ ID NO: 2740445 - protein, 25 aa, Entamoeba histolytica
SITAECFELASSVSPFSDELSLVES

SEQ ID NO: 2740446 - protein, 20 aa, Entamoeba histolytica
SITKRYMVVPNKHIVLEKYD

SEQ ID NO: 2740447 - protein, 20 aa, Entamoeba histolytica
SKDNFKLYYGFNITQNNNIN

SEQ ID NO: 2740448 - protein, 22 aa, Entamoeba histolytica
SKFCKERNVVCCVAISPSPYLI

SEQ ID NO: 2740449 - protein, 22 aa, Entamoeba histolytica
SKFNISVGILSYRGYGNSTGKP

SEQ ID NO: 2740450 - protein, 17 aa, Entamoeba histolytica
SKHEWLEDYVDIMNCRI

SEQ ID NO: 2740451 - protein, 35 aa, Entamoeba histolytica
SKIKLPKKRREFYKLMKRRYWKECCNCSCCKHTNP

SEQ ID NO: 2740452 - protein, 18 aa, Entamoeba histolytica
SKLKEMNNQFKLWKKQFE

SEQ ID NO: 2740453 - protein, 17 aa, Entamoeba histolytica
SKLKKSLAKKISKTSKN

SEQ ID NO: 2740454 - protein, 17 aa, Entamoeba histolytica
SKLKMSKLIDDKSYRDN

SEQ ID NO: 2740455 - protein, 24 aa, Entamoeba histolytica
SKLKSGGVAGVMGDVWWGLVETSP

SEQ ID NO: 2740456 - protein, 17 aa, Entamoeba histolytica
SKLSMAIMAQELAKRND

SEQ ID NO: 2740457 - protein, 19 aa, Entamoeba histolytica
SKLYIKYDKSFCSDITTNF

SEQ ID NO: 2740458 - protein, 20 aa, Entamoeba histolytica
SKYMLSYNWIGGMCSIEKCS

SEQ ID NO: 2740459 - protein, 24 aa, Entamoeba histolytica
SLATLIPFNVCSEIKTFTISTIEG

SEQ ID NO: 2740460 - protein, 20 aa, Entamoeba histolytica
SLEKYWGKLLGFYVALGSNN

SEQ ID NO: 2740461 - protein, 18 aa, Entamoeba histolytica
SLGLYVILDGVFGHHKSG

SEQ ID NO: 2740462 - protein, 18 aa, Entamoeba histolytica
SLGLYVILDGVLKNNKSG

SEQ ID NO: 2740463 - protein, 18 aa, Entamoeba histolytica
SLHKAIDIPHIIPLKPNF

SEQ ID NO: 2740464 - protein, 18 aa, Entamoeba histolytica
SLIKLVINPLQLVLDHSF

SEQ ID NO: 2740465 - protein, 21 aa, Entamoeba histolytica
SLKDFWNAKTFYIKQHSQITL

SEQ ID NO: 2740466 - protein, 19 aa, Entamoeba histolytica
SLKRKLNVVDQVRKKIAKK

SEQ ID NO: 2740467 - protein, 26 aa, Entamoeba histolytica
SLKVIQTFMFRYMAPLQFGIIPINIP

SEQ ID NO: 2740468 - protein, 25 aa, Entamoeba histolytica
SLMSKCFKFTISFPNKIPSKTLLFP

SEQ ID NO: 2740469 - protein, 26 aa, Entamoeba histolytica
SLNESRIKLTLIRESKFGSPLPPLGK

SEQ ID NO: 2740470 - protein, 23 aa, Entamoeba histolytica
SLSMSICGVSFIGSDVGGFYDTV

SEQ ID NO: 2740471 - protein, 21 aa, Entamoeba histolytica
SLSTLRIKGIKNIAIITTNSK

SEQ ID NO: 2740472 - protein, 18 aa, Entamoeba histolytica
SLTKCKFFNYEYDKHGTC

SEQ ID NO: 2740473 - protein, 20 aa, Entamoeba histolytica
SLYDFLKRCLAYDPKERLTP

SEQ ID NO: 2740474 - protein, 23 aa, Entamoeba histolytica
SLYYRLLLIMLFLFFTVKQTNIV

SEQ ID NO: 2740475 - protein, 25 aa, Entamoeba histolytica
SNEMWKSSCTLNRRILNIELMYEKD

SEQ ID NO: 2740476 - protein, 24 aa, Entamoeba histolytica
SNEMWKTSCTLNRRVKNIELMYEK

SEQ ID NO: 2740477 - protein, 19 aa, Entamoeba histolytica
SNHECSMNDTCVALRKNQF

SEQ ID NO: 2740478 - protein, 23 aa, Entamoeba histolytica
SNIPTACVYVCNLRNVIGTLSNV

SEQ ID NO: 2740479 - protein, 17 aa, Entamoeba histolytica
SNLPLITTSSFKAYSVN

SEQ ID NO: 2740480 - protein, 26 aa, Entamoeba histolytica
SNPKEFLYCYSAYFGQLYQQYHNYLK

SEQ ID NO: 2740481 - protein, 18 aa, Entamoeba histolytica
SNYCIYAKLLRECAYLDG

SEQ ID NO: 2740482 - protein, 18 aa, Entamoeba histolytica
SNYVSGNIVSKVNKNLTL

SEQ ID NO: 2740483 - protein, 19 aa, Entamoeba histolytica
SPCFPNYHIENFKNVQNKN

SEQ ID NO: 2740484 - protein, 20 aa, Entamoeba histolytica
SPEEISAMIIHKMAKTASDY

SEQ ID NO: 2740485 - protein, 22 aa, Entamoeba histolytica
SPNIYIDEGIVFDIEKLTRTVR

SEQ ID NO: 2740486 - protein, 17 aa, Entamoeba histolytica
SQCPAKHTVSISKVYAD

SEQ ID NO: 2740487 - protein, 24 aa, Entamoeba histolytica
SQEKCQSIAREIRGLRSSIKKTID

SEQ ID NO: 2740488 - protein, 24 aa, Entamoeba histolytica
SQIIRKLHMERWIQVYTYLVPHMK

SEQ ID NO: 2740489 - protein, 18 aa, Entamoeba histolytica
SQLILFPSGYSVLIDLGE

SEQ ID NO: 2740490 - protein, 25 aa, Entamoeba histolytica
SQLKTNYPLIVSWSAIGIELFKSLQ

SEQ ID NO: 2740491 - protein, 25 aa, Entamoeba histolytica
SQQNCGGCWAVSLANLAQYLYSNLT

SEQ ID NO: 2740492 - protein, 33 aa, Entamoeba histolytica
SQRNSNAISFRYDWRTLLAVIRMHLPPIEYFVG

SEQ ID NO: 2740493 - protein, 24 aa, Entamoeba histolytica
SRKESFEKIPIWLEECRKYSNPNT

SEQ ID NO: 2740494 - protein, 18 aa, Entamoeba histolytica
SRVKSVLKTIMNKVPEQY

SEQ ID NO: 2740495 - protein, 18 aa, Entamoeba histolytica
SRYDLRPKECIPSPTNPT

SEQ ID NO: 2740496 - protein, 25 aa, Entamoeba histolytica
SSHFDILFHYFKCRKQVPRLLYQMA

SEQ ID NO: 2740497 - protein, 17 aa, Entamoeba histolytica
SSIGSAIGRAVDKGTKW

SEQ ID NO: 2740498 - protein, 17 aa, Entamoeba histolytica
SSINRFPLEYVPNNVTL

SEQ ID NO: 2740499 - protein, 25 aa, Entamoeba histolytica
SSKEIIKIVVIGSVKPKFMFNGKDR

SEQ ID NO: 2740500 - protein, 23 aa, Entamoeba histolytica
SSKKRAEFHFKVAQKRNKIATKA

SEQ ID NO: 2740501 - protein, 18 aa, Entamoeba histolytica
SSNLPINVIINGGYVLEK

SEQ ID NO: 2740502 - protein, 26 aa, Entamoeba histolytica
SSNPALCLRTSLKLSTVAFQEKNKDL

SEQ ID NO: 2740503 - protein, 28 aa, Entamoeba histolytica
SSNSYSSSSSYSTLFSSSLPFSSNSISS

SEQ ID NO: 2740504 - protein, 18 aa, Entamoeba histolytica
SSQGDKSLSQPVEGNSSP

SEQ ID NO: 2740505 - protein, 20 aa, Entamoeba histolytica
SSRRTRVGVSRTFKKDSRRT

SEQ ID NO: 2740506 - protein, 20 aa, Entamoeba histolytica
SSSLECCPLPSFDIIFTDSF

SEQ ID NO: 2740507 - protein, 25 aa, Entamoeba histolytica
SSSNSRPSTLFSFFKRFTSMQYLYF

SEQ ID NO: 2740508 - protein, 17 aa, Entamoeba histolytica
SSSVFLILSITLTFLFF

SEQ ID NO: 2740509 - protein, 26 aa, Entamoeba histolytica
SSSYGFCKEAFNFFIDVFSTYSSEQQ

SEQ ID NO: 2740510 - protein, 21 aa, Entamoeba histolytica
SSTALKWLCYATNSNIKNAMT

SEQ ID NO: 2740511 - protein, 23 aa, Entamoeba histolytica
SSTQVCKKCWILMSCAAKVIHHI

SEQ ID NO: 2740512 - protein, 20 aa, Entamoeba histolytica
SSYGLCKTGLLSNTNSECKI

SEQ ID NO: 2740513 - protein, 19 aa, Entamoeba histolytica
STANGRKTLNLDFWRESTY

SEQ ID NO: 2740514 - protein, 18 aa, Entamoeba histolytica
STLFALRVNPLFRNDNDL

SEQ ID NO: 2740515 - protein, 19 aa, Entamoeba histolytica
STLPLIISDTLTFTTMDIT

SEQ ID NO: 2740516 - protein, 26 aa, Entamoeba histolytica
STLYLRWLQIQTFFPLFRGNGEINGY

SEQ ID NO: 2740517 - protein, 30 aa, Entamoeba histolytica
STMLSFKIDIGISFPDFYSSVQLTETQTFL

SEQ ID NO: 2740518 - protein, 23 aa, Entamoeba histolytica
STNAEFWFWASGKTDASAKTIST

SEQ ID NO: 2740519 - protein, 24 aa, Entamoeba histolytica
STPDGRSNTFFSQLDYKADKFTGS

SEQ ID NO: 2740520 - protein, 25 aa, Entamoeba histolytica
STSMFKGKLSLLVSRVVFNEIIPSE

SEQ ID NO: 2740521 - protein, 17 aa, Entamoeba histolytica
STSMILSLALIISIGMF

SEQ ID NO: 2740522 - protein, 24 aa, Entamoeba histolytica
STYDKLQCEINMHNFLIKGIILNP

SEQ ID NO: 2740523 - protein, 17 aa, Entamoeba histolytica
STYPECCFTYWKNEEIT

SEQ ID NO: 2740524 - protein, 18 aa, Entamoeba histolytica
SVAGKVASFVPIPQVKAA

SEQ ID NO: 2740525 - protein, 20 aa, Entamoeba histolytica
SVGGKVWLQLSPNECLRQLS

SEQ ID NO: 2740526 - protein, 18 aa, Entamoeba histolytica
SVIGGVYFDLYPRKGKRS

SEQ ID NO: 2740527 - protein, 23 aa, Entamoeba histolytica
SVSNFPFKFCSTSGGRSNLCSSK

SEQ ID NO: 2740528 - protein, 23 aa, Entamoeba histolytica
SWDYNRYAFKEMCYEVDDDNVKA

SEQ ID NO: 2740529 - protein, 22 aa, Entamoeba histolytica
SWGTSWGDKGYILMSRNKNNQC

SEQ ID NO: 2740530 - protein, 23 aa, Entamoeba histolytica
SWYRRISYELNEQWNKNVICDGG

SEQ ID NO: 2740531 - protein, 29 aa, Entamoeba histolytica
SYCDMYDYWKFSGVKVKWIPKVKTSVALP

SEQ ID NO: 2740532 - protein, 19 aa, Entamoeba histolytica
SYGIHCARLAHLPSSLISR

SEQ ID NO: 2740533 - protein, 20 aa, Entamoeba histolytica
SYIQLFNKFNIVRIAYSNED

SEQ ID NO: 2740534 - protein, 23 aa, Entamoeba histolytica
SYKGGKCIVCVDGYYAKAGECFE

SEQ ID NO: 2740535 - protein, 17 aa, Entamoeba histolytica
SYNNLYVIYKSSLSQSL

SEQ ID NO: 2740536 - protein, 20 aa, Entamoeba histolytica
SYQGYSHVVAYARIQYKDTS

SEQ ID NO: 2740537 - protein, 19 aa, Entamoeba histolytica
SYQGYSHVVAYARIQYKNT

SEQ ID NO: 2740538 - protein, 19 aa, Entamoeba histolytica
SYYTCPLPYTCTDTTNCQH

SEQ ID NO: 2740539 - protein, 23 aa, Entamoeba histolytica
TAELYTFDDFELFSEIEYQVDLS

SEQ ID NO: 2740540 - protein, 17 aa, Entamoeba histolytica
TAGSFVFTTTGIIYEYN

SEQ ID NO: 2740541 - protein, 24 aa, Entamoeba histolytica
TCDGKCKKGLLCALSHLTEAEYKE

SEQ ID NO: 2740542 - protein, 26 aa, Entamoeba histolytica
TCDKCGGKGKIYGKVCHVCNGKKVEE

SEQ ID NO: 2740543 - protein, 27 aa, Entamoeba histolytica
TCPHCKKLIPRFNQFGVIHNNQPNFRL

SEQ ID NO: 2740544 - protein, 17 aa, Entamoeba histolytica
TCQSCKEGLTLTRSNLC

SEQ ID NO: 2740545 - protein, 24 aa, Entamoeba histolytica
TCSSRSWCNLNRFRPVSHYNADVR

SEQ ID NO: 2740546 - protein, 21 aa, Entamoeba histolytica
TDAKYTLEYTFEGADYDNSYW

SEQ ID NO: 2740547 - protein, 18 aa, Entamoeba histolytica
TDCFLFVNDCCGADRSDT

SEQ ID NO: 2740548 - protein, 24 aa, Entamoeba histolytica
TDCKCGYSSFNPCGYSFQTMTDCT

SEQ ID NO: 2740549 - protein, 20 aa, Entamoeba histolytica
TDILIRFCPMYENECRETQS

SEQ ID NO: 2740550 - protein, 17 aa, Entamoeba histolytica
TDLWMKVGSSWISVPQL

SEQ ID NO: 2740551 - protein, 20 aa, Entamoeba histolytica
TDPGEMMMWFNATLKVLREK

SEQ ID NO: 2740552 - protein, 29 aa, Entamoeba histolytica
TEAWQTSMVRNWVFQMMLPITTDVKTMEE

SEQ ID NO: 2740553 - protein, 17 aa, Entamoeba histolytica
TECNGNIRFDDVQFVYP

SEQ ID NO: 2740554 - protein, 24 aa, Entamoeba histolytica
TEFSTSCYPEGSIVSAQAPDTSNL

SEQ ID NO: 2740555 - protein, 25 aa, Entamoeba histolytica
TEGGEINWFYSFPFLYDKILPSAVC

SEQ ID NO: 2740556 - protein, 17 aa, Entamoeba histolytica
TEIVLIFLLAQKGWSFY

SEQ ID NO: 2740557 - protein, 17 aa, Entamoeba histolytica
TELKLLVEFVPMLLSQI

SEQ ID NO: 2740558 - protein, 17 aa, Entamoeba histolytica
TEPIPATKQFACNTPAV

SEQ ID NO: 2740559 - protein, 20 aa, Entamoeba histolytica
TEVQWKFNYNATQEYNLKDL

SEQ ID NO: 2740560 - protein, 21 aa, Entamoeba histolytica
TEVSYDYILHVQTWAGQFCKT

SEQ ID NO: 2740561 - protein, 28 aa, Entamoeba histolytica
TEYYPLNSCIGFTDYAAYFFYNNNTHMN

SEQ ID NO: 2740562 - protein, 26 aa, Entamoeba histolytica
TFAIPRCWRSTGSWDPYCANNCANAH

SEQ ID NO: 2740563 - protein, 22 aa, Entamoeba histolytica
TGECWPLKSNWVDFLSEEARNW

SEQ ID NO: 2740564 - protein, 17 aa, Entamoeba histolytica
TGHYKYKKLDANLNFNH

SEQ ID NO: 2740565 - protein, 17 aa, Entamoeba histolytica
TGKLEGAAHVFVDKVFG

SEQ ID NO: 2740566 - protein, 24 aa, Entamoeba histolytica
THEGCKGGFILKNSWNDTVYGPSI

SEQ ID NO: 2740567 - protein, 20 aa, Entamoeba histolytica
THLTKGWGFLKIETVRKYLP

SEQ ID NO: 2740568 - protein, 24 aa, Entamoeba histolytica
TIEKKWRAQRKALIMLERARDAKN

SEQ ID NO: 2740569 - protein, 20 aa, Entamoeba histolytica
TIFEIKRLIGRTFDDKEVQR

SEQ ID NO: 2740570 - protein, 17 aa, Entamoeba histolytica
TIFEIKRLIGRTYDDKE

SEQ ID NO: 2740571 - protein, 25 aa, Entamoeba histolytica
TIGSCSKLTLTGTRTIKTLKLSKSC

SEQ ID NO: 2740572 - protein, 25 aa, Entamoeba histolytica
TIKQIKNLRIMLAARVAVYNKSKIV

SEQ ID NO: 2740573 - protein, 19 aa, Entamoeba histolytica
TILDESFITVVGFHKGDNN

SEQ ID NO: 2740574 - protein, 26 aa, Entamoeba histolytica
TILYLKTQCLFLFFSLNIITDNFIVP

SEQ ID NO: 2740575 - protein, 23 aa, Entamoeba histolytica
TIQCLECPEGKVIVNGKSCQPIE

SEQ ID NO: 2740576 - protein, 23 aa, Entamoeba histolytica
TKEFNFTISYSMMGSKDKVAYMV

SEQ ID NO: 2740577 - protein, 21 aa, Entamoeba histolytica
TKEIIKLMIEDIIKYIEETKL

SEQ ID NO: 2740578 - protein, 17 aa, Entamoeba histolytica
TKFTGFVENQRKCGVCS

SEQ ID NO: 2740579 - protein, 21 aa, Entamoeba histolytica
TKGKDSLIIFCVERADMCKYF

SEQ ID NO: 2740580 - protein, 21 aa, Entamoeba histolytica
TKHWEHLCVFGSEKKTESQLV

SEQ ID NO: 2740581 - protein, 17 aa, Entamoeba histolytica
TKKSNCNGKGWSYSSES

SEQ ID NO: 2740582 - protein, 31 aa, Entamoeba histolytica
TKLNNEKDWRYGIKAQHQFNDKWSGSLEVGK

SEQ ID NO: 2740583 - protein, 17 aa, Entamoeba histolytica
TKLPVTWTHGLYNKVFR

SEQ ID NO: 2740584 - protein, 19 aa, Entamoeba histolytica
TKRFKECVDNIDLIEGFEM

SEQ ID NO: 2740585 - protein, 27 aa, Entamoeba histolytica
TKSEVIHRMVVDWLKKEFEDAKARTGV

SEQ ID NO: 2740586 - protein, 24 aa, Entamoeba histolytica
TKSPLKFWLIEDFLSPEGRIKLKE

SEQ ID NO: 2740587 - protein, 25 aa, Entamoeba histolytica
TLAFARSSMWGSMDYKGLNVRDWEN

SEQ ID NO: 2740588 - protein, 17 aa, Entamoeba histolytica
TLKEGRKNIKNEIRKEK

SEQ ID NO: 2740589 - protein, 19 aa, Entamoeba histolytica
TLLFMRFLYTPLIQSPSLF

SEQ ID NO: 2740590 - protein, 18 aa, Entamoeba histolytica
TLMSIVFTYLYPRIDTNV

SEQ ID NO: 2740591 - protein, 25 aa, Entamoeba histolytica
TLPSLCPNNNLPLVLTTNSDDKINV

SEQ ID NO: 2740592 - protein, 18 aa, Entamoeba histolytica
TLSIAIAETCTRHPVIII

SEQ ID NO: 2740593 - protein, 20 aa, Entamoeba histolytica
TLSLSASIDYVFTDVTDADV

SEQ ID NO: 2740594 - protein, 28 aa, Entamoeba histolytica
TLWPEIPWKKITGIWRKFISHLEELGYQ

SEQ ID NO: 2740595 - protein, 18 aa, Entamoeba histolytica
TMDLCVVQKMTIGTDGKI

SEQ ID NO: 2740596 - protein, 17 aa, Entamoeba histolytica
TMLKVTVEWENFNKYAA

SEQ ID NO: 2740597 - protein, 17 aa, Entamoeba histolytica
TMMCIPTDVMLRNAALV

SEQ ID NO: 2740598 - protein, 20 aa, Entamoeba histolytica
TNAFFPLFVRRVNDDPKPMS

SEQ ID NO: 2740599 - protein, 19 aa, Entamoeba histolytica
TNKDIGGVIPKSLAFGVIK

SEQ ID NO: 2740600 - protein, 26 aa, Entamoeba histolytica
TNNILSFKLKPTWSINKNIQLNIISL

SEQ ID NO: 2740601 - protein, 22 aa, Entamoeba histolytica
TNNLCDAYAFLLALLSKSCSIK

SEQ ID NO: 2740602 - protein, 20 aa, Entamoeba histolytica
TNYTCPSWVDTLPEEEKNKK

SEQ ID NO: 2740603 - protein, 17 aa, Entamoeba histolytica
TPITIIWENGESVSVTY

SEQ ID NO: 2740604 - protein, 17 aa, Entamoeba histolytica
TQEFPLSIINLLKRKNE

SEQ ID NO: 2740605 - protein, 17 aa, Entamoeba histolytica
TQIARDILVDAHNRHLA

SEQ ID NO: 2740606 - protein, 19 aa, Entamoeba histolytica
TQVEIFIRDALGVLQKDNT

SEQ ID NO: 2740607 - protein, 17 aa, Entamoeba histolytica
TRELICIGNKGKNTIKV

SEQ ID NO: 2740608 - protein, 20 aa, Entamoeba histolytica
TRKAYKEKRKVLKQQRKAQK

SEQ ID NO: 2740609 - protein, 20 aa, Entamoeba histolytica
TRPSHHVLKGIDLEIKKGKT

SEQ ID NO: 2740610 - protein, 25 aa, Entamoeba histolytica
TRRSELYARQAWLLSELKALAKRET

SEQ ID NO: 2740611 - protein, 26 aa, Entamoeba histolytica
TSLGFRFQNIRFRGEMDRSDVIEHVS

SEQ ID NO: 2740612 - protein, 28 aa, Entamoeba histolytica
TSNCKICNSEKCFLCFDNYIVSGTKCIE

SEQ ID NO: 2740613 - protein, 23 aa, Entamoeba histolytica
TSNCKYMNNGICLVCPPGKTQEP

SEQ ID NO: 2740614 - protein, 17 aa, Entamoeba histolytica
TSQYPMIVMYSGITERS

SEQ ID NO: 2740615 - protein, 18 aa, Entamoeba histolytica
TSSLPIIELISGHDDTLY

SEQ ID NO: 2740616 - protein, 25 aa, Entamoeba histolytica
TSTYFRNRHVMLFCYDITKKESFNH

SEQ ID NO: 2740617 - protein, 27 aa, Entamoeba histolytica
TSVKVILPGGIDWSTPITLKEFEEASE

SEQ ID NO: 2740618 - protein, 19 aa, Entamoeba histolytica
TSVNSKCIVCTEFDKYFDG

SEQ ID NO: 2740619 - protein, 22 aa, Entamoeba histolytica
TTDKRLNPESSTTGQEETTPKQ

SEQ ID NO: 2740620 - protein, 18 aa, Entamoeba histolytica
TTEALDLLEKVLVFDHQK

SEQ ID NO: 2740621 - protein, 21 aa, Entamoeba histolytica
TTECSKCNKGYEMIHGECKRK

SEQ ID NO: 2740622 - protein, 42 aa, Entamoeba histolytica
TTENPPSPILQWKFANPAIKGWGCCFLAACYIGGLNTYEQIN

SEQ ID NO: 2740623 - protein, 22 aa, Entamoeba histolytica
TTILYKLQCGKVIQTMPTIGFN

SEQ ID NO: 2740624 - protein, 17 aa, Entamoeba histolytica
TTISVTINKGMREGEVI

SEQ ID NO: 2740625 - protein, 25 aa, Entamoeba histolytica
TTLSIPKRNSLSFVGVVEPPEYPMR

SEQ ID NO: 2740626 - protein, 19 aa, Entamoeba histolytica
TTTEIKIGTSFISNEYSYS

SEQ ID NO: 2740627 - protein, 17 aa, Entamoeba histolytica
TTTIKLGYSRPWEKGKE

SEQ ID NO: 2740628 - protein, 25 aa, Entamoeba histolytica
TTYFRNRHCILFTYDITKRETLEHV

SEQ ID NO: 2740629 - protein, 24 aa, Entamoeba histolytica
TTYNCPPIRCSYKQENKLPTGCYC

SEQ ID NO: 2740630 - protein, 26 aa, Entamoeba histolytica
TVAAFFRPKIAIGLLPQGKKMKSLED

SEQ ID NO: 2740631 - protein, 30 aa, Entamoeba histolytica
TVCKCGRTQYNPCVWNFLDLPDCEKKPGDF

SEQ ID NO: 2740632 - protein, 17 aa, Entamoeba histolytica
TVDEIRDSYFLIYLYYD

SEQ ID NO: 2740633 - protein, 26 aa, Entamoeba histolytica
TVIKTLKWPTYKRHFYLPYRLDVDLC

SEQ ID NO: 2740634 - protein, 30 aa, Entamoeba histolytica
TVKDFVSSLGMKWLSWVLKKSVIKKRQQQK

SEQ ID NO: 2740635 - protein, 23 aa, Entamoeba histolytica
TVSEQIPGYVFYKDFSTSLESTG

SEQ ID NO: 2740636 - protein, 25 aa, Entamoeba histolytica
TVSQLPVKFIIPWEALTPAKDQGSR

SEQ ID NO: 2740637 - protein, 18 aa, Entamoeba histolytica
TWAGQFCKTQCCDLPETT

SEQ ID NO: 2740638 - protein, 32 aa, Entamoeba histolytica
TWCREEYQQRYGFKCIFVFGESSAKQLEQYNE

SEQ ID NO: 2740639 - protein, 23 aa, Entamoeba histolytica
TYGCKRCSDGYYLTTNMKCSKCD

SEQ ID NO: 2740640 - protein, 18 aa, Entamoeba histolytica
TYPKIYSLHGYDLNNLES

SEQ ID NO: 2740641 - protein, 20 aa, Entamoeba histolytica
TYWLDGRHVVFGEVIEGMDV

SEQ ID NO: 2740642 - protein, 17 aa, Entamoeba histolytica
VADKLKLSHKVTHKTLK

SEQ ID NO: 2740643 - protein, 29 aa, Entamoeba histolytica
VAKEIKRTCKHLRITKKVCKKIANKMRSK

SEQ ID NO: 2740644 - protein, 21 aa, Entamoeba histolytica
VATAVSPVFPPAAGVAGAALA

SEQ ID NO: 2740645 - protein, 21 aa, Entamoeba histolytica
VCGKCSEIGETYCKYKEENGV

SEQ ID NO: 2740646 - protein, 18 aa, Entamoeba histolytica
VCNGKADAVFLWVNGTSP

SEQ ID NO: 2740647 - protein, 21 aa, Entamoeba histolytica
VCPNSRGSVDWLNDNPSHDYK

SEQ ID NO: 2740648 - protein, 20 aa, Entamoeba histolytica
VDASILRKEERTLHKVHKYH

SEQ ID NO: 2740649 - protein, 18 aa, Entamoeba histolytica
VDFINKRVKNIFEKYQCV

SEQ ID NO: 2740650 - protein, 17 aa, Entamoeba histolytica
VDFLSEEARNWWAGLYS

SEQ ID NO: 2740651 - protein, 23 aa, Entamoeba histolytica
VDGSILRKKARTLHKVHKYHLKI

SEQ ID NO: 2740652 - protein, 26 aa, Entamoeba histolytica
VDIAVPWKSECYINYLSGIWNNQTNK

SEQ ID NO: 2740653 - protein, 23 aa, Entamoeba histolytica
VDKAFSILLQRILKKNPPKTPRK

SEQ ID NO: 2740654 - protein, 23 aa, Entamoeba histolytica
VDLSEPWIFHWQNKDLFYGLRLT

SEQ ID NO: 2740655 - protein, 21 aa, Entamoeba histolytica
VDMEEDWSLGGIQEGFNKLVN

SEQ ID NO: 2740656 - protein, 17 aa, Entamoeba histolytica
VDNTIRIYRGEVCEMPK

SEQ ID NO: 2740657 - protein, 17 aa, Entamoeba histolytica
VEAIKRYKFVIEEQRKE

SEQ ID NO: 2740658 - protein, 24 aa, Entamoeba histolytica
VECPCSLGNGNANINCVYNIPSST

SEQ ID NO: 2740659 - protein, 25 aa, Entamoeba histolytica
VEDQRKCGVCSPSSMPSSSDETITY

SEQ ID NO: 2740660 - protein, 20 aa, Entamoeba histolytica
VEKGARIGQKVVNVATTASK

SEQ ID NO: 2740661 - protein, 20 aa, Entamoeba histolytica
VEMRGQIAVLEMKKSRVKSV

SEQ ID NO: 2740662 - protein, 17 aa, Entamoeba histolytica
VENGGGIKEEKTKNEEE

SEQ ID NO: 2740663 - protein, 17 aa, Entamoeba histolytica
VFGIKMIDTCSVPNPSP

SEQ ID NO: 2740664 - protein, 23 aa, Entamoeba histolytica
VFQRFSAIAERFWSNKNLIDDES

SEQ ID NO: 2740665 - protein, 21 aa, Entamoeba histolytica
VFTALPFIRTFLLNETKSLLN

SEQ ID NO: 2740666 - protein, 21 aa, Entamoeba histolytica
VFTCRGCAGTLIKTPRAYSST

SEQ ID NO: 2740667 - protein, 23 aa, Entamoeba histolytica
VFYLHFKTLNGINRFNQISLNRI

SEQ ID NO: 2740668 - protein, 20 aa, Entamoeba histolytica
VGASGCRKSTTIQLIQRNYE

SEQ ID NO: 2740669 - protein, 17 aa, Entamoeba histolytica
VGGCSECFACVPHKELF

SEQ ID NO: 2740670 - protein, 17 aa, Entamoeba histolytica
VGLTLGKKAWIVTDTHF

SEQ ID NO: 2740671 - protein, 17 aa, Entamoeba histolytica
VGMPYKNGFWYLMEKAG

SEQ ID NO: 2740672 - protein, 24 aa, Entamoeba histolytica
VGQYSLKVKRVWFDIEGTWTSSVS

SEQ ID NO: 2740673 - protein, 23 aa, Entamoeba histolytica
VHEARQLILKRFNVTSAEYTVIF

SEQ ID NO: 2740674 - protein, 25 aa, Entamoeba histolytica
VIGDFLFTCALEIYNASKAFDFYNC

SEQ ID NO: 2740675 - protein, 23 aa, Entamoeba histolytica
VIIGNGYDRFYIRYQSYTNRPYL

SEQ ID NO: 2740676 - protein, 17 aa, Entamoeba histolytica
VINLEIPDEILIQRIVS

SEQ ID NO: 2740677 - protein, 20 aa, Entamoeba histolytica
VINTLKYVFEKLVKEKEIVK

SEQ ID NO: 2740678 - protein, 17 aa, Entamoeba histolytica
VISKGLEIEQYNEQGNK

SEQ ID NO: 2740679 - protein, 25 aa, Entamoeba histolytica
VKADLFSFDEFDLIEELSFGSHLYD

SEQ ID NO: 2740680 - protein, 29 aa, Entamoeba histolytica
VKCLYKCGMKAHLCCLGKMFSENTHTLIP

SEQ ID NO: 2740681 - protein, 20 aa, Entamoeba histolytica
VKDTNIYGVFLKNEASPEKL

SEQ ID NO: 2740682 - protein, 24 aa, Entamoeba histolytica
VKFDRYEPEIGLALTEEGIKEVPI

SEQ ID NO: 2740683 - protein, 18 aa, Entamoeba histolytica
VKKTLSYVDKCKVRSHIL

SEQ ID NO: 2740684 - protein, 24 aa, Entamoeba histolytica
VKKYFRAVLNIPPTCTLRTEPGIS

SEQ ID NO: 2740685 - protein, 24 aa, Entamoeba histolytica
VKLIDFGSACFENYTLYSYIQSRH

SEQ ID NO: 2740686 - protein, 21 aa, Entamoeba histolytica
VKLSTGPFKWNEPAKEHTFIA

SEQ ID NO: 2740687 - protein, 26 aa, Entamoeba histolytica
VKMSKICSVSGCVSLGLSEINEIGEA

SEQ ID NO: 2740688 - protein, 22 aa, Entamoeba histolytica
VKNFIDRMICVFDFDNNTCKES

SEQ ID NO: 2740689 - protein, 23 aa, Entamoeba histolytica
VKNFIDRMICVFDFDTNTCKDSF

SEQ ID NO: 2740690 - protein, 17 aa, Entamoeba histolytica
VKRIKKIVLLKRHINSL

SEQ ID NO: 2740691 - protein, 21 aa, Entamoeba histolytica
VKSKGFPKVVFYHYNGMKFNF

SEQ ID NO: 2740692 - protein, 17 aa, Entamoeba histolytica
VLDAIQFKDIPQEHLIF

SEQ ID NO: 2740693 - protein, 18 aa, Entamoeba histolytica
VLEMKKSRVKSVLKTIMN

SEQ ID NO: 2740694 - protein, 17 aa, Entamoeba histolytica
VLFAHPVFWLSIPGEVK

SEQ ID NO: 2740695 - protein, 22 aa, Entamoeba histolytica
VLIPRFIRSITRYEHIQQQLLN

SEQ ID NO: 2740696 - protein, 25 aa, Entamoeba histolytica
VLPEWKTDQTKIWKNWKYILDFHEI

SEQ ID NO: 2740697 - protein, 18 aa, Entamoeba histolytica
VLTWIRVQVANWLSSKEG

SEQ ID NO: 2740698 - protein, 17 aa, Entamoeba histolytica
VMGDVWWGLVETSPKSY

SEQ ID NO: 2740699 - protein, 18 aa, Entamoeba histolytica
VMHFFVWNAITSPQNEYF

SEQ ID NO: 2740700 - protein, 28 aa, Entamoeba histolytica
VMKGSLYRWRTVGLYDRNEVQIKCAITA

SEQ ID NO: 2740701 - protein, 18 aa, Entamoeba histolytica
VMSKCPDFRNFGYKIAAP

SEQ ID NO: 2740702 - protein, 18 aa, Entamoeba histolytica
VNELIKALPMLGFNCNKR

SEQ ID NO: 2740703 - protein, 24 aa, Entamoeba histolytica
VNGDNAWRYAAWIRKATNSYLVVV

SEQ ID NO: 2740704 - protein, 18 aa, Entamoeba histolytica
VNKFKALWMKKRTMKKII

SEQ ID NO: 2740705 - protein, 21 aa, Entamoeba histolytica
VNLYREGILFSSFDGQKKVST

SEQ ID NO: 2740706 - protein, 19 aa, Entamoeba histolytica
VPASVDWRAEGKVTPVRDQ

SEQ ID NO: 2740707 - protein, 17 aa, Entamoeba histolytica
VPSENDYSISLRIQLGD

SEQ ID NO: 2740708 - protein, 22 aa, Entamoeba histolytica
VPTKPESQGVQPLSQDGNSQTT

SEQ ID NO: 2740709 - protein, 18 aa, Entamoeba histolytica
VPTLISYGDLDFVVDKSQ

SEQ ID NO: 2740710 - protein, 22 aa, Entamoeba histolytica
VQEDKLFITMNFHNVSDMYIAE

SEQ ID NO: 2740711 - protein, 17 aa, Entamoeba histolytica
VQIANLLSSKRGSGVQW

SEQ ID NO: 2740712 - protein, 18 aa, Entamoeba histolytica
VQIKCAITATSKEEMLQC

SEQ ID NO: 2740713 - protein, 29 aa, Entamoeba histolytica
VQLCFLIGILSRFCSLTFQRPRKKSSQTQ

SEQ ID NO: 2740714 - protein, 22 aa, Entamoeba histolytica
VQSGKYLQCYIKLNTTTEIKIG

SEQ ID NO: 2740715 - protein, 27 aa, Entamoeba histolytica
VQYNLKFEQGIDCGGGYIKLLPKKSIE

SEQ ID NO: 2740716 - protein, 25 aa, Entamoeba histolytica
VREKCKTCCRVIFASDYNYKTEKQF

SEQ ID NO: 2740717 - protein, 20 aa, Entamoeba histolytica
VRLILRRLGIELHKIQKQVF

SEQ ID NO: 2740718 - protein, 25 aa, Entamoeba histolytica
VRNSWGTSWGMDGYILMSRNKNNQC

SEQ ID NO: 2740719 - protein, 30 aa, Entamoeba histolytica
VRNYRLPFQIKEGWGMTRINQSLGISDGSD

SEQ ID NO: 2740720 - protein, 19 aa, Entamoeba histolytica
VRRAFRSEVVKQFFKNHPD

SEQ ID NO: 2740721 - protein, 20 aa, Entamoeba histolytica
VRSEMRRNSAELLLRKYEEK

SEQ ID NO: 2740722 - protein, 18 aa, Entamoeba histolytica
VSCSSCFYDTIYKVERTV

SEQ ID NO: 2740723 - protein, 20 aa, Entamoeba histolytica
VSFNAGFNFENKYGQKTKNF

SEQ ID NO: 2740724 - protein, 17 aa, Entamoeba histolytica
VSIHPGVVISNILHKYP

SEQ ID NO: 2740725 - protein, 29 aa, Entamoeba histolytica
VSLPVIIKEHLYFVSPIFFGMTVQDSLDL

SEQ ID NO: 2740726 - protein, 24 aa, Entamoeba histolytica
VSLSREYRGELVFIHTDDKETMEF

SEQ ID NO: 2740727 - protein, 22 aa, Entamoeba histolytica
VSPYSVHFMFVLLKSKKGQYYV

SEQ ID NO: 2740728 - protein, 23 aa, Entamoeba histolytica
VSSFKFLLPCLRSITTSYHDIAH

SEQ ID NO: 2740729 - protein, 24 aa, Entamoeba histolytica
VSTLQRWIVRCMSDLLSKTDEDDI

SEQ ID NO: 2740730 - protein, 18 aa, Entamoeba histolytica
VTDYDVHSVREMMSSGKT

SEQ ID NO: 2740731 - protein, 29 aa, Entamoeba histolytica
VTKPHPVFTRKGSDLYASVTVSLLESLTG

SEQ ID NO: 2740732 - protein, 18 aa, Entamoeba histolytica
VTLCLIFTQVNALDFHDF

SEQ ID NO: 2740733 - protein, 27 aa, Entamoeba histolytica
VTLWRAVPYYCYRWGMTEEELLDDIEH

SEQ ID NO: 2740734 - protein, 25 aa, Entamoeba histolytica
VVPGRFADACAVGYYDDTIQTTGWG

SEQ ID NO: 2740735 - protein, 24 aa, Entamoeba histolytica
VYFYPCLSCGNAAGQVQSFWSSVI

SEQ ID NO: 2740736 - protein, 19 aa, Entamoeba histolytica
VYIKECPVKTVIVSSQCQH

SEQ ID NO: 2740737 - protein, 17 aa, Entamoeba histolytica
VYMSPIRFIPNPYYYYR

SEQ ID NO: 2740738 - protein, 24 aa, Entamoeba histolytica
VYQYRQLHCGSSFINKVKNNDNII

SEQ ID NO: 2740739 - protein, 23 aa, Entamoeba histolytica
WAWQICSEYSYFQPVNESLPFSK

SEQ ID NO: 2740740 - protein, 28 aa, Entamoeba histolytica
WCYGQSRFKQATCPNGLECKCGKTIYNP

SEQ ID NO: 2740741 - protein, 17 aa, Entamoeba histolytica
WDYIVSSSMRYGENVLA

SEQ ID NO: 2740742 - protein, 17 aa, Entamoeba histolytica
WFEPYSFISEYQVKDIS

SEQ ID NO: 2740743 - protein, 22 aa, Entamoeba histolytica
WFRAWVNVDIAVPWKSECYINY

SEQ ID NO: 2740744 - protein, 20 aa, Entamoeba histolytica
WGFGCILGSLIFKKEPIFEG

SEQ ID NO: 2740745 - protein, 18 aa, Entamoeba histolytica
WGQLYIRSNFKLAETEQS

SEQ ID NO: 2740746 - protein, 26 aa, Entamoeba histolytica
WIDFTNKQGYEWYRFMSKISPVLTLW

SEQ ID NO: 2740747 - protein, 27 aa, Entamoeba histolytica
WITDVCSYCPQGVKVMIVGNKIDLEME

SEQ ID NO: 2740748 - protein, 24 aa, Entamoeba histolytica
WKDRRKVDLTKEVKFIPNIFDGNS

SEQ ID NO: 2740749 - protein, 17 aa, Entamoeba histolytica
WKSLEMQRKMFIRYMKS

SEQ ID NO: 2740750 - protein, 17 aa, Entamoeba histolytica
WKSQIPDTLKFLDQKIL

SEQ ID NO: 2740751 - protein, 18 aa, Entamoeba histolytica
WLEECRKYSNPNTTIMLV

SEQ ID NO: 2740752 - protein, 18 aa, Entamoeba histolytica
WLNYCPHKNYLFNTPNIR

SEQ ID NO: 2740753 - protein, 19 aa, Entamoeba histolytica
WLPQSALETFKRGGYYTKE

SEQ ID NO: 2740754 - protein, 19 aa, Entamoeba histolytica
WMYRVALPLFQPINEDIKM

SEQ ID NO: 2740755 - protein, 18 aa, Entamoeba histolytica
WNGNVSFERLITFETTPS

SEQ ID NO: 2740756 - protein, 17 aa, Entamoeba histolytica
WNNNLCALEHPRNSEKD

SEQ ID NO: 2740757 - protein, 18 aa, Entamoeba histolytica
WNSMFYLDYHVPYTNKFK

SEQ ID NO: 2740758 - protein, 18 aa, Entamoeba histolytica
WRPYYAMMRIYKKYTFPF

SEQ ID NO: 2740759 - protein, 19 aa, Entamoeba histolytica
WRVTGDGFISNKYGQKSNG

SEQ ID NO: 2740760 - protein, 17 aa, Entamoeba histolytica
WRYADRSNNNWIEKTTQ

SEQ ID NO: 2740761 - protein, 17 aa, Entamoeba histolytica
WSAKAAHKMNKDSSWFI

SEQ ID NO: 2740762 - protein, 17 aa, Entamoeba histolytica
WSGSLEVGKSSKNGLEY

SEQ ID NO: 2740763 - protein, 21 aa, Entamoeba histolytica
WSNEGICFLFKLNKIVSSIQI

SEQ ID NO: 2740764 - protein, 17 aa, Entamoeba histolytica
WTNNSKFMYLRQNHNSV

SEQ ID NO: 2740765 - protein, 17 aa, Entamoeba histolytica
WYQAGALQPFFRQHSSQ

SEQ ID NO: 2740766 - protein, 18 aa, Entamoeba histolytica
YAKLLRECAYLDGDCKEM

SEQ ID NO: 2740767 - protein, 23 aa, Entamoeba histolytica
YANNDIDWHLNWKLRTKCSGLIR

SEQ ID NO: 2740768 - protein, 18 aa, Entamoeba histolytica
YASAWDFYGLHASPIISG

SEQ ID NO: 2740769 - protein, 19 aa, Entamoeba histolytica
YASDNILLKVEEAKPTPQE

SEQ ID NO: 2740770 - protein, 18 aa, Entamoeba histolytica
YCDEAMKLTKLTKLNDYT

SEQ ID NO: 2740771 - protein, 21 aa, Entamoeba histolytica
YCDMYDYWKFSGVKVKWIPKV

SEQ ID NO: 2740772 - protein, 28 aa, Entamoeba histolytica
YCDMYDYWKFSGVKVKWIPKVKTSVALP

SEQ ID NO: 2740773 - protein, 22 aa, Entamoeba histolytica
YCTDHIKFIWCYGTDSGSALSC

SEQ ID NO: 2740774 - protein, 18 aa, Entamoeba histolytica
YDIELWYSLLARSKVPFL

SEQ ID NO: 2740775 - protein, 19 aa, Entamoeba histolytica
YDPELYKYDSFAYIGIDVW

SEQ ID NO: 2740776 - protein, 17 aa, Entamoeba histolytica
YDQGCKNLQYILNKKKF

SEQ ID NO: 2740777 - protein, 20 aa, Entamoeba histolytica
YDSWSSDTIFEFLKEGTSPV

SEQ ID NO: 2740778 - protein, 19 aa, Entamoeba histolytica
YDTTYLCGILNTLGYSIDI

SEQ ID NO: 2740779 - protein, 18 aa, Entamoeba histolytica
YEKYNYKLPFDIKMQCMI

SEQ ID NO: 2740780 - protein, 22 aa, Entamoeba histolytica
YEYLKHGTCIPSISHGEDGPQY

SEQ ID NO: 2740781 - protein, 18 aa, Entamoeba histolytica
YFFSTSITTWFEDIKLNI

SEQ ID NO: 2740782 - protein, 18 aa, Entamoeba histolytica
YFIIRNSWASGWGEGDNY

SEQ ID NO: 2740783 - protein, 17 aa, Entamoeba histolytica
YGGCNTNGFSQIVKQAK

SEQ ID NO: 2740784 - protein, 20 aa, Entamoeba histolytica
YIHNNIHLIAETTTSSQGAK

SEQ ID NO: 2740785 - protein, 17 aa, Entamoeba histolytica
YIIKAYAQIHSKIDVVK

SEQ ID NO: 2740786 - protein, 25 aa, Entamoeba histolytica
YIITLKVPSYFPAIKYCKNEELRKE

SEQ ID NO: 2740787 - protein, 22 aa, Entamoeba histolytica
YKDKKSLFGLGYDWRYADVNYN

SEQ ID NO: 2740788 - protein, 17 aa, Entamoeba histolytica
YKEVMFVVDTCQATSLS

SEQ ID NO: 2740789 - protein, 18 aa, Entamoeba histolytica
YKFKIPVESGRTFHVTND

SEQ ID NO: 2740790 - protein, 20 aa, Entamoeba histolytica
YKGGDEHYERINSIFRKIEK

SEQ ID NO: 2740791 - protein, 19 aa, Entamoeba histolytica
YKLPFPIKMHCLISSGHES

SEQ ID NO: 2740792 - protein, 18 aa, Entamoeba histolytica
YKSFSICDIDGYSRVTLC

SEQ ID NO: 2740793 - protein, 19 aa, Entamoeba histolytica
YLAEKCAYIVMPMYSTDGE

SEQ ID NO: 2740794 - protein, 20 aa, Entamoeba histolytica
YLFEELGFTAGKYIERDFGS

SEQ ID NO: 2740795 - protein, 18 aa, Entamoeba histolytica
YLKGKKGISTKGITLKDV

SEQ ID NO: 2740796 - protein, 25 aa, Entamoeba histolytica
YLMEKAGITFGKFIDRDAGVIKSRV

SEQ ID NO: 2740797 - protein, 24 aa, Entamoeba histolytica
YLMEKAGITFGKFIDRDAGVVKNG

SEQ ID NO: 2740798 - protein, 22 aa, Entamoeba histolytica
YLQVLNCYNIPFPSNEKEQITI

SEQ ID NO: 2740799 - protein, 18 aa, Entamoeba histolytica
YLSKAMNYIYLFNGKTKF

SEQ ID NO: 2740800 - protein, 18 aa, Entamoeba histolytica
YLWCYGRTEGTPGKCIGE

SEQ ID NO: 2740801 - protein, 25 aa, Entamoeba histolytica
YLYDYVDLITARICHNVTLPCKDNE

SEQ ID NO: 2740802 - protein, 19 aa, Entamoeba histolytica
YLYERFPKQLESFFQYNPY

SEQ ID NO: 2740803 - protein, 23 aa, Entamoeba histolytica
YMKVEMKKRYTIIAKNLKKMLPN

SEQ ID NO: 2740804 - protein, 17 aa, Entamoeba histolytica
YMWKGSCEPGQLTPEGI

SEQ ID NO: 2740805 - protein, 24 aa, Entamoeba histolytica
YNCWNVPVIGGWCSTKRSNLFTIS

SEQ ID NO: 2740806 - protein, 25 aa, Entamoeba histolytica
YNFDSPDAFDWPLIYKTMKRVKQRK

SEQ ID NO: 2740807 - protein, 18 aa, Entamoeba histolytica
YNGVFPKHVPLLTVNEFL

SEQ ID NO: 2740808 - protein, 18 aa, Entamoeba histolytica
YNKACTFTDSKVIPVNSY

SEQ ID NO: 2740809 - protein, 17 aa, Entamoeba histolytica
YPDCVYNSSLFDLALTN

SEQ ID NO: 2740810 - protein, 20 aa, Entamoeba histolytica
YPERLWLAIIHTMPNKISHI

SEQ ID NO: 2740811 - protein, 22 aa, Entamoeba histolytica
YPLNSCIGFTDYAAYFFYNNNT

SEQ ID NO: 2740812 - protein, 21 aa, Entamoeba histolytica
YPLNSCISFTDYAAYFFYNNN

SEQ ID NO: 2740813 - protein, 24 aa, Entamoeba histolytica
YPTTCSSFDKCFRCDDKKCIQCVD

SEQ ID NO: 2740814 - protein, 19 aa, Entamoeba histolytica
YPVPIQWKTIIQHFALVIN

SEQ ID NO: 2740815 - protein, 23 aa, Entamoeba histolytica
YPVPIRISEHYHYVTLITESDNP

SEQ ID NO: 2740816 - protein, 20 aa, Entamoeba histolytica
YQMICLYSYPNRVMDMLYNT

SEQ ID NO: 2740817 - protein, 18 aa, Entamoeba histolytica
YQRLWIALKDLNPFNNDC

SEQ ID NO: 2740818 - protein, 21 aa, Entamoeba histolytica
YQRYGCIKTPPKFSAQRFLDV

SEQ ID NO: 2740819 - protein, 21 aa, Entamoeba histolytica
YQYSSPYLMIWNDMNEPSVFN

SEQ ID NO: 2740820 - protein, 20 aa, Entamoeba histolytica
YRLDVDLCYQAKSAADIPSK

SEQ ID NO: 2740821 - protein, 20 aa, Entamoeba histolytica
YRNAKCKPIVKKIYKKKQPK

SEQ ID NO: 2740822 - protein, 17 aa, Entamoeba histolytica
YRPNCIKNDIEYISEDI

SEQ ID NO: 2740823 - protein, 18 aa, Entamoeba histolytica
YSDPLSNRGIVYISRRME

SEQ ID NO: 2740824 - protein, 19 aa, Entamoeba histolytica
YSEESFSNFVCLNEGVYLL

SEQ ID NO: 2740825 - protein, 24 aa, Entamoeba histolytica
YSEESFSNFVCLNEGVYLLHNGQI

SEQ ID NO: 2740826 - protein, 17 aa, Entamoeba histolytica
YSGRGDYIFNYPHCPCD

SEQ ID NO: 2740827 - protein, 18 aa, Entamoeba histolytica
YSLTGVSFMPPRFSLGFH

SEQ ID NO: 2740828 - protein, 24 aa, Entamoeba histolytica
YSNLKKKWYFAPRKCSNKAYDKQE

SEQ ID NO: 2740829 - protein, 20 aa, Entamoeba histolytica
YSPEEISAMVIKKMADTAST

SEQ ID NO: 2740830 - protein, 18 aa, Entamoeba histolytica
YSPVERLRRKAIFISNFN

SEQ ID NO: 2740831 - protein, 18 aa, Entamoeba histolytica
YSSLRIVDSICVFADAFH

SEQ ID NO: 2740832 - protein, 25 aa, Entamoeba histolytica
YSSSMLKWACYSSSLIDKTNVSSIR

SEQ ID NO: 2740833 - protein, 18 aa, Entamoeba histolytica
YSSTAIKWLCYATNKQLQ

SEQ ID NO: 2740834 - protein, 18 aa, Entamoeba histolytica
YSSWPPYASYIIFEMYEK

SEQ ID NO: 2740835 - protein, 26 aa, Entamoeba histolytica
YTFSFIPFDCCVSGATSGFGCNQIVV

SEQ ID NO: 2740836 - protein, 17 aa, Entamoeba histolytica
YTFSISSLTVFNLLNTS

SEQ ID NO: 2740837 - protein, 21 aa, Entamoeba histolytica
YTNKEIFLRELISNASDAIDK

SEQ ID NO: 2740838 - protein, 26 aa, Entamoeba histolytica
YTPDFEWYCNIVIHILEFNKVEPMQE

SEQ ID NO: 2740839 - protein, 25 aa, Entamoeba histolytica
YTPPEVLNGLPFTKSGDVFSFAIAC

SEQ ID NO: 2740840 - protein, 29 aa, Entamoeba histolytica
YTSQEIIKDFLFLARGVRRIPFYSINDTH

SEQ ID NO: 2740841 - protein, 22 aa, Entamoeba histolytica
YTYEEILLILSYYIAAEYNVDN

SEQ ID NO: 2740842 - protein, 19 aa, Entamoeba histolytica
YVIVGEVAVGKSCLLLQFQ

SEQ ID NO: 2740843 - protein, 26 aa, Entamoeba histolytica
YVRAKCKTCCRVIFASDYNYETQKQF

SEQ ID NO: 2740844 - protein, 26 aa, Entamoeba histolytica
YVRAKCKTCCRVIFASDYNYKTEKQF

SEQ ID NO: 2740845 - protein, 26 aa, Entamoeba histolytica
YVRAKCKTCCRVIFASDYNYKTKKPF

SEQ ID NO: 2740846 - protein, 26 aa, Entamoeba histolytica
YVRAKCKTCCRVIFASDYNYKTNTQF

SEQ ID NO: 2740847 - protein, 26 aa, Entamoeba histolytica
YVSNDNEIRWGISTNCGKFIGFTQYY

SEQ ID NO: 2740848 - protein, 18 aa, Entamoeba histolytica
YWILKNCWGSSWGSNGYL

SEQ ID NO: 2740849 - protein, 21 aa, Entamoeba histolytica
YWKFSGVKVKWIPKVKTSVAL

SEQ ID NO: 2740850 - protein, 25 aa, Entamoeba histolytica
YWYSSEVWNRMSFDQLMNVTADYPK

SEQ ID NO: 2740851 - protein, 21 aa, Entamoeba histolytica
YYAPWCGHCKALKPVYENLAK

SEQ ID NO: 2740852 - protein, 26 aa, Entamoeba histolytica
YYDKGCKNLQYIFGKKKLCFPHDGRW

SEQ ID NO: 2740853 - protein, 26 aa, Entamoeba histolytica
YYDKGCKNLQYIFGKKKLCFPQDGRW

SEQ ID NO: 2740854 - protein, 19 aa, Entamoeba histolytica
YYIDICNSPIILQCGISLQ

SEQ ID NO: 2740855 - protein, 18 aa, Entamoeba histolytica
YYIYPGGYLSIFSQDIIK

SEQ ID NO: 2740856 - protein, 23 aa, Entamoeba histolytica
YYKGEFKKLFYGKSLLNINVTAT

SEQ ID NO: 2740857 - protein, 23 aa, Entamoeba histolytica
YYRDLDDSFSCFAKNAKALENVP

SEQ ID NO: 2740858 - protein, 25 aa, Entamoeba histolytica
YYSHCKKCQHGHIKPGLSTGSSSGS

SEQ ID NO: 2740859 - protein, 23 aa, Entamoeba histolytica
YYYKVWSRDATFASIIMLALGET

SEQ ID NO: 2740860 - protein, 25 aa, Entamoeba histolytica
YYYPCISCGNMAGQVRTFWQKVGQY

SEQ ID NO: 2740861 - protein, 19 aa, Entamoeba histolytica
RFFQEWYFDLLLSHTDKVL

SEQ ID NO: 2740862 - protein, 18 aa, Entamoeba histolytica
EKPIECFCEMYGIPYSSV

SEQ ID NO: 2740863 - protein, 22 aa, Entamoeba histolytica
GRSWFFQTCIAYGYYQAVSEQS

SEQ ID NO: 2740864 - protein, 20 aa, Entamoeba histolytica
RAKCKTCCRVIFASDYNYKT

SEQ ID NO: 2740865 - protein, 17 aa, Entamoeba histolytica
SIGQVFIREGWGCLTMN

SEQ ID NO: 2740866 - protein, 17 aa, Entamoeba histolytica
AALRGILIYPEIDIPGH

SEQ ID NO: 2740867 - protein, 22 aa, Entamoeba histolytica
AIKGDIPTAIDWRAEGKVTPIR

SEQ ID NO: 2740868 - protein, 20 aa, Entamoeba histolytica
AKDKISAMSLFFKAKVTQSV

SEQ ID NO: 2740869 - protein, 18 aa, Entamoeba histolytica
AKESFSFARYQATDDGSY

SEQ ID NO: 2740870 - protein, 23 aa, Entamoeba histolytica
ANSILKFDIKIVKVISYFDAQFN

SEQ ID NO: 2740871 - protein, 18 aa, Entamoeba histolytica
ARASIAIRSVEKIEDKIF

SEQ ID NO: 2740872 - protein, 18 aa, Entamoeba histolytica
ASVKGRMKKIAKLAKKRV

SEQ ID NO: 2740873 - protein, 18 aa, Entamoeba histolytica
ATSSLKCSSIEFGSVLYS

SEQ ID NO: 2740874 - protein, 22 aa, Entamoeba histolytica
AVCDRFGYKRFLLFKEGENYEN

SEQ ID NO: 2740875 - protein, 17 aa, Entamoeba histolytica
CDKSGFETLQFHVQAGP

SEQ ID NO: 2740876 - protein, 18 aa, Entamoeba histolytica
CGCCKTCMAQKPPSCGCY

SEQ ID NO: 2740877 - protein, 19 aa, Entamoeba histolytica
CGKTIYNPCMWPFQGNTPD

SEQ ID NO: 2740878 - protein, 18 aa, Entamoeba histolytica
CGSCYSFGSLAAIESRLL

SEQ ID NO: 2740879 - protein, 18 aa, Entamoeba histolytica
CGSEICLFEDFVKYYGKI

SEQ ID NO: 2740880 - protein, 18 aa, Entamoeba histolytica
CLLELTLAVYPTGCKKKG

SEQ ID NO: 2740881 - protein, 18 aa, Entamoeba histolytica
CLTVSLAYEDDVFVDNVD

SEQ ID NO: 2740882 - protein, 19 aa, Entamoeba histolytica
CPHCVRFSPIYSEFAVKMQ

SEQ ID NO: 2740883 - protein, 21 aa, Entamoeba histolytica
CTSNQCILCLDGIINENGICV

SEQ ID NO: 2740884 - protein, 22 aa, Entamoeba histolytica
CWIVSFILPSWIELKWSNEGIC

SEQ ID NO: 2740885 - protein, 18 aa, Entamoeba histolytica
CYSLAFKIAKYAANLFDP

SEQ ID NO: 2740886 - protein, 24 aa, Entamoeba histolytica
DDAVAESLFAEFDDEDLLDSDEGL

SEQ ID NO: 2740887 - protein, 18 aa, Entamoeba histolytica
DEDDEFELEDDDEDDDEE

SEQ ID NO: 2740888 - protein, 17 aa, Entamoeba histolytica
DGGFFPTCYDWYTGKIS

SEQ ID NO: 2740889 - protein, 18 aa, Entamoeba histolytica
DKACGKYVSVGYDYLAVK

SEQ ID NO: 2740890 - protein, 18 aa, Entamoeba histolytica
DKCGGKGKIYGKVCHVCN

SEQ ID NO: 2740891 - protein, 18 aa, Entamoeba histolytica
DLWEGYLYFRGFKCNTAQ

SEQ ID NO: 2740892 - protein, 24 aa, Entamoeba histolytica
DTLFPLRHAWTFTAVFLPGAIPRS

SEQ ID NO: 2740893 - protein, 20 aa, Entamoeba histolytica
DTLFQHGWGFLRINSAQSTS

SEQ ID NO: 2740894 - protein, 23 aa, Entamoeba histolytica
EEEYELTQEWSEQAKSEVHPLDK

SEQ ID NO: 2740895 - protein, 21 aa, Entamoeba histolytica
EEKRLKLAVHGKLPGQKADLI

SEQ ID NO: 2740896 - protein, 17 aa, Entamoeba histolytica
EELKKFKIVIAIPPMFI

SEQ ID NO: 2740897 - protein, 18 aa, Entamoeba histolytica
EENAKCVLYGDGKTIKVY

SEQ ID NO: 2740898 - protein, 31 aa, Entamoeba histolytica
EFCGHYMFPYCILNKHLPFWGGYVGSHFEIE

SEQ ID NO: 2740899 - protein, 22 aa, Entamoeba histolytica
EFYKLMKRRYWKECCNCSCCKH

SEQ ID NO: 2740900 - protein, 20 aa, Entamoeba histolytica
EGIRWSQKVLRRIAIEMREE

SEQ ID NO: 2740901 - protein, 22 aa, Entamoeba histolytica
EGPYQYNPCVWLDQTTWFNKKN

SEQ ID NO: 2740902 - protein, 19 aa, Entamoeba histolytica
EKCKTCCRVIFASDYNYKT

SEQ ID NO: 2740903 - protein, 17 aa, Entamoeba histolytica
EKCVKKRDEFGVLRNKC

SEQ ID NO: 2740904 - protein, 23 aa, Entamoeba histolytica
EPCNYPSQLEWRGWKHVTYVETN

SEQ ID NO: 2740905 - protein, 20 aa, Entamoeba histolytica
EQRQAVKIVRVYEKQQHKKE

SEQ ID NO: 2740906 - protein, 26 aa, Entamoeba histolytica
ERRDMLWKKRCIRFRKTANMKQNEEL

SEQ ID NO: 2740907 - protein, 19 aa, Entamoeba histolytica
EVHPLDKIESAERLLAELA

SEQ ID NO: 2740908 - protein, 23 aa, Entamoeba histolytica
EYGKALGVTIEYCRFHWPYFMFK

SEQ ID NO: 2740909 - protein, 21 aa, Entamoeba histolytica
FACCVGMKCVLSFPRKKTRNV

SEQ ID NO: 2740910 - protein, 19 aa, Entamoeba histolytica
FALFLTVHAEEEFELDDDF

SEQ ID NO: 2740911 - protein, 46 aa, Entamoeba histolytica
FALFLTVHAEEEFELDDDFEINNEDFDFNDDEYELEDDEEDDDDDE

SEQ ID NO: 2740912 - protein, 35 aa, Entamoeba histolytica
FALLLTVHAEEDSFDLDENVEMEHEYQLEDNELEE

SEQ ID NO: 2740913 - protein, 36 aa, Entamoeba histolytica
FALLLTVHAEEDSFDLDENVEMEHEYQLEDNELEED

SEQ ID NO: 2740914 - protein, 19 aa, Entamoeba histolytica
FARSSMWGSMDYKGLNVRD

SEQ ID NO: 2740915 - protein, 22 aa, Entamoeba histolytica
FDQRIALFLVEICKRKFKKDPS

SEQ ID NO: 2740916 - protein, 18 aa, Entamoeba histolytica
FEQGIDCGGGYIKLLPKK

SEQ ID NO: 2740917 - protein, 17 aa, Entamoeba histolytica
FFLGYPLFGATSEYNLL

SEQ ID NO: 2740918 - protein, 18 aa, Entamoeba histolytica
FIFRCWRSLGSWDPNAKG

SEQ ID NO: 2740919 - protein, 17 aa, Entamoeba histolytica
FIKNDYCAYSFLTYSSF

SEQ ID NO: 2740920 - protein, 17 aa, Entamoeba histolytica
FLCVAFAYVPRTLSVIE

SEQ ID NO: 2740921 - protein, 20 aa, Entamoeba histolytica
FNHQLPIFWYFSAKHNQTEH

SEQ ID NO: 2740922 - protein, 19 aa, Entamoeba histolytica
FPTILFHRAHLRDRTFDED

SEQ ID NO: 2740923 - protein, 19 aa, Entamoeba histolytica
FRINLLLSKCHGFSNFYIL

SEQ ID NO: 2740924 - protein, 19 aa, Entamoeba histolytica
FRKFYRLRVSTFEYNINNY

SEQ ID NO: 2740925 - protein, 18 aa, Entamoeba histolytica
FSKLTWLLAQGMTPDEVR

SEQ ID NO: 2740926 - protein, 33 aa, Entamoeba histolytica
FSLFLAAYAEENFDLDNNVEVEEEYELENNYNN

SEQ ID NO: 2740927 - protein, 21 aa, Entamoeba histolytica
FTNKQGYEWYRFMSKISPVLT

SEQ ID NO: 2740928 - protein, 25 aa, Entamoeba histolytica
FVKKAECPEMVMARLAQKAHLSPVI

SEQ ID NO: 2740929 - protein, 21 aa, Entamoeba histolytica
FYDYWCPFGREFSKYLEKVAK

SEQ ID NO: 2740930 - protein, 20 aa, Entamoeba histolytica
GAKFPLDWICKINSLSNNKH

SEQ ID NO: 2740931 - protein, 24 aa, Entamoeba histolytica
GEEMWKCGLCENGTMYKCGNKTMN

SEQ ID NO: 2740932 - protein, 17 aa, Entamoeba histolytica
GEINWFYSFPFLYDKIL

SEQ ID NO: 2740933 - protein, 20 aa, Entamoeba histolytica
GEKFFNKWCDVYHKEINTRR

SEQ ID NO: 2740934 - protein, 19 aa, Entamoeba histolytica
GGCYAMALAQVLQAHYTHL

SEQ ID NO: 2740935 - protein, 17 aa, Entamoeba histolytica
GGLMFYKFLDYVGKEFA

SEQ ID NO: 2740936 - protein, 18 aa, Entamoeba histolytica
GGLMFYKFLDYVGKEFAD

SEQ ID NO: 2740937 - protein, 17 aa, Entamoeba histolytica
GHCKRLAPTYEEVAQAF

SEQ ID NO: 2740938 - protein, 23 aa, Entamoeba histolytica
GKDWYKKRMQWLSKVGPGLDEES

SEQ ID NO: 2740939 - protein, 24 aa, Entamoeba histolytica
GKFDYKASNAWRVTGDGFISNKYG

SEQ ID NO: 2740940 - protein, 18 aa, Entamoeba histolytica
GKKWKQQYIYSISKDGEL

SEQ ID NO: 2740941 - protein, 21 aa, Entamoeba histolytica
GKLCERCFALAKTIRSAVFEK

SEQ ID NO: 2740942 - protein, 18 aa, Entamoeba histolytica
GNKYPLKNYEVWSMDDEE

SEQ ID NO: 2740943 - protein, 17 aa, Entamoeba histolytica
HFKIDWDTLCGINGIDH

SEQ ID NO: 2740944 - protein, 17 aa, Entamoeba histolytica
HRMVVDWLKKEFEDAKA

SEQ ID NO: 2740945 - protein, 28 aa, Entamoeba histolytica
IAMFLTLAFAVEEDATLDNKETENNDEL

SEQ ID NO: 2740946 - protein, 17 aa, Entamoeba histolytica
ICFCAFAEEDLFNPFIH

SEQ ID NO: 2740947 - protein, 20 aa, Entamoeba histolytica
IDFGSACFENYTLYSYIQSR

SEQ ID NO: 2740948 - protein, 18 aa, Entamoeba histolytica
IDVPRLATKIIIKKSDKI

SEQ ID NO: 2740949 - protein, 17 aa, Entamoeba histolytica
IELYMLLSVGDLENLNE

SEQ ID NO: 2740950 - protein, 19 aa, Entamoeba histolytica
IENLPVYTLWYFYQGTIPK

SEQ ID NO: 2740951 - protein, 23 aa, Entamoeba histolytica
IERRLKVMIKRAVIARLNSAKTA

SEQ ID NO: 2740952 - protein, 23 aa, Entamoeba histolytica
IEYCRFHWPYFMFKQVSKTRIIW

SEQ ID NO: 2740953 - protein, 17 aa, Entamoeba histolytica
IFYKGCSGLLIPKIEQC

SEQ ID NO: 2740954 - protein, 18 aa, Entamoeba histolytica
IIEYAPWINRIFLVTDGE

SEQ ID NO: 2740955 - protein, 20 aa, Entamoeba histolytica
IIRKEEKGITGVVEEKNNKE

SEQ ID NO: 2740956 - protein, 18 aa, Entamoeba histolytica
IKLIYKYCLHIYLQKIDL

SEQ ID NO: 2740957 - protein, 18 aa, Entamoeba histolytica
IKRWLVICKTELIFKKNM

SEQ ID NO: 2740958 - protein, 26 aa, Entamoeba histolytica
IKSKEYKRMYKLYKVHFKSVNEIAEE

SEQ ID NO: 2740959 - protein, 19 aa, Entamoeba histolytica
IKTLKWPTYKRHFYLPYRL

SEQ ID NO: 2740960 - protein, 17 aa, Entamoeba histolytica
ILRRYGGVHHRADENFY

SEQ ID NO: 2740961 - protein, 22 aa, Entamoeba histolytica
INRLRIKVAIFKRKIDKCKNSP

SEQ ID NO: 2740962 - protein, 17 aa, Entamoeba histolytica
IPCSGIIHINDKTKTTS

SEQ ID NO: 2740963 - protein, 17 aa, Entamoeba histolytica
IQLLRYAALRGILIYPE

SEQ ID NO: 2740964 - protein, 21 aa, Entamoeba histolytica
ISFRYDWRTLLAVIRMHLPPI

SEQ ID NO: 2740965 - protein, 23 aa, Entamoeba histolytica
ISKVWKKKWASFMDKKLLKYLSK

SEQ ID NO: 2740966 - protein, 17 aa, Entamoeba histolytica
KCGVCSPSSMPSSPDKT

SEQ ID NO: 2740967 - protein, 18 aa, Entamoeba histolytica
KCGVCSPSSMPSSPDKTI

SEQ ID NO: 2740968 - protein, 18 aa, Entamoeba histolytica
KCGVCSPSSMPSSSDETI

SEQ ID NO: 2740969 - protein, 18 aa, Entamoeba histolytica
KEIIKIVVIGSVKPKFMF

SEQ ID NO: 2740970 - protein, 17 aa, Entamoeba histolytica
KEILKWFDDIDESFKQI

SEQ ID NO: 2740971 - protein, 25 aa, Entamoeba histolytica
KELKSFIPNCCQVHFVQYFLPSSQL

SEQ ID NO: 2740972 - protein, 18 aa, Entamoeba histolytica
KFSGVKVKWIPKVKTSVA

SEQ ID NO: 2740973 - protein, 22 aa, Entamoeba histolytica
KGCAPFCGVCPFGYSCNQAARC

SEQ ID NO: 2740974 - protein, 19 aa, Entamoeba histolytica
KGRCAICSDGYFLNKNGSC

SEQ ID NO: 2740975 - protein, 25 aa, Entamoeba histolytica
KGSRPSGLCQLRWNGNGYTQNLIQG

SEQ ID NO: 2740976 - protein, 19 aa, Entamoeba histolytica
KGTKWLAKNGEAISNTLGK

SEQ ID NO: 2740977 - protein, 26 aa, Entamoeba histolytica
KHVIKRRGCPCIHKVPDVPCKCSSIK

SEQ ID NO: 2740978 - protein, 19 aa, Entamoeba histolytica
KIDFCCIKLIYKYCLHIYL

SEQ ID NO: 2740979 - protein, 19 aa, Entamoeba histolytica
KIDIGISFPDFYSSVQLTE

SEQ ID NO: 2740980 - protein, 20 aa, Entamoeba histolytica
KIESAERLLAELANHPYHGM

SEQ ID NO: 2740981 - protein, 18 aa, Entamoeba histolytica
KKERCPRNSDELANASPE

SEQ ID NO: 2740982 - protein, 19 aa, Entamoeba histolytica
KKLTEKWVHLACTDKKIVE

SEQ ID NO: 2740983 - protein, 18 aa, Entamoeba histolytica
KKMKMMKMMMMKKTMKKM

SEQ ID NO: 2740984 - protein, 23 aa, Entamoeba histolytica
KKWWKVMIENVISFCIQFIIKHQ

SEQ ID NO: 2740985 - protein, 19 aa, Entamoeba histolytica
KMILKRSGMNAIIIVDNEI

SEQ ID NO: 2740986 - protein, 19 aa, Entamoeba histolytica
KNNKCSKCSFWYGTNEEGN

SEQ ID NO: 2740987 - protein, 18 aa, Entamoeba histolytica
KQHKIMYNLYKAELKGEV

SEQ ID NO: 2740988 - protein, 21 aa, Entamoeba histolytica
KQYKIKDFVPIDWYINSPYLD

SEQ ID NO: 2740989 - protein, 21 aa, Entamoeba histolytica
KRLRPLSLLLFFIGGGGKIEE

SEQ ID NO: 2740990 - protein, 21 aa, Entamoeba histolytica
KTMMKKTMMKKMKMMKMMMMK

SEQ ID NO: 2740991 - protein, 24 aa, Entamoeba histolytica
KTTNLCGIGWRIGDYVYPLNMIVY

SEQ ID NO: 2740992 - protein, 20 aa, Entamoeba histolytica
KVKNLQRVVSWMKKKLETRK

SEQ ID NO: 2740993 - protein, 17 aa, Entamoeba histolytica
KYLDPIRTCFGRLKNSY

SEQ ID NO: 2740994 - protein, 24 aa, Entamoeba histolytica
LAFAWRPNPSYGLTNFKDMITTWC

SEQ ID NO: 2740995 - protein, 17 aa, Entamoeba histolytica
LCLLRLISMRLFSQNVI

SEQ ID NO: 2740996 - protein, 21 aa, Entamoeba histolytica
LEDDDFDYDDDDDFELEEDEE

SEQ ID NO: 2740997 - protein, 18 aa, Entamoeba histolytica
LIAFAFAEENELDNTFDI

SEQ ID NO: 2740998 - protein, 19 aa, Entamoeba histolytica
LIECGGIVLQECKTDTTTY

SEQ ID NO: 2740999 - protein, 21 aa, Entamoeba histolytica
LKAIKTAVNFARLGEVKMLES

SEQ ID NO: 2741000 - protein, 21 aa, Entamoeba histolytica
LKEFRLRRTIAIILKQMATVL

SEQ ID NO: 2741001 - protein, 19 aa, Entamoeba histolytica
LKFQWWFPLVERLDAKDLQ

SEQ ID NO: 2741002 - protein, 21 aa, Entamoeba histolytica
LKGKQWRNARVKVANKIDKTK

SEQ ID NO: 2741003 - protein, 23 aa, Entamoeba histolytica
LKQMLRLYVRRVFVSGDFYTTLP

SEQ ID NO: 2741004 - protein, 24 aa, Entamoeba histolytica
LLFEIPKKYPIVWYFDKNITEQIK

SEQ ID NO: 2741005 - protein, 19 aa, Entamoeba histolytica
LNNEFYYLLCKDIFNVDKQ

SEQ ID NO: 2741006 - protein, 18 aa, Entamoeba histolytica
LPGGIDWSTPITLKEFEE

SEQ ID NO: 2741007 - protein, 20 aa, Entamoeba histolytica
LPKKRREFYKLMKRRYWKEC

SEQ ID NO: 2741008 - protein, 22 aa, Entamoeba histolytica
LPRREAIRLARRFDLRHRFDFA

SEQ ID NO: 2741009 - protein, 23 aa, Entamoeba histolytica
LPTGCYCTYSLISKQECIFDCEN

SEQ ID NO: 2741010 - protein, 21 aa, Entamoeba histolytica
LQSLEWCKLPGFAKVVKDLGK

SEQ ID NO: 2741011 - protein, 31 aa, Entamoeba histolytica
LQWKFANPAIKGWGCCFLAACYIGGLNTYEQ

SEQ ID NO: 2741012 - protein, 17 aa, Entamoeba histolytica
LRGNIAIFRSQEKYQNK

SEQ ID NO: 2741013 - protein, 20 aa, Entamoeba histolytica
LRLKKRLNKMVSIAKECEKK

SEQ ID NO: 2741014 - protein, 18 aa, Entamoeba histolytica
LSALPVIRPLFLNYPNDQ

SEQ ID NO: 2741015 - protein, 21 aa, Entamoeba histolytica
LSPHCWWGFYGKLLNRRQLNK

SEQ ID NO: 2741016 - protein, 17 aa, Entamoeba histolytica
LVFLCLYISFPLTITET

SEQ ID NO: 2741017 - protein, 21 aa, Entamoeba histolytica
LVQLYFKVIFNYLRSEKSIIN

SEQ ID NO: 2741018 - protein, 24 aa, Entamoeba histolytica
LWPEIPWKKITGIWRKFISHLEEL

SEQ ID NO: 2741019 - protein, 24 aa, Entamoeba histolytica
LYDGLKSQCWFKALQSCGCCKTCM

SEQ ID NO: 2741020 - protein, 23 aa, Entamoeba histolytica
LYLKTQCLFLFFSLNIITDNFIV

SEQ ID NO: 2741021 - protein, 18 aa, Entamoeba histolytica
MGKMKRCLPIWKQDLPSL

SEQ ID NO: 2741022 - protein, 18 aa, Entamoeba histolytica
MKCVLSFPRKKTRNVTTF

SEQ ID NO: 2741023 - protein, 18 aa, Entamoeba histolytica
MLSFKIDIGISFPDFYSS

SEQ ID NO: 2741024 - protein, 17 aa, Entamoeba histolytica
MREVIKVLPKREQYRLL

SEQ ID NO: 2741025 - protein, 22 aa, Entamoeba histolytica
MSKICSVSGCVSLGLSEINEIG

SEQ ID NO: 2741026 - protein, 17 aa, Entamoeba histolytica
NEIHGSLNYKSKDGKFD

SEQ ID NO: 2741027 - protein, 25 aa, Entamoeba histolytica
NEKDWRYGIKAQHQFNDKWSGSLEV

SEQ ID NO: 2741028 - protein, 22 aa, Entamoeba histolytica
NELDNTFDIDFTELDNVELFEE

SEQ ID NO: 2741029 - protein, 22 aa, Entamoeba histolytica
NESRIKLTLIRESKFGSPLPPL

SEQ ID NO: 2741030 - protein, 19 aa, Entamoeba histolytica
NGKTPVCWEEVYQKGSADK

SEQ ID NO: 2741031 - protein, 29 aa, Entamoeba histolytica
NKHKIMYKIYKLQLKGEEGITKTPSVQST

SEQ ID NO: 2741032 - protein, 17 aa, Entamoeba histolytica
NKWRAKYGWVFDKDCKD

SEQ ID NO: 2741033 - protein, 23 aa, Entamoeba histolytica
NLHTFHSMFIFLLIIVITNATES

SEQ ID NO: 2741034 - protein, 24 aa, Entamoeba histolytica
NNILSFKLKPTWSINKNIQLNIIS

SEQ ID NO: 2741035 - protein, 22 aa, Entamoeba histolytica
NPALCLRTSLKLSTVAFQEKNK

SEQ ID NO: 2741036 - protein, 19 aa, Entamoeba histolytica
NPDNKWGIGIDGDISNKNG

SEQ ID NO: 2741037 - protein, 18 aa, Entamoeba histolytica
NQLFRLKHRMFRVEEKIR

SEQ ID NO: 2741038 - protein, 18 aa, Entamoeba histolytica
NRCYKCFDGYHIHHGECE

SEQ ID NO: 2741039 - protein, 17 aa, Entamoeba histolytica
NRHCILFTYDITKRETL

SEQ ID NO: 2741040 - protein, 18 aa, Entamoeba histolytica
NSEKCFLCFDNYIVSGTK

SEQ ID NO: 2741041 - protein, 19 aa, Entamoeba histolytica
NSFTRRIEVTGGQIEVNNK

SEQ ID NO: 2741042 - protein, 19 aa, Entamoeba histolytica
NSIGLCWSRSFDIDDIFNY

SEQ ID NO: 2741043 - protein, 17 aa, Entamoeba histolytica
NSNAISFRYDWRTLLAV

SEQ ID NO: 2741044 - protein, 21 aa, Entamoeba histolytica
NSWGSFWGMDGYILMSRNKNN

SEQ ID NO: 2741045 - protein, 22 aa, Entamoeba histolytica
NTLLDWIRIVLAVRASKNGKEF

SEQ ID NO: 2741046 - protein, 24 aa, Entamoeba histolytica
NWAQYRFNSIDGWTCKYTADNIDP

SEQ ID NO: 2741047 - protein, 18 aa, Entamoeba histolytica
NWGGWPFEDLMKGMDYLK

SEQ ID NO: 2741048 - protein, 21 aa, Entamoeba histolytica
PEKWVIPSLRKNSMQFGSIIQ

SEQ ID NO: 2741049 - protein, 21 aa, Entamoeba histolytica
PEVLNGLPFTKSGDVFSFAIA

SEQ ID NO: 2741050 - protein, 18 aa, Entamoeba histolytica
PFNIKSFYGMMKRKENSD

SEQ ID NO: 2741051 - protein, 20 aa, Entamoeba histolytica
PGRFADACAVGYYDDTIQTT

SEQ ID NO: 2741052 - protein, 21 aa, Entamoeba histolytica
PIKKCCIHPNLIIMTDHFHTI

SEQ ID NO: 2741053 - protein, 22 aa, Entamoeba histolytica
PKEFLYCYSAYFGQLYQQYHNY

SEQ ID NO: 2741054 - protein, 17 aa, Entamoeba histolytica
PKIAIGLLPQGKKMKSL

SEQ ID NO: 2741055 - protein, 24 aa, Entamoeba histolytica
PKQHKRMYNGYNIQLKGEVSQEPT

SEQ ID NO: 2741056 - protein, 20 aa, Entamoeba histolytica
PLARLDAGWFLRDILSFQQM

SEQ ID NO: 2741057 - protein, 17 aa, Entamoeba histolytica
PLFRRIENLPVYTLWYF

SEQ ID NO: 2741058 - protein, 18 aa, Entamoeba histolytica
PNKNFTFGISGSKENKYG

SEQ ID NO: 2741059 - protein, 19 aa, Entamoeba histolytica
PREGWNWKLQILEIANAPM

SEQ ID NO: 2741060 - protein, 18 aa, Entamoeba histolytica
PSDFFLKAIRSFESSYGM

SEQ ID NO: 2741061 - protein, 18 aa, Entamoeba histolytica
PSYSKHFYLPFSNNNLCY

SEQ ID NO: 2741062 - protein, 22 aa, Entamoeba histolytica
QEPFCWSESVFADVVHKNLPDR

SEQ ID NO: 2741063 - protein, 25 aa, Entamoeba histolytica
QGNFSYKANNNWTFTGNGKANNQYG

SEQ ID NO: 2741064 - protein, 20 aa, Entamoeba histolytica
QIVHPILRRYGGVHHRADEN

SEQ ID NO: 2741065 - protein, 17 aa, Entamoeba histolytica
QMLPYWYSLWYYHRVDY

SEQ ID NO: 2741066 - protein, 21 aa, Entamoeba histolytica
QNCGGCWAVSLANLAQYLYSN

SEQ ID NO: 2741067 - protein, 18 aa, Entamoeba histolytica
QQRYGFKCIYVLVESSVR

SEQ ID NO: 2741068 - protein, 25 aa, Entamoeba histolytica
QSKQHKRMFNLHKVQLKGEVTKEPE

SEQ ID NO: 2741069 - protein, 23 aa, Entamoeba histolytica
QSKQHKRMFNLYDIQLKGENEEA

SEQ ID NO: 2741070 - protein, 20 aa, Entamoeba histolytica
RAKCKTCCRVIFASDYNYET

SEQ ID NO: 2741071 - protein, 22 aa, Entamoeba histolytica
RAKCKTCCRVIFASDYNYKTEK

SEQ ID NO: 2741072 - protein, 24 aa, Entamoeba histolytica
RIDYPLKVCAMINCAKREILNTNC

SEQ ID NO: 2741073 - protein, 17 aa, Entamoeba histolytica
RKFKGKIFAIIESDEDM

SEQ ID NO: 2741074 - protein, 20 aa, Entamoeba histolytica
RLATAHARASIAIRSVEKIE

SEQ ID NO: 2741075 - protein, 17 aa, Entamoeba histolytica
RLLGKVAGSSLSYNEII

SEQ ID NO: 2741076 - protein, 22 aa, Entamoeba histolytica
RLPFQIKEGWGMTRINQSLGIS

SEQ ID NO: 2741077 - protein, 17 aa, Entamoeba histolytica
RNAVNWRQYQVLFNHFS

SEQ ID NO: 2741078 - protein, 17 aa, Entamoeba histolytica
RQNSLRLLGKVAGSSLS

SEQ ID NO: 2741079 - protein, 18 aa, Entamoeba histolytica
RTQYNPCVWNFLDLPDCE

SEQ ID NO: 2741080 - protein, 17 aa, Entamoeba histolytica
SCGNMAGQVRTFWQKVG

SEQ ID NO: 2741081 - protein, 17 aa, Entamoeba histolytica
SDIPCSGIIHINDKTKT

SEQ ID NO: 2741082 - protein, 17 aa, Entamoeba histolytica
SKGRTAIIIAHRLSTIQ

SEQ ID NO: 2741083 - protein, 19 aa, Entamoeba histolytica
SKNGLEYSAGVNYDLGKNS

SEQ ID NO: 2741084 - protein, 19 aa, Entamoeba histolytica
SLYRWRTVGLYDRNEVQIK

SEQ ID NO: 2741085 - protein, 23 aa, Entamoeba histolytica
SSNSRPSTLFSFFKRFTSMQYLY

SEQ ID NO: 2741086 - protein, 17 aa, Entamoeba histolytica
STLFALRVNPLFRNDND

SEQ ID NO: 2741087 - protein, 18 aa, Entamoeba histolytica
TAPYPGIILLSGDLAGHY

SEQ ID NO: 2741088 - protein, 23 aa, Entamoeba histolytica
TCPCSGDKCIIDFSATTSVIYKL

SEQ ID NO: 2741089 - protein, 18 aa, Entamoeba histolytica
TDHIKFIWCYGTDSGSAL

SEQ ID NO: 2741090 - protein, 23 aa, Entamoeba histolytica
TGRFKCIICHDGIMDSEGSYYYM

SEQ ID NO: 2741091 - protein, 26 aa, Entamoeba histolytica
TIEIKEIPDYVGTFSFGIDDDTCSHR

SEQ ID NO: 2741092 - protein, 20 aa, Entamoeba histolytica
TINGCFWKKFKIPWRNVAVA

SEQ ID NO: 2741093 - protein, 26 aa, Entamoeba histolytica
TLDNKETENNDELNIEDNDDEEYDDD

SEQ ID NO: 2741094 - protein, 17 aa, Entamoeba histolytica
TLVKFFVPWCGHCNSLK

SEQ ID NO: 2741095 - protein, 23 aa, Entamoeba histolytica
TLYLRWLQIQTFFPLFRGNGEIN

SEQ ID NO: 2741096 - protein, 22 aa, Entamoeba histolytica
TNCLKCLNGVCIQCKDNYFLDN

SEQ ID NO: 2741097 - protein, 19 aa, Entamoeba histolytica
TPVELVFPFSTNPRIRNAQ

SEQ ID NO: 2741098 - protein, 19 aa, Entamoeba histolytica
VAKELKISYFGGGTVVMAA

SEQ ID NO: 2741099 - protein, 19 aa, Entamoeba histolytica
VHAEEEFELDDDFEINNED

SEQ ID NO: 2741100 - protein, 17 aa, Entamoeba histolytica
VIHRMVVDWLKKEFEDA

SEQ ID NO: 2741101 - protein, 22 aa, Entamoeba histolytica
VKSRLEIFGSKIIFYKNTQVKN

SEQ ID NO: 2741102 - protein, 23 aa, Entamoeba histolytica
VSQLPVKFIIPWEALTPAKDQGS

SEQ ID NO: 2741103 - protein, 18 aa, Entamoeba histolytica
VSSLGMKWLSWVLKKSVI

SEQ ID NO: 2741104 - protein, 19 aa, Entamoeba histolytica
WCGHCKHLAPEFASAAKEV

SEQ ID NO: 2741105 - protein, 17 aa, Entamoeba histolytica
WDIPGSILMEMDETIMR

SEQ ID NO: 2741106 - protein, 17 aa, Entamoeba histolytica
WHYRNWWLRRHWMRNWK

SEQ ID NO: 2741107 - protein, 34 aa, Entamoeba histolytica
WIFLTFCLFLGASSSSNSYSYSSSSSSSSSSSSS

SEQ ID NO: 2741108 - protein, 20 aa, Entamoeba histolytica
WRAKYGWVFDKDCKDCNFPK

SEQ ID NO: 2741109 - protein, 18 aa, Entamoeba histolytica
WRTLLAVIRMHLPPIEYF

SEQ ID NO: 2741110 - protein, 17 aa, Entamoeba histolytica
WYCNIVIHILEFNKVEP

SEQ ID NO: 2741111 - protein, 18 aa, Entamoeba histolytica
YDWAVANKRIRGSDCYVY

SEQ ID NO: 2741112 - protein, 25 aa, Entamoeba histolytica
YEHCSLCSSSECLKCEKGYGIDEEG

SEQ ID NO: 2741113 - protein, 18 aa, Entamoeba histolytica
YFRRYPWRRYRFWRKHHH

SEQ ID NO: 2741114 - protein, 18 aa, Entamoeba histolytica
YGANPLLFCFGNFFDEFR

SEQ ID NO: 2741115 - protein, 24 aa, Entamoeba histolytica
YKCGMKAHLCCLGKMFSENTHTLI

SEQ ID NO: 2741116 - protein, 20 aa, Entamoeba histolytica
YNLYKAELKGEVTTQITDEV

SEQ ID NO: 2741117 - protein, 17 aa, Entamoeba histolytica
YPKHFYLPFSNNNLCYQ

SEQ ID NO: 2741118 - protein, 19 aa, Entamoeba histolytica
YPLFIQWGYKILGFFIFKS

SEQ ID NO: 2741119 - protein, 25 aa, Entamoeba histolytica
YQQRYGFKCIFVFGESSAKQLEQYN

SEQ ID NO: 2741120 - protein, 27 aa, Entamoeba histolytica
YSNKHKRIYNRYGIYLKGEAEVTEPTI

SEQ ID NO: 2741121 - protein, 25 aa, Entamoeba histolytica
YSPFKRSCVIQNRINTITAQTKAIH

SEQ ID NO: 2741122 - protein, 17 aa, Entamoeba histolytica
YYCLCLMEFLVVKVKGF

SEQ ID NO: 2741123 - protein, 27 aa, Entamoeba histolytica
YYECATTFKGFRPCASGTWCQGEQEGP

SEQ ID NO: 2741124 - protein, 23 aa, Entamoeba histolytica
AGKISGVHWWYNDQSHAAEMTAG

SEQ ID NO: 2741125 - protein, 23 aa, Entamoeba histolytica
GETRYPSYPLSRWSYCGVGEFQC

SEQ ID NO: 2741126 - protein, 27 aa, Entamoeba histolytica
NADIVLFAHPVFWLSIPGEVKNFIDRM

SEQ ID NO: 2741127 - protein, 23 aa, Entamoeba histolytica
QHGLTAFTYLRMTRGLLDDGNAW

SEQ ID NO: 2741128 - protein, 25 aa, Entamoeba histolytica
GGVAGVMADVWWGLVETSPRNYNWN

SEQ ID NO: 2741129 - protein, 32 aa, Entamoeba histolytica; identical to SEQ ID NO: 2518671

SEQ ID NO: 2741130 - protein, 18 aa, Entamoeba histolytica
CMYLVSSLELVDGECKGR

SEQ ID NO: 2741131 - protein, 25 aa, Entamoeba histolytica
DGCSACMSGYYLKDGKCQIPPNSLC

SEQ ID NO: 2741132 - protein, 17 aa, Entamoeba histolytica
ECFCEMYGIPYSSVYLF

SEQ ID NO: 2741133 - protein, 17 aa, Entamoeba histolytica
IIALSYAKVLDAETLVK

SEQ ID NO: 2741134 - protein, 18 aa, Entamoeba histolytica
AIINAMRGWMGLGSISAK

SEQ ID NO: 2741135 - protein, 29 aa, Entamoeba histolytica
DGYGECDGHKFLWVRSSWGNDWGVENGHF

SEQ ID NO: 2741136 - protein, 17 aa, Entamoeba histolytica
DVDDFELEDEEEDDMTT

SEQ ID NO: 2741137 - protein, 24 aa, Entamoeba histolytica
EAENSIVIELRKLIRKSIERITVV

SEQ ID NO: 2741138 - protein, 18 aa, Entamoeba histolytica
EIRRYVQETLVRAHSGWA

SEQ ID NO: 2741139 - protein, 24 aa, Entamoeba histolytica
FALLLTVHAEEDSFDLDENVEMEH

SEQ ID NO: 2741140 - protein, 29 aa, Entamoeba histolytica
FSKLRHQAKAEYRALYRQCTKKIIKVLLN

SEQ ID NO: 2741141 - protein, 18 aa, Entamoeba histolytica
GMNALWMTPIFNSNGGSQ

SEQ ID NO: 2741142 - protein, 25 aa, Entamoeba histolytica
HSNNAEWLGVLKPTVSLISCGHGNL

SEQ ID NO: 2741143 - protein, 32 aa, Entamoeba histolytica
IANQKQMFKILKNKIIQLIYKLRQTQDAKQKV

SEQ ID NO: 2741144 - protein, 19 aa, Entamoeba histolytica
ILFFSLSSAYIWEFDPNKL

SEQ ID NO: 2741145 - protein, 25 aa, Entamoeba histolytica
INGIKQLNLELLKYALKELDIAAKQ

SEQ ID NO: 2741146 - protein, 24 aa, Entamoeba histolytica
KAERKEIAILKTARALLKQMRRKG

SEQ ID NO: 2741147 - protein, 18 aa, Entamoeba histolytica
KKKLACSSLISINKKYQQ

SEQ ID NO: 2741148 - protein, 24 aa, Entamoeba histolytica
KNDPYQYYCLLYKILNTEAVIVLP

SEQ ID NO: 2741149 - protein, 28 aa, Entamoeba histolytica
KSNKEACGLILFVGWKGQAKARYLKSYL

SEQ ID NO: 2741150 - protein, 18 aa, Entamoeba histolytica
KVHKYHLKINAKLDKTIA

SEQ ID NO: 2741151 - protein, 21 aa, Entamoeba histolytica
LEIDYPLKFATSNKFTHFANK

SEQ ID NO: 2741152 - protein, 17 aa, Entamoeba histolytica
LFISLCFAETLKQKKKL

SEQ ID NO: 2741153 - protein, 18 aa, Entamoeba histolytica
LHSGILVLFYSDSGNETK

SEQ ID NO: 2741154 - protein, 17 aa, Entamoeba histolytica
NANKRLWRDMRISEMEA

SEQ ID NO: 2741155 - protein, 19 aa, Entamoeba histolytica
NGIFNAGYPDFAYPNMFIT

SEQ ID NO: 2741156 - protein, 24 aa, Entamoeba histolytica
NSCAVSYDYLLLVETWPGQFCHSK

SEQ ID NO: 2741157 - protein, 24 aa, Entamoeba histolytica
RDSHFLIYVYYDKGCKNLQYIFGK

SEQ ID NO: 2741158 - protein, 23 aa, Entamoeba histolytica
RHRAAIAFLAAYTGPITIYYGDE

SEQ ID NO: 2741159 - protein, 23 aa, Entamoeba histolytica
RSCFHFPGRYNLVQTLACEESGK

SEQ ID NO: 2741160 - protein, 25 aa, Entamoeba histolytica
RTDRNWTHRLLLSSYTLIDGANGND

SEQ ID NO: 2741161 - protein, 22 aa, Entamoeba histolytica
SSLYHFEKHYKSMDKNHAMIKN

SEQ ID NO: 2741162 - protein, 20 aa, Entamoeba histolytica
TDSLLRYVGGIYKSESCTGK

SEQ ID NO: 2741163 - protein, 25 aa, Entamoeba histolytica
TVYKPNLILKVLGSFLPFSIYINDD

SEQ ID NO: 2741164 - protein, 19 aa, Entamoeba histolytica
VVFASAKEFYKYNYVGTGD

SEQ ID NO: 2741165 - protein, 25 aa, Entamoeba histolytica
YIDLEPLDFVWSIPAANLAPNYNKG

SEQ ID NO: 2741166 - protein, 17 aa, Entamoeba histolytica
YLNLPSHFSKYSLKGQF

SEQ ID NO: 2741167 - protein, 20 aa, Entamoeba histolytica
AAFDWRFISQPDSWKKDLVN

SEQ ID NO: 2741168 - protein, 31 aa, Entamoeba histolytica
AAGYIESYLTHQWIWIYWQNYKKNEYKHGIN

SEQ ID NO: 2741169 - protein, 19 aa, Entamoeba histolytica
AARKAFGTSLPLAAKVSGV

SEQ ID NO: 2741170 - protein, 19 aa, Entamoeba histolytica
ACIYCRKYFRQCAECDGMT

SEQ ID NO: 2741171 - protein, 20 aa, Entamoeba histolytica
ADKIREYMKIWNNQLKQLSG

SEQ ID NO: 2741172 - protein, 24 aa, Entamoeba histolytica
ADKYIDNWIAISTPFLGSGKAIAA

SEQ ID NO: 2741173 - protein, 21 aa, Entamoeba histolytica
ADLLSFAFEQWDKMTTTEEGR

SEQ ID NO: 2741174 - protein, 24 aa, Entamoeba histolytica
ADRDWKVFPDYLPPKYEAGTLNFL

SEQ ID NO: 2741175 - protein, 18 aa, Entamoeba histolytica
AETLVKLQKLSLGCHLNG

SEQ ID NO: 2741176 - protein, 17 aa, Entamoeba histolytica
AFNLELPVDKLFIQFKT

SEQ ID NO: 2741177 - protein, 17 aa, Entamoeba histolytica
AFNLKWMKSNIKGTWNR

SEQ ID NO: 2741178 - protein, 25 aa, Entamoeba histolytica
AGFRAYHDYFTLNYGRAFVLTSLDF

SEQ ID NO: 2741179 - protein, 20 aa, Entamoeba histolytica
AGKVAGIHWWYNDQSHAAEL

SEQ ID NO: 2741180 - protein, 25 aa, Entamoeba histolytica
AGKVASFVPIPQVKAAAGAIAAGAK

SEQ ID NO: 2741181 - protein, 21 aa, Entamoeba histolytica
AGLNVLRILNEPTAAAMAYGL

SEQ ID NO: 2741182 - protein, 26 aa, Entamoeba histolytica
AGNIKLLGINVFNELILEGSIIKSDN

SEQ ID NO: 2741183 - protein, 23 aa, Entamoeba histolytica
AGVSMGYSFPLAKKFFGIPEHAT

SEQ ID NO: 2741184 - protein, 28 aa, Entamoeba histolytica
AHLNVPEVVLVFGGLLLRGNRVTKTSAN

SEQ ID NO: 2741185 - protein, 27 aa, Entamoeba histolytica
AISFTDDCYLWYLHGVWNPITNKLENI

SEQ ID NO: 2741186 - protein, 19 aa, Entamoeba histolytica
AISSLPSFILQRPGYQKRF

SEQ ID NO: 2741187 - protein, 20 aa, Entamoeba histolytica
AITCALADQSAFYVKNYYEV

SEQ ID NO: 2741188 - protein, 23 aa, Entamoeba histolytica
AKAIKKVVTLEQKAFKKVVTGNQ

SEQ ID NO: 2741189 - protein, 17 aa, Entamoeba histolytica
AKCKTCCRVIFASDYNY

SEQ ID NO: 2741190 - protein, 25 aa, Entamoeba histolytica
AKSNGLISFTYLRMTRALLDDGTAW

SEQ ID NO: 2741191 - protein, 25 aa, Entamoeba histolytica
ALAKLDLRIELAKPFVLQQPKGPMV

SEQ ID NO: 2741192 - protein, 25 aa, Entamoeba histolytica
ALERLEIQKLKDQYYRLAALKERQK

SEQ ID NO: 2741193 - protein, 19 aa, Entamoeba histolytica
ALFLVYSEAVITFPHVISA

SEQ ID NO: 2741194 - protein, 17 aa, Entamoeba histolytica
ALIVYDITSRDSFEIVQ

SEQ ID NO: 2741195 - protein, 17 aa, Entamoeba histolytica
ALMSAIHKFGVLGIGLD

SEQ ID NO: 2741196 - protein, 21 aa, Entamoeba histolytica
ALSNFLAKQYLWWTNQCKTNS

SEQ ID NO: 2741197 - protein, 27 aa, Entamoeba histolytica
ALSNIPKDLFYILNGIYSLTKLKRNEE

SEQ ID NO: 2741198 - protein, 19 aa, Entamoeba histolytica
ALTAYYYYYTQTKKTDLLL

SEQ ID NO: 2741199 - protein, 32 aa, Entamoeba histolytica
ALVDKKLEWPTYKRHFYLPYRLDVDLCYQAKS

SEQ ID NO: 2741200 - protein, 18 aa, Entamoeba histolytica
AMKLMTLYDTQSLDFITS

SEQ ID NO: 2741201 - protein, 25 aa, Entamoeba histolytica
ANEGATLIIWPKNPPLSDAPGTRNQ

SEQ ID NO: 2741202 - protein, 30 aa, Entamoeba histolytica
ANGMYTKLNNEKDWRYGIKAQHQFNDKWSG

SEQ ID NO: 2741203 - protein, 22 aa, Entamoeba histolytica
ANKILFLDMMFPQTVDKIIFMD

SEQ ID NO: 2741204 - protein, 25 aa, Entamoeba histolytica
ANQKETLLILKKQAEIKNFALKNAK

SEQ ID NO: 2741205 - protein, 28 aa, Entamoeba histolytica
ANRAEYLYRFAVFLDNKKFVEANANTEL

SEQ ID NO: 2741206 - protein, 23 aa, Entamoeba histolytica
ANTQKNYFYIDPSKELPGLNLDY

SEQ ID NO: 2741207 - protein, 25 aa, Entamoeba histolytica
APATQAPIIIQGYSGSAAASSASSA

SEQ ID NO: 2741208 - protein, 23 aa, Entamoeba histolytica
APNTHLPLVLKFDKNKWKEQIKE

SEQ ID NO: 2741209 - protein, 33 aa, Entamoeba histolytica
APSCNKTIIITPVELVFPFSTNPRIRNAQILMN

SEQ ID NO: 2741210 - protein, 22 aa, Entamoeba histolytica
AQAFLQTFYPLERRKSVVDIEI

SEQ ID NO: 2741211 - protein, 19 aa, Entamoeba histolytica
AQFEKACSTFVFAILEEIP

SEQ ID NO: 2741212 - protein, 22 aa, Entamoeba histolytica
AQHLSTIYAYLTKQADNNKPKR

SEQ ID NO: 2741213 - protein, 24 aa, Entamoeba histolytica
AQSSGFWMPTLYRVQERLGEVAMR

SEQ ID NO: 2741214 - protein, 23 aa, Entamoeba histolytica
ARLDAGWFLRDILSFQQMKYEGK

SEQ ID NO: 2741215 - protein, 21 aa, Entamoeba histolytica
ARLRNMEIGKYFNILASHFSQ

SEQ ID NO: 2741216 - protein, 25 aa, Entamoeba histolytica
ASDYGKFFLEFYTQLMLNHTDRVII

SEQ ID NO: 2741217 - protein, 26 aa, Entamoeba histolytica
ASFSNALAWILLSKGYSLQLGINALK

SEQ ID NO: 2741218 - protein, 24 aa, Entamoeba histolytica
ASGRSWFFQTCIAYGYYQAVSEQS

SEQ ID NO: 2741219 - protein, 18 aa, Entamoeba histolytica
ASVKGRMKKIAKLAKKRV

SEQ ID NO: 2741220 - protein, 18 aa, Entamoeba histolytica
ASYDWRYYRYGEYKHKRN

SEQ ID NO: 2741221 - protein, 25 aa, Entamoeba histolytica
AVEALRRRAIFNMNAKFVAKFNKEH

SEQ ID NO: 2741222 - protein, 24 aa, Entamoeba histolytica
AVGKSCLLLQFQDKRFQPIHDLTI

SEQ ID NO: 2741223 - protein, 22 aa, Entamoeba histolytica
AVPWKSECYINYLSGIWNNQTN

SEQ ID NO: 2741224 - protein, 32 aa, Entamoeba histolytica
AVSLPVIIKEHLYFVSPIFFGMTVQDSLDLQK

SEQ ID NO: 2741225 - protein, 21 aa, Entamoeba histolytica
AWRYAAWIRKATNSYLVVVNY

SEQ ID NO: 2741226 - protein, 18 aa, Entamoeba histolytica
AYPKSQFQFPWSIADFVT

SEQ ID NO: 2741227 - protein, 23 aa, Entamoeba histolytica
CAPHITLYLTKFQETSIPIVVEK

SEQ ID NO: 2741228 - protein, 19 aa, Entamoeba histolytica
CCFVNVTSYDLFDELSDET

SEQ ID NO: 2741229 - protein, 22 aa, Entamoeba histolytica
CDMYDYWKFSGVKVKWIPKVKT

SEQ ID NO: 2741230 - protein, 24 aa, Entamoeba histolytica
CDQYIDKIITLNAPFIGSTKTLRT

SEQ ID NO: 2741231 - protein, 24 aa, Entamoeba histolytica
CEKYIEKIITISAPFIGTIKALRS

SEQ ID NO: 2741232 - protein, 17 aa, Entamoeba histolytica
CFHLVIDILSEKNIFVS

SEQ ID NO: 2741233 - protein, 17 aa, Entamoeba histolytica
CFIEYMKTYWNSSTSKM

SEQ ID NO: 2741234 - protein, 20 aa, Entamoeba histolytica
CFNLIRNNDIERITLIGSSG

SEQ ID NO: 2741235 - protein, 23 aa, Entamoeba histolytica
CGDPFVGKTCFFQRFSNGEFNAN

SEQ ID NO: 2741236 - protein, 25 aa, Entamoeba histolytica
CGKTIYNPCMWPFQGNTPDCDGKPG

SEQ ID NO: 2741237 - protein, 18 aa, Entamoeba histolytica
CGPLLFLLNTLYSGRYIP

SEQ ID NO: 2741238 - protein, 38 aa, Entamoeba histolytica; identical to SEQ ID NO: 2555728

SEQ ID NO: 2741239 - protein, 19 aa, Entamoeba histolytica
CILFVYTTAHSLEEDFEMD

SEQ ID NO: 2741240 - protein, 25 aa, Entamoeba histolytica
CILLVLDSFALSFNDDYSDFLDDAP

SEQ ID NO: 2741241 - protein, 17 aa, Entamoeba histolytica
CKDGAFSIVSIIALMLF

SEQ ID NO: 2741242 - protein, 23 aa, Entamoeba histolytica
CKKKGYHCVFDGIKHDKYFECNE

SEQ ID NO: 2741243 - protein, 25 aa, Entamoeba histolytica
CKKLNLGYPLKFATSNKFTHFANKN

SEQ ID NO: 2741244 - protein, 19 aa, Entamoeba histolytica
CKPGYIPVDFEFCKKSDGC

SEQ ID NO: 2741245 - protein, 22 aa, Entamoeba histolytica
CKTCEEGYYLSKDKCLKGVEHC

SEQ ID NO: 2741246 - protein, 23 aa, Entamoeba histolytica
CKVCVNLAEFILRQARNGKSKKK

SEQ ID NO: 2741247 - protein, 20 aa, Entamoeba histolytica
CKYFKEVVPYCAISAKDGCS

SEQ ID NO: 2741248 - protein, 17 aa, Entamoeba histolytica
CLDDTLFIWCYGYSEGF

SEQ ID NO: 2741249 - protein, 29 aa, Entamoeba histolytica
CLRDLGFNSFFIFRAWRSLGSFDPNAKSI

SEQ ID NO: 2741250 - protein, 27 aa, Entamoeba histolytica
CLRNIGFNSFFIFRCWRSLGSWDPNAK

SEQ ID NO: 2741251 - protein, 17 aa, Entamoeba histolytica
CNKLNVFFDTPTALIYI

SEQ ID NO: 2741252 - protein, 20 aa, Entamoeba histolytica
CPVFAIYHQFISTFYDKIDD

SEQ ID NO: 2741253 - protein, 30 aa, Entamoeba histolytica
CTICRDMYDGKYNFYLPTNGTCERYSEIAK

SEQ ID NO: 2741254 - protein, 18 aa, Entamoeba histolytica
CVILCFAQQSQENKPEPS

SEQ ID NO: 2741255 - protein, 27 aa, Entamoeba histolytica
CWIVSFILPSWIELKWSNEGICFLFKL

SEQ ID NO: 2741256 - protein, 24 aa, Entamoeba histolytica
CYSDKFIWWGEYGLGTVGIKVNSD

SEQ ID NO: 2741257 - protein, 24 aa, Entamoeba histolytica
DACDTYVNPLFEKSPCLTCREAYW

SEQ ID NO: 2741258 - protein, 17 aa, Entamoeba histolytica
DALWLDIEHTQRKRYFT

SEQ ID NO: 2741259 - protein, 23 aa, Entamoeba histolytica
DARNMLIIQKKKVQVIKKIVKKL

SEQ ID NO: 2741260 - protein, 24 aa, Entamoeba histolytica
DASVGKTGIFKRFIKDQFSKNEKS

SEQ ID NO: 2741261 - protein, 30 aa, Entamoeba histolytica; identical to SEQ ID NO: 2555759

SEQ ID NO: 2741262 - protein, 27 aa, Entamoeba histolytica
DDEALDAFMTLFETNDFLLSDTLKGKQ

SEQ ID NO: 2741263 - protein, 32 aa, Entamoeba histolytica
DDEEYFVFNKFTILNMFSFFTDVDYKLTRVDD

SEQ ID NO: 2741264 - protein, 20 aa, Entamoeba histolytica
DDSAPSMFIGILSIITLFFF

SEQ ID NO: 2741265 - protein, 25 aa, Entamoeba histolytica
DEEDDDEFELEDDDEFELEDDEEED

SEQ ID NO: 2741266 - protein, 26 aa, Entamoeba histolytica
DEEYDLEDDDFDYDDDDDFELEEDEE

SEQ ID NO: 2741267 - protein, 23 aa, Entamoeba histolytica
DERKPIAYFTNSTLGLTKEGLCD

SEQ ID NO: 2741268 - protein, 19 aa, Entamoeba histolytica
DFEDSLWDTLKKKSQNLLM

SEQ ID NO: 2741269 - protein, 29 aa, Entamoeba histolytica
DFKNFDYIFVMDNDNYYELLDRCPEQYKQ

SEQ ID NO: 2741270 - protein, 25 aa, Entamoeba histolytica
DFRNFGYKIAAPLLEKIGSIIDFKI

SEQ ID NO: 2741271 - protein, 20 aa, Entamoeba histolytica
DFVSQFFKFEALPEIPESQL

SEQ ID NO: 2741272 - protein, 17 aa, Entamoeba histolytica
DFYGLHASPIISGMEHF

SEQ ID NO: 2741273 - protein, 18 aa, Entamoeba histolytica
DGCTLCQRGYLAFNKVVV

SEQ ID NO: 2741274 - protein, 20 aa, Entamoeba histolytica
DGFYCVIDGLHDRDYYECSP

SEQ ID NO: 2741275 - protein, 20 aa, Entamoeba histolytica
DGLKYYLNAYVFKDILKNPP

SEQ ID NO: 2741276 - protein, 31 aa, Entamoeba histolytica
DGQDYYIVKNSWGSFWGMDGYILMSRNKNNQ

SEQ ID NO: 2741277 - protein, 19 aa, Entamoeba histolytica
DGQDYYIVKNSWGTSWGDK

SEQ ID NO: 2741278 - protein, 19 aa, Entamoeba histolytica
DGQDYYIVRNSWGTSWGMD

SEQ ID NO: 2741279 - protein, 18 aa, Entamoeba histolytica
DGVDEILRELQAVEIRKL

SEQ ID NO: 2741280 - protein, 29 aa, Entamoeba histolytica
DGYGECDGHKFLWVRNSWGNDWGVEGGHF

SEQ ID NO: 2741281 - protein, 25 aa, Entamoeba histolytica
DHCSLCMDGFLLQNGECVYGRSVIK

SEQ ID NO: 2741282 - protein, 22 aa, Entamoeba histolytica
DHDITLYNFVYAKQINVDDNVK

SEQ ID NO: 2741283 - protein, 24 aa, Entamoeba histolytica
DIHNNYMPILSKILTEGKGFVHER

SEQ ID NO: 2741284 - protein, 19 aa, Entamoeba histolytica
DIKIVSADFYSFLDSVDNE

SEQ ID NO: 2741285 - protein, 24 aa, Entamoeba histolytica
DIKKIKIWQSWYPAEWGKCEENSD

SEQ ID NO: 2741286 - protein, 21 aa, Entamoeba histolytica
DILFHYFKCRKQVPRLLYQMA

SEQ ID NO: 2741287 - protein, 19 aa, Entamoeba histolytica
DISHLYTLIIRPNNTYVVK

SEQ ID NO: 2741288 - protein, 23 aa, Entamoeba histolytica
DIVNKYPLFIKEKYNPEWADKEC

SEQ ID NO: 2741289 - protein, 24 aa, Entamoeba histolytica
DKAFSILLQRILKKNPPKTPRKCS

SEQ ID NO: 2741290 - protein, 26 aa, Entamoeba histolytica
DKFRSEYIIHFYGAVFIPSKICMVTE

SEQ ID NO: 2741291 - protein, 24 aa, Entamoeba histolytica
DKIYQIKLFNFIGSSIFINIKFIP

SEQ ID NO: 2741292 - protein, 24 aa, Entamoeba histolytica
DKSYITIKEDYPLFLRYNKQINDK

SEQ ID NO: 2741293 - protein, 19 aa, Entamoeba histolytica
DKYEFMYDALWLDIEHTQR

SEQ ID NO: 2741294 - protein, 17 aa, Entamoeba histolytica
DKYIDNWVAMSTPFLGS

SEQ ID NO: 2741295 - protein, 17 aa, Entamoeba histolytica
DLFIDHLQRRYIKSFYG

SEQ ID NO: 2741296 - protein, 25 aa, Entamoeba histolytica
DLGLKLDPLLLRPLARSWESDYQLM

SEQ ID NO: 2741297 - protein, 24 aa, Entamoeba histolytica
DLVPQLFMENFFKSLQRIIVKNVD

SEQ ID NO: 2741298 - protein, 23 aa, Entamoeba histolytica
DMCKYFLTTPLAKVAKRMQGIDT

SEQ ID NO: 2741299 - protein, 20 aa, Entamoeba histolytica
DMDIIFTDIVPLIHCHKNIL

SEQ ID NO: 2741300 - protein, 18 aa, Entamoeba histolytica
DMRILDEKFKNLKVIVEA

SEQ ID NO: 2741301 - protein, 20 aa, Entamoeba histolytica
DMTTFDEEMENEEDCPCTKY

SEQ ID NO: 2741302 - protein, 25 aa, Entamoeba histolytica
DNEKQRILCPLPKEKCHPRIIKIDV

SEQ ID NO: 2741303 - protein, 17 aa, Entamoeba histolytica
DNKWGIGIDGDISNKNG

SEQ ID NO: 2741304 - protein, 18 aa, Entamoeba histolytica
DNQFILVHRSKSPLPKIN

SEQ ID NO: 2741305 - protein, 18 aa, Entamoeba histolytica
DNQIINFYIIFDNNAKKE

SEQ ID NO: 2741306 - protein, 41 aa, Entamoeba histolytica
DNTEVMHTQIKSKEYKRMYKLYKVHFKSVNEIAEEKGQSEK

SEQ ID NO: 2741307 - protein, 25 aa, Entamoeba histolytica
DNYDNLDAASSPFIVLFAIIGVILF

SEQ ID NO: 2741308 - protein, 31 aa, Entamoeba histolytica
DNYKSEYGKFFLGWYQQLLLDHANNVLSAAK

SEQ ID NO: 2741309 - protein, 25 aa, Entamoeba histolytica
DNYRRKFVQFIKKDPYSRYVKELTD

SEQ ID NO: 2741310 - protein, 28 aa, Entamoeba histolytica
DPALLDDIAFYWPSLSRCHFIEYEYDKH

SEQ ID NO: 2741311 - protein, 17 aa, Entamoeba histolytica
DQLLFFNADDHACHPRN

SEQ ID NO: 2741312 - protein, 23 aa, Entamoeba histolytica
DQRIALFLVEICKRKFKKDPSDN

SEQ ID NO: 2741313 - protein, 18 aa, Entamoeba histolytica
DQSAFYVKNYYEVQEKIS

SEQ ID NO: 2741314 - protein, 21 aa, Entamoeba histolytica
DRDMYFSFSPNFQSNSFKVLI

SEQ ID NO: 2741315 - protein, 20 aa, Entamoeba histolytica
DSFDLDENVEMEHEYQLEDN

SEQ ID NO: 2741316 - protein, 25 aa, Entamoeba histolytica
DSFDLDENVEMEHEYQLEDNELEED

SEQ ID NO: 2741317 - protein, 21 aa, Entamoeba histolytica
DSIKYPIVYLLHGMDSDCQSF

SEQ ID NO: 2741318 - protein, 19 aa, Entamoeba histolytica
DSLPQILCMAAYPSNNGIA

SEQ ID NO: 2741319 - protein, 18 aa, Entamoeba histolytica
DTKKYLCIAFACCVGMKC

SEQ ID NO: 2741320 - protein, 19 aa, Entamoeba histolytica
DTLFQHGWGFLRINSAQST

SEQ ID NO: 2741321 - protein, 26 aa, Entamoeba histolytica
DTNGSQFFITLVPTAWLDGRHVVFGE

SEQ ID NO: 2741322 - protein, 23 aa, Entamoeba histolytica
DTTNPHFPFSFTDKVFVPSPTQN

SEQ ID NO: 2741323 - protein, 27 aa, Entamoeba histolytica
DVAYFDPILFGYFFTANGIPISESITI

SEQ ID NO: 2741324 - protein, 29 aa, Entamoeba histolytica
DYATAAMNILIKHDMWKLFKANGVKADGA

SEQ ID NO: 2741325 - protein, 20 aa, Entamoeba histolytica
DYFETSFWAFPPKSQWMLNN

SEQ ID NO: 2741326 - protein, 24 aa, Entamoeba histolytica
DYTHPLAVHYPLIYIGNEQETFDD

SEQ ID NO: 2741327 - protein, 41 aa, Entamoeba histolytica
EAAENYFSTGDTKRQYASDNILLKVEEAKPTPQEKPSVTAT

SEQ ID NO: 2741328 - protein, 32 aa, Entamoeba histolytica
EAALLIRTNWMSWMDMIWVTTVSPEIAIARMT

SEQ ID NO: 2741329 - protein, 25 aa, Entamoeba histolytica
EADNDWYFDYWKSDRMKLIQRDAPH

SEQ ID NO: 2741330 - protein, 45 aa, Entamoeba histolytica
EAIEMKYLLIDYWYKEYFMSVRNKEPLLKPLFLMYPEDEMTYNID

SEQ ID NO: 2741331 - protein, 40 aa, Entamoeba histolytica
EALDVFMNLFEVNDFMLEDDGFFGDLWNGAKKMAGDAVNA

SEQ ID NO: 2741332 - protein, 23 aa, Entamoeba histolytica
EALRRRAIFLQNSKLIQMINKQN

SEQ ID NO: 2741333 - protein, 17 aa, Entamoeba histolytica
EALTGVKVVKDLTLPPA

SEQ ID NO: 2741334 - protein, 33 aa, Entamoeba histolytica
EARKAINTLLFMRFLYTPLIQSPSLFKKVQTII

SEQ ID NO: 2741335 - protein, 20 aa, Entamoeba histolytica
EARNWWAGLYSFDKYKDTTE

SEQ ID NO: 2741336 - protein, 29 aa, Entamoeba histolytica
EDDDAVAESLFAEFDDEDLLDSDEGLDDD

SEQ ID NO: 2741337 - protein, 46 aa, Entamoeba histolytica; identical to SEQ ID NO: 2739152

SEQ ID NO: 2741338 - protein, 26 aa, Entamoeba histolytica
EDFESLIQLPLIGLKININEKTQLKN

SEQ ID NO: 2741339 - protein, 18 aa, Entamoeba histolytica
EDFFIIPMLGNHDVYPAN

SEQ ID NO: 2741340 - protein, 18 aa, Entamoeba histolytica
EDIIKILKDILGDNYVYI

SEQ ID NO: 2741341 - protein, 25 aa, Entamoeba histolytica
EDLQNFRTFMAAADKPFNIKSFYGM

SEQ ID NO: 2741342 - protein, 25 aa, Entamoeba histolytica
EDVMVNMTFRNMPTILVFRGSDHKP

SEQ ID NO: 2741343 - protein, 30 aa, Entamoeba histolytica; identical to SEQ ID NO: 2396168

SEQ ID NO: 2741344 - protein, 28 aa, Entamoeba histolytica
EEDIRVSKSNVFRTSKNLKHGTITTEDI

SEQ ID NO: 2741345 - protein, 25 aa, Entamoeba histolytica
EEEEYDLGFFFKPIYSAVADEDGDI

SEQ ID NO: 2741346 - protein, 23 aa, Entamoeba histolytica
EEEHKRRIFLNKFLTSTDDVEKS

SEQ ID NO: 2741347 - protein, 24 aa, Entamoeba histolytica
EELKKFKIVIAIPPMFIFTEHEIE

SEQ ID NO: 2741348 - protein, 25 aa, Entamoeba histolytica
EENGFNFEWCLIYKIDRINKRIISL

SEQ ID NO: 2741349 - protein, 23 aa, Entamoeba histolytica
EENHWVLRPYNSIDWHAQVFDWL

SEQ ID NO: 2741350 - protein, 21 aa, Entamoeba histolytica
EEQFRFQIFKNNLKNIKTLNE

SEQ ID NO: 2741351 - protein, 31 aa, Entamoeba histolytica
EEQKQYMSSLFGGAPELPFLEDQYLVNPMEI

SEQ ID NO: 2741352 - protein, 30 aa, Entamoeba histolytica; identical to SEQ ID NO: 2555850

SEQ ID NO: 2741353 - protein, 28 aa, Entamoeba histolytica
EFCGHYMFPYCILNKHLPFWGGYVGSHF

SEQ ID NO: 2741354 - protein, 18 aa, Entamoeba histolytica
EFYKYNYVGTGDDKNLTS

SEQ ID NO: 2741355 - protein, 23 aa, Entamoeba histolytica
EGAEKFLKWLSTSELRDGGFFPT

SEQ ID NO: 2741356 - protein, 28 aa, Entamoeba histolytica
EGATQETNIFYKGCSGLLIPKIEQCEIT

SEQ ID NO: 2741357 - protein, 24 aa, Entamoeba histolytica
EGCEYLIYRRVILFFLFNLSKKYL

SEQ ID NO: 2741358 - protein, 20 aa, Entamoeba histolytica
EGDLLWCNYGDYQYSKYFTE

SEQ ID NO: 2741359 - protein, 21 aa, Entamoeba histolytica
EGDLLWCNYGDYQYTKYLTEQ

SEQ ID NO: 2741360 - protein, 30 aa, Entamoeba histolytica
EGGEINWFYSFPFLYDKILPSAVCPYTATV

SEQ ID NO: 2741361 - protein, 26 aa, Entamoeba histolytica
EGGLPPFNWELFPSIQHWGTPRVYNF

SEQ ID NO: 2741362 - protein, 18 aa, Entamoeba histolytica
EGIDFRKFGKLTYIREQT

SEQ ID NO: 2741363 - protein, 17 aa, Entamoeba histolytica
EGKYFFGTFTDKECKTS

SEQ ID NO: 2741364 - protein, 23 aa, Entamoeba histolytica
EGNTRIFTSIEFGKCYYTGTVTS

SEQ ID NO: 2741365 - protein, 20 aa, Entamoeba histolytica
EGPIPPLYSSSLRHLDLRGT

SEQ ID NO: 2741366 - protein, 18 aa, Entamoeba histolytica
EGVYQYRQLHCGSSFINK

SEQ ID NO: 2741367 - protein, 24 aa, Entamoeba histolytica
EHHNMDNVSTIFILLSTITLTLLF

SEQ ID NO: 2741368 - protein, 17 aa, Entamoeba histolytica
EHSLPYDSIPSKCKRCK

SEQ ID NO: 2741369 - protein, 23 aa, Entamoeba histolytica
EIERRLKVMIKRAVIARLNSAKT

SEQ ID NO: 2741370 - protein, 31 aa, Entamoeba histolytica
EIFYTINGCFWKKFKIPWRNVAVAISFGKFH

SEQ ID NO: 2741371 - protein, 21 aa, Entamoeba histolytica
EIHERANAFNLKWMKSNIKGT

SEQ ID NO: 2741372 - protein, 23 aa, Entamoeba histolytica
EIMKRDILLALGTKKREFMMKKI

SEQ ID NO: 2741373 - protein, 18 aa, Entamoeba histolytica
EIQSFTYFPINTCTYYNE

SEQ ID NO: 2741374 - protein, 18 aa, Entamoeba histolytica
EISRYIDTLKSELNGSLN

SEQ ID NO: 2741375 - protein, 27 aa, Entamoeba histolytica
EITDWYSVIFAPDKFWTFIREYEDVKY

SEQ ID NO: 2741376 - protein, 24 aa, Entamoeba histolytica
EKAQPIIISLLRKKDLSMDVIQLV

SEQ ID NO: 2741377 - protein, 23 aa, Entamoeba histolytica
EKFFNKWCDVYHKEINTRRIYIK

SEQ ID NO: 2741378 - protein, 17 aa, Entamoeba histolytica
EKGFFSMRWYCESKLSM

SEQ ID NO: 2741379 - protein, 38 aa, Entamoeba histolytica
EKLKQRLIIVNGHKKELLIKIKVLENRLLNYQKVRQQQ

SEQ ID NO: 2741380 - protein, 23 aa, Entamoeba histolytica
EKLVKLIPQIDRLEKEYKTELKQ

SEQ ID NO: 2741381 - protein, 18 aa, Entamoeba histolytica
EKMYKLRLKKRLNKMVSI

SEQ ID NO: 2741382 - protein, 21 aa, Entamoeba histolytica
EKNILVFDLGGGTFDVSLLNI

SEQ ID NO: 2741383 - protein, 33 aa, Entamoeba histolytica
EKNQRIRSLVQLYFKVIFNYLRSEKSIINSISS

SEQ ID NO: 2741384 - protein, 21 aa, Entamoeba histolytica
EKRFKIFGPIKAVRIGFLDIE

SEQ ID NO: 2741385 - protein, 25 aa, Entamoeba histolytica
EKSPCLTCREAYWIEDGKCVKTQIE

SEQ ID NO: 2741386 - protein, 17 aa, Entamoeba histolytica
EKVISSMALFLKPSLSE

SEQ ID NO: 2741387 - protein, 17 aa, Entamoeba histolytica
ELDYLHFYALNTEMDNF

SEQ ID NO: 2741388 - protein, 19 aa, Entamoeba histolytica
ELNGSLNRKNSLVNGINAL

SEQ ID NO: 2741389 - protein, 25 aa, Entamoeba histolytica
ELPVDKLFIQFKTKYNKHYSLTEEQ

SEQ ID NO: 2741390 - protein, 18 aa, Entamoeba histolytica
ELQFFEFAPYRMYTSYAI

SEQ ID NO: 2741391 - protein, 24 aa, Entamoeba histolytica
ELRMTKNFWIARESFSLKAHSLEH

SEQ ID NO: 2741392 - protein, 24 aa, Entamoeba histolytica
EMEKLKVLFPQLKISKEKLEWVES

SEQ ID NO: 2741393 - protein, 17 aa, Entamoeba histolytica
EMKELITAPFNYITDFL

SEQ ID NO: 2741394 - protein, 31 aa, Entamoeba histolytica
EMNNDGYLALIERLFRLLHLIEMKKEINLMG

SEQ ID NO: 2741395 - protein, 58 aa, Entamoeba histolytica
ENDMKDMSILVGIKDRKLLMCKMRTIRKNLRKIAMLKVKLNAQMRKGLNMISYDNQAR

SEQ ID NO: 2741396 - protein, 23 aa, Entamoeba histolytica
ENELQFFEFAPYKMYTSFSIPRR

SEQ ID NO: 2741397 - protein, 32 aa, Entamoeba histolytica
ENEQKRLIVQLRRLYRHKKVLLRDIKDKEQQT

SEQ ID NO: 2741398 - protein, 24 aa, Entamoeba histolytica
ENIDQIFALLARRLVEQQGNLQKK

SEQ ID NO: 2741399 - protein, 29 aa, Entamoeba histolytica
ENIILDYKESIPPFLLIEGDVSVTIKTNY

SEQ ID NO: 2741400 - protein, 19 aa, Entamoeba histolytica
ENVEMEHEYQLEDNELEED

SEQ ID NO: 2741401 - protein, 30 aa, Entamoeba histolytica
ENVLNKPFIIQLLRYAALRGILIYPEIDIP

SEQ ID NO: 2741402 - protein, 25 aa, Entamoeba histolytica
EPPEYPMRFYGKVYFNNTLKITKSD

SEQ ID NO: 2741403 - protein, 25 aa, Entamoeba histolytica
EPQCEYLHCFGKQCKCRMVHLEYLL

SEQ ID NO: 2741404 - protein, 18 aa, Entamoeba histolytica
EQFFFEEFIPYVETLFSV

SEQ ID NO: 2741405 - protein, 33 aa, Entamoeba histolytica
EQGTKIILELKDKYFLDINVLKDLVKKYSEFIQ

SEQ ID NO: 2741406 - protein, 20 aa, Entamoeba histolytica
EQLKNVRELIKNKLKKVMHE

SEQ ID NO: 2741407 - protein, 29 aa, Entamoeba histolytica
EQLVFHFDYPVPIQWKTIIQHFALVINST

SEQ ID NO: 2741408 - protein, 27 aa, Entamoeba histolytica
EQSIDILFNALWLRSFIKNNQRIINGR

SEQ ID NO: 2741409 - protein, 27 aa, Entamoeba histolytica
EQTCPVLRLQLLNKLKSHPFRFIASLE

SEQ ID NO: 2741410 - protein, 19 aa, Entamoeba histolytica
ERDISLYPAFIIIRHHSQK

SEQ ID NO: 2741411 - protein, 17 aa, Entamoeba histolytica
ERFKSYPFVWRISINSN

SEQ ID NO: 2741412 - protein, 26 aa, Entamoeba histolytica
ERGKCYSLAFKIAKYAANLFDPQELK

SEQ ID NO: 2741413 - protein, 24 aa, Entamoeba histolytica
ERKKEGYIITLKVPSYFPAIKYCK

SEQ ID NO: 2741414 - protein, 25 aa, Entamoeba histolytica
ERKLKKFLIVFKDCENYYDPCDCLK

SEQ ID NO: 2741415 - protein, 23 aa, Entamoeba histolytica
ERKRKILNTKLKAAKIAENAEMI

SEQ ID NO: 2741416 - protein, 18 aa, Entamoeba histolytica
ERKRLLQQRLSLLEKRIN

SEQ ID NO: 2741417 - protein, 37 aa, Entamoeba histolytica
ERKVILFSKKERLIKKKLARLVVRRKKYNSSEKLVKL

SEQ ID NO: 2741418 - protein, 40 aa, Entamoeba histolytica
ERNKKVIHTQIQSKQHKRMFNLYDIQLKGENEEAKEIIRK

SEQ ID NO: 2741419 - protein, 42 aa, Entamoeba histolytica
ERNNEIIHTQIYSNKHKRIYNRYGIYLKGEAEVTEPTIKESN

SEQ ID NO: 2741420 - protein, 26 aa, Entamoeba histolytica
ESAFSNFMAYMLISKGYKLHLNTNNM

SEQ ID NO: 2741421 - protein, 23 aa, Entamoeba histolytica
ESAKAFIVGFSNFGLVYSNENNT

SEQ ID NO: 2741422 - protein, 25 aa, Entamoeba histolytica
ESIGQVFIREGWGCLTMNSKIIERV

SEQ ID NO: 2741423 - protein, 24 aa, Entamoeba histolytica
ESIGQVFIREGWGCLTMNSKIWER

SEQ ID NO: 2741424 - protein, 24 aa, Entamoeba histolytica
ESKITCLLYHDYYSVCTDKEDECN

SEQ ID NO: 2741425 - protein, 26 aa, Entamoeba histolytica
ESNPKEFLYCYSAYFGQLYQQYHNYL

SEQ ID NO: 2741426 - protein, 20 aa, Entamoeba histolytica
ETLLQLIRPNGNTFVISQLP

SEQ ID NO: 2741427 - protein, 17 aa, Entamoeba histolytica
ETLVKLQKLSLGCHLNG

SEQ ID NO: 2741428 - protein, 19 aa, Entamoeba histolytica
ETNDFLLSDTLKGKQWRNA

SEQ ID NO: 2741429 - protein, 25 aa, Entamoeba histolytica
ETNRPKIIIWIYHKHGTDGLFVGIG

SEQ ID NO: 2741430 - protein, 23 aa, Entamoeba histolytica
ETNYEGWCWPGNSVYIDFINPKA

SEQ ID NO: 2741431 - protein, 22 aa, Entamoeba histolytica
ETRYPSYPLSRWSYCGVGEFQC

SEQ ID NO: 2741432 - protein, 24 aa, Entamoeba histolytica
ETSKVMHFFVWNAITSPQNEYFEI

SEQ ID NO: 2741433 - protein, 18 aa, Entamoeba histolytica
EVEWERKTCPCSGDKCII

SEQ ID NO: 2741434 - protein, 20 aa, Entamoeba histolytica
EVFIIQVLILYVLKIQKCLI

SEQ ID NO: 2741435 - protein, 22 aa, Entamoeba histolytica
EVIRRKMLILQEQIKTAKIQNN

SEQ ID NO: 2741436 - protein, 26 aa, Entamoeba histolytica
EVKDTNIYGVFLKNEASPEKLEEAEE

SEQ ID NO: 2741437 - protein, 24 aa, Entamoeba histolytica
EVKNYPMIIFMINQQKKDIMKFYN

SEQ ID NO: 2741438 - protein, 17 aa, Entamoeba histolytica
EVMDVLPVDVINSEFEC

SEQ ID NO: 2741439 - protein, 26 aa, Entamoeba histolytica
EVQRDLHIFPFNIINQDNKPFIKVTL

SEQ ID NO: 2741440 - protein, 23 aa, Entamoeba histolytica
EYARYADILFDTRFNRGTLERIF

SEQ ID NO: 2741441 - protein, 27 aa, Entamoeba histolytica
EYDFDDLPIVLIFPENKTLISIKDGIQ

SEQ ID NO: 2741442 - protein, 18 aa, Entamoeba histolytica
EYERLWVALKNVRPLKND

SEQ ID NO: 2741443 - protein, 18 aa, Entamoeba histolytica
EYGYYLNSIYECNKYMNG

SEQ ID NO: 2741444 - protein, 24 aa, Entamoeba histolytica
EYPGEYLFNIKYYALNSLQIDASI

SEQ ID NO: 2741445 - protein, 23 aa, Entamoeba histolytica
EYQKIKVTAFKKAKKDAIREKRR

SEQ ID NO: 2741446 - protein, 23 aa, Entamoeba histolytica
EYQNKHLFTFNKFISFSNDIEVI

SEQ ID NO: 2741447 - protein, 25 aa, Entamoeba histolytica
EYQNRLFTIIKKYKSTINSLLLGHI

SEQ ID NO: 2741448 - protein, 23 aa, Entamoeba histolytica
EYRLKMLFIQVDGKDIELGLYGQ

SEQ ID NO: 2741449 - protein, 17 aa, Entamoeba histolytica
EYSMIINDFIDNSIFYL

SEQ ID NO: 2741450 - protein, 26 aa, Entamoeba histolytica
EYTLDIYGKCNLGYKIKLVISNTQNE

SEQ ID NO: 2741451 - protein, 25 aa, Entamoeba histolytica
FAAAVEYLLPFRRKHQYHDGYTGWN

SEQ ID NO: 2741452 - protein, 26 aa, Entamoeba histolytica
FADKYIDNWIAISTPFLGSGKAIAAA

SEQ ID NO: 2741453 - protein, 18 aa, Entamoeba histolytica
FADQSSTAYYIREFYEVQ

SEQ ID NO: 2741454 - protein, 19 aa, Entamoeba histolytica
FALFLTVHAEEEFELDDDF

SEQ ID NO: 2741455 - protein, 46 aa, Entamoeba histolytica; identical to SEQ ID NO: 2740911

SEQ ID NO: 2741456 - protein, 18 aa, Entamoeba histolytica
FAYIGIDVWQVKAGTIYD

SEQ ID NO: 2741457 - protein, 18 aa, Entamoeba histolytica
FCCIKLIYKYCLHIYLQK

SEQ ID NO: 2741458 - protein, 18 aa, Entamoeba histolytica
FCCVSCFPSDGVVGDGCL

SEQ ID NO: 2741459 - protein, 25 aa, Entamoeba histolytica
FCDKYIHRWVAMSTPFIGTTIANDV

SEQ ID NO: 2741460 - protein, 25 aa, Entamoeba histolytica
FCDKYIQKWIAISAPFIGTGVVPKQ

SEQ ID NO: 2741461 - protein, 27 aa, Entamoeba histolytica
FDDTPVVVQMNLPPPPPPVTEVEEEED

SEQ ID NO: 2741462 - protein, 24 aa, Entamoeba histolytica
FDFVAPLVPECQLKKLYQGCLSSS

SEQ ID NO: 2741463 - protein, 33 aa, Entamoeba histolytica
FDLAKLQQFFDISTLPIISYFMDQSRLSMYSNK

SEQ ID NO: 2741464 - protein, 33 aa, Entamoeba histolytica
FDPMYIHDINNRYILWVFFNQTLNEQYDQLFSE

SEQ ID NO: 2741465 - protein, 25 aa, Entamoeba histolytica
FDQDVFIAYLPLAHIFELCIEFAVI

SEQ ID NO: 2741466 - protein, 32 aa, Entamoeba histolytica; identical to SEQ ID NO: 2555960

SEQ ID NO: 2741467 - protein, 31 aa, Entamoeba histolytica
FDQPQDNLLNPWYWIYQPVSYSLNSRMGTRK

SEQ ID NO: 2741468 - protein, 25 aa, Entamoeba histolytica
FDSPDAFDWPLIYKTMKRVKQRKKV

SEQ ID NO: 2741469 - protein, 17 aa, Entamoeba histolytica
FDVDVNGILRVSAQDKK

SEQ ID NO: 2741470 - protein, 25 aa, Entamoeba histolytica
FDVVKSFILMILIGNKYDLEKERNV

SEQ ID NO: 2741471 - protein, 26 aa, Entamoeba histolytica
FEGTMKKMILPFSSVAQIVKLGITGA

SEQ ID NO: 2741472 - protein, 19 aa, Entamoeba histolytica
FFFSVFASDLIDLYNSAYQ

SEQ ID NO: 2741473 - protein, 26 aa, Entamoeba histolytica
FFGGSYIYPYASSTPLWYPHYDHNPS

SEQ ID NO: 2741474 - protein, 21 aa, Entamoeba histolytica
FFLLILCVFAKYHIVIPMIGS

SEQ ID NO: 2741475 - protein, 32 aa, Entamoeba histolytica; identical to SEQ ID NO: 2555970

SEQ ID NO: 2741476 - protein, 17 aa, Entamoeba histolytica
FFSMRWYCESKLSMAIM

SEQ ID NO: 2741477 - protein, 20 aa, Entamoeba histolytica
FGGLFEIYKRLYGVSFKLNK

SEQ ID NO: 2741478 - protein, 17 aa, Entamoeba histolytica
FGIQKLVTTFSAVLNRT

SEQ ID NO: 2741479 - protein, 25 aa, Entamoeba histolytica
FGKCYYTGTVTSYYYTHNGNNITIS

SEQ ID NO: 2741480 - protein, 20 aa, Entamoeba histolytica
FGLNSFKGEKQILVFDLGGG

SEQ ID NO: 2741481 - protein, 27 aa, Entamoeba histolytica
FHEGFTMHGWWPNFVSGYPSCCKSPYT

SEQ ID NO: 2741482 - protein, 27 aa, Entamoeba histolytica
FHFKDIPLHFYYYSHTLILYSSSIIQN
